United States Patent 7,745,391 (HUMAN THROMBOSPONDIN POLYPEPTIDE) - sequence listing, part 10

SEQ ID NO: 23686 - DNA, 4616 bp, Homo sapiens
ctgggtgcgcgccggctccggctgcagttcccgggtccctcggccaccgaagccaccctgccctggtgaaagggctcccgcaccgcccggtgctccccatctgcctggcgttgtgcgcagagctggaaagcatggctgttataaatgaattctgattttggggagcagatgccaacttagagcctcgtaccaatctctctgtctttaaaagatgagaagcactgaggtggacactgcgggttgtgaggttcaggaggggtaagtggctggcacaaggtcacagagcagcgctgccatttggctactttccaattcagcatagctgccctctctgctggtggtattcacagcatgcaagataaaatactcaccaaggaacaagtggctaactcctcacagagctctcacggtttcctctttcctgacaaaaaggtgcccagctaagacctgaatgccatcaccctccccagggctctgcagttttctcgtggtgaacccttgatggatttgttgttgcttgagaaatggcgatgatcgaattggggtttggaagacagaattttcatccattaaagaggaagagttcattgctgttgaaactcatagctgttgtctttgctgtgcttctattttgtgaatttttaatctattacttagcgatctttcagtgtaattggcctgaagtgaaaaccacagcctctgatggtgaacagaccacacgtgagcctgtgctcaaagccatgtttttggctgacacccatttgcttggggaattcctaggccactggctggacaaattacgaagggaatggcagatggagagagcgttccagacagctctgtggttgctgcagccggaagtcgtcttcatcctgggggatatctttgatgaagggaagtggagcacccctgaggcctgggcggatgatgtggagcggtttcagaaaatgttcagacacccaagtcatgtacagctgaaggtagttgctggaaaccatgacattggcttccattatgagatgaacacatacaaagtagaacgctttgagaaagtgttcagctctgaaagactgttttcttggaaaggcattaactttgtgatggtcaacagcgtggcgctgaacggggatggctgtggcatctgctctgaaacagaagcagagctcattgaagtttctcacagactgaactgctcccgagaggtaggagagcatctgaatgccacaggtgccttctgtcccgtgttgctccgcttcggttgctcactcagccccctagcgcttcttgccctttgatgagggtcaggtgtgcggattaatggcctgacttgtacccagcaggcacgtggctccagccggtgtggacctgggcctctgctgcccacgtctgcccctgtcctcctgcaggtgagctgggggaggaaagggctcatggcagacagcaggcagcctgtggtttcacgatagccgcctgaactcctctctccaccccggacagcattatcctctgtatcggagaagtgatgctaactgttctggggaagacgctgctcctgcagaggaaagggacatcccatttaaggagaactatgacgtgctttcacgggaggcatcacaaaaggtttgccagggtgtcgtgatgctaattcatgtcacagtgtgactctcatcaccttgcatgtcaacaagcagagtgcccaggctagagcaggtgtttgctgaaacgttcatgacttagttatcacctggggggacaggggtggaggcctggctttcacagtatctcagattttcatttaatcgctttttttttttccagtaaacctacttctgtttcctaccctcaagtcagtaatagtctcagctattctttgtattcagagtttttcaccaacttaaatgtatttagaaatgtgaatggaactgaaaagtcaattttttagggacttaattaaaattaaaatgcattttcttatatagatttatataatacatattacattatacataatatataaatataagaaatatttataagataaatgtataaaatatttataaagataaaataccgtaaaaagtatataaaatctgggatgagaacaaagggctgaccttacctttgatttagtgtaaataaaccaaaggatttttaaggaaaaaaataaaccagtccttcaaaataaggatttagtatgtaatttaaggaaagaagcgatggccagcggccgtcctgctgagcggtgagagcctggttgaggatgagctaacagcctgctttgctgtcttctcggccactgtcagctgctgtggtggctccagccgcgcctggttctcagtggccacacgcacagcgcctgcgaggtgcaccacgggggccgagtccccgagctcagcgtcccatctttcagttggaggaacagaaacaaccccagtttcatcatgggaacagatgcttagttgagcatcaaggggcaggaagacacctttccctccttgttcctcgctgaccgatgaccctggaactccacggtgcctctctgaatctctgttatggatcccccactatatttgatgggaacccagtgagccaggggccagttttgacagggtagcatcacgcccacagactacaccctctccaagtgctacctcccacgtgaggatgtggttttgatcatctactgtggagtggtgggcttccttgtggtcctcacactcactcactttgggcttctagcctcaccttttctttctggtttgaacttgctcggaaagcgtaagacaagatgaagagcaggcgccattataaatatcaaagcccaagaaatggaactttgggcagagatcatgttagaatcaagtggatgatgagaccaattacaggccgtctctctgcacagcacagaaattctcaatcactgaaatgagtaactgcaaaataaatagttgattgtactgttctcatgctataaaagtggacaggtactctacaacaaatctgttttctcatttttatcaaatatatgtatcatcaaaggttgcatctgtacagtatgtaaatgctattaatgtcgtcactcacatgcacgacagtccttgttcccccaggaagggcctggtggccccagcacacacttgggattatgtgtatacataaataaatattgggctgtttccctcttcctgtgaagtggttctcaaattcctatgtactgtaaagctgtacccttaaaagtacagatgtggccgggcacagtggctcacacctgtaatcccagcactttgggaggctgaggcgggtggatcacttgaggtcaggagttcaagaccagcctggccaacatggtgaaacctcgtctccgctagaaatacaaaaattagccaagcatggtagcaagtgcctataataccagctgaggctgaggcaggagaatcccttgagcccgggaggcggaggttgcagtgagccaagatcatgccactgcactccagcctgggcaacagagtgagactccgtctcaaaaaatatatttaaaaaaaaaaaagtacagatgtgatgtgcagaacatattgttttcgtagatttttatacttgatcaattaatggaatcagatttttagataagtgtaattttctctataggagaccacgttgctacatctgttaatgcctgtcagtgatcaaaagaaacttaaaaagtggaatgggatatggcttttggtacctgaaaataaatgctttaataattgtaagccagataaaagttattctttttgttttttttcttaacagtctggctgttgtttgaattaaactcttaaacaggatgtttagttagagggtaattgttgagtaatgatgcatacaacagcatacttccctttcttgctgggggtgcagcttttcagttttcttgttttactttgacagtgcaaggggaactgaaaataatttccattgtattatttatcttagttcagctgagggctttatgagacagtggatggggaggcagtaagacggtgatgagataaaatgtgtgtgttgcactgactgtctataaagttatcctttcttcatgaaaaagtagcatttaaatctggatgagtttataaaggattacaaaatgctgatttatagagtaaactttaaaatattaaagactaaagactaaaagaagagtaataatgaagtaatgtaggctgtcacttctctagatttgtattgttgaaaatttaactttggacatctttatagattattattttagacctacaaaaactaccctcaactctgtggctacagctagaatatgaagcatcattgctacaccagttcttactttctagatattgttggtgtgtcataatgtttgaggctgtatttgtaagtcttgcaagtgtgagaaagagccgtatcttttgactttatacttcagattaaggttttgtaatgtttcttcttcaaaaggcaagtgaagctgtcatcctcattctcctaggccagacacaaacattgacacgtcaaggtttttttttttttttttttttggcctgagtctcactttgatgtccaggctggagtgcgatggcacgacctcggctcactgcaat

SEQ ID NO: 23687 - DNA, 4523 bp, Homo sapiens
ctgggtgcgcgccggctccggctgcagttcccgggtccctcggccaccgaagccaccctgccctggtgaaagggctcccgcaccgcccggtgctccccatctgcctggcgttgtgcgcagagctggaaagcatggctgttataaatgaattctgattttggggagcagatgccaacttagagcctcgtaccaatctctctgtctttaaaagatgaggtgacttggtgattttcctggaaaattatagaggctctccagcagagaacccaggcccttcaccatactggtgcatggttcctgccacttgtgcagtccattccgaagtttcttacagatgaggtgcccagctaagacctgaatgccatcaccctccccagggctctgcagttttctcgtggtgaacccttgatggatttgttgttgcttgagaaatggcgatgatcgaattggggtttggaagacagaattttcatccattaaagaggaagagttcattgctgttgaaactcatagctgttgtctttgctgtgcttctattttgtgaatttttaatctattacttagcgatctttcagtgtaattggcctgaagtgaaaaccacagcctctgatggtgaacagaccacacgtgagcctgtgctcaaagccatgtttttggctgacacccatttgcttggggaattcctaggccactggctggacaaattacgaagggaatggcagatggagagagcgttccagacagctctgtggttgctgcagccggaagtcgtcttcatcctgggggatatctttgatgaagggaagtggagcacccctgaggcctgggcggatgatgtggagcggtttcagaaaatgttcagacacccaagtcatgtacagctgaaggtagttgctggaaaccatgacattggcttccattatgagatgaacacatacaaagtagaacgctttgagaaagtgttcagctctgaaagactgttttcttggaaaggcattaactttgtgatggtcaacagcgtggcgctgaacggggatggctgtggcatctgctctgaaacagaagcagagctcattgaagtttctcacagactgaactgctcccgagaggtaggagagcatctgaatgccacaggtgccttctgtcccgtgttgctccgcttcggttgctcactcagccccctagcgcttcttgccctttgatgagggtcaggtgtgcggattaatggcctgacttgtacccagcaggcacgtggctccagccggtgtggacctgggcctctgctgcccacgtctgcccctgtcctcctgcaggtgagctgggggaggaaagggctcatggcagacagcaggcagcctgtggtttcacgatagccgcctgaactcctctctccaccccggacagcattatcctctgtatcggagaagtgatgctaactgttctggggaagacgctgctcctgcagaggaaagggacatcccatttaaggagaactatgacgtgctttcacgggaggcatcacaaaaggtttgccagggtgtcgtgatgctaattcatgtcacagtgtgactctcatcaccttgcatgtcaacaagcagagtgcccaggctagagcaggtgtttgctgaaacgttcatgacttagttatcacctggggggacaggggtggaggcctggctttcacagtatctcagattttcatttaatcgctttttttttttccagtaaacctacttctgtttcctaccctcaagtcagtaatagtctcagctattctttgtattcagagtttttcaccaacttaaatgtatttagaaatgtgaatggaactgaaaagtcaattttttagggacttaattaaaattaaaatgcattttcttatatagatttatataatacatattacattatacataatatataaatataagaaatatttataagataaatgtataaaatatttataaagataaaataccgtaaaaagtatataaaatctgggatgagaacaaagggctgaccttacctttgatttagtgtaaataaaccaaaggatttttaaggaaaaaaataaaccagtccttcaaaataaggatttagtatgtaatttaaggaaagaagcgatggccagcggccgtcctgctgagcggtgagagcctggttgaggatgagctaacagcctgctttgctgtcttctcggccactgtcagctgctgtggtggctccagccgcgcctggttctcagtggccacacgcacagcgcctgcgaggtgcaccacgggggccgagtccccgagctcagcgtcccatctttcagttggaggaacagaaacaaccccagtttcatcatgggaacagatgcttagttgagcatcaaggggcaggaagacacctttccctccttgttcctcgctgaccgatgaccctggaactccacggtgcctctctgaatctctgttatggatcccccactatatttgatgggaacccagtgagccaggggccagttttgacagggtagcatcacgcccacagactacaccctctccaagtgctacctcccacgtgaggatgtggttttgatcatctactgtggagtggtgggcttccttgtggtcctcacactcactcactttgggcttctagcctcaccttttctttctggtttgaacttgctcggaaagcgtaagacaagatgaagagcaggcgccattataaatatcaaagcccaagaaatggaactttgggcagagatcatgttagaatcaagtggatgatgagaccaattacaggccgtctctctgcacagcacagaaattctcaatcactgaaatgagtaactgcaaaataaatagttgattgtactgttctcatgctataaaagtggacaggtactctacaacaaatctgttttctcatttttatcaaatatatgtatcatcaaaggttgcatctgtacagtatgtaaatgctattaatgtcgtcactcacatgcacgacagtccttgttcccccaggaagggcctggtggccccagcacacacttgggattatgtgtatacataaataaatattgggctgtttccctcttcctgtgaagtggttctcaaattcctatgtactgtaaagctgtacccttaaaagtacagatgtggccgggcacagtggctcacacctgtaatcccagcactttgggaggctgaggcgggtggatcacttgaggtcaggagttcaagaccagcctggccaacatggtgaaacctcgtctccgctagaaatacaaaaattagccaagcatggtagcaagtgcctataataccagctgaggctgaggcaggagaatcccttgagcccgggaggcggaggttgcagtgagccaagatcatgccactgcactccagcctgggcaacagagtgagactccgtctcaaaaaatatatttaaaaaaaaaaaagtacagatgtgatgtgcagaacatattgttttcgtagatttttatacttgatcaattaatggaatcagatttttagataagtgtaattttctctataggagaccacgttgctacatctgttaatgcctgtcagtgatcaaaagaaacttaaaaagtggaatgggatatggcttttggtacctgaaaataaatgctttaataattgtaagccagataaaagttattctttttgttttttttcttaacagtctggctgttgtttgaattaaactcttaaacaggatgtttagttagagggtaattgttgagtaatgatgcatacaacagcatacttccctttcttgctgggggtgcagcttttcagttttcttgttttactttgacagtgcaaggggaactgaaaataatttccattgtattatttatcttagttcagctgagggctttatgagacagtggatggggaggcagtaagacggtgatgagataaaatgtgtgtgttgcactgactgtctataaagttatcctttcttcatgaaaaagtagcatttaaatctggatgagtttataaaggattacaaaatgctgatttatagagtaaactttaaaatattaaagactaaagactaaaagaagagtaataatgaagtaatgtaggctgtcacttctctagatttgtattgttgaaaatttaactttggacatctttatagattattattttagacctacaaaaactaccctcaactctgtggctacagctagaatatgaagcatcattgctacaccagttcttactttctagatattgttggtgtgtcataatgtttgaggctgtatttgtaagtcttgcaagtgtgagaaagagccgtatcttttgactttatacttcagattaaggttttgtaatgtttcttcttcaaaaggcaagtgaagctgtcatcctcattctcctaggccagacacaaacattgacacgtcaaggtttttttttttttttttttttggcctgagtctcactttgatgtccaggctggagtgcgatggcacgacctcggctcactgcaat

SEQ ID NO: 23688 - DNA, 4324 bp, Homo sapiens
ctgggtgcgcgccggctccggctgcagttcccgggtccctcggccaccgaagccaccctgccctggtgaaagggctcccgcaccgcccggtgctccccatctgcctggcgttgtgcgcagagctggaaagcatggctgttgtgcccagctaagacctgaatgccatcaccctccccagggctctgcagttttctcgtggtgaacccttgatggatttgttgttgcttgagaaatggcgatgatcgaattggggtttggaagacagaattttcatccattaaagaggaagagttcattgctgttgaaactcatagctgttgtctttgctgtgcttctattttgtgaatttttaatctattacttagcgatctttcagtgtaattggcctgaagtgaaaaccacagcctctgatggtgaacagaccacacgtgagcctgtgctcaaagccatgtttttggctgacacccatttgcttggggaattcctaggccactggctggacaaattacgaagggaatggcagatggagagagcgttccagacagctctgtggttgctgcagccggaagtcgtcttcatcctgggggatatctttgatgaagggaagtggagcacccctgaggcctgggcggatgatgtggagcggtttcagaaaatgttcagacacccaagtcatgtacagctgaaggtagttgctggaaaccatgacattggcttccattatgagatgaacacatacaaagtagaacgctttgagaaagtgttcagctctgaaagactgttttcttggaaaggcattaactttgtgatggtcaacagcgtggcgctgaacggggatggctgtggcatctgctctgaaacagaagcagagctcattgaagtttctcacagactgaactgctcccgagaggtaggagagcatctgaatgccacaggtgccttctgtcccgtgttgctccgcttcggttgctcactcagccccctagcgcttcttgccctttgatgagggtcaggtgtgcggattaatggcctgacttgtacccagcaggcacgtggctccagccggtgtggacctgggcctctgctgcccacgtctgcccctgtcctcctgcaggtgagctgggggaggaaagggctcatggcagacagcaggcagcctgtggtttcacgatagccgcctgaactcctctctccaccccggacagcattatcctctgtatcggagaagtgatgctaactgttctggggaagacgctgctcctgcagaggaaagggacatcccatttaaggagaactatgacgtgctttcacgggaggcatcacaaaaggtttgccagggtgtcgtgatgctaattcatgtcacagtgtgactctcatcaccttgcatgtcaacaagcagagtgcccaggctagagcaggtgtttgctgaaacgttcatgacttagttatcacctggggggacaggggtggaggcctggctttcacagtatctcagattttcatttaatcgctttttttttttccagtaaacctacttctgtttcctaccctcaagtcagtaatagtctcagctattctttgtattcagagtttttcaccaacttaaatgtatttagaaatgtgaatggaactgaaaagtcaattttttagggacttaattaaaattaaaatgcattttcttatatagatttatataatacatattacattatacataatatataaatataagaaatatttataagataaatgtataaaatatttataaagataaaataccgtaaaaagtatataaaatctgggatgagaacaaagggctgaccttacctttgatttagtgtaaataaaccaaaggatttttaaggaaaaaaataaaccagtccttcaaaataaggatttagtatgtaatttaaggaaagaagcgatggccagcggccgtcctgctgagcggtgagagcctggttgaggatgagctaacagcctgctttgctgtcttctcggccactgtcagctgctgtggtggctccagccgcgcctggttctcagtggccacacgcacagcgcctgcgaggtgcaccacgggggccgagtccccgagctcagcgtcccatctttcagttggaggaacagaaacaaccccagtttcatcatgggaacagatgcttagttgagcatcaaggggcaggaagacacctttccctccttgttcctcgctgaccgatgaccctggaactccacggtgcctctctgaatctctgttatggatcccccactatatttgatgggaacccagtgagccaggggccagttttgacagggtagcatcacgcccacagactacaccctctccaagtgctacctcccacgtgaggatgtggttttgatcatctactgtggagtggtgggcttccttgtggtcctcacactcactcactttgggcttctagcctcaccttttctttctggtttgaacttgctcggaaagcgtaagacaagatgaagagcaggcgccattataaatatcaaagcccaagaaatggaactttgggcagagatcatgttagaatcaagtggatgatgagaccaattacaggccgtctctctgcacagcacagaaattctcaatcactgaaatgagtaactgcaaaataaatagttgattgtactgttctcatgctataaaagtggacaggtactctacaacaaatctgttttctcatttttatcaaatatatgtatcatcaaaggttgcatctgtacagtatgtaaatgctattaatgtcgtcactcacatgcacgacagtccttgttcccccaggaagggcctggtggccccagcacacacttgggattatgtgtatacataaataaatattgggctgtttccctcttcctgtgaagtggttctcaaattcctatgtactgtaaagctgtacccttaaaagtacagatgtggccgggcacagtggctcacacctgtaatcccagcactttgggaggctgaggcgggtggatcacttgaggtcaggagttcaagaccagcctggccaacatggtgaaacctcgtctccgctagaaatacaaaaattagccaagcatggtagcaagtgcctataataccagctgaggctgaggcaggagaatcccttgagcccgggaggcggaggttgcagtgagccaagatcatgccactgcactccagcctgggcaacagagtgagactccgtctcaaaaaatatatttaaaaaaaaaaaagtacagatgtgatgtgcagaacatattgttttcgtagatttttatacttgatcaattaatggaatcagatttttagataagtgtaattttctctataggagaccacgttgctacatctgttaatgcctgtcagtgatcaaaagaaacttaaaaagtggaatgggatatggcttttggtacctgaaaataaatgctttaataattgtaagccagataaaagttattctttttgttttttttcttaacagtctggctgttgtttgaattaaactcttaaacaggatgtttagttagagggtaattgttgagtaatgatgcatacaacagcatacttccctttcttgctgggggtgcagcttttcagttttcttgttttactttgacagtgcaaggggaactgaaaataatttccattgtattatttatcttagttcagctgagggctttatgagacagtggatggggaggcagtaagacggtgatgagataaaatgtgtgtgttgcactgactgtctataaagttatcctttcttcatgaaaaagtagcatttaaatctggatgagtttataaaggattacaaaatgctgatttatagagtaaactttaaaatattaaagactaaagactaaaagaagagtaataatgaagtaatgtaggctgtcacttctctagatttgtattgttgaaaatttaactttggacatctttatagattattattttagacctacaaaaactaccctcaactctgtggctacagctagaatatgaagcatcattgctacaccagttcttactttctagatattgttggtgtgtcataatgtttgaggctgtatttgtaagtcttgcaagtgtgagaaagagccgtatcttttgactttatacttcagattaaggttttgtaatgtttcttcttcaaaaggcaagtgaagctgtcatcctcattctcctaggccagacacaaacattgacacgtcaaggtttttttttttttttttttttggcctgagtctcactttgatgtccaggctggagtgcgatggcacgacctcggctcactgcaat

SEQ ID NO: 23689 - DNA, 5063 bp, Homo sapiens
ctgggtgcgcgccggctccggctgcagttcccgggtccctcggccaccgaagccaccctgccctggtgaaagggctcccgcaccgcccggtgctccccatctgcctggcgttgtgcgcagagctggaaagcatggctgttataaatgaattctgattttggggagcagatgccaacttagagcctcgtaccaatctctctgtctttaaaagatgaggtgacttggtgattttcctggaaaattataggtgcccagctaagacctgaatgccatcaccctccccagggctctgcagttttctcgtggtgaacccttgatggatttgttgttgcttgagaaatggcgatgatcgaattggggtttggaagacagaattttcatccattaaagaggaagagttcattgctgttgaaactcatagctgttgtctttgctgtgcttctattttgtgaatttttaatctattacttagcgatctttcagtgtaattggcctgaagtgaaaaccacagcctctgatggtgaacagaccacacgtgagcctgtgctcaaagccatgtttttggctgacacccatttgcttggggaattcctaggccactggctggacaaattacgaagggaatggcagatggagagagcgttccagacagctctgtggttgctgcagccggaagtcgtcttcatcctgggggatatctttgatgaagggaagtggagcacccctgaggcctgggcggatgatgtggagcggtttcagaaaatgttcagacacccaagtcatgtacagctgaaggtagttgctggaaaccatgacattggcttccattatgagatgaacacatacaaagtagaacgctttgagaaagtgttcagctctgaaagactgttttcttggaaaggcattaactttgtgatggtcaacagcgtggcgctgaacggggatggctgtggcatctgctctgaaacagaagcagagctcattgaagtttctcacagactgaactgctcccgagaggtaggagagcatctgaatgccacaggtgccttctgtcccgtgttgctccgcttcggttgctcactcagccccctagcgcttcttgccctttgatgagggtcaggtgtgcggattaatggcctgacttgtacccagcaggcacgtggctccagccggtgtggacctgggcctctgctgcccacgtctgcccctgtcctcctgcaggtgagctgggggaggaaagggctcatggcagacagcaggcagcctgtggtttcacgatagccgcctgaactcctctctccaccccggacagcattatcctctgtatcggagaagtgatgctaactgttctggggaagacgctgctcctgcagaggaaagggacatcccatttaaggagaactatgacgtgctttcacgggaggcatcacaaaaggtttgccagggtgtcgtgatgctaattcatgtcacagtgtgactctcatcaccttgcatgtcaacaagcagagtgcccaggctagagcaggtgtttgctgaaacgttcatgacttagttatcacctggggggacaggggtggaggcctggctttcacagtatctcagattttcatttaatcgctttttttttttccagtaaacctacttctgtttcctaccctcaagtcagtaatagtctcagctattctttgtattcagagtttttcaccaacttaaatgtatttagaaatgtgaatggaactgaaaagtcaattttttagggacttaattaaaattaaaatgcattttcttatatagatttatataatacatattacattatacataatatataaatataagaaatatttataagataaatgtataaaatatttataaagataaaataccgtaaaaagtatataaaatctgggatgagaacaaagggctgaccttacctttgatttagtgtaaataaaccaaaggatttttaaggaaaaaaataaaccagtccttcaaaataaggatttagtatgtaatttaaggaaagaagcgatggccagcggccgtcctgctgagcggtgagagcctggttgaggatgagctaacagcctgctttgctgtcttctcggccactgtcagctgctgtggtggctccagccgcgcctggttctcagtggccacacgcacagcgcctgcgaggtgcaccacgggggccgagtccccgagctcagcgtcccatctttcagttggaggaacagaaacaaccccagtttcatcatggtaacgtgaaagtttatttttgtctgaaagctttcataagtatttaaatcaacacagtaatcaactatttaattgctgcaatcggtcaaaatttacaaaagccacacacaaatttctctccttctacacgtagctccatacactgccccttgccaaacacccttccgggaaccaatcagcatgacattcctgggcagttaatgtgagaagcgagggcagggcaccgtccaggtggactttatccttcagggagggccgtatcctctcctcttacactctgtgtgtgtttaattttctaaagaaacaaccatttattcattagctatactcagccatcttctcttattttctaaacatgcccatttgacctggcagagaacgctgcagcttttgcaggttgataaaagatgtttcacttaatgaccactgggcgttttaactcctttcagccatgggctcctgcatccagctcatgatgctggtacgacaggttcttttacttcataaaaaggtggaggaaaccctaacattttcaaattcaaagtaaatgaaaacatttgccactgttgttccacataaaagtatctgcaaagaaaagcccatggagacgacctggacacatgtatttctagggaacagatgcttagttgagcatcaaggggcaggaagacacctttccctccttgttcctcgctgaccgatgaccctggaactccacggtgcctctctgaatctctgttatggatcccccactatatttgatgggaacccagtgagccaggggccagttttgacagggtagcatcacgcccacagactacaccctctccaagtgctacctcccacgtgaggatgtggttttgatcatctactgtggagtggtgggcttccttgtggtcctcacactcactcactttgggcttctagcctcaccttttctttctggtttgaacttgctcggaaagcgtaagacaagatgaagagcaggcgccattataaatatcaaagcccaagaaatggaactttgggcagagatcatgttagaatcaagtggatgatgagaccaattacaggccgtctctctgcacagcacagaaattctcaatcactgaaatgagtaactgcaaaataaatagttgattgtactgttctcatgctataaaagtggacaggtactctacaacaaatctgttttctcatttttatcaaatatatgtatcatcaaaggttgcatctgtacagtatgtaaatgctattaatgtcgtcactcacatgcacgacagtccttgttcccccaggaagggcctggtggccccagcacacacttgggattatgtgtatacataaataaatattgggctgtttccctcttcctgtgaagtggttctcaaattcctatgtactgtaaagctgtacccttaaaagtacagatgtggccgggcacagtggctcacacctgtaatcccagcactttgggaggctgaggcgggtggatcacttgaggtcaggagttcaagaccagcctggccaacatggtgaaacctcgtctccgctagaaatacaaaaattagccaagcatggtagcaagtgcctataataccagctgaggctgaggcaggagaatcccttgagcccgggaggcggaggttgcagtgagccaagatcatgccactgcactccagcctgggcaacagagtgagactccgtctcaaaaaatatatttaaaaaaaaaaaagtacagatgtgatgtgcagaacatattgttttcgtagatttttatacttgatcaattaatggaatcagatttttagataagtgtaattttctctataggagaccacgttgctacatctgttaatgcctgtcagtgatcaaaagaaacttaaaaagtggaatgggatatggcttttggtacctgaaaataaatgctttaataattgtaagccagataaaagttattctttttgttttttttcttaacagtctggctgttgtttgaattaaactcttaaacaggatgtttagttagagggtaattgttgagtaatgatgcatacaacagcatacttccctttcttgctgggggtgcagcttttcagttttcttgttttactttgacagtgcaaggggaactgaaaataatttccattgtattatttatcttagttcagctgagggctttatgagacagtggatggggaggcagtaagacggtgatgagataaaatgtgtgtgttgcactgactgtctataaagttatcctttcttcatgaaaaagtagcatttaaatctggatgagtttataaaggattacaaaatgctgatttatagagtaaactttaaaatattaaagactaaagactaaaagaagagtaataatgaagtaatgtaggctgtcacttctctagatttgtattgttgaaaatttaactttggacatctttatagattattattttagacctacaaaaactaccctcaactctgtggctacagctagaatatgaagcatcattgctacaccagttcttactttctagatattgttggtgtgtcataatgtttgaggctgtatttgtaagtcttgcaagtgtgagaaagagccgtatcttttgactttatacttcagattaaggttttgtaatgtttcttcttcaaaaggcaagtgaagctgtcatcctcattctcctaggccagacacaaacattgacacgtcaaggtttttttttttttttttttttggcctgagtctcactttgatgtccaggctggagtgcgatggcacgacctcggctcactgcaat

SEQ ID NO: 23690 - DNA, 3354 bp, Homo sapiens
ctgggtgcgcgccggctccggctgcagttcccgggtccctcggccaccgaagccaccctgccctggtgaaagggctcccgcaccgcccggtgctccccatctgcctggcgttgtgcgcagagctggaaagcatggctgttataaatgaattctgattttggggagcagatgccaacttagagcctcgtaccaatctctctgtctttaaaagatgaggtgacttggtgattttcctggaaaattataggtgcccagctaagacctgaatgccatcaccctccccagggctctgcagttttctcgtggtgaacccttgatggatttgttgttgcttgagaaatggcgatgatcgaattggggtttggaagacagaattttcatccattaaagaggaagagttcattgctgttgaaactcatagctgttgtctttgctgtgcttctattttgtgaatttttaatctattacttagcgatctttcagtgtaattggcctgaagtgaaaaccacagcctctgatggtgaacagaccacacgtgagcctgtgctcaaagccatgtttttggctgacacccatttgcttggggaattcctaggccactggctggacaaattacgaagggaatggcagatggagagagcgttccagacagctctgtggttgctgcagccggaagtcgtcttcatcctgggggatatctttgatgaagggaagtggagcacccctgaggcctgggcggatgatgtggagcggtttcagaaaatgttcagacacccaagtcatgtacagctgaaggtagttgctggaaaccatgacattggcttccattatgagatgaacacatacaaagtagaacgctttgagaaagtgttcagctctgaaagactgttttcttggaaaggcattaactttgtgatggtcaacagcgtggcgctgaacggggatggctgtggcatctgctctgaaacagaagcagagctcattgaagtttctcacagactgaactgctcccgagaggcacgtggctccagccggtgtggacctgggcctctgctgcccacgtctgcccctgtcctcctgcagcattatcctctgtatcggagaagtgatgctaactgttctggggaagacgctgctcctgcagaggaaagggacatcccatttaaggagaactatgacgtgctttcacgggaggcatcacaaaagctgctgtggtggctccagccgcgcctggttctcagtggccacacgcacagcgcctgcgaggtgcaccacgggggccgagtccccgagctcagcgtcccatctttcagttggaggaacagaaacaaccccagtttcatcatgggtagcatcacgcccacagactacaccctctccaagtgctacctcccacgtgaggatgtggttttgatcatctactgtggagtggtgggcttccttgtggtcctcacactcactcactttgggcttctagcctcaccttttctttctggtttgaacttgctcggaaagcgtaagacaagatgaagagcaggcgccattataaatatcaaagcccaagaaatggaactttgggcagagatcatgttagaatcaagtggatgatgagaccaattacaggccgtctctctgcacagcacagaaattctcaatcactgaaatgagtaactgcaaaataaatagttgattgtactgttctcatgctataaaagtggacaggtactctacaacaaatctgttttctcatttttatcaaatatatgtatcatcaaaggttgcatctgtacagtatgtaaatgctattaatgtcgtcactcacatgcacgacagtccttgttcccccaggaagggcctggtggccccagcacacacttgggattatgtgtatacataaataaatattgggctgtttccctcttcctgtgaagtggttctcaaattcctatgtactgtaaagctgtacccttaaaagtacagatgtggccgggcacagtggctcacacctgtaatcccagcactttgggaggctgaggcgggtggatcacttgaggtcaggagttcaagaccagcctggccaacatggtgaaacctcgtctccgctagaaatacaaaaattagccaagcatggtagcaagtgcctataataccagctgaggctgaggcaggagaatcccttgagcccgggaggcggaggttgcagtgagccaagatcatgccactgcactccagcctgggcaacagagtgagactccgtctcaaaaaatatatttaaaaaaaaaaaagtacagatgtgatgtgcagaacatattgttttcgtagatttttatacttgatcaattaatggaatcagatttttagataagtgtaattttctctataggagaccacgttgctacatctgttaatgcctgtcagtgatcaaaagaaacttaaaaagtggaatgggatatggcttttggtacctgaaaataaatgctttaataattgtaagccagataaaagttattctttttgttttttttcttaacagtctggctgttgtttgaattaaactcttaaacaggatgtttagttagagggtaattgttgagtaatgatgcatacaacagcatacttccctttcttgctgggggtgcagcttttcagttttcttgttttactttgacagtgcaaggggaactgaaaataatttccattgtattatttatcttagttcagctgagggctttatgagacagtggatggggaggcagtaagacggtgatgagataaaatgtgtgtgttgcactgactgtctataaagttatcctttcttcatgaaaaagtagcatttaaatctggatgagtttataaaggattacaaaatgctgatttatagagtaaactttaaaatattaaagactaaagactaaaagaagagtaataatgaagtaatgtaggctgtcacttctctagatttgtattgttgaaaatttaactttggacatctttatagattattattttagacctacaaaaactaccctcaactctgtggctacagctagaatatgaagcatcattgctacaccagttcttactttctagatattgttggtgtgtcataatgtttgaggctgtatttgtaagtcttgcaagtgtgagaaagagccgtatcttttgactttatacttcagattaaggttttgtaatgtttcttcttcaaaaggcaagtgaagctgtcatcctcattctcctaggccagacacaaacattgacacgtcaaggtttttttttttttttttttttggcctgagtctcactttgatgtccaggctggagtgcgatggcacgacctcggctcactgcaat

SEQ ID NO: 23691 - DNA, 3519 bp, Homo sapiens
ctgggtgcgcgccggctccggctgcagttcccgggtccctcggccaccgaagccaccctgccctggtgaaagggctcccgcaccgcccggtgctccccatctgcctggcgttgtgcgcagagctggaaagcatggctgttataaatgaattctgattttggggagcagatgccaacttagagcctcgtaccaatctctctgtctttaaaagatgaggtgacttggtgattttcctggaaaattataggtgcccagctaagacctgaatgccatcaccctccccagggctctgcagttttctcgtggtgaacccttgatggatttgttgttgcttgagaaatggcgatgatcgaattggggtttggaagacagaattttcatccattaaagaggaagagttcattgctgttgaaactcatagctgttgtctttgctgtgcttctattttgtgaatttttaatctattacttagcgatctttcagtgtaattggcctgaagtgaaaaccacagcctctgatggtgaacagaccacacgtgagcctgtgctcaaagccatgtttttggctgacacccatttgcttggggaattcctaggccactggctggacaaattacgaagggaatggcagatggagagagcgttccagacagctctgtggttgctgcagccggaagtcgtcttcatcctgggggatatctttgatgaagggaagtggagcacccctgaggcctgggcggatgatgtggagcggtttcagaaaatgttcagacacccaagtcatgtacagctgaaggtagttgctggaaaccatgacattggcttccattatgagatgaacacatacaaagtagaacgctttgagaaagtgttcagctctgaaagactgttttcttggaaaggcattaactttgtgatggtcaacagcgtggcgctgaacggggatggctgtggcatctgctctgaaacagaagcagagctcattgaagtttctcacagactgaactgctcccgagaggcacgtggctccagccggtgtggacctgggcctctgctgcccacgtctgcccctgtcctcctgcagcattatcctctgtatcggagaagtgatgctaactgttctggggaagacgctgctcctgcagaggaaagggacatcccatttaaggagaactatgacgtgctttcacgggaggcatcacaaaagctgctgtggtggctccagccgcgcctggttctcagtggccacacgcacagcgcctgcgaggtgcaccacgggggccgagtccccgagctcagcgtcccatctttcagttggaggaacagaaacaaccccagtttcatcatgggaacagatgcttagttgagcatcaaggggcaggaagacacctttccctccttgttcctcgctgaccgatgaccctggaactccacggtgcctctctgaatctctgttatggatcccccactatatttgatgggaacccagtgagccaggggccagttttgacagggtagcatcacgcccacagactacaccctctccaagtgctacctcccacgtgaggatgtggttttgatcatctactgtggagtggtgggcttccttgtggtcctcacactcactcactttgggcttctagcctcaccttttctttctggtttgaacttgctcggaaagcgtaagacaagatgaagagcaggcgccattataaatatcaaagcccaagaaatggaactttgggcagagatcatgttagaatcaagtggatgatgagaccaattacaggccgtctctctgcacagcacagaaattctcaatcactgaaatgagtaactgcaaaataaatagttgattgtactgttctcatgctataaaagtggacaggtactctacaacaaatctgttttctcatttttatcaaatatatgtatcatcaaaggttgcatctgtacagtatgtaaatgctattaatgtcgtcactcacatgcacgacagtccttgttcccccaggaagggcctggtggccccagcacacacttgggattatgtgtatacataaataaatattgggctgtttccctcttcctgtgaagtggttctcaaattcctatgtactgtaaagctgtacccttaaaagtacagatgtggccgggcacagtggctcacacctgtaatcccagcactttgggaggctgaggcgggtggatcacttgaggtcaggagttcaagaccagcctggccaacatggtgaaacctcgtctccgctagaaatacaaaaattagccaagcatggtagcaagtgcctataataccagctgaggctgaggcaggagaatcccttgagcccgggaggcggaggttgcagtgagccaagatcatgccactgcactccagcctgggcaacagagtgagactccgtctcaaaaaatatatttaaaaaaaaaaaagtacagatgtgatgtgcagaacatattgttttcgtagatttttatacttgatcaattaatggaatcagatttttagataagtgtaattttctctataggagaccacgttgctacatctgttaatgcctgtcagtgatcaaaagaaacttaaaaagtggaatgggatatggcttttggtacctgaaaataaatgctttaataattgtaagccagataaaagttattctttttgttttttttcttaacagtctggctgttgtttgaattaaactcttaaacaggatgtttagttagagggtaattgttgagtaatgatgcatacaacagcatacttccctttcttgctgggggtgcagcttttcagttttcttgttttactttgacagtgcaaggggaactgaaaataatttccattgtattatttatcttagttcagctgagggctttatgagacagtggatggggaggcagtaagacggtgatgagataaaatgtgtgtgttgcactgactgtctataaagttatcctttcttcatgaaaaagtagcatttaaatctggatgagtttataaaggattacaaaatgctgatttatagagtaaactttaaaatattaaagactaaagactaaaagaagagtaataatgaagtaatgtaggctgtcacttctctagatttgtattgttgaaaatttaactttggacatctttatagattattattttagacctacaaaaactaccctcaactctgtggctacagctagaatatgaagcatcattgctacaccagttcttactttctagatattgttggtgtgtcataatgtttgaggctgtatttgtaagtcttgcaagtgtgagaaagagccgtatcttttgactttatacttcagattaaggttttgtaatgtttcttcttcaaaaggcaagtgaagctgtcatcctcattctcctaggccagacacaaacattgacacgtcaaggtttttttttttttttttttttggcctgagtctcactttgatgtccaggctggagtgcgatggcacgacctcggctcactgcaat

SEQ ID NO: 23692 - DNA, 3377 bp, Homo sapiens
cagtgattctttttccctcaggcctgggcggatgatgtggagcggtttcagaaaatgttcagacacccaagtcatgtacagctgaaggtagttgctggaaaccatgacattggcttccattatgagatgaacacatacaaagtagaacgctttgagaaagtgttcagctctgaaagactgttttcttggaaaggcattaactttgtgatggtcaacagcgtggcgctgaacggggatggctgtggcatctgctctgaaacagaagcagagctcattgaagtttctcacagactgaactgctcccgagagcattatcctctgtatcggagaagtgatgctaactgttctggggaagacgctgctcctgcagaggaaagggacatcccatttaaggagaactatgacgtgctttcacgggaggcatcacaaaagctgctgtggtggctccagccgcgcctggttctcagtggccacacgcacagcgcctgcgaggtgcaccacgggggccgagtccccgagctcagcgtcccatctttcagttggaggaacagaaacaaccccagtttcatcatggtaacgtgaaagtttatttttgtctgaaagctttcataagtatttaaatcaacacagtaatcaactatttaattgctgcaatcggtcaaaatttacaaaagccacacacaaatttctctccttctacacgtagctccatacactgccccttgccaaacacccttccgggaaccaatcagcatgacattcctgggcagttaatgtgagaagcgagggcagggcaccgtccaggtggactttatccttcagggagggccgtatcctctcctcttacactctgtgtgtgtttaattttctaaagaaacaaccatttattcattagctatactcagccatcttctcttattttctaaacatgcccatttgacctggcagagaacgctgcagcttttgcaggttgataaaagatgtttcacttaatgaccactgggcgttttaactcctttcagccatgggctcctgcatccagctcatgatgctggtacgacaggttcttttacttcataaaaaggtggaggaaaccctaacattttcaaattcaaagtaaatgaaaacatttgccactgttgttccacataaaagtatctgcaaagaaaagcccatggagacgacctggacacatgtatttctagggaacagatgcttagttgagcatcaaggggcaggaagacacctttccctccttgttcctcgctgaccgatgaccctggaactccacggtgcctctctgaatctctgttatggatcccccactatatttgatgggaacccagtgagccaggggccagttttgacagggtagcatcacgcccacagactacaccctctccaagtgctacctcccacgtgaggatgtggttttgatcatctactgtggagtggtgggcttccttgtggtcctcacactcactcactttgggcttctagcctcaccttttctttctggtttgaacttgctcggaaagcgtaagacaagatgaagagcaggcgccattataaatatcaaagcccaagaaatggaactttgggcagagatcatgttagaatcaagtggatgatgagaccaattacaggccgtctctctgcacagcacagaaattctcaatcactgaaatgagtaactgcaaaataaatagttgattgtactgttctcatgctataaaagtggacaggtactctacaacaaatctgttttctcatttttatcaaatatatgtatcatcaaaggttgcatctgtacagtatgtaaatgctattaatgtcgtcactcacatgcacgacagtccttgttcccccaggaagggcctggtggccccagcacacacttgggattatgtgtatacataaataaatattgggctgtttccctcttcctgtgaagtggttctcaaattcctatgtactgtaaagctgtacccttaaaagtacagatgtggccgggcacagtggctcacacctgtaatcccagcactttgggaggctgaggcgggtggatcacttgaggtcaggagttcaagaccagcctggccaacatggtgaaacctcgtctccgctagaaatacaaaaattagccaagcatggtagcaagtgcctataataccagctgaggctgaggcaggagaatcccttgagcccgggaggcggaggttgcagtgagccaagatcatgccactgcactccagcctgggcaacagagtgagactccgtctcaaaaaatatatttaaaaaaaaaaaagtacagatgtgatgtgcagaacatattgttttcgtagatttttatacttgatcaattaatggaatcagatttttagataagtgtaattttctctataggagaccacgttgctacatctgttaatgcctgtcagtgatcaaaagaaacttaaaaagtggaatgggatatggcttttggtacctgaaaataaatgctttaataattgtaagccagataaaagttattctttttgttttttttcttaacagtctggctgttgtttgaattaaactcttaaacaggatgtttagttagagggtaattgttgagtaatgatgcatacaacagcatacttccctttcttgctgggggtgcagcttttcagttttcttgttttactttgacagtgcaaggggaactgaaaataatttccattgtattatttatcttagttcagctgagggctttatgagacagtggatggggaggcagtaagacggtgatgagataaaatgtgtgtgttgcactgactgtctataaagttatcctttcttcatgaaaaagtagcatttaaatctggatgagtttataaaggattacaaaatgctgatttatagagtaaactttaaaatattaaagactaaagactaaaagaagagtaataatgaagtaatgtaggctgtcacttctctagatttgtattgttgaaaatttaactttggacatctttatagattattattttagacctacaaaaactaccctcaactctgtggctacagctagaatatgaagcatcattgctacaccagttcttactttctagatattgttggtgtgtcataatgtttgaggctgtatttgtaagtcttgcaagtgtgagaaagagccgtatcttttgactttatacttcagattaaggttttgtaatgtttcttcttcaaaaggcaagtgaagctgtcatcctcattctcctaggccagacacaaacattgacacgtcaaggtttttttttttttttttttttggcctgagtctcactttgatgtccaggctggagtgcgatggcacgacctcggctcactgcaat

SEQ ID NO: 23693 - DNA, 2207 bp, Homo sapiens
gagctcggtaccccatcaaccctaaatttattatgggaacagatgcttagttgagcatcaaggggcaggaagacacctttccctccttgttcctcgctgaccgatgaccctggaactccacggtgcctctctgaatctctgttatggatcccccactatatttgatgggaacccagtgagccaggggccagttttgacagggtagcatcacgcccacagactacaccctctccaagtgctacctcccacgtgaggatgtggttttgatcatctactgtggagtggtgggcttccttgtggtcctcacactcactcactttgggcttctagcctcaccttttctttctggtttgaacttgctcggaaagcgtaagacaagatgaagagcaggcgccattataaatatcaaagcccaagaaatggaactttgggcagagatcatgttagaatcaagtggatgatgagaccaattacaggccgtctctctgcacagcacagaaattctcaatcactgaaatgagtaactgcaaaataaatagttgattgtactgttctcatgctataaaagtggacaggtactctacaacaaatctgttttctcatttttatcaaatatatgtatcatcaaaggttgcatctgtacagtatgtaaatgctattaatgtcgtcactcacatgcacgacagtccttgttcccccaggaagggcctggtggccccagcacacacttgggattatgtgtatacataaataaatattgggctgtttccctcttcctgtgaagtggttctcaaattcctatgtactgtaaagctgtacccttaaaagtacagatgtggccgggcacagtggctcacacctgtaatcccagcactttgggaggctgaggcgggtggatcacttgaggtcaggagttcaagaccagcctggccaacatggtgaaacctcgtctccgctagaaatacaaaaattagccaagcatggtagcaagtgcctataataccagctgaggctgaggcaggagaatcccttgagcccgggaggcggaggttgcagtgagccaagatcatgccactgcactccagcctgggcaacagagtgagactccgtctcaaaaaatatatttaaaaaaaaaaaagtacagatgtgatgtgcagaacatattgttttcgtagatttttatacttgatcaattaatggaatcagatttttagataagtgtaattttctctataggagaccacgttgctacatctgttaatgcctgtcagtgatcaaaagaaacttaaaaagtggaatgggatatggcttttggtacctgaaaataaatgctttaataattgtaagccagataaaagttattctttttgttttttttcttaacagtctggctgttgtttgaattaaactcttaaacaggatgtttagttagagggtaattgttgagtaatgatgcatacaacagcatacttccctttcttgctgggggtgcagcttttcagttttcttgttttactttgacagtgcaaggggaactgaaaataatttccattgtattatttatcttagttcagctgagggctttatgagacagtggatggggaggcagtaagacggtgatgagataaaatgtgtgtgttgcactgactgtctataaagttatcctttcttcatgaaaaagtagcatttaaatctggatgagtttataaaggattacaaaatgctgatttatagagtaaactttaaaatattaaagactaaagactaaaagaagagtaataatgaagtaatgtaggctgtcacttctctagatttgtattgttgaaaatttaactttggacatctttatagattattattttagacctacaaaaactaccctcaactctgtggctacagctagaatatgaagcatcattgctacaccagttcttactttctagatattgttggtgtgtcataatgtttgaggctgtatttgtaagtcttgcaagtgtgagaaagagccgtatcttttgactttatacttcagattaaggttttgtaatgtttcttcttcaaaaggcaagtgaagctgtcatcctcattctcctaggccagacacaaacattgacacgtcaaggtttttttttttttttttttttggcctgagtctcactttgatgtccaggctggagtgcgatggcacgacctcggctcactgcaat

SEQ ID NO: 23694 - DNA, 729 bp, Homo sapiens
ctgggtgcgcgccggctccggctgcagttcccgggtccctcggccaccgaagccaccctgccctggtgaaagggctcccgcaccgcccggtgctccccatctgcctggcgttgtgcgcagagctggaaagcatggctgttataaatgaattctgattttggggagcagatgccaacttagagcctcgtaccaatctctctgtctttaaaagatgaggtgacttggtgattttcctggaaaattatagaagcactgaggtggacactgcgggttgtgaggttcaggaggggtaagtggctggcacaaggtcacagagcagcgctgccatttggctactttccaattcagcatagctgccctctctgctggtggtattcacagcatgcaagataaaatactcaccaaggaacaagtggctaactcctcacagagctctcacggtttcctctttcctgacaaaaagaatattaatgaaactttatcatcttggtgagaaaagcattctaatagctttattctgacatacggaggtatggagagcttgaaggagtcagagaggtgcccagctaagacctgaatgccatcaccctccccagggctctgcagttttctcgtggtgaacccttgatggatttgttgttgcttgagaaatggcgatgatcgaattggggtttggaagacagaattttcatccattaaagaggaagagttcattgctgttgaaactca

SEQ ID NO: 23695 - DNA, 421 bp, Homo sapiens
agtttcagctatggttttgggtttagcttttaggattttaggagattctaggccttttgaaagaaaaatgagatagtaagatcgaatggctgcctttgacatatttgatttaatcacaacaaaggaaattgcctggcgttaaggaacctgttatttatccctcagaggctctccagcagagaacccaggcccttcaccatactggtgcatggttcctgccacttgtgcagtccattccgaagtttcttacagatgaggtgggtgactgcaaacaggcactgctgcttctcctctatgtcagagtaagcacaggcagcacagggtggctgcacatcctgagttgtctgggacagtcctggtttacaccattgccctgttttaatttttattagtgatatttttcactcaaagctgtccccag

SEQ ID NO: 23696 - DNA, 514 bp, Homo sapiens
ggtttgcatactggaagactcctcagcctgccccagaaggtcagcattccttccctctcaactagttctgtacagctggaggaaacataaggtgttagaaagtttcagctatggttttgggtttagcttttaggattttaggagattctaggccttttgaaagaaaaatgagatagtaagatcgaatggctgcctttgacatatttgatttaatcacaacaaaggaaattgcctggcgttaaggaacctgttatttatccctcagaggctctccagcagagaacccaggcccttcaccatactggtgcatggttcctgccacttgtgcagtccattccgaagtttcttacagatgaggtgggtgactgcaaacaggcactgctgcttctcctctatgtcagagtaagcacaggcagcacagggtggctgcacatcctgagttgtctgggacagtcctggtttacaccattgccctgttttaatttttattagtgatatttttcactcaaagctg

SEQ ID NO: 23697 - DNA, 4431 bp, Homo sapiens
ctgggtgcgcgccggctccggctgcagttcccgggtccctcggccaccgaagccaccctgccctggtgaaagggctcccgcaccgcccggtgctccccatctgcctggcgttgtgcgcagagctggaaagcatggctgttataaatgaattctgattttggggagcagatgccaacttagagcctcgtaccaatctctctgtctttaaaagatgaggtgacttggtgattttcctggaaaattataggtgcccagctaagacctgaatgccatcaccctccccagggctctgcagttttctcgtggtgaacccttgatggatttgttgttgcttgagaaatggcgatgatcgaattggggtttggaagacagaattttcatccattaaagaggaagagttcattgctgttgaaactcatagctgttgtctttgctgtgcttctattttgtgaatttttaatctattacttagcgatctttcagtgtaattggcctgaagtgaaaaccacagcctctgatggtgaacagaccacacgtgagcctgtgctcaaagccatgtttttggctgacacccatttgcttggggaattcctaggccactggctggacaaattacgaagggaatggcagatggagagagcgttccagacagctctgtggttgctgcagccggaagtcgtcttcatcctgggggatatctttgatgaagggaagtggagcacccctgaggcctgggcggatgatgtggagcggtttcagaaaatgttcagacacccaagtcatgtacagctgaaggtagttgctggaaaccatgacattggcttccattatgagatgaacacatacaaagtagaacgctttgagaaagtgttcagctctgaaagactgttttcttggaaaggcattaactttgtgatggtcaacagcgtggcgctgaacggggatggctgtggcatctgctctgaaacagaagcagagctcattgaagtttctcacagactgaactgctcccgagaggtaggagagcatctgaatgccacaggtgccttctgtcccgtgttgctccgcttcggttgctcactcagccccctagcgcttcttgccctttgatgagggtcaggtgtgcggattaatggcctgacttgtacccagcaggcacgtggctccagccggtgtggacctgggcctctgctgcccacgtctgcccctgtcctcctgcaggtgagctgggggaggaaagggctcatggcagacagcaggcagcctgtggtttcacgatagccgcctgaactcctctctccaccccggacagcattatcctctgtatcggagaagtgatgctaactgttctggggaagacgctgctcctgcagaggaaagggacatcccatttaaggagaactatgacgtgctttcacgggaggcatcacaaaaggtttgccagggtgtcgtgatgctaattcatgtcacagtgtgactctcatcaccttgcatgtcaacaagcagagtgcccaggctagagcaggtgtttgctgaaacgttcatgacttagttatcacctggggggacaggggtggaggcctggctttcacagtatctcagattttcatttaatcgctttttttttttccagtaaacctacttctgtttcctaccctcaagtcagtaatagtctcagctattctttgtattcagagtttttcaccaacttaaatgtatttagaaatgtgaatggaactgaaaagtcaattttttagggacttaattaaaattaaaatgcattttcttatatagatttatataatacatattacattatacataatatataaatataagaaatatttataagataaatgtataaaatatttataaagataaaataccgtaaaaagtatataaaatctgggatgagaacaaagggctgaccttacctttgatttagtgtaaataaaccaaaggatttttaaggaaaaaaataaaccagtccttcaaaataaggatttagtatgtaatttaaggaaagaagcgatggccagcggccgtcctgctgagcggtgagagcctggttgaggatgagctaacagcctgctttgctgtcttctcggccactgtcagctgctgtggtggctccagccgcgcctggttctcagtggccacacgcacagcgcctgcgaggtgcaccacgggggccgagtccccgagctcagcgtcccatctttcagttggaggaacagaaacaaccccagtttcatcatgggaacagatgcttagttgagcatcaaggggcaggaagacacctttccctccttgttcctcgctgaccgatgaccctggaactccacggtgcctctctgaatctctgttatggatcccccactatatttgatgggaacccagtgagccaggggccagttttgacagggtagcatcacgcccacagactacaccctctccaagtgctacctcccacgtgaggatgtggttttgatcatctactgtggagtggtgggcttccttgtggtcctcacactcactcactttgggcttctagcctcaccttttctttctggtttgaacttgctcggaaagcgtaagacaagatgaagagcaggcgccattataaatatcaaagcccaagaaatggaactttgggcagagatcatgttagaatcaagtggatgatgagaccaattacaggccgtctctctgcacagcacagaaattctcaatcactgaaatgagtaactgcaaaataaatagttgattgtactgttctcatgctataaaagtggacaggtactctacaacaaatctgttttctcatttttatcaaatatatgtatcatcaaaggttgcatctgtacagtatgtaaatgctattaatgtcgtcactcacatgcacgacagtccttgttcccccaggaagggcctggtggccccagcacacacttgggattatgtgtatacataaataaatattgggctgtttccctcttcctgtgaagtggttctcaaattcctatgtactgtaaagctgtacccttaaaagtacagatgtggccgggcacagtggctcacacctgtaatcccagcactttgggaggctgaggcgggtggatcacttgaggtcaggagttcaagaccagcctggccaacatggtgaaacctcgtctccgctagaaatacaaaaattagccaagcatggtagcaagtgcctataataccagctgaggctgaggcaggagaatcccttgagcccgggaggcggaggttgcagtgagccaagatcatgccactgcactccagcctgggcaacagagtgagactccgtctcaaaaaatatatttaaaaaaaaaaaagtacagatgtgatgtgcagaacatattgttttcgtagatttttatacttgatcaattaatggaatcagatttttagataagtgtaattttctctataggagaccacgttgctacatctgttaatgcctgtcagtgatcaaaagaaacttaaaaagtggaatgggatatggcttttggtacctgaaaataaatgctttaataattgtaagccagataaaagttattctttttgttttttttcttaacagtctggctgttgtttgaattaaactcttaaacaggatgtttagttagagggtaattgttgagtaatgatgcatacaacagcatacttccctttcttgctgggggtgcagcttttcagttttcttgttttactttgacagtgcaaggggaactgaaaataatttccattgtattatttatcttagttcagctgagggctttatgagacagtggatggggaggcagtaagacggtgatgagataaaatgtgtgtgttgcactgactgtctataaagttatcctttcttcatgaaaaagtagcatttaaatctggatgagtttataaaggattacaaaatgctgatttatagagtaaactttaaaatattaaagactaaagactaaaagaagagtaataatgaagtaatgtaggctgtcacttctctagatttgtattgttgaaaatttaactttggacatctttatagattattattttagacctacaaaaactaccctcaactctgtggctacagctagaatatgaagcatcattgctacaccagttcttactttctagatattgttggtgtgtcataatgtttgaggctgtatttgtaagtcttgcaagtgtgagaaagagccgtatcttttgactttatacttcagattaaggttttgtaatgtttcttcttcaaaaggcaagtgaagctgtcatcctcattctcctaggccagacacaaacattgacacgtcaaggtttttttttttttttttttttggcctgagtctcactttgatgtccaggctggagtgcgatggcacgacctcggctcactgcaat

SEQ ID NO: 23698 - DNA, 4660 bp, Homo sapiens
ctgggtgcgcgccggctccggctgcagttcccgggtccctcggccaccgaagccaccctgccctggtgaaagggctcccgcaccgcccggtgctccccatctgcctggcgttgtgcgcagagctggaaagcatggctgttataaatgaattctgattttggggagcagatgccaacttagagcctcgtaccaatctctctgtctttaaaagatgaggtgacttggtgattttcctggaaaattatagaagcactgaggtggacactgcgggttgtgaggttcaggagggaggctctccagcagagaacccaggcccttcaccatactggtgcatggttcctgccacttgtgcagtccattccgaagtttcttacagatgagaatattaatgaaactttatcatcttggtgagaaaagcattctaatagctttattctgacatacggaggtatggagagcttgaaggagtcagagaggtgcccagctaagacctgaatgccatcaccctccccagggctctgcagttttctcgtggtgaacccttgatggatttgttgttgcttgagaaatggcgatgatcgaattggggtttggaagacagaattttcatccattaaagaggaagagttcattgctgttgaaactcatagctgttgtctttgctgtgcttctattttgtgaatttttaatctattacttagcgatctttcagtgtaattggcctgaagtgaaaaccacagcctctgatggtgaacagaccacacgtgagcctgtgctcaaagccatgtttttggctgacacccatttgcttggggaattcctaggccactggctggacaaattacgaagggaatggcagatggagagagcgttccagacagctctgtggttgctgcagccggaagtcgtcttcatcctgggggatatctttgatgaagggaagtggagcacccctgaggcctgggcggatgatgtggagcggtttcagaaaatgttcagacacccaagtcatgtacagctgaaggtagttgctggaaaccatgacattggcttccattatgagatgaacacatacaaagtagaacgctttgagaaagtgttcagctctgaaagactgttttcttggaaaggcattaactttgtgatggtcaacagcgtggcgctgaacggggatggctgtggcatctgctctgaaacagaagcagagctcattgaagtttctcacagactgaactgctcccgagaggtaggagagcatctgaatgccacaggtgccttctgtcccgtgttgctccgcttcggttgctcactcagccccctagcgcttcttgccctttgatgagggtcaggtgtgcggattaatggcctgacttgtacccagcaggcacgtggctccagccggtgtggacctgggcctctgctgcccacgtctgcccctgtcctcctgcaggtgagctgggggaggaaagggctcatggcagacagcaggcagcctgtggtttcacgatagccgcctgaactcctctctccaccccggacagcattatcctctgtatcggagaagtgatgctaactgttctggggaagacgctgctcctgcagaggaaagggacatcccatttaaggagaactatgacgtgctttcacgggaggcatcacaaaaggtttgccagggtgtcgtgatgctaattcatgtcacagtgtgactctcatcaccttgcatgtcaacaagcagagtgcccaggctagagcaggtgtttgctgaaacgttcatgacttagttatcacctggggggacaggggtggaggcctggctttcacagtatctcagattttcatttaatcgctttttttttttccagtaaacctacttctgtttcctaccctcaagtcagtaatagtctcagctattctttgtattcagagtttttcaccaacttaaatgtatttagaaatgtgaatggaactgaaaagtcaattttttagggacttaattaaaattaaaatgcattttcttatatagatttatataatacatattacattatacataatatataaatataagaaatatttataagataaatgtataaaatatttataaagataaaataccgtaaaaagtatataaaatctgggatgagaacaaagggctgaccttacctttgatttagtgtaaataaaccaaaggatttttaaggaaaaaaataaaccagtccttcaaaataaggatttagtatgtaatttaaggaaagaagcgatggccagcggccgtcctgctgagcggtgagagcctggttgaggatgagctaacagcctgctttgctgtcttctcggccactgtcagctgctgtggtggctccagccgcgcctggttctcagtggccacacgcacagcgcctgcgaggtgcaccacgggggccgagtccccgagctcagcgtcccatctttcagttggaggaacagaaacaaccccagtttcatcatgggaacagatgcttagttgagcatcaaggggcaggaagacacctttccctccttgttcctcgctgaccgatgaccctggaactccacggtgcctctctgaatctctgttatggatcccccactatatttgatgggaacccagtgagccaggggccagttttgacagggtagcatcacgcccacagactacaccctctccaagtgctacctcccacgtgaggatgtggttttgatcatctactgtggagtggtgggcttccttgtggtcctcacactcactcactttgggcttctagcctcaccttttctttctggtttgaacttgctcggaaagcgtaagacaagatgaagagcaggcgccattataaatatcaaagcccaagaaatggaactttgggcagagatcatgttagaatcaagtggatgatgagaccaattacaggccgtctctctgcacagcacagaaattctcaatcactgaaatgagtaactgcaaaataaatagttgattgtactgttctcatgctataaaagtggacaggtactctacaacaaatctgttttctcatttttatcaaatatatgtatcatcaaaggttgcatctgtacagtatgtaaatgctattaatgtcgtcactcacatgcacgacagtccttgttcccccaggaagggcctggtggccccagcacacacttgggattatgtgtatacataaataaatattgggctgtttccctcttcctgtgaagtggttctcaaattcctatgtactgtaaagctgtacccttaaaagtacagatgtggccgggcacagtggctcacacctgtaatcccagcactttgggaggctgaggcgggtggatcacttgaggtcaggagttcaagaccagcctggccaacatggtgaaacctcgtctccgctagaaatacaaaaattagccaagcatggtagcaagtgcctataataccagctgaggctgaggcaggagaatcccttgagcccgggaggcggaggttgcagtgagccaagatcatgccactgcactccagcctgggcaacagagtgagactccgtctcaaaaaatatatttaaaaaaaaaaaagtacagatgtgatgtgcagaacatattgttttcgtagatttttatacttgatcaattaatggaatcagatttttagataagtgtaattttctctataggagaccacgttgctacatctgttaatgcctgtcagtgatcaaaagaaacttaaaaagtggaatgggatatggcttttggtacctgaaaataaatgctttaataattgtaagccagataaaagttattctttttgttttttttcttaacagtctggctgttgtttgaattaaactcttaaacaggatgtttagttagagggtaattgttgagtaatgatgcatacaacagcatacttccctttcttgctgggggtgcagcttttcagttttcttgttttactttgacagtgcaaggggaactgaaaataatttccattgtattatttatcttagttcagctgagggctttatgagacagtggatggggaggcagtaagacggtgatgagataaaatgtgtgtgttgcactgactgtctataaagttatcctttcttcatgaaaaagtagcatttaaatctggatgagtttataaaggattacaaaatgctgatttatagagtaaactttaaaatattaaagactaaagactaaaagaagagtaataatgaagtaatgtaggctgtcacttctctagatttgtattgttgaaaatttaactttggacatctttatagattattattttagacctacaaaaactaccctcaactctgtggctacagctagaatatgaagcatcattgctacaccagttcttactttctagatattgttggtgtgtcataatgtttgaggctgtatttgtaagtcttgcaagtgtgagaaagagccgtatcttttgactttatacttcagattaaggttttgtaatgtttcttcttcaaaaggcaagtgaagctgtcatcctcattctcctaggccagacacaaacattgacacgtcaaggtttttttttttttttttttttggcctgagtctcactttgatgtccaggctggagtgcgatggcacgacctcggctcactgcaat

SEQ ID NO: 23699 - DNA, 3006 bp, Homo sapiens
ctgggtgcgcgccggctccggctgcagttcccgggtccctcggccaccgaagccaccctgccctggtgaaagggctcccgcaccgcccggtgctccccatctgcctggcgttgtgcgcagagctggaaagcatggctgttataaatgaattctgattttggggagcagatgccaacttagagcctcgtaccaatctctctgtctttaaaagatgaggtgacttggtgattttcctggaaaattataggtgcccagctaagacctgaatgccatcaccctccccagggctctgcagttttctcgtggtgaacccttgatggatttgttgttgcttgagaaatggcgatgatcgaattggggtttggaagacagaattttcatccattaaagaggaagagttcattgctgttgaaactcatagctgttgtctttgctgtgcttctattttgtgaatttttaatctattacttagcgatctttcagtgtaattggcctgaagtgaaaaccacagcctctgatggtgaacagaccacacgtgagcctgtgctcaaagccatgtttttggctgacacccatttgcttggggaattcctaggccactggctggacaaattacgaagggaatggcagatggagagagcgttccagacagctctgtggttgctgcagccggaagtcgtcttcatcctgggggatatctttgatgaagggaagtggagcacccctgaggcctgggcggatgatgtggagcggtttcagaaaatgttcagacacccaagtcatgtacagctgaaggtagttgctggaaaccatgacattggcttccattatgagatgaacacatacaaagtagaacgctttgagaaagtgttcagctctgaaagactgttttcttggaaaggcattaactttgtgatggtcaacagcgtggcgctgaacggggatggctgtggcatctgctctgaaacagaagcagagctcattgaagtttctcacagactgaactgctcccgagaggtaggagagcatctgaatgccacaggtgccttctgtcccgtgttgctccgcttcggttgctcactcagccccctagcgcttcttgccctttgatgagggtcaggtgtgcggattaatggcctgacttgtacccagcaggcacgtggctccagccggtgtggacctgggcctctgctgcccacgtctgcccctgtcctcctgcaggtgagctgggggaggaaagggctcatggcagacagcaggcagcctgtggtttcacgatagccgcctgaactcctctctccaccccggacagcattatcctctgtatcggagaagtgatgctaactgttctggggaagacgctgctcctgcagaggaaagggacatcccatttaaggagaactatgacgtgctttcacgggaggcatcacaaaaggtttgccagggtgtcgtgatgctaattcatgtcacagtgtgactctcatcaccttgcatgtcaacaagcagagtgcccaggctagagcaggtgtttgctgaaacgttcatgacttagttatcacctggggggacaggggtggaggcctggctttcacagtatctcagattttcatttaatcgctttttttttttccagtaaacctacttctgtttcctaccctcaagtcagtaatagtctcagctattctttgtattcagagtttttcaccaacttaaatgtatttagaaatgtgaatggaactgaaaagtcaattttttagggacttaattaaaattaaaatgcattttcttatatagatttatataatacatattacattatacataatatataaatataagaaatatttataagataaatgtataaaatatttataaagataaaataccgtaaaaagtatataaaatctgggatgagaacaaagggctgaccttacctttgatttagtgtaaataaaccaaaggatttttaaggaaaaaaataaaccagtccttcaaaataaggatttagtatgtaatttaaggaaagaagcgatggccagcggccgtcctgctgagcggtgagagcctggttgaggatgagctaacagcctgctttgctgtcttctcggccactgtcagctgctgtggtggctccagccgcgcctggttctcagtggccacacgcacagcgcctgcgaggtgcaccacgggggccgagtccccgagctcagcgtcccatctttcagttggaggaacagaaacaaccccagtttcatcatgggaacagatgcttagttgagcatcaaggggcaggaagacacctttccctccttgttcctcgctgaccgatgaccctggaactccacggtgcctctctgaatctctgttatggatcccccactatatttgatgggaacccagtgagccaggggccagttttgacagggtagcatcacgcccacagactacaccctctccaagtgctacctcccacgtgaggatgtggttttgatcatctactgtggagtggtgggcttccttgtggtcctcacactcactcactttgggcttctagcctcaccttttctttctggtttgaacttgctcggaaagcgtaagacaagatgaagagcaggcgccattataaatatcaaagcccaagaaatggaactttgggcagagatcatgttagaatcaagtggatgatgagaccaattacaggccgtctctctgcacagcacagaaattctcaatcactgaaatgagtaactgcaaaataaatagttgattgtactgttctcatgctataaaagtggacaggtactctacaacaaatctgttttctcatttttatcaaatatatgtatcatcaaaggttgcatctgtacagtatgtaaatgctattaatgtcgtcactcacatgcacgacagtccttgttcccccaggaagggcctggtggccccagcacacacttgggattatgtgtatacataaataaatattgggctgtttccctcttcctgtga

SEQ ID NO: 23700 - DNA, 5314 bp, Homo sapiens
ctgggtgcgcgccggctccggctgcagttcccgggtccctcggccaccgaagccaccctgccctggtgaaagggctcccgcaccgcccggtgctccccatctgcctggcgttgtgcgcagagctggaaagcatggctgttataaatgaattctgattttggggagcagatgccaacttagagcctcgtaccaatctctctgtctttaaaagatgaggtgacttggtgattttcctggaaaattataggtgcccagctaagacctgaatgccatcaccctccccagggctctgcagttttctcgtggtgaacccttgatggatttgttgttgcttgagaaatggcgatgatcgaattggggtttggaagacagaattttcatccattaaagaggaagagttcattgctgttgaaactcatagctgttgtctttgctgtgcttctattttgtgaatttttaatctattacttagcgatctttcagtgtaattggcctgaagtgaaaaccacagcctctgatggtgaacagaccacacgtgagcctgtgctcaaagccatgtttttggctgacacccatttgcttggggaattcctaggccactggctggacaaattacgaagggaatggcagatggagagagcgttccagacagctctgtggttgctgcagccggaagtcgtcttcatcctgggggatatctttgatgaagggaagtggagcacccctgaggcctgggcggatgatgtggagcggtttcagaaaatgttcagacacccaagtcatgtacagctgaaggtagttgctggaaaccatgacattggcttccattatgagatgaacacatacaaagtagaacgctttgagaaagtgttcagctctgaaagactgttttcttggaaaggcattaactttgtgatggtcaacagcgtggcgctgaacggggatggctgtggcatctgctctgaaacagaagcagagctcattgaagtttctcacagactgaactgctcccgagaggtaggagagcatctgaatgccacaggtgccttctgtcccgtgttgctccgcttcggttgctcactcagccccctagcgcttcttgccctttgatgagggtcaggtgtgcggattaatggcctgacttgtacccagcaggcacgtggctccagccggtgtggacctgggcctctgctgcccacgtctgcccctgtcctcctgcaggtgagctgggggaggaaagggctcatggcagacagcaggcagcctgtggtttcacgatagccgcctgaactcctctctccaccccggacagcattatcctctgtatcggagaagtgatgctaactgttctggggaagacgctgctcctgcagaggaaagggacatcccatttaaggagaactatgacgtgctttcacgggaggcatcacaaaaggtttgccagggtgtcgtgatgctaattcatgtcacagtgtgactctcatcaccttgcatgtcaacaagcagagtgcccaggctagagcaggtgtttgctgaaacgttcatgacttagttatcacctggggggacaggggtggaggcctggctttcacagtatctcagattttcatttaatcgctttttttttttccagtaaacctacttctgtttcctaccctcaagtcagtaatagtctcagctattctttgtattcagagtttttcaccaacttaaatgtatttagaaatgtgaatggaactgaaaagtcaattttttagggacttaattaaaattaaaatgcattttcttatatagatttatataatacatattacattatacataatatataaatataagaaatatttataagataaatgtataaaatatttataaagataaaataccgtaaaaagtatataaaatctgggatgagaacaaagggctgaccttacctttgatttagtgtaaataaaccaaaggatttttaaggaaaaaaataaaccagtccttcaaaataaggatttagtatgtaatttaaggaaagaagcgatggccagcggccgtcctgctgagcggtgagagcctggttgaggatgagctaacagcctgctttgctgtcttctcggccactgtcagctgctgtggtggctccagccgcgcctggttctcagtggccacacgcacagcgcctgcgaggtgcaccacgggggccgagtccccgagctcagcgtcccatctttcagttggaggaacagaaacaaccccagtttcatcatggtaacgtgaaagtttatttttgtctgaaagctttcataagtatttaaatcaacacagtaatcaactatttaattgctgcaatcggtcaaaatttacaaaagccacacacaaatttctctccttctacacgtagctccatacactgccccttgccaaacacccttccgggaaccaatcagcatgacattcctgggcagttaatgtgagaagcgagggcagggcaccgtccaggtggactttatccttcagggagggccgtatcctctcctcttacactctgtgtgtgtttaattttctaaagaaacaaccatttattcattagctatactcagccatcttctcttattttctaaacatgcccatttgacctggcagagaacgctgcagcttttgcaggttgataaaagatgtttcacttaatgaccactgggcgttttaactcctttcagccatgggctcctgcatccagctcatgatgctggtacgacaggttcttttacttcataaaaaggtggaggaaaccctaacattttcaaattcaaagtaaatgaaaacatttgccactgttgttccacataaaagtatctgcaaagaaaagcccatggagacgacctggacacatgtatttctagggaacagatgcttagttgagcatcaaggggcaggaagacacctttccctccttgttcctcgctgaccgatgaccctggaactccacggtgcctctctgaatctctgttatggatcccccactatatttgatgggaacccagtgagccaggggccagttttgacaggtcagtgtcccagacattttccactcaggcacacttgggccttacttgtctctcctgctggagcctgggctggtcgggggtgagctgtgcagggagaaggctgggcccccttggtctcaggtgaggagggcccgttccctgcctcacctgagggggacctgagaaggcagtcttccctctgctgtttctaagactgcggtgttcaacgtgtgcctggtgctctcagcataactttcccttctcctttccagggtagcatcacgcccacagactacaccctctccaagtgctacctcccacgtgaggatgtggttttgatcatctactgtggagtggtgggcttccttgtggtcctcacactcactcactttgggcttctagcctcaccttttctttctggtttgaacttgctcggaaagcgtaagacaagatgaagagcaggcgccattataaatatcaaagcccaagaaatggaactttgggcagagatcatgttagaatcaagtggatgatgagaccaattacaggccgtctctctgcacagcacagaaattctcaatcactgaaatgagtaactgcaaaataaatagttgattgtactgttctcatgctataaaagtggacaggtactctacaacaaatctgttttctcatttttatcaaatatatgtatcatcaaaggttgcatctgtacagtatgtaaatgctattaatgtcgtcactcacatgcacgacagtccttgttcccccaggaagggcctggtggccccagcacacacttgggattatgtgtatacataaataaatattgggctgtttccctcttcctgtgaagtggttctcaaattcctatgtactgtaaagctgtacccttaaaagtacagatgtggccgggcacagtggctcacacctgtaatcccagcactttgggaggctgaggcgggtggatcacttgaggtcaggagttcaagaccagcctggccaacatggtgaaacctcgtctccgctagaaatacaaaaattagccaagcatggtagcaagtgcctataataccagctgaggctgaggcaggagaatcccttgagcccgggaggcggaggttgcagtgagccaagatcatgccactgcactccagcctgggcaacagagtgagactccgtctcaaaaaatatatttaaaaaaaaaaaagtacagatgtgatgtgcagaacatattgttttcgtagatttttatacttgatcaattaatggaatcagatttttagataagtgtaattttctctataggagaccacgttgctacatctgttaatgcctgtcagtgatcaaaagaaacttaaaaagtggaatgggatatggcttttggtacctgaaaataaatgctttaataattgtaagccagataaaagttattctttttgttttttttcttaacagtctggctgttgtttgaattaaactcttaaacaggatgtttagttagagggtaattgttgagtaatgatgcatacaacagcatacttccctttcttgctgggggtgcagcttttcagttttcttgttttactttgacagtgcaaggggaactgaaaataatttccattgtattatttatcttagttcagctgagggctttatgagacagtggatggggaggcagtaagacggtgatgagataaaatgtgtgtgttgcactgactgtctataaagttatcctttcttcatgaaaaagtagcatttaaatctggatgagtttataaaggattacaaaatgctgatttatagagtaaactttaaaatattaaagactaaagactaaaagaagagtaataatgaagtaatgtaggctgtcacttctctagatttgtattgttgaaaatttaactttggacatctttatagattattattttagacctacaaaaactaccctcaactctgtggctacagctagaatatgaagcatcattgctacaccagttcttactttctagatattgttggtgtgtcataatgtttgaggctgtatttgtaagtcttgcaagtgtgagaaagagccgtatcttttgactttatacttcagattaaggttttgtaatgtttcttcttcaaaaggcaagtgaagctgtcatcctcattctcctaggccagacacaaacattgacacgtcaaggtttttttttttttttttttttggcctgagtctcactttgatgtccaggctggagtgcgatggcacgacctcggctcactgcaat

SEQ ID NO: 23701 - DNA, 4698 bp, Homo sapiens
ggggcctgttcctgcacaccacagtgtctggggtgtgtggaagggatggccggactcttctctgatacttaattccccacctttaatcagatatggactctttggcccttcaagccagggatgggaatgcaagagtggggctctggaagaaggagagtggaaccatttagtttgctgtttaaatggtgcataatacagaagtagcctccacctaggaaagagactgatgccttactttttcctattggcatcaagggaatggcagatggagagagcgttccagacagctctgtggttgctgcagccggaagtcgtcttcatcctgggggatatctttgatgaagggaagtggagcacccctgaggcctgggcggatgatgtggagcggtttcagaaaatgttcagacacccaagtcatgtacagctgaaggtagttgctggaaaccatgacattggcttccattatgagatgaacacatacaaagtagaacgctttgagaaagtgttcagctctgaaagactgttttcttggaaaggcattaactttgtgatggtcaacagcgtggcgctgaacggggatggctgtggcatctgctctgaaacagaagcagagctcattgaagtttctcacagactgaactgctcccgagaggtaggagagcatctgaatgccacaggtgccttctgtcccgtgttgctccgcttcggttgctcactcagccccctagcgcttcttgccctttgatgagggtcaggtgtgcggattaatggcctgacttgtacccagcaggcacgtggctccagccggtgtggacctgggcctctgctgcccacgtctgcccctgtcctcctgcaggtgagctgggggaggaaagggctcatggcagacagcaggcagcctgtggtttcacgatagccgcctgaactcctctctccaccccggacagcattatcctctgtatcggagaagtgatgctaactgttctggggaagacgctgctcctgcagaggaaagggacatcccatttaaggagaactatgacgtgctttcacgggaggcatcacaaaaggtttgccagggtgtcgtgatgctaattcatgtcacagtgtgactctcatcaccttgcatgtcaacaagcagagtgcccaggctagagcaggtgtttgctgaaacgttcatgacttagttatcacctggggggacaggggtggaggcctggctttcacagtatctcagattttcatttaatcgctttttttttttccagtaaacctacttctgtttcctaccctcaagtcagtaatagtctcagctattctttgtattcagagtttttcaccaacttaaatgtatttagaaatgtgaatggaactgaaaagtcaattttttagggacttaattaaaattaaaatgcattttcttatatagatttatataatacatattacattatacataatatataaatataagaaatatttataagataaatgtataaaatatttataaagataaaataccgtaaaaagtatataaaatctgggatgagaacaaagggctgaccttacctttgatttagtgtaaataaaccaaaggatttttaaggaaaaaaataaaccagtccttcaaaataaggatttagtatgtaatttaaggaaagaagcgatggccagcggccgtcctgctgagcggtgagagcctggttgaggatgagctaacagcctgctttgctgtcttctcggccactgtcagctgctgtggtggctccagccgcgcctggttctcagtggccacacgcacagcgcctgcgaggtgcaccacgggggccgagtccccgagctcagcgtcccatctttcagttggaggaacagaaacaaccccagtttcatcatggtaacgtgaaagtttatttttgtctgaaagctttcataagtatttaaatcaacacagtaatcaactatttaattgctgcaatcggtcaaaatttacaaaagccacacacaaatttctctccttctacacgtagctccatacactgccccttgccaaacacccttccgggaaccaatcagcatgacattcctgggcagttaatgtgagaagcgagggcagggcaccgtccaggtggactttatccttcagggagggccgtatcctctcctcttacactctgtgtgtgtttaattttctaaagaaacaaccatttattcattagctatactcagccatcttctcttattttctaaacatgcccatttgacctggcagagaacgctgcagcttttgcaggttgataaaagatgtttcacttaatgaccactgggcgttttaactcctttcagccatgggctcctgcatccagctcatgatgctggtacgacaggttcttttacttcataaaaaggtggaggaaaccctaacattttcaaattcaaagtaaatgaaaacatttgccactgttgttccacataaaagtatctgcaaagaaaagcccatggagacgacctggacacatgtatttctagggaacagatgcttagttgagcatcaaggggcaggaagacacctttccctccttgttcctcgctgaccgatgaccctggaactccacggtgcctctctgaatctctgttatggatcccccactatatttgatgggaacccagtgagccaggggccagttttgacagggtagcatcacgcccacagactacaccctctccaagtgctacctcccacgtgaggatgtggttttgatcatctactgtggagtggtgggcttccttgtggtcctcacactcactcactttgggcttctagcctcaccttttctttctggtttgaacttgctcggaaagcgtaagacaagatgaagagcaggcgccattataaatatcaaagcccaagaaatggaactttgggcagagatcatgttagaatcaagtggatgatgagaccaattacaggccgtctctctgcacagcacagaaattctcaatcactgaaatgagtaactgcaaaataaatagttgattgtactgttctcatgctataaaagtggacaggtactctacaacaaatctgttttctcatttttatcaaatatatgtatcatcaaaggttgcatctgtacagtatgtaaatgctattaatgtcgtcactcacatgcacgacagtccttgttcccccaggaagggcctggtggccccagcacacacttgggattatgtgtatacataaataaatattgggctgtttccctcttcctgtgaagtggttctcaaattcctatgtactgtaaagctgtacccttaaaagtacagatgtggccgggcacagtggctcacacctgtaatcccagcactttgggaggctgaggcgggtggatcacttgaggtcaggagttcaagaccagcctggccaacatggtgaaacctcgtctccgctagaaatacaaaaattagccaagcatggtagcaagtgcctataataccagctgaggctgaggcaggagaatcccttgagcccgggaggcggaggttgcagtgagccaagatcatgccactgcactccagcctgggcaacagagtgagactccgtctcaaaaaatatatttaaaaaaaaaaaagtacagatgtgatgtgcagaacatattgttttcgtagatttttatacttgatcaattaatggaatcagatttttagataagtgtaattttctctataggagaccacgttgctacatctgttaatgcctgtcagtgatcaaaagaaacttaaaaagtggaatgggatatggcttttggtacctgaaaataaatgctttaataattgtaagccagataaaagttattctttttgttttttttcttaacagtctggctgttgtttgaattaaactcttaaacaggatgtttagttagagggtaattgttgagtaatgatgcatacaacagcatacttccctttcttgctgggggtgcagcttttcagttttcttgttttactttgacagtgcaaggggaactgaaaataatttccattgtattatttatcttagttcagctgagggctttatgagacagtggatggggaggcagtaagacggtgatgagataaaatgtgtgtgttgcactgactgtctataaagttatcctttcttcatgaaaaagtagcatttaaatctggatgagtttataaaggattacaaaatgctgatttatagagtaaactttaaaatattaaagactaaagactaaaagaagagtaataatgaagtaatgtaggctgtcacttctctagatttgtattgttgaaaatttaactttggacatctttatagattattattttagacctacaaaaactaccctcaactctgtggctacagctagaatatgaagcatcattgctacaccagttcttactttctagatattgttggtgtgtcataatgtttgaggctgtatttgtaagtcttgcaagtgtgagaaagagccgtatcttttgactttatacttcagattaaggttttgtaatgtttcttcttcaaaaggcaagtgaagctgtcatcctcattctcctaggccagacacaaacattgacacgtcaaggtttttttttttttttttttttggcctgagtctcactttgatgtccaggctggagtgcgatggcacgacctcggctcactgcaat

SEQ ID NO: 23702 - DNA, 754 bp, Homo sapiens
ctgggtgcgcgccggctccggctgcagttcccgggtccctcggccaccgaagccaccctgccctggtgaaagggctcccgcaccgcccggtgctccccatctgcctggcgttgtgcgcagagctggaaagcatggctgttataaatgaattctgattttggggagcagatgccaacttagagcctcgtaccaatctctctgtctttaaaagatgaggtgacttggtgattttcctggaaaattatagaggctctccagcagagaacccaggcccttcaccatactggtgcatggttcctgccacttgtgcagtccattccgaagtttcttacagatgaggtgcccagctaagacctgaatgccatcaccctccccagggctctgcagttttctcgtggtgaacccttgatggatttgttgttgcttgagaaatggcgatgatcgaattggggtttggaagacagaattttcatccattaaagaggaagagttcattgctgttgaaactcatagctgttgtctttgctgtgcttctattttgtgaatttttaatctattacttagcgatctttcagtgtaattggcctgaagtgaaaaccacagcctctgatggtgaacagaccacacgtgagcctgtgctcaaagccatgtttttggctgacacccatttgcttggggaattcctaggccactggctggacaaattacgaagagatggagttttgctgtgttgcccatgctggttttgaactcc

SEQ ID NO: 23703 - DNA, 504 bp, Homo sapiens
ctcaactgttcctatatgctattctgagtctaattgcaagctcttttttccttagcacaactcagcaagaaaaggatctaatagaagattcctctgttcagaaggatggtctcaatcagacaactataccagtttctcctccaagtactacaaagccatcgagggcaagtactgcttcaccatgtaataataacataaatgcagctacagctgtggctctacaggtaacttgaagattttagtttatgttaaaaaaaatacaatagattagatttttttttttttttcacgtaacactttgttagaacagagtcatttggaagtagcccaagttggggctgactatcagaaagaagcttaaggagtgttagggtcactgcaaagagatggaaagttttaggctgaggtgggagaattgcttgaacccaggaggcagaggctgcagtgagctgagatcgcaccactgcacttcagcctggacgacagcaagaccccatttcaaaa

SEQ ID NO: 23704 - DNA, 4814 bp, Homo sapiens
tctgatgttgttaaaggtgtctacaaagaaaaggataatgaagagttgacaattagttgcccagtgcctgcagatgagcagacagaatgcacttctgcccagcaactcaatatgagtaccagttctccatgtgctgctgagcttactgcattaagcacaactcagcaagaaaaggatctaatagaagattcctctgttcagaaggatggtctcaatcagacaactataccagtttctcctccaagtactacaaagccatcgagggcaagtactgcttcaccatgtaataataacataaatgcagctacagctgtggctctacaggaaccccgaaagttaagttatgctgaagtgtgccagaagccccctaaagagccatcttcagttcttgtgcagccactacgggaacttcgctccaatgtggtgtctcccaccaaaaatgaagacaatggagctcctgagaactccgttgagaaaccacatgagaagccagaagcaagggctagtaaggattattctggcttccgaggcaatataatccccaggggagcagcaggaaaaatcagggaacagagacgccagtttagccatagggctatacctcagggagtgactcgacgtaatggcaaagagcaatatgtgccacccagatcaccaaagtaaaaaacaacaaaactattcaaaaacttcactctcttcccattaaacttgaactgtggctatattgaactgttttggaggggagggggtagccaggaaggaaacaagagaaagtacgtccatttcattatggattttggagttgtgagtgataggatcccaaaattcatctctaatgtggtttttaaatgctggaggattccaatcaatataaatatatatatatatatacacacacatatataaaaagtataatttttctatttttgtttttggttttaatttgcagagatttgctgccaggaatcaattttgagggttcagatttagcttggaagaaaaaaaagaaacatacatccttcagtataggagatgagggaatgagagaaaatattttttgaagaagcatttctgtaaaattagaaattactttttttaatctatttaaagtttggcttgaagaatgccatctctgactatatggccttgtattgcaaagcagatcagtggctggggtgcctgttgtgggtgtgagtgtgtacaagagcgattgaagccaaatctgttgtcatgttagtaaatgatttgaaaactgaatgtaatacttgagtagatttttttttctagtttgaaatttagtctgtctttttgaccttactaatatttcatttaacaagttgtaaaactctgattgtacttagagatgtgactaccaatcagtttgatactcaaggaaagggggttattcaagaaattgaaaatttcatcttggacctcagtgcatcggtcaaatggatttcagaggtttaaacttccctgtgattccccctgaatacccccaaaatgagaaacaaaattttttttcttactccatttgttactctctgttctttgactgcccacccacagaaaagcaaaataaccaactacctactcaattgtgtgtttgtaattgctttgagcagtctagtcaaatcatataaattgttctaaatttcagaattgaacattgaagtattaactcttctgttcacacatttagaattttagctcccaagatggtagggcagactgaccgtacagtaatttatttgtcgttagtgttaaagattaagcatagtaactgactcttaagtgttaaataatgtagaagtaaaaaaatttttttaaaggcttaatttgggaggggggacttatttctgtttacagtgtattaccttccttccctcctcttctccccccacacccaacaaaatacagtttggaattcactgaaacagtaccagcaagtcatgagattttttagtaaagatgagaaagatggttgaagaaaattagtgcataatttctcagtgaataaagttgtagctctcatatactaaatagacaagtttacatgctgttatttagaaaatgactaaaatattaaaaaccgtgttgtgttaatctgttttaagtcataccatgttcagagttctatgtaaggtgggttttatttttcttttaagggatagtttgtaatagtaagaactgtcccatatgttagtaaattacatatgtacaaattgaaactgtaaattgtgaacactggaaagcaccattgtgacatagagtaaacatcttagtaatatattaaagtgaatgtaaatggtggttaaaattacattactgtgaaattcatcttccaactctaagttaagctttggagatacatgttagtggttaactgttaagagctttgaaaacactgcacatatctgtacaagccagaattactatttctttgacttattattagcttggcagttgcttttgatttgattgttttatgacatggtatactactatatttactcagtttgaaactattcatttctacacactatttttaaaaattgcctactaggtgaaacataacaataaaactacctgtgctgaaatttgggggaagtttaggtcctttaaaaaaacatattaatcattgactacatctatgataaaagtgcttattttggtttactaagataatgcagttggtggaaatgataaacgttttaagtgttaacatcctttgaatgcgttggatttcagagaataaacattttgtaaaaatcacttggtaaggattataaacttaattactgcacttaaaatgaaacattactttttttaaacaatgtgtcacaaatgtaggtctgtattacttgtatgcttgtgtgacttactgttagtccagctctaaaaatttaaaggttgtaattgaaatacaagaaaagagccttcttttagaagaaagcaagtatatttttgcttttacttcaaatgttatttaaagtagaaatttaatttgtagatataacctttaaaaattttctcattaagacaatgtttttaatttaatttgcctcattacatctaatagttcccatttgatggcatgtatagggaagagtgagagagtgtgtgtgtgtgtatgtgtgtgtaatatttatatatattcacagtatgtatttagcatttattttattacagcagatttaaagtttgtatctaaataatgcctatgagttgtgtgaagctcttggctttttttccaacgttactttgtaactaatgagggtggatgttcattgtagtttatttatttggttctttagatggaggaatttaaaaaatcaaatttttctcttcacctttatgacttgacatttccttgatctgttggaggctaaaagtaggtataaatgatattgaatgttgggtatagtgatactctgccatagttcttactgcatgaagagaacaagagtcacacaagttcaccactttgcacttcatagagaaggtacatagagacattgcaaaacctgtctccatttgctatcctgataattaaggttttcataatacctagggcctgtctctgagtaattttaattttgccaaatacactgacatttaaaatagtgatccatctaaatttttttcagctgggttttgaggaatataagagctttcaatgataaaggtttgttgtagttgtcttatgtgctgaatttgcagatgatcagatgctgtgcagaattctgatttatttttgtttcctaaaattaagatagcttgaatattatttcacattcctttttcttttttaaataaacaggtttgctttggaaaggcttaatgatggaatgttagcatcttcactagggtaaagaagaacaaaaagaatgttgctggaacgtaaaatagtatttaaaagttaatgaacacttctctagttttcttagttatggccttaataattagtctcttggcttaaatgtccactggttttactttgacacagttgaacaacactggggttaagtctctggtatttaggctggcaatatatatattaaccatattttaaaagtaccaattttgtttttacagaaaagataaaactcaaaagagaacagtgtattccttctgaggggcttttataaattattaactataatatatgatggattttttcctaattttttatatttccttacaattttggtggccattaatttaactttaggcttttgggcatatgctagtctgagcttccgaaaagatacatatatgtttcccttttcattagctgaatgaggatattttaagaagttgaaagagaatttattttcaagttgtgagtaaatcctcctttgaaattcacctgattattagataacttaaagtttatttttaaaagctgacaactttttatgaatcttcgagttgacagttcctaaaagcgtaactcagatattaatgggctgtgtattaaatggttttattttcagttttgcagcacagaacactgttgaaatatccatatcaacttgatttttttaacctaattcaggtgtcctttgcatctcttaaatgttgggggtgggggtcagagccagttatccggcttctgttttgtcgattgcttagatttgttcctgttgtcaaaactgttacccccaaaattggtgtgacacatgctcatgcataaaatgttaaaatgagtacatccttgtatttgtatttgttttcaacatcgccaaggtgctatgggaaattaacaaaattagaaaaaaaataaaattattaaaaagcaaaaaaaaaat

SEQ ID NO: 23705 - DNA, 1190 bp, Homo sapiens
aaggtgttcagaggatcccctcggatgcaagtgtcgaggaatataagagctttcaatgataaaggtttgttgtagttgtcttatgtgctgaatttgcagatgatcagatgctgtgcagaattctgatttatttttgtttcctaaaattaagatagcttgaatattatttcacattcctttttcttttttaaataaacaggtttgctttggaaaggcttaatgatggaatgttagcatcttcactagggtaaagaagaacaaaaagaatgttgctggaacgtaaaatagtatttaaaagttaatgaacacttctctagttttcttagttatggccttaataattagtctcttggcttaaatgtccactggttttactttgacacagttgaacaacactggggttaagtctctggtatttaggctggcaatatatatattaaccatattttaaaagtaccaattttgtttttacagaaaagataaaactcaaaagagaacagtgtattccttctgaggggcttttataaattattaactataatatatgatggattttttcctaattttttatatttccttacaattttggtggccattaatttaactttaggcttttgggcatatgctagtctgagcttccgaaaagatacatatatgtttcccttttcattagctgaatgaggatattttaagaagttgaaagagaatttattttcaagttgtgagtaaatcctcctttgaaattcacctgattattagataacttaaagtttatttttaaaagctgacaactttttatgaatcttcgagttgacagttcctaaaagcgtaactcagatattaatgggctgtgtattaaatggttttattttcagttttgcagcacagaacactgttgaaatatccatatcaacttgatttttttaacctaattcaggtgtcctttgcatctcttaaatgttgggggtgggggtcagagccagttatccggcttctgttttgtcgattgcttagatttgttcctgttgtcaaaactgttacccccaaaattggtgtgacacatgctcatgcataaaatgttaaaatgagtacatccttgtatttgtatttgttttcaacatcgccaaggtgctatgggaaattaacaaaattagaaaaaaaataaaattattaaaaagcaaaaaaaaaat

SEQ ID NO: 23706 - DNA, 2774 bp, Homo sapiens
tctgatgttgttaaaggtgtctacaaagaaaaggataatgaagagttgacaattagttgcccagtgcctgcagatgagcagacagaatgcacttctgcccagcaactcaatatgagtaccagttctccatgtgctgctgagcttactgcattaagcacaactcagcaagaaaaggatctaatagaagattcctctgttcagaaggatggtctcaatcagacaactataccagtttctcctccaagtactacaaagccatcgagggcaagtactgcttcaccatgtaataataacataaatgcagctacagctgtggctctacaggaaccccgaaagttaagttatgctgaagtgtgccagaagccccctaaagagccatcttcagttcttgtgcagccactacgggaacttcgctccaatgtggtgtctcccaccaaaaatgaagacaatggagctcctgagaactccgttgagaaaccacatgagaagccagaagcaagggctagtaaggattattctggcttccgaggcaatataatccccaggggagcagcaggaaaaatcagggaacagagacgccagtttagccatagggctatacctcagggagtgactcgacgtaatggcaaagagcaatatgtgccacccagatcaccaaagtaaaaaacaacaaaactattcaaaaacttcactctcttcccattaaacttgaactgtggctatattgaactgttttggaggggagggggtagccaggaaggaaacaagagaaagtacgtccatttcattatggattttggagttgtgagtgataggatcccaaaattcatctctaatgtggtttttaaatgctggaggattccaatcaatataaatatatatatatatatacacacacatatataaaaagtataatttttctatttttgtttttggttttaatttgcagagatttgctgccaggaatcaattttgagggttcagatttagcttggaagaaaaaaaagaaacatacatccttcagtataggagatgagggaatgagagaaaatattttttgaagaagcatttctgtaaaattagaaattactttttttaatctatttaaagtttggcttgaagaatgccatctctgactatatggccttgtattgcaaagcagatcagtggctggggtgcctgttgtgggtgtgagtgtgtacaagagcgattgaagccaaatctgttgtcatgttagtaaatgatttgaaaactgaatgtaatacttgagtagatttttttttctagtttgaaatttagtctgtctttttgaccttactaatatttcatttaacaagttgtaaaactctgattgtacttagagatgtgactaccaatcagtttgatactcaaggaaagggggttattcaagaaattgaaaatttcatcttggacctcagtgcatcggtcaaatggatttcagaggtttaaacttccctgtgattccccctgaatacccccaaaatgagaaacaaaattttttttcttactccatttgttactctctgttctttgactgcccacccacagaaaagcaaaataaccaactacctactcaattgtgtgtttgtaattgctttgagcagtctagtcaaatcatataaattgttctaaatttcagaattgaacattgaagtattaactcttctgttcacacatttagaattttagctcccaagatggtagggcagactgaccgtacagtaatttatttgtcgttagtgttaaagattaagcatagtaactgactcttaagtgttaaataatgtagaagtaaaaaaatttttttaaaggcttaatttgggaggggggacttatttctgtttacagtgtattaccttccttccctcctcttctccccccacacccaacaaaatacagtttggaattcactgaaacagtaccagcaagtcatgagattttttagtaaagatgagaaagatggttgaagaaaattagtgcataatttctcagtgaataaagttgtagctctcatatactaaatagacaagtttacatgctgttatttagaaaatgactaaaatattaaaaaccgtgttgtgttaatctgttttaagtcataccatgttcagagttctatgtaaggtgggttttatttttcttttaagggatagtttgtaatagtaagaactgtcccatatgttagtaaattacatatgtacaaattgaaactgtaaattgtgaacactggaaagcaccattgtgacatagagtaaacatcttagtaatatattaaagtgaatgtaaatggtggttaaaattacattactgtgaaattcatcttccaactctaagttaagctttggagatacatgttagtggttaactgttaagagctttgaaaacactgcacatatctgtacaagccagaattactatttctttgacttattattagcttggcagttgcttttgatttgattgttttatgacatggtatactactatatttactcagtttgaaactattcatttctacacactatttttaaaaattgcctactaggtgaaacataacaataaaactacctgtgctgaaatttgggggaagtttaggtcctttaaaaaaacatattaatcattgactacatctatgataaaagtgcttattttggtttactaagataatgcagttggtggaaatgataaacgttttaagtgttaacatcctttgaatgcgttggatttcagagaataaacattttgtaaaaatc

SEQ ID NO: 23707 - DNA, 1084 bp, Homo sapiens
gtgagcgttcagaggtcccctcggatgcaaggtcctaaaattaagatagcttgaatattatttcacattcctttttcttttttaaataaacaggtttgctttggaaaggcttaatgatggaatgttagcatcttcactagggtaaagaagaacaaaaagaatgttgctggaacgtaaaatagtatttaaaagttaatgaacacttctctagttttcttagttatggccttaataattagtctcttggcttaaatgtccactggttttactttgacacagttgaacaacactggggttaagtctctggtatttaggctggcaatatatatattaaccatattttaaaagtaccaattttgtttttacagaaaagataaaactcaaaagagaacagtgtattccttctgaggggcttttataaattattaactataatatatgatggattttttcctaattttttatatttccttacaattttggtggccattaatttaactttaggcttttgggcatatgctagtctgagcttccgaaaagatacatatatgtttcccttttcattagctgaatgaggatattttaagaagttgaaagagaatttattttcaagttgtgagtaaatcctcctttgaaattcacctgattattagataacttaaagtttatttttaaaagctgacaactttttatgaatcttcgagttgacagttcctaaaagcgtaactcagatattaatgggctgtgtattaaatggttttattttcagttttgcagcacagaacactgttgaaatatccatatcaacttgatttttttaacctaattcaggtgtcctttgcatctcttaaatgttgggggtgggggtcagagccagttatccggcttctgttttgtcgattgcttagatttgttcctgttgtcaaaactgttacccccaaaattggtgtgacacatgctcatgcataaaatgttaaaatgagtacatccttgtatttgtatttgttttcaacatcgccaaggtgctatgggaaattaacaaaattagaaaaaaaataaaattattaaaaagcaaaaaaaaaat

SEQ ID NO: 23708 - DNA, 1040 bp, Homo sapiens
actagttctagatcgcgagcggccgtccatttcttttttaaataaacaggtttgctttggaaaggcttaatgatggaatgttagcatcttcactagggtaaagaagaacaaaaagaatgttgctggaacgtaaaatagtatttaaaagttaatgaacacttctctagttttcttagttatggccttaataattagtctcttggcttaaatgtccactggttttactttgacacagttgaacaacactggggttaagtctctggtatttaggctggcaatatatatattaaccatattttaaaagtaccaattttgtttttacagaaaagataaaactcaaaagagaacagtgtattccttctgaggggcttttataaattattaactataatatatgatggattttttcctaattttttatatttccttacaattttggtggccattaatttaactttaggcttttgggcatatgctagtctgagcttccgaaaagatacatatatgtttcccttttcattagctgaatgaggatattttaagaagttgaaagagaatttattttcaagttgtgagtaaatcctcctttgaaattcacctgattattagataacttaaagtttatttttaaaagctgacaactttttatgaatcttcgagttgacagttcctaaaagcgtaactcagatattaatgggctgtgtattaaatggttttattttcagttttgcagcacagaacactgttgaaatatccatatcaacttgatttttttaacctaattcaggtgtcctttgcatctcttaaatgttgggggtgggggtcagagccagttatccggcttctgttttgtcgattgcttagatttgttcctgttgtcaaaactgttacccccaaaattggtgtgacacatgctcatgcataaaatgttaaaatgagtacatccttgtatttgtatttgttttcaacatcgccaaggtgctatgggaaattaacaaaattagaaaaaaaataaaattattaaaaagcaaaaaaaaaat

SEQ ID NO: 23709 - DNA, 439 bp, Homo sapiens
ttgaaaaatctttttactttaaggataatgaagagttgacaattagttgcccagtgcctgcagatgagcagacagaatgcacttctgcccagcaactcaatatgagtaccagttctccatgtgctgctgagcttactgcattaagcacaactcagcaagaaaaggatctaatagaagattcctctgttcagaaggatggtctcaatcagacaactataccagtttctcctccaagtactacaaagccatcgagggcaagtactgcttcaccatgtaataataacataaatgcagctacagctgtggctctacaggcatttaggtcgctcccatcattataaacaacgctgacatgaacatccttcagttaaattccttacgtgaaattattgtataataaataaagattgtaccagtgtactctaagcagtatatatga

SEQ ID NO: 23710 - DNA, 4598 bp, Homo sapiens
tctgatgttgttaaaggtgtctacaaagaaaaggataatgaagagttgacaattagttgcccagtgcctgcagatgagcagacagaatgcacttctgcccagcaactcaatatgagtaccagttctccatgtgctgctgagcttactgcattaagcacaactcagcaagaaaaggatctaatagaagattcctctgttcagaaggatggtctcaatcagacaactataccagtttctcctccaagtactacaaagccatcgagggcaagtactgcttcaccatgtaataataacataaatgcagctacagctgtggctctacaggaaccccgaaagttaagttatgctgaagtgtgccagaagccccctaaagagccatcttcagttcttgtgcagccactacgggaacttcgctccaatgtggtgtctcccaccaaaaatgaagacaatggagctcctgagaactccgttgagaaaccacatgagaagccagaagcaagggctagtaaggattattctggcttccgaggcaatataatccccaggggagcagcaggaaaaatcagggaacagagacgccagtttagccatagggctatacctcagggagtgactcgacgtaatggcaaagagcaatatgtgccacccagatcaccaaagtaaaaaacaacaaaactattcaaaaacttcactctcttcccattaaacttgaactgtggctatattgaactgttttggaggggagggggtagccaggaaggaaacaagagaaagtacgtccatttcattatggattttggagttgtgagtgataggatcccaaaattcatctctaatgtggtttttaaatgctggaggattccaatcaatataaatatatatatatatatacacacacatatataaaaagtataatttttctatttttgtttttggttttaatttgcagagatttgctgccaggaatcaattttgagggttcagatttagcttggaagaaaaaaaagaaacatacatccttcagtataggagatgagggaatgagagaaaatattttttgaagaagcatttctgtaaaattagaaattactttttttaatctatttaaagtttggcttgaagaatgccatctctgactatatggccttgtattgcaaagcagatcagtggctggggtgcctgttgtgggtgtgagtgtgtacaagagcgattgaagccaaatctgttgtcatgttagtaaatgatttgaaaactgaatgtaatacttgagtagatttttttttctagtttgaaatttagtctgtctttttgaccttactaatatttcatttaacaagttgtaaaactctgattgtacttagagatgtgactaccaatcagtttgatactcaaggaaagggggttattcaagaaattgaaaatttcatcttggacctcagtgcatcggtcaaatggatttcagaggtttaaacttccctgtgattccccctgaatacccccaaaatgagaaacaaaattttttttcttactccatttgttactctctgttctttgactgcccacccacagaaaagcaaaataaccaactacctactcaattgtgtgtttgtaattgctttgagcagtctagtcaaatcatataaattgttctaaatttcagaattgaacattgaagtattaactcttctgttcacacatttagaattttagctcccaagatggtagggcagactgaccgtacagtaatttatttgtcgttagtgttaaagattaagcatagtaactgactcttaagtgttaaataatgtagaagtaaaaaaatttttttaaaggcttaatttgggaggggggacttatttctgtttacagtgtattaccttccttccctcctcttctccccccacacccaacaaaatacagtttggaattcactgaaacagtaccagcaagtcatgagattttttagtaaagatgagaaagatggttgaagaaaattagtgcataatttctcagtgaataaagttgtagctctcatatactaaatagacaagtttacatgctgttatttagaaaatgactaaaatattaaaaaccgtgttgtgttaatctgttttaagtcataccatgttcagagttctatgtaaggtgggttttatttttcttttaagggatagtttgtaatagtaagaactgtcccatatgttagtaaattacatatgtacaaattgaaactgtaaattgtgaacactggaaagcaccattgtgacatagagtaaacatcttagtaatatattaaagtgaatgtaaatggtggttaaaattacattactgtgaaattcatcttccaactctaagttaagctttggagatacatgttagtggttaactgttaagagctttgaaaacactgcacatatctgtacaagccagaattactatttctttgacttattattagcttggcagttgcttttgatttgattgttttatgacatggtatactactatatttactcagtttgaaactattcatttctacacactatttttaaaaattgcctactaggtgaaacataacaataaaactacctgtgctgaaatttgggggaagtttaggtcctttaaaaaaacatattaatcattgactacatctatgataaaagtgcttattttggtttactaagataatgcagttggtggaaatgataaacgttttaagtgttaacatcctttgaatgcgttggatttcagagaataaacattttgtaaaaatcacttggtaaggattataaacttaattactgcacttaaaatgaaacattactttttttaaacaatgtgtcacaaatgtaggtctgtattacttgtatgcttgtgtgacttactgttagtccagctctaaaaatttaaaggttgtaattgaaatacaagaaaagagccttcttttagaagaaagcaagtatatttttgcttttacttcaaatgttatttaaagtagaaatttaatttgtagatataacctttaaaaattttctcattaagacaatgtttttaatttaatttgcctcattacatctaatagttcccatttgatggcatgtatagggaagagtgagagagtgtgtgtgtgtgtatgtgtgtgtaatatttatatatattcacagtatgtatttagcatttattttattacagcagatttaaagtttgtatctaaataatgcctatgagttgtgtgaagctcttggctttttttccaacgttactttgtaactaatgagggtggatgttcattgtagtttatttatttggttctttagatggaggaatttaaaaaatcaaatttttctcttcacctttatgacttgacatttccttgatctgttggaggctaaaagtaggtataaatgatattgaatgttgggtatagtgatactctgccatagttcttactgcatgaagagaacaagagtcacacaagttcaccactttgcacttcatagagaaggtacatagagacattgcaaaacctgtctccatttgctatcctgataattaaggttttcataatacctagggcctgtctctgagtaattttaattttgccaaatacactgacatttaaaatagtgatccatctaaatttttttcagctgggttttgaggaatataagagctttcaatgataaaggtttgttgtagttgtcttatgtgctgaatttgcagatgatcagatgctgtgcagaattctgatttatttttgtttcctaaaattaagatagcttgaatattatttcacattcctttttcttttttaaataaacaggtttgctttggaaaggcttaatgatggaatgttagcatcttcactagggtaaagaagaacaaaaagaatgttgctggaacgtaaaatagtatttaaaagttaatgaacacttctctagttttcttagttatggccttaataattagtctcttggcttaaatgtccactggttttactttgacacagttgaacaacactggggttaagtctctggtatttaggctggcaatatatatattaaccatattttaaaagtaccaattttgtttttacagaaaagataaaactcaaaagagaacagtgtattccttctgaggggcttttataaattattaactataatatatgatggattttttcctaattttttatatttccttacaattttggtggccattaatttaactttaggcttttgggcatatgctagtctgagcttccgaaaagatacatatatgtttcccttttcattagctgaatgaggatattttaagaagttgaaagagaatttattttcaagttgtgagtaaatcctcctttgaaattcacctgattattagataacttaaagtttatttttaaaagctgacaactttttatgaatcttcgagttgacagttcctaaaagcgtaactcagatattaatgggctgtgtattaaatggttttattttcagttttgcagcacagaacactgttgatatggatattataaccatctgttatctaggctgtccatttaccggttggacactgatactctgtcaaattccttt

SEQ ID NO: 23711 - DNA, 435 bp, Homo sapiens
gttataaatgtaaggagatggatatttgctgcttaacttcggaactgtcttaataagcataaacataagacttatattatacctcagaaaaccacttgaggcaccaaagaatagtttattgcttccctgtactaaatgtccttaatataaagagcaaattcaccttatggaaaggcaactatcttcccaaggagtcccttagttgtttgtaaggtaatgctgaagctatcaacccgtgcgttgagtttaaatgcctatcctaaatagaccatgtctgacttagtcatgtatggaggcaccatccatcagtagttgaaggcagttgaaaaggagtggttgggggattcttctagtgggttgaacaaggtcatttggcatcagaggtctgcacagaggggtgctgagtagaactggagtggtcagacagccttctgg

SEQ ID NO: 23712 - DNA, 4890 bp, Homo sapiens
agcgggggcatcgccgcccgcgcccctctaagtgccgggccgcaagctccaccgcagccgcctgcaagcagcggcgcctcggccctcgacctgcgcgcaaagcctgtgctggagccgtcctcccgcggcggggaccgggaccggggacccaagccaatcgaaagctccaaccatggccatggggctcttccgcgtgtgtctggtggtggtgacggccatcatcaaccacccgctgctgttcccgcgggagaacgccacagtccccgagaacgaggaggagatcatccgcaagatgcaggcgcaccaggagaagctgcagctggagcagttgcgcctggaggaggaggtggctcggctggcggccgaaaaggaggcactggagcaggtggcggaggagggcaggcagcagaacgagacacgcgtggcctgggacctctggagcaccctctgcatgatcctcttcctgatgatcgaggtgtggcggcaggaccaccaggaggggccctcacctgagtgcctgggcggtgaggaggatgagctgcctgggctggggggcgcccccttgcagggcctcaccctgcccaacaaggccacgcttggccacttttatgagcgctgcatccggggggccacggccgatgcagcccgtacccgggagttcctggaaggcttcgtggatgacttgctggaagccctgaggagcctctgcaaccgggacaccgacatggaggtggaggacttcattggcgtggacagcatgtacgagaactggcaggtggacaggccactgctgtgccaccttttcgtgcccttcacaccccccgagccctaccgcttccacccagagctctggtgctccggccgctcagtgcccctggatcgccagggctacggccagatcaaggtggtccgcgccgatggggacacattgagctgcatctgcggcaagaccaagctcggggaagacatgctgtgtctcctgcacggcaggaacagcatggcgcctccctgcggcgacatggagaacctgctgtgtgccacagattccctgtacctggacacgatgcaggtcatgaagtggttccagacggccctcaccagagcctggaagggcatcgcccacaagtacgagttcgacctggcctttggccagctggacagcccggggtccctgaagatcaagttccgttcagggaagttcatgcccttcaacctgattcctgtgatccagtgtgatgactcggacctgtactttgtctcccaccttcccagggagccctctgagggcaccccagcctccagcacagactggctcctgtcctttgctgtctatgagcgacacttcctcaggacgacactaaaggcactgcccgagggcgcctgccacctcagctgcctgcagatagcatccttcctgctctccaagcagagccgcctgaccggtcccagcgggctcagcagctaccacctgaagacggccctactgcacctcctactcctccggcaggccgccgactggaaggcggggcagctggacgctcgtctgcacgagttgctgtgcttcctggagaagagcttgctccagaagaagctccaccacttcttcatcggcaaccgcaaggtgcctgaggccatgggactccctgaggccgtgctcagggccgagcccctcaacctcttccggcccttcgtcctgcagcgaagcctttaccgtaagacactggactccttctatgagatgctcaagaatgccccagcgctcattagcgagtattccctacatgtcccctcagaccagcctaccccaaaaagctgacgtcttttacagaatgtgggatcctcgagctaagatgagggcatccctcacgttcacacccctggtggcatctgccagccctgttctggggacaaggcgggctttcgtgggagccgtgctcagcctgccaggaagccaagccctacagtgcagaggaaacagaatttcaacgggaagctggtttgcttcataccattgggatctgctggtaaagctgttatttgggtttagggactgatcccttgcagtttacttctggatcaccatgaatggccaagatggtggcagaacacgctgtggaccctgagttagagacaatgcaaatgttggattgggtgtaattctttttgaatcccagatccagtctgtacttgaatatgagcagaggatctacaagaatgctgacagggaaccgtgttaagacccagcacccctattcccaggagcttctggcctgaccatctgcagccaaagcactaacagggacagatatgggaatgtccacctttgatccgcatcctgcacaatagtggtcccaccatggctgccacttttttatactatttggagaaaagaccttgtataaattcgaggcccgagtgactaacgtctctgtcacacggaaatgggtacttggtggcatagagaaacacaattagccactttttcagctacacttctcactcagctgcaccctacacttctcactcaggtgcacccccttctgctgtcctttccccaacgtactgggtcccgagcgtggtgggtatttgccacactgggtgccagctcagcagccccccacctctctttattctctccaaagctggtctttctgactatcattgtggtagggggaggacagatgctaaaggtggaagctgacctggagaaagagacacacggggtgactgtggcaaaggacagctggaaaagaaactctatcacttcttcattggcaaccacaaggcacctgaggccatggcactcccagaggctgtgcgcagagccaagcctctcaacctcttctggccctgcgtcctgcagcgaagtctctgctgtaagacagtagactccttcgatgaggtgctcaaaaatgctacccggggtggtggtgtctggcttgcagtctggcccagttcagagaaagttgcagagatcaggggccaaggatgtcatagccccaggttgtcctcagggtcccaatcctagggcagggtgtgcatggaagcaagaactatggaaacctagctccagtctgcaggctctgagcccctagttcctcactccagcggggctccctcactgcacagaacccaccccttctgtgtgggcactgctgaccacacagatgacccagacccaaagagcctggcagaagctctgtggttggagctgggctccgtctccaggtctggttcagggggatcaggaaggctcttttccacctgtggcttcactggccctttgagatttcctatctcaccgttacttcagttacccttgcagggggccagggagtcaagaatataccgtgttcctccagggtttaagccggccatgccttcccgagagcataaccaacttgacaggggtgcccagttaccccacaaactgaaggaaggagatccttcccccatccccaggagtgctctcaaccagcctcagaaagcttgagaagatggaccctttgcccaccagggttaattcctggtggggcagctcggctgtgatcagggcaaccaaacctataggaagccttccagtgtgagctggaattagactgaacatgtgcttgggcctgcctctccctagacgcagttgcggggcactccagggaatgaaccagctcaagtgtgtccctaacagcagcctggagctacccccaatccctcacagcctgaccctcctcattccatcagatgcatttgtagaatcggggcaaatttccttatttatttatggcccatgcctttccccctcttcatcctgatcccgttttgctttgaagagaccccagtaaccaaaaaacagcctccagaagccaaaaccatgcctggatctcccatagcttctcctttgcttccaggagaaagttcactgaaaaaaaaatatcttctggcttcttgtgtgtacagagacaacagaactcggtggggaaacgggaatcttttctgcaccaaagctgcttctaaagcagaaagcagtggggctcttggtgtttcatgctgccttatttatattaaaggaagaattaaatcttgcaaggagtagaaatggtcactgtttgtttttaacttcaggaaatctgtgaggctcccagggcagagttggggacaggggggtggatttcctattgacaaagcagaagctttcactccctttttattcttacactttcaggagactttaaaaaataacaaaacagaacatttctaccctgtctttgaggcaacttgtgtgctgcccgcagggctccagaaagggcctttgaaagctggctgtagggtggattccagcctaagaccttatttcacagagctaatgtcagcgagaaatataggagctggaactaacaggaagcttttgggttttaaagaaagagattgtattttaaatagaggattttgagtcctctagggcactttggcctttccactaaggacaaccctgccctctttccccagagtctctttcccaaggatgcttgactttccccagcaactgctcacttgctttgcaaaataacaagggtgaaatgaatagagttggcccctaggccaagaggctggttatgttggggaagggccttatatcctcaaaagctctagcccctctgcatgcctggctgaagcacagcccccgttgagaacctgggggtggagctctggttcatcatcaagggtgtcatccgaatcacccagacaacctggtccattgccccgaccccgccttgaacctacatggtgctcagaatccagtctggagtggtcaggctaggctcgatttttaaagatttcccccaagtgactgatgtacccctagctgaggaagagctcagctttctttcttaa

SEQ ID NO: 23713 - DNA, 4270 bp, Homo sapiens
agtctcggtaacatcatcagtaaaatggggatgaccctcagggctgtggggagggttgacccagacgatgcacagaaggctctgagcaccgtgcctggtgcagactggaaacctggccagtgtgcgctcttcaggacagcagaggtcggttggaggtctgcattctctgccgacttgggccccaacttccccatcaggtcactgctccctcctctgaggtctggacaaaggacaaggctgtagggacctagactgtcctagacggggaggacatctatcctcagtggtctttccagcagtttgtttggagctgctcatcctgatcttttggctgactctggcagagggaaagtcagatttgaggcctgagctctaacaggcatccagagaggaaggaagggcccaccccgtgacatcagtgaaacggaagcaccctgcaggtgacatcactgttgctcagggcaacgcctccaccctaaggcggacggggaggtgaaaaatcggcctcaagtgtgagacgcatgttgaagggaagggacatagaaggtgtaacgttcacaggaaagctccaaccatggccatggggctcttccgcgtgtgtctggtggtggtgacggccatcatcaaccacccgctgctgttcccgcgggagaacgccacagtccccgagaacgaggaggagatcatccgcaagatgcaggcgcaccaggagaagctgcagctggagcagttgcgcctggaggaggaggtggctcggctggcggccgaaaaggaggcactggagcaggtggcggaggagggcaggcagcagaacgagacacgcgtggcctgggacctctggagcaccctctgcatgatcctcttcctgatgatcgaggtgtggcggcaggaccaccaggaggggccctcacctgagtgcctgggcggtgaggaggatgagctgcctgggctggggggcgcccccttgcagggcctcaccctgcccaacaaggccacgcttggccacttttatgagcgctgcatccggggggccacggccgatgcagcccgtacccgggagttcctggaaggcttcgtggatgacttgctggaagccctgaggagcctctgcaaccgggacaccgacatggaggtggaggacttcattggcgtggacagcatgtacgagaactggcaggtggacaggccactgctgtgccaccttttcgtgcccttcacaccccccgagccctaccgcttccacccagagctctggtgctccggccgctcagtgcccctggatcgccagggctacggccagatcaaggtggtccgcgccgatggggacacattgagctgcatctgcggcaagaccaagctcggggaagacatgctgtgtctcctgcacggcaggaacagcatggcgcctccctgcggcgacatggagaacctgctgtgtgccacagattccctgtacctggacacgatgcaggtcatgaagtggttccagacggccctcaccagagcctggaagggcatcgcccacaagtacgagttcgacctggcctttggccagctggacagcccggggtccctgaagatcaagttccgttcagggaagttcatgcccttcaacctgattcctgtgatccagtgtgatgactcggacctgtactttgtctcccaccttcccagggagccctctgagggcaccccagcctccagcacagactggctcctgtcctttgctgtctatgagcgacacttcctcaggacgacactaaaggcactgcccgagggcgcctgccacctcagctgcctgcagatagcatccttcctgctctccaagcagagccgcctgaccggtcccagcgggctcagcagctaccacctgaagacggccctactgcacctcctactcctccggcaggccgccgactggaaggcggggcagctggacgctcgtctgcacgagttgctgtgcttcctggagaagagcttgctccagaagaagctccaccacttcttcatcggcaaccgcaaggtgcctgaggccatgggactccctgaggccgtgctcagggccgagcccctcaacctcttccggcccttcgtcctgcagcgaagcctttaccgtaagacactggactccttctatgagatgctcaagaatgccccagcgctcattagcgagtattccctacatgtcccctcagaccagcctaccccaaaaagctgacgtcttttacagaatgtgggatcctcgagctaagatgagggcatccctcacgttcacacccctggtggcatctgccagccctgttctggggacaaggcgggctttcgtgggagccgtgctcagcctgccaggaagccaagccctacagtgcagaggaaacagaatttcaacgggaagctggtttgcttcataccattgggatctgctggtaaagctgttatttgggtttagggactgatcccttgcagtttacttctggatcaccatgaatggccaagatggtggcagaacacgctgtggaccctgagttagagacaatgcaaatgttggattgggtgtaattctttttgaatcccagatccagtctgtacttgaatatgagcagaggatctacaagaatgctgacagggaaccgtgttaagacccagcacccctattcccaggagcttctggcctgaccatctgcagccaaagcactaacagggacagatatgggaatgtccacctttgatccgcatcctgcacaatagtggtcccaccatggctgccacttttttatactatttggagaaaagaccttgtataaattcgaggcccgagtgactaacgtctctgtcacacggaaatgggtacttggtggcatagagaaacacaattagccactttttcagctacacttctcactcagctgcaccctacacttctcactcaggtgcacccccttctgctgtcctttccccaacgtactgggtcccgagcgtggtgggtatttgccacactgggtgccagctcagcagccccccacctctctttattctctccaaagctggtctttctgactatcattgtggtagggggaggacagatgctaaaggtggaagctgacctggagaaagagacacacggggtgactgtggcaaaggacagctggaaaagaaactctatcacttcttcattggcaaccacaaggcacctgaggccatggcactcccagaggctgtgcgcagagccaagcctctcaacctcttctggccctgcgtcctgcagcgaagtctctgctgtaagacagtagactccttcgatgaggtgctcaaaaatgctacccggggtggtggtgtctggcttgcagtctggcccagttcagagaaagttgcagagatcaggggccaaggatgtcatagccccaggttgtcctcagggtcccaatcctagggcagggtgtgcatggaagcaagaactatggaaacctagctccagtctgcaggctctgagcccctagttcctcactccagcggggctccctcactgcacagaacccaccccttctgtgtgggcactgctgaccacacagatgacccagacccaaagagcctggcagaagctctgtggttggagctgggctccgtctccaggtctggttcagggggatcaggaaggctcttttccacctgtggcttcactggccctttgagatttcctatctcaccgttacttcagttacccttgcagggggccagggagtcaagaatataccgtgttcctccagggtttaagccggccatgccttcccgagagcataaccaacttgacaggggtgcccagttaccccacaaactgaaggaaggagatccttcccccatccccaggagtgctctcaaccagcctcagaaagcttgagaagatggaccctttgcccaccagggttaattcctggtggggcagctcggctgtgatcagggcaaccaaacctataggaagccttccagtgtgagctggaattagactgaacatgtgcttgggcctgcctctccctagacgcagttgcggggcactccagggaatgaaccagctcaagtgtgtccctaacagcagcctggagctacccccaatccctcacagcctgaccctcctcattccatcagatgcatttgtagaatcggggcaattcttattttatggccatgcttccctttatctggtcgttgttgagaaccgtacaaaagtcagagccactgcggtccatttctgtcgggagtctgggaaaaaacggtt

SEQ ID NO: 23714 - DNA, 4484 bp, Homo sapiens
agtctcggtaacatcatcagtaaaatggggatgaccctcagggctgtggggagggttgacccagacgatgcacagaaggctctgagcaccgtgcctggtgcagactggaaacctggccagtgtgcgctcttcaggacagcagaggtcggttggaggtctgcattctctgccgacttgggccccaacttccccatcaggtcactgctccctcctctgaggtctggacaaaggacaaggctgtagggacctagactgtcctagacggggaggacatctatcctcagtggtctttccagcagtttgtttggagctgctcatcctgatcttttggctgactctggcagagggaaagtcagatttgaggcctgagctctaacaggcatccagagaggaaggaagggcccaccccgtgacatcagtgaaacggaagcaccctgcaggtgacatcactgttgctcagggcaacgcctccaccctaaggcggacggggaggtgaaaaatcggcctcaagtgtgagacgcatgttgaagggaagggacatagaaggtgtaacgttcacaggaaagctccaaccatggccatggggctcttccgcgtgtgtctggtggtggtgacggccatcatcaaccacccgctgctgttcccgcgggagaacgccacagtccccgagaacgaggaggagatcatccgcaagatgcaggcgcaccaggagaagctgcagctggagcagttgcgcctggaggaggaggtggctcggctggcggccgaaaaggaggcactggagcaggtggcggaggagggcaggcagcagaacgagacacgcgtggcctgggacctctggagcaccctctgcatgatcctcttcctgatgatcgaggtgtggcggcaggaccaccaggaggggccctcacctgagtgcctgggcggtgaggaggatgagctgcctgggctggggggcgcccccttgcagggcctcaccctgcccaacaaggccacgcttggccacttttatgagcgctgcatccggggggccacggccgatgcagcccgtacccgggagttcctggaaggcttcgtggatgacttgctggaagccctgaggagcctctgcaaccgggacaccgacatggaggtggaggacttcattggcgtggacagcatgtacgagaactggcaggtggacaggccactgctgtgccaccttttcgtgcccttcacaccccccgagccctaccgcttccacccagagctctggtgctccggccgctcagtgcccctggatcgccagggctacggccagatcaaggtggtccgcgccgatggggacacattgagctgcatctgcggcaagaccaagctcggggaagacatgctgtgtctcctgcacggcaggaacagcatggcgcctccctgcggcgacatggagaacctgctgtgtgccacagattccctgtacctggacacgatgcaggtcatgaagtggttccagacggccctcaccagagcctggaagggcatcgcccacaagtacgagttcgacctggcctttggccagctggacagcccggggtccctgaagatcaagttccgttcagggaagttcatgcccttcaacctgattcctgtgatccagtgtgatgactcggacctgtactttgtctcccaccttcccagggagccctctgagggcaccccagcctccagcacagactggctcctgtcctttgctgtctatgagcgacacttcctcaggacgacactaaaggcactgcccgagggcgcctgccacctcagctgcctgcagatagcatccttcctgctctccaagcagagccgcctgaccggtcccagcgggctcagcagctaccacctgaagacggccctactgcacctcctactcctccggcaggccgccgactggaaggcggggcagctggacgctcgtctgcacgagttgctgtgcttcctggagaagagcttgctccagaagaagctccaccacttcttcatcggcaaccgcaaggtgcctgaggccatgggactccctgaggccgtgctcagggccgagcccctcaacctcttccggcccttcgtcctgcagcgaagcctttaccgtaagacactggactccttctatgagatgctcaagaatgccccagcgctcattagcgagtattccctacatgtcccctcagaccagcctaccccaaaaagctgacgtcttttacagaatgtgggatcctcgagctaagatgagggcatccctcacgttcacacccctggtggcatctgccagccctgttctggggacaaggcgggctttcgtgggagccgtgctcagcctgccaggaagccaagccctacagtgcagaggaaacagaatttcaacgggaagctggtttgcttcataccattgggatctgctggtaaagctgttatttgggtttagggactgatcccttgcagtttacttctggatcaccatgaatggccaagatggtggcagaacacgctgtggaccctgagttagagacaatgcaaatgttggattgggtgtaattctttttgaatcccagatccagtctgtacttgaatatgagcagaggatctacaagaatgctgacagggaaccgtgttaagacccagcacccctattcccaggagcttctggcctgaccatctgcagccaaagcactaacagggacagatatgggaatgtccacctttgatccgcatcctgcacaatagtggtcccaccatggctgccacttttttatactatttggagaaaagaccttgtataaattcgaggcccgagtgactaacgtctctgtcacacggaaatgggtacttggtggcatagagaaacacaattagccactttttcagctacacttctcactcagctgcaccctacacttctcactcaggtgcacccccttctgctgtcctttccccaacgtactgggtcccgagcgtggtgggtatttgccacactgggtgccagctcagcagccccccacctctctttattctctccaaagctggtctttctgactatcattgtggtagggggaggacagatgctaaaggtggaagctgacctggagaaagagacacacggggtgactgtggcaaaggacagctggaaaagaaactctatcacttcttcattggcaaccacaaggcacctgaggccatggcactcccagaggctgtgcgcagagccaagcctctcaacctcttctggccctgcgtcctgcagcgaagtctctgctgtaagacagtagactccttcgatgaggtgctcaaaaatgctacccggggtggtggtgtctggcttgcagtctggcccagttcagagaaagttgcagagatcaggggccaaggatgtcatagccccaggttgtcctcagggtcccaatcctagggcagggtgtgcatggaagcaagaactatggaaacctagctccagtctgcaggctctgagcccctagttcctcactccagcggggctccctcactgcacagaacccaccccttctgtgtgggcactgctgaccacacagatgacccagacccaaagagcctggcagaagctctgtggttggagctgggctccgtctccaggtctggttcagggggatcaggaaggctcttttccacctgtggcttcactggccctttgagatttcctatctcaccgttacttcagttacccttgcagggggccagggagtcaagaatataccgtgttcctccagggtttaagccggccatgccttcccgagagcataaccaacttgacaggggtgcccagttaccccacaaactgaaggaaggagatccttcccccatccccaggagtgctctcaaccagcctcagaaagcttgagaagatggaccctttgcccaccagggttaattcctggtggggcagctcggctgtgatcagggcaaccaaacctataggaagccttccagtgtgagctggaattagactgaacatgtgcttgggcctgcctctccctagacgcagttgcggggcactccagggaatgaaccagctcaagtgtgtccctaacagcagcctggagctacccccaatccctcacagcctgaccctcctcattccatcagatgcatttgtagaatcggggcaaatttccttatttatttatggcccatgcctttccccctcttcatcctgatcccgttttgctttgaagagaccccagtaaccaaaaaacagcctccagaagccaaaaccatgcctggatctcccatagcttctcctttgcttccaggagaaagttcactgaaaaaaaaatatcttctggcttcttgtgtgtacagagacaacagaactcggtggggaaacgggaatcttttctgcaccaaagctgcttctaaagcagaaagcagtggggctcttggtgtttcatgctgccttatttatattaaaggaagaattaaatcttgca

SEQ ID NO: 23715 - DNA, 3794 bp, Homo sapiens
agtctcggtaacatcatcagtaaaatggggatgaccctcagggctgtggggagggttgacccagacgatgcacagaaggctctgagcaccgtgcctggtgcagactggaaacctggccagtgtgcgctcttcaggacagcagaggtcggttggaggtctgcattctctgccgacttgggccccaacttccccatcaggtcactgctccctcctctgaggtctggacaaaggacaaggctgtagggacctagactgtcctagacggggaggacatctatcctcagtggtctttccagcagtttgtttggagctgctcatcctgatcttttggctgactctggcagagggaaagtcagatttgaggcctgagctctaacaggcatccagagaggaaggaagggcccaccccgtgacatcagtgaaacggaagcaccctgcaggtgacatcactgttgctcagggcaacgcctccaccctaaggcggacggggaggtgaaaaatcggcctcaagtgtgagacgcatgttgaagggaagggacatagaaggtgtaacgttcacaggaaagctccaaccatggccatggggctcttccgcgtgtgtctggtggtggtgacggccatcatcaaccacccgctgctgttcccgcgggagaacgccacagtccccgagaacgaggaggagatcatccgcaagatgcaggcgcaccaggagaagctgcagctggagcagttgcgcctggaggaggaggtggctcggctggcggccgaaaaggaggcactggagcaggtggcggaggagggcaggcagcagaacgagacacgcgtggcctgggacctctggagcaccctctgcatgatcctcttcctgatgatcgaggtgtggcggcaggaccaccaggaggggccctcacctgagtgcctgggcggtgaggaggatgagctgcctgggctggggggcgcccccttgcagggcctcaccctgcccaacaaggccacgcttggccacttttatgagcgctgcatccggggggccacggccgatgcagcccgtacccgggagttcctggaaggcttcgtggatgacttgctggaagccctgaggagcctctgcaaccgggacaccgacatggaggtggaggacttcattggcgtggacagcatgtacgagaactggcaggtggacaggccactgctgtgccaccttttcgtgcccttcacaccccccgagccctaccgcttccacccagagctctggtgctccggccgctcagtgcccctggatcgccagggctacggccagatcaaggtggtccgcgccgatggggacacattgagctgcatctgcggcaagaccaagctcggggaagacatgctgtgtctcctgcacggcaggaacagcatggcgcctccctgcggcgacatggagaacctgctgtgtgccacagattccctgtacctggacacgatgcaggtcatgaagtggttccagacggccctcaccagagcctggaagggcatcgcccacaagtacgagttcgacctggcctttggccagctggacagcccggggtccctgaagatcaagttccgttcagggaagttcatgcccttcaacctgattcctgtgatccagtgtgatgactcggacctgtactttgtctcccaccttcccagggagccctctgagggcaccccagcctccagcacagactggctcctgtcctttgctgtctatgagcgacacttcctcaggacgacactaaaggcactgcccgagggcgcctgccacctcagctgcctgcagatagcatccttcctgctctccaagcagagccgcctgaccggtcccagcgggctcagcagctaccacctgaagacggccctactgcacctcctactcctccggcaggccgccgactggaaggcggggcagctggacgctcgtctgcacgagttgctgtgcttcctggagaagagcttgctccagaagaagctccaccacttcttcatcggcaaccgcaaggtgcctgaggccatgggactccctgaggccgtgctcagggccgagcccctcaacctcttccggcccttcgtcctgcagcgaagcctttaccgtaagacactggactccttctatgagatgctcaagaatgccccagcgctcattagcgagtattccctacatgtcccctcagaccagcctaccccaaaaagctgacgtcttttacagaatgtgggatcctcgagctaagatgagggcatccctcacgttcacacccctggtggcatctgccagccctgttctggggacaaggcgggctttcgtgggagccgtgctcagcctgccaggaagccaagccctacagtgcagaggaaacagaatttcaacgggaagctggtttgcttcataccattgggatctgctggtaaagctgttatttgggtttagggactgatcccttgcagtttacttctggatcaccatgaatggccaagatggtggcagaacacgctgtggaccctgagttagagacaatgcaaatgttggattgggtgtaattctttttgaatcccagatccagtctgtacttgaatatgagcagaggatctacaagaatgctgacagggaaccgtgttaagacccagcacccctattcccaggagcttctggcctgaccatctgcagccaaagcactaacagggacagatatgggaatgtccacctttgatccgcatcctgcacaatagtggtcccaccatggctgccacttttttatactatttggagaaaagaccttgtataaattcgaggcccgagtgactaacgtctctgtcacacggaaatgggtacttggtggcatagagaaacacaattagccactttttcagctacacttctcactcactgcttctaaagcagaaagcagtggggctcttggtgtttcatgctgccttatttatattaaaggaagaattaaatcttgcaaggagtagaaatggtcactgtttgtttttaacttcaggaaatctgtgaggctcccagggcagagttggggacaggggggtggatttcctattgacaaagcagaagctttcactccctttttattcttacactttcaggagactttaaaaaataacaaaacagaacatttctaccctgtctttgaggcaacttgtgtgctgcccgcagggctccagaaagggcctttgaaagctggctgtagggtggattccagcctaagaccttatttcacagagctaatgtcagcgagaaatataggagctggaactaacaggaagcttttgggttttaaagaaagagattgtattttaaatagaggattttgagtcctctagggcactttggcctttccactaaggacaaccctgccctctttccccagagtctctttcccaaggatgcttgactttccccagcaactgctcacttgctttgcaaaataacaagggtgaaatgaatagagttggcccctaggccaagaggctggttatgttggggaagggccttatatcctcaaaagctctagcccctctgcatgcctggctgaagcacagcccccgttgagaacctgggggtggagctctggttcatcatcaagggtgtcatccgaatcacccagacaacctggtccattgccccgaccccgccttgaacctacatggtgctcagaatccagtctggagtggtcaggctaggctcgatttttaaagatttcccccaagtgactgatgtacccctagctgaggaagagctcagctttctttcttaa

SEQ ID NO: 23716 - DNA, 1104 bp, Homo sapiens
aacgaaagcaaaaattgacaaatgggacatgattaaacagaattaccatttgactcagcaatcccattattggttatatacccaaaggaatctaaatcattctgtcataaagacatatatacacaaatgttcacggcagcactatacacaatcgcaaagtcagggaatcaaactaaatgtccatcagtggtagaaaggataaagaaaatgtggtggcagggagtggtggctcatgtctgtaatcccagcactttgggaggctgaggcgggtggttcacctgaggtcaggagtttgagaccagcctggccaacatggagaaactccgtctccgctaaaaatacgaaaattagccaggcgtggtggcgagcacctgtcatcccagctacttgggaggcctaggcgtgagaatcgcttgaacctggaaggtggtggttgcagtgagccgagatcctgccactgcactccagcctgggcaaccaagcgagactctgccttaaaaaaaaaaaaagaaaatgtggcacatatacaccatggaatactatgcagccataaaaaagaatgggatcatgtcctgtgcagcaacgtggatggagctggaagccattatcctaaatgaactcactcagaaacagaaaaccaaataccacatgttctcacttataagtagaagctaaacattgagtacacatggatacaaagaagggaaccgcagacactggggcctacctgaggtcggagcatggaaggagggtgaggatcaaaaaactacctatctggtactatgctttttatctggatgatgaaataatctgtacaacaaaccctggtgacatgcaatttacctatatagcaagcctacacatgtgcccctgaacctaaaaaaaaagttaaaagaaaaacgtttggattattttccctctttcgaacaaagacattggtttgcccaaggactacaaataaaccaacgggaaaaaagaaaggttccagttttgtctgaaaattctgattaagcctctgggccctacagcctggagaacctggagaatcctacacccacagaacccggctttgtccccaaagaataaaaacacctctctaaaaaa

SEQ ID NO: 23717 - DNA, 400 bp, Homo sapiens
gggagctctttcccctgtcccagggtatatatggctgacctagccaccgctgagttcaaacgctctatggctcccaatttccttgccttggccacactgaattgtcaactgattccaaaacatggccccacactcccaccccatctggagttacggggaatgcctgctctgggatcagagaccagggttcaaacctcagttctgccacttactagctatgtgaccttggacaagtgactttatctctgagcctccagttcctcatgtgtaaagcaatgcctgcccctagggttgtgccagtgttccatgagacagtgcactcatatgttagtaacaagctggcggttatcagccaataaacgctgcctcttgattaataaacgtgtatccctcaaaagcc

SEQ ID NO: 23718 - DNA, 404 bp, Homo sapiens
gaaattaaggaaaatttaatagtgcaagaggtattggtaatgtagtctatagacataaacatttcattcattttaataaatacatgactgtctcacagaaagaatgttacaaagtttgagatacacaggtaaataagagttgaatttccagtcctcatggaatttacaatctagcaggtaaataaatgggaaccacaaaacaatttttagcccgatgagtttttaatatagagaagaccacaatcctatgggaatacagagcagcaaaatttgcccttgtctcctcgaaaataaaccattaaactcattcaaaataatagtagctagtaaatattagagaagtatgccttgaagaagcaatagacataaaagctgtgagaagaaagaatgcagaacgtcttagc

SEQ ID NO: 23719 - DNA, 422 bp, Homo sapiens
ttttttttgagatggagtctcactctgtcacccaggctggagtgcagtggcatgatctcggctcactgcaagctccgcctcctgggttcacgccattctcctgcctcagcctccctagtagctgggactacaggcgcccgccaccacgccccgctaattttttgtatttttagtagagacgggtttcatcatgttagccaggatggtctcgatctcctgacttcgtgatccgcccacctcggtctcccgaaatgctgggattacaggcatgagcaaccatgcctggccagtcacagattcttaaaacaataaagataaaattaattgattcatgttatacgtagctgtaatcattttttcttaatagcaaagaaatgctactaaagagagcagagatttatataaaaatggaagatgtatac

SEQ ID NO: 23720 - DNA, 465 bp, Homo sapiens
tatacttttgattacatatttgggatgattagataagtggatgttttccaaaagcttttttctcttttattccctcatatgaggaatgaagaggcattaccattctggggtaggatggctgtctggttgaccaagtatataataggaaaaaggagagagaatagggaaaaactaacatttctggccgggtgcggtggttcacgcctgtaatcccaacactttgggaggccgaggcgggcagatcacgaggccaggagatcaagaccatcctggttaacacagtgaaaccccatctctactaaaaatacaaaaaaaaaattagctgggtgtggtgggggatgcctgtagtcccagctactcgggagggtgaggcaggagaatggcatgaactcgggaggcggagcttgcagtgagccgagattgcaacactgcactccagcctgggtgacagagtgagactccatc

SEQ ID NO: 23721 - DNA, 402 bp, Homo sapiens
ttttttttttatagagacagagtctcaattatgttgcccaggctagtctcaaactcctgggctcaaacgagcctcccactttggcactccaacatgttaggattacaggtgtgagccaccgcacccagcctctgtctgattcagtttcaagaagcagtggtcaagcaccaacttccaggccacagacaatctgtactcggattatgaggctcatcagtaatcgtgaggtgtatctgttactaaatctggctacccaggtggcagtacccaattgtgctctaataatgacaaaagaggaaaataacaatgtggtccttggagagatgggcgagcaagcacatgacatcaacatggcatcgagctccaacacaagcaaagggtgtgaggagacaaaggtccatc

SEQ ID NO: 23722 - DNA, 358 bp, Homo sapiens
ttaaaaacagttcctctgctcaatgatagatttcaggttaatcacatggaaatgttaaaatatacacaggaatcatatttgctatgtatttttcacaacctcaagtactttccttgtgcctagacatctgctctcccatattcagtactgtgttcctgggggaacagtttcttctgtagattcaggagaatctacagaagaaaccttagcaaaaacttttcaaacaaaatcccaatttgattaaagcagatttcatttcttaagaagtggttatgcatttgtaaaattaatcaactttctatagactattctaattttatgaaagaacacacctagtaatcacatgaagtaacaaaag

SEQ ID NO: 23723 - DNA, 2296 bp, Homo sapiens
gaatggaatgaaaagccttgtacaagaggcttcgtgccatgttcagcctgccccttagccttccactgtgtgaggacacagcattccttccttccaagtgctgcagctctcacaagacaatcaaacaagcccgcaccttgatcatgatcttcctagcctccggaacgcactttcagaccatgctgaagtctaaattgaatgtcttaacactgaaaaaggaacctctcccagcggtcatcttccatgagccggaggccattgagctgtgcacgaccacaccgctgatgaagacaaggactcacagtggctgcaagcactttcagaccatgctgaagtctaaattgaatgtcttaacactgaaaaaggaacctctcccagcggtcatcttccatgagccggaggccattgagctgtgcacgaccacaccgctgatgaagacaaggactcacagtggctgcaaggttacctacctgggcaaagtctccaccactggcatgcagtttttgtcaggctgcacagaaaagccagtcattgagctctggaagaagcacacgctagcccgagaggatgtctttccggccaatgccctcctggaaatccggccattccaagtttggctccatcatctcgaccacaaaggggaggccacagtgcacatggataccttccaggtggcccgcatcgcctactgcaccgccgaccacaacgtgagccccaacatcttcgcctgggtctacagggagatcaatgatgacctgtcctaccagatggactgccacgccgtggagtgcgagagcaagctcgaggccaagaaactggcccacgccatgatggaggccttcaggaagactttccacagtatgaagagcgacgggcggatccacagcaacagctcctccgaagaggtttcccaggaattggaatccgatgatggctgaatgaacttgagacgcttcagcaaaggcagcattggtcacggagttcaagggaatagatgagtaagcaacgtttcaaatttgggatgaaaagactgccaaactattggctgaccaaggtttttaaattcagaagagcaattctaaatctaaagaaatgtatcattaaagtaattacgttacattgaaacctgctgctgctgtgactgtgaggagggtgggagtgtggatggggaggaaggttctaggctctcttcttatttttctcatttcccaatgcctctctgtgggagagctccatgccagttttcaccacgctcaggcaaatactctgcagctgttattggatgggccattccgatctgccttatgaaattccacaagaatgttaggggcaccctctttccccttctaacatccttagagggatgaaatctcagcatatgttgcaggacaccaaaaggaagaaaacaatcaagcaaataaaataaacagtcaaacaaaccaggagtttaaaacaacaaccccaacaacagaagccttggcaaagaggaataagtgatcagcaagtgaacacactctatgtcaactctccttttatccagctgagatttatggtaacttatttaattaatggtcctgtctgatgcatccttgatggcaagcttcaaatctgatttggtatcaccgaggaaaccttgcccccatcactcagcattgcacttagatacagaatgagttagataaacttggcttgtctagagacccatgtcatcttaacctaaagggaaatcttattgcgttatcataaaattgatgatatcttagggtcagaattgccctttttttttattttgaatgggaagttctcactaaaacaatcctgagatttcttaatttcatggttctttaaatattataaacacagagtcaacatagaatgaaattgtatttgttaaaatacacacattggaggacaagagcagatgactacttttcgaagtaatgctgctccttcctaaaagtctgttttcaatcctggtaatattaggggcactgcggcacctaagaagccttaaatgagagctaatccaatctagagagcgatggtgtcagcatttcggtctgcatatctgtgtgtccgtatctgcgtttgtgtgcgtgtacgtgtgcccctgtgtgtgggcccagttttcaggcatgtagaataagcatggagtcatattgaggaggactcacttcttgaagatatgcttgttgctttacaacatatgtaagctattctttagcataaatgcattcattctttaataaaaatatgtttgcattaataaagctgaggagtttcatactttgtgtct

SEQ ID NO: 23724 - DNA, 582 bp, Homo sapiens
cctttctattacctgaagcttctgcttatggagttttgaagttctccaggatggtttttctatttctctgagcactgaagtggctaatgccatggcagatgtcatacctaatgctgcagaagcagagcataagcactttcagaccatgctgaagtctaaattgaatgtcttaacactgaaaaaggaacctctcccagcggtcatcttccatgagccggaggccattgagctgtgcacgaccacaccgctgatgaagacaaggactcacagtggctgcaaggtacatggtttcactgtgttgcccaggatggtctcaaactcatggcctcaagcaatactcagacttcagcctctgaaagtgctgggattataggcgtgaaccactgtgactggcctgtattttacttttaaattgccaagggtgatcaagtttatatcctgttaaacacctttaagccttttatgctatgtctattagcttgatttaaaaacttgaaatttcataaatggtattttaattatgatgatcataatgcgtcacttgctatagaaccaaataatatactatgtttacatttcatt

SEQ ID NO: 23725 - DNA, 2603 bp, Homo sapiens
cgccgcgcgctcgccgggcccgggcggagctgcgcagtcctctcgcagctgcgccaggacagccggcgcgcggccgtgcccacaagttgccggcagctgagcgccgcgcctcctcctgctcgcagccccctacgcccacccggcggcggtggccagcgccaggacgcacatcccgcggacaccgaccccagatgtaaagcgggaccccagcccctcgccccccggcgcgatcgacagtctcgccagcgtctcctctgccaaaacccagggctggaagatgtggcagccggccacggagcgcctgcagcactttcagaccatgctgaagtctaaattgaatgtcttaacactgaaaaaggaacctctcccagcggtcatcttccatgagccggaggccattgagctgtgcacgaccacaccgctgatgaagacaaggactcacagtggctgcaaggttacctacctgggcaaagtctccaccactggcatgcagtttttgtcaggctgcacagaaaagccagtcattgagctctggaagaagcacacgctagcccgagaggatgtctttccggccaatgccctcctggaaatccggccattccaagtttggctccatcatctcgaccacaaaggggaggccacagtgcacatggataccttccaggtggcccgcatcgcctactgcaccgccgaccacaacgtgagccccaacatcttcgcctgggtctacagggagatcaatgatgacctgtcctaccagatggactgccacgccgtggagtgcgagagcaagctcgaggccaagaaactggcccacgccatgatggaggccttcaggaagactttccacagtatgaagagcgacgggcggatccacagcaacagctcctccgaagaggtttcccaggaattggaatccgatgatggctgaatgaacttgagacgcttcagcaaaggcagcattggtcacggagttcaagggaatagatgagtaagcaacgtttcaaatttgggatgaaaagactgccaaactattggctgaccaaggtttttaaattcagaagagcaattctaaatctaaagaaatgtatcattaaagtaattacgttacattgaaacctgctgctgctgtgactgtgaggagggtgggagtgtggatggggaggaaggttctaggctctcttcttatttttctcatttcccaatgcctctctgtgggagagctccatgccagttttcaccacgctcaggcaaatactctgcagctgttattggatgggccattccgatctgccttatgaaattccacaagaatgttaggggcacctatgggatctctagtggggtgggcagggtgctgatggggacgctggccgcagggaggaaggaacatctcgggagggccctctgttcctctcccacggcagatgccctcctctgtatgcaaatcagcacagcctttattgagctttacaactaacaacctgatagttggcagttaattcacagttacagataatgcttttatttacataaatataccaagtagtaccctcttattgtattcacttcatctattttcttagaatacttgcaattactaatgaccccttccctttccctcctgctgccctgtccaccctctttccccttctaacatccttagagggatgaaatctcagcatatgttgcaggacaccaaaaggaagaaaacaatcaagcaaataaaataaacagtcaaacaaaccaggagtttaaaacaacaaccccaacaacagaagccttggcaaagaggaataagtgatcagcaagtgaacacactctatgtcaactctccttttatccagctgagatttatggtaacttatttaattaatggtcctgtctgatgcatccttgatggcaagcttcaaatctgatttggtatcaccgaggaaaccttgcccccatcactcagcattgcacttagatacagaatgagttagataaacttggcttgtctagagacccatgtcatcttaacctaaagggaaatcttattgcgttatcataaaattgatgatatcttagggtcagaattgccctttttttttattttgaatgggaagttctcactaaaacaatcctgagatttcttaatttcatggttctttaaatattataaacacagagtcaacatagaatgaaattgtatttgttaaaatacacacattggaggacaagagcagatgactacttttcgaagtaatgctgctccttcctaaaagtctgttttcaatcctggtaatattaggggcactgcggcacctaagaagccttaaatgagagctaatccaatctagagagcgatggtgtcagcatttcggtctgcatatctgtgtgtccgtatctgcgtttgtgtgcgtgtacgtgtgcccctgtgtgtgggcccagttttcaggcatgtagaataagcatggagtcatattgaggaggactcacttcttgaagatatgcttgttgctttacaacatatgtaagctattctttagcataaatgcattcattctttaataaaaatatgtttgcattaataaagctgaggagtttcatactttgtgtct

SEQ ID NO: 23726 - DNA, 2463 bp, Homo sapiens
gaatggaatgaaaagccttgtacaagaggcttcgtgccatgttcagcctgccccttagccttccactgtgtgaggacacagcattccttccttccaagtgctgcagctctcacaagacaatcaaacaagcccgcaccttgatcatgatcttcctagcctccggaacgcactttcagaccatgctgaagtctaaattgaatgtcttaacactgaaaaaggaacctctcccagcggtcatcttccatgagccggaggccattgagctgtgcacgaccacaccgctgatgaagacaaggactcacagtggctgcaaggttacctacctgggcaaagtctccaccactggcatgcagtttttgtcaggctgcacagaaaagccagtcattgagctctggaagaagcacacgctagcccgagaggatgtctttccggccaatgccctcctggaaatccggccattccaagtttggctccatcatctcgaccacaaaggggaggccacagtgcacatggataccttccaggtggcccgcatcgcctactgcaccgccgaccacaacgtgagccccaacatcttcgcctgggtctacagggagatcaatgatgacctgtcctaccagatggactgccacgccgtggagtgcgagagcaagctcgaggccaagaaactggcccacgccatgatggaggccttcaggaagactttccacagtatgaagagcgacgggcggatccacagcaacagctcctccgaagaggtttcccaggaattggaatccgatgatggctgaatgaacttgagacgcttcagcaaaggcagcattggtcacggagttcaagggaatagatgagtaagcaacgtttcaaatttgggatgaaaagactgccaaactattggctgaccaaggtttttaaattcagaagagcaattctaaatctaaagaaatgtatcattaaagtaattacgttacattgaaacctgctgctgctgtgactgtgaggagggtgggagtgtggatggggaggaaggttctaggctctcttcttatttttctcatttcccaatgcctctctgtgggagagctccatgccagttttcaccacgctcaggcaaatactctgcagctgttattggatgggccattccgatctgccttatgaaattccacaagaatgttaggggcacctatgggatctctagtggggtgggcagggtgctgatggggacgctggccgcagggaggaaggaacatctcgggagggccctctgttcctctcccacggcagatgccctcctctgtatgcaaatcagcacagcctttattgagctttacaactaacaacctgatagttggcagttaattcacagttacagataatgcttttatttacataaatataccaagtagtaccctcttattgtattcacttcatctattttcttagaatacttgcaattactaatgaccccttccctttccctcctgctgccctgtccaccctctttccccttctaacatccttagagggatgaaatctcagcatatgttgcaggacaccaaaaggaagaaaacaatcaagcaaataaaataaacagtcaaacaaaccaggagtttaaaacaacaaccccaacaacagaagccttggcaaagaggaataagtgatcagcaagtgaacacactctatgtcaactctccttttatccagctgagatttatggtaacttatttaattaatggtcctgtctgatgcatccttgatggcaagcttcaaatctgatttggtatcaccgaggaaaccttgcccccatcactcagcattgcacttagatacagaatgagttagataaacttggcttgtctagagacccatgtcatcttaacctaaagggaaatcttattgcgttatcataaaattgatgatatcttagggtcagaattgccctttttttttattttgaatgggaagttctcactaaaacaatcctgagatttcttaatttcatggttctttaaatattataaacacagagtcaacatagaatgaaattgtatttgttaaaatacacacattggaggacaagagcagatgactacttttcgaagtaatgctgctccttcctaaaagtctgttttcaatcctggtaatattaggggcactgcggcacctaagaagccttaaatgagagctaatccaatctagagagcgatggtgtcagcatttcggtctgcatatctgtgtgtccgtatctgcgtttgtgtgcgtgtacgtgtgcccctgtgtgtgggcccagttttcaggcatgtagaataagcatggagtcatattgaggaggactcacttcttgaagatatgcttgttgctttacaacatatgtaagctattctttagcataaatgcattcattctttaataaaaatatgtttgcattaataaagctgaggagtttcatactttgtgtct

SEQ ID NO: 23727 - DNA, 1115 bp, Homo sapiens
cgccgcgcgctcgccgggcccgggcggagctgcgcagtcctctcgcagctgcgccaggacagccggcgcgcggccgtgcccacaagttgccggcagctgagcgccgcgcctcctcctgctcgcagccccctacgcccacccggcggcggtggccagcgccaggacgcacatcccgcggacaccgaccccagatgtaaagcgggaccccagcccctcgccccccggcgcgatcgacagtctcgccagcgtctcctctgccaaaacccagggctggaagatgtggcagccggccacggagcgcctgcagcactttcagaccatgctgaagtctaaattgaatgtcttaacactgaaaaaggaacctctcccagcggtcatcttccatgagccggaggccattgagctgtgcacgaccacaccgctgatgaagacaaggactcacagtggctgcaaggttacctacctgggcaaagtctccaccactggcatgcagtttttgtcaggctgcacagaaaagccagtcattgagctctggaagaagcacacgctagcccgagaggatgtctttccggccaatgccctcctggaaatccggccattccaagtttggctccatcatctcgaccacaaaggggaggccacagtgcacatggataccttccaggtggcccgcatcgcctactgcaccgccgaccacaacgtgagccccaacatcttcgcctgggtctacagggagatcaatgatgacctgtcctaccagatggactgccacgccgtggagtgcgagagcaagctcgaggccaagaaactggcccacgccatgatggaggccttcaggaagactttccacagtatgaagagcgacgggcggatccacagcaacagctcctccgaagaggtttcccaggaattggaatccgatgatggctgaatgaacttgagacgcttcagcaaaggcagcattggtcacggagttcaagggaatagatgagtaagcaacgtttcaaatttgggatgaaaagactgccaaactattggctgaccaaggtttttaaattcagaagagcaattctaaatctaaagaaatgtatcattaaagtaattacgttacattg

SEQ ID NO: 23728 - DNA, 408 bp, Homo sapiens
tcatctgttctccttctacagtgtctagacttttcccaaaataacccctataacatcctcttccaaacatcttatgtagctgaatctgcatggattccattgccacaatttcatctgtatacagtacgttggaagagcttctcagaacataatgtcctgggtgaggtgactttaccactaagtcatgtttctgtggactctgcttaggaattgactgtctccacagtttcatctgagtgacgtcctgacaggacacagttccccctcctctgttttactaaatatctcttggcctcccctaatagaacagagtcaataaaacaagttgctactgggtttaatgtacaattgcaggacataaaagtccaagtgattaaactacatgtggcttatttttctgcttttcag

SEQ ID NO: 23729 - DNA, 422 bp, Homo sapiens
ccacaacgtgagccccaacatcttcgcctgggtctacagggagatcaatgatgacctgtcctaccagatggactgccacgccgtggagtgcgagagcaagctcgaggccaagaaactggcccacgccatgatggaggccttcaggaagactttccacagtatgaagagcgacgggcggatccacagcaacagctcctccgaagaggtttcccaggaattggaatccgatgatggctgaatgaacttgagacgcttcagcaaaggcagcattggtcacggagttcaagggaatagatgagtaagcaacgtttcaaatttgggatgaaaagactgccaaactattggctgaccaaggtttttaaattcagaagagcaattctaaatctaaagaaatgtatcattaaagtaattacgttacattg

SEQ ID NO: 23730 - DNA, 309 bp, Homo sapiens
cccagaagagcctgggttttgtgttattgacaattggaagcatcataatttatatttgtgatctccctattataagcctcttaaaattttttaataaaagaaaaagcaaaacattttttccaggtattaaatttatataataatttcttagcccttgaggttaattgtacccaaatactatagctgctatataagggaatggtgtttgtcaaatgggaagcatcaacaaaatttatgtttcagtgtctatacctataattcatgccactcattcacttgttgcactctcaactaaacaaaacctattca

SEQ ID NO: 23731 - DNA, 1793 bp, Homo sapiens
aacaccctcctggaggatgctggtgagaggcagggaccaggggtccggctcccggctcgggcctatcgttaggcgctgggcccccaggccctctcctttgcagagtctcgctgcctccctcgacgcagagccttcaagcgccgcagtccccgacggcttccccgcgggccccactgtctccccaagacgcctggcgaggccgccggggctggaggaggcgctgagcgcgctggggctgcagggagaacgcgagtacgccggggacatcttcgccgaagtcatggagtacctgggtctggctggtgacacactttatctggcggttcacctgcttgattcctacctgagcgctggccgcgtgcgtctacatcgcctgcagctgctgggcgtggcttgcctgtttgtggcgtgcaaaatggaagagtgcgtgcttcccgaggaaactgaggtccggaacttggggcctttccagggcagggagtaaagagcccggatccaagactccttcacctccccccgcatcccccatctgcagcccgccttcctctgcctcctgagcgcggactccttctcacgggcggagctgctgcgcgccgagcgtcgcatcctgagccgcctggatttccggctgcaccaccccggcccgctgctgtgcctcgggctgctggccgcgctggcagggagcagcccccaggtgatgttacttgccacctacttcctggagctgtctttgctggaggccgaggcggcgggatgggagccgggtcgtcgtgcggctgcggctctgagcctggcgcaccgcttgctcgacggggcgggctccaggctccagccagaactttacaggtgtagtcttggcggaggaagtgtatggggtcaccgcagcttcagggacttaccttcctggtcatttttacggtctcggagaatgagagacaattattgaggaggaggtggcacctagacttgatttttctgggtgtgggagagaatggggtgggaggacccccattagtccagatctggggtctcttaaccttgccccagagtggaagatagtctcccaggcccagaagatgctcctattgccttccagggctgagaacgaaggatcacccaggcctcgagtcctccatctctgtatctggtggtggatggggtgttcctttagctgctagggccgctaaccatgctaccaggtggcagggcgaaccatggtttccctcagcctgtgcacccagcatagagaggatggctgcccatcctcagctcccctccttgcttcctcgagtgttctgactccgcactagccgcgccctgtaggaagaatagggtgtccacctctccccggtgctcgcctagtcactccagttgaagacgggacgcgtgcccgatctcaagagagcccccgacccgtccgtggggaaccacatcgacgcttcttctcagcctccagtctccagttccaaggatgggtcatctccaaccccttgccctgcctcagtttctccatctccctgctgcagccccgaggaactgggcaccctcgagccgtgcatggcccgcgctgcgctccgaggtcccgcgccgggtcgcgccgcagtcttcctcaagtatgcgcggccccagcgccaggggaccagccttgccgccgcctgcctgctccgccgcctccagtctgagcctccctgagtactgggactcagtcacaaaaaaatcaacaacaaaaaacaaaaccctcccagtgtgtgtccgtctctcatctcaataaaagaatttattttattctgaac

SEQ ID NO: 23732 - DNA, 1516 bp, Homo sapiens
tttttaaaataaattcttttattgagatgagagacggacacacactgggagggttttgttttttgttgttgatttttttgtgactgagtcccagtactcatggagtacctgggtctggctggtgacacactttatctggcggttcacctgcttgattcctacctgagcgctggccgcgtgcgtctacatcgcctgcagctgctgggcgtggcttgcctgtttgtggcgtgcaaaatggaagagtgcgtgcttcccgagcccgccttcctctgcctcctgagcgcggactccttctcacgggcggagctgctgcgcgccgagcgtcgcatcctgagccgcctggatttccggctgcaccaccccggcccgctgctgtgcctcgggctgctggccgcgctggcagggagcagcccccaggtgatgttacttgccacctacttcctggagctgtctttgctggaggccgaggcggcgggatgggagccgggtcgtcgtgcggctgcggctctgagcctggcgcaccgcttgctcgacggggcgggctccaggctccagccagaactttacaggtgtagtcttggcggaggaagtgtatggggtcaccgcagcttcagggacttaccttcctggtcatttttacggtctcggagaatgagagacaattattgaggaggaggtggcacctagacttgatttttctgggtgtgggagagaatggggtgggaggacccccattagtccagatctggggtctcttaaccttgccccagagtggaagatagtctcccaggcccagaagatgctcctattgccttccagggctgagaacgaaggatcacccaggcctcgagtcctccatctctgtatctggtggtggatggggtgttcctttagctgctagggccgctaaccatgctaccaggtggcagggcgaaccatggtttccctcagcctgtgcacccagcatagagaggatggctgcccatcctcagctcccctccttgcttcctcgagtgttctgactccgcactagccgcgccctgtaggaagaatagggtgtccacctctccccggtgctcgcctagtcactccagttgaagacgggacgcgtgcccgatctcaagagagcccccgacccgtccgtggggaaccacatcgacgcttcttctcagcctccagtctccagttccaaggatgggtcatctccaaccccttgccctgcctcagtttctccatctccctgctgcagccccgaggaactgggcaccctcgagccgtgcatggcccgcgctgcgctccgaggtcccgcgccgggtcgcgccgcagtcttcctcaagtatgcgcggccccagcgccaggggaccagccttgccgccgcctgcctgctccgccgcctccagtctgagcctccctgagtactgggactcagtcacaaaaaaatcaacaacaaaaaacaaaaccctcccagtgtgtgtccgtctctcatctcaataaaagaatttattttattctgaac

SEQ ID NO: 23733 - DNA, 1579 bp, Homo sapiens
gcatccagggctggagctcaggagaaaggcagaggcacaggtgtggagagtgaagcgtccctgccccaaccccaggtgtgccgcgtgctgcccctgagagccctgccccgcgctgtgaccccggagatgcgcgccctggtggtagactggctggtccaggtgcacgagtacctgggtctggctggtgacacactttatctggcggttcacctgcttgattcctacctgagcgctggccgcgtgcgtctacatcgcctgcagctgctgggcgtggcttgcctgtttgtggcgtgcaaaatggaagagtgcgtgcttcccgagcccgccttcctctgcctcctgagcgcggactccttctcacgggcggagctgctgcgcgccgagcgtcgcatcctgagccgcctggatttccggctgcaccaccccggcccgctgctgtgcctcgggctgctggccgcgctggcagggagcagcccccaggtgatgttacttgccacctacttcctggagctgtctttgctggaggccgaggcggcgggatgggagccgggtcgtcgtgcggctgcggctctgagcctggcgcaccgcttgctcgacggggcgggctccaggctccagccagaactttacaggtgtagtcttggcggaggaagtgtatggggtcaccgcagcttcagggacttaccttcctggtcatttttacggtctcggagaatgagagacaattattgaggaggaggtggcacctagacttgatttttctgggtgtgggagagaatggggtgggaggacccccattagtccagatctggggtctcttaaccttgccccagagtggaagatagtctcccaggcccagaagatgctcctattgccttccagggctgagaacgaaggatcacccaggcctcgagtcctccatctctgtatctggtggtggatggggtgttcctttagctgctagggccgctaaccatgctaccaggtggcagggcgaaccatggtttccctcagcctgtgcacccagcatagagaggatggctgcccatcctcagctcccctccttgcttcctcgagtgttctgactccgcactagccgcgccctgtaggaagaatagggtgtccacctctccccggtgctcgcctagtcactccagttgaagacgggacgcgtgcccgatctcaagagagcccccgacccgtccgtggggaaccacatcgacgcttcttctcagcctccagtctccagttccaaggatgggtcatctccaaccccttgccctgcctcagtttctccatctccctgctgcagccccgaggaactgggcaccctcgagccgtgcatggcccgcgctgcgctccgaggtcccgcgccgggtcgcgccgcagtcttcctcaagtatgcgcggccccagcgccaggggaccagccttgccgccgcctgcctgctccgccgcctccagtctgagcctccctgagtactgggactcagtcacaaaaaaatcaacaacaaaaaacaaaaccctcccagtgtgtgtccgtctctcatctcaataaaagaatttattttattctgaac

SEQ ID NO: 23734 - DNA, 836 bp, Homo sapiens
tttttaaaataaattcttttattgagatgagagacggacacacactgggagggttttgttttttgttgttgatttttttgtgactgagtcccagtactcatggagtacctgggtctggctggtgacacactttatctggcggttcacctgcttgattcctacctgagcgctggccgcgtgcgtctacatcgcctgcagctgctgggcgtggcttgcctgtttgtggcgtgcaaaatggaagagtgcgtgcttcccgagcccgccttcctctgcctcctgagcgcggactccttctcacgggcggagctgctgcgcgccgagcgtcgcatcctgagccgcctggatttccggctgcaccaccccggcccgctgctgtgcctcgggctgctggccgcgctggcagggagcagcccccaggtgatgttacttgccacctacttcctggagctgtctttgctggaggccgaggcggcgggatgggagccgggtcgtcgtgcggctgcggctctgagcctggcgcaccgcttgctcgacggggcgggctccaggctccagccagaactttacagccccgaggaactgggcaccctcgagccgtgcatggcccgcgctgcgctccgaggtcccgcgccgggtcgcgccgcagtcttcctcaagtatgcgcggccccagcgccaggggaccagccttgccgccgcctgcctgctccgccgcctccagtctgagcctccctgagtactgggactcagtcacaaaaaaatcaacaacaaaaaacaaaaccctcccagtgtgtgtccgtctctcatctcaataaaagaatttattttattctgaac

SEQ ID NO: 23735 - DNA, 398 bp, Homo sapiens
agactcagataacaaggggtagctgcatttactctgtgacagatattggcagaaatcctggaaataggtgaatgatgaagacaaaattgctgctccacagaacagttaggaaaaaaatggcaaataaatatttaaaatatggtgagataagttttctaatggagacatgtaaaaggagctctaagaacacagcaagggatgggcctaacccttccttctatacagaggagaccttctcaggatcccggtgatagctcatagcaactgactggctgtctgcgccaggcactgttgcaagcatattacacatatttattcatttactcttacaacaaccccatgagacaggtacttttattatcattctcattttaaagataagaaaactgaggagtata

SEQ ID NO: 23736 - DNA, 567 bp, Homo sapiens
ccactgcacccggcctagtacacagtttttaactttgataaacattgccaaattcctctccaggaaggctgtattaatttgtattccctctgagaaagtataagactaaattaccccctctcttgcctaattggctatcatcattttttgtattttctgggagtaagttcttagaaagttttgtaagggacacttacattaaaccaggacatctccctggtaacaataaaagcatggagaaaggaccagggaaggagaaaacaggtataaagttcccagagaccccactaggttttctacctgtgcgatcctagattaaaaccacttgttttgatttcaggaaattagggacaaaataaaaatctcagcctgaactggaccttgtagaaattatccctgcttgagcaataagcactctaaattcagtctgtttagaaagattcctgcccgttagccaggtgtggtagcacaggcctcaagtccaagctgctcaggaggctgaggaaggaggatgccttgagcccaggagtttggggcttcaggcaacaacagcaagagcccatctct

SEQ ID NO: 23737 - DNA, 401 bp, Homo sapiens
tttttttgagacggagtctcactctgtcccccaggctggagtgcactggcgtgatcttggctcactgcaagctccccctccctggtttacgccattctcctgcctcagtctcctgagtagctgggactacaggtgcccaccaccacgcccggctaattttttatatttttagtacagatggggtttcaccatgttagacaggatggtctcgatctcctcccctcgtgatccgcccgcctcagccttccaaagtgctgggattacagacatgagccatcgcgctaaatacttttataatattagagtagagaaggattttctaagcaagacataaaacatcaaaatcacaaaagattgatatagttaactaaatgaagatttctaaatatcggtatgatttt

SEQ ID NO: 23738 - DNA, 320 bp, Homo sapiens
tattttttttagtagagacggggtttcaccatgttagccaggatggtctcgatctcctgacctcgtgatccgcccacctcggcctcccaaagtgctgggattacaggcgtgagccaccatgcccagcctgtgaattcttatgatgccacttttttggagagttttgatagactttattgtaccctcaagatgggtatcatggggagaggagcatagattatggcttagctcctgccactacctctttcctcttctcctccctcttccattctatatgcaattttttaaagcacaagctctttgccagagccatgtcgaac

SEQ ID NO: 23739 - DNA, 263 bp, Homo sapiens
tctggggacattgggaggaacagaggtagcttagtgactctactgtccctaccacccaacctgctattagccctgctggtccgctcgtgtttgaggtcatgagtcagtctacttaataaaatcatcagctggagcttacaaagcaatagtgcttaatagatacaagcatgctaatatattttttaagtgaatgctgatctttctgagctgtgtgtctaaaatcatcattgtgaataaaagaattgtaatttccaacccataca

SEQ ID NO: 23740 - DNA, 457 bp, Homo sapiens
ccccaccatgcttcagctcaccctccttgggctgtacccactgtccaaccagccctgatgagatagatgtaccaggttcctcagttggaaatgaagaaatcacctgccttctgcatcgatctccctgggagctgccgaccagagctgttcctattcagtcatcttgccagcaaccccagtatcttatttttgatgtttagattgttattttcaaaaatattttatacttagttttgataaacatcgttatagttaaatatttgtgatttttcaaggtgattttcttaggcgaaatctcagaagtaaaatttctgtgtttaaaaaagaatgggcacttttaagcttttgattcatattttaaaattacctctcaggaagagttactaatttacattcccactggtagtatatgagaatacttatttttccatgcacttatctatactgaatattattt

SEQ ID NO: 23741 - DNA, 307 bp, Homo sapiens
accaaaaaaaaaaaaaaaaaaaaaaaacacctcaaactaagcagaaggcagtaatggaaggattgagaaacaaaaaaaaagaaacatttctaaaaataataaaatggtagtagtcttttcttatcagtaataattttaaatgtaaattgcttaaattatccaattaaatagcagagattggcagaatggataccaatagcaacaaaaccccaacaaaacaaagcttatggttcatctatatgctatctagaagagactccttcagatccaaagacacacataggctgaaagtgaaagaacagaaaaa

SEQ ID NO: 23742 - DNA, 635 bp, Homo sapiens
gataacctggagatccagtgtcccgcggagccccggagggggagctgggcagggatgagagcagagagcagtcagagccccccagacaccccaccacgaggatgccccctggaagctccgcaaactgtacccacatttccagggctttcattatgtccacagcccagtgcctggcatgaggggaagcccaaggatggcagggagctccactcctgggtgatcgaggactgctgccagctagaaaatgaggcgcacagcctccctagggacaagccagctgaagccaggcagccttcctcctgtgtgtattttggcacagggacgcctggtgctcgtgcctcttcctgtaactcctacctgcagccaactccattttatctcaaacttactgggcatcctagcctaacgggttctgcctgagtggggcagaggtgatggggtgggaacacccagaagcagtctaaggcatagctgtgcccaccaaggagctcatgagggactacgtgggggacagaaaagacccctggcgaacttccaccaggctctttatctcctgagtgtcaacacctacatcaccaagaccaggtgtccaccttaccagtatggagaaggcactcataatgggcaaagctggg

SEQ ID NO: 23743 - DNA, 139 bp, Homo sapiens
caccttccctccaccacccctgctcccaaacacacattcactctgctctctccctgcattgcttttacagcctgcaggtgtttggtggaagataaaagtggttcctggggtgagatttcacctcctagaattatcaaag

SEQ ID NO: 23744 - DNA, 171 bp, Homo sapiens
ctatgctatgatagggttgtacttataactccctataaaaaatgtattctattcttgttgaaacgaaaaagataatctgaatttgttctttggtaccaagtcttcatactcctaagttgttattgaaaactaaaaatcagccaggcacggtggctcacgcctgtaatccca

SEQ ID NO: 23745 - DNA, 414 bp, Homo sapiens
taatgtcagatgactagtaaatcaatttgttagaatacattgttttctgtccatatcttctgcgagtcactcgcccagcagccaggcttctcaagaacggaaggactgctgacgttcacaggtggctaccgggtgggacgctgtgcctgggttatctgatttcttccttcctgccacctcgggaggtagggagagccttctggcaggccaggggcagggacgggttctgagccaaggccttcctgctttcagggcccaccctcttcgtgccatgctgacttacacagttacgttttaatctaatcgctaattttaataaaccttctaaattacctctgcacagattaaaaatacctatgccggtgaagttttgattagagtgattagatattgagggcacagttctaagcactt

SEQ ID NO: 23746 - DNA, 2705 bp, Homo sapiens
aaatgctcggtgctttaaatttgcaattaccatatttgcagaaacttgaaaaatcatcccaattaaatgacaaaatgtataggaggattatctttcttttgcccttacaactcaaattatattcgaagtaacatttttacagcagtcaaaacttttaaccaaaactcacacctgcagtctcataagtttaacaaaatggccacattccacgctttattttcttaacaaccctgactgtttaaatgactcccattgaaccaacagcttacagttgctgggcaataaaaaagcgagcaaaaggacctccagccctgctgttttagctattacccagcactctcagagtttgctctagtctggctgttcaatcaaattcattttccagtagcttctggcctttgtctcctctttctggccacgcatttcattgcctcctgaatttgatgacaacattttctttcttcactttgaatcttggcccagaatctcactctcccagccccatggaaagatggggaaaagatttcattctgctgatcaaatttgttagaagacattctttagagtctgaaaaaatatatttcattagcagttctctaggtagtggaatttttagtgatgtttactcttttttccttgttctaattttcctctaataaacagaaaaaaagcaagagtaacccaccaaatttggataaagggcttctgcttttcatattctcttcaaccagaacagcttaacttttctccatttatttatttaagtatttattcatatttgaaacaggctggggtgcagtggcatgatctcagctcactgcaacctccacctctcgggtacaagtgattctcctgccttggcctcccaaagtgctgggattataggcgtgagccaccgcacctggccttaatttgatttttattatccacaacactcatatctctttttgatcctactgtaatatcacattatcctacctaaagatgaattgttccaaccctgatgctttggtaatcatcttttctaaattaaaaattgaggccaggtgcagtggctcaggcctgtaatcccaacactttgggaggacgaggcaggtggatcgcttgagatcaggagtgagagaccagcttggccaacatggtgaaaccccatctctactaaaaatgcagaaaaattagctgggcatggtggtgcatgcctgtaatcctagctacttgggaagctgaggcacgagaatctcttgaacccgggaaggagagattgcagtgagccaagatcatgccactgcactccagcctgggtgacagaacgagaccctgtctcaaaaaaagaaaaaaaaaaaagagagagagagatttgtaatctagcaaaatatgttatttacttattttctttccaacttttagtgtgggcccaagcgggtacctgtgcaggtttgtttcacgagtaaattgtgtgtcatgggggtttgttttacagatgattttgttactgagataatcagcataatatgtgatatgtagttttttaatccttaccctcctcttatctccaccctcaggtaggccccagtgtctgttgttcccttctttgtgtccatgtgtactcaatgtttagctcccacttataagtgagaatatgcagtatttggttttctgttcctgcattaatttatttagagatcttttatttaaatacatgaattcattttcaggaaaagccttccagagatataaaagtcaaaatccaataaaagaatgacctttgttatggaaaaacaaagaaagaaagaaatcaggtcttttttggaaaatctgggacattgaattgttacacgtaacatgtgtccccctagggacataggtcactttcagtatttgccaaagcattaggtcagccagacatgtgaaacatctcggagcttaataactgagctgcttcaatgtgttttgataaaagtttaaattctctggccccaatttattgaacacatgcctttgacaatacagcatttctttcttaggctattagtgaaagattaaccatctactcagtgattgttattgtgcctgtatgtgtgcagtatgaacagttatgtaacaaaacttcaaagattagagacctttaaaaggatctggggaaataggaagagtctataatcttataggaaaggaatgaattatgcaagcaactaaaagtgtgtcaatattctctgcttcacaaacaaattggaaaccagtggtaaactttagatcagaaacagaaactcaaaaaatgaaagaactggccatgagcagtggctcaggcctgtaatcccagcactttgggaggtcgaggcaggcggatcacctgaggtcgggagtttgagaccagcctgaccaacatggagaaaccctatctttactaaaaatacaaaaaattagacaggcatgatggcagatgcctgtaatcccagctacttgggaggctgaggcaggagaatcacatgaacccaggaggtggaggttgtggtgagcctatgttgcgccattgcacttcagcctgggcaacaagagcaaaactctgtctcaaaaaaagaaaaaagaaaaagaaaagaagaaaaagaaagaacctagaaacttagaggtcaactaaggagacaggcatttttataaaaagagttgaaagaaatttgtggtagaataacagaaaatacagacaagtt

SEQ ID NO: 23747 - DNA, 2486 bp, Homo sapiens
aaatgctcggtgctttaaatttgcaattaccatatttgcagaaacttgaaaaatcatcccaattaaatgacaaaatgtataggaggattatctttcttttgcccttacaactcaaattatattcgaagtaacatttttacagcagtcaaaacttttaaccaaaactcacacctgcagtctcataagtttaacaaaatggccacattccacgctttattttcttaacaaccctgactgtttaaatgactcccattgaaccaacagcttacagttgctgggcaataaaaaagcgagcaaaaggacctccagccctgctgttttagctattacccagcactctcagagtttgctctagtctggctgttcaatcaaattcattttccagtagcttctggcctttgtctcctctttctggccacgcatttcattgcctcctgaatttgatgacaacattttctttcttcactttgaatcttggcccagaatctcactctcccagccccatggaaagatggggaaaagatttcattctgctgatcaaatttgttagaagacattctttagagtctgaaaaaatatatttcattagcagttctctaggtagtggaatttttagtgatgtttactcttttttccttgttctaattttcctctaataaacagaaaaaaagcaagagtaacccaccaaatttggataaagggcttctgcttttcatattctcttcaaccagaacagcttaacttttctccatttatttatttaagtatttattcatatttgaaacaggctggggtgcagtggcatgatctcagctcactgcaacctccacctctcgggtacaagtgattctcctgccttggcctcccaaagtgctgggattataggcgtgagccaccgcacctggccttaatttgatttttattatccacaacactcatatctctttttgatcctactgtaatatcacattatcctacctaaagatgaattgttccaaccctgatgctttggtaatcatcttttctaaattaaaaattgaggccaggtgcagtggctcaggcctgtaatcccaacactttgggaggacgaggcaggtggatcgcttgagatcaggagtgagagaccagcttggccaacatggtgaaaccccatctctactaaaaatgcagaaaaattagctgggcatggtggtgcatgcctgtaatcctagctacttgggaagctgaggcacgagaatctcttgaacccgggaaggagagattgcagtgagccaagatcatgccactgcactccagcctgggtgacagaacgagaccctgtctcaaaaaaagaaaaaaaaaaaagagagagagagatttgtaatctagcaaaatatgttatttacttattttctttccaacttttagtgtgggcccaagcgggtacctgtgcaggtttgtttcacgagtaaattgtgtgtcatgggggtttgttttacagatgattttgttactgagataatcagcataatatgtgatatgtagttttttaatccttaccctcctcttatctccaccctcaggtaggccccagtgtctgttgttcccttctttgtgtccatgtgtactcaatgtttagctcccacttataagtgagaatatgcagtatttggttttctgttcctgcattaatttatttagagaatgacctttgttatggaaaaacaaagaaagaaagaaatcaggtcttttttggaaaatctgggacattgaattgttacacgtaacatgtgtccccctagggacataggtcactttcagtatttgccaaagcattaggtcagccagacatgtgaaacatctcggagcttaataactgagctgcttcaatgtgttttgataaaagtttaaattctctggccccaatttattgaacacatgcctttgacaatacagcatttctttcttaggctattagtgaaagattaaccatctactcagtgattgttattgtgcctgtatgtgtgcagtatgaacagttatgtaacaaaacttcaaagattagagacctttaaaaggatctggggaaataggaagagtctataatcttataggaaaggaatgaattatgcaagcaactaaaagtgtgtcaatattctctgcttcacaaacaaattggaaaccagtggtaaactttagatcagaaacagaaactcaaaaaatgaaagaactggccatgagcagtggctcaggcctgtaatcccagcactttgggaggtcgaggcaggcggatcacctgaggtcgggagtttgagaccagcctgaccaacatggagaaaccctatctttactaaaaatacaaaaaattagacaggcatgatggcagatgcctgtaatcccagctacttgggaggctgaggcaggagaatcacatgaacccaggaggtggaggttgtggtgagctgagaatgcacggtagcctaggtgacagggtgagacgctatctc

SEQ ID NO: 23748 - DNA, 2535 bp, Homo sapiens
aaatgctcggtgctttaaatttgcaattaccatatttgcagaaacttgaaaaatcatcccaattaaatgacaaaatgtataggaggattatctttcttttgcccttacaactcaaattatattcgaagtaacatttttacagcagtcaaaacttttaaccaaaactcacacctgcagtctcataagtttaacaaaatggccacattccacgctttattttcttaacaaccctgactgtttaaatgactcccattgaaccaacagcttacagttgctgggcaataaaaaagcgagcaaaaggacctccagccctgctgttttagctattacccagcactctcagagtttgctctagtctggctgttcaatcaaattcattttccagtagcttctggcctttgtctcctctttctggccacgcatttcattgcctcctgaatttgatgacaacattttctttcttcactttgaatcttggcccagaatctcactctcccagccccatggaaagatggggaaaagatttcattctgctgatcaaatttgttagaagacattctttagagtctgaaaaaatatatttcattagcagttctctaggtagtggaatttttagtgatgtttactcttttttccttgttctaattttcctctaataaacagaaaaaaagcaagagtaacccaccaaatttggataaagggcttctgcttttcatattctcttcaaccagaacagcttaacttttctccatttatttatttaagtatttattcatatttgaaacaggctggggtgcagtggcatgatctcagctcactgcaacctccacctctcgggtacaagtgattctcctgccttggcctcccaaagtgctgggattataggcgtgagccaccgcacctggccttaatttgatttttattatccacaacactcatatctctttttgatcctactgtaatatcacattatcctacctaaagatgaattgttccaaccctgatgctttggtaatcatcttttctaaattaaaaattgaggccaggtgcagtggctcaggcctgtaatcccaacactttgggaggacgaggcaggtggatcgcttgagatcaggagtgagagaccagcttggccaacatggtgaaaccccatctctactaaaaatgcagaaaaattagctgggcatggtggtgcatgcctgtaatcctagctacttgggaagctgaggcacgagaatctcttgaacccgggaaggagagattgcagtgagccaagatcatgccactgcactccagcctgggtgacagaacgagaccctgtctcaaaaaaagaaaaaaaaaaaagagagagagagatttgtaatctagcaaaatatgttatttacttattttctttccaacttttagtgtgggcccaagcgggtacctgtgcaggtttgtttcacgagtaaattgtgtgtcatgggggtttgttttacagatgattttgttactgagataatcagcataatatgtgatatgtagttttttaatccttaccctcctcttatctccaccctcaggtaggccccagtgtctgttgttcccttctttgtgtccatgtgtactcaatgtttagctcccacttataagtgagaatatgcagtatttggttttctgttcctgcattaatttatttagagatcttttatttaaatacatgaattcattttcaggaaaagccttccagagatataaaagtcaaaatccaataaaagaatgacctttgttatggaaaaacaaagaaagaaagaaatcaggtcttttttggaaaatctgggacattgaattgttacacgtaacatgtgtccccctagggacataggtcactttcagtatttgccaaagcattaggtcagccagacatgtgaaacatctcggagcttaataactgagctgcttcaatgtgttttgataaaagtttaaattctctggccccaatttattgaacacatgcctttgacaatacagcatttctttcttaggctattagtgaaagattaaccatctactcagtgattgttattgtgcctgtatgtgtgcagtatgaacagttatgtaacaaaacttcaaagattagagacctttaaaaggatctggggaaataggaagagtctataatcttataggaaaggaatgaattatgcaagcaactaaaagtgtgtcaatattctctgcttcacaaacaaattggaaaccagtggtaaactttagatcagaaacagaaactcaaaaaatgaaagaactggccatgagccaccgtgcccagcctatttatttatttttttaagtggaggttgtggtgagcctatgttgcgccattgcacttcagcctgggcaacaagagcaaaactctgtctcaaaaaaagaaaaaagaaaaagaaaagaagaaaaagaaagaacctagaaacttagaggtcaactaaggagacaggcatttttataaaaagagttgaaagaaatttgtggtagaataacagaaaatacagacaagtt

SEQ ID NO: 23749 - DNA, 1973 bp, Homo sapiens
cagtccggccgggcggagctaggggcgggcccctgcgtctctgggcgctggagcgcggcgactatcacgccgcgtggcggacggacggactgacggacgcgcagccttacccgaaaggccatggcggagcacgcccctcgccgctgctgcctgggctgggacttcagcacgcagcaggtaaaggttgttgctgttgatgcagagttgaatgtcttctatgaggaaagtgtgcattttgacagagatcttccagaatttgggcatgtacttgatgtgcatgactcagggcggtgttcatgtgcacaaggatgggctgacggtcacttctccagtactaatgtgggtccaggcactggatatcatcttggagaagatgaaggcttcgggcttcgacttctctcaagtcctagccttgtccggggcgggccagcaacacggaagtatatactggaaggctggagcccagcaggcactgacaagcttatcaccagacctccggctacaccagcagcttcaggactgtttctccatcagcgactgcccggtgtggatggactccagcaccacagcccagtgccgccagctggaggctgctgtgggtggtgctcaggctctcagctgcctcacggggtcccgtgcctatgagcgttttacagggaaccaaattgcaaaaatttaccagcagaaccccgaggcctactcacatacagagagaatttctttggtcagtagctttgctgcttccctgttccttggctcttactcccctattgactacagtgatggttctggaatgaatttgttgcagatacaggataaagtctggtcccaggcttgccttggtgcctgtgcacctcatttagaggagaagcttagcccaccagtaccatcatgctcagttgtgggagccatttcttcctactacgtccagcgctacggatttcctccaggatgcaaagtggtggccttcactggggacaacccagcgtcgctggcaggcatgagactggaggaaggtgacattgcggtcagcctgggcaccagtgacaccctgtttctctggctccaagagcccatgcctgccctggaaggccacatcttctgcaacccggttgactcccagcactacatggcactcctgtgctttaaaaatggctccctcatgagagagaagatccgcaacgagtctgtatcccgttcctggagcgatttctctaaggcactgcagtccacagagatgggcaacggtggaaacctgggtttttattttgatgtaatggagatcacccctgaaattattggacgtcataggtttaacacagaaaaccacaaggttgcagcattccctggggatgtggaggttcgagcactaattgaaggacaattcatggccaagaggattcacgcagaaggcctgggctatcgagtcatgtccaagacaaagattttggccacaggaggagcatctcacaatagagaaatcttacaggtgcttgcagatgtgtttgatgccccggtgtatgttatagacactgccaactcggcctgtgtgggttctgcataccgagcttttcatggtcttgcaggtggaacagatgtgcccttttcagaggttgtgaagttagctccaaatcccagactagctgctaccccaagcccgggagcttctcaggtgagagaccatcagaatttgtttgtagcatttgcattatgaaagcccgctagggttttttcccccaccaaaaggtcacctacattgaacgtgatgtgctcaactaaaggagaaattctgctttattgaaattatcaagaaaatggagctaaagggccatgttgtcagctgcaagtcacagatactgctgattttacagccagggtcagatggattgctgggcatatttgtattgcttcttatgcctcacggtgggcccttccatgtcactgggctataaaagctactgaaaggatccatc

SEQ ID NO: 23750 - DNA, 2038 bp, Homo sapiens
cagtccggccgggcggagctaggggcgggcccctgcgtctctgggcgctggagcgcggcgactatcacgccgcgtggcggacggacggactgacggacgcgcagccttacccgaaaggccatggcggagcacgcccctcgccgctgctgcctgggctgggacttcagcacgcagcaggtaaaggttgttgctgttgatgcagagttgaatgtcttctatgaggaaagtgtgcattttgacagagatcttccagaatttgggactcagggcggtgttcatgtgcacaaggatgggctgacggtcacttctccagtactaatgtgggtccaggcactggatatcatcttggagaagatgaaggcttcgggcttcgacttctctcaagtcctagccttgtccggggcgggccagcaacacggaagtatatactggaaggctggagcccagcaggcactgacaagcttatcaccagacctccggctacaccagcagcttcaggactgtttctccatcagcgactgcccggtgtggatggactccagcaccacagcccagtgccgccagctggaggctgctgtgggtggtgctcaggctctcagctgcctcacggggtcccgtgcctatgagcgttttacagggaaccaaattgcaaaaatttaccagcagaaccccgaggcctactcacatacagagagaatttctttggtcagtagctttgctgcttccctgttccttggctcttactcccctattgactacagtgatggttctggaatgaatttgttgcagatacaggataaagtctggtcccaggcttgccttggtgcctgtgcacctcatttagaggagaagcttagcccaccagtaccatcatgctcagttgtgggagccatttcttcctactacgtccagcgctacggatttcctccaggatgcaaagtggtggccttcactggggacaacccagcgtcgctggcaggcatgagactggaggaaggtgacattgcggtcagcctgggcaccagtgacaccctgtttctctggctccaagagcccatgcctgccctggaaggccacatcttctgcaacccggttgactcccagcactacatggcactcctgtgctttaaaaatggctccctcatgagagagaagatccgcaacgagtctgtatcccgttcctggagcgatttctctaaggcactgcagtccacagagatgggcaacggtggaaacctgggtttttattttgatgtaatggagatcacccctgaaattattggacgtcataggtttaacacagaaaaccacaaggttgcagcattccctggggatgtggaggttcgagcactaattgaaggacaattcatggccaagaggattcacgcagaaggcctgggctatcgagtcatgtccaagacaaagattttggccacaggaggagcatctcacaatagagaaatcttacaggtgcttgcagatgtgtttgatgccccggtgtatgttatagacactgccaactcggcctgtgtgggttctgcataccgagcttttcatggtcttgcaggtggaacagatgtgcccttttcagaggttgtgaagttagctccaaatcccagactagctgctaccccaagcccgggagcttctcaggtctacgaggcccttctcccccagtatgccaaactcgagcagagaatcttgtctcagacccgggggcctccggagtgaacaggcatccctgttgcccctgcctgcccagatttactgaccccatttgtcgacatggccccagacaggagggatccacttctctgttctgaacagctcttcctgcccctactgactccttggagtgtccaggaccatcttaaagccgccctcagcacatctgcatgaagatagataggcactcctgtccctgtgcccgtgtgccccagggcaggaaagcatctctcttttcctgtcttttatcccaggaggcaggacaacactgagactgggatatgtccaataaaaactatgacttttccccttg

SEQ ID NO: 23751 - DNA, 664 bp, Homo sapiens
cagtccggccgggcggagctaggggcgggcccctgcgtctctgggcgctggagcgcggcgactatcacgccgcgtggcggacggacggactgacggacgcgcagccttacccgaaaggccatggcggagcacgcccctcgccgctgctgcctgggctgggacttcagcacgcagcaggtaaaggttgttgctgttgatgcagagttgaatgtcttctatgaggaaagtgtgcattttgacagagatcttccagaatttggagcaaccttggaagcacatgtggaacatgacagagccaccatcaacctggttcctgaatgactgcatggagcagaactccccactccccactcatgttcctaaccacctactgattgtgctttacatgaggagaaagaaacttcagctgtatcaagccatagaaatgtgtttttccttaactaatataattttttccctcatatcctttttttaaagaaaatactggggccaggtgtggtcgctcacgcctgtaatcccagcactttgggattacagaggcgggcacatcacgaggtcaggagatcgagaccatcctggctaatgcagtgaaaccccgtctctactaaaaatacaaaaatttagccaggcttggtgccgggcgcctgtagtcccagctgctcgg

SEQ ID NO: 23752 - DNA, 3792 bp, Homo sapiens
cagtccggccgggcggagctaggggcgggcccctgcgtctctgggcgctggagcgcggcgactatcacgccgcgtggcggacggacggactgacggacgcgcagccttacccgaaaggccatggcggagcacgcccctcgccgctgctgcctgggctgggacttcagcacgcagcaggtaaaggttgttgctgttgatgcagagttgaatgtcttctatgaggaaagtgtgcattttgacagagatcttccagaatttgggactcagggcggtgttcatgtgcacaaggatgggctgacggtcacttctccagtactaatgtgggtccaggcactggatatcatcttggagaagatgaaggcttcgggcttcgacttctctcaagtcctagccttgtccggggcgggccagcaacacggaagtatatactggaaggctggagcccagcaggcactgacaagcttatcaccagacctccggctacaccagcagcttcaggactgtttctccatcagcgactgcccggtgtggatggactccagcaccacagcccagtgccgccagctggaggctgctgtgggtggtgctcaggctctcagctgcctcacggggtcccgtgcctatgagcgttttacagggaaccaaattgcaaaaatttaccagcagaaccccgaggcctactcacatacagagagaatttctttggtcagtagctttgctgcttccctgttccttggctcttactcccctattgactacagtgatggttctggaatgaatttgttgcagatacaggataaagtctggtcccaggcttgccttggtgcctgtgcacctcatttagaggagaagcttagcccaccagtaccatcatgctcagttgtgggagccatttcttcctactacgtccagcgctacggatttcctccaggatgcaaagtggtggccttcactggggacaacccagcgtcgctggcaggcatgagactggaggaaggtgacattgcggtcagcctgggcaccagtgacaccctgtttctctggctccaagagcccatgcctgccctggaaggccacatcttctgcaacccggttgactcccagcactacatggcactcctgtgctttaaaaatggctccctcatgagagagaagatccgcaacgagtctgtatcccgttcctggagcgatttctctaaggcactgcagtccacagagatgggcaacggtggaaacctgggtttttattttgatgtaatggagatcacccctgaaattattggacgtcataggtttaacacagaaaaccacaaggttgcagcattccctggggatgtggaggttcgagcactaattgaaggacaattcatggccaagaggattcacgcagaaggcctgggctatcgagtcatgtccaagacaaagattttggccacaggaggagcatctcacaatagagaaatcttacaggtgcttgcagatgtgtttgatgccccggtgtatgttatagacactgccaactcggcctgtgtgggttctgcataccgagcttttcatggtcttgcaggtggaacagatgtgcccttttcagaggttgtgaagttagctccaaatcccagactagctgctaccccaagcccgggagcttctcaggtctacgaggcccttctcccccagtatgccaaactcgagcagagaatcttgtctcagacccgggggcctccggagtgaacaggcatccctgttgcccctgcctgcccagatttactgaccccatttgtcgacatggccccagacaggagggatccacttctctgttctgaacagctcttcctgcccctactgactccttggagtgtccaggaccatcttaaagccgccctcagcacatctgcatgaagatagataggcactcctgtccctgtgcccgtgtgccccagggcaggaaagcatctctcttttcctgtcttttatcccaggaggcaggacaacactgagactgggatatgtccaataaaaactatgacttttccccttgcagaggcagaattaaagctaatctagggactcaaatcagcagaatgggggagacaaagcccggtctcaccccctaacctcatcctatctctttctccaaccctgactgcccactcctccgcaaaccgtgacccatagccgcccccaccccataccttgatctaccatccatcctcttccccaatccaaaccccacagtctcttctctcccacaccctgccctccttgtttcagctgtctgaggtgcctcgcagggcctctcttacttgccccatgctcaccctttccatgctgtccccattctctcctttcaccatctctcctctccccctccttcatctctcctccctccccaaactcacttggcataattcacaacctcccacccaaacaatgggcctggtggacgtgcttcctgtgccctccctttagctatgcccacagatcactgagagggaccatctcccaagtggtgcagtttagaacttctctccctttttctccctcattccctctctcttcttgcagtccacttgctgaagaagttgtgtcatttctctggaagaatttccaaaattctggatttcttttttattttggagtatttcatcagctgaaaagtgattctcactttgagttttcttcctatatttgtatagtgagttcctttttccttcctctttatccctcctgttttactttatacctctctattccttgctcaaattattgcaaaagcctctatagaaagtcctctgtgatctgactcctgcagactcttccagatttttctgcccaaggcctttactgagctcaggactccagctaaatcaaaatacgcatgttctcacccagagtgacaaaatcctgcagataggtttaagacctagtggctcagagcagtagctactgggaagttaaaaggaaggggcttagaaaatgaatgggaccaaaggcatcacttctgatggagatgaagccatcttgaaagtgagtggtgtcctttggaggcatggtggatgaaaggcgcaaaggaagcaagaggttaaagataatggcccattagatacaacagcaagcccaagattccgaagaagacagacaactccccctagtaccacctagacattactttttaaagacattttacattattgtccagcagaaaaaggctgtcttggaccatgaaacagtaaactgtaactaaacacttcaacatgaatttgaaaataaataattgtggatataaaagaacaccagagatcagaaattcaaaaactcagaataaaaatgaaaaagctacaagcatatatgagaagagaactgactgaacttgggaaataatttgaacaaaaagataaatcttcacagatatgaatactaaattatatcttaatgaaaatagatatggtcacaagtacattaaggcacgtagaaggtaggagtaagaaaagctaagagaagcaaaacaaacaaagcaatattaaaggaagagccaaaaagacccagaaataaaatgacagataaagaagattgtcaaagaaaagatgatacaggtaagattggaactcatgaagacaaaagataagacagtggcatagagttaatatttaaaattcaaatattaaaactcaaataaaccccaaagaacttttggaaaacaaaagaaaaccttaaactttatcttgaaagggtctatcttgttacttagaatattgaatcagaatgattagctctgagacatagcctaccaac

SEQ ID NO: 23753 - DNA, 1019 bp, Homo sapiens
cagtccggccgggcggagctaggggcgggcccctgcgtctctgggcgctggagcgcggcgactatcacgccgcgtggcggacggacggactgacggacgcgcagccttacccgaaaggccatggcggagcacgcccctcgccgctgctgcctgggctgggacttcagcacgcagcaggtaaaggttgttgctgttgatgcagagttgaatgtcttctatgaggaaagtgtgcattttgacagagatcttccagaatttgggactcagggcggtgttcatgtgcacaaggatgggctgacggtcacttctccagtactaatgtgggtccaggcactggatatcatcttggagaagatgaaggcttcgggcttcgacttctctcaagtcctagccttgtccggggcgggccagcaacacggaagtatatactggaaggctggagcccagcaggcactgacaagcttatcaccagacctccggctacaccagcagcttcaggactgtttctccatcagcgactgcccggtgtggatggactccagcaccacagcccagtgccgccagctggaggctgctgtgggtggtgctcaggctctcagctgcctcacggggtcccgtgcctatgagcgttttacagggaaccaaattgcaaaaatttaccagcagaaccccgaggcctactcacatacagagagaatttctttggtcagtagctttgctgcttccctgttccttggctcttactcccctattgactacagtgatggttctggaatgaatttgttgcagatacaggataaagtctggtcccaggcttgccttggtgcctgtgcacctcatttagaggagaagcttagcccaccagtaccatcatgctcagttgtggtaggtctcctttctggtgatgtggctcatttaagagctggcagctaccagggaagcactgtagcgcacacacacgcacacacacacacacacacacacacacactctgcacacacccttatttgttcctcacc

SEQ ID NO: 23754 - DNA, 389 bp, Homo sapiens
tccttactctgtgcccaccttttcctggagacaggttgcagcattccctggggatgtggaggttcgagcactaattgaaggacaattcatggccaagaggattcacgcagaaggcctgggctatcgagtcagtaagtgagccactggcagcatgtgtcccggggtgggggctcagggccagctcactcgcaggggccagggctagtggggcaatatctactaaagttttcttacagggggacttgtgcaggagggaggtggagcctgacctcagggatggggtgagaaagtgtcaattggcacttgtaggcaagcatagaatagcagacaggttgttcccgcttctcagctgtgtccacaatagcctgaccttttggccaggacctgta

SEQ ID NO: 23755 - DNA, 457 bp, Homo sapiens
catgaacgtaatggatgcagattatgtaaaagtgataaatattgtgagccacatgactatgaatactgctgtccttgtgagtggcaccgtacagaacatgataggcaactcaatgaagtagagaacaatattaagaagaaagcttgctgttgtgagggattcccattccatgaggttattcaagaattccttttaaacaaggataaattggtgaaggttatcaggtaccaaagacctgatttgttattgtttcagagatttactcttgaaaaaatggagtggcccaatcactatgcatgtgagaaattgctggtacttttgacccattatgacatgatagaaagaaagcttggtagcagaaactctaatcaactacagccaattcggtaatgtaaagaactgtatggtgaaggtggtgtttttacttgagtattttataattaaaatattcctaata

SEQ ID NO: 23756 - DNA, 5862 bp, Homo sapiens
  misc_feature (2314)..(2314): n is a, c, g, or t
catgaacgtaatggatgcagattatgtaaaagtgataaatattgtgagccacatgactatgaatactgctgtccttgtgagtggcaccgtacagaacatgataggcaactcaatgaagtagagaacaatattaagaagaaagcttgctgttgtgagggattcccattccatgaggttattcaagaattccttttaaacaaggataaattggtgaaggttatcaggtaccaaagacctgatttgttattgtttcagagatttactcttgaaaaaatggagtggcccaatcactatgcatgtgagaaattgctggtacttttgacccattatgacatgatagaaagaaagcttggtagcagaaactctaatcaactacagccaattcgaattgttaagactcgaatcagaaatggagttcattgttttgaaatagaatgggaaaagcctgaacattatgctatggaagataaacaacatggagaatttgctttattaacaattgaggaagaatcattgtttgaagcagcatatcctgagatcgttgctgtttaccaaaaacaaaagttagaaattaaagggaagaaacaaaaacgtattaagcctaaagaaaacaatttgccagaaccagatgaagtaatgagctttcagtcacacatgactttaaaacccacatgtgaaatctttcataagcagaattccaagttaaattcggggatttcccctgatcctacattaccacaggaatctatttctgcctcattgaatagcttgcttttacctaaaaatactccatgtttgaatgcacaagaacagttcatgtcttctctaagacctttggctatacagcaaattaaagctgtcagtaagtctctaatttcagaatctagtcaacccaatacctcatctcataatatatccgtgattgctgatctacacttgagcactattgactgggaaggtacttcttttagtaattctccagctattcaaaggaatactttttctcatgatttaaaatcagaagttgaatcagagctatcagccatccctgatggctttgaaaatatcccagaacaactgtcctgtgaatcagaaaggtacactgcaaacataaagaaagtgttggatgaggattctgatgggattagtcctgaagagcatctactttctggcattactgatttatgtcttcaggatttgcctttaaaggaacgaatatttacaaaattatcatatcctcaggataatctacaaccagatgtcaacctgaaaactttgtccatacttagtgtaaaagaatcttgtattgctaacagtggttctgattgtacatcacatctttcaaaggatcttccaggaattcccttgcaaaatgaatccagagactctaaaattctaaaaggagaccagctgcttcaagaagactataaagtcaatacttctgtcccttattctgtcagtaacacagtggtaaagacctgcaatgttagaccaccaaatactgctttagatcatagtagaaaagttgatatgcaaaccactcggaaaattttaatgaagaagagtgtttgccttgacagacattcctctgatgaacaaagtgccccagtgtttgggaaagctaagtacacaactcaaagaatgaagcacagttctcaaaagcataattcatcccatttcaaagaaagtggccataacaagttgagtagccctaagatacatattaaagaaactgaacagtgtgtcagatcttatgaaacagctgaaaatgaagaaagctgtttcccagattcaacaaaaagttctctgagttctctacaatgtcataagaaagaaaacaactctggtacttgtttggatagccctcttcctttacgccagagattaaaactaagattccaaagcacttgaaatttaaaacacttaggtataacttaactattttagtactatcagcaatagcagagacagagggaaggtatctagttcatgtgtggtaaaaattttaatgttctctgtgtcatgaaacacttgccattttaatcaaagttgtaatttttaaaaagtcacctaaaactctggttttaaaagatcctctgtattgaaaacttctgataatgtatgtcattatgtccttactattccttaattgtagttttaaaatattggtatagtacttgacagagtaaatacttcatctgattgttcatttttactttttcttccacaagcctctaaagtatttatattccagcttgttcccaagaggataattctttatacttctcttcattcttttaaggccttgcaaggncttccgttataactcgctttcctaaaagctattttctccctcagtgtgaagatacctttagtgtgctcttccactttggaaggccatgcaaggtgttccattataactctttttcctaagagttatattctccctcagtttgaagatacctttagtgtgctcttccacttttggtgtcttagtctcttttgaggggcaaaaatagaaaaggagagaagatgtcagtatgtttagtaaaaatcatgctcgtaatggctgaataaactgagcaaagtaactccttatgtatccccagaagttcacaggtatatcgggtggaaaaagatttggaaaatcaaatgtataaccaaaaggattagaaactagcccaggatcacgtagctaactaataatcctgtgggaatcagttttcttgcctgctaatttttttatttttctattttttccttctatagcacttttcccccttttgttttgaatctatgcaatattgactttaataccaccaaatattaagtcatgcattaatttaggtcgcactcaaaaattctagagaggcatccagattgaaaaggaaaatggtgtctgcagatgacaagattgtatgcatcaaaaattctaagaaatccactagaaaactattaaaactgataaagcgagttcatccaggtcgtagaatacaagaccaatgtgcaatgatcattgcattttgtttttgtttgtttgtttttttttgagacagagtctcactcttgtcgagactggggtgtagtggcgccatcttggctcactgcaacctctgcctcccaggttcacgcaattcacatgcctcagccacctgagtagcagggattacaggtgtgtgccaccatgcctggctaatttttagtatttttagtagagatgggattttcccttgttggtcaggctagtcatgaactcctggcctcaagcgatccacccatcttggcctcccagagtgctgggattacaggtgtgaatcaccatactcagcctcaattgtatttctgtacacctctaaataaatggaaatacattccatgttcatgaatcagaagacataagatgaccatactccccaaactgatctacaggttaaatgtaattcccattaattccagctggtttctttgctgattctaaaattcatatggaaatttcaggaacacagaatattaggaagaatcttgaaagagtttgaatgacccacccttcctgattttaagtatacagaactacagtaatgaatgtgttgtactggtataaaggtagacatataggtcaatatagatcaatggcatagaattgagaattcagaaaaaaagccttcacgtttatggtcagttgattttaaaccagagtgccaagacaattcaatgggaaaaggaaacagtctttgaaccaactgtcttctggatctattggatatctatgtaaaaaagagtgacatttgattcctacttcacatgatatttaagaagtaacttaagatggatcaaatacctaaatgtaagctaaagctataaaactcttagaagaaaacatagacgtaaatctttgtgactttggattaggcaaggatttcttaaatatacccaaagcataggcaacaaaagagaatacacaaactggacttcatcaaaactaaaaactgttgtttgaaatgacaccatcaagaaagtgaaaagacagcttacagaatgggagaaaatatttgcaaatcataaatgtgataagggacttgtatcttggtggtatataaagaactcgtaactcaattataaaaagacaactttgaaatgggcaaaatagctcaacaggcttttctgcaaagaagaaatacaaatgaccaagaagcacatttaaaaattttcagtactattactcatcaggaaaatgcaaatcaaaaccacaagacacccaatgtctacaatcaaaaagataataactagtattgatgaggatgtggagaaattgaaattctcataacatgctggtaggaatgtaaaatggggcagccactttggaaaaagtctggtagttcttcaaatggttaaatgtagagttacgatatgatccagcaattcctctcccaggtatatacccaagataaatgaaaacttatatccacataaaaacctgtgcacaaatgtccatagcagcgttattcataatagcctaaaagtggaaacaatcccagttccagaatgaggaaggggagaaactaatgtgtattagctattgtgtgctaagcattcaactagattatttacaaaccttgtatcatctcaactctttaaagactgtattgcaatgttttgaatattcagagagaaaaaagtcgttgctaaaacattttccaaggttctgcttattctgatttgttcagtcgtggctgtgatagttcaggaccatctagaccaggtaaataaaatatctagaggcattcttgagattgtatgagatgaaaataacaaaattagttgggagtggccagtctgagttcattttgctatatagctcaggagtccccaacccctgggctatggacaggtaccagtccatcacctgtcaggaaccggcctgcacagcaggtgttgagcggcatgcaagcgagaattaccgcctgagctctgcctcctgtcagatcagcggtggcattagagtctcataggagcatgaaccctattgtgaactacgcatgcgaggatctagtttgtgcactcctactgagaatctaatgcctgatgatataaggtggaacagcttcatcccacagccatctccccctcatcatccgtggaaaaactgttttccacgaaagtggtcctcggtgccagaaaggttggggactgctgatatacctaatataggcataagtgtaaaattatagttcctcctcctcaaggatttctctgttttcattgtccaggttataccaattctttttaaagcattccatgttcttgttccttgatgtggtcatgttatcacttgtaaatcaaatcttttaagttgctgcttacgtatttgctcatcacttcattgtcttgttgaggatgccttgcttccctttgaaatactctgccaaagatctgcctccagctgctaggatcctgtaattggtttctttctgatggctccatgctaaggccctgctctggcctaactgctttgggctttgtgtaatcaatcttaagtccttggcggtttttcttttagattttttttccatataaaatctctatctggccacacatggtggccgtgcctgtaatcccagcacgctgggaggctgaggcgggtggattgcttgaggccaggagttcaagaccagcctggccaacatggtgaaaccccatctctactaaaaatacaaaaatcagtggggcctggtggcgtgcacctgtaatcccagctactcgggaagctgaggcaggagaatcgcttgaacctgggaggcagaggttgcagtgagctgagatagtgccactgcacttcactccaggatgggcgaaaaagtgtct

SEQ ID NO: 23757 - DNA, 4781 bp, Homo sapiens
  misc_feature (2314)..(2314): n is a, c, g, or t
catgaacgtaatggatgcagattatgtaaaagtgataaatattgtgagccacatgactatgaatactgctgtccttgtgagtggcaccgtacagaacatgataggcaactcaatgaagtagagaacaatattaagaagaaagcttgctgttgtgagggattcccattccatgaggttattcaagaattccttttaaacaaggataaattggtgaaggttatcaggtaccaaagacctgatttgttattgtttcagagatttactcttgaaaaaatggagtggcccaatcactatgcatgtgagaaattgctggtacttttgacccattatgacatgatagaaagaaagcttggtagcagaaactctaatcaactacagccaattcgaattgttaagactcgaatcagaaatggagttcattgttttgaaatagaatgggaaaagcctgaacattatgctatggaagataaacaacatggagaatttgctttattaacaattgaggaagaatcattgtttgaagcagcatatcctgagatcgttgctgtttaccaaaaacaaaagttagaaattaaagggaagaaacaaaaacgtattaagcctaaagaaaacaatttgccagaaccagatgaagtaatgagctttcagtcacacatgactttaaaacccacatgtgaaatctttcataagcagaattccaagttaaattcggggatttcccctgatcctacattaccacaggaatctatttctgcctcattgaatagcttgcttttacctaaaaatactccatgtttgaatgcacaagaacagttcatgtcttctctaagacctttggctatacagcaaattaaagctgtcagtaagtctctaatttcagaatctagtcaacccaatacctcatctcataatatatccgtgattgctgatctacacttgagcactattgactgggaaggtacttcttttagtaattctccagctattcaaaggaatactttttctcatgatttaaaatcagaagttgaatcagagctatcagccatccctgatggctttgaaaatatcccagaacaactgtcctgtgaatcagaaaggtacactgcaaacataaagaaagtgttggatgaggattctgatgggattagtcctgaagagcatctactttctggcattactgatttatgtcttcaggatttgcctttaaaggaacgaatatttacaaaattatcatatcctcaggataatctacaaccagatgtcaacctgaaaactttgtccatacttagtgtaaaagaatcttgtattgctaacagtggttctgattgtacatcacatctttcaaaggatcttccaggaattcccttgcaaaatgaatccagagactctaaaattctaaaaggagaccagctgcttcaagaagactataaagtcaatacttctgtcccttattctgtcagtaacacagtggtaaagacctgcaatgttagaccaccaaatactgctttagatcatagtagaaaagttgatatgcaaaccactcggaaaattttaatgaagaagagtgtttgccttgacagacattcctctgatgaacaaagtgccccagtgtttgggaaagctaagtacacaactcaaagaatgaagcacagttctcaaaagcataattcatcccatttcaaagaaagtggccataacaagttgagtagccctaagatacatattaaagaaactgaacagtgtgtcagatcttatgaaacagctgaaaatgaagaaagctgtttcccagattcaacaaaaagttctctgagttctctacaatgtcataagaaagaaaacaactctggtacttgtttggatagccctcttcctttacgccagagattaaaactaagattccaaagcacttgaaatttaaaacacttaggtataacttaactattttagtactatcagcaatagcagagacagagggaaggtatctagttcatgtgtggtaaaaattttaatgttctctgtgtcatgaaacacttgccattttaatcaaagttgtaatttttaaaaagtcacctaaaactctggttttaaaagatcctctgtattgaaaacttctgataatgtatgtcattatgtccttactattccttaattgtagttttaaaatattggtatagtacttgacagagtaaatacttcatctgattgttcatttttactttttcttccacaagcctctaaagtatttatattccagcttgttcccaagaggataattctttatacttctcttcattcttttaaggccttgcaaggncttccgttataactcgctttcctaaaagctattttctccctcagtgtgaagatacctttagtgtgctcttccactttggaaggccatgcaaggtgttccattataactctttttcctaagagttatattctccctcagtttgaagatacctttagtgtgctcttccacttttggtgtcttagtctcttttgaggggcaaaaatagaaaaggagagaagatgtcagtatgtttagtaaaaatcatgctcgtaatggctgaataaactgagcaaagtaactccttatgtatccccagaagttcacaggtatatcgggtggaaaaagatttggaaaatcaaatgtataaccaaaaggattagaaactagcccaggatcacgtagctaactaataatcctgtgggaatcagttttcttgcctgctaatttttttatttttctattttttccttctatagcacttttcccccttttgttttgaatctatgcaatattgactttaataccaccaaatattaagtcatgcattaatttaggtcgcactcaaaaattctagagaggcatccagattgaaaaggaaaatggtgtctgcagatgacaagattgtatgcatcaaaaattctaagaaatccactagaaaactattaaaactgataaagcgagttcatccaggtcgtagaatacaagaccaatgtgcaatgatcattgcattttgtttttgtttgtttgtttttttttgagacagagtctcactcttgtcgagactggggtgtagtggcgccatcttggctcactgcaacctctgcctcccaggttcacgcaattcacatgcctcagccacctgagtagcagggattacaggtgtgtgccaccatgcctggctaatttttagtatttttagtagagatgggattttcccttgttggtcaggctagtcatgaactcctggcctcaagcgatccacccatcttggcctcccagagtgctgggattacaggtgtgaatcaccatactcagcctcaattgtatttctgtacacctctaaataaatggaaatacattccatgttcatgaatcagaagacataagatgaccatactccccaaactgatctacaggttaaatgtaattcccattaattccagctggtttctttgctgattctaaaattcatatggaaatttcaggaacacagaatattaggaagaatcttgaaagagtttgaatgacccacccttcctgattttaagtatacagaactacagtaatgaatgtgttgtactggtataaaggtagacatataggtcaatatagatcaatggcatagaattgagaattcagaaaaaaagccttcacgtttatggtcagttgattttaaaccagagtgccaagacaattcaatgggaaaaggaaacagtctttgaaccaactgtcttctggatctattggatatctatgtaaaaaagagtgacatttgattcctacttcacatgatatttaagaagtaacttaagatggatcaaatacctaaatgtaagctaaagctataaaactcttagaagaaaacatagacgtaaatctttgtgactttggattaggcaaggatttcttaaatatacccaaagcataggcaacaaaagagaatacacaaactggacttcatcaaaactaaaaactgttgtttgaaatgacaccatcaagaaagtgaaaagacagcttacagaatgggagaaaatatttgcaaatcataaatgtgataagggacttgtatcttggtggtatataaagaactcgtaactcaattataaaaagacaactttgaaatgggcaaaatagctcaacaggcttttctgcaaagaagaaatacaaatgaccaagaagcacatttaaaaattttcagtactattactcatcaggaaaatgcaaatcaaaaccacaagacacccaatgtctacaatcaaaaagataataactagtattgatgaggatgtggagaaattgaaattctcataacatgctggtaggaatgtaaaatggggcagccactttggaaaaagtctggtagttcttcaaatggttaaatgtagagttacgatatgatccagcaattcctctcccaggtatatacccaagataaatgaaaacttatatccacataaaaacctgtgcacaaatgtccatagcagcgttattcataatagcctaaaagtggaaacaatcccagttccagaatgaggaaggggagaaactaatgtgtattagctattgtgtgctaagcattcaactagattatttacaaaccttgtatcatctcaactctttaaagactgtattgcaatgttttgaatattcagagagaaaaaagtcgttgctaaaacattttccaaggttctgcttattctgatttgttcagtcgtggctgtgatagttcaggaccatctagaccaggtaaataaaatatctagaggca

SEQ ID NO: 23758 - DNA, 2348 bp, Homo sapiens
cggacgcgtgggtcgacccacgcgtcgccacccttcctgattttaagtatacagaactacagtaatgaatgtgttgtactggtataaaggtagacatataggtcaatatagatcaatggcatagaattgagaattcagaaaaaaagccttcacgtttatggtcagttgattttaaaccagagtgccaagacaattcaatgggaaaaggaaacagtctttgaaccaactgtcttctggatctattggatatctatgtaaaaaagagtgacatttgattcctacttcacatgatatttaagaagtaacttaagatggatcaaatacctaaatgtaagctaaagctataaaactcttagaagaaaacatagacgtaaatctttgtgactttggattaggcaaggatttcttaaatatacccaaagcataggcaacaaaagagaatacacaaactggacttcatcaaaactaaaaactgttgtttgaaatgacaccatcaagaaagtgaaaagacagcttacagaatgggagaaaatatttgcaaatcataaatgtgataagggacttgtatcttggtggtatataaagaactcgtaactcaattataaaaagacaactttgaaatgggcaaaatagctcaacaggcttttctgcaaagaagaaatacaaatgaccaagaagcacatttaaaaattttcagtactattactcatcaggaaaatgcaaatcaaaaccacaagacacccaatgtctacaatcaaaaagataataactagtattgatgaggatgtggagaaattgaaattctcataacatgctggtaggaatgtaaaatggggcagccactttggaaaaagtctggtagttcttcaaatggttaaatgtagagttacgatatgatccagcaattcctctcccaggtatatacccaagataaatgaaaacttatatccacataaaaacctgtgcacaaatgtccatagcagcgttattcataatagcctaaaagtggaaacaatcccagttccagaatgaggaaggggagaaactaatgtgtattagctattgtgtgctaagcattcaactagattatttacaaaccttgtatcatctcaactctttaaagactgtattgcaatgttttgaatattcagagagaaaaaagtcgttgctaaaacattttccaaggttctgcttattctgatttgttcagtcgtggctgtgatagttcaggaccatctagaccaggtaaataaaatatctagaggcattcttgagattgtatgagatgaaaataacaaaattagttgggagtggccagtctgagttcattttgctatatagctcaggagtccccaacccctgggctatggacaggtaccagtccatcacctgtcaggaaccggcctgcacagcaggtgttgagcggcatgcaagcgagaattaccgcctgagctctgcctcctgtcagatcagcggtggcattagagtctcataggagcatgaaccctattgtgaactacgcatgcgaggatctagtttgtgcactcctactgagaatctaatgcctgatgatataaggtggaacagcttcatcccacagccatctccccctcatcatccgtggaaaaactgttttccacgaaagtggtcctcggtgccagaaaggttggggactgctgatatacctaatataggcataagtgtaaaattatagttcctcctcctcaaggatttctctgttttcattgtccaggttataccaattctttttaaagcattccatgttcttgttccttgatgtggtcatgttatcacttgtaaatcaaatcttttaagttgctgcttacgtatttgctcatcacttcattgtcttgttgaggatgccttgcttccctttgaaatactctgccaaagatctgcctccagctgctaggatcctgtaattggtttctttctgatggctccatgctaaggccctgctctggcctaactgctttgggctttgtgtaatcaatcttaagtccttggcggtttttcttttagattttttttccatataaaatctctatctggccacacatggtggccgtgcctgtaatcccagcacgctgggaggctgaggcgggtggattgcttgaggccaggagttcaagaccagcctggccaacatggtgaaaccccatctctactaaaaatacaaaaatcagtggggcctggtggcgtgcacctgtaatcccagctactcgggaagctgaggcaggagaatcgcttgaacctgggaggcagaggttgcagtgagctgagatagtgccactgcacttcactccaggatgggcgaaaaagtgtct

SEQ ID NO: 23759 - DNA, 447 bp, Homo sapiens
aattaaaatattcctaatatctttaagctcgtttttgtaaaggtggaggaaaggcctcctggaatattaaaagcttattcagggcttataatcagaacaacatagtaagtcatgctttatcatacttttctacttcaaacacatagtaataatagattataaaaagaaacaagcataaaaggatatagccaggctttataagacaactatttcagtggaccagaaaaggaacaaacgtgttaagggaatgtgggaactaaaactggttttgcagagccttaaatctagaagcagccgtatcatccaggaggtaaatcgcttcagagaaaaaaaaaaaaatggggaccaaaagtgcaagatgttgatggagtcaggcttatttcttgaaacccagtagctagggtggaatttctctgttcctatcaggagattagaggctggggtaga

SEQ ID NO: 23760 - DNA, 351 bp, Homo sapiens
gaaagcttgctgttgtgagggattcccattccatgaggtaatatccagtaattcaactctattaattttagaaactttcttaaaagtttaaatctcagtttctattttcttttttcttgctaggttattcaagaattccttttaaacaaggataaattggtgaaggttatcaggtaccaaagacctgatttgttattgtttcaggtatctgaaaataaattcttctttactgtatgaagttatatgctggaaagataggaacagatattcactctgattggtcttagaggaggtttaaaattaaaacaggcagctcttatattttttcagcatttatttctactctctcat

SEQ ID NO: 23761 - DNA, 448 bp, Homo sapiens
accatgttctgggctcagtgcttaagtagactaaagtttacctgttctgttgtgccagttttgtgctaggattgtaaagatgaatacactattgttactttctctgattgtgtagtctagtgtataggtcagcaaactttttctatgaagggccagatagtaaattactttatagggcatatgttctttgttgccaccactcacctttactgttgtaccaccaaagtagccatggacaatatgtaaatgaatgagcatgactgtattccattaaaactttatttacaaagacagatggtggattgaatttggcctgtgggcctagtttgccaacttctgttccagtggaagaaatggttacataaatagaatacagtaaacagttgattcttgttatttgtggtggttatgttctatacattcaataaattcaccacaaacactgaat

SEQ ID NO: 23762 - DNA, 439 bp, Homo sapiens
ggcccaaagaagacatttcatgaatattattcttacttccacttttcctttctttgtctcttttcctctaatttcagtctgccttctttctctctcctccatttattggcttaaaggattgaaaccacagtatgttaaccagcagcctgggaaaagtcccatggtgctcacctccacccctgtgctgacaaactgtaggttaccctcaaaaaccacaaggctaatgtccaactgccttcagggcactccctgaagcttggagaacatttaaatagcatagaagatctaattagcagcagcctagtcctcatgagcattctttacaccaccatccaattacccatcctgtgcagtcaatttgggtgcaggttttggtaacagaagcttttccatatttagtcatcatgataatttatgcttaaatattttgtaggtttgt

SEQ ID NO: 23763 - DNA, 748 bp, Homo sapiens
caggtgagccctgaaaacacaaaaggacagttctgtgttgaaacaccccatcccctcacgttctcaccccaggcccagaagtaggttgcaactgcctttggaagattttgccccttagccatccccacccacttgtaccagctaagaatgctggagactctgccaccatgctctgcgtgcccctgaacctctgtgcagcccggaaggctgatgtacaggtgtacctcaatccacattacagccatgctcctaatgtacatggacatttttgtaactcagctcatattctgactgtatttgagaagctggctgtttaagggaacccagaagtgaattcttttgtaaagtaaagcacccttttgtaatgcaattaattatcccttaatgtatctgttttgtaagtctgcatttttgtatatcggatttaccttaagcttctctagtgaggcattctgagcagtggtgatcacatgccagatcgccctgcctatccacaaagtagatgaccaatgcacgctcctcaaacatctttggaggaactacctggccaaaacactggccaggatgcagcaagcagcagcaggggctgacagcaggcttactgccatcaacattgcttgaaatgcctctatgttctgaataaagaaaaaccataattgcttgtggtgaaacgaagcagtcttcatgttaagtagcaatggttatttttattggtagtaactgaacagtgttttgcaatttgtgaaac

SEQ ID NO: 23764 - DNA, 400 bp, Homo sapiens
taaatacacgttgtgtgaattaatgcacattgtttaaccaggcccccattgataaactttgcatttcttttgttctttactattgtaaacatttccttgcctttgtgtactgtatttgaaggataaatttccagatcttgaattgctagatttaaaacagcgcagatgtccttcaacaggtgaatgactaagcaaaccatgatttgctttgtattccaaatcatggaattcacatcagccataaaaaggaacagactagtggtacacactacaacttggatgaatctagggaattatgttgagtgaaaaaagctaattcaaaaagtatgatatacgtgctatatcatttcatttatttaacatttttaagcgacaaaattttcttttttccttctccttc

SEQ ID NO: 23765 - DNA, 700 bp, Homo sapiens
ccaaatctatataaaaatgacattccacacattgaaaaataaaagtggctattgctgctgggaatgcaaaatgaaacagctgttttggaaaatgctttgatagtttcttataaattaaacatacacttacaaagtgatccagaattgctactcctaggtatttatatcaaagaaatgaaaacttatgtatacaaaagcctatacacgaatgtttagagtggatttattcatagttgccagaaattggaacaacccaatgtcttcaaactgggaaatggataaacaaactatggtgtattcatacagtggaatactactcagtaataaaaagaaatgagcacccaatacatgcaacaacttggagttacatcaaatgcattatgctaattagaggaagtcagacttaaaatgctacatactgtatataatccatatggcattttaaaaactacaggatcagcaaacagatctgtgctgtgagttggaggaagaattgatgaaaaaagacacaagaaaattgtttgaagtgatggagctgttctatatcttgattgtagtagtgatggcattgaatgcatttgccaaaactcatagaactctgtaactaaaaaataatgaattttattatatataaattataccttcataacagggtaccctcaaatgagtagtaatatatttttgcgtgtgttttgatttt

SEQ ID NO: 23766 - DNA, 130 bp, Homo sapiens
aatttcttgttatcatgggaaattttggttctagggatagaatacatctcatagaagtcagagatccttactccctttttcttttttttttccaatttttttggcctttctagcactcatctttatgtag

SEQ ID NO: 23767 - DNA, 369 bp, Homo sapiens
gtatttctagtagagatagggttttgccatgttgcccaggcttgtcttgaactcctgagttcaggtaatctgccgcctcggcctcccaaagtgctgggattataggcatgagccatcgtgcccggccaacagtggttgttttatctctggtatggaatatggctgtggggtgtgtgtgtacgtgcacacatgcacttgtaaatgttcttgctttttgctttttttttttttggagacagtgtctcgctctgttgcccaggctggtcttgaacccctgggctcaggcaatcctcccacttgggcctctgccaaaaatgactttggaaagaaaaacacagctgggagtctctctggcttgggggctgcctg

SEQ ID NO: 23768 - DNA, 950 bp, Homo sapiens
acagtttcaaaatatcaaatataactaaatattgaaatgaaaagcacacgtcctgtctctgcagtctgaagctacatgtaagcaggacactcatgtgtcttccaattacaactaaacagacctggctgtcagtaatctgcattctcagtggcctctgggctcactttagacaatactttcagcctccttcattccaattacttcactaccttgggggaaataattttagagaagataaaagtagcatttttcattctctaaaatcactttgtattttatagtagtacatgcctttgctgtctgaactaaaaaaagacaaaatatagaaatgcttttgattttctttgtaaatggtattttgactcctatagtgtatttgtacctgacatcatctccgttaaagcagttttattcctgagatgagggtacagtggaaaacacattagcatcatagattaaaaccagttgacagcggtctcctaaaatgctaaataataaaaattccaccaaaagcaccataacaggttatgaaactcccaaataactacagccctaggaaatattttttaattaaaaaaagttcacaatcttttatgttacaggaaaaaaatccgtaaatctttctgactataaaccgcctcacaagtctgagaatatgacacttttacactgatttaccactttcattgttatcagttaaaatccatatggcttttagtcttttacctacccaaaaaggtgagggggcagggggttccttcatagtgcccaggattttgagggacatttcccaaccaaatgtaattcagcattaaattttccacagataaattaggcacatcagaccagatttcaactgcattgagatttcaacactgtatatcctgactgaaataactaacttgaaagcttccactagtgactgaagggatggtgggaagggggttgtg

SEQ ID NO: 23769 - DNA, 465 bp, Homo sapiens
ctgacattgacatcattgcccagcttccaacagccagacagcttcacacgtctggcttccttttcaactggagaacactgtgaatcgtgtggggacacattttggaaggaggtgaaatattaaataactgctctgttatgatggaatcttccccacctcccaatccaatggtgtcttcatctctcctccaacccctaacccagggcttctcagctggaatgcactttagaattgctgagcaagcttcagttacaggcacccaagttctattctccatctactgaatcagaaactcacagggtgcagcacaggtaggtgcatttttaatagcaccccagagattctcaacctgattccacaaaaggacctgcagtgagtcgctctgagcggaaaacacctgatgctctcagtattgctcgtctcagctgaatttgtgtcttaacaagaatccaagcctagagttta

SEQ ID NO: 23770 - DNA, 535 bp, Homo sapiens
atggcactggctgcagttagagatgaattcagaattaggataagtttgttttctccccgagtatgagcatcaagcttctgtgtcaacttctcctcccaatgccatgctttccccactgtactgcagctggtgcatatgtagaaaaattgtatgtatcccagaaagcatcccctgattttgtaaactattctcattttgtcctgaagatcagggtcccagcttccccacacacatacctatgcatctgatcagaactgcaaatggaggtggtagagacttcaaggcagttactattgctagaagaggaactgccctctcccatttcactgccaggcttactttattcaggacactgaagtctggggacaggctgcagaagcaggctccagtctgtgatgatgtgtgcgtaaaagaatgtaatccacatgcagctggaagccggagcctgttcaggggcatggtgtctccacatgcgcctgccttatgtgctacaagcatcatggccaggccctggggcagcaggtgtgagctggaa

SEQ ID NO: 23771 - DNA, 369 bp, Homo sapiens
aggctgcctagaggatcccgacgtatggtgatccctgaagatcagggtcccagcttccccacacacatacctatgcatctgatcagaactgcaaatggaggtggtagagacttcaaggcagttactattgctagaagaggaactgccctctcccatttcactgccaggcttactttattcaggacactgaagtctggggacaggctgcagaagcaggctccagtctgtgatgatgtgtgcgtaaaagaatgtaatccacatgcagctggaagccggagcctgttcaggggcatggtgtctccacatgcgcctgccttatgtgctacaagcatcatggccaggccctggggcagcaggtgtgagctggaa

SEQ ID NO: 23772 - DNA, 566 bp, Homo sapiens
  misc_feature (40)..(40): n is a, c, g, or t
gcacaagaccgccaccgcgacgttccctcagaacaaacgncacccaaccacctagttaactttggggactcccagaagataaaataataagaaaaaaagctgaaatcctgccatttgaccagtgaacgttcctgatctagtggacttagaaaccttcccgagggacctgatgcaaatttgcaccaaagcagcagctgcatttccacagttctagcttcaccttcacaatgtttcccttgctcaaaaaggcactaagtcatctccaagtttgaagcacccagcgaacaacagcaaggcagagccaccagaagcatacacctgattttcatgacaaacacggtaacgctgtatgagctagtgaaaccactttctgtattgctgtacggatatgtatagcaacacaaactggaatagaatggaacatgtcccctgttggcagagtcaccccaaaggaatggagagataagtaggcatcccagctggtataacactgaattgttcagaaaacaactcataattgatgccaagtgaaagcactgtgtacccattaaaacattacattattg

SEQ ID NO: 23773 - DNA, 553 bp, Homo sapiens
agcaaggcaaatagtcaagacggagatgaacttctttggcagttaactttggggactcccagaagataaaataataagaaaaaaagctgaaatcctgccatttgaccagtgaacgttcctgatctagtggacttagaaaccttcccgagggacctgatgcaaatttgcaccaaagcagcagctgcatttccacagttctagcttcaccttcacaatgtttcccttgctcaaaaaggcactaagtcatctccaagtttgaagcacccagcgaacaacagcaaggcagagccaccagaagcatacacctgattttcatgacaaacacggtaacgctgtatgagctagtgaaaccactttctgtattgctgtacggatatgtatagcaacacaaactggaatagaatggaacatgtcccctgttggcagagtcaccccaaaggaatggagagataagtaggcatcccagctggtataacactgaattgttcagaaaacaactcataattgatgccaagtgaaagcactgtgtacccattaaaacattacattattg

SEQ ID NO: 23774 - DNA, 505 bp, Homo sapiens
tcccagctactcgggaggctgaggcaggagaatggcgtgaacccgggaggcggagcttgcagtgagccaagatggcgcccctgcactccagcctgggtgacagagcgagactccgtctcaaaaaaaaaaaaaaaaaagaaaacgaaaaccaatcattgacctgaaaattgtgtaattgaatttaaaaattaatctcaggtacagatacctatttagatttaaatgttgtttgatattttatgtccacaaagcaaatacttaatgagtcctaaaatgcatctctagaaagctttagaaaataaagcttaactttgcagtctaaaccactattgaattaatcttatttatttgttatatagatttcaaaggatcagaaaataggactcaggctgggtgcagtcgtcccgcctataatcgcaacacttagcaaggccgaggtggacgatcacctgaggtcaggagttggagaccagcctggccaacatggtgaaaccccgtctctact

SEQ ID NO: 23775 - DNA, 458 bp, Homo sapiens
ggcttacactgctactggctatttactaaaaatcagagcaaactttgccttattattatgtattgcatatatatttttgaaaggtcactcttgcagttttactaaaaaaaaaataaataaaagtttcagtgaattccggaagtttgggaattctcggtttacgctagccctgtcctgtgtttctgtttggctctgtcctcaggccttgccaccattttctctcggtgaaagaacttggcttcacattctgttcagtttcatgaacctgcctgtcactttgaggcagcgtttgggattctgcttcattagcctttgaactcatgaaccaagttgagaggatttgctactatagacaattatttgatcttcgagatattttgaacagttcccaagtgcaacaccagtggttgtccaaaagacacagagaagtgatgtgaaattttaattatgtaaaaaaa

SEQ ID NO: 23776 - DNA, 421 bp, Homo sapiens
gtatttgtaatttgttccctttcactctgctcaactaaaacaaggatgaaaaacatttttccattaaagattattaattttaaaaattaattgagtcagaaaaaataaatgcaaattaattttattttattttaaaattattttaatcttttgctttaaagaaaacactgagtttatgggtcactttacaagtgaaataagaacacagatttgggggtaataaacataatttagcaccaaatatatttgttctaatttatttcacagttcaaaaacaaagtgtaagagtagaaaaaggaaagaaagaagaaaggagagagagagaagtacagaaaaagttacaataatcaaaataaaaatcaagagaaaagggaaaagaaagactagcagagacataaatggaaagatagtcgtatgactt

SEQ ID NO: 23777 - DNA, 213 bp, Homo sapiens
acacaaaaatgtatttattgactcaaataatttggaaaaccagggcttatcagtccagctttagatatgactagatttagaagttcaaaataattttctctgcttactaaacttgaagttggctgcattattgggcaggctctccccacaatgtggcaaaaatgaccagcagcagttcctagtttatgttgtactggcagctggaatttctag

SEQ ID NO: 23778 - DNA, 581 bp, Homo sapiens
acaaaactgcaatattaatagatttacatacattgataaattgataaatataattttgcttatcaacaagaaattaagaattactggtacgatttggtaatgctgtcacccaccgctgtcattctttttacgtcctctaaaaagtatatgccgtataatatttttgtgcattatttcctctgatttctgatggttggaggactatgactggtctaaaattgttaggcaatgcagagatttcttgtggttattcattattttaatttttcagactatgagattcagaaattattctcattataatccatgcaaaaaggagaggtttaaatacgcagctaaagctaatcaggtataggaacaataaataatactctgctaaacaatagtcttaacagttcctaagttttaaaaaactgacactttgcttgcatttacatgttaatttatttgcttttgctgcagcagcttgactgctctttatcagtgctcaagtaaagtaaattttgttgtggtcctttaagattagagtagagcagggtaaaatgtctgattaatttatgcatattagcacagccgacttt

SEQ ID NO: 23779 - DNA, 394 bp, Homo sapiens
gaaatataagtaaatatataccatttgaatcttagtcattattttctccaatatatatacatcatttaagaattatttttaaggaatctattttaatattctcacgttctaaaaacttgtcttcaaattgaccctttccaaagtcattttggggacatgtatcatgcagcacaacttactgacatttagcttccttcttgtgaaaggattatctcttaagtattttggtatggcaattatatgaaagtttaattcactcctaacatgtcagttgcattagacacttaagaatgttgttggttgcaggtggctcgagtcttttattatctttgtgtcattgcactgcagtatgtggcgcctctggtaatgctgcttcacacaactctgcttttga

SEQ ID NO: 23780 - DNA, 470 bp, Homo sapiens
gattaggagactgttacctacaaaaccaccacaaagggtctttgttggtcaactcattcaagaggcttcgagatctttaataaggacaataagccaggctcagggccttaaatccacagcaacatagtatagtatgctggtctaaatgttttttttttttaattcatcctcttaatgtaattggcaggctttccctttacaatgaaattatctagaaattaggaggcagactaatatgtagttagggttgatttagatttcgagccatctaaggacagaaaactcccagtgttcagactggaatggtgagctgggattaaatttttgaattcccagtgggccaagtagagattcagatctgaatgccactaacccctgtgtgaaaggaaacccccatgtcagcaacctggagtcagcagtacccgaagagaggccttcacaaaggtgcctagggatcttctcggtcccca

SEQ ID NO: 23781 - DNA, 395 bp, Homo sapiens
ctttcttaaactatacagtcatgcactgtataacaatgttttggtcaactataagccacatgtatgatagtagtaccataagattataacactgtatttttactgtaacttttctatgtctagatgcacaaatacttaccactgtgttacagttgcctacaatattcaatacagtaacatgctgtaaatgtttatagcctaggagcaataggccagaccatataacctatctgtgtagtaggctatactatctaagtttgtgtaagtgcactctatgaggtttgcaacaatgatgaaattccctaatgacaccttgcttagactatatcccatcattgtgctatagcccatcgttctgaatacatgactgtattcagaaagaagaaagctcctaa

SEQ ID NO: 23782 - DNA, 423 bp, Homo sapiens
actttctgtcatgcaactatcttaccaatgtctacagtaggtactatttctctctcactaaatccaatcaccataatctcattgatgtcatggaccagtgtgatatctcttgaaagggaaaaatgatcaagatcccactgggtgcagtggctcatgcctgtaatcccagcactttgggaggccagtgcgggaggattgcttgagcccaggagtttaaaaccagcctgggtaatgtattgagaccctgtttctacaaaaaaatttttaaaaattagccacatgtggtgatacatgcctggagtcctagctactcgggaagctgaagtgggaagattgtttgagcgtgggacgttggggctgcaatgtgctctgatcgtgccactgcacttcagcctgggcaagagaatgagaccctgtctcaaa

SEQ ID NO: 23783 - DNA, 4668 bp, Homo sapiens
  misc_feature (1)..(1): n is a, c, g, or t
  misc_feature (1501)..(1501): n is a, c, g, or t
ngtaaaattgctgagtactttacagacatcatctcatttaatcctcacaaaagccctgtgaggtcagtactgttgttatccccattttactgatgtggaaatggtctcataaagaggttaaagaatttgtcctactcatttgtagaggtagagctaattcagacatgagcctggctgactgtaaggtttgtgctttttatccatataataatctccaaccaaagagaaatgaaaaaccaccatacggacacaaagagcagctcgcccagcttcttactctgggaaaccagattgattttgaggtggggagaagcctggataaagtcccatacacttagatctctaggccataaagattcattccacagcattcaattagaataatgtaaatatgtaaaacccagtgcctggtatatcataattatttagtaagtgggagtgaactattacaataattctacgactaagccagaaattaggttcctgttcataaaataggaaaagaaaaaaattcccatagtcccacaatcccttacttgaaactcttggagtcatgtgagttttgttttagaattatagcaaggtaatatgtatatttaccatatgctatgtaacatccccagcagagaccagggcagccccctgtaatcaaaacaccaacaatttctgcaatgaaatatatgaatattcacactaagcagaagaaatgaagactatagccttaaatcagttcaggtaaagttttgctgccaaatgagtgaagaaaaactcttttgcatttcagagcttattgtataagagttgaagggaagggattgtgtacttgtaaagcatacaacaacatttcaaggagaataaagaagcaattactttactaagttgaatagacaagtgatagttctgttcaaaagagactgttaatcctaagtcaaagcatgaagtctttttggcctctgatttcaaatgctaataattacatccaaagagagaaaacaagcatctcttattttatcttctttcaaataagtatgcgtcactttaaatgaagttggggactaaaatcaagtactatattttttttctagaggatctgtgtttatcaaagaaaacacaagaagctaaatccatttgaattgggttttttttttgtagattcctttttgtaatagaatctcatttttttaaaatgagaatggaaaaatgatattctgtatggtggtctttaagtgctgaaggatccacagagtcttctgaactttgaaagaaactaagtttggccactcctgagcaaaagtaatctagaaaaagcgataagtatataaggtgatggatatgttaattagcttgatttaatcattgcacaatgtatacatttatcgaaatatgttgtatatcataaatctataaaatttttatcaattaaaccttaataaatttggaggagaaaaggaaatctaccttccatccttccgtaaaaggaattgaataattctaaaggaanggaatttcaaattttaggaagataagcaattatagttgatggcagtacctgttgtagataaaactgaagcagaataattaaacacctgcttctttatctctaccctcttcatgtcctagcttccttccctactggtttatattccaccgtacatgattacacatcctcagcttcctcgttcttccttcctctattgaatttgaccccacccctggtcaaatccaactgttcatttgctctgcattggcccttgagtagctgaacatggttggagtaaatggatgaccatgttggtctggcttgaattttaaattaatgatcactaatcccaagttggcccttagggctgcttgacagttccccttcatttccttagtccattcattcttttccatcacctaaacaattatttcacaccttctcttgtctctatgcctctggtatcctcacgcagtgtcagctgatgacctttcctttttactttcactgagaatagacacagtcgtgaaagaacttccacatgatcgcctaccccttaacctgcatgcatttgtatgcatgtactctgcctatcctcctgttagaattggccaagcagcagtggtctctgaagtcagcctttctacttctgctttgatctccacctctcttaccttcttccccattaaatcaatttctaggagttgttccttaataggtagttgagattgagaaccactctgctagaatgtaaactccacagaccaaagatttgttctcttgctcattgctgtattctcaatgcctgtaacaatacataatccaatagtaggcactcagtcttgtgtttaatggatagatgagtgaatggataaatgaacaaatgaatctttctggtaaaaaagatataaattgcagtacaagctctgaagagcttaataaataatctttccttgtgttttatgatcaaattggagctaaactgttcatcttacaatgttcatttaaagagttttctgctgatttactgtaactatcctcacctgaaaacttttcctagcatttttatgcacacagtcctagttatctggatttttgttgttgttgttgttattgggaactgagatttttctgatttctaagtggttaagctttgcttttcaaatgaatttctctggtggcagtttcacaagtgaatagatctgtacaaatccagaactgttcattttactcattactgctacttggaagacctgagttcaactgcctgctccatcactttttctcactgaagtgaatctgggcatgattcttgtattgagaaatgcctagtatagtctcaatataattgattgcatttctttcattaaaatcaggggaaacatgtttgtttccttgacacctgtgtttcatgaaaaatcgtagaaaacagccacatgtattttaatttagttctatatctcttttcccttaatcctaatttgtagaagtgtggctgttcaaacagactctcatgtattttgaaatacatgcagtgcggtttttgtatgggagcaagtactatggattttcttgggctataacttagtagcatggcagtaggttatagaaccagtccatgaatcctgcagttcttactaatgtgagtcaaatggtattatggtaaagatacctcgctgcttttttggtggctgtgtttttatttgtaggacaaccctaaaatagaactcagctaggtcatttctaaacgtaatgttgtggtggataccccagaacaaacaccattaatgtggttagtcatttacttggaaagctattgccagggcaaactcagagccactagagacagaaagcacataagtaaacctgcttgttaaagtggagatacagagtaactcagcaatgtaataatacgaagtaatggttaagtattcagtttatagaaatttgactcagatgtttcaataaaatatctgtttttgtaaatcaaaagataactaccttcattggtatttgggaccaaagtttttcctccttcactttctgcccttttggaagacacagtaaaaatagaattcatgaaacatttctaaataatgggtgtatagagattctctttatgtgtggtatcagtgctctgctatgtaattatttgttatattttaaatttcaatttatgtgttctctcttgcccccttcagccccgtgccacataatttttgtttttggtggaaccattcagccttaaatacttttagtatatatcgtctgagaatagggacataactccaaaactactatcacacccaagaaatttgactttgattcagtgccatctaatatataacccatattcaaattttctcagttgtcccccaaataactggattttctaattttctttgatccagcatctaataaaagttcatatgttacatttagttgttttgtttcttcatctttctttaatctaaaacagttcccatgccctccctttaaaaataaaaataatctatcttgacatttctggagtctagaccagttattttatgaaatgttcctcattcttgatttgtctgattattttcttactgttaattttaggttaaatctttctggttaccatatagagtctgattattttttaagaagtgtagtattcagttatagagaatcttgacttgttctgcctgcttgcacctgcttttcttagagtcctaacctctcaactcaggtgcaaggaagcagagtttgactacttttgtgggtactgaagacctagcttattgtaacaacaaaaaaaaatgtggttttatttttagtaaaaatcagtgtccaatatgcgctctaaatataatctggttatttttgaaatttatgttaagaagtaagaatttggctgggcgcggtggctcacatctgtaatcctggcacttcaggaggccgagacaggcggattgcctgagttccggagtttgagactagcctaggcaacatggtgaaaccctgtctctactaaaatacaaaaaaaatcagccaggtgtggtggtgggcgcctgtaatctcagctatcaggagtctgaggcatgagaattgcttgaacctgggaggcggaggttgcagtgagctgagatcgtgccactgcactccagcttgcgcaacaaagcgaaactgtctcaaaaaaaaaa

SEQ ID NO: 23784 - DNA, 322 bp, Homo sapiens
tatatacatgacacatccttctccagttcattcatcctgctccctggaaagctgatgtgaaagctggacctccagcagccatctaggaacataaggataaggaatggcagaagggtgagctggaaggttcctgagttcctaatgactttgtggacccaccacaccgacattgggttacctacatccagacttcttttatgtgtgagaaaaattaacttgcttgagttactgttatttgaactctattttatctaatatcccctccaaactggtcatgtcttgcaagacaaggaacttggtcaataacatcaacattcactat

SEQ ID NO: 23785 - DNA, 161 bp, Homo sapiens
gactatgggagattataaagagtatgttgctactatttagcagcgactgatggttaccatcaaggaacatgtggccagggttagcagatgttccatgttttcaagagaagctctctgtttttaaatgttgtcagctagttcaaatttaaaaccttctggcc

SEQ ID NO: 23786 - DNA, 3215 bp, Homo sapiens
ggagatattacaggggacccagcccgcagcgacaggcacaaagtcacggggtaatgaacttcggggacccttcgccgctgcgtgcgcggctctccccggaaacccggacctggccgcctcttccctcggaagatttcccagcaatctagttttcccactctgcgcttgggttccggcagcgcggagcccgtctgcctctgagactgcggtagtgttttccttctttccttgggagaccagcggtcggcagagattgcccacactctgcatgcctatgtagagggagagatcgaagactgagtgacaggaatggggaaaaagagggatttcgctccgtaggaaggccattttcgtgtctccatctctgtctttcaacatccctctcttgctgttcttccttcttcctcagtcttcctgtccatctctccatctgtctgtccatgtgtgtgtccatatcaagcagcattcccagcagctgcggttttgcaagagccgggaagaaacttaaggatgcttaaatttccactgttggacgaattctgagcgcccagggagcagcgcagcgcgcgactgacacccacctgtcccgcccaggagccttgcaggctggagggcggctggagagcggcggcgcccggcggcgaggcgggcgctgccggccgggactcgggcagcgcccaccaaccgctccgccccgggacagccagcatgagcaagccagccggatcaacaagccgcattttagatatcccctgcaaagtgtgtggcgaccgcagctcggggaagcactacggggtctacgcctgcgacggctgctcaggttttttcaaacggagcatccgaaggaataggacctatgtctgcaaatctggaaaccagggaggctgtccggtggacaagacgcacagaaaccagtgcagggcgtgtcggctgaagaagtgtttggaagtcaacatgaacaaagacgccgtgcagcacgagcgggggcctcggacgtccaccatccgcaagcaagtggccctctacttccgtggacacaaggaggagaacggggccgccgcgcactttccctcggcggcgctccctgcgccggccttcttcaccgcggtcacgcagctggagccgcacggcctggagctggccgcggtgtccaccactccagagcggcagaccctcgtgagcctggctcagcccacgcccaagtacccccatgaagtgaatgggaccccaatgtatctctatgaagtggccacggagtcggtgtgtgaatcagctgccagacttctcttcatgagcatcaagtgggctaagagtgtgccagccttctccacgctgtctttgcaagaccagctgatgcttttggaagatgcttggagagaactgtttgttctaggaatagcacaatgggccattccggttgatgctaacactctactggctgtatctggcatgaacggtgacaacacagattcccagaagctgaacaagatcatatctgaaatacaggctttacaagaggtggtggctcgatttagacaactccggttagatgctactgaatttgcctgtctaaaatgcatcgtcactttcaaagccgttcctacacatagtggttctgaactgagaagtttccggaatgctgccgccattgcagcccttcaagatgaggctcagctaacgctcaacagctacatccataccagatatcccactcaaccctgtcgctttggaaaactcctgttgcttttgccagctttacgttctattagcccatcaactatagaagaagtgtttttcaaaaaaaccatcggcaatgtgccaattacaagactgctttcagatatgtacaaatccagtgatatctaagctcacaagatacccacttttcaggatgggacagtatcagatgaacttcaacccatggagaacaagcctcaactaacaaacccttcaggaagcatataccggggaatgtgtagccttcaggaaaaaaatgccaattgacacaaagcattccagtagctatgacctgccgccctgaccaggatagggcgggtgggaaggagaggggtgcaacaggaccgcctgcactgaaaactcactgctgccatgccctgggagggggcaaactgggggttgccacaggccgtgccattctgcctcttacctggaagatcaggctgaacgatcaaaagctgaaacataagtagtgctttctcttcctttttagcatacaaagtttggtaaccaaatatagctctgtgtataacatcgtactgcggccttcaaaactacgttatgttggagcatttattttaaaaataatggtaggttttaaattaaaagtgttatcaaaagtttcccctctattgtaatacattattaagtggccttcagaactgagttaataagtgaaaagtagcttatgccatgtgatttgctttttctctatcttcttttttcttttctttctctttcttttgttctttcttcttcttttttaataccataggccaggcaaccttgtcaaaggaattgatggacaaaatgagattctcaccaggacttcaggttggataacatgtcaaaaagagaagagctttactaaaagaacataagtcaagggaggatgaataaaaacagcaaaaccaaataaagtggagatgagtgattgagtgaggtagattgctgtcccgttaacatagtgctgaaaccaaaggcagtgggggtccaaactcgtggtgcagcaagtcacaccagacaggaaacgaatatggacgtaattgcagaaggaacttcaaggagatgaatgaatgctaaaagggttcttgactgatccattgctaacagcctgagactcttcaatgcctttccgaaaactggtttctagtaaagccttgaatgaacacacacacacacacacacacacacacacacacacacacacacacacaccgtcctacactttaagctgctcctttggtatgactctatacttatggaaatgtagaaacaaacatttttaaatagctgctgtacttttcacattttgatttattaggtactagcactgaggaaaaaaaattcagcacttggactatcataggatgagtaaaacttttcttgtacaaagtgaattaactgatttgtgaagttaaaaggttgtactcattgtatttacaaagaataaaaatatattgaatttaaatgaactc

SEQ ID NO: 23787 - DNA, 481 bp, Homo sapiens
ggctgaggtgagaggattgcttgagcccaggatgtcgaggctactgtgaaccatgatcacaccactgcactctagcctgggtgacagagcaagaatctgtatcaaaaaaaaaaaaaaaaaaaaaaaaaaaaaatggaaataggtacttatacattgtctgcttgctttttctctctccatctattagttttctcccttcttgctatataatggcatgctttacttggtgaggactaaggccacctttgttcttcaaggcctacatctggaggatctcactggcaatgatagtcttacttctctgccctcattctggctttagaattctggaaacagaaaatattgacccagtcttggtcaaatgctcccccttagaacaatcaactctggcaggcgcatggcatggtcatataaaaactttgtattccctgatataacaatatgattaggattagaaagccaatagtttccaggagaaaga

SEQ ID NO: 23788 - DNA, 517 bp, Homo sapiens
gagcaaaatcgtgtgtgtagaatccttctagatttctccaactgccctggtttatagctgtctgacccaaacctaatttagcaccttttttttttaaagcatttttctaaaagaaacttctctagagcagtgccgtgtgcttccgtggggccgagctctgtttccacggatgcgtgcggccacaccgtccgatggtggactccaagctccccagccaggagctgcctgcccggggtggccttcgtcgtgcagcccgagcctgggcgcccctggagctcctgctgtagcagctcttcagccttcaggaggctctcagccttggtttccgtttccgacacgggaggtttcccctccgtgttttgcaaaggcacatacgcctccagatcggtgaggatgaggctgctgtttactacactgtgtgttcactgatttcctacccttttagggtgattgccgcagattagccctgcaggttgtcagtccgtagggttaataagctagatatggatcgcgctaa

SEQ ID NO: 23789 - DNA, 304 bp, Homo sapiens
ttcactgtcagcgcaggctgagcctctgggactgcacccttctttgcactattacctccagttgctgaagaattgttcaggaacgttgaaacttggaaataaaaagggaaaagcaatgtaaatataggaaaaggctgactacgcattttatgaactcatagctaatatgctgcatgttcacagaaaggcagcaagccttgctaacatggaaatctccaaacatttctttgtaattctttgtaaacctttttaacttaatgtattgctaaactttgttaacctttacgacataactaggattcat

SEQ ID NO: 23790 - DNA, 423 bp, Homo sapiens
acaactctgaaggctataccaaatagtgtcctggagggcttgggtggcattggcccgttgtctacaatgataatctatctgctcatgaatgctaccactactgcttcttcttctctgtctgaattttccacttctctacaggtgatggccctcaaagcctgtctcaggatctgcttctggagcaaagaataaggacccaggttttgggattatgagattaggcacagatgtctgtaaaagtttgttgaaaggaattgaattatgtgaaatttaattgaattaaattaaattatcctgcaacctcaatctctttgggccaaatccaaatactcatgtgctgttatgagagctgggaaagaaggggtggggcatgttattattatcaatctgttgacaattaatttataaacaatcttaactagt

SEQ ID NO: 23791 - DNA, 354 bp, Homo sapiens
ttttttttgagacagggtctcactctgacacccaggctgaagtacagtggtgcgatcaaggctcactgcaccctccgcctaccaggctcaagtgatcctcccaccttggcctcctgagcagctgggattacagtcatgcaccatcacgcccagtgaattttttgtagagatggggtcttgccatgttgcccaggctggtctcgaactcctgagctcaaacaatctgcctgcctcagcttcccaaagtgctgcaattacaggcgtgagccacctcccctggccaataagtggcttcttacaggtacatcaaaagcatagaacccaaggttccccatgagcctgcttctggatgtt

SEQ ID NO: 23792 - DNA, 274 bp, Homo sapiens
accacttttaatatcttgggaaaaagtatctgaatgctattctgatctcaagtctggttttagggtttattgtagtagccatttagataaaatatctgtggtacggttcatttggattaagaacacatcagaatcagatcctttcattcaaaaatatttgtttacaggatagatcttcagtaaagagaatgcagcctgaatcattcaaatatatttatgagaaagaatataacttacctgagtaattcctggccagtcataaaatgctgaggag

SEQ ID NO: 23793 - DNA, 187 bp, Homo sapiens
ccggcccactgagcctcccagatgagaacctgcatttcaacaaggtccttgatgcagcaaagtttgagatatactgggctagaacactcaggggacacaaaggttctctgaaaactaaggaaaataggcagggtgtggtggctcatgcctgtaatccttgtattttgggatgccaaggcgggcggat

SEQ ID NO: 23794 - DNA, 405 bp, Homo sapiens
acacacacacacacacacacacacacagagcagaggaatcaggagccgccttccgcctttctgctcttcatcctagcaggcttttcctgctggccttgtttctgatgggccaattacagtgcaaaactgttccagacctgacctttcatcccggttccagtggcccgccaagaatcagccttgccttgttacacctccatcagcagcacagcccaaccgcagcttcatcacattaggatgtggcttcatcacattatgattttctctgagttggggagcaaaggtgagttggggagaccaggcagggttcctcacaaagttgcccaggaagggcaggaagacggggcagtgtccgagaggcagcatgacccaggggtcaggtgcggaggccctggagccaaactg

SEQ ID NO: 23795 - DNA, 1220 bp, Homo sapiens
tactatgtatatttactctgtggtatagtatactacttgtaaaacaaataacagcatcaaaacagtgaaatctccctagagacttttcaaagaaaaaaatgaatgtaatgtatctgttataactactctaaaaattttaggctttattttatagtgctataaaagctcttaagagtttattcaaataaaacatgaaatataaattatgtcatatatcctaagttttgaatttgtaacacaagcaaaatctgtttgtaatacatatgctgctgttagaaataggtgcataattggggtgagtatataagtgtgtatttatgcataattatacactgttatatttggtattatgataactattgttataactggttatgataaaatctggtatactagatactggtataactggtattttgttatgatatcccaggcagatgaatacagccccccactaaattccatgaggtgtaaagtggcggttggctctcaacaaagggtgatgctgtcctccctcctccccgccaagacatgtctcaatatctggagacattttggtttatcagaactgagggtaggggtaatataggcatttagtggttgtaagttaaggatgctgctaaacatagtacaatgcacaggacaactcccacaacaaaaatatatctagcccaaaatgtcagtagtgctgaggttgagaaattgtgaacatctttttaggatgtatgtgctcttgtaagctaacccaagtcctttacggaaacaagtgagttatcaggaaatatacatttaagagcaacaatatacttcgtgttagatgcagttattttcagtacttgcaaaagccagtaaactgtgattcttagagtgaatcaaactcatatctaccaaatgaaaacataaccctgaagtatatatgtgtgcatgcatatttatatttgtatgtatgtgaagtataattttctcttaaaatcattcaccttataagctgccataaattttctaacactagatacttgtaatttttaaataaatattttatatacgtgtatgtgtttgtgtgtgtgtgtttattcacccaggcattagaattgataactaaaaagcatggcagagccataaaaaacattttttgcaagtgtgaaataatatggcttgactgccaatgttactatttttggcaaaaattttctgaaatatttgtatcatcttagctgaaa

SEQ ID NO: 23796 - DNA, 347 bp, Homo sapiens
tagttggtgaactgcagtaaagttggtagggataaatctggcagattaaatacgaactatttcaagaacagccttaaatgacaacttgacctaggagataaacaatttttttttttttttttttttttttttttggagatggagtctcactctgtcaccaggctggagtgcaatggtatgatctcggctcaccgaaacctccacctcccaggttcaagcgattgtcctgcttcagcctcccaagtagctgggactacaggcgtgcaccaccatgcccggctaatttttgtatttttagtagagatgggatttcactatgttggccaggctggtctcgaactcctgac

SEQ ID NO: 23797 - DNA, 485 bp, Homo sapiens
aacagagtgaaatttatagcattaaagcctgtgttagaaaagacaaaaaagatctcagattagtgggctcaactaccaccttaggaaactggaaaagaaaaaaagacccaattaaacccaaagtaagcaaaataaaggatataacaatgagaatagagatcagcaaactagaaaatagaataatttaaaaaaactaaccaaaaactagttatttgagaatgtcagtaaaatggttaagcctctagccagactgatcagaaagagaagacacaaattttcagtatcagtaatatgagaggtggcatcagtacagattcaacccatattagaaggaatatttttaaaaactatatatgggctgggtgtggtggctcacgcctgtaatcccagtgctttgtgggggccaaagcaggagaatcacttgacaccaagagttgaagaccagcctgggtatcatagtaagactccatctcttacaaaaaaaa

SEQ ID NO: 23798 - DNA, 433 bp, Homo sapiens
gacatttttgtaaagttgcttaacctgtccatgcctcaccttttaaactctttgaaaaatgagtacttgtgtttgtcaagaagattaaatgagataatatatataaagtacatagcatattatttggtacataataaggtcttggtaaacattagctgttgcttctgccattgctcttttaaacaggcttagggtccagacctatagtcaggagttcaaaagaagggatttcttgtttaactttccaaggttcttctattaggcacactttctttctctcttaatcctatagtggtgtcattcttatgctacctttactattttgcatttagactgcaaaatagacacccagcaacccattttaatcttgccatattttaaaatttgttggcacattataaccagagctcactaagctcttcattcattcact

SEQ ID NO: 23799 - DNA, 439 bp, Homo sapiens
tgcccttgccgaggctgcctggtggagggagtccgcctggagcagacagcaaggaagaaagccaagctgagagctgcggggaggcggattccccatgctgtcgtacctgagcacctggatccaaccctgcctgaagctagacctggggcttaatgtttaacaaattaccaagtccatcttctttcctaaagcccatacaagatgcatttttataactggagtgggaaaaatcctgccaggtgagactctgcccaggctggcatcctctacctcagggaagaacgggtcactcctgcccaagggaggtctgtggctctgactaatgaaaagtggggaagttagaagattttctgatagataatagtgtgtttgtcacggttgcggcaggaaaggcatctcccaacactgcaagctctggagagaggaaggtgctgtcctt

SEQ ID NO: 23800 - DNA, 667 bp, Homo sapiens
cgagacagggtctcactctgtcacccaggctggagtgcagtggcgtgatctcagctcactgcaacctccacctcctgggttcaagcgattctcccgcctcagcctcccaagtagctgggactacaggtgcacaccaccacgcgtagctaattcaagtgtccctttatgaagcccacgtaacaaacccacaggctcagactgctagacataaggtttcttccttcttctggaattcaaggagtttctttggaaagcatgctccatgcatcacacattccttttgggggctgctgtatacagaaaattctgacttcagaattcaacgtcagaaaccaagcaagggcacctgctgcccgaaggatagtcacgtacacttccatcttaggaaactgctaatagacacaggggctccacccgggggaagccaccgtgagtcacaggcctacgcatccggtactactgggcccaaaatatctgattgcgtctggggaagcgacagccaagcccttaggcagaatcctgggtgtgctgcttgaaatcctcaaatgaagccggccacagacaagacgtggcaggagggccacgaaaccaacacgccctgacaatgccaagaataaacattctgcagactgaaaaatgcccctgaaaatactggggcacagtgggc

SEQ ID NO: 23801 - DNA, 613 bp, Homo sapiens
cgagacagggtctcactctgtcacccaggctggagtgcagtggcgtgatctcagctcactgcaacctccacctcctgggttcaagcgattctcccgcctcagcctcccaagtagctgggactacaggtgcacaccaccacgcgtagctaattcaagtgtccctttatgaagcccacgtaacaaacccacaggctcagactgctagacataaggtttcttccttcttttgggggctgctgtatacagaaaattctgacttcagaattcaacgtcagaaaccaagcaagggcacctgctgcccgaaggatagtcacgtacacttccatcttaggaaactgctaatagacacaggggctccacccgggggaagccaccgtgagtcacaggcctacgcatccggtactactgggcccaaaatatctgattgcgtctggggaagcgacagccaagcccttaggcagaatcctgggtgtgctgcttgaaatcctcaaatgaagccggccacagacaagacgtggcaggagggccacgaaaccaacacgccctgacaatgccaagaataaacattctgcagactgaaaaatgcccctgaaaatactggggcacagtgggc

SEQ ID NO: 23802 - DNA, 368 bp, Homo sapiens
ggttgatgaagaaattcagaaggaaatttgacgatttcttgaaacaaatgcaaatggaaatacaacataccaaaatctataggacacagcaaaagcagttgtaagagggaagcttgtagcaatgaacacctatatcaaaaatgtagaaagactgaacgatctaatgaggcatctcaaagaaccaggaaaacccagacaaaccaaatccaaaatgagtaggaggaaagaagtaataaatatcagagcacaaataaatgaaaaggaaatgtaaaaaacaatacaggccaggcacagtagttcacccctgtaatcccagcacttttgaggctgaggcaggtggatcacttgagcccaggagttcaaaacca

SEQ ID NO: 23803 - DNA, 537 bp, Homo sapiens
aaaagctggaagatggccctactttcttgaagtctggtgatgctgccatcgttgatatggttcctggcaagcccatgtgtgttgagagcttctcagtctacccacctctgagtcgctttgctgtttgtgatatgagacagacagttgctgtgggtgtcatcgaagcaatggacaagaaggctgctggagctggcaaggtcaccaagtctacccagaaagctcagaaggctaaatgaacattatccctaatacctgtcacccaagtcttaatcagtggtggaagaacagtctcagaactgtttgtttcaattggccatttaagtttaatagtaaatgactggttaatgataacaatgcatcataaaaccttcagaaggaaaggagaatgttttgtggaccactttggtttttttttatatgtgtgtggccattttaagtcattagtttttaaaattagtactttttaatggaaacaacttgaccaaaaatctgtcacagaattttgagacccattaaaatgaagtttactaagaaata

SEQ ID NO: 23804 - DNA, 340 bp, Homo sapiens
taattgatggggtttcaaccatgttgcctatgttgagttttctcaaacttctgggctcaagtgatccacttgcctcagcctcccagtgttgtgattacaggcatgagccactatgcctggccccaaagcaatattaatggaaataaaaataacagtttattttcataaattaaaacaccctccttaaatcttgccttcccctccccccaaattactaaatcactatttatatgtagaaaaaggtagacttatacgcctttaggtcacagtatatgggccaaacttaaggccagttttttattatgaatctggagtgaaggtttgatttcaccagagttac

SEQ ID NO: 23805 - DNA, 1706 bp, Homo sapiens
cataccctgaattttttttaattgagaaaagtaatagaattttaaatatagaaatatgagaattttaaagtaatatattgattaaagatcactgatgatatagatataatatatcataacagaaggaaagtaaatggacttgagcttaacttctcaccctggaattattagtgggtgaagaggggaatcattagcattctgggcgtttttatattaaatgttttgtgaatatgccagaagatctgccttcaacttgtaattaggcaagatagtaatgcttgatggtaacttctatgtttgtgtagaaataataccagttagttttggaaagccattcagatccattcaaaaattccataaagtatgatgtatgctttggaagagggatatgagtgatacaattgttatataaatggaatagacaaaccatttgaatgcatttttctagggcaaacattttttgagatttttgagttaagaagatttttcggcttgagcagaagatgtgtttgttttgcatttttcagctccaaggaaatagcccccatggctttaaaaggccctgaagttcagatagtagtaggtagtgttttgttattgttttaatttgagagttgcaggaataatgggcagagctgtcatttgccggtaggctaccatctgcctacatagaattattggactgtaagctaaaacagactgtaaaagacctacttgctaaagcattgcttattcagtggtattcagtagataagatctatttcctgatatattgtgctcaagttatttgcacatcttaagaaacttttaatatctaaaaccattgttgtaagatttaggtagaggaggtttccttttgtgtgatgcataataatagaaaacactgatacagtgtttactatgtgccaagcaagcatatgataactaattcttaacaactctatgaggcagggtcatttattatcctgttgtcatatgaggaaatctcgccagagagaagttaattaacctgcccaaggtcgtatagttagtaaagtggtcatgcttggattttaacctaggcagattacttcagagtcagcgtctgccttactatcctgtttcctgagcaggaatttccccttgtgtcaggcaacactaggtgttaggagtggaggtgtgcagatgttgccttacattctgttttcctgatgtggtgtgcttcctaagagtacaaacctgagcatatgtccaggcttgcaaagtctcaggcaaagctgggactaaggcttgtgtttcctgccttgggtaggattttcttctatgcatgttgggtgcttctcacttaacctaatagtatgccttgtctgttttccccccttcccctttttgtttaaattgattcacagaacacaaaaatttactaggtatgaacatttgaaaaaatggaatagagaaaatggtacatcacatgtaataaagataaatattgttttgtgaaatgtctttttcaatcataaatatgtgttgtgtgctatataaaactatttcttattgtggatattgaagtttgaagcctgttgttcatctatagatgcactggatgggattggaagtcttcagatttcagtagggttttccacaagcttatgaagacattgttctgtttaggctgtaaactgtttttatttcttgatgaaaaatgttcttctatttatatgatccca

SEQ ID NO: 23806 - DNA, 1479 bp, Homo sapiens
cataccctgaattttttttaattgagaaaagtaatagaattttaaatatagaaatatgagaattttaaagtaatatattgattaaagatcactgatgatatagatataatatatcataacagaaggaaagtaaatggacttgagcttaacttctcaccctggaattattagtgggtgaagaggggaatcattagcattctgggcgtttttatattaaatgttttgtgaatatgccagaagatctgccttcaacttgtaattaggcaagatagtaatgcttgatggtaacttctatgtttgtgtagaaataataccagttagttttggaaagccattcagatccattcaaaaattccataaagtatgatgtatgctttggaagagggatatgagtgatacaattgttatataaatggaatagacaaaccatttgaatgcatttttctagggcaaacattttttgagatttttgagttaagaagatttttcggcttgagcagaagatgtgtttgttttgcatttttcagctccaaggaaatagcccccatggctttaaaaggccctgaagttcagatagtagtaggtagtgttttgttattgttttaatttgagagttgcaggaataatgggcagagctgtcatttgccggtaggctaccatctgcctacatagaattattggactgtaagctaaaacagactgtaaaagacctacttgctaaagcattgcttattcagtggtattcagtagataagatctatttcctgatatattgtgctcaagttatttgcacatcttaagaaacttttaatatctaaaaccattgttgtaagatttaggtagaggaggtttccttttgtgtgatgcataataatagaaaacactgatacagtgtttactatgtgccaagcaagcatatgataactaattcttaacaactctatgaggcagggtcatttattatcctgttgtcatatgaggaaatctcgccagagagaagttaattaacctgcccaaggtcgtatagttagtaaagtggtcatgcttggattttaacctaggcagattacttcagagtcagcgtctgccttactatcctgtttcctgagcaggaatttccccttgtgtcaggcaacactaggtgttaggagtggaggtgtgcagatgttgccttacattctgttttcctgatgtggtgtgcttcctaagagtacaaacctgagcatatgtccaggcttgcaaagtctcaggcaaagctgggactaaggcttgtgtttcctgccttgggtaggattttcttctatgcatgttgggtgcttctcacttaacctaatagtatgccttgtctgttttccccccttcccctttttgtttaaattgattcacagaacacaaaaatttactaggtatgaacatttgaaaaaatggaatagagaaaatggtacatcacatgtaataaagataaatattgttttgtga

SEQ ID NO: 23807 - DNA, 114 bp, Homo sapiens
attcaccactcaccagtccttcagatcatcatcccccagccatgtatgtgcccatcctttttatagtctccctgcaaagctctcccatcttcaggtcctggatcttgcctttac

SEQ ID NO: 23808 - DNA, 344 bp, Homo sapiens
cctaactcttgagagaaagctagacatctagttccaggaagatcaaagaaccccagatacattcaacccagacattatagtcaaattgtgaaaaatcaaagacaaagatattttaaaatagcaagagaaaagtaacacacttataatggaatccccattagactaacagctgatttcccagcagaaaccttaggctagaagagaatgggatgatatattcgaagttctgaaagaaaaaaaatctttcggccaagaatattatacccagcacagctatccgttacaaatgaagacataaaatctgtcacagataaacaaaaaccaagataattcatcaccactag

SEQ ID NO: 23809 - DNA, 532 bp, Homo sapiens
tggtttttttaaatggatgttcagagcagcaccagtcacgagatcaaaatgataaggaaaaaccttaatggtcatttcttcatggcttaaatttctgggtatctctttttctacaatggcatctagtctaacagtatgtgtaaagttcccatatatataccactgagaaactcttgcaactaacatttgtaaacatgacaatttcctactagagggatctggaagtcaggaaagccaagaagagttaaacaaacagtgagatgtagtaagtcaattaaaatatgtgcattatattggctcaagaaaatgtgtatgcgtaacaaagtgaacaaaaagaaagtaaaaaagcagaacaggccaggtgcggtggctcatgcctataatcccagcactttgggaggccaaggtggtcagatcatgaggtcaggagtttgagaccagcctggccaatatggtgaaaccccgtctctactaaaaatacaaaaaaactagccaggtgtggtggcatgcgcctgtgtcccagctacttggg

SEQ ID NO: 23810 - DNA, 3094 bp, Homo sapiens
caggaaccacctactacagactcccaggaggcccagagtcctggtcattccagtgcagggcaagagggtgaggatacactgaggaggcgactgctggccccagaggctggaagtcatccacaacaaacacaaaaattggaagaaattaaagagaatgcacaggacaccatgagacagattaataaaaagggtttttggagctatggccctgtgattcttgtcgtcctggttgtggctgttgtggcaagttctgtgaatagctactattcctctccagcccagcaagtgcccaaaaatccagctttggaggcctttttggcccagtttagccaattggaagataaatttccaggccagagttccttcctgtggcagagaggacggaagtttctccagaagcacctcaatgcttccaaccccactgagccagccaccatcatatttacagcagctcgggagggaagagagaccctgaagtgcctgagccaccatgttgcagatgcctacacctcttcccagaaagtctctcccattcagattgatggggctggaaggacctggcaggacagtgacacggtcaagctgttggttgacctggagctgagctatgggtttgagaatggccagaaggctgctgtggtacaccacttcgaatccttccctgccggctccactttgatcttctataagtattgtgatcatgagaatgctgcctttaaagatgtggccctggtcctgactgttctgctagaggaggaaacattagaagcaagtgtaggcccaagggaaacggaagaaaaagtgagagacttactctgggccaagtttaccaactctgacactcccacctccttcaaccacatggactcagacaaattgagtgggctgtggagccgaatttcacacctggtactgccagtccagccagtgagtagcatagaagaacaggggtgccttttctaaagctaagcacagagttggttacagaaggtatatgtttatgaaaaagtttgtttaaagaccttccatttatatggaaggaggttgataaaatagcttgaggaaatagcctgaaaaacaaagatgagcttattttagaaacaagtttttattttttattccttgtaaaatctttctaatctaagccttgacaaagctaaaaattaacctgactttttttctttggaccaaatcaggtttgaaatatcgatgatatatatgagaattttttttaaattctaaaatatagcaacattgcacaggaagatactcttacttcttagagtaactacagagtgatttttttttttcttgagtgagactctgaagaaccttttcgataatgtttggacttggactaaagcaattagaattatgaagcaatgataacctttagaaaatttttctatcacatgttgaatattttcaaaccttactttaataatctaaagttacgggattatatcttatattaattttgcagttttgagtagtatgataaaagaaataagaattcaaaccattaagtacctacctaaatactacatgtaaggcactgtgcttttatttcattcagctgaggtataagcagctgtactcaaatgttcttaaaaatgagaaccagtggggaaattgtttataatcattggaaatgaagaaattccaattggctatatctttacttcagcttttcttgaacaatttacagcattgattttcaaactgtgtctactggcacccttcccctttgtatcagagcagttctgcttttaactgttttatatgttggggttctctatgagatttcattggaacaaagagtttcactgatattcgagtttgaaaaccattgattaagtgaaaaaacatcttagaagataggaaatatgtttaaaaaatgaatgtattaaatcttatgagtaggaagatgaaatacaggtttattgtatagatacattatttatgaaggataaagatctatacatgaacagcagaatgtataagctagcatttactagcatgtctctgatgcttttgttcatttctgttaatcgtcatttctgtcccctctgcatggaattttatacttgtctagggtaagagtttgtagactctttcagcagaacagattttaataaccaatttatttgttttattttaaaaatttatttttgaataaccaatttaatagtaaattttatatgaacatttggcataactttaccagtttatttctatgcagtgatggaacattatgtaatgcagctcatttcttgaccaactagttatagaagtaccattaggttaaaaattagagaaatctaagagatgttatactcagtgagaggaagcagaaatggtgggtagattctcagaggttttgatgttcagtactgacggaccatgttctgtgattgtaagaaagattgaaaacagtttgtatggagatagagttgattagcatttgagctctgaaagcagaactctagtaaaatgatctcgacctaacaaagggtctgttccattatatagactattaccataatcctggattatttcaactgggttttggcctctccattatatgagatcatatgtatatagctaagaagtctgattaaagtatggaaagattttaggaaacactaagaagatacagggatctttactgatacctaaaaagattacaattgagtaattgctcaattgagtgtaggggcatacctgaaggaagaatttgcatttgggacttcgaaggaagcttccaagagatttgggaagagacctgaacaaaaagttaaagcatggtgaatgtgatatcactgtcaatccagtataaaagcagaggaagttgaaggaaaatctgtatcccatatgcacattttttctgtctttttagatcttagatgctagcgttacatccacaaaaccagtgttgccttgtataactattatattggcctgctgacctgtgctacctcagatctgtcaaggaaccagtatgtcgcatattcttgtttcttcattcagttgaatatggtttttcatcatttctcttcaaaataatttagaaaaataaatttctaaagtcata

SEQ ID NO: 23811 - DNA, 3112 bp, Homo sapiens
ctggccaaggtatagaaagccttttagtcaaatcattctttggtttggtgagagatataaaggtatacatactgtcattagtgtactgcctaaaaataatattgattcttttcctctccagaggctggaagtcatccacaacaaacacaaaaattggaagaaattaaagagaatgcacaggacaccatgagacagattaataaaaagggtttttggagctatggccctgtgattcttgtcgtcctggttgtggctgttgtggcaagttctgtgaatagctactattcctctccagcccagcaagtgcccaaaaatccagctttggaggcctttttggcccagtttagccaattggaagataaatttccaggccagagttccttcctgtggcagagaggacggaagtttctccagaagcacctcaatgcttccaaccccactgagccagccaccatcatatttacagcagctcgggagggaagagagaccctgaagtgcctgagccaccatgttgcagatgcctacacctcttcccagaaagtctctcccattcagattgatggggctggaaggacctggcaggacagtgacacggtcaagctgttggttgacctggagctgagctatgggtttgagaatggccagaaggctgctgtggtacaccacttcgaatccttccctgccggctccactttgatcttctataagtattgtgatcatgagaatgctgcctttaaagatgtggccctggtcctgactgttctgctagaggaggaaacattagaagcaagtgtaggcccaagggaaacggaagaaaaagtgagagacttactctgggccaagtttaccaactctgacactcccacctccttcaaccacatggactcagacaaattgagtgggctgtggagccgaatttcacacctggtactgccagtccagccagtgagtagcatagaagaacaggggtgccttttctaaagctaagcacagagttggttacagaaggtatatgtttatgaaaaagtttgtttaaagaccttccatttatatggaaggaggttgataaaatagcttgaggaaatagcctgaaaaacaaagatgagcttattttagaaacaagtttttattttttattccttgtaaaatctttctaatctaagccttgacaaagctaaaaattaacctgactttttttctttggaccaaatcaggtttgaaatatcgatgatatatatgagaattttttttaaattctaaaatatagcaacattgcacaggaagatactcttacttcttagagtaactacagagtgatttttttttttcttgagtgagactctgaagaaccttttcgataatgtttggacttggactaaagcaattagaattatgaagcaatgataacctttagaaaatttttctatcacatgttgaatattttcaaaccttactttaataatctaaagttacgggattatatcttatattaattttgcagttttgagtagtatgataaaagaaataagaattcaaaccattaagtacctacctaaatactacatgtaaggcactgtgcttttatttcattcagctgaggtataagcagctgtactcaaatgttcttaaaaatgagaaccagtggggaaattgtttataatcattggaaatgaagaaattccaattggctatatctttacttcagcttttcttgaacaatttacagcattgattttcaaactgtgtctactggcacccttcccctttgtatcagagcagttctgcttttaactgttttatatgttggggttctctatgagatttcattggaacaaagagtttcactgatattcgagtttgaaaaccattgattaagtgaaaaaacatcttagaagataggaaatatgtttaaaaaatgaatgtattaaatcttatgagtaggaagatgaaatacaggtttattgtatagatacattatttatgaaggataaagatctatacatgaacagcagaatgtataagctagcatttactagcatgtctctgatgcttttgttcatttctgttaatcgtcatttctgtcccctctgcatggaattttatacttgtctagggtaagagtttgtagactctttcagcagaacagattttaataaccaatttatttgttttattttaaaaatttatttttgaataaccaatttaatagtaaattttatatgaacatttggcataactttaccagtttatttctatgcagtgatggaacattatgtaatgcagctcatttcttgaccaactagttatagaagtaccattaggttaaaaattagagaaatctaagagatgttatactcagtgagaggaagcagaaatggtgggtagattctcagaggttttgatgttcagtactgacggaccatgttctgtgattgtaagaaagattgaaaacagtttgtatggagatagagttgattagcatttgagctctgaaagcagaactctagtaaaatgatctcgacctaacaaagggtctgttccattatatagactattaccataatcctggattatttcaactgggttttggcctctccattatatgagatcatatgtatatagctaagaagtctgattaaagtatggaaagattttaggaaacactaagaagatacagggatctttactgatacctaaaaagattacaattgagtaattgctcaattgagtgtaggggcatacctgaaggaagaatttgcatttgggacttcgaaggaagcttccaagagatttgggaagagacctgaacaaaaagttaaagcatggtgaatgtgatatcactgtcaatccagtataaaagcagaggaagttgaaggaaaatctgtatcccatatgcacattttttctgtctttttagatcttagatgctagcgttacatccacaaaaccagtgttgccttgtataactattatattggcctgctgacctgtgctacctcagatctgtcaaggaaccagtatgtcgcatattcttgtttcttcattcagttgaatatggtttttcatcatttctcttcaaaataatttagaaaaataaatttctaaagtcata

SEQ ID NO: 23812 - DNA, 3175 bp, Homo sapiens
caggaaccacctactacagactcccaggaggcccagagtcctggtcattccagtgcagggcaagagggtgaggatacactgaggaggcgactgctggccccagaggctggaagtcatccacaacaaacacaaaaattggaagaaattaaagagaatgcacaggacaccatgagacagattaataaaaagggtttttggagctatggccctgtgattcttgtcgtcctggttgtggctgttgtggcaagttctgtgaatagctactattcctctccagcccagcaagtgcccaaaaatccagctttggaggcctttttggcccagtttagccaattggaagataaatttccaggccagagttccttcctgtggcagagaggacggaagtttctccagaagcacctcaatgcttccaaccccactgagccagccaccatcatatttacagcagctcgggagggaagagagaccctgaagtgcctgagccaccatgttgcagatgcctacacctcttcccagaaagtctctcccattcagattgatggggctggaaggacctggcaggacagtgacacggtcaagctgttggttgacctggagctgagctatgggtttgagaatggccagaaggctgctgtggtacaccacttcgaatccttccctgccggctccactttgatcttctataagtattgtgatcatgagaatgctgcctttaaagatgtggccctggtcctgactgttctgctagaggaggaaacattagaagcaagtgtaggcccaagggaaacggaagaaaaagtgagagacttactctgggccaagtttaccaactctgacactcccacctccttcaaccacatggactcagacaaattgagtgggctgtggagccgaatttcacacctggtactgccagtccagccagtgagtagcatagaagaacaggggtgccttttctaaagctaagcacagagttggttacagaaggtatatgtttatgaaaaagtttgtttaaagaccttccatttatatggaaggaggttgataaaatagcttgaggaaatagcctgaaaaacaaagatgagcttattttagaaacaagtttttattttttattccttgtaaaatctttctaatctaagccttgacaaagctaaaaattaacctgactttttttctttggaccaaatcaggtttgaaatatcgatgatatatatgagaattttttttaaattctaaaatatagcaacattgcacaggaagatactcttacttcttagagtaactacagagtgatttttttttttcttgagtgagactctgaagaaccttttcgataatgtttggacttggactaaagcaattagaattatgaagcaatgataacctttagaaaatttttctatcacatgttgaatattttcaaaccttactttaataatctaaagttacgggattatatcttatattaattttgcagttttgagtagtatgataaaagaaataagaattcaaaccattaagtacctacctaaatactacatgtaaggcactgtgcttttatttcattcagctgaggtataagcagctgtactcaaatgttcttaaaaatgagaaccagtggggaaattgtttataatcattggaaatgaagaaattccaattggctatatctttacttcagcttttcttgaacaatttacagcattgattttcaaactgtgtctactggcacccttcccctttgtatcagagcagttctgcttttaactgttttatatgttggggttctctatgagatttcattggaacaaagagtttcactgatattcgagtttgaaaaccattgattaagtgaaaaaacatcttagaagataggaaatatgtttaaaaaatgaatgtattaaatcttatgagtaggaagatgaaatacaggtttattgtatagatacattatttatgaaggataaagatctatacatgaacagcagaatgtataagctagcatttactagcatgtctctgatgcttttgttcatttctgttaatcgtcatttctgtcccctctgcatggaattttatacttgtctagggtaagagtttgtagactctttcagcagaacagattttaataaccaatttatttgttttattttaaaaatttatttttgaataaccaatttaatagtaaattttatatgaacatttggcataactttaccagtttatttctatgcagtgatggaacattatgtaatgcagctcatttcttgaccaactagttatagaagtaccattaggttaaaaattagagaaatctaagagatgttatactcagtgagaggaagcagaaatggtgggtagattctcagaggttttgatgttcagtactgacggaccatgttctgtgattgtaagaaagattgaaaacagtttgtatggagatagagttgattagcatttgagctctgaaagcagaactctagtaaaatgatctcgacctaacaaagggtctgttccattatatagactattaccataatcctggattatttcaactgggttttggcctctccattatatgagatcatatgtatatagctaagaagtctgattaaagtatggaaagattttaggaaacactaagaagatacagggatctttactgatacctaaaaagattacaattgagtaattgctcaattgagtgtaggggcatacctgaaggaagaatttgcatttgggacttcgaaggaagcttccaagagatttgggaagagacctgaacaaaaagttaaagcatggtgaatgtgatatcactgtcaatccagtataaaagcagaggaagttgaaggaaaatctgtatcccatatgcacattttttctgtctttttagatcttagatgctagcgttacatccacaaaaccagtgttgccttgtataactattatattggcctgctgacctgtgctacctcagatctgtcaaggaaccagtatgtcgcatattcttgtttcttcattcagttgaatatggtttttcatcatttctcttcaaaataatttagaaaaataaatttctaaagtcataatttttaatttagcctttttaaaaacattttcccttctatgtatagtgcaatcaattgaggatggtccgcacagtctgtct

SEQ ID NO: 23813 - DNA, 1122 bp, Homo sapiens
caggaaccacctactacagactcccaggaggcccagagtcctggtcattccagtgcagggcaagagggtgaggatacactgaggaggcgactgctggccccagaggctggaagtcatccacaacaaacacaaaaattggaagaaattaaagagaatgcacaggacaccatgagacagattaataaaaagggtttttggagctatggccctgtgattcttgtcgtcctggttgtggctgttgtggcaagttctgtgaatagctactattcctctccagcccagcaagtgcccaaaaatccagctttggaggcctttttggcccagtttagccaattggaagataaatttccaggccagagttccttcctgtggcagagaggacggaagtttctccagaagcacctcaatgcttccaaccccactgagccagccaccatcatatttacagcagctcgggagggaagagagaccctgaagtgcctgagccaccatgttgcagatgcctacacctcttcccagaaagtctctcccattcagattgatggggctggaaggacctggcaggacagtgacacggtcaagctgttggttgacctggagctgagctatgggtttgagaatggccagaaggctgctgtggtacaccacttcgaatccttccctgccggctccactttgatcttctataagtattgtgatcatgagaatgctgcctttaaagatgtggccctggtcctgactgttctgctagaggaggaaacattagaagcaagtgtaggcccaagggaaacggaagaaaaagtgagagacttactctgggccaagtttaccaactctgacactcccacctccttcaaccacatggactcagacaaattgagtgggctgtggagccgaatttcacacctggtactgccagtccagccaatcttagatgctagcgttacatccacaaaaccagtgttgccttgtataactattatattggcctgctgacctgtgctacctcagatctgtcaaggaaccagtatgtcgcatattcttgtttcttcattcagttgaatatggtttttcatcatttctcttcaaaataatttagaaaaataaatttctaaagtcata

SEQ ID NO: 23814 - DNA, 1203 bp, Homo sapiens
caggaaccacctactacagactcccaggaggcccagagtcctggtcattccagtgcagggcaagagggtgaggatacactgaggaggcgactgctggccccagaggctggaagtcatccacaacaaacacaaaaattggaagaaattaaagagaatgcacaggacaccatgagacagattaataaaaagggtttttggagctatggccctgtgattcttgtcgtcctggttgtggctgttgtggcaagttctgtgaatagctactattcctctccagcccagcaagtgcccaaaaatccagctttggaggcctttttggcccagtttagccaattggaagataaatttccaggccagagttccttcctgtggcagagaggacggaagtttctccagaagcacctcaatgcttccaaccccactgagccagccaccatcatatttacagcagctcgggagggaagagagaccctgaagtgcctgagccaccatgttgcagatgcctacacctcttcccagaaagtctctcccattcagattgatggggctggaaggacctggcaggacagtgacacggtcaagctgttggttgacctggagctgagctatgggtttgagaatggccagaaggctgctgtggtacaccacttcgaatccttccctgccggctccactttgatcttctataagtattgtgatcatgagaatgctgcctttaaagatgtggccctggtcctgactgttctgctagaggaggaaacattagaagcaagtgtaggcccaagggaaacggaagaaaaagtgagagacttactctgggccaagtttaccaactctgacactcccacctccttcaaccacatggactcagacaaattgagtgggctgtggagccgaatttcacacctggtactgccagtccagccaatcttagatgctagcgttacatccacaaaaccagtgttgccttgtataactattatattggcctgctgacctgtgctacctcagatctgtcaaggaaccagtatgtcgcatattcttgtttcttcattcagttgaatatggtttttcatcatttctcttcaaaataatttagaaaaataaatttctaaagtcataatttttaatttagcctttttaaaaacattttcccttctatgtatagtgcaatcaattgaggatggtccgcacagtctgtct

SEQ ID NO: 23815 - DNA, 4243 bp, Homo sapiens
agtgcaaaacctggccagcagcccgagtgagtaggagccatgtgactctggtgagttggagtgtgcaattgcctcctgcttcagagctacctgatccgaatactaagcagagcgagtgccgggctgagtgtaagacactgaagacactgcagagcaaggtgcttattccagaggcgttacaaaacatggagattaaagaccagggagcccaaatggagccgctgctgcctacgagaaatgatgaagaagcagttgtggatagaggtggaactcgttctattctcaaaacacactttgagaaagaagatttagaaggtcatcgaacactatttattggagtacatgtgcccttgggaggaagaaaaagccatcgacgtcacaggcatcgtggtcataaacacagaaagagagacagagaaagagattcaggattagaggatggaagggagtcaccttcttttgacaccccatcacagagggtacagtttattcttggaaccgaggatgatgacgaggaacacattcctcatgaccttttcacagaactggatgagatttgttggcgtgaaggtgaggacgctgagtggcgagaaacagccaggtggttgaagtttgaagaagatgtggaagatggaggagaaaggtggagcaagccttatgtggctactctttcattgcacagcttgtttgaattgagaagttgtattctgaatggaactgtgttgctggacatgcatgccaacactttagaagaaattgcagatatggttcttgaccaacaagtgagctcaggtcagctgaatgaagatgtacgccatagggtccatgaggcattgatgaaacagcatcatcatcagaatcagaaaaaactcaccaacaggattcccattgttcgttcctttgctgatattggcaagaaacagtcagaaccaaattccatggacaaaaatgcaggtcaggttgtttctcctcagtctgctccagcctgtgttgaaaataaaaatgatgttagcagagaaaacagcactgttgactttagcaaggttgatctgcattttatgaaaaagattcctccaggtgctgaagcatcgaacatcttactgggagaactggagttcttggatcgaacagtagttgcgtttgtcaggttgtctccagctgtattgcttcaaggactggctgaagtcccaatcccaaccagatttttgttcattcttctgggacccctgggaaagggtcaacagtaccatgagattggcagatcaattgcaaccctaatgacagatgaggtatttcatgatgttgcctataaagctaaagatcgtaatgacttggtatcaggaattgatgagtttctggatcaggttactgttctccctcctggagaatgggatccaagcattcgaatagagcctcccaaaaatgttccttcccaggagaagaggaagattcctgctgtaccaaatggaacagcagctcatggggaagcagagccccacggaggacatagtggacctgaactccagcgaactggaaggatttttgggggacttattttagatatcaaaagaaaagctccatacttctggagtgacttcagagatgctttcagcctgcagtgcttagcatcttttctatttctctactgcgcgtgtatgtctcctgtcatcacgtttggaggactgctgggagaagcaactgaagggcgtataagtgcaattgaatctctctttggagcatccatgaccgggatagcctattctctctttggtggacagcctcttaccatattaggcagtacaggaccagttttggtgtttgaaaagattttgtttaaattttgcaaagaatatgggctgtcatacctatctttaagagctagcattggactttggactgcaactctatgtatcatacttgtggccacagatgctagttcccttgtctgctacatcactcggtttactgaagaagcttttgcttccctgatttgcatcattttcatttatgaggccctggagaagttgtttgaactcagtgaagcatatccaatcaacatgcataatgatctggaactgctgacacaatactcgtgtaactgtgtggaaccgcataatcccagcaatggcacattgaaggaatggagggaatccaatatttctgcctctgacataatttgggagaacctaactgtgtcagaatgcaaatcattgcatggagagtatgttggacgggcctgtggccatgatcacccatatgttccagatgttctattttggtctgtgatcctgttcttttccacagttactctgtcagccaccctgaagcagttcaagactagcagatattttccaaccaaggttcgatccatagtgagtgactttgctgtctttcttacaattctgtgtatggttttaattgactatgccattgggatcccatctccaaaactacaagtaccaagtgttttcaagcccactagagatgatcgtggctggtttgttacgcctttaggtccaaacccatggtggacagtaatagctgctataattccagctctgctttgtactattctaattttcatggaccaacagattacagctgtcatcatcaacaggaaagagcataagctaaagaaaggttgtgggtaccatctggacctattaatggtggctgtcatgctcggtgtatgctccatcatgggcctgccatggtttgtggctgccacagtcctctccatcactcatgtcaatagcctaaaactggaatcagaatgctcagctccaggagaacaacccaaatttctcggcattcgggagcaaagggttactgggcttatgatttttattcttatgggttcatcagtctttatgaccagtattctgaagtttattcccatgccagtgctatatggagtgtttctttatatgggtgcttcatctctaaagggaattcagttctttgataggataaagctcttctggatgccggcaaaacatcaaccagattttatatacctaaggcacgtaccgcttcgaaaagtgcatctcttcacaattattcagatgagttgccttggccttttgtggataataaaagtttcaagagctgctattgtctctcccatgatggtgttagccctggtatttgtaagaaagttgatggacttgttgttcacgaagcgggaactcagctggttggatgatttgatgcccgagagtaagaaaaagaaactggaaagtagctggaaagaagaagaacaatgtgtgctacctatggaagatgagggcacagtacaactcccattggaagggcactatagagatgatccatctgtgatcaatatatctgatgaaatgtcaaagactgccttgtggaggaaccttctgattactgccgataactcaaaagataaggagtcaagctttccttccaaaagctccccttcctaatcactctagaagctgattccccaaagcattgaaagccgaaaagagaagaaagctgactcagggaaaggtgttgacagggagacttgtctatgactcgatcttcaatttattttttacatatatatgagaagagtgtcacaattattaataaaactgctttgatcatgtattgtaaattctgtccctcaacccaaatccaccttcatactgtaagtagtgcaatacttgtttcatttctgtgtttaaacttctgagcagtgagacatccctgtgagcagatacaatagccaatgcaagaatctgtgtgttccttgctgtacgttagacatttgtaaactggattctgattgtcagttttatgagagcaatagcttccttaaagagataagtcatatttacctagtttgtattctcctactttagtgacctgaagatgcctgataatttcattcagaagaatttttgaaaggtagtcttacttctttttagtttttatagcttagcattagtgacttatttcaaaagacccaaatcaaaaagttagtttgaaagcattttttaataattgtatttatgcatttggctactgtaagttttgctccatggaataatgatgtgatagcaaaaatgaataagactatgaataagttcctacatgaaggttaatgtcagtggtgaaaaatcttattatgctccaatatactgccagcatgctgagtatacttggatcataaaaaactgtttcatttttcttatttattttatgcataggaatattcattccggaattc

SEQ ID NO: 23816 - DNA, 4368 bp, Homo sapiens
agtgcaaaacctggccagcagcccgagtgagtaggagccatgtgactctggtgagttggagtgtgcaattgcctcctgcttcagagctacctgatccgaatactaagcagagcgagtgccgggctgagtgtaagacactgaagacactgcagagcaaggtgcttattccagaggcgttacaaaacatggagattaaagaccagggagcccaaatggagccgctgctgcctacgagaaatgatgaagaagcagttgtggatagaggtggaactcgttctattctcaaaacacactttgagaaagaagatttagaaggtcatcgaacactatttattggagtacatgtgcccttgggaggaagaaaaagccatcgacgtcacaggcatcgtggtcataaacacagaaagagagacagagaaagagattcaggattagaggatggaagggagtcaccttcttttgacaccccatcacagagggtacagtttattcttggaaccgaggatgatgacgaggaacacattcctcatgaccttttcacagaactggatgagatttgttggcgtgaaggtgaggacgctgagtggcgagaaacagccaggtggttgaagtttgaagaagatgtggaagatggaggagaaaggtggagcaagccttatgtggctactctttcattgcacagcttgtttgaattgagaagttgtattctgaatggaactgtgttgctggacatgcatgccaacactttagaagaaattgcagatatggttcttgaccaacaagtgagctcaggtcagctgaatgaagatgtacgccatagggtccatgaggcattgatgaaacagcatcatcatcagaatcagaaaaaactcaccaacaggattcccattgttcgttcctttgctgatattggcaagaaacagtcagaaccaaattccatggacaaaaatgcaggtcaggttgtttctcctcagtctgctccagcctgtgttgaaaataaaaatgatgttagcagagaaaacagcactgttgactttagcaaggttgatctgcattttatgaaaaagattcctccaggtgctgaagcatcgaacatcttactgggagaactggagttcttggatcgaacagtagttgcgtttgtcaggttgtctccagctgtattgcttcaaggactggctgaagtcccaatcccaaccagatttttgttcattcttctgggacccctgggaaagggtcaacagtaccatgagattggcagatcaattgcaaccctaatgacagatgaggtatttcatgatgttgcctataaagctaaagatcgtaatgacttggtatcaggaattgatgagtttctggatcaggttactgttctccctcctggagaatgggatccaagcattcgaatagagcctcccaaaaatgttccttcccaggagaagaggaagattcctgctgtaccaaatggaacagcagctcatggggaagcagagccccacggaggacatagtggacctgaactccagcgaactggaaggatttttgggggacttattttagatatcaaaagaaaagctccatacttctggagtgacttcagagatgctttcagcctgcagtgcttagcatcttttctatttctctactgcgcgtgtatgtctcctgtcatcacgtttggaggactgctgggagaagcaactgaagggcgtataagtgcaattgaatctctctttggagcatccatgaccgggatagcctattctctctttggtggacagcctcttaccatattaggcagtacaggaccagttttggtgtttgaaaagattttgtttaaattttgcaaagaatatgggctgtcatacctatctttaagagctagcattggactttggactgcaactctatgtatcatacttgtggccacagatgctagttcccttgtctgctacatcactcggtttactgaagaagcttttgcttccctgatttgcatcattttcatttatgaggccctggagaagttgtttgaactcagtgaagcatatccaatcaacatgcataatgatctggaactgctgacacaatactcgtgtaactgtgtggaaccgcataatcccagcaatggcacattgaaggaatggagggaatccaatatttctgcctctgacataatttgggagaacctaactgtgtcagaatgcaaatcattgcatggagagtatgttggacgggcctgtggccatgatcacccatatgttccagatgttctattttggtctgtgatcctgttcttttccacagttactctgtcagccaccctgaagcagttcaagactagcagatattttccaaccaaggttcgatccatagtgagtgactttgctgtctttcttacaattctgtgtatggttttaattgactatgccattgggatcccatctccaaaactacaagtaccaagtgttttcaagcccactagagatgatcgtggctggtttgttacgcctttaggtccaaacccatggtggacagtaatagctgctataattccagctctgctttgtactattctaattttcatggaccaacagattacagctgtcatcatcaacaggaaagagcataagctaaagaaaggttgtgggtaccatctggacctattaatggtggctgtcatgctcggtgtatgctccatcatgggcctgccatggtttgtggctgccacagtcctctccatcactcatgtcaatagcctaaaactggaatcagaatgctcagctccaggagaacaacccaaatttctcggcattcgggagcaaagggttactgggcttatgatttttattcttatgggttcatcagtctttatgaccagtattctgaagtttattcccatgccagtgctatatggagtgtttctttatatgggtgcttcatctctaaagggaattcagttctttgataggataaagctcttctggatgccggcaaaacatcaaccagattttatatacctaaggcacgtaccgcttcgaaaagtgcatctcttcacaattattcagatgagttgccttggccttttgtggataataaaagtttcaagagctgctattgtctctcccatgatggtgttagccctggtatttgtaagaaagttgatggacttgttgttcacgaagcgggaactcagctggttggatgatttgatgcccgagagtaagaaaaagaaactggaaagtagctggaaagaagaagaacaatgtgtgctacctatggaagatgagggcacagtacaactcccattggaagggcactatagagatgatccatctgtgatcaatatatctgatgaaatgtcaaagactgccttgtggaggaaccttctgattactgccgataactcaaaagataaggagtcaagctttccttccaaaagctccccttcctaatcactctagaagctgattccccaaagcattgaaagccgaaaagagaagaaagctgactcagggaaaggtgttgacagggagacttgtctatgactcgatcttcaatttattttttacatatatatgagaagagtgtcacaattattaataaaactgctttgatcatgtattgtaaattctgtccctcaacccaaatccaccttcatactgtaagtagtgcaatacttgtttcatttctgtgtttaaacttctgagcagtgagacatccctgtgagcagatacaatagccaatgcaagaatctgtgtgttccttgctgtacgttagacatttgtaaactggattctgattgtcagttttatgagagcaatagcttccttaaagagataagtcatatttacctagtttgtattctcctactttagtgacctgaagatgcctgataatttcattcagaagaatttttgaaaggtagtcttacttctttttagtttttatagcttagcattagtgacttatttcaaaagacccaaatcaaaaagttagtttgaaagcattttttaataattgtatttatgcatttccttgatttaatatgataaatttaatacttaacaatttatatgtaactaaaacttaaagtcatttgaaaaatatatagaaacctatttacaacttgttaaggacaatcagacataatgcagagttaagtagtatttgcttaaaattcaagttgtgactaatgatcaaatactaggcttgtacgaaatgctttagaaaaactttgtaacagttttgtgggatttttcaatataaacctttatcagaaatatactaagtttgtctcccactgacaacagatgttttccaaataaacatattctatacataacttgtggaatgccacatggtgaatca

SEQ ID NO: 23817 - DNA, 4005 bp, Homo sapiens
ctggtgactcttgaggatcccccccaaatggaatccacagaaagagagacagagaaagagattcaggattagaggatggaagggagtcaccttcttttgacaccccatcacagagggtacagtttattcttggaaccgaggatgatgacgaggaacacattcctcatgaccttttcacagaactggatgagatttgttggcgtgaaggtgaggacgctgagtggcgagaaacagccaggtggttgaagtttgaagaagatgtggaagatggaggagaaaggtggagcaagccttatgtggctactctttcattgcacagcttgtttgaattgagaagttgtattctgaatggaactgtgttgctggacatgcatgccaacactttagaagaaattgcagatatggttcttgaccaacaagtgagctcaggtcagctgaatgaagatgtacgccatagggtccatgaggcattgatgaaacagcatcatcatcagaatcagaaaaaactcaccaacaggattcccattgttcgttcctttgctgatattggcaagaaacagtcagaaccaaattccatggacaaaaatgcaggtcaggttgtttctcctcagtctgctccagcctgtgttgaaaataaaaatgatgttagcagagaaaacagcactgttgactttagcaaggttgatctgcattttatgaaaaagattcctccaggtgctgaagcatcgaacatcttactgggagaactggagttcttggatcgaacagtagttgcgtttgtcaggttgtctccagctgtattgcttcaaggactggctgaagtcccaatcccaaccagatttttgttcattcttctgggacccctgggaaagggtcaacagtaccatgagattggcagatcaattgcaaccctaatgacagatgaggtatttcatgatgttgcctataaagctaaagatcgtaatgacttggtatcaggaattgatgagtttctggatcaggttactgttctccctcctggagaatgggatccaagcattcgaatagagcctcccaaaaatgttccttcccaggagaagaggaagattcctgctgtaccaaatggaacagcagctcatggggaagcagagccccacggaggacatagtggacctgaactccagcgaactggaaggatttttgggggacttattttagatatcaaaagaaaagctccatacttctggagtgacttcagagatgctttcagcctgcagtgcttagcatcttttctatttctctactgcgcgtgtatgtctcctgtcatcacgtttggaggactgctgggagaagcaactgaagggcgtataagtgcaattgaatctctctttggagcatccatgaccgggatagcctattctctctttggtggacagcctcttaccatattaggcagtacaggaccagttttggtgtttgaaaagattttgtttaaattttgcaaagaatatgggctgtcatacctatctttaagagctagcattggactttggactgcaactctatgtatcatacttgtggccacagatgctagttcccttgtctgctacatcactcggtttactgaagaagcttttgcttccctgatttgcatcattttcatttatgaggccctggagaagttgtttgaactcagtgaagcatatccaatcaacatgcataatgatctggaactgctgacacaatactcgtgtaactgtgtggaaccgcataatcccagcaatggcacattgaaggaatggagggaatccaatatttctgcctctgacataatttgggagaacctaactgtgtcagaatgcaaatcattgcatggagagtatgttggacgggcctgtggccatgatcacccatatgttccagatgttctattttggtctgtgatcctgttcttttccacagttactctgtcagccaccctgaagcagttcaagactagcagatattttccaaccaaggttcgatccatagtgagtgactttgctgtctttcttacaattctgtgtatggttttaattgactatgccattgggatcccatctccaaaactacaagtaccaagtgttttcaagcccactagagatgatcgtggctggtttgttacgcctttaggtccaaacccatggtggacagtaatagctgctataattccagctctgctttgtactattctaattttcatggaccaacagattacagctgtcatcatcaacaggaaagagcataagctaaagaaaggttgtgggtaccatctggacctattaatggtggctgtcatgctcggtgtatgctccatcatgggcctgccatggtttgtggctgccacagtcctctccatcactcatgtcaatagcctaaaactggaatcagaatgctcagctccaggagaacaacccaaatttctcggcattcgggagcaaagggttactgggcttatgatttttattcttatgggttcatcagtctttatgaccagtattctgaagtttattcccatgccagtgctatatggagtgtttctttatatgggtgcttcatctctaaagggaattcagttctttgataggataaagctcttctggatgccggcaaaacatcaaccagattttatatacctaaggcacgtaccgcttcgaaaagtgcatctcttcacaattattcagatgagttgccttggccttttgtggataataaaagtttcaagagctgctattgtctctcccatgatggtgttagccctggtatttgtaagaaagttgatggacttgttgttcacgaagcgggaactcagctggttggatgatttgatgcccgagagtaagaaaaagaaactggaaagtagctggaaagaagaagaacaatgtgtgctacctatggaagatgagggcacagtacaactcccattggaagggcactatagagatgatccatctgtgatcaatatatctgatgaaatgtcaaagactgccttgtggaggaaccttctgattactgccgataactcaaaagataaggagtcaagctttccttccaaaagctccccttcctaatcactctagaagctgattccccaaagcattgaaagccgaaaagagaagaaagctgactcagggaaaggtgttgacagggagacttgtctatgactcgatcttcaatttattttttacatatatatgagaagagtgtcacaattattaataaaactgctttgatcatgtattgtaaattctgtccctcaacccaaatccaccttcatactgtaagtagtgcaatacttgtttcatttctgtgtttaaacttctgagcagtgagacatccctgtgagcagatacaatagccaatgcaagaatctgtgtgttccttgctgtacgttagacatttgtaaactggattctgattgtcagttttatgagagcaatagcttccttaaagagataagtcatatttacctagtttgtattctcctactttagtgacctgaagatgcctgataatttcattcagaagaatttttgaaaggtagtcttacttctttttagtttttatagcttagcattagtgacttatttcaaaagacccaaatcaaaaagttagtttgaaagcattttttaataattgtatttatgcatttccttgatttaatatgataaatttaatacttaacaatttatatgtaactaaaacttaaagtcatttgaaaaatatatagaaacctatttacaacttgttaaggacaatcagacataatgcagagttaagtagtatttgcttaaaattcaagttgtgactaatgatcaaatactaggcttgtacgaaatgctttagaaaaactttgtaacagttttgtgggatttttcaatataaacctttatcagaaatatactaagtttgtctcccactgacaacagatgttttccaaataaacatattctatacataacttgtggaatgccacatggtgaatca

SEQ ID NO: 23818 - DNA, 1380 bp, Homo sapiens
aatgttttatacatatatatctttaatttttactttaatctcaggcctaatagaaattgtttctaccaaaaaccatacaggcaaatctacacctctcgttttaattttttttccactttaaactagtttattatttacttcaggtgttagccctggtatttgtaagaaagttgatggacttgttgttcacgaagcgggaactcagctggttggatgatttgatgcccgagagtaagaaaaagaaactggaaagtagctggaaagaagaagaacaatgtgtgctacctatggaagatgagggcacagtacaactcccattggaagggcactatagagatgatccatctgtgatcaatatatctgatgaaatgtcaaagactgccttgtggaggaaccttctgattactgccgataactcaaaagataaggagtcaagctttccttccaaaagctccccttcctaatcactctagaagctgattccccaaagcattgaaagccgaaaagagaagaaagctgactcagggaaaggtgttgacagggagacttgtctatgactcgatcttcaatttattttttacatatatatgagaagagtgtcacaattattaataaaactgctttgatcatgtattgtaaattctgtccctcaacccaaatccaccttcatactgtaagtagtgcaatacttgtttcatttctgtgtttaaacttctgagcagtgagacatccctgtgagcagatacaatagccaatgcaagaatctgtgtgttccttgctgtacgttagacatttgtaaactggattctgattgtcagttttatgagagcaatagcttccttaaagagataagtcatatttacctagtttgtattctcctactttagtgacctgaagatgcctgataatttcattcagaagaatttttgaaaggtagtcttacttctttttagtttttatagcttagcattagtgacttatttcaaaagacccaaatcaaaaagttagtttgaaagcattttttaataattgtatttatgcatttccttgatttaatatgataaatttaatacttaacaatttatatgtaactaaaacttaaagtcatttgaaaaatatatagaaacctatttacaacttgttaaggacaatcagacataatgcagagttaagtagtatttgcttaaaattcaagttgtgactaatgatcaaatactaggcttgtacgaaatgctttagaaaaactttgtaacagttttgtgggatttttcaatataaacctttatcagaaatatactaagtttgtctcccactgacaacagatgttttccaaataaacatattctatacataacttgtggaatgccacatggtgaatca

SEQ ID NO: 23819 - DNA, 210 bp, Homo sapiens
gatatcatttttgtcccacctatgtaaccatggtacttttgactgcacactgttttcctgtaatatgaaggtaggtgacctgcccccaaaagtgacaatctttggacagattatgtatgagatggaagtcatatttctttaggaaagtgacatttcacatctgctttaaatagaaaaacctttctaggtaaaaacagtgaagtgagaatg

SEQ ID NO: 23820 - DNA, 4276 bp, Homo sapiens
  misc_feature (371)..(371): n is a, c, g, or t
  misc_feature (400)..(400): n is a, c, g, or t
  misc_feature (957)..(958): n is a, c, g, or t
  misc_feature (1040)..(1041): n is a, c, g, or t
  misc_feature (1057)..(1058): n is a, c, g, or t
  misc_feature (1103)..(1104): n is a, c, g, or t
  misc_feature (3564)..(3564): n is a, c, g, or t
  misc_feature (3575)..(3575): n is a, c, g, or t
  misc_feature (3579)..(3579): n is a, c, g, or t
  misc_feature (3581)..(3581): n is a, c, g, or t
  misc_feature (3589)..(3589): n is a, c, g, or t
cgccaagatgcagcggcggctccggttgtcgccgggcgggccaggagcagcgcgacccgagccgggcagggggcgcccgccacggcacccgcgcgctcctagcgcccagacccgcctgcgggcccggatcctccttgccactgtcccacccgccgtccctgccactccaccctttgtgtcgccgcagcccggtgcccccggctctgcggaaccccggctgggccggaccctggcaaagcgccaggccccgcgtgggctcccggcgagcggttgatggcgagggggcgcggcgcggctctgtagcccgagttcccgacgctggaggcccggcccgcctcagccgcattgtcccgggccgcgcgcaccggccntgagctgcgccgccgcagcacccgccgcncccgcggggccatgcggagagccgccgggatggaggacttctccgcggaggaagaggagtcctggtacgaccagcaggacctggagcaggacttgcacctagctgcggagctggggaagactctgctggagaggaacaaggagctggaggggtccctgcagcagatgtactccaccaatgaggaacaggtgcaggagatcgagtacctaaccaagcagctggacacgctgcggcacgtgaacgagcagcacgccaaagtctatgagcagctggacctgacagcccgggacctggagctgaccaaccacaggctggtgctggagagtaaggctgcccagcagaagatccatgggctgacggagaccattgagccctccaggctcaggtggaggagctgcaggcccaggtggagcaactgagaggcctggaacagctgcgagtgctccgggagaagcgggaacgcaggcgtaccatccacaccttcccctgcctcaaggagctgtgcaccagcccccggtgcaaggatgctttccgcctacacagttcctccctggagnngcccgcggcccctggagcaggagaacgagcggctgcagaccctggtggggcgctgcgctcccaggtgagccaggagcggccnnaaggagcgggcggagnncgatacaccgcggtgctgcaggagtactcggagctggagcgccanngtgcgagatggaggcctgtcgcctgcgtgtgcagagctggaggccgagctgctggagctgcagcagatgaagcaggccaagacctacctactgggtccggacgaccacctggccgaggccctgctcgcacccctcacgcaggcccctgaggccgacgatccccagcccggccgcggggacgacttgggcgcccaggacggggtctcctcaccggcagcctctccaggccacgtggtgcgcaagagctgcagcgacactgcgctcaacgccatcgtggccaaagacccagccagccggcacgcgggcaacctcacactgcacgccaacagcgtgcgcaagcggggcatgtccatcctgcgggaggtggacgagcagtaccacgcgctgctggagaagtacgaggagctgctgagcaagtgccggcagcacggggccggagtgcggcacgccggcgtgcagacctcgcgccccatctcccgggacagctcgtggagggacctgcgcgggggtgaggagggccagggtgaggtcaaggcaggagagaagagcctgagccagcacgtggaggccgtggacaagcggctggagcagagccagcccgagtacaaggcgctcttcaaagagatcttctccaggatccagaagaccaaggctgacatcaacgccaccaaagtcaagacgcacagcagcaagtgacccttctccggcctgcagcctcccccagggtggaagccgtggggtccctcaggcctgggcggtgcagcttccagagagcgagcgccctttagcggcctgccaccacagcacgcggcctcctgatccggaagcacgcagcatgttccctgctgagcggaggcagcccacctgtcctgcctcccaggagcccttggccacctcgcgccagcccaaaggcgcagctctgagttcaaagccaaatgtccccactaccccagggatcccccagctcccccagcccctggcttcctgaccctgcgcctcaccctcagactggtgaccaggcttctgaaagccattctggatcagttggcttttttttttttttgggttaagtttgttttttctaagagatttgcaatgcaaggtctccttgaccccttgccacaactggaaacacttgaaaggggaccccagggccagctgtttcaggggtttcctggaccacccactgcttctccccaaccctgatgcgctgacattcccttagcaccagctgtcccacctccagggtcctgaccaggtcagagatgtcccctgccatgcagagcaggaagcctcagctgggcctggagtgtccctgctccagccctgccagggacaggtttctccctggatactcttggcccaccgcagatctgtagccagtcagaggaggaggagaaggagcccctcagcagagtggtgcagtttcgctcagagcttgtctccttggcttccaaccccagaaatgcctgctgggccttaagctttccaggggccggggcagtggggagcccccatcccttcacaccgccaccaactaaccaagcttggcctctgactcccgtctctgtgcttgcccccatctcagggaccatgatgtctcagtcactccacgctccccacaggccaaccctggcacaggtcatgtctgcagcccccagaatgttctggacatgcaccaccagccggtggtcccaatgtccacccctgcctccccttcactggggactggggttttcgccccatgctgcatcgtgttgtattgggatggggctgaggaacatgctccctccctccctcccataaaatgcctgctcttcacctcccacctttgtggggggcttttgaggacccagctgcgtcaggagttttgcttcaagatgtcagaaagtcaagttcagctaagagacacccaggtccccagcttgccctgagcagcccttcagggcttctggttccttctgccgcccttcctgagaccttagaaaccagaagagccatacagtcagtggaaggcgggggggccctggcctctgcaccgggatcccagtgggaaccttcatgccttatttatttctaatgggtaaaggggttttcttaccaagcatccctgacctcctggagacaccacctgctttccgggcggcactgtgatgggagctggtggcgactgagtccttctgtacgtgcaactgggaaacttttgtcctttgaggctaggcagctccctgccctccgtgtgtgtctgttatctgggggagaggagtgtggaagggttgggggaagagctccagcctgtctgctccccagctctgtagtggcagaccagcgtcacctttgaagtatacgtgagagaaatatatttacaaatgctttattctcttctttaataaaaaatgcaccagtattctaaaagcaaaaaaaaaaaaaaaaaaattcggagattagttcccccggtgntggggaggatngggncntcctacangaaagaattcagagattcccgagaagtacctggataccaggagagattcacatcgcgacagggcacgctatgggcaggagacctcgtgaaggagatctcacattgggagaaacacgctggggagaatgctcaggataactcgcttagactgtgtcgcaaaagggacctgacagcgtgggggcaactgcgcacgccgagaggcacatcaccgcggcgaacaaacagaacagaggaacctatcgcgcaaacatcacgagccccccagtggacgcaaagcaaaccgcgggcgtcatgacaccacaacgcaacaacatacgaccggcgctccccacacacgagaaacggaggttgaacaacacacacccagcgacacatccacggaaagctggacaccccgcaaggcaaaggcaacgaaagcggacacgccccacaggagcaatagggggcagcaacacgcaccaacggggaggataccaccagaacgacggcggcggcgacagccaccacagaggggaggccccgatatagaacacatcacgccaaagatataccaacgaaaccgaagcagaggagggggagctcccccaacaacgagaacacagaacaagagttcacatacaaccgccgttatgcccgcgggagccccgaacaacacgctaggagacaaccaacacggagacgaacagg

SEQ ID NO: 23821 - DNA, 443 bp, Homo sapiens
ccctgagaatcgtgggcaaaactttcacaacctggaaaatgttgaaagcaaccattccctatttttgtttgttttttattaaatcttgccacacacacacacacacacacacagacacacacaaaaagaacattccaggcagaaataacagtgcaaaggcttagctcctggcttacctctcctcccaggcctggaggctcccagtgtcttggttacattggggtcacctagagtagatgctcggaacatgaatgggcgtcctctgcctttgttctcatgctcgtgtttctcctatcctagacttgcacctagctgcggagctggggaagactctgctggagaggaacaaggagctggaggggtccctgcagcagatgtactccaccaatgaggaacaggtgcaggagatcgaggtgagggccctgcatgtgcttgcccacacc

SEQ ID NO: 23822 - DNA, 3526 bp, Homo sapiens
  misc_feature (371)..(371): n is a, c, g, or t
  misc_feature (400)..(400): n is a, c, g, or t
  misc_feature (957)..(958): n is a, c, g, or t
  misc_feature (1040)..(1041): n is a, c, g, or t
  misc_feature (1057)..(1058): n is a, c, g, or t
  misc_feature (1103)..(1104): n is a, c, g, or t
cgccaagatgcagcggcggctccggttgtcgccgggcgggccaggagcagcgcgacccgagccgggcagggggcgcccgccacggcacccgcgcgctcctagcgcccagacccgcctgcgggcccggatcctccttgccactgtcccacccgccgtccctgccactccaccctttgtgtcgccgcagcccggtgcccccggctctgcggaaccccggctgggccggaccctggcaaagcgccaggccccgcgtgggctcccggcgagcggttgatggcgagggggcgcggcgcggctctgtagcccgagttcccgacgctggaggcccggcccgcctcagccgcattgtcccgggccgcgcgcaccggccntgagctgcgccgccgcagcacccgccgcncccgcggggccatgcggagagccgccgggatggaggacttctccgcggaggaagaggagtcctggtacgaccagcaggacctggagcaggacttgcacctagctgcggagctggggaagactctgctggagaggaacaaggagctggaggggtccctgcagcagatgtactccaccaatgaggaacaggtgcaggagatcgagtacctaaccaagcagctggacacgctgcggcacgtgaacgagcagcacgccaaagtctatgagcagctggacctgacagcccgggacctggagctgaccaaccacaggctggtgctggagagtaaggctgcccagcagaagatccatgggctgacggagaccattgagccctccaggctcaggtggaggagctgcaggcccaggtggagcaactgagaggcctggaacagctgcgagtgctccgggagaagcgggaacgcaggcgtaccatccacaccttcccctgcctcaaggagctgtgcaccagcccccggtgcaaggatgctttccgcctacacagttcctccctggagnngcccgcggcccctggagcaggagaacgagcggctgcagaccctggtggggcgctgcgctcccaggtgagccaggagcggccnnaaggagcgggcggagnncgatacaccgcggtgctgcaggagtactcggagctggagcgccanngtgcgagatggaggcctgtcgcctgcgtgtgcagagctggaggccgagctgctggagctgcagcagatgaagcaggccaagacctacctactgggtccggacgaccacctggccgaggccctgctcgcacccctcacgcaggcccctgaggccgacgatccccagcccggccgcggggacgacttgggcgcccaggacggggtctcctcaccggcagcctctccaggccacgtggtgcgcaagagctgcagcgacactgcgctcaacgccatcgtggccaaagacccagccagccggcacgcgggcaacctcacactgcacgccaacagcgtgcgcaagcggggcatgtccatcctgcgggaggtggacgagcagtaccacgcgctgctggagaagtacgaggagctgctgagcaagtgccggcagcacggggccggagtgcggcacgccggcgtgcagacctcgcgccccatctcccgggacagctcgtggagggacctgcgcgggggtgaggagggccagggtgaggtcaaggcaggagagaagagcctgagccagcacgtggaggccgtggacaagcggctggagcagagccagcccgagtacaaggcgctcttcaaagagatcttctccaggatccagaagaccaaggctgacatcaacgccaccaaagtcaagacgcacagcagcaagtgacccttctccggcctgcagcctcccccagggtggaagccgtggggtccctcaggcctgggcggtgcagcttccagagagcgagcgccctttagcggcctgccaccacagcacgcggcctcctgatccggaagcacgcagcatgttccctgctgagcggaggcagcccacctgtcctgcctcccaggagcccttggccacctcgcgccagcccaaaggcgcagctctgagttcaaagccaaatgtccccactaccccagggatcccccagctcccccagcccctggcttcctgaccctgcgcctcaccctcagactggtgaccaggcttctgaaagccattctggatcagttggcttttttttttttttgggttaagtttgttttttctaagagatttgcaatgcaaggtctccttgaccccttgccacaactggaaacacttgaaaggggaccccagggccagctgtttcaggggtttcctggaccacccactgcttctccccaaccctgatgcgctgacattcccttagcaccagctgtcccacctccagggtcctgaccaggtcagagatgtcccctgccatgcagagcaggaagcctcagctgggcctggagtgtccctgctccagccctgccagggacaggtttctccctggatactcttggcccaccgcagatctgtagccagtcagaggaggaggagaaggagcccctcagcagagtggtgcagtttcgctcagagcttgtctccttggcttccaaccccagaaatgcctgctgggccttaagctttccaggggccggggcagtggggagcccccatcccttcacaccgccaccaactaaccaagcttggcctctgactcccgtctctgtgcttgcccccatctcagggaccatgatgtctcagtcactccacgctccccacaggccaaccctggcacaggtcatgtctgcagcccccagaatgttctggacatgcaccaccagccggtggtcccaatgtccacccctgcctccccttcactggggactggggttttcgccccatgctgcatcgtgttgtattgggatggggctgaggaacatgctccctccctccctcccataaaatgcctgctcttcacctcccacctttgtggggggcttttgaggacccagctgcgtcaggagttttgcttcaagatgtcagaaagtcaagttcagctaagagacacccaggtccccagcttgccctgagcagcccttcagggcttctggttccttctgccgcccttcctgagaccttagaaaccagaagagccatacagtcagtggaaggcgggggggccctggcctctgcaccgggatcccagtgggaaccttcatgccttatttatttctaatgggtaaaggggttttcttaccaagcatccctgacctcctggagacaccacctgctttccgggcggcactgtgatgggagctggtggcgactgagtccttctgtacgtgcaactgggaaacttttgtcctttgaggctaggcagctccctgccctccgtgtgtgtctgttatctgggggagaggagtgtggaagggttgggggaagagctccagcctgtctgctccccagctctgtagtggcagaccagcgtcacctttgaagtatacgtgagagaaatatatttacaaatgctttattctcttctttaataaaaaatgcaccagtattctaaaagcaaaaa

SEQ ID NO: 23823 - DNA, 2241 bp, Homo sapiens
  misc_feature (270)..(270): n is a, c, g, or t
  misc_feature (304)..(304): n is a, c, g, or t
cgacgcagtgcgccagacgtcgtaggacgatagttcccatttcgcatggcggcgccagtgctatcacaggccatatccccaagcgtctgcctgtgttgagcaaaaggttgagctcaaccgttagtcttgtgtaggatcgatattgactagaggcctagaggagctgccgcgattgtggtacaccgtcgtgactggctacgaagtgctatctctgcggagtactatcgtcgatgggaagccatccatgtctcctggtggggttgtaggacnaatcgccttagggactgaacgtcaccatgacagnagagatataaaagcctctgtagaccgtgacaatgatggaagagtcctgtaagactgtgactgagactggtgttcaagacagtcacgcgtgccgtagttcctatgcgtcgctcgtagcagtgaggatctttactcgcaagtgattcactattatgaccaaatgtttaggtacatcaggcagctacatgatcaagacgcacagcagcaagtgacccttctccggcctgcagcctcccccagggtggaagccgtggggtccctcaggcctgggcggtgcagcttccagagagcgagcgccctttagcggcctgccaccacagcacgcggcctcctgatccggaagcacgcagcatgttccctgctgagcggaggcagcccacctgtcctgcctcccaggagcccttggccacctcgcgccagcccaaaggcgcagctctgagttcaaagccaaatgtccccactaccccagggatcccccagctcccccagcccctggcttcctgaccctgcgcctcaccctcagactggtgaccaggcttctgaaagccattctggatcagttggcttttttttttttttgggttaagtttgttttttctaagagatttgcaatgcaaggtctccttgaccccttgccacaactggaaacacttgaaaggggaccccagggccagctgtttcaggggtttcctggaccacccactgcttctccccaaccctgatgcgctgacattcccttagcaccagctgtcccacctccagggtcctgaccaggtcagagatgtcccctgccatgcagagcaggaagcctcagctgggcctggagtgtccctgctccagccctgccagggacaggtttctccctggatactcttggcccaccgcagatctgtagccagtcagaggaggaggagaaggagcccctcagcagagtggtgcagtttcgctcagagcttgtctccttggcttccaaccccagaaatgcctgctgggccttaagctttccaggggccggggcagtggggagcccccatcccttcacaccgccaccaactaaccaagcttggcctctgactcccgtctctgtgcttgcccccatctcagggaccatgatgtctcagtcactccacgctccccacaggccaaccctggcacaggtcatgtctgcagcccccagaatgttctggacatgcaccaccagccggtggtcccaatgtccacccctgcctccccttcactggggactggggttttcgccccatgctgcatcgtgttgtattgggatggggctgaggaacatgctccctccctccctcccataaaatgcctgctcttcacctcccacctttgtggggggcttttgaggacccagctgcgtcaggagttttgcttcaagatgtcagaaagtcaagttcagctaagagacacccaggtccccagcttgccctgagcagcccttcagggcttctggttccttctgccgcccttcctgagaccttagaaaccagaagagccatacagtcagtggaaggcgggggggccctggcctctgcaccgggatcccagtgggaaccttcatgccttatttatttctaatgggtaaaggggttttcttaccaagcatccctgacctcctggagacaccacctgctttccgggcggcactgtgatgggagctggtggcgactgagtccttctgtacgtgcaactgggaaacttttgtcctttgaggctaggcagctccctgccctccgtgtgtgtctgttatctgggggagaggagtgtggaagggttgggggaagagctccagcctgtctgctccccagctctgtagtggcagaccagcgtcacctttgaagtatacgtgagagaaatatatttacaaatgctttattctcttctttaataaaaaatgcaccagtattctaaaagcaaaaa

SEQ ID NO: 23824 - DNA, 338 bp, Homo sapiens
ggggtttcaccacgttgtccaggctggtctcgaactcctgacctcaggtaatccatccgcctcggcctcctaaagttacacggttttaatacttgaaaaaatatttatgttttgtaaacatgttgttatgtttaaatatgaaattaaaaacaatttaaatcctctgattattaagccagggaactgcaaacattaaattttctgcctgcaattaagagatagtaattattgttttaaacactaatccaatttttaaaaatctatgcttgtaatacaggcagtttccaacttgacaaatgttttatggtctatatgagcaaccagtagaaaagtacaag

SEQ ID NO: 23825 - DNA, 458 bp, Homo sapiens
ctcagcaagaatttgctgagccgctgccctgtgccaggcagtgccacctgctctcagctcacacctggcattctgacagagggaggcagacagcaatggcccagagtgtcagagggggttagtgccgcagaccaggagtgagcggcgtcgggagggagtgcaagattccagcaggcggtatgacaaagcacagcacacaagatgaaatggattgggtgcacctgctcacaatgggggactagggagtgtctcaaagttatagtttcattttcaagaatgttctgatacctctgttactgtacctagatttgttttgagcctacgtttctttgaggtaattgaggggtgtctgatggagaatatatgatgaataggcacagaaaggaatgcgcacccaccaccagactcccagcactgcctgtgtaaaggagagatcaataggccaggagaaccagatc

SEQ ID NO: 23826 - DNA, 396 bp, Homo sapiens
cattctggccaacttggtgaaaccccgtctccactaaaaaacaaaaaaattagccgggcaagatggtgcgcgcctgtagtcccagccactcgggaggctgaggcagcggaatcgcttgaacccacccgccggaggttgcagtgagccgagatcgtgccacggcatccagcctggctacagagggagactctgtctcaaaaaaaaaaaaaaaaaaaaaaaaaaagtccaaagtcactgtaagtctgtgcccctccctgcacaagcacccccaccgcggctctcaccgggcaccccctttctccctgcttctcacttcttccgccaaactccaggtctttctccccgcgcggcccctctcccgagttcttctcgctccggactccaggtctttctccc

SEQ ID NO: 23827 - DNA, 594 bp, Homo sapiens
cgtacgaaccccgagccgccgccgccgccgccagcagcagctgcagcagtggcagctgcagtagcggcagcagccccagcctcaaggccagtttaagctatgaagaaggacatccctcacactctgaaacagatctccttcagagacagagttttgcagcctctcatcagcttcctggatatgctcccacacctcagcctactggtctttctggaatatttgatactagtgtgaacagtgccagcagtaacactaaagagtcttcagtgatgaattttctgtctactgctgaatcccgaactgctcaggctgctgcttcaggaactactctcttaccacaattcagggctccatcctggcagacaggcatgcattcctcagcagcaactgagctgtttgctactggacctttgccaagcactggaacacttccaccatctctctctgcttatcagcatcccaccaccttcagcaatagaaactttgctaccacttcacctttggtgcttcaggattcaacttttaacactacatcaaatggaattttaagtcatcatgaccctttgctacaaatcaagacttcccagggaactg

SEQ ID NO: 23828 - DNA, 578 bp, Homo sapiens
  misc_feature (16)..(16): n is a, c, g, or t
gtcaagatgcttatanaagcgtctctactcccttaactactttggatgctacttctgataaaaagaagaaaacagtttaagctatgaagaaggacatccctcacactctgaaacagatctccttcagagacagagttttgcagcctctcatcagcttcctggatatgctcccacacctcagcctactggtctttctggaatatttgatactagtgtgaacagtgccagcagtaacactaaagagtcttcagtgatgaattttctgtctactgctgaatcccgaactgctcaggctgctgcttcaggaactactctcttaccacaattcagggctccatcctggcagacaggcatgcattcctcagcagcaactgagctgtttgctactggacctttgccaagcactggaacacttccaccatctctctctgcttatcagcatcccaccaccttcagcaatagaaactttgctaccacttcacctttggtgcttcaggattcaacttttaacactacatcaaatggaattttaagtcatcatgaccctttgctacaaatcaagacttcccagggaactg

SEQ ID NO: 23829 - DNA, 836 bp, Homo sapiens
cttaatatggggctatttctcaagaaaaaatagtagcccctgtcttgtcccctaactcctcatagcagcaagtttgaagtttgctgatctacaaaaggtcctcaaatctggcctgaagcagcaatagtatctctccatttatccaaaaattcatgtttgtgtagtccttctctgttgtaattcccaaagcaagagtttttaagtgcaggagcatgtctgaaaatcaggacccccagggctcttgctcaatcccaagaaggttagagtggttcttagcttcagctgtcccatcctaaacgaggaggtgggattctggaatttctaaaagtcattcctactccactgccctataatttctaagaaaaaagccagccacttcgtcatagagttgggtattccacctcctctgaaacatgtatggagaacagcttgaaccttttcactgctcacctctgcttttagtgactaaggatagaaaggtcagaggcaaagtggcaaaggacttgaaaactaccttcaaaaactaactgcaaaaaccaaactactaatatcgtttggtggctgggcgcggtggctcacgcctgcaatcccaccactgtgggaggccgaggcgggcgaattgcctgagctcaggagtttgaaaccagcctgtgcaacacggtgaaacctcgtctctaataaaatacaaaaaattagctgggcttggcagagtgcacctgtagtcccggatactcaggaggctgagacaggagaactgcttgaacctgggaggtggagtttgccgtgagccaagatcgcgccactgcactccagcctggcaacagagactttgtctc

SEQ ID NO: 23830 - DNA, 304 bp, Homo sapiens
tctcctactttgcagaaacggtcatgttaaggtcaccaatgataaaatcctcagtcctcatctcactttttaatagcagtatagacacaagttaatcactcttttcttggaaacacttccttttgggacaacacattctcctcctggttttcctccaaactctggcttgttttccttctcaacttggctgatttatgtctcacctgcttgtcttgttaacattggagtatccaggctacaatcttagatctcttcttttctctctatttaaatttactaggtaatcttatcccatcccttgtta

SEQ ID NO: 23831 - DNA, 3435 bp, Homo sapiens
gtgtctcctgtctggctgtttttttgagacggagtctcactctgccgcccaggctggagtgcagtggaacgatctcggctcactgcaacctccacttcctgggttcaagccattctcctgcctcagcctccctagtagctgggattacaggcgcccaccaccacaccctgtctctactaaaaatacaacattagccaggcgtggtggtgcatgcctgtattcccagctactttggaggctgagacagaattgcttgaacccgggaggcggagggtgcagtgagccgagattgggccattgccctccagcctgggcaacaagagtgaaattacatctccaaaaaaaaaattttttttatttctcgagtttgagtgaaaggagcgacccggaggtgaggcagtggggcgtgtgggtgcgcatgagtgcgaacacacgtgggggtgcaagtgcatgtgtgtatgtgcacgcaggttgctcctaggggtgcaaaggcgcgcgcacgggtgcggggtgcgcgccccctcgcggcgccttcacggccctcccgcccctcgccctgcagagtacagcggccgccggcagccctaccccttcgagcgcatgatcttcggcgcctgcgctggcctcatcgggcagtcggcctcgtacccgctggatgtggtgcggcggcgcatgcagacggccggcgtcacgggctacccgcgcgcctccatcgcccgcacgctgcgcaccatcgtgcgggaggagggcgccgtgcgcggcctctacaaaggcttgagcatgaactgggtcaagggtcccatcgccgtgggcatcagcttcaccaccttcgacctcatgcagatcctgctgcggcacctgcagagctaggggaccctgagctgctctcaggacggtggaccggtgacccctttgtattctgggcccatggaacggtgggggggtgcgcttgattctacttcaggaggcacatggggcgctttatggaacgagcaggtgggcctgaggggcctgggctcagagtccacgtccaaacgcaaagctggcagccctggaagtgcagtgttggggcgatggtgtggggggtcccgcagctcccctcttccttcctctgcagacgctggcgctgtctgccggaggtgttgcccaaaaggccctagtggggcgtggtcagctccacctcctgatcctgtgtgtcctccgacatgctgctgattctagtgacccctgtccccaccaggctcagagccagactgcgcctggaccttcttgttctgactccacgtgcctgcccggcctccagggtgcgggggcgcctttcttgcaggcggaccctgcccaggatggggccagcctcgtgctcagctttggccacaaatgcagcccctggcccaccccaccctgccggccctgccttctccagtatttcccacatggccacgactcctcagtcactagagcctcctgctgggaacagtgtcccccagagcctcatgtctatcctagaccctgcaagcagctgggtccccaagagtgcatctccccctagagttgcctgcccatgcccacctgctttgtaaccttcccaggagattcatgcttgctctgcacagcagggctcgaggcccaggccatgacacggaactgcctcaggtttgggtcagacctgcatcctggggcatctgctgaaatgtgagcacacaaaccacctcctttggcccagaagccccccaggcctagcatctcagtgccccaaccctctgcccagctgtggtatccagcaggtccttgggtccccacttgagcaggcacttggctgggatatggagcaatttaaagcccacaggggttgttcagtttctatgaaatggagcatggggtgcctgctagcctcaatcccccgaagtgggagcctcatgatagagtatagcttgggggtgggaggtgaggaaaatctgaggtacccaggggaacccccagctaactggtctctcagaggagtcccccagggcccgccagctatcacagggactcagaaacacccatttcctaatgacatggtgagtttcttgatttcttttttttgtttgttttgttttggttttcaacttggctgaccccgggtctatgatctattcacatcgaacccctgactggtctgcctggtgccagggtgagcgtgaccgtgagtgttgctttcgacagctggctcagcacacgctgtgtgaagggatctgagcttgttcatctccagtcgtgacttcatttcccttccttctgtcctcctcctgttcttgccttggacctgcaggtgtgcagaccgctctctctgccttccttgcatgtggccaccagccatccctgatcttgtccccagaggcccaggcagcctgtgatggctgtgaggggctgtcccactgtgtgggtatcccttacccagcacttaaacttggcaggagaggcagggcaaccctcacagggagatgggagggcacccaactcccacaagcatgcaacagcagtaggaattgggggtctgccccaaggtgggtgagaccaaatgagtggatttggggccacaggctaggcaggagagacaaggggtaggtgggagggtcccccagtccctgctgaccccagtgtgtctccccggagatggctcctagctgagtgggacccggcaggagttggggacagtgctgtcccccacccctgcacacagccaggccctcaggctctgcggtcactcgcctccctgctggtcactggtcttggtctggagttatattttgatgccatgaagacactgtttatatctaatgtttatatattttaaagatttgtgccaagagagtatatttaataaaaacttaaatgacttcttctcctgctcctggctcttctttggctctgaccgcccccccatcttcccccatgaacccccaaacagggttgaagtgcttttgacacatttgtgataaaagttctgaataaaagtcttgaataaagaagtttttaaatgcaattgttgtttgaattaatacataccacaattttccagaaaacaccagctgtccacaagggtttacagtgaaaagtaggtgaacagttccctctgcagggggcctcctgtgaccattttctcttgtctcctcccacagagattctgtgcatacactcatccctttcaggatatatgtggccacccacaaaggcaggaggggccgtctctgtgcagccagcacagcccaaagtctcatgggcttgaacatggccttccttcccaagagccctgcactctggggctggctgaggcttcaggcctgaacgtcagtcaccatctgcaggggcagccaccagagggtctccagtggcaatcctggctcacttcacctgcagcccattggccagagcaacttggaggacccacccact

SEQ ID NO: 23832 - DNA, 3335 bp, Homo sapiens
gtgtctcctgtctggctgtttttttgagacggagtctcactctgccgcccaggctggagtgcagtggaacgatctcggctcactgcaacctccacttcctgggttcaagccattctcctgcctcagctactttggaggctgagacagaattgcttgaacccgggaggcggagggtgcagtgagccgagattgggccattgccctccagcctgggcaacaagagtgaaattacatctccaaaaaaaaaattttttttatttctcgagtttgagtgaaaggagcgacccggaggtgaggcagtggggcgtgtgggtgcgcatgagtgcgaacacacgtgggggtgcaagtgcatgtgtgtatgtgcacgcaggttgctcctaggggtgcaaaggcgcgcgcacgggtgcggggtgcgcgccccctcgcggcgccttcacggccctcccgcccctcgccctgcagagtacagcggccgccggcagccctaccccttcgagcgcatgatcttcggcgcctgcgctggcctcatcgggcagtcggcctcgtacccgctggatgtggtgcggcggcgcatgcagacggccggcgtcacgggctacccgcgcgcctccatcgcccgcacgctgcgcaccatcgtgcgggaggagggcgccgtgcgcggcctctacaaaggcttgagcatgaactgggtcaagggtcccatcgccgtgggcatcagcttcaccaccttcgacctcatgcagatcctgctgcggcacctgcagagctaggggaccctgagctgctctcaggacggtggaccggtgacccctttgtattctgggcccatggaacggtgggggggtgcgcttgattctacttcaggaggcacatggggcgctttatggaacgagcaggtgggcctgaggggcctgggctcagagtccacgtccaaacgcaaagctggcagccctggaagtgcagtgttggggcgatggtgtggggggtcccgcagctcccctcttccttcctctgcagacgctggcgctgtctgccggaggtgttgcccaaaaggccctagtggggcgtggtcagctccacctcctgatcctgtgtgtcctccgacatgctgctgattctagtgacccctgtccccaccaggctcagagccagactgcgcctggaccttcttgttctgactccacgtgcctgcccggcctccagggtgcgggggcgcctttcttgcaggcggaccctgcccaggatggggccagcctcgtgctcagctttggccacaaatgcagcccctggcccaccccaccctgccggccctgccttctccagtatttcccacatggccacgactcctcagtcactagagcctcctgctgggaacagtgtcccccagagcctcatgtctatcctagaccctgcaagcagctgggtccccaagagtgcatctccccctagagttgcctgcccatgcccacctgctttgtaaccttcccaggagattcatgcttgctctgcacagcagggctcgaggcccaggccatgacacggaactgcctcaggtttgggtcagacctgcatcctggggcatctgctgaaatgtgagcacacaaaccacctcctttggcccagaagccccccaggcctagcatctcagtgccccaaccctctgcccagctgtggtatccagcaggtccttgggtccccacttgagcaggcacttggctgggatatggagcaatttaaagcccacaggggttgttcagtttctatgaaatggagcatggggtgcctgctagcctcaatcccccgaagtgggagcctcatgatagagtatagcttgggggtgggaggtgaggaaaatctgaggtacccaggggaacccccagctaactggtctctcagaggagtcccccagggcccgccagctatcacagggactcagaaacacccatttcctaatgacatggtgagtttcttgatttcttttttttgtttgttttgttttggttttcaacttggctgaccccgggtctatgatctattcacatcgaacccctgactggtctgcctggtgccagggtgagcgtgaccgtgagtgttgctttcgacagctggctcagcacacgctgtgtgaagggatctgagcttgttcatctccagtcgtgacttcatttcccttccttctgtcctcctcctgttcttgccttggacctgcaggtgtgcagaccgctctctctgccttccttgcatgtggccaccagccatccctgatcttgtccccagaggcccaggcagcctgtgatggctgtgaggggctgtcccactgtgtgggtatcccttacccagcacttaaacttggcaggagaggcagggcaaccctcacagggagatgggagggcacccaactcccacaagcatgcaacagcagtaggaattgggggtctgccccaaggtgggtgagaccaaatgagtggatttggggccacaggctaggcaggagagacaaggggtaggtgggagggtcccccagtccctgctgaccccagtgtgtctccccggagatggctcctagctgagtgggacccggcaggagttggggacagtgctgtcccccacccctgcacacagccaggccctcaggctctgcggtcactcgcctccctgctggtcactggtcttggtctggagttatattttgatgccatgaagacactgtttatatctaatgtttatatattttaaagatttgtgccaagagagtatatttaataaaaacttaaatgacttcttctcctgctcctggctcttctttggctctgaccgcccccccatcttcccccatgaacccccaaacagggttgaagtgcttttgacacatttgtgataaaagttctgaataaaagtcttgaataaagaagtttttaaatgcaattgttgtttgaattaatacataccacaattttccagaaaacaccagctgtccacaagggtttacagtgaaaagtaggtgaacagttccctctgcagggggcctcctgtgaccattttctcttgtctcctcccacagagattctgtgcatacactcatccctttcaggatatatgtggccacccacaaaggcaggaggggccgtctctgtgcagccagcacagcccaaagtctcatgggcttgaacatggccttccttcccaagagccctgcactctggggctggctgaggcttcaggcctgaacgtcagtcaccatctgcaggggcagccaccagagggtctccagtggcaatcctggctcacttcacctgcagcccattggccagagcaacttggaggacccacccact

SEQ ID NO: 23833 - DNA, 3024 bp, Homo sapiens
gtgtctcctgtctggctgtttttttgagacggagtctcactctgccgcccaggctggagtgcagtggaacgatctcggctcactgcaacctccacttcctgggttcaagccattctcctgcctcagcctccctagtagctgggattacaggcgcccaccaccacaccctgtctctactaaaaatacaacattagccaggcgtggtggtgcatgcctgtattcccagctactttggaggctgagacagaattgcttgaacccgggaggcggagggtgcagtgagccgagattgggccattgccctccagcctgggcaacaagagtgaaattacatctccaaaaaaaaaattttttttatttctcgagtttgagtgaaaggagcgacccggaggtgaggcagtggggcgtgtgggtgcgcatgagtgcgaacacacgtgggggtgcaagtgcatgtgtgtatgtgcacgcaggttgctcctaggggtgcaaaggcgcgcgcacgggtgcggggtgcgcgccccctcgcggcgccttcacggccctcccgcccctcgccctgcagagtacagcggccgccggcagccctaccccttcgagcgcatgatcttcggcgcctgcgctggcctcatcgggcagtcggcctcgtacccgctggatgtggtgcggcggcgcatgcagacggccggcgtcacgggctacccgcgcgcctccatcgcccgcacgctgcgcaccatcgtgcgggaggagggcgccgtgcgcggcctctacaaaggcttgagcatgaactgggtcaagggtcccatcgccgtgggcatcagcttcaccaccttcgacctcatgcagatcctgctgcggcacctgcagagctaggggaccctgagctgctctcaggacggtggaccggtgacccctttgtattctgggcccatggaacggtgggggggtgcgcttgattctacttcaggaggcacatggggcgctttatggaacgagcaggtgggcctgaggggcctgggctcagagtccacgtccaaacgcaaagctggcagccctggaagtgcagtgttggggcgatggtgtggggggtcccgcagctcccctcttccttcctctgcagacgctggcgctgtctgccggaggtgttgcccaaaaggccctagtggggcgtggtcagctccacctcctgatcctgtgtgtcctccgacatgctgctgattctagtgacccctgtccccaccaggctcagagccagactgcgcctggaccttcttgttctgactccacgtgcctgcccggcctccagggtgcgggggcgcctttcttgcaggcggaccctgcccaggatggggccagcctcgtgctcagctttggccacaaatgcagcccctggcccaccccaccctgccggccctgccttctccagtatttcccacatggccacgactcctcagtcactagagcctcctgctgggaacagtgtcccccagagcctcatgtctatcctagaccctgcaagcagctgggtccccaagagtgcatctccccctagagttgcctgcccatgcccacctgctttgtaaccttcccaggagattcatgcttgctctgcacagcagggctcgaggcccaggccatgacacggaactgcctcaggtttgggtcagacctgcatcctggggcatctgctgaaatgtgagcacacaaaccacctcctttggcccagaagccccccaggcctagcatctcagtgccccaaccctctgcccagctgtggtatccagcaggtccttgggtccccacttgagcaggcacttggctgggatatggagcaatttaaagcccacaggggttgttcagtttctatgaaatggagcatggggtgcctgctagcctcaatcccccgaagtgggagcctcatgatagagtatagcttgggggtgggaggtgaggaaaatctgaggtacccaggggaacccccagctaactggtctctcagaggagtcccccagggcccgccagctatcacagggactcagaaacacccatttcctaatgacatggtgagtttcttgatttcttttttttgtttgttttgttttggttttcaacttggctgaccccgggtctatgatctattcacatcgaacccctgactggtctgcctggtgccagggtgagcgtgaccgtgagtgttgctttcgacagctggctcagcacacgctgtgtgaagggatctgagcttgttcatctccagtcgtgacttcatttcccttccttctgtcctcctcctgttcttgccttggacctgcaggtgtgcagaccgctctctctgccttccttgcatgtggccaccagccatccctgatcttgtccccagaggcccaggcagcctgtgatggctgtgaggggctgtcccactgtgtgggtatcccttacccagcacttaaacttggcaggagaggcagggcaaccctcacagggagatgggagggcacccaactcccacaagcatgcaacagcagtaggaattgggggtctgccccaaggtgggtgagaccaaatgagtggatttggggccacaggctaggcaggagagacaaggggtaggtgggagggtcccccagtccctgctgaccccagtgtgtctccccggagatggctcctagctgagtgggacccggcaggagttggggacagtgctgtcccccacccctgcacacagccaggccctcaggctctgcggtcactcgcctccctgctggtcactggtcttggtctggagttatattttgatgccatgaagacactgtttatatctaatgtttatatattttaaagatttgtgccaagagagtatatttaataaaaacttaaatgacttcttctcctgctcctggctcttctttggctctgaccgcccccccatcttcccccatgaacccccaaacagggttgaagtgcttttgacacatttgtgataaaagttctgaataaaagtcttgaataaagaagtttttaaatgca

SEQ ID NO: 23834 - DNA, 3381 bp, Homo sapiens
gtgtctcctgtctggctgtttttttgagacggagtctcactctgccgcccaggctggagtgcagtggaacgatctcggctcactgcaacctccacttcctgggttcaagccattctcctgcctcagcctccctagtagctgggattacaggcgcccaccaccacaccctgtctctactaaaaatacaacattagccaggcgtggtggtgcatgcctgtattcccagctactttggaggctgagacagaattgcttgaacccgggaggcggagggtgcagtgagccgagattgggccattgccctccagcctgggcaacaagagtgaaattacatctccaaaaaaaaaattttttttatttctcgagtttgagtgaaaggagcgacccggaggtgaggcagtggggcgtgtgggtgcgcatgagtgcgaacacacgtgggggtgcaagtgcatgtgtgtatgtgcacgcaggttgctcctaggggtgcaaaggcgcgcgcacgggtgcggggtgcgcgccccctcgcggcgccttcacggccctcccgcccctcgccctgcagagtacagcggccgccggcagccctaccccttcgagcgcatgatcttcggcgcctgcgctggcctcatcgggcagtcggcctcgtacccgctggatgtggtgcggcggcgcatgcagacggccggcgtcacgggctacccgcgcgcctccatcgcccgcacgctgcgcaccatcgtgcgggaggagggcgccgtgcgcggcctctacaaaggcttgagcatgaactgggtcaagggtcccatcgccgtgggcatcagcttcaccaccttcgacctcatgcagatcctgctgcggcacctgcagagctaggggaccctgagctgctctcaggacggtggaccggtgacccctttgtattctgggcccatggaacggtgggggggtgcgcttgattctacttcaggaggcacatggggcgctttatggaacgagcaggtgggcctgaggggcctgggctcagagtccacgtccaaacgcaaagctggcagccctggaagtgcagtgttggggcgatggtgtggggggtcccgcagctcccctcttccttcctctgcagacgctggcgctgtctgccggaggtgttgcccaaaaggccctagtggggcgtggtcagctccacctcctgatcctgtgtgtcctccgacatgctgctgattctagtgacccctgtccccaccaggctcagagccagactgcgcctggaccttcttgttctgactccacgtgcctgcccggcctccagggtgcgggggcgcctttcttgcaggcggaccctgcccaggatggggccagcctcgtgctcagctttggccacaaatgcagcccctggcccaccccaccctgccggccctgccttctccagtatttcccacatggccacgactcctcagtcactagagcctcctgctgggaacagtgtcccccagagcctcatgtctatcctagaccctgcaagcagctgggtccccaagagtgcatctccccctagagttgcctgcccatgcccacctgctttgtaaccttcccaggagattcatgcttgctctgcacagcagggctcgaggcccaggccatgacacggaactgcctcaggtttgggtcagacctgcatcctggggcatctgctgaaatgtgagcacacaaaccacctcctttggcccagaagccccccaggcctagcatctcagtgccccaaccctctgcccagctgtggtatccagcaggtccttgggtccccacttgagcaggcacttggctgggatatggagcaatttaaagcccacaggggttgttcagtttctatgaaatggagcatggggtgcctgctagcctcaatcccccgaagtgggagcctcatgatagagtatagcttgggggtgggaggtgaggcccagggcccgccagctatcacagggactcagaaacacccatttcctaatgacatggtgagtttcttgatttcttttttttgtttgttttgttttggttttcaacttggctgaccccgggtctatgatctattcacatcgaacccctgactggtctgcctggtgccagggtgagcgtgaccgtgagtgttgctttcgacagctggctcagcacacgctgtgtgaagggatctgagcttgttcatctccagtcgtgacttcatttcccttccttctgtcctcctcctgttcttgccttggacctgcaggtgtgcagaccgctctctctgccttccttgcatgtggccaccagccatccctgatcttgtccccagaggcccaggcagcctgtgatggctgtgaggggctgtcccactgtgtgggtatcccttacccagcacttaaacttggcaggagaggcagggcaaccctcacagggagatgggagggcacccaactcccacaagcatgcaacagcagtaggaattgggggtctgccccaaggtgggtgagaccaaatgagtggatttggggccacaggctaggcaggagagacaaggggtaggtgggagggtcccccagtccctgctgaccccagtgtgtctccccggagatggctcctagctgagtgggacccggcaggagttggggacagtgctgtcccccacccctgcacacagccaggccctcaggctctgcggtcactcgcctccctgctggtcactggtcttggtctggagttatattttgatgccatgaagacactgtttatatctaatgtttatatattttaaagatttgtgccaagagagtatatttaataaaaacttaaatgacttcttctcctgctcctggctcttctttggctctgaccgcccccccatcttcccccatgaacccccaaacagggttgaagtgcttttgacacatttgtgataaaagttctgaataaaagtcttgaataaagaagtttttaaatgcaattgttgtttgaattaatacataccacaattttccagaaaacaccagctgtccacaagggtttacagtgaaaagtaggtgaacagttccctctgcagggggcctcctgtgaccattttctcttgtctcctcccacagagattctgtgcatacactcatccctttcaggatatatgtggccacccacaaaggcaggaggggccgtctctgtgcagccagcacagcccaaagtctcatgggcttgaacatggccttccttcccaagagccctgcactctggggctggctgaggcttcaggcctgaacgtcagtcaccatctgcaggggcagccaccagagggtctccagtggcaatcctggctcacttcacctgcagcccattggccagagcaacttggaggacccacccact

SEQ ID NO: 23835 - DNA, 2877 bp, Homo sapiens
gtgtctcctgtctggctgtttttttgagacggagtctcactctgccgcccaggctggagtgcagtggaacgatctcggctcactgcaacctccacttcctgggttcaagccattctcctgcctcagcctccctagtagctgggattacaggcgcccaccaccacaccctgtctctactaaaaatacaacattagccaggcgtggtggtgcatgcctgtattcccagctactttggaggctgagacagaattgcttgaacccgggaggcggagggtgcagtgagccgagattgggccattgccctccagcctgggcaacaagagtgaaattacatctccaaaaaaaaaattttttttatttctcgagtttgagtgaaaggagcgacccggaggtgaggcagtggggcgtgtgggtgcgcatgagtgcgaacacacgtgggggtgcaagtgcatgtgtgtatgtgcacgcaggttgctcctaggggtgcaaaggcgcgcgcacgggtgcggggtgcgcgccccctcgcggcgccttcacggccctcccgcccctcgccctgcagagtacagcggccgccggcagccctaccccttcgagcgcatgatcttcggcgcctgcgctggcctcatcgggcagtcggcctcgtacccgctggatgtggtgcggcggcgcatgcagacggccggcgtcacgggctacccgcgcgcctccatcgcccgcacgctgcgcaccatcgtgcgggaggagggcgccgtgcgcggcctctacaaaggcttgagcatgaactgggtcaagggtcccatcgccgtgggcatcagcttcaccaccttcgacctcatgcagatcctgctgcggcacctgcagagctaggggaccctgagctgctctcaggacggtggaccggtgacccctttgtattctgggcccatggaacggtgggggggtgcgcttgattctacttcaggaggcacatggggcgctttatggaacgagcaggtgggcctgaggggcctgggctcagagtccacgtccaaacgcaaagctggcagccctggaagtgcagtgttggggcgatggtgtggggggtcccgcagctcccctcttccttcctctgcagacgctggcgctgtctgccggaggtgttgcccaaaaggccctagtggggcgtggtcagctccacctcctgatcctgtgtgtcctccgacatgctgctgattctagtgacccctgtccccaccaggctcagagccagactgcgcctggaccttcttgttctgactccacgtgcctgcccggcctccagggtgcgggggcgcctttcttgcaggcggaccctgcccaggatggggccagcctcgtgctcagctttggccacaaatgcagcccctggcccaccccaccctgccggccctgccttctccactaactggtctctcagaggagtcccccagggcccgccagctatcacagggactcagaaacacccatttcctaatgacatggtgagtttcttgatttcttttttttgtttgttttgttttggttttcaacttggctgaccccgggtctatgatctattcacatcgaacccctgactggtctgcctggtgccagggtgagcgtgaccgtgagtgttgctttcgacagctggctcagcacacgctgtgtgaagggatctgagcttgttcatctccagtcgtgacttcatttcccttccttctgtcctcctcctgttcttgccttggacctgcaggtgtgcagaccgctctctctgccttccttgcatgtggccaccagccatccctgatcttgtccccagaggcccaggcagcctgtgatggctgtgaggggctgtcccactgtgtgggtatcccttacccagcacttaaacttggcaggagaggcagggcaaccctcacagggagatgggagggcacccaactcccacaagcatgcaacagcagtaggaattgggggtctgccccaaggtgggtgagaccaaatgagtggatttggggccacaggctaggcaggagagacaaggggtaggtgggagggtcccccagtccctgctgaccccagtgtgtctccccggagatggctcctagctgagtgggacccggcaggagttggggacagtgctgtcccccacccctgcacacagccaggccctcaggctctgcggtcactcgcctccctgctggtcactggtcttggtctggagttatattttgatgccatgaagacactgtttatatctaatgtttatatattttaaagatttgtgccaagagagtatatttaataaaaacttaaatgacttcttctcctgctcctggctcttctttggctctgaccgcccccccatcttcccccatgaacccccaaacagggttgaagtgcttttgacacatttgtgataaaagttctgaataaaagtcttgaataaagaagtttttaaatgcaattgttgtttgaattaatacataccacaattttccagaaaacaccagctgtccacaagggtttacagtgaaaagtaggtgaacagttccctctgcagggggcctcctgtgaccattttctcttgtctcctcccacagagattctgtgcatacactcatccctttcaggatatatgtggccacccacaaaggcaggaggggccgtctctgtgcagccagcacagcccaaagtctcatgggcttgaacatggccttccttcccaagagccctgcactctggggctggctgaggcttcaggcctgaacgtcagtcaccatctgcaggggcagccaccagagggtctccagtggcaatcctggctcacttcacctgcagcccattggccagagcaacttggaggacccacccact

SEQ ID NO: 23836 - DNA, 2572 bp, Homo sapiens
gtgtctcctgtctggctgtttttttgagacggagtctcactctgccgcccaggctggagtgcagtggaacgatctcggctcactgcaacctccacttcctgggttcaagccattctcctgcctcagcctccctagtagctgggattacaggcgcccaccaccacaccctgtctctactaaaaatacaacattagccaggcgtggtggtgcatgcctgtattcccagctactttggaggctgagacagaattgcttgaacccgggaggcggagggtgcagtgagccgagattgggccattgccctccagcctgggcaacaagagtgaaattacatctccaaaaaaaaaattttttttatttctcgagtttgagtgaaaggagcgacccggaggtgaggcagtggggcgtgtgggtgcgcatgagtgcgaacacacgtgggggtgcaagtgcatgtgtgtatgtgcacgcaggttgctcctaggggtgcaaaggcgcgcgcacgggtgcggggtgcgcgccccctcgcggcgccttcacggccctcccgcccctcgccctgcagagtacagcggccgccggcagccctaccccttcgagcgcatgatcttcggcgcctgcgctggcctcatcgggcagtcggcctcgtacccgctggatgtggtgcggcggcgcatgcagacggccggcgtcacgggctacccgcgcgcctccatcgcccgcacgctgcgcaccatcgtgcgggaggagggcgccgtgcgcggcctctacaaaggcttgagcatgaactgggtcaagggtcccatcgccgtgggcatcagcttcaccaccttcgacctcatgcagatcctgctgcggcacctgcagagctaggggaccctgagctgctctcaggacggtggaccggtgacccctttgtattctgggcccatggaacggtgggggggtgcgcttgattctacttcaggaggcacatggggcgctttatggaacgagcaggtgggcctgaggggcctgggctcagagtccacgtccaaacgcaaagctggcagccctggaagtgcagtgttggggcgatggtgtggggggtcccgcagctcccctcttccttcctctgcagacgctggcgctgtctgccggaggtgttgcccaaaaggccctagtggggcgtggtcagctccacctcctgatcctgtgtgtcctccgacatgctgctgattctagtgacccctgtccccaccaggctcagagccagactgcgcctggaccttcttgttctgactccacgtgcctgcccggcctccagggtgcgggggcgcctttcttgcaggcggaccctgcccaggatggggccagcctcgtgctcagctttggccacaaatgcagcccctggcccaccccaccctgccggccctgccttctccagtatttcccacatggccacgactcctcagtcactagagcctcctgctgggaacagtgtcccccagagcctcatgtctatcctagaccctgcaagcagctgggtccccaagagtgcatctccccctagagttgcctgcccatgcccacctgctttgtaaccttcccaggagattcatgcttgctctgcacagcagggctcgaggcccaggccatgacacggaactgcctcaggtttgggtcagacctgcatcctggggcatctgctgaaatgtgagcacacaaaccacctcctttggcccagaagccccccaggcctagcatctcagtgccccaaccctctgcccagctgtggtatccagcaggtccttgggtccccacttgagcaggcacttggctgggatatggagcaatttaaagcccacaggggttgttcagtttctatgaaatggagcatggggtgcctgctagcctcaatcccccgaagtgggagcctcatgatagagtatagcttgggggtgggaggtgaggaaaatctgaggtacccaggggaacccccagctaactggtctctcagaggagtcccccagggcccgccagctatcacagggactcagaaacacccatttcctaatgacatggtgagtttcttgatttcttttttttgtttgttttgttttggttttcaacttggctgaccccgggtctatgatctattcacatcgaacccctgactggtctgcctggtgccagggtgagcgtgaccgtgagtgttgctttcgacagctggctcagcacacgctgtgtgaagggatctgagcttgttcatctccagtcgtgacttcatttcccttccttctgtcctcctcctgttcttgccttggacctgcaggtgtgcagaccgctctctctgccttccttgcatgtggccaccagccatccctgatcttgtccccagaggcccaggcagcctgtgatggctgtgaggggctgtcccactgtgtgggtatcccttacccagcacttaaacttggcaggagaggcagggcaaccatcttcccccatgaacccccaaacagggttgaagtgcttttgacacatttgtgataaaagttctgaataaaagtcttgaataaagaagtttttaaatgca

SEQ ID NO: 23837 - DNA, 308 bp, Homo sapiens
tctaagagttgtacagtttttgctcttacatttagatctttgatctattatgggttgatttttgtacatggtgttatgtaaaggttctagttttcttgcccttgaatatccagctttcccaatatcatttggtgagaacactgtcccttccccattgaatgatcttggcacactcgatgaaaatcatttggccatatatgcaagaatttctttctgggctattatacttcattaatttctatgtcctcctttatgccagtaccacactgtattgattactggggctttgtagtaaatgctgaaatcag

SEQ ID NO: 23838 - DNA, 1052 bp, Homo sapiens
ttattaacattgaaatcatggccaacagctctgtaaatcatgcctcaatgaagattatctcacacttgtattttctctgtagtctttgctccttgaacactagacagcactttagcactacgcttagggactgttttcaacagtgaaatcaccaatagcaagcacaaaaatgagaaaaacatggcactaaatagaccatgaaaaggacacttgtttacactatgtaagctgaaactagaatgtgcacgtcagtagactcacatttttcaccattgtgcacatgtctgcaatgacagtggaagtgctatgagtaatgattttggggatacaaataaatgttagtgagtagatgaatttgtaaatatagtatcctcaactaatgaggagcaacctttgttataggtagatatgtatatgcacatattatgtctataatttgaaaagcagattctcaggggtaggttgtatgttataactaaactgttaaagttttctctctgaaacattatatactttgtatcataatgtctttgtagtcaagcacataagtgtttgaaaatagaacttgcacctttttagttcctcctcaaagtttaaaggactgataacatagtgaggcagttcatgttttttttctcaaaaacatgtttaggagtctgtactaagcagatcccagctttggtctgtagaaatgagggagagcggtatgttggttttagcttcaaacagtgacaaattgtcaggctcatataattaattcaatgtaaccttccaagtttttactaaaacctggggttggcttgttgaccacatgcatcaccataacaagcctttggtgctagtctgaggaatttaatactgattgataataagttggtttttgagtaggggacattgttttccctaaatgtccttggtacaaaatggacctaaaatggggtgttgagactgggagagcagagataacttgttgagataatgtaatcacgaggttatgggggctgggtaggaatgatagtgtgaatatggtgatgtgggtaagatttactgag

SEQ ID NO: 23839 - DNA, 318 bp, Homo sapiens
taatttaaatatatttacttaactggaatgaagaaactgagacaccaagattaagtaacttactcaggatcaagcaatcttactcctaagcctactctcttaactatgttgtaatgaaaaccctactgtttaagaaagctggagtaggtttgctaatatttgcaacataaaatggactaaatgatggtctgaaaaagggttacccagtctcccttttcctcctctgctccttacacctggaaaatatttagtatccaccaccccatcataggctcctctgtctatccttctcttgcccctagttcaatttgtcatgtt

SEQ ID NO: 23840 - DNA, 258 bp, Homo sapiens
gaaaagagtcattgcccacagtgaaggcagagaaagatgagaactagaaggagacactcaataatgtcagagtaaaatggagaaaataataaaaaaaagagagaaaggggagagagagtccacgataggaacagaagaaaatcctcacaccaccaagcctagcggagcagcagtgacggtacttaatgcagtccagcactcatctggtccctccacttagatatcatctagttgcaaagtccagatgtgattggatca

SEQ ID NO: 23841 - DNA, 220 bp, Homo sapiens
aacctgtgaggcagagtcttcagtgagccgagaacatgccgttgcactccagcctgggcaacagcgagactgcctcaaacaaacaaaaaaacttgctacattagaaaaatagtaagaaaaatgctaactatatatgttattaaagaaaccacccagaaaagtaatgcaaataaatgtattaaggaacaactacatttcaggttaattatatctagtataa

SEQ ID NO: 23842 - DNA, 420 bp, Homo sapiens
gcgcacctgtagtcccagctacttgggatgctaaagtgggaggattgcttgagctgagaagttcaaggctactaatgtgggctatgattgcaccactgcactccagcctggacaacataagagaaaaaaaagtaaatgttaattatctgaattgtctttgtaattgttgtccatttttctattagaatgtttgatttgtaaaggatctttgttaggaatattaaccctttgccatatttattgtaaatattttttcatttgtcttatatatgttttttctttttatttttgtcatacagaatatcttaatttttatgtagtcaaatttaacattattttactttgtgttctttttgtaactatctttgacctagtatttaataaaaaggggggaagggagcaggtagtggggaacagctt

SEQ ID NO: 23843 - DNA, 162 bp, Homo sapiens
gcgatgatagctcctaaaccgtagattaaatgagagaatactttccccataggattaagtaagataatgattgcatggaatgtcctgagcactgggcggggccaaacattccctaaatgtttgctttatgggaatataggggaatcctattcctatctttgc

SEQ ID NO: 23844 - DNA, 569 bp, Homo sapiens
catttttgtagatggggtctcactatgtgcccagactggtcttgaactcttgggctcaagcaatccccccacctcagtctcccaaagtgctaggattagaggtatgagctacttaccctggctgattctgtatatttttttttaaatcaccaaacttcctctgttgacgttttaaaagtaatgttatttatctttacaatatcagttggtcagaattgatgatgcttcttgtttgtatggatttttagtagtattgctaaggcatctcgggtttattagttgggaaccactgaaagggatatgatttagcctttactttcttagtttaatgacaaatatttctattatccaagggggcaaattcagtgccacatcacactttttcttttaaatcttaaaattacctcagatttttttttttgttttaagaaaactggaatgcaattatatattaaataaattttaactgccatcttgttgcatgtgtctgtttcatgtgagtgaatagtgtatcacttcagaaaaaccttgttcttttttttgatggactattaagtattttttcaact

SEQ ID NO: 23845 - DNA, 583 bp, Homo sapiens
tcaaatgtgaaaagtaacaagtggcaacattcttgttaaaaactcatatagaaagttggtcatttgcaaaacaggtctgccaaaggaaaaaaaaaaaaaaacaaaaaaacaacaacaacacatacacatttagaggttttaaaagcctattctggtttttcaagcagggtatacagaaacaaaacatcaaattaaatgactttaactcaactagaagtaggaattaatattattcctttctctgacattcaaagctcatcaggcaaagttctcaagacagtattttcttggcttacactacttgagacaaaagtatttcctagtgattaacattacgtgaccctttcaaacctgagcaaagctcgcctaactattctaaaatggtattacaaattgagtattccttattgaaatgtctgggaacagaagtgtttcaaactttttcggattctgaaatagttgcatgaaatttactggttgagcatcctgaatctgaaaatctgaaatccgaaatactccaatgagcactctcagtatcgtgctggtgctcaaaaagtttcagattttggagcattttgggttg

SEQ ID NO: 23846 - DNA, 421 bp, Homo sapiens
tgaagagtctcgtggtgagaaagacagaattcctagccaggaaaatgccccgtgcttgccccttggaggcaggtgctcaccacggcagggtctatctaggtgtttattaaggtgtctcaccacgtatcgcccggattcaccagagatgcagaggcggaggatacgttcctgtttacattgatacatagttacataggtgaagagctttacagtgaggaagcggctcacgcggccatgagggacccaggcaggagctgctgttgctgccccaggtgcgattccttcctcctcagggagggctcagctccccgctgcagccaggtgggcccaggcaggcctccttggcctacagcgcagacggccaagtgctggtcacggccattgcatctacaccaccctttctcagcagcaactccacgag

SEQ ID NO: 23847 - DNA, 615 bp, Homo sapiens
gcactcacctaatagagacacagttgggaaaggggtagccaccagtggctctctcactagtgtccgtggagttgagatggagccgtgtgtggagggagagcattgtctggcagcaacttttgtttcttgagagtttccagaatatgctagaatgtgcgacagagaaccacgactaatcagcaaacagagctcagaatggaagatggagaaggttctcagggaaactggggcttcagtgaaccatgacctgtccatttcttgggctgaagaggagatttgttcaaacatagggtgacttctcatcctggttttagtcccttgtcctgggaaatgcctcagtcccgggaaaacgatgatggctggccaccgtacttaaactctagagagacgattcccagggacgcgttccctctctccaaacctctcttcagtgttgatggtgccttggttcccccatccactctgcgaatgcccttggaacacaccaggcctagctctccacgggtttcaacaggcagtagccaccattggtggagagacttctgggtctccagcttcatgggtactttcaactaattatctctgctcctcagacctaccctacaaagtgtgtat

SEQ ID NO: 23848 - DNA, 167 bp, Homo sapiens
ttcttcaatgacaacactgatgcaaagtcctaacagcagtcttggatgatgcgcttttagctgttttataaaaatctgtgtctggtattaatacaagctgttcaatcagaatattgctcataaaattctatttgttttagagttttatattacttcctgcattttcc

SEQ ID NO: 23849 - DNA, 476 bp, Homo sapiens
gatctggaaacctgagggctataggctgcgtccaggcgcaggaagtctggcatggtgtcctggacactggacacagctatccctggcttctctctacctcgtgctctggagtcaggcagaaacctttctactttctggagttgctgagaaggttcagtgataccagcatgaagctcctagaagaagggctggtgcatagctgctgctcagggtggcacagcccctccacagtcctgcccacatgtgagttgccccttcacaccactccctaacactgccctcaccaaagatgcaagcctggtatctcaaccagagaggcatctttcaacatggcaagcaagattactccaaaaaaatgccacttaccatacctttggtgtactgcctctagaggcaaagtttaccgctttactgtcatgaaatagactgtgacttgtgatttatcatttatgtgaccaattatagttacaatcatg

SEQ ID NO: 23850 - DNA, 262 bp, Homo sapiens
ggatttaaattttatttcaaattttgtatttgttaaattaaataataatttactcatatgatttaaaataataaaatattttcataagcatactttttcatacatagttttaaaagatatttagaaaatatcaaagtattattgtttatagtttaaatgtgcaatttctatattattttggatgttggaatatcaacaggagtaatcgatagtatttaaaactttttatatatccatgattgtggtaagcattgagggtcat

SEQ ID NO: 23851 - DNA, 5223 bp, Homo sapiens
  misc_feature (2766)..(2766): n is a, c, g, or t
ctcggggccacggtccccccgcagcgctagtcccgggcccgcgagcaccggcccccgccacccgcaggttgcggagggaggagggcgggagcgggcggcgcggagccgggaggcgggggaggggccggcgtccgaggcggcggcggcggcggctggagcagcctctggcagcagcggggagaatgggagtgcggggcgccagaccgccgcggggtgtcacggccgccacgaagcctgcgaggcgcggggccggcgcccgcggcttttaaacccgggaaggcgcggcggcggcggcggcggcgggcagatcgcggcgcgcaccaggcgccggggcggcggccgaatggagagaaagggctcggcggccggggccaaggggaacccgagcccgcccgcggccggagaggggcagcggccaccgccgccgctgtgcgtcccgggcggcggcggaggagccccagcgaggggccaggtcggggcggcggccgagccggccgagctcatccgacgagcgcacgagttcaaaagccaaggggcgcagtgctacaaggacaagaaattccgtgaagccataggcaaataccaccgggcgttgctggagctgaaggggctgctgccgccccccggggaacgggagcgggactcgcgcgcggcctccccggctggggccctgaagcccggccgcctctcggaggagcagagcaagacggtggaagccatcgagatcgactgttacaacagcctggcagcctgcctgctccaggctgagctggtaaactatgaacgagtcaaggaatattgcctcaaagtcttgaagaaggaaggggagaacttcaaggccctttaccggtctggtgtggccttctaccaccttggggactatgacaaagcactctactacctgaaagaagcaaggacccaacaaccaacagacaccaacgtgattcggtatatccagctgacggagatgaaactcagccgatgctcccagagagaaaaagaagccatgtaaccaggaagcagctccagagctgcgcccacgcctgaccggggacttccaggcatcccctggcagagagccccgtcctggattctgtccctttctccccacttcttctggctcctcatttttcctcctgttgcaccccagctctttgtctcctcccagtacgaaaaggagagatgcaaatttggaatctggtaggtcgcccagacaatggagacatcctctcctctagcaggtcagcgactgagaggggcctgacttctgctgggacagctggagaggagtctcatgggctgggatgctgttgtggctttgactttggccagtgcttctgacagaggcggagcctggcaagtgtaccatcccacaggcagcaggcacacagcccatgggctggatccttccacactttcctgacagaccagaaccagagcatctcgaggcaactgttagaaatccagggacgagacaaacagagaagcgctggtgaagccaacatagagactgtcaatgtgtacactggagttcccacccccaccccccacccgtcacttagcccctgcctccttcccccactcgttgtcttggcttgtgctttctcctctccccatcggggatccgagactctgccaggattcacatgccactgaagcccactcagtgccctctggtgaccacacataccattcccccggactcccacccagcaggcagctgtgaccgcagaagggcaggatgaagtgggccaaggtttgggacaggttgactgtgtaggtgacagggagggaaagatgatggccaggggaaagagcatcgtataggctaggggattgaactgtggactgattcagtgtaaataaaaataaattaacaggtagtagttcctgtcagttctgttggaagcagcccactccctcacttttactccttcctccaaccctcaatcagagctacttacagccaggcaggatggggctttccccaaagcaattggccgtttgtccagtggcagacaatggtggctacagcctttgtgcttttaagagtgggctgggattgtggagactgcccaggggcttggctttgtcagaacttgtacaatcttcttttgatgaaattatctgaactcaacatctagcacatagaatgtgttcaacaaatgcttgttgaatgaataaattatgactgcagactggctctcctgccttaaactaatttcatcccagcctagtctcctgatgtctgtgctcgttatgctatgccatgttgcttcagtcaaacaagaaacacttactgagggcatattgtttgcccatcattgtgcaatatgctgtgggacatgggatgtcgtctcagtcttcaaggaaatggaagggttaagaaatgcatatgagattattaccaatgacacctttaatttatatgatgctttaaaattatcagagcactttcatgtatttttcgtgtgactagtgaaaaagacaatgttgtacaaaattaaaatatatacagatgcaataatgtgaatagttaggatttattaaatgcattatcttcagatctttacatgtataatctcatttctttcatgcagttactctgggatactgttcccatttgatgggtaagaatattgaaaaccagaaaaattaattatcccaaggttgcatggcctttagtggcatagctaggatttgaaccaggcctgcctgactccagagctctggctagtatctatgctatacttagttgcctctctntaagtataatattgggcaattataaccatttgagaacaggacaatatgtattaacctgaaaagtgttcatgatgtcagtgatagtacatggcctccttatgtatttactcaagggccccaaaagaccagaggccagaatccctagtagtcagagcagtgacaggtcagaaaaaggcagctgaggtccaatagttatgtctgtgtattgctcattctacttactgatggagccagcatgtatctcaacaactcacctagcattcatcacccatccccagcattgggaaagggtcacaattaagaccgaaaggaaacacaaagttaaatatgggttaattatgtaagcagatgccccaccacggcaggatccaatcacagccgaggggcccagaagagagcagcgtaagttatattcacatagttccccaaaggctttcaacgggggctacaggaaggtgctagaaatattgaggggcctgccattactcacctagagctcactctctggagaagaggaaaaggaagaagctatttcagctgccacattctccccaatccctactatattatgctgtctttcctcttcctcctagctggctttacatgaccctaacccaaaactaccctatggccccacacgggaatgtgttcaaacgccccgacccccacccccacccccattcccaagcctccaacttagaacgtttgtgatttggcagatggtttgttaggatctgaaggatgaagagaagggtagaggtcacctggagaatgagttcaaactgccagggtcttcccttggtctttgtgcgtcaggaaggactccgagtaattattccctatgcagagacaggagagaggtcttgtttacatgagtgtgctggggcagggctggacaatccaggatatgattgtagccatcccatgtagaaagatcaaaaaccagaacgaaatgaagacagcctctcagaacctcatagaacaagcgtccaggtcatctgcttgtttggtgacttagatatacaggcttactggaactccattcactgtgacctgaagttaaataatcccaaagagaaaaagctacctggggtattggttgatgtttggggtgatagggctgaattttctgtgcatttgtccaacaaaggctttagagcacaaaaccaggttcattctccctaccaaatcttcagcttccttctcctcatccctccccaaaacaagaactgtgatttaattccgtacgttgcggatgtcactgctgacctatgtagctggagtactaatcaggcatctgacctgcactgtcatcccctgcctggacttttgcgatggactctttgggggaaaaactaacgctttttaattattgtgaaagcatcatgtgtgtattgtagaagttttaggaaaaaaaggacaaaatccaatccataagcttaccacccaagacaaacgtgtattcttttgaatataccttttagttctttttggtgtaaatgtacacacgcacacacagttgtggatttttttaaacaaaaactggatacactgaatatactctttaataacttttcaagtgtgtatttatattttagaatatgtaatcctacacagatacaaaattcaaaaagtacaaactgctctgtagtcagaagtaaatcttctccctaccccgtctgccagcatctagtttccctctaatttattttgcatcctagtggagatgcttacacattgtcaaacatatgtatatattcttttatcacacacaaatggcagcatattggacactttttgttttttgctccttctgttccttcacttaataatatcacgaacattttcggcatatcaaactttctcaacagcatcttcattgtatggatggaccctttttttatcatcaatcctcaaatagtgattatttcatttgttcccaatcttcattgtaaatagtgttgcaactgacattcttgtagctaaattttgcacatgtctataacgatttccttaggataaactccaagaagagacttgcttggctatttttaagaattttgatacatgttgccaaccaccctccagaaagtttgtaccaaaacgctctcctatttggatcctagagagtaccctgtttcctgcaccctaacactaggtatcatcacttatcaaatctttcccaatttggtagctgggataatagtatgtcaatgttattttaactttctttgattcttcgcgaataacattttcatatgcttattgaccatttgtacttctttctttgtgaattttctatttatttgatattggtatgtttattatcaatttgtaattttattaagaatattatttttgtcaagaaatgctgcaaatatgctttccaagtgctttgctttcaaattttgtttatggtgctttttgacatacataaattcttaattctgcaattaa

SEQ ID NO: 23852 - DNA, 2572 bp, Homo sapiens
ctcggggccacggtccccccgcagcgctagtcccgggcccgcgagcaccggcccccgccacccgcaggttgcggagggaggagggcgggagcgggcggcgcggagccgggaggcgggggaggggccggcgtccgaggcggcggcggcggcggctggagcagcctctggcagcagcggggagaatgggagtgcggggcgccagaccgccgcggggtgtcacggccgccacgaagcctgcgaggcgcggggccggcgcccgcggcttttaaacccgggaaggcgcggcggcggcggcggcggcgggcagatcgcggcgcgcaccaggcgccggggcggcggccgaatggagagaaagggctcggcggccggggccaaggggaacccgagcccgcccgcggccggagaggggcagcggccaccgccgccgctgtgcgtcccgggcggcggcggaggagccccagcgaggggccaggtcggggcggcggccgagccggccgagctcatccgacgagcgcacgagttcaaaagccaaggggcgcagtgctacaaggacaagaaattccgtgaagccataggcaaataccaccgggcgttgctggagctgaaggggctgctgccgccccccggggaacgggagcgggactcgcgcgcggcctccccggctggggccctgaagcccggccgcctctcggaggagcagagcaagacggtggaagccatcgagatcgactgttacaacagcctggcagcctgcctgctccaggctgagctggtaaactatgaacgagtcaaggaatattgcctcaaagtcttgaagaaggaaggggagaacttcaaggccctttaccggtctggtgtggccttctaccaccttggggactatgacaaagcactctactacctgaaagaagcaaggacccaacaaccaacagacaccaacgtgattcggtatatccagctgacggagatgaaactcagccgatgctcccagagagaaaaagaagccatgtaaccaggaagcagctccagagctgcgcccacgcctgaccggggacttccaggcatcccctggcagagagccccgtcctggattctgtccctttctccccacttcttctggctcctcatttttcctcctgttgcaccccagctctttgtctcctcccagtacgaaaaggagagatgcaaatttggaatctggtaggtcgcccagacaatggagacatcctctcctctagcaggtcagcgactgagaggggcctgacttctgctgggacagctggagaggagtctcatgggctgggatgctgttgtggctttgactttggccagtgcttctgacagaggcggagcctggcaagtgtaccatcccacaggcagcaggcacacagcccatgggctggatccttccacactttcctgacagaccagaaccagagcatctcgaggcaactgttagaaatccagggacgagacaaacagagaagcgctggtgaagccaacatagagactgtcaatgtgtacactggagttcccacccccaccccccacccgtcacttagcccctgcctccttcccccactcgttgtcttggcttgtgctttctcctctccccatcggggatccgagactctgccaggattcacatgccactgaagcccactcagtgccctctggtgaccacacataccattcccccggactcccacccagcaggcagctgtgaccgcagaagggcaggatgaagtgggccaaggtttgggacaggttgactgtgtaggtgacagggagggaaagatgatggccaggggaaagagcatcgtataggctaggggattgaactgtggactgattcagtgtaaataaaaataaattaacaggtagtagttcctgtcagttctgttggaagcagcccactccctcacttttactccttcctccaaccctcaatcagagctacttacagccaggcaggatggggctttccccaaagcaattggccgtttgtccagtggcagacaatggtggctacagcctttgtgcttttaagagtgggctgggattgtggagactgcccaggggcttggctttgtcagaacttgtacaatcttcttttgatgaaattatctgaactcaacatctagcacatagaatgtgttcaacaaatgcttgttgaatgaataaattatgactgcagactggctctcctgccttaaactaatttcatcccagcctagtctcctgatgtctgtgctcgttatgctatgccatgttgcttcagtcaaacaagaaacacttactgagggcatattgtttgcccatcattgtgcaatatgctgtgggacatgggatgtcgtctcagtcttcaaggaaatggaagggttaagaaatgcatatgagattattaccaatgacacctttaatttatatgatgctttaaaattatcagagcactttcatgtatttttcgtgtgactagtgaaaaagacaatgttgtacaaaattaaaatatatacagatgcaataatgtgaatagttaggatttattaaatgcattatcttcagatcttta

SEQ ID NO: 23853 - DNA, 415 bp, Homo sapiens
tgacaatgcaggagagagagaggagaattattaaagcactgttctgcaataggcaagggtgagtgagtgggtctgggctagtggacatgttggccatggagaggggcccagaggctctgcctacaataatagatgggatggcagagcataagctggtaagaagggacatgggacttctctatttatttcatgtcatactgtccaagactgtacagtactgtagtggccttcattataaggccccagaccttcatgttttgtgtgcccttttatgacctatgtatagctcttcttcctttgctgtcatttctgtctcagtttgcctgactctacagccttcctccccaccccatttctaacttgcttctatttatgccatagattcaaacatccacaactaaggccattaaattac

SEQ ID NO: 23854 - DNA, 351 bp, Homo sapiens
ttaaaaaaaggtgtgagaaggagtcttaaaattaatgtcattaatcaagacagagcatgttcaaaagactgctttggtttcagagtcctggtgatatggtttgaaagtgtccccacccaaatttcgtcttgaattgtatttctcataatccccacgagtcatgggaggggcccactgggaggtaattgaatcatgggggcggttaccctcatgctattcttgtgatagttagtgggttctcacgagatctgatggttttataagggactttccccgctttgcttggcactcattctctcttttgccactctgtgaagaggtgccttctgccatgattgtgttcctgaggcc

SEQ ID NO: 23855 - DNA, 303 bp, Homo sapiens
gtccctgtctcatgacatagcaccattttgcagaaacattccttcagtaatctgttttattgtatttatcaatagtcatattaagtttcttggggaaaaacaagacaatagctatttttttggtagtatagaattttttactttcaatggtaaaaaaaaaaaaaaatccaactttaatgttaacaaattcaaagttactttgtaaaaagaatacgatgaccataatgtcaaaaagaccagtcaggcccagtgcggtggctcatgcctgtaatcccagcactgtgggaggccaaggcgggcgga

SEQ ID NO: 23856 - DNA, 455 bp, Homo sapiens
gccagacactcccataactcttcttgagctatcagtgtgatgaggctgctgcattctgcacagatgtggtgcacttgctctgagacatttgagtcccaaagcttagcctgagctttgcaactatggttgttgctgctgccaagatgatgcacgccagcaaagccaactaatcacattgacttgatcattataccaggagcacacttgactgtgagtgctccctggtccctcctctaccaccaaattatgaagaaaaaagggagagaaggaaaagctgagattttccaaatgagctatctgattaaaggattaaacaatgatttcatttaatttagagttaatgtgatcttaataggcttagagttctaaacctaacctgaccttggtgtttaaacaccctgtgccaagtggcaactacttcctttaaagggaaaaaaaaacctgaagaaaactaa

SEQ ID NO: 23857 - DNA, 540 bp, Homo sapiens
ggaaatcaaagacattttaaagtgattataaatctttgtacatgttgacaatattcaattcagttaaaggctttatcacggtacattgtgacctctctttaaatggttacattactttgagctctgaaaatttgttatacttacattgttctaattgttcataactaggaattcactgactttgctttaatgtatgctaggaaaactgaagtagataaatcatacttcccctttcagtctccttctctcttttggatttaattttaactcgaggtttattaattacagaagttacactcatgttgctgcaaatgtattttttctagttgttaatttgttcatgacattctgcttgatgatagtaatattatgatgaaggtgcctcagatatcaaaaaagatttcaagtctatagaacgtacctctagctacagagtcacaggatatgtgacagcaatgatattaggggatgctgagctggaaacccaattcagcaccagagacagaaatactgtattttgactcattcatcttacatgga

SEQ ID NO: 23858 - DNA, 413 bp, Homo sapiens
taattaaaacagtatggtactggtataaagacacatagattaatggaacagaatagagagttcacaaataaatccacacatgatacggtcaactgatgtttgacaagagtgccaagaatacgcaaagtggaaaggatagtctcttcaacaaatagtgttagcaaaactggatatccccatacaaaagaataaaattgggccccaatcttacatcatacacaaaaaatcaattcaaaatggattaaaaacttgaacataagaactgaaactgtaaaactttcagaagaaaacataggggaaagcttcatcacattagtcttggtaatgatttcatggatatgaaaatcacaggccacaaaagcaaaaatggacatgtgggattacaaaaccataaaagcttttgtacagccaaa

SEQ ID NO: 23859 - DNA, 494 bp, Homo sapiens
tatacggcaacatgacagagtaacttgatttctatgaaatgtagtaataaaaataggggcttgtatttgcttgacattggctttctttttaatttcattgtttatgatttatttttcatacacttaaaaaacatcatggtgcacaatggatttgagaaaaactggccctttacacgatgatttgagagcttggtatatgtggcatcaaaaatcccaggaaacaagtgaagaattaaaatagaagtctgcatgttttacctatccagcaaaaggtggaagtggaaaaagtccagagttccaactggatgggtcagttctctgccagatgttggtgtcctgtagacccggccagaggacatgctttgatactctgcccttggagatgcactcagtattgtcagaggaatacaggtccaaagtgaagaactatctgactgcaggggctgatggctcttctgggctggtgggatctacgtggagattgctgtgctcta

SEQ ID NO: 23860 - DNA, 176 bp, Homo sapiens
tgtgagtggggattactggggcgccagtcatgccttatttcttgagccacatgttgtgttggttacacgggtgttttccatttggggaagtttgttagctgcacacttagaatgtgtagacttcttcctatgtatgttattcttcaattttaaaaatgcattaaaaaataagtaaa

SEQ ID NO: 23861 - DNA, 3164 bp, Homo sapiens
aaaccggaacggggcccaacttctggggcctggagaagggaaacgaagtcccccccggtttcccgaggttgcctttcctcgggcatccctggggctgccgcgggacctcgcagggcggatataaagaaccgcggccttgggaagaggcggagaccggcttttaaagaaagaagtcctgggtcctgcggtctgcgggcgaggcaagggcgcttttctgcccacgctccccgtggcccatcgatcccccgcgcgtccgccgctgttctaaggagagaagtgggggccccccaggctcgcgcgtggagcgaagcagcatgggcagtcggtgcgcgctggccctggcggtgctctcggccttgctgtgtcaggtctggagctctggggtgttcgaactgaagctgcaggagttcgtcaacaagaaggggctgctggggaaccgcaactgctgccgcgggggcgcggggccaccgccgtgcgcctgccggaccttcttccgcgtgtgcctcaagcactaccaggccagcgtgtcccccgagccgccctgcacctacggcagcgccgtcacccccgtgctgggcgtcgactccttcagtctgcccgacggcgggggcgccgactccgcgttcagcaaccccatccgcttccccttcggcttcacctggccgggcaccttctctctgattattgaagctctccacacagattctcctgatgacctcgcaacagaaaacccagaaagactcatcagccgcctggccacccagaggcacctgacggtgggcgaggagtggtcccaggacctgcacagcagcggccgcacggacctcaagtactcctaccgcttcgtgtgtgacgaacactactacggagagggctgctccgttttctgccgtccccgggacgatgccttcggccacttcacctgtggggagcgtggggagaaagtgtgcaaccctggctggaaagggccctactgcacagagccgatctgcctgcctggatgtgatgagcagcatggattttgtgacaaaccaggggaatgcaagtgcagagtgggctggcagggccggtactgtgacgagtgtatccgctatccaggctgtctccatggcacctgccagcagccctggcagtgcaactgccaggaaggctgggggggccttttctgcaaccaggacctgaactactgcacacaccataagccctgcaagaatggagccacctgcaccaacacgggccaggggagctacacttgctcttgccggcctgggtacacaggtgccacctgcgagctggggattgacgagtgtgaccccagcccttgtaagaacggagggagctgcacggatctcgagaacagctactcctgtacctgcccacccggcttctacggcaaaatctgtgaattgagtgccatgacctgtgcggacggcccttgctttaacgggggtcggtgctcagacagccccgatggagggtacagctgccgctgccccgtgggctactccggcttcaactgtgagaagaaaattgactactgcagctcttcaccctgttctaatggtgccaagtgtgtggacctcggtgatgcctacctgtgccgctgccaggccggcttctcggggaggcactgtgacgacaacgtggacgactgcgcctcctccccgtgcgccaacgggggcacctgccgggatggcgtgaacgacttctcctgcacctgcccgcctggctacacgggcaggaactgcagtgcccccgtcagcaggtgcgagcacgcaccctgccacaatggggccacctgccacgagaggggccaccgctatgtgtgcgagtgtgcccgaggctacgggggtcccaactgccagttcctgctccccgagctgcccccgggcccagcggtggtggacctcactgagaagctagagggccagggcgggccattcccctgggtggccgtgtgcgccggggtcatccttgtcctcatgctgctgctgggctgtgccgctgtggtggtctgcgtccggctgaggctgcagaagcaccggcccccagccgacccctgccggggggagacggagaccatgaacaacctggccaactgccagcgtgagaaggacatctcagtcagcatcatcggggccacgcagatcaagaacaccaacaagaaggcggacttccacggggaccacagcgccgacaagaatggcttcaaggcccgctacccagcggtggactataacctcgtgcaggacctcaagggtgacgacaccgccgtcagggacgcgcacagcaagcgtgacaccaagtgccagccccagggctcctcaggggaggagaaggggaccccgaccacactcaggggtggagaagcatctgaaagaaaaaggccggactcgggctgttcaacttcaaaagacaccaagtaccagtcggtgtacgtcatatccgaggagaaggatgagtgcgtcatagcaactgaggtgtaaaatggaagtgagatggcaagactcccgtttctcttaaaataagtaaaattccaaggatatatgccccaacgaatgctgctgaagaggagggaggcctcgtggactgctgctgagaaaccgagttcagaccgagcaggttctcctcctgaggtcctcgacgcctgccgacagcctgtcgcggcccggccgcctgcggcactgccttccgtgacgtcgccgttgcactatggacagttgctcttaagagaatatatatttaaatgggtgaactgaattacgcataagaagcatgcactgcctgagtgtatattttggattcttatgagccagtcttttcttgaattagaaacacaaacactgcctttattgtcctttttgatacgaagatgtgctttttctagatggaaaagatgtgtgttattttttggatttgtaaaaatatttttcatgatatctgtaaagcttgagtattttgtgatgttcgttttttataatttaaattttggtaaatatgtacaaaggcacttcgggtctatgtgactatatttttttgtatataaatgtatttatggaatattgtgcaaatgttatttgagttttttactgttttgttaatgaagaaattcctttttaaaatatttttccaaaataaattttatgaatgacaaacagaaggcg

SEQ ID NO: 23862 - DNA, 3644 bp, Homo sapiens
agccagatcctctgcgcgcacccgcggagacccgacccggccgagggcagagcgcaggggaacccgggcagccgcggcgcagagcctcctcccacggcccggcccctccggtcctgcgcgtgtgtactggatggcattggctggattcatcggaaagacgcggatctttgctgtgacaccggagatcggagcccggagtgctcccggaacgaccgccgccgccgagtgacaccgggccgcgatccgcaggggccgccgcgcacacccgccgccgccgaccgtcccctcagcgcgcgccgctggccccggattatcgccttgcccgtgggatttccagaccgcggctttctaatcggctcgggaggaagctctgcagctctcttgggaattaagctcaatctctggactctctctctttctctttctccccctccctctcctgcgaagaagctcaagacaaaaccaggaagccggcgaccctcacctcctcgggggctgggaggaaggaggaaaacgaaagtcgccgccgccgcgctgtcccccgagagctgcctttcctcgggcatccctggggctgccgcgggacctcgcagggcggatataaagaaccgcggccttgggaagaggcggagaccggcttttaaagaaagaagtcctgggtcctgcggtctgcgggcgaggcaagggcgcttttctgcccacgctccccgtggcccatcgatcccccgcgcgtccgccgctgttctaaggagagaagtgggggccccccaggctcgcgcgtggagcgaagcagcatgggcagtcggtgcgcgctggccctggcggtgctctcggccttgctgtgtcaggtctggagctctggggtgttcgaactgaagctgcaggagttcgtcaacaagaaggggctgctggggaaccgcaactgctgccgcgggggcgcggggccaccgccgtgcgcctgccggaccttcttccgcgtgtgcctcaagcactaccaggccagcgtgtcccccgagccgccctgcacctacggcagcgccgtcacccccgtgctgggcgtcgactccttcagtctgcccgacggcgggggcgccgactccgcgttcagcaaccccatccgcttccccttcggcttcacctggccgggcaccttctctctgattattgaagctctccacacagattctcctgatgacctcgcaacagaaaacccagaaagactcatcagccgcctggccacccagaggcacctgacggtgggcgaggagtggtcccaggacctgcacagcagcggccgcacggacctcaagtactcctaccgcttcgtgtgtgacgaacactactacggagagggctgctccgttttctgccgtccccgggacgatgccttcggccacttcacctgtggggagcgtggggagaaagtgtgcaaccctggctggaaagggccctactgcacagagccgatctgcctgcctggatgtgatgagcagcatggattttgtgacaaaccaggggaatgcaagtgcagagtgggctggcagggccggtactgtgacgagtgtatccgctatccaggctgtctccatggcacctgccagcagccctggcagtgcaactgccaggaaggctgggggggccttttctgcaaccaggacctgaactactgcacacaccataagccctgcaagaatggagccacctgcaccaacacgggccaggggagctacacttgctcttgccggcctgggtacacaggtgccacctgcgagctggggattgacgagtgtgaccccagcccttgtaagaacggagggagctgcacggatctcgagaacagctactcctgtacctgcccacccggcttctacggcaaaatctgtgaattgagtgccatgacctgtgcggacggcccttgctttaacgggggtcggtgctcagacagccccgatggagggtacagctgccgctgccccgtgggctactccggcttcaactgtgagaagaaaattgactactgcagctcttcaccctgttctaatggtgccaagtgtgtggacctcggtgatgcctacctgtgccgctgccaggccggcttctcggggaggcactgtgacgacaacgtggacgactgcgcctcctccccgtgcgccaacgggggcacctgccgggatggcgtgaacgacttctcctgcacctgcccgcctggctacacgggcaggaactgcagtgcccccgtcagcaggtgcgagcacgcaccctgccacaatggggccacctgccacgagaggggccaccgctatgtgtgcgagtgtgcccgaggctacgggggtcccaactgccagttcctgctccccgagctgcccccgggcccagcggtggtggacctcactgagaagctagagggccagggcgggccattcccctgggtggccgtgtgcgccggggtcatccttgtcctcatgctgctgctgggctgtgccgctgtggtggtctgcgtccggctgaggctgcagaagcaccggcccccagccgacccctgccggggggagacggagaccatgaacaacctggccaactgccagcgtgagaaggacatctcagtcagcatcatcggggccacgcagatcaagaacaccaacaagaaggcggacttccacggggaccacagcgccgacaagaatggcttcaaggcccgctacccagcggtggactataacctcgtgcaggacctcaagggtgacgacaccgccgtcagggacgcgcacagcaagcgtgacaccaagtgccagccccagggctcctcaggggaggagaaggggaccccgaccacactcaggggtggagaagcatctgaaagaaaaaggccggactcgggctgttcaacttcaaaagacaccaagtaccagtcggtgtacgtcatatccgaggagaaggatgagtgcgtcatagcaactgaggtgtaaaatggaagtgagatggcaagactcccgtttctcttaaaataagtaaaattccaaggatatatgccccaacgaatgctgctgaagaggagggaggcctcgtggactgctgctgagaaaccgagttcagaccgagcaggttctcctcctgaggtcctcgacgcctgccgacagcctgtcgcggcccggccgcctgcggcactgccttccgtgacgtcgccgttgcactatggacagttgctcttaagagaatatatatttaaatgggtgaactgaattacgcataagaagcatgcactgcctgagtgtatattttggattcttatgagccagtcttttcttgaattagaaacacaaacactgcctttattgtcctttttgatacgaagatgtgctttttctagatggaaaagatgtgtgttattttttggatttgtaaaaatatttttcatgatatctgtaaagcttgagtattttgtgatgttcgttttttataatttaaattttggtaaatatgtacaaaggcacttcgggtctatgtgactatatttttttgtatataaatgtatttatggaatattgtgcaaatgttatttgagttttttactgttttgttaatgaagaaattcctttttaaaatatttttccaaaataaattttatgaatgacaaacagaaggcg

SEQ ID NO: 23863 - DNA, 3795 bp, Homo sapiens
agccagatcctctgcgcgcacccgcggagacccgacccggccgagggcagagcgcaggggaacccgggcagccgcggcgcagagcctcctcccacggcccggcccctccggtcctgcgcgtgtgtactggatggcattggctggattcatcggaaagacgcggatctttgctgtgacaccggagatcggagcccggagtgctcccggaacgaccgccgccgccgagtgacaccgggccgcgatccgcaggggccgccgcgcacacccgccgccgccgaccgtcccctcagcgcgcgccgctggccccggattatcgccttgcccgtgggatttccagaccgcggctttctaatcggctcgggaggaagctctgcagctctcttgggaattaagctcaatctctggactctctctctttctctttctccccctccctctcctgcgaagaagctcaagacaaaaccaggaagccggcgaccctcacctcctcgggggctgggaggaaggaggaaaacgaaagtcgccgccgccgcgctgtcccccgagagctgcctttcctcgggcatccctggggctgccgcgggacctcgcagggcggatataaagaaccgcggccttgggaagaggcggagaccggcttttaaagaaagaagtcctgggtcctgcggtctgcgggcgaggcaagggcgcttttctgcccacgctccccgtggcccatcgatcccccgcgcgtccgccgctgttctaaggagagaagtgggggccccccaggctcgcgcgtggagcgaagcagcatgggcagtcggtgcgcgctggccctggcggtgctctcggccttgctgtgtcaggtctggagctctggggtgttcgaactgaagctgcaggagttcgtcaacaagaaggggctgctggggaaccgcaactgctgccgcgggggcgcggggccaccgccgtgcgcctgccggaccttcttccgcgtgtgcctcaagcactaccaggccagcgtgtcccccgagccgccctgcacctacggcagcgccgtcacccccgtgctgggcgtcgactccttcagtctgcccgacggcgggggcgccgactccgcgttcagcaaccccatccgcttccccttcggcttcacctggccgggcaccttctctctgattattgaagctctccacacagattctcctgatgacctcgcaacagaaaacccagaaagactcatcagccgcctggccacccagaggcacctgacggtgggcgaggagtggtcccaggacctgcacagcagcggccgcacggacctcaagtactcctaccgcttcgtgtgtgacgaacactactacggagagggctgctccgttttctgccgtccccgggacgatgccttcggccacttcacctgtggggagcgtggggagaaagtgtgcaaccctggctggaaagggccctactgcacagagccgatctgcctgcctggatgtgatgagcagcatggattttgtgacaaaccaggggaatgcaagtgcagagtgggctggcagggccggtactgtgacgagtgtatccgctatccaggctgtctccatggcacctgccagcagccctggcagtgcaactgccaggaaggctgggggggccttttctgcaaccaggaccagggtaagccttctctccctgaggcagcctgctccctccagagcagccctggacttccctggctgtttgatcactggaaaaataaagtcttcctgcatttgatgtcgagcttcctatctcctacttttcctgtccccacccttcacagacctgaactactgcacacaccataagccctgcaagaatggagccacctgcaccaacacgggccaggggagctacacttgctcttgccggcctgggtacacaggtgccacctgcgagctggggattgacgagtgtgaccccagcccttgtaagaacggagggagctgcacggatctcgagaacagctactcctgtacctgcccacccggcttctacggcaaaatctgtgaattgagtgccatgacctgtgcggacggcccttgctttaacgggggtcggtgctcagacagccccgatggagggtacagctgccgctgccccgtgggctactccggcttcaactgtgagaagaaaattgactactgcagctcttcaccctgttctaatggtgccaagtgtgtggacctcggtgatgcctacctgtgccgctgccaggccggcttctcggggaggcactgtgacgacaacgtggacgactgcgcctcctccccgtgcgccaacgggggcacctgccgggatggcgtgaacgacttctcctgcacctgcccgcctggctacacgggcaggaactgcagtgcccccgtcagcaggtgcgagcacgcaccctgccacaatggggccacctgccacgagaggggccaccgctatgtgtgcgagtgtgcccgaggctacgggggtcccaactgccagttcctgctccccgagctgcccccgggcccagcggtggtggacctcactgagaagctagagggccagggcgggccattcccctgggtggccgtgtgcgccggggtcatccttgtcctcatgctgctgctgggctgtgccgctgtggtggtctgcgtccggctgaggctgcagaagcaccggcccccagccgacccctgccggggggagacggagaccatgaacaacctggccaactgccagcgtgagaaggacatctcagtcagcatcatcggggccacgcagatcaagaacaccaacaagaaggcggacttccacggggaccacagcgccgacaagaatggcttcaaggcccgctacccagcggtggactataacctcgtgcaggacctcaagggtgacgacaccgccgtcagggacgcgcacagcaagcgtgacaccaagtgccagccccagggctcctcaggggaggagaaggggaccccgaccacactcaggggtggagaagcatctgaaagaaaaaggccggactcgggctgttcaacttcaaaagacaccaagtaccagtcggtgtacgtcatatccgaggagaaggatgagtgcgtcatagcaactgaggtgtaaaatggaagtgagatggcaagactcccgtttctcttaaaataagtaaaattccaaggatatatgccccaacgaatgctgctgaagaggagggaggcctcgtggactgctgctgagaaaccgagttcagaccgagcaggttctcctcctgaggtcctcgacgcctgccgacagcctgtcgcggcccggccgcctgcggcactgccttccgtgacgtcgccgttgcactatggacagttgctcttaagagaatatatatttaaatgggtgaactgaattacgcataagaagcatgcactgcctgagtgtatattttggattcttatgagccagtcttttcttgaattagaaacacaaacactgcctttattgtcctttttgatacgaagatgtgctttttctagatggaaaagatgtgtgttattttttggatttgtaaaaatatttttcatgatatctgtaaagcttgagtattttgtgatgttcgttttttataatttaaattttggtaaatatgtacaaaggcacttcgggtctatgtgactatatttttttgtatataaatgtatttatggaatattgtgcaaatgttatttgagttttttactgttttgttaatgaagaaattcctttttaaaatatttttccaaaataaattttatgaatgacaaacagaaggcg

SEQ ID NO: 23864 - DNA, 1750 bp, Homo sapiens
agccagatcctctgcgcgcacccgcggagacccgacccggccgagggcagagcgcaggggaacccgggcagccgcggcgcagagcctcctcccacggcccggcccctccggtcctgcgcgtgtgtactggatggcattggctggattcatcggaaagacgcggatctttgctgtgacaccggagatcggagcccggagtgctcccggaacgaccgccgccgccgagtgacaccgggccgcgatccgcaggggccgccgcgcacacccgccgccgccgaccgtcccctcagcgcgcgccgctggccccggattatcgccttgcccgtgggatttccagaccgcggctttctaatcggctcgggaggaagctctgcagctctcttgggaattaagctcaatctctggactctctctctttctctttctccccctccctctcctgcgaagaagctcaagacaaaaccaggaagccggcgaccctcacctcctcgggggctgggaggaaggaggaaaacgaaagtcgccgccgccgcgctgtcccccgagagctgcctttcctcgggcatccctggggctgccgcgggacctcgcagggcggatataaagaaccgcggccttgggaagaggcggagaccggcttttaaagaaagaagtcctgggtcctgcggtctgcgggcgaggcaagggcgcttttctgcccacgctccccgtggcccatcgatcccccgcgcgtccgccgctgttctaaggagagaagtgggggccccccaggctcgcgcgtggagcgaagcagcatgggcagtcggtgcgcgctggccctggcggtgctctcggccttgctgtgtcaggtctggagctctggggtgttcgaactgaagctgcaggagttcgtcaacaagaaggggctgctggggaaccgcaactgctgccgcgggggcgcggggccaccgccgtgcgcctgccggaccttcttccgcgtgtgcctcaagcactaccaggccagcgtgtcccccgagccgccctgcacctacggcagcgccgtcacccccgtgctgggcgtcgactccttcagtctgcccgacggcgggggcgccgactccgcgttcagcaaccccatccgcttccccttcggcttcacctggccgggcaccttctctctgattattgaagctctccacacagattctcctgatgacctcgcaacagaaaacccagaaagactcatcagccgcctggccacccagaggcacctgacggtgggcgaggagtggtcccaggacctgcacagcagcggccgcacggacctcaagtactcctaccgcttcgtgtgtgacgaacactactacggagagggctgctccgttttctgccgtccccgggacgatgccttcggccacttcacctgtggggagcgtggggagaaagtgtgcaaccctggctggaaagggccctactgcacagagcgtgagtctctgggaaggcaccgctggctcactcgtccacgaacacggaccacgcgcagggacggggcttcctgagccacggggggcttgggactgtagagatgttctggtggggaaactgaggcccagaggacagaagtggattgctataagtcacagctcgtcagtgggggggttgggtcaacgcagacattttaacatcccaggctgtgtttatccactatcggaactgcctttcttaatcagggaggattttagagacagggccaggggtcaggaagtaaagc

SEQ ID NO: 23865 - DNA, 3172 bp, Homo sapiens
gaattccattttaagttatacaaaactgattaccataagtgcggtcgactgcttttatttttacgttgtgtgtgttggaaaaatgctaaaacatcagtctacaattctatatattgttattaaagattaatccaaccagcaacccaaggacatataagcgatttccactattgcatcagagcactcggcaggaaaggcctagccacggggaacattagaagctacagaagcattgcagagaagagaagatcccccgcgcgtccgccgctgttctaaggagagaagtgggggccccccaggctcgcgcgtggagcgaagcagcatgggcagtcggtgcgcgctggccctggcggtgctctcggccttgctgtgtcaggtctggagctctggggtgttcgaactgaagctgcaggagttcgtcaacaagaaggggctgctggggaaccgcaactgctgccgcgggggcgcggggccaccgccgtgcgcctgccggaccttcttccgcgtgtgcctcaagcactaccaggccagcgtgtcccccgagccgccctgcacctacggcagcgccgtcacccccgtgctgggcgtcgactccttcagtctgcccgacggcgggggcgccgactccgcgttcagcaaccccatccgcttccccttcggcttcacctggccgggcaccttctctctgattattgaagctctccacacagattctcctgatgacctcgcaacagaaaacccagaaagactcatcagccgcctggccacccagaggcacctgacggtgggcgaggagtggtcccaggacctgcacagcagcggccgcacggacctcaagtactcctaccgcttcgtgtgtgacgaacactactacggagagggctgctccgttttctgccgtccccgggacgatgccttcggccacttcacctgtggggagcgtggggagaaagtgtgcaaccctggctggaaagggccctactgcacagagccgatctgcctgcctggatgtgatgagcagcatggattttgtgacaaaccaggggaatgcaagtgcagagtgggctggcagggccggtactgtgacgagtgtatccgctatccaggctgtctccatggcacctgccagcagccctggcagtgcaactgccaggaaggctgggggggccttttctgcaaccaggacctgaactactgcacacaccataagccctgcaagaatggagccacctgcaccaacacgggccaggggagctacacttgctcttgccggcctgggtacacaggtgccacctgcgagctggggattgacgagtgtgaccccagcccttgtaagaacggagggagctgcacggatctcgagaacagctactcctgtacctgcccacccggcttctacggcaaaatctgtgaattgagtgccatgacctgtgcggacggcccttgctttaacgggggtcggtgctcagacagccccgatggagggtacagctgccgctgccccgtgggctactccggcttcaactgtgagaagaaaattgactactgcagctcttcaccctgttctaatggtgccaagtgtgtggacctcggtgatgcctacctgtgccgctgccaggccggcttctcggggaggcactgtgacgacaacgtggacgactgcgcctcctccccgtgcgccaacgggggcacctgccgggatggcgtgaacgacttctcctgcacctgcccgcctggctacacgggcaggaactgcagtgcccccgtcagcaggtgcgagcacgcaccctgccacaatggggccacctgccacgagaggggccaccgctatgtgtgcgagtgtgcccgaggctacgggggtcccaactgccagttcctgctccccgagctgcccccgggcccagcggtggtggacctcactgagaagctagagggccagggcgggccattcccctgggtggccgtgtgcgccggggtcatccttgtcctcatgctgctgctgggctgtgccgctgtggtggtctgcgtccggctgaggctgcagaagcaccggcccccagccgacccctgccggggggagacggagaccatgaacaacctggccaactgccagcgtgagaaggacatctcagtcagcatcatcggggccacgcagatcaagaacaccaacaagaaggcggacttccacggggaccacagcgccgacaagaatggcttcaaggcccgctacccagcggtggactataacctcgtgcaggacctcaagggtgacgacaccgccgtcagggacgcgcacagcaagcgtgacaccaagtgccagccccagggctcctcaggggaggagaaggggaccccgaccacactcaggggtggagaagcatctgaaagaaaaaggccggactcgggctgttcaacttcaaaagacaccaagtaccagtcggtgtacgtcatatccgaggagaaggatgagtgcgtcatagcaactgaggtgtaaaatggaagtgagatggcaagactcccgtttctcttaaaataagtaaaattccaaggatatatgccccaacgaatgctgctgaagaggagggaggcctcgtggactgctgctgagaaaccgagttcagaccgagcaggttctcctcctgaggtcctcgacgcctgccgacagcctgtcgcggcccggccgcctgcggcactgccttccgtgacgtcgccgttgcactatggacagttgctcttaagagaatatatatttaaatgggtgaactgaattacgcataagaagcatgcactgcctgagtgtatattttggattcttatgagccagtcttttcttgaattagaaacacaaacactgcctttattgtcctttttgatacgaagatgtgctttttctagatggaaaagatgtgtgttattttttggatttgtaaaaatatttttcatgatatctgtaaagcttgagtattttgtgatgttcgttttttataatttaaattttggtaaatatgtacaaaggcacttcgggtctatgtgactatatttttttgtatataaatgtatttatggaatattgtgcaaatgttatttgagttttttactgttttgttaatgaagaaattcctttttaaaatatttttccaaaataaattttatgaatgacaaacagaaggcg

SEQ ID NO: 23866 - DNA, 3762 bp, Homo sapiens
agccagatcctctgcgcgcacccgcggagacccgacccggccgagggcagagcgcaggggaacccgggcagccgcggcgcagagcctcctcccacggcccggcccctccggtcctgcgcgtgtgtactggatggcattggctggattcatcggaaagacgcggatctttgctgtgacaccggagatcggagcccggagtgctcccggaacgaccgccgccgccgagtgacaccgggccgcgatccgcaggggccgccgcgcacacccgccgccgccgaccgtcccctcagcgcgcgccgctggccccggattatcgccttgcccgtgggatttccagaccgcggctttctaatcggctcgggaggaagctctgcagctctcttgggaattaagctcaatctctggactctctctctttctctttctccccctccctctcctgcgaagaagctcaagacaaaaccaggaagccggcgaccctcacctcctcgggggctgggaggaaggaggaaaacgaaagtcgccgccgccgcgctgtcccccgagagctgcctttcctcgggcatccctggggctgccgcgggacctcgcagggcggatataaagaaccgcggccttgggaagaggcggagaccggcttttaaagaaagaagtcctgggtcctgcggtctgcgggcgaggcaagggcgcttttctgcccacgctccccgtggcccatcgatcccccgcgcgtccgccgctgttctaaggagagaagtgggggccccccaggctcgcgcgtggagcgaagcagcatgggcagtcggtgcgcgctggccctggcggtgctctcggccttgctgtgtcaggtctggagctctggggtgttcgaactgaagctgcaggagttcgtcaacaagaaggggctgctggggaaccgcaactgctgccgcgggggcgcggggccaccgccgtgcgcctgccggaccttcttccgcgtgtgcctcaagcactaccaggccagcgtgtcccccgagccgccctgcacctacggcagcgccgtcacccccgtgctgggcgtcgactccttcagtctgcccgacggcgggggcgccgactccgcgttcagcaaccccatccgcttccccttcggcttcacctggccgggcaccttctctctgattattgaagctctccacacagattctcctgatgacctcgcaacagaaaacccagaaagactcatcagccgcctggccacccagaggcacctgacggtgggcgaggagtggtcccaggacctgcacagcagcggccgcacggacctcaagtactcctaccgcttcgtgtgtgacgaacactactacggagagggctgctccgttttctgccgtccccgggacgatgccttcggccacttcacctgtggggagcgtggggagaaagtgtgcaaccctggctggaaagggccctactgcacagagccgatctgcctgcctggatgtgatgagcagcatggattttgtgacaaaccaggggaatgcaagtgcagagtgggctggcagggccggtactgtgacgagtgtatccgctatccaggctgtctccatggcacctgccagcagccctggcagtgcaactgccaggaaggctgggggggccttttctgcaaccaggacctgaactactgcacacaccataagccctgcaagaatggagccacctgcaccaacacgggccaggggagctacacttgctcttgccggcctgggtacacaggtgccacctgcgagctggggattgacgagtgtgaccccagcccttgtaagaacggagggagctgcacggtgagtcggaggctccatggcatctcacccggaagctggggtgccctggtgttgaatggagtgtgtgggctccttggagcaactttggaaagccttttctgacctctccatcgtgtaggatctcgagaacagctactcctgtacctgcccacccggcttctacggcaaaatctgtgaattgagtgccatgacctgtgcggacggcccttgctttaacgggggtcggtgctcagacagccccgatggagggtacagctgccgctgccccgtgggctactccggcttcaactgtgagaagaaaattgactactgcagctcttcaccctgttctaatggtgccaagtgtgtggacctcggtgatgcctacctgtgccgctgccaggccggcttctcggggaggcactgtgacgacaacgtggacgactgcgcctcctccccgtgcgccaacgggggcacctgccgggatggcgtgaacgacttctcctgcacctgcccgcctggctacacgggcaggaactgcagtgcccccgtcagcaggtgcgagcacgcaccctgccacaatggggccacctgccacgagaggggccaccgctatgtgtgcgagtgtgcccgaggctacgggggtcccaactgccagttcctgctccccgagctgcccccgggcccagcggtggtggacctcactgagaagctagagggccagggcgggccattcccctgggtggccgtgtgcgccggggtcatccttgtcctcatgctgctgctgggctgtgccgctgtggtggtctgcgtccggctgaggctgcagaagcaccggcccccagccgacccctgccggggggagacggagaccatgaacaacctggccaactgccagcgtgagaaggacatctcagtcagcatcatcggggccacgcagatcaagaacaccaacaagaaggcggacttccacggggaccacagcgccgacaagaatggcttcaaggcccgctacccagcggtggactataacctcgtgcaggacctcaagggtgacgacaccgccgtcagggacgcgcacagcaagcgtgacaccaagtgccagccccagggctcctcaggggaggagaaggggaccccgaccacactcaggggtggagaagcatctgaaagaaaaaggccggactcgggctgttcaacttcaaaagacaccaagtaccagtcggtgtacgtcatatccgaggagaaggatgagtgcgtcatagcaactgaggtgtaaaatggaagtgagatggcaagactcccgtttctcttaaaataagtaaaattccaaggatatatgccccaacgaatgctgctgaagaggagggaggcctcgtggactgctgctgagaaaccgagttcagaccgagcaggttctcctcctgaggtcctcgacgcctgccgacagcctgtcgcggcccggccgcctgcggcactgccttccgtgacgtcgccgttgcactatggacagttgctcttaagagaatatatatttaaatgggtgaactgaattacgcataagaagcatgcactgcctgagtgtatattttggattcttatgagccagtcttttcttgaattagaaacacaaacactgcctttattgtcctttttgatacgaagatgtgctttttctagatggaaaagatgtgtgttattttttggatttgtaaaaatatttttcatgatatctgtaaagcttgagtattttgtgatgttcgttttttataatttaaattttggtaaatatgtacaaaggcacttcgggtctatgtgactatatttttttgtatataaatgtatttatggaatattgtgcaaatgttatttgagttttttactgttttgttaatgaagaaattcctttttaaaatatttttccaaaataaattttatgaatgacaaacagaaggcg

SEQ ID NO: 23867 - DNA, 2586 bp, Homo sapiens
aacggctatgagaatttacagatagtagtttaaaaagagttggcacaggaaatgatagtatagttcaatggttctcaaatgttgcctcatcctagaatcactcagggagtgatttttgagatgctgacactggtgctgccctaacacccaagaagccagaacctctggtggggcccaggcccaggctgcagctcccaaggtgacccagtgttctgctaatctggagaaccagaggctcactggtgctgcgggaagatggtttctagggtgagaatgtccactgcaaagccagcaacagtcaacgtccatctgagtcttctgcttttctcaccagggtaagccttctctccctgaggcagcctgctccctccagagcagccctggacttccctggctgtttgatcactggaaaaataaagtcttcctgcatttgatgtcgagcttcctatctcctacttttcctgtccccacccttcacagacctgaactactgcacacaccataagccctgcaagaatggagccacctgcaccaacacgggccaggggagctacacttgctcttgccggcctgggtacacaggtgccacctgcgagctggggattgacgagtgtgaccccagcccttgtaagaacggagggagctgcacggtgagtcggaggctccatggcatctcacccggaagctggggtgccctggtgttgaatggagtgtgtgggctccttggagcaactttggaaagccttttctgacctctccatcgtgtaggatctcgagaacagctactcctgtacctgcccacccggcttctacggcaaaatctgtgaattgagtgccatgacctgtgcggacggcccttgctttaacgggggtcggtgctcagacagccccgatggagggtacagctgccgctgccccgtgggctactccggcttcaactgtgagaagaaaattgactactgcagctcttcaccctgttctaatggtgccaagtgtgtggacctcggtgatgcctacctgtgccgctgccaggccggcttctcggggaggcactgtgacgacaacgtggacgactgcgcctcctccccgtgcgccaacgggggcacctgccgggatggcgtgaacgacttctcctgcacctgcccgcctggctacacgggcaggaactgcagtgcccccgtcagcaggtgcgagcacgcaccctgccacaatggggccacctgccacgagaggggccaccgctatgtgtgcgagtgtgcccgaggctacgggggtcccaactgccagttcctgctccccgagctgcccccgggcccagcggtggtggacctcactgagaagctagagggccagggcgggccattcccctgggtggccgtgtgcgccggggtcatccttgtcctcatgctgctgctgggctgtgccgctgtggtggtctgcgtccggctgaggctgcagaagcaccggcccccagccgacccctgccggggggagacggagaccatgaacaacctggccaactgccagcgtgagaaggacatctcagtcagcatcatcggggccacgcagatcaagaacaccaacaagaaggcggacttccacggggaccacagcgccgacaagaatggcttcaaggcccgctacccagcggtggactataacctcgtgcaggacctcaagggtgacgacaccgccgtcagggacgcgcacagcaagcgtgacaccaagtgccagccccagggctcctcaggggaggagaaggggaccccgaccacactcaggggtggagaagcatctgaaagaaaaaggccggactcgggctgttcaacttcaaaagacaccaagtaccagtcggtgtacgtcatatccgaggagaaggatgagtgcgtcatagcaactgaggtgtaaaatggaagtgagatggcaagactcccgtttctcttaaaataagtaaaattccaaggatatatgccccaacgaatgctgctgaagaggagggaggcctcgtggactgctgctgagaaaccgagttcagaccgagcaggttctcctcctgaggtcctcgacgcctgccgacagcctgtcgcggcccggccgcctgcggcactgccttccgtgacgtcgccgttgcactatggacagttgctcttaagagaatatatatttaaatgggtgaactgaattacgcataagaagcatgcactgcctgagtgtatattttggattcttatgagccagtcttttcttgaattagaaacacaaacactgcctttattgtcctttttgatacgaagatgtgctttttctagatggaaaagatgtgtgttattttttggatttgtaaaaatatttttcatgatatctgtaaagcttgagtattttgtgatgttcgttttttataatttaaattttggtaaatatgtacaaaggcacttcgggtctatgtgactatatttttttgtatataaatgtatttatggaatattgtgcaaatgttatttgagttttttactgttttgttaatgaagaaattcctttttaaaatatttttccaaaataaattttatgaatgacaaacagaaggcg

SEQ ID NO: 23868 - DNA, 894 bp, Homo sapiens
ttgccgcagcgggaggagtaacagctgttcacacacacaggcttcatccactctatccggggtaggacaggcaggcctctgtgcaggcccaggtcctggaaactaaaagaggagcacagcagaccatctgcaaacatactctgtttgctgctaaggatggcactcggtaacttccaggcagccagtacacctgcatcctctccacccggctgggtgtttgagcggtgttttcctagcacagggaccagcatgggctgactaggcacccaccgctgctaagcgtcacccagtgattgtaacgggcactctgactcctcacagtgcaggctctgggcagagaggcctggagggaaaggccagcacagagcagccactcacagggacaaacaccaccctaagccttgggagcccgactaacccagacccaacactctcccaaccttcctgacagccaggggtgaggggaacctgtctcgtggctcccacgagggcaggctcaaccttgaggaggctggtgccctcggacctggtcacagcatgagccggtaacagaggactcaccccaaggcccagcaaagcaagacatgagctcagagcccataggagcatcagaaccctgagtaacacaggttctaaatctaacttctcggaggcaccaagcatgagctctgaatcagcagcctcaagggtgccctggtgctccaaaaaagctgtcccaggagagaggagcaagcctggaggaggcgccccggaccacccccgagacctgccaatgggaagaactcctgaaaggaccggactgtttccaataatctaactgtcccacaacaaagctcaagaatttttacaggaatgtagatatccatcacctaacaaggtgaaactcaaaataca

SEQ ID NO: 23869 - DNA, 419 bp, Homo sapiens
ctgcctccaatctgaacttcctctcgcctcctgtgtctaaaaaaagatgtaccaaaaagtggaggaggtcaggaaaaagcaaactaattgttaagtataatatggcttgttgtttttgtatttacattttcatggattccctcccccgcccaccatttgactaggacttactaattagtgattgatatatgtctttcttaacacagaactcagcagccaaaagaaaagatttgtcaataccacaaatgcatcatcattttaggtgagtggcatgaaaaatgtgggcaaaggcagtcagaaaataatcaggacccagaatctgtaggtcaaatatatttcaccccactttctaaactatatccaatttggttcttcattaagcctgcaaacaagtagaactactcattctccaagttcct

SEQ ID NO: 23870 - DNA, 403 bp, Homo sapiens
accaataaagtagctaccacttactgagtacttacaatgaatctttagattagaactcttcttcatcggggcaaggacccatttgtccccagtatccacaatagctccaagcacagtatgtgctcaaaacatatcagtacatgtaataaattgatgccagccacaatgcaaaaatctttacatgcattcctaatttaatctcaacactctcctcatcacttaccacacatacaaacacacagcttggtgaaagcagtatctttagcccccattttgcaaatgatgaaaccaatattacgagggttgaatggctgggcctggtgatgcacacctgtaatcccagcattttgggaggccaagaggaatcgcttgagctcaggagttcaagagcagcgtggccgac

SEQ ID NO: 23871 - DNA, 394 bp, Homo sapiens
agccaccccaaatattttctttttctacctgttttatatctcgtgatgttcagtcaccaaagggattgttcacaagattgtcttttctgaaggaagacatttaatgtaatatattaatttaaagatgaatctcttcaaaatggttaggaataagtatgactcccacacgataggtaatggctccttcaaatgagttaggccggctaggggggaaatgatttctcagccatcgctaggttcatggtcgagtcccttaggaacaaatgacagattaaccagaggaaaagtgtgcaagtttacgtaagattaagttttaccaggacacagggagccttcaggaaagaaaaactcaagagaaacaggaaatcctgtgtcaattggatgctgtctgatg

SEQ ID NO: 23872 - DNA, 412 bp, Homo sapiens
ggtagagaaaaatttatctttgtgaaagattagttttatggaggggattaactccagttttctttagtggttgtcagagatcttggagctgtggatccttatctaaaagaaaaaaaagtgtagcagttcagatctgtgtaaggaaaatttgtgaaagtctgaaacctaacaaaaggattactgaatagcttcagtggaacccaggtgctggctagagcaattttcttggttactactctgtagtctgtagctttcattgtttttgatgtattttacaaccttgtaagttgtgaataacaataatacaaattattcttgcccttttacatgcaaaggatgtttgttggaagtacaatggttttctttttctcttttgtggaagaagccagttttttatctgttaagcaaattc

SEQ ID NO: 23873 - DNA, 603 bp, Homo sapiens
cgcttggttgtgcctgctgtgtaccgaggcgtggggcatggcggcacggctgtgagcgcacagtccagccacagaaggaggcttcaagaatctttgcggtgctgccatctggacatctgtgtcattgaagtcacaggaggaggcttcaagaatcttcgaggtgctgccatctggacatctgtgtcattttgataacgtgtgtgagatcagtggaggggagccttaggaaaatcggctgtggtttaataaactgaacttcccgctgctttgagccggagcctcctggactggaaaggcgtgggcctcatggccacctccggcctgcgcagctgggtctgcactctcacaactgtgctgagcccacgcttgtgcccttactagtggcctgacctctgcgctgtggagaagggtggatattgtcgccaactctcagacttcttgtgtgtgttcagaaagtacccaaacggattcaaaggaataattagcgtatcctgtaagatatgaatcttaattcctaaattacatatttagcagattgtccaaaatagcacttgtaatggcaacattcaattagtttaaaaaatgtatattattgcaacactc

SEQ ID NO: 23874 - DNA, 398 bp, Homo sapiens
tgcattttctttctgagataaaaacttatttttaattgtattctgaattacttataacacattgttattagagctctggtttcagctaccaactgtaaagaaaaactttagcctttctagagttctttagagagcagttcatctcttcgaatcatcacacaaaaataattatctctggtgttgttttaataaaaagaaggcaagctccaagtgaagggaggagagtgggggtagagaggatggattcaggcttgaatagctgtgagaagaatgctttacccaatgagcccagcgccgggcttttttcccctaagacctcggaagtgaaattcttatgctgatatggttataactgattaccagctagtcagcacttcagtgaatttaaagttttattg

SEQ ID NO: 23875 - DNA, 390 bp, Homo sapiens
ctcaggtggcacccacttttcctggaggtctctgcttaagtggccctcagacatgcccagctggctgccgctctgacctgggatgaaagtctcccctcccccttcccactctgttcctttatgccgtgtcctacagtcttggatcatgtgctcatgggcagccctggccttccctgtatcaggcttctggaggcagaggctgtctgctgtgctcatctgggtccccagcacctgcacgttgctgggtactccaaacaggttgtcgcttgctcagggactgggcaggcagtgaagtggtgtcattgtctggggtgaatacctgagatttgttgtgagccaagatcgcgccactgcactccagcctgggcgatagatggagacttggtctca

SEQ ID NO: 23876 - DNA, 382 bp, Homo sapiens
tttttttgtaactcactcaaggcaacacagtgagttgtgtgagtaagcagactaactggattcgaattcagatccattctgttcacaattacacacactgcatgtctcctccactagaacaaagaaagggcagtaatcatctttatgtgttccccacacctagaacagatcatagcacagagtaagtagctgctaaataaatatttgcagaattaaatgtgtaacttcagagcgaattttgcctcaacctccattgctctgtgaacaccacgcttcatcttacttctgctcctggatgtcctagttaacttctctttccctgcacaaacatgtgcaccccaccacgatgtataccttttgttcttttctttttttcccttca

SEQ ID NO: 23877 - DNA, 392 bp, Homo sapiens
ttatagaccatgaccaagtcgacggatttatccctggaatgcaaggtggttcaacatataaaaacggatcaatgcaataacaccacattaacagaatgaagaaaaaatctatatgataatctgaactgacgcagaaaaagcatttaacaaaattcaataccctttcacaataaagcactcaacaaagtgggcataaaaggaaattacctcaacataataagggccatgtgagaaaagcacacagctaatatattcaatggtgagactgaaagctttcctgtaagatcaggaacaagactatgcctgcttttgctacttctattcaacacagtattggaagttctagtcagagcaattcgtcaataaaaaaaaaaagtctacgcaaattggaa

SEQ ID NO: 23878 - DNA, 627 bp, Homo sapiens
cgagctcggttccccgtgttctggggttggatcattggcctgacgtttgcaaattgaggaaccttagggcaaatcagtgaacttctgaactgccttcgtcttcagttatatggggatttccccacttttgagatccttgtaaggattatatgagatgaagagatgagacaaggtatataaaagtcctagcacagagcgtgtcatataatatggcttcacaagtaccctcatctcctttccagtcgttttttgtttttgtttttgtttttttgagaccatctcactctgttgcccaggctggagtgcctcttcatttttatttctttattcagcaagtattgatcaaatgtgctttgtaccaggtactgagctcttcgttgggatataatggtgatcaaggagattgtagattctggcagggaaaactgacatcaaacacggcgacccgacatagtgagaccctgtctctactagaagaactttaaaaatcacctaggtgtgggccgggcacggtggctaacgcctgtaatcccagcactttgagatgctgaggcaggtggatcacgaggtcaggagatcgagaccatcctggataacacggagaaaccccgtctctactaaaaatac

SEQ ID NO: 23879 - DNA, 1063 bp, Homo sapiens
gtccttcactgccaaacatacctggggttggatcattggcctgacgtttgcaaattgaggaaccttagggcaaatcagtgaacttctgaactgccttcgtcttcagttatatggggatttccccacttttgagatccttgtaaggattatatgagatgaagagatgagacaaggtatataaaagtcctagcacagagcgtgtcatataatatggcttcacaagtaccctcatctcctttccagtcgttttttgtttttgtttttgtttttttgggcgacagaatgagactccatctcaaaaaaaaaaaagaaaccaaggatatagaataaaacaagagtgtagatttgggcattgaggccttcaaattggattgttctcaatgtccagaagaaaaaaaaaatttagaagagacccaaatcagaaaacaaaagttgggctgaattcaatgcgaattattttctagctcaatattaatactgcttatgtcagctgaatttcagcctttcaataacagctagtcaagtatttttttagttggttcctattgatcgtcatcttattttagtggaatccattatattgaagatgtcaagttcctcatttcccatacaaagaatgtgagattcatctttcttgaatctttgctaagtgttgaaggggacttttggcatcttttcaggaggactataattgggccctctaactaaaaagtctcctatgccccttagatagatgagatttttttttttgaccttgtacccaccaacattggtgggaggctcagaagggactgtgtttgtaactttgtagcactttctaaacagtgacctgttgtatgggcattataggacagtccgtggggtggggcgggggatgggggagatggacaaatgaggtctggtttaaagaatgagaagtgtgaccaggcatggtgactcatgcctgtaatccagcactttgggatgctgaggcaggagaatcgcttgaaccagggaggtggaggttgcagtgagctgagattgcgccactgcactccagcctgggtgacagagactctgtctc

SEQ ID NO: 23880 - DNA, 815 bp, Homo sapiens
gatcacgccactgcactccagcctgggcgacagaatgagactccatctcaaaaaaaaaaaagaaaccaaggatatagaataaaacaagagtgtagatttgggcattgaggccttcaaattggattgttctcaatgtccagaagaaaaaaaaaatttagaagagacccaaatcagaaaacaaaagttgggctgaattcaatgcgaattattttctagctcaatattaatactgcttatgtcagctgaatttcagcctttcaataacagctagtcaagtatttttttagttggttcctattgatcgtcatcttattttagtggaatccattatattgaagatgtcaagttcctcatttcccatacaaagaatgtgagattcatctttcttgaatctttgctaagtgttgaaggggacttttggcatcttttcaggaggactataattgggccctctaactaaaaagtctcctatgccccttagatagatgagatttttttttttgaccttgtacccaccaacattggtgggaggctcagaagggactgtgtttgtaactttgtagcactttctaaacagtgacctgttgtatgggcattataggacagtccgtggggtggggcgggggatgggggagatggacaaatgaggtctggtttaaagaatgagaagtgtgaccaggcatggtgactcatgcctgtaatccagcactttgggatgctgaggcaggagaatcgcttgaaccagggaggtggaggttgcagtgagctgagattgcgccactgcactccagcctgggtgacagagactctgtctc

SEQ ID NO: 23881 - DNA, 656 bp, Homo sapiens
accaatagaacagtgagttagctctatgtttcactgttcagggtttcacaagagtcctaagcaaaagcatttggaaaatagtcagaagggataaaagagaaaataaataaaagtttgatccgatgtcttctacttttttatgatttaagcctgccatctacgaagacagcgtaagtctaacaacaaaaccatgtgttcaattcactaagtcagtgaaaggaaatatatagggaatcagcaatggttgaacaaaatgccaagatggtaaattaggaaaagcactgaacagtgcctcatccaacagttttcctatcacttccatgtggctttttctgagtgtgaacagaatgacatttgatgatcgcgtcaccatgtgcgtaccccagtagtttgccaatccctgtggtagggctcactttctgctttgtccaatccatgtgtcctcatcctgattactgctctgctagcatctgcttgaacttactaaattgaagctctcatacatatttagtaaacttacatttaccaagttcacagggcagatttctgccttctagaagtttctaatcttttcttgaatactcgtaagtaaatatagcagtttatagatgctttccaaatttggaaagcacaaaacagtctcctgagagtacaaa

SEQ ID NO: 23882 - DNA, 811 bp, Homo sapiens
ttcatctgcaatcaaatctcaggattaaggatgtcgtattacatcaaatcattacaggaagtatgactgtatcagcggctttttacaaaaacaaacctccagatcacaaaaggaagctgtgtttgtgtactgacacgaagtgttacgtagcagccaggagaggaaggatagcagccgacttggatccatttttgaggaattatttctgtaaggtgtcatggaattgtaagttacaaaaataaggcttttgtaaacagaatctccattccagaaggacggactccaaaatgctacttaatgaaattcatgggaatgttatggtgatggaaatcccaaatgacatgtagattttatatgcaaacaatcccactgcttgtaactcctggcagtgtgtacttaccaaaatcttgatcacacttaggtctcttgctatatatagaaccacatctgatccttatacagtgttgcaagatatatgtccttgctttcccatggttcttaagtgagtcttaagcttggatttgctccagcagaatggtggtttgtgtttctcaaggctgagctactatttggtgcatgtcggaaatctcacactaactgtggatactctgtcatcactgaacccaatcatacaatgaccagacagctttaaatacctacttttgtatgctatgaattcatccgtttacttgtcaaatcctttatttccatatgtgtctccatcaccttttttttctctccggataaatggaattactgtaacttgtgaaacaatggcaaacactataaagctaattttacagtcttgagt

SEQ ID NO: 23883 - DNA, 362 bp, Homo sapiens
gtcgacgcagtctgtgatgatggagagagtgatgtcatatggtttggcaaatgaactgcaatccttcacattccctttgacaaagttgaatacgtgccaaacccatttagcctttctctgccactgctttaactttcctttttttactctcaaaacccctaggttccacttataccgaacaggagtgatttagaaatcatgtaactaactttcttggattaataaaaagttaccaagtaactctacatgtgctttcatttctctttaggagattagcgtttgaggatggataaatgtatagttgtgtgcggcataacaacatttccatcaacatcacactgtacatacagtgatggttccat

SEQ ID NO: 23884 - DNA, 875 bp, Homo sapiens
ttggggatctatgcacatgagtaattggtctatattgtgcatgccatattaagcatctctcagtttttaatattcgaaaatgctttccttacgctgaaatttcctgtttcaaaaaaacaggaaatgtaaattgagaaccctgtatttgcatagcattgaagaaaaagagaaacctgtctctcctgctacttccttccctcccctcatcaatcaataccttattcttaagccacactgaattcttttttctcactattatttggggacctaagacctccttaccacgttgtaccttctgcctcggatcagcaaggtctttgctgctggtgtagagctaggattttgtcagttaaaaagtggaatgtggagctcttaagcgcaggggcactggagccagactgtctggatttgaattctggctctgccaattaccagctctgtgaccttgagcaaggtcactgattttttttgtgcctcagatttatctgttaagtggcagtaataagtgtacctacctcccagggaaggtgtgaggattaaataaattaatatatgtaaaatgcttcaaacagtatctggtgcatggcaagcactcataaagttcgctattattcatgcttttaaaactttactgtggccctcattcaatttgcagatgaaaaatctttctttggaagcagcataggggaagagcatgagcttcagagtcaaacagatgttggagaaattcttaaccactctgaacttgtttttttatctgttaaatggagataaccttacctatcttgcaaagttgttttgcatttgacgcttattattttatatatatgatttcattcgagatataaataaaaattatataaaaatgtgaaaat

SEQ ID NO: 23885 - DNA, 2122 bp, Homo sapiens
atgagtgagtgaaggggaaatgagggctgaaggggtggaaggaatgtggtaaactcctaggtagaaggaacagcaggtgcgaaactgtgcgggaagagatgggaatcagagaaattttaagcagttccctgttcctggagcactttcccagggtgattgtagggtttgatgacataatagcatgcacactactgtgaatggtaactcgccatgtaagttaagatattgttatgcagacctgtacctaccagtcacttactatatcttttgatagtcaaagaaaaaggaaggataatttcgaagaaagacttcgtgggacggcttctgtgacttacatgctgggtcctgggacctcaccccatcctctacactagttttgtacagtccatgttcgtggcctgagaaggcgtggtgttgccttgaccacgaatctcattggcctttcaaaggggaaactgttgtaggattggctgtggagatagcaagaggcctgccccctgtcgctgattgggtgagagcggccaaccccctgcctccgtctctcggcggccccacgggggcctgttggttggcaaccgatttgcttcctccggtgcgtggctgcggggttgcacctgtgaagcgaagacaacctgctaggaccctgataggcgtacacctctcactcccactcacgcgccgacgacatgggcttgtctccgttactcatccaagtttgtcttgagactgggctgtgagccggcactgcagtgaaacgccgcagatgaggaagtgcccaagtcttccttcgggaagttctcgtttagaggagtcaggagaaaaagtcattgttatatcccaactttagaagccgcttatcttggtaccgttctgaggttctagaaagcaagtaacttatatcagtttactaagtgtgggaaagtgacccataacttcaaacatctgcctcagagtaaacctgaggcatttggggacaagtgtcagaccctccgctgcctatcatgcacggcagagcttacctcttgctgcacagagacttctgtgatctcaaggagaacaattataagggtatcactgctaagcctgtaagtgaagatatgatggaatgggaagttgaaattgaaggtctacagaattcagtttggcagggtttagtcttccaactgacaatacattttacatcggagtacaactatgctcctccagttgtgaaatttataacaattccgtttcatccaaatgtagacccacacactggtcagccctgtatagactttttggacaaccctgagaagtggaatacaaactatacattgagcagcatcttacttgccctacaggttatgctttctaatccagtgctagagaatccagtgaatttggaagcagccagaatactggttaaagatgaatctctgtacagaacaattctaagacttttcaacaggccattacaaatgaaagatgacagccaggagttacctaaagacccacgtaaatgtatcagaccaattaaaacaacctcatttagtgattactaccagacatggtccagaatagctacatcaaaagccacagaatactacagaactccattgctcaaagttccaaatttcattggacagtattacaaatggaagaaaatggatctacagcatcagaaagaatggaatttaaagtattccgttatcaagtgttggcttgctagaaaaagaatgcctcatgaagtcactcactcaatggaagaaattaagctctgcccaactctaaatgaaatttttcttgagtcaccaactgcaataaatagcatcacagacatttatgaaacagaagaggaggggtggaagagtgacacttcattatatgaaaatgacacagatgagcccagggaagaggaagtggaagatctgatctcctggaccaatactctcaatacaaatacttcagaagattaagcagaacattatcagattcaaaaaataaacagcctccgccatagcccagcgttgtggagcaattttggaagactctcagaacttggatttcattttttttaagttgttctcacccactcactgcaagtacaaattagaaatataagtacaaatcagtaaaaatgttg

SEQ ID NO: 23886 - DNA, 2033 bp, Homo sapiens
atgagtgagtgaaggggaaatgagggctgaaggggtggaaggaatgtggtaaactcctaggtagaaggaacagcaggtgcgaaactgtgcgggaagagatgggaatcagagaaattttaagcagttccctgttcctggagcactttcccagggtgattgtagggtttgatgacataatagcatgcacactactgtgaatggtaactcgccatgtaagttaagatattgttatgcagacctgtacctaccagtcacttactatatcttttgatagtcaaagaaaaaggaaggataatttcgaagaaagacttcgtgggacggcttctgtgacttacatgctgggtcctgggacctcaccccatcctctacactagttttgtacagtccatgttcgtggcctgagaaggcgtggtgttgccttgaccacgaatctcattggcctttcaaaggggaaactgttgtaggattggctgtggagatagcaagaggcctgccccctgtcgctgattgggtgagagcggccaaccccctgcctccgtctctcggcggccccacgggggcctgttggttggcaaccgatttgcttcctccggtgcgtggctgcggggttgcacctgtgaagcgaagacaacctgctaggaccctgataggcgtacacctctcactcccactcacgcgccgacgacatgggcttgtctccgttactcatccaagtttgtcttgagactgggctgtgagccggcactgcagtgaaacgccgcagatgaggaagtgcccaagtcttccttcgggaagttctcgtttagaggagtcaggagaaaaagtcattgttatatcccaactttagaagccgcttatcttggtaccgttctgaggttctagaaagcaagtaacttatatcagtttactaagtgtgggaaagtgacccataacttcaaacatctgcctcagagtaaacctgaggcatttggggacaagtgtcagaccctccgctgcctatcatgcacggcagagcttacctcttgctgcacagagacttctgtgatctcaaggagaacaattataagggtatcactgctaagcctgtaagtgaagatatgatggaatgggaagttgaaattgaaggtctacagaattcagtttggcagggtttagtcttccaactgacaatacattttacatcggagtacaactatgctcctccagttgtgaaatttataacaattccgtttcatccaaatgtagacccacacactggtcagccctgtatagactttttggacaaccctgagaagtggaatacaaactatacattgagcagcatcttacttgccctacaggttatgctttctaatccagtgctagagaatccagtgaatttggaagcagccagaatactggttaaagatgaatctctgtacagaacaattctaagacttttcaacaggccattacaaatgaaagatgacagccaggagttacctaaagacccacgtaaatgtatcagtgctcaaagttccaaatttcattggacagtattacaaatggaagaaaatggatctacagcatcagaaagaatggaatttaaagtattccgttatcaagtgttggcttgctagaaaaagaatgcctcatgaagtcactcactcaatggaagaaattaagctctgcccaactctaaatgaaatttttcttgagtcaccaactgcaataaatagcatcacagacatttatgaaacagaagaggaggggtggaagagtgacacttcattatatgaaaatgacacagatgagcccagggaagaggaagtggaagatctgatctcctggaccaatactctcaatacaaatacttcagaagattaagcagaacattatcagattcaaaaaataaacagcctccgccatagcccagcgttgtggagcaattttggaagactctcagaacttggatttcattttttttaagttgttctcacccactcactgcaagtacaaattagaaatataagtacaaatcagtaaaaatgttg

SEQ ID NO: 23887 - DNA, 1898 bp, Homo sapiens
atgagtgagtgaaggggaaatgagggctgaaggggtggaaggaatgtggtaaactcctaggtagaaggaacagcaggtgcgaaactgtgcgggaagagatgggaatcagagaaattttaagcagttccctgttcctggagcactttcccagggtgattgtagggtttgatgacataatagcatgcacactactgtgaatggtaactcgccatgtaagttaagatattgttatgcagacctgtacctaccagtcacttactatatcttttgatagtcaaagaaaaaggaaggataatttcgaagaaagacttcgtgggacggcttctgtgacttacatgctgggtcctgggacctcaccccatcctctacactagttttgtacagtccatgttcgtggcctgagaaggcgtggtgttgccttgaccacgaatctcattggcctttcaaaggggaaactgttgtaggattggctgtggagatagcaagaggcctgccccctgtcgctgattgggtgagagcggccaaccccctgcctccgtctctcggcggccccacgggggcctgttggttggcaaccgatttgcttcctccggtgcgtggctgcggggttgcacctgtgaagcgaagacaacctgctaggaccctgataggcgtacacctctcactcccactcacgcgccgacgacatgggcttgtctccgttactcatccaagtttgtcttgagactgggctgtgagccggcactgcagtgaaacgccgcagatgaggaagtgcccaagtcttccttcgggaagttctcgtttagaggagtcaggagaaaaagtcattgttatatcccaactttagaagccgcttatcttggtaccgttctgaggttctagaaagcaagtaacttatatcagtttactaagtgtgggaaagtgacccataacttcaaacatctgcctcagagtaaacctgaggcatttggggacaagtgtcagaccctccgctgcctatcatgcacggcagagcttacctcttgctgcacagagacttctgtgatctcaaggagaacaattataagggtatcactgctaagcctgtaagtgaagatatgatggaatgggaagttgaaattgaaggtctacagaattcagtttggcagggtttagtcttccaactgacaatacattttacatcggagtacaactatgctcctccagttgtgaaatttataacaattccgtttcatccaaatgtagacccacacactggtcagccctgtatagactttttggacaaccctgagaagtggaatacaaactatacattgagcagcatcttacttgccctacaggttatgctttctaatccagtgctagagaatccagtgaatttggaagcagccagaatactggttaaagatgaatctctgtacagaacaattctaagacttttcaacaggccattacaaatgaaagatgacagccaggagttacctaaagacccacgtaaatgtatcagaccaattaaaacaacctcatttagtgattactaccagacatggtccagaatagctacatcaaaagccacagaatactacagaactccattgctcaaagttccaaatttcattggacagtattacaaatggaagaaaatggatctacagcatcagaaagaatggaatttaaaatgaaaaatctttctttggaagcagcataggggaagagcatgagcttcagagtcaaacagatgttggagaaattcttaaccactctgaacttgtttttttatctgttaaatggagataaccttacctatcttgcaaagttgttttgcatttgacgcttattattttatatatatgatttcattcgagatataaataaaaattatataaaaatgtgaaaat

SEQ ID NO: 23888 - DNA, 1809 bp, Homo sapiens
atgagtgagtgaaggggaaatgagggctgaaggggtggaaggaatgtggtaaactcctaggtagaaggaacagcaggtgcgaaactgtgcgggaagagatgggaatcagagaaattttaagcagttccctgttcctggagcactttcccagggtgattgtagggtttgatgacataatagcatgcacactactgtgaatggtaactcgccatgtaagttaagatattgttatgcagacctgtacctaccagtcacttactatatcttttgatagtcaaagaaaaaggaaggataatttcgaagaaagacttcgtgggacggcttctgtgacttacatgctgggtcctgggacctcaccccatcctctacactagttttgtacagtccatgttcgtggcctgagaaggcgtggtgttgccttgaccacgaatctcattggcctttcaaaggggaaactgttgtaggattggctgtggagatagcaagaggcctgccccctgtcgctgattgggtgagagcggccaaccccctgcctccgtctctcggcggccccacgggggcctgttggttggcaaccgatttgcttcctccggtgcgtggctgcggggttgcacctgtgaagcgaagacaacctgctaggaccctgataggcgtacacctctcactcccactcacgcgccgacgacatgggcttgtctccgttactcatccaagtttgtcttgagactgggctgtgagccggcactgcagtgaaacgccgcagatgaggaagtgcccaagtcttccttcgggaagttctcgtttagaggagtcaggagaaaaagtcattgttatatcccaactttagaagccgcttatcttggtaccgttctgaggttctagaaagcaagtaacttatatcagtttactaagtgtgggaaagtgacccataacttcaaacatctgcctcagagtaaacctgaggcatttggggacaagtgtcagaccctccgctgcctatcatgcacggcagagcttacctcttgctgcacagagacttctgtgatctcaaggagaacaattataagggtatcactgctaagcctgtaagtgaagatatgatggaatgggaagttgaaattgaaggtctacagaattcagtttggcagggtttagtcttccaactgacaatacattttacatcggagtacaactatgctcctccagttgtgaaatttataacaattccgtttcatccaaatgtagacccacacactggtcagccctgtatagactttttggacaaccctgagaagtggaatacaaactatacattgagcagcatcttacttgccctacaggttatgctttctaatccagtgctagagaatccagtgaatttggaagcagccagaatactggttaaagatgaatctctgtacagaacaattctaagacttttcaacaggccattacaaatgaaagatgacagccaggagttacctaaagacccacgtaaatgtatcagtgctcaaagttccaaatttcattggacagtattacaaatggaagaaaatggatctacagcatcagaaagaatggaatttaaaatgaaaaatctttctttggaagcagcataggggaagagcatgagcttcagagtcaaacagatgttggagaaattcttaaccactctgaacttgtttttttatctgttaaatggagataaccttacctatcttgcaaagttgttttgcatttgacgcttattattttatatatatgatttcattcgagatataaataaaaattatataaaaatgtgaaaat

SEQ ID NO: 23889 - DNA, 463 bp, Homo sapiens
gtagcactgtcccagatcactccaaagaggcccaggaccctctgtcgaggcgggatgacaacctgaaaccagggccgtgcttggtgtccctctgctgctggttcaccccaacaagggtgggccgccagatcccctccaagtctaaggcatgctctccttgctgctgagagagctggtggcattttacaggtaaccactcacagctgcatccctctccaggaggccctcttagccaaaagaagctgccttgcctaagagaatgcccctccctaaggacagcagacattcagtgactgattgctgtgggggcacaaaggccaagcgcgggccatctgcaggccatcccactctcgagtttttcaggctgaggccctgctgggacttcactgcggttcagcttctccctctgcctaattccaccccctcaccctgagagcacttcacagtaaaccttctgcacgta

SEQ ID NO: 23890 - DNA, 434 bp, Homo sapiens
caggcctaacctattataataattgcctctgaaatactaataaaatactatattataggtagatatcaggggagaagacagaatgaagaaattatttttgagtctgttttgcagccaattagattgattctctaatttcataactgacagtataaattgctggtaaaaatgttgacaaacaggccgggtaatcctagcactttgggaggctgaggtgggcggattacgaggtcaggagttcaacactagcctggccagcatggagaaaccccgtctctactaaaaatacaaaaattagccaggcgtggtggcatgcacctgtaatcccagctactcaggaggctgaggcaggagaatcgcttgaacccaggaggcggaggctgcgtgagccaagatcgcgccactgcactccagagagagactccatctcaaaa

SEQ ID NO: 23891 - DNA, 1382 bp, Homo sapiens
aagagaatttcacatattttctggttcagagctcactcatgaaaagacagggatttcttcaaggccaaagcagtgagtataggtcccagcctttagttcctctgaccctgggtggtaatgtgagcatgacctattaaccctgaaaattttcaaacaaatatcagagtaacttaggacctagaatagattgcacgttcaatgatgggacttacatgctctttttcctttccttccctgcctctatcctgtttgattttaacagcactcgcaaacaaaattacatgatgaatttttcacgacaacatgggctcagacatttctacaacagaagacgaaggtcacttaggcgatacccatgaagaatcaaaaagtttattttttttcttccaacatgtgatgtgttgctctccattcttttaaatctcgcactacatctgatatcaggaaatatctgtgaaggacttggtgattacctgaaagcccttctcaagaccgagtgtacaccactttcccacactgtgaactaatgacaagtgacttatttgctcataagtaaatgtcttcatgttgatgtgtccgtgaaagttgtgatctgttgtaatatcagttacagtggcagtattgacaataagaaacagtttaacagaaaaatgaaatttaagcacaaaaaatttaagagattttatgtttaaaatggcatttagcacagtatttaacattcttggtcacaaagctatttaagtggactgtatttcagctatgtctcatgttttatatgattaaattatcattgtttgtcctttatgtattctcttctacaatacaacacattgaaactgtatttacttgttatgttgtaatattttgctgctgaatttggggctacttatattctgcagaaaattaattgaaatacctattcaagaagatagttgtaaagatattgtatctcctttaatatactccttaaaaatgtatgttggtttagcgttgttttgtggataagaaaaatgcttgaccctgaaatattttctactttaaattgtggatgaagaccctatctcccacaaataagttcccatttccttgtctaaagatctttttttaagtgttctgtggctgatttactaacagtaactgccattttttgtctgtgataacagagtgatttgtaaaacagtggttgttttttcattgtgttttcttcgtggattgttttttctgcgggtcatattcataccttctgatgaagttgtacaacaccagcaacattataatggccctgtagctctgaatgctatttgtgtaactgaaaggttgcactctagggtgaaccaagctataaaagcccatgcttaaataaaaattatgtccaaaagcca

SEQ ID NO: 23892 - DNA, 11581 bp, Homo sapiens
  misc_feature (144)..(144): n is a, c, g, or t
cacgcgtgggctcggcgggggcccgctcccaggcccgctcccgagcccgttccgctcccgtccgccttcttctcgccttctctccgcgtggctcctccgtcccggcgtctccaaaactgaatgagcgagcggcgcgtagggcgncggcggcggcggcggcggcggcggcggcggcatggagcgcagtggctgggcccggcagactttcctcctagcgctgttgctgggggcgacgctgagggcgcgcgcggcggctggctattacccccgcttttcgcccttctttttcctgtgcacccaccacggggagctggaaggggatggggagcagggcgaggtgctcatttccctgcatattgcgggcaaccccacctactacgttccgggacaagaataccatgtgacaatttcaacaagcaccttttttgacggcttgctggtgacaggactatacacatctacaagtgttcaggcatcacagagcattggaggttccagtgctttcggatttgggatcatgtctgaccaccagtttggtaaccagtttatgtgcagtgtggtagcctctcacgtgagtcacctgcccacaaccaacctcagtttcatctggattgctccacctgcgggcacaggctgtgtgaatttcatggctacagcaacacaccggggccaggttattttcaaagatgctttagcccagcagttgtgtgaacaaggagctccaacagatgtcactgtgcacccacatctagctgaaatacatagtgacagcattatcctgagagatgactttgactcctaccaccaactgcaattaaatccaaatatatgggttgaatgtaacaactgtgagactggagaacagtgtggcgcgattatgcatggcaatgccgtcaccttctgtgaaccatatggcccacgagaactgattaccacaggccttaatacaacaacagcttctgtcctccaattttccattgggtcaggttcatgtcgctttagttattcagaccccagcatcatcgtgttatatgccaagaataactctgcggactggattcagctagagaaaattagagccccttccaatgtcagcacaatcatccatatcctctaccttcctgaggacgccaaaggggagaatgtccaatttcagtggaagcaggaaaatcttcgtgtaggtgaagtgtatgaagcctgctgggccttagataacatcttgatcatcaattcagctcacagacaagtcgttttagaagatagtctcgacccagtggacacaggcaactggcttttcttcccaggagctacagttaagcatagctgtcagtcagatgggaactccatttatttccatggaaatgaaggcagcgagttcaattttgccaccaccagggatgtagatctttccacagaagatattcaagagcaatggtcagaagaatttgagagccagcctacaggatgggatgtcttgggagctgtcattggtacagaatgtggaacgatagaatcaggcttatcaatggtcttcctcaaagatggagagaggaaattatgcactccatccatggacactaccggttatgggaacctgaggttttactttgtgatgggaggaatttgtgaccctggaaattctcatgaaaatgacataatcctgtatgcaaaaattgaaggaagaaaagagcatataacactggataccctttcctattcctcatataaggttccgtctttggtttctgtggtcatcaatcctgaacttcagactcctgctaccaaattttgtctcaggcaaaagaaccatcaaggacataataggaatgtctgggctgtagactttttccatgtcttgcctgttctcccttctacaatgtctcacatgatacagttttccatcaatctgggatgtggaacgcatcagcctggtaacagtgtcagcttggaattttctaccaaccatgggcgctcctggtccctccttcacactgaatgcttacctgagatctgtgctggaccccacctcccccacagcactgtctactcctctgaaaactacagtgggtggaaccgaataacaattccccttcctaacgcagcactaacccggaacaccaggattcgctggagacaaacaggaccaatccttggaaacatgtgggcaattgataatgtttatattggcccgtcatgtctcaaattctgttctggcagaggacagtgcactagacatggttgcaagtgtgaccctggattttctggcccagcttgtgagatggcatcccagacattcccaatgtttatttctgaaagctttggcagttccaggctctcctcttaccataacttttactctatccgtggtgctgaagtcagctttggttgtggtgtcttggccagtggtaaggccctggttttcaacaaagaagggcggcgtcagctaattacatctttccttgacagctcacaatccaggtttctccagttcacactgagactggggagcaaatctgttctgagcacgtgcagagcccctgatcagcctggtgaaggagttttgctgcattattcttatgataatgggataacttggaaactcctggagcattattcatatctcagctatcatgagcccagaataatctccgtagaactaccaggtgatgcaaagcagtttggaattcagttcagatggtggcaaccgtatcattcttcccagagagaagatgtatgggctattgatgagattatcatgacatctgtgcttttcaacagcattagtcttgactttaccaatcttgtggaggtcactcagtctctgggattctaccttggaaatgttcagccatactgtggccacgactggaccctttgttttacaggagattctaaacttgcctcaagtatgcgctatgtggaaacacaatcaatgcagataggagcatcctatatgattcagttcagtttggtgatgggatgtggccagaaatacaccccacacatggacaaccaggtgaagctggagtactcaaccaaccacggccttacctggcacctcgtccaagaagaatgccttccaagtatgccaagttgtcaggaatttacatcagcaagtatttaccatgccagtgagtttacacagtggaggagagtcatagtgcttcttccccagaaaacttggtccagtgctacccgtttccgctggagccagagctattacacagctcaagacgagtgggctttggacagcatttacattgggcagcagtgccccaacatgtgcagtgggcatggctcatgcgatcatggcatatgcaggtgtgaccaggggtaccaaggcactgaatgccacccagaagctgcccttccgtccacaattatgtcagattttgagaaccagaatggctgggagtctgactggcaagaagttattgggggagaaattgtaaaaccagaacaagggtgtggtgtcatctcttctggatcatctctgtacttcagcaaggctgggaaaagacagctggtgagttgggacctggatacttcttgggtggactttgtccagttctacatccagataggcggagagagtgcttcatgcaacaagcctgacagcagagaggagggcgtcctccttcagtacagcaacaatgggggcatccagtggcacctgctagcagagatgtacttttcagacttcagcaaacccagatttgtctatctggagcttccagctgctgccaagaccccttgcaccaggttccgctggtggcagcccgtgttctcaggggaggactatgaccagtgggcagtcgatgacatcatcattctgtccgagaagcagaagcagatcatcccagttatcaatccaactttacctcagaacttttatgagaagccagcttttgattaccctatgaatcagatgagtgtgtggttgatgttggctaatgaaggaatggttaaaaatgaaaccttctgtgctgccacaccatcagcaatgatatttggaaaatcagatggagatcgatttgcagtaactcgagatttgaccctgaaacctggatatgtgctacagttcaagctaaacataggttgtgccaatcaattcagcagtactgctccagttcttcttcagtactctcatgatgctggtatgtcctggtttctggtgaaagaaggctgttacccggcttctgcaggcaaaggatgcgaaggaaactccagagaactaagtgagcccaccatgtatcacacaggggactttgaagaatggacaagaatcaccattgttattccaaggtctcttgcatccagcaagaccagattccgatggatccaggagagcagctcacagaaaaacgtgcctccatttggtttagatggagtgtacatatccgagccttgtcccagttactgcagtggccatggggactgcatttcaggagtgtgtttctgtgacctgggatatactgctgcacaaggaacctgtgtgtcaaatgtccccaatcacaatgagatgttcgataggtttgaggggaagctcagccctctgtggtacaagataacaggtgcccaggttggaactggctgtggaacacttaacgatggcaaatctctctacttcaatggccctgggaaaagggaagcccggacggtccctctggacaccaggaatatcagacttgttcaattttatatacaaattggaagcaaaacttcaggcattacctgcatcaaaccaagaactagaaatgaagggcttattgttcagtattcaaatgacaatgggatactctggcatttgcttcgagagttggacttcatgtccttcctggaaccacagatcatttccattgacctgccacaggacgcgaagacacctgcaacggcatttcgatggtggcaaccgcaacatgggaagcattcagcccagtgggctttggatgatgttcttataggaatgaatgacagctctcaaactggatttcaagacaaatttgatggctctatagatttgcaagccaactggtatcgaatccaaggaggtcaagttgatattgactgtctctctatggatactgctctgatattcactgaaaacataggaaaacctcgttatgctgagacctgggattttcatgtgtcagcatctacctttttgcagtttgaaatgagcatgggctgtagcaagcccttcagcaactcccacagtgtacagctccagtattctctgaacaatggcaaggactggcatcttgtcaccgaagagtgtgttcctccaaccattggctgtctgcattacacggaaagttcaatttacacctcggaaagattccagaattggaagcggatcactgtctaccttccactctccaccatttctcccaggacccggttcagatggattcaggccaactacactgtgggggctgattcctgggcgattgataatgttgtactggcctcagggtgcccttggatgtgctcaggacgagggatttgtgatgctggacgctgtgtgtgtgaccggggctttggtggaccctattgtgttcctgttgttcctctgccctcgattcttaaagacgatttcaatgggaatttacatcctgacctttggcctgaagtgtatggtgcagagagggggaatctgaatggtgaaaccatcaaatctggaacatctctaatttttaaaggggaaggactaaggatgcttatttcaagagatctagattgtacaaatacaatgtatgtccagttttcacttagatttatagcaaaaagtaccccagagagatctcactctattctgttacaattctccatcagtggaggaatcacttggcacctgatggatgaattttactttcctcaaacaacgaatatacttttcatcaatgttcccttgccatacactgcccaaaccaatgctacaagattcagactctggcaaccttataataacggtaagaaagaagaaatctggattgttgatgacttcattatcgatggaaataatgtaaacaaccctgtgatgctcttggatacatttgattttgggcccagagaagacaattggtttttctatcctggtggtaacatcggtctttattgtccatattcttcaaagggggcacctgaagaagattcagctatggtgtttgtttcaaatgaagttggtgagcattccattaccacccgtgacctaaatgtgaatgagaacaccatcatacaatttgagatcaacgttggctgttcgactgatagctcatccgcggatccagtgagactggaattttcaagggacttcggggcgacctggcaccttctgctgcccctctgctaccacagcagcagccacgtcagctctttatgctccaccgagcaccaccccagcagcacctactacgcaggaaccatgcagggctggaggagggaggtcgtgcactttgggaagctgcacctttgtggatctgtccgtttcagatggtaccagggattttaccctgccggctctcagccagtgacatgggccattgataatgtctacatcggtccccagtgtgaggagatgtgtaatggacaggggagctgtatcaatggaaccaaatgtatatgtgaccctggctactcaggtccaacctgtaaaataagcaccaaaaatcctgattttctcaaagatgatttcgaaggtcagctagaatctgatagattcttattaatgagtggtgggaaaccatctcgaaagtgtggaatcctttctagtggaaacaacctctttttcaatgaagatggcttgcgcatgttgatgacacgagacctggatttatcacatgctagatttgtgcagttcttcatgagactgggatgtggtaaaggcgttcctgaccccaggagtcaacccgtgctcctacagtattctctcaacggtggcctctcgtggagtcttcttcaggagttccttttcagcaattccagcaatgtgggcaggtacattgccctggagatacccttgaaagcccgttctggttctactcgccttcgctggtggcaaccgtctgagaatgggcacttctacagcccctgggttatcgatcagattcttattggaggaaatatttctggtaatacggtcttggaagatgatttcacaacccttgatagtaggaaatggctgcttcacccaggaggcaccaagatgcccgtgtgtggctctactggtgatgccctggtcttcattgaaaaggccagcacccgttacgtggtcagcacagacgttgccgtgaatgaggattccttcctacagatagacttcgctgcctcctgctcagtcacagactcttgttatgcgattgaattggaatactcagtagatcttggattgtcatggcacccattggtaagggactgtctgcctaccaatgtggaatgcagtcgctatcatctgcaacggatcctggtgtcagacactttcaacaagtggactagaatcactctgcctctccctccttataccaggtcccaagccactcgtttccgttggcatcaaccagctccttttgacaagcagcagacatgggcaatagataatgtctatatcggggatggctgcatagacatgtgcagtggccatgggagatgcatccagggaaactgcgtctgtgatgaacagtggggtggcctgtactgtgatgaccccgagacctctcttccaacccaactcaaagacaacttcaatcgagctccatccagtcagaactggctgactgtgaacggagggaaattgagtacagtgtgtggagccgtggcgtcgggaatggctctccatttcagtgggggttgtagtcgattattagtcactgtggatctaaacctcactaatgctgagttcatccaattttacttcatgtatgggtgcctgattacaccaaacaaccgtaaccaaggtgttctcttggaatattctgtcaatggaggcattacctggaacctgctcatggagattttctatgaccagtacagtaagcccggatttgtgaatatccttctccctcctgatgctaaagagattgccactcgcttccgctggtggcagccaagacatgacggcctggatcagaacgactgggccattgacaatgtcctcatctcaggctctgctgaccaaaggaccgttatgctggacaccttcagcagcgccccagtaccccagcacgagcgctcccctgcagatgccggccctgtcgggaggatcgcctttgacatgtttatggaagacaaaacttcagtgaatgagcactggctattccatgatgattgtacagtagaaagattctgtgactcccctgatggtgtgatgctctgtggcagtcatgatggacgggaggtgtatgcagtgacccatgacctgactcccactgaaggctggattatgcaattcaagatctcagttggatgtaaggtgtctgaaaaaattgcccagaatcaaattcatgtgcagtattctactgacttcggtgtgagttggaattatctggtccctcagtgcttgcctgctgacccaaaatgctctggaagtgtttctcagccatctgtattctttccaactaaagggtggaaaaggatcacctacccacttcctgaaagcttagtgggaaatccggtaaggtttaggttctatcagaagtactcagacatgcagtgggcaatcgataatttctacctgggccctggatgcttggacaactgcaggggccatggagattgcttaagggaacagtgcatctgtgatccgggatactcagggccaaactgctacttgacccacactctgaagactttcctgaaggaacgctttgacagtgaagaaatcaaacctgacttatggatgtccttagaaggtggaagtacttgcactgagtgtggaattcttgccgaggacactgcactctattttgggggatccactgtgagacaagcggttacacaagatttggatcttcgaggtgcaaagttcctgcaatactgggggcgcatcggtagtgagaacaacatgacctcttgccatcgtcccatctgccggaaggaaggcgtgctgttggactactctaccgatggaggaattacctggactttgctccatgagatggattaccagaaatacatttctgttagacacgactacatacttcttcctgaagatgccctcaccaacacaactcgacttcgctggtggcagccttttgtgatcagcaatggaattgtggtctctggggtggagcgtgctcagtgggcactggacaacattttgattggtggagcagaaatcaatcccagccaattggtggacacttttgatgatgaaggcacttcccatgaagaaaactggagtttttaccctaatgctgtaaggacagcaggattttgtggcaatccatcctttcacctctattggccaaataaaaagaaggacaagactcacaatgctctctcctcccgagaactcattatacagccaggatacatgatgcagtttaaaattgtggtgggttgtgaagccacttcttgtggtgaccttcattccgtaatgctggaatacactaaggatgcaagatcggattcctggcagctcgtacagacccagtgccttccttcctcttctaacagcattggctgctcccctttccagttccatgaagccaccatctacaactctgtcaacagctcaagctggaaaagaatcaccatccagctgcctgaccatgtctcctctagtgcaacacagttccgctggatccagaagggagaagaaactgagaagcaaagctgggcaattgaccacgtgtacattggagaggcttgccccaagctctgcagcgggcacggatactgcacgaccggtgccatctgcatctgcgacgagagcttccaaggtgatgactgctctgttttcagtcacgaccttcccagttatattaaagataattttgagtccgcaagagtcaccgaggcaaactgggagaccattcaaggtggagtcataggaagtggctgtgggcagctggccccctacgcccatggagactcactgtactttaatggctgtcagatcaggcaagcagctaccaagcctctggatctcactcgagcaagcaaaatcatgtttgttttgcaaattgggagcatgtcgcagacggacagctgcaacagtgacctgagtggcccccacgctgtggacaaggcagtgctgctgcaatacagcgtcaacaacgggatcacctggcatgtcatcgcccagcaccagccaaaggacttcacacaagctcagagagtgtcttacaatgtccccctggaggcacggatgaaaggagtcttactgcgctggtggcaaccacgccacaatggaacaggtcatgatcaatgggctttggaccatgtggaggtcgtcctagtaagcactcgcaaacaaaattacatgatgaatttttcacgacaacatgggctcagacatttctacaacagaagacgaaggtcacttaggcgatacccatgaagaatcaaaaagtttattttttttcttccaacatgtgatgtgttgctctccattcttttaaatctcgcactacatctgatatcaggaaatatctgtgaaggacttggtgattacctgaaagcccttctcaagaccgagtgtacaccactttcccacactgtgaactaatgacaagtgacttatttgctcataagtaaatgtcttcatgttgatgtgtccgtgaaagttgtgatctgttgtaatatcagttacagtggcagtattgacaataagaaacagtttaacagaaaaatgaaatttaagcacaaaaaatttaagagattttatgtttaaaatggcatttagcacagtatttaacattcttggtcacaaagctatttaagtggactgtatttcagctatgtctcatgttttatatgattaaattatcattgtttgtcctttatgtattctcttctacaatacaacacattgaaactgtatttacttgttatgttgtaatattttgctgctgaatttggggctacttatattctgcagaaaattaattgaaatacctattcaagaagatagttgtaaagatattgtatctcctttaatatactccttaaaaatgtatgttggtttagcgttgttttgtggataagaaaaatgcttgaccctgaaatattttctactttaaattgtggatgaagaccctatctcccacaaataagttcccatttccttgtctaaagatctttttttaagtgttctgtggctgatttactaacagtaactgccattttttgtctgtgataacagagtgatttgtaaaacagtggttgttttttcattgtgttttcttcgtggattgttttttctgcgggtcatattcataccttctgatgaagttgtacaacaccagcaacattataatggccctgtagctctgaatgctatttgtgtaactgaaaggttgcactctagggtgaaccaagctataaaagcccatgcttaaataaaaattatgtccaaaagcca

SEQ ID NO: 23893 - DNA, 5205 bp, Homo sapiens
tagattagatatggcatttagcttcctttcattctctattccttcagttgcctaagcttataaaaataaacaacataacagaaggactaggtcctgctcatagaggattctgccatatggatagagggactttatcaagcgtgatacaaggttataattctctgaaaaggaaaatgtgcaaattagcattggtgccacatgcagtagttcccaaatcctctttcttgcctttgaagaaaaaaataaatcaatctcccccacatccttatagactgctccaaaggatctttatacataataagatgtatatcaaatagaactcaaagaacctgttaacaaaccgtagagttcatgcaaagaattggaactgaaatgccttagggtacaactgtccttaaatagaaattttacatggaaaataatcacacataagccaaattttgcttcccagcttgggtacatgtcgtttgcaaaggcacagtttggccaatgtaggctgtgaatggttttgtcaatcctttgatttgttttgtgtagtttcttgccagatgggcaagcagacataaacaagagcattctgaaaggcccctcacattctgctggccgtccagtgccagttctgagcaggccaacagatcaaaacaaacaaacaaacaaacgaaaaaggcagaactttccatttcttaaaactaaatggaaaatttgggattttttaaaaatacatttcagattcttattggaggaaatatttctggtaatacggtcttggaagatgatttcacaacccttgatagtaggaaatggctgcttcacccaggaggcaccaagatgcccgtgtgtggctctactggtgatgccctggtcttcattgaaaaggccagcacccgttacgtggtcagcacagacgttgccgtgaatgaggattccttcctacagatagacttcgctgcctcctgctcagtcacagactcttgttatgcgattgaattggaatactcagtagatcttggattgtcatggcacccattggtaagggactgtctgcctaccaatgtggaatgcagtcgctatcatctgcaacggatcctggtgtcagacactttcaacaagtggactagaatcactctgcctctccctccttataccaggtcccaagccactcgtttccgttggcatcaaccagctccttttgacaagcagcagacatgggcaatagataatgtctatatcggggatggctgcatagacatgtgcagtggccatgggagatgcatccagggaaactgcgtctgtgatgaacagtggggtggcctgtactgtgatgaccccgagacctctcttccaacccaactcaaagacaacttcaatcgagctccatccagtcagaactggctgactgtgaacggagggaaattgagtacagtgtgtggagccgtggcgtcgggaatggctctccatttcagtgggggttgtagtcgattattagtcactgtggatctaaacctcactaatgctgagttcatccaattttacttcatgtatgggtgcctgattacaccaaacaaccgtaaccaaggtgttctcttggaatattctgtcaatggaggcattacctggaacctgctcatggagattttctatgaccagtacagtaagcccggatttgtgaatatccttctccctcctgatgctaaagagattgccactcgcttccgctggtggcagccaagacatgacggcctggatcagaacgactgggccattgacaatgtcctcatctcaggctctgctgaccaaaggaccgttatgctggacaccttcagcagcgccccagtaccccagcacgagcgctcccctgcagatgccggccctgtcgggaggatcgcctttgacatgtttatggaagacaaaacttcagtgaatgagcactggctattccatgatgattgtacagtagaaagattctgtgactcccctgatggtgtgatgctctgtggcagtcatgatggacgggaggtgtatgcagtgacccatgacctgactcccactgaaggctggattatgcaattcaagatctcagttggatgtaaggtgtctgaaaaaattgcccagaatcaaattcatgtgcagtattctactgacttcggtgtgagttggaattatctggtccctcagtgcttgcctgctgacccaaaatgctctggaagtgtttctcagccatctgtattctttccaactaaagggtggaaaaggatcacctacccacttcctgaaagcttagtgggaaatccggtaaggtttaggttctatcagaagtactcagacatgcagtgggcaatcgataatttctacctgggccctggatgcttggacaactgcaggggccatggagattgcttaagggaacagtgcatctgtgatccgggatactcagggccaaactgctacttgacccacactctgaagactttcctgaaggaacgctttgacagtgaagaaatcaaacctgacttatggatgtccttagaaggtggaagtacttgcactgagtgtggaattcttgccgaggacactgcactctattttgggggatccactgtgagacaagcggttacacaagatttggatcttcgaggtgcaaagttcctgcaatactgggggcgcatcggtagtgagaacaacatgacctcttgccatcgtcccatctgccggaaggaaggcgtgctgttggactactctaccgatggaggaattacctggactttgctccatgagatggattaccagaaatacatttctgttagacacgactacatacttcttcctgaagatgccctcaccaacacaactcgacttcgctggtggcagccttttgtgatcagcaatggaattgtggtctctggggtggagcgtgctcagtgggcactggacaacattttgattggtggagcagaaatcaatcccagccaattggtggacacttttgatgatgaaggcacttcccatgaagaaaactggagtttttaccctaatgctgtaaggacagcaggattttgtggcaatccatcctttcacctctattggccaaataaaaagaaggacaagactcacaatgctctctcctcccgagaactcattatacagccaggatacatgatgcagtttaaaattgtggtgggttgtgaagccacttcttgtggtgaccttcattccgtaatgctggaatacactaaggatgcaagatcggattcctggcagctcgtacagacccagtgccttccttcctcttctaacagcattggctgctcccctttccagttccatgaagccaccatctacaactctgtcaacagctcaagctggaaaagaatcaccatccagctgcctgaccatgtctcctctagtgcaacacagttccgctggatccagaagggagaagaaactgagaagcaaagctgggcaattgaccacgtgtacattggagaggcttgccccaagctctgcagcgggcacggatactgcacgaccggtgccatctgcatctgcgacgagagcttccaaggtgatgactgctctgttttcagtcacgaccttcccagttatattaaagataattttgagtccgcaagagtcaccgaggcaaactgggagaccattcaaggtggagtcataggaagtggctgtgggcagctggccccctacgcccatggagactcactgtactttaatggctgtcagatcaggcaagcagctaccaagcctctggatctcactcgagcaagcaaaatcatgtttgttttgcaaattgggagcatgtcgcagacggacagctgcaacagtgacctgagtggcccccacgctgtggacaaggcagtgctgctgcaatacagcgtcaacaacgggatcacctggcatgtcatcgcccagcaccagccaaaggacttcacacaagctcagagagtgtcttacaatgtccccctggaggcacggatgaaaggagtcttactgcgctggtggcaaccacgccacaatggaacaggtcatgatcaatgggctttggaccatgtggaggtcgtcctagtaagcactcgcaaacaaaattacatgatgaatttttcacgacaacatgggctcagacatttctacaacagaagacgaaggtcacttaggcgatacccatgaagaatcaaaaagtttattttttttcttccaacatgtgatgtgttgctctccattcttttaaatctcgcactacatctgatatcaggaaatatctgtgaaggacttggtgattacctgaaagcccttctcaagaccgagtgtacaccactttcccacactgtgaactaatgacaagtgacttatttgctcataagtaaatgtcttcatgttgatgtgtccgtgaaagttgtgatctgttgtaatatcagttacagtggcagtattgacaataagaaacagtttaacagaaaaatgaaatttaagcacaaaaaatttaagagattttatgtttaaaatggcatttagcacagtatttaacattcttggtcacaaagctatttaagtggactgtatttcagctatgtctcatgttttatatgattaaattatcattgtttgtcctttatgtattctcttctacaatacaacacattgaaactgtatttacttgttatgttgtaatattttgctgctgaatttggggctacttatattctgcagaaaattaattgaaatacctattcaagaagatagttgtaaagatattgtatctcctttaatatactccttaaaaatgtatgttggtttagcgttgttttgtggataagaaaaatgcttgaccctgaaatattttctactttaaattgtggatgaagaccctatctcccacaaataagttcccatttccttgtctaaagatctttttttaagtgttctgtggctgatttactaacagtaactgccattttttgtctgtgataacagagtgatttgtaaaacagtggttgttttttcattgtgttttcttcgtggattgttttttctgcgggtcatattcataccttctgatgaagttgtacaacaccagcaacattataatggccctgtagctctgaatgctatttgtgtaactgaaaggttgcactctagggtgaaccaagctataaaagcccatgcttaaataaaaattatgtccaaaagcca

SEQ ID NO: 23894 - DNA, 10408 bp, Homo sapiens
  misc_feature (144)..(144): n is a, c, g, or t
cacgcgtgggctcggcgggggcccgctcccaggcccgctcccgagcccgttccgctcccgtccgccttcttctcgccttctctccgcgtggctcctccgtcccggcgtctccaaaactgaatgagcgagcggcgcgtagggcgncggcggcggcggcggcggcggcggcggcggcatggagcgcagtggctgggcccggcagactttcctcctagcgctgttgctgggggcgacgctgagggcgcgcgcggcggctggctattacccccgcttttcgcccttctttttcctgtgcacccaccacggggagctggaaggggatggggagcagggcgaggtgctcatttccctgcatattgcgggcaaccccacctactacgttccgggacaagaataccatgtgacaatttcaacaagcaccttttttgacggcttgctggtgacaggactatacacatctacaagtgttcaggcatcacagagcattggaggttccagtgctttcggatttgggatcatgtctgaccaccagtttggtaaccagtttatgtgcagtgtggtagcctctcacgtgagtcacctgcccacaaccaacctcagtttcatctggattgctccacctgcgggcacaggctgtgtgaatttcatggctacagcaacacaccggggccaggttattttcaaagatgctttagcccagcagttgtgtgaacaaggagctccaacagatgtcactgtgcacccacatctagctgaaatacatagtgacagcattatcctgagagatgactttgactcctaccaccaactgcaattaaatccaaatatatgggttgaatgtaacaactgtgagactggagaacagtgtggcgcgattatgcatggcaatgccgtcaccttctgtgaaccatatggcccacgagaactgattaccacaggccttaatacaacaacagcttctgtcctccaattttccattgggtcaggttcatgtcgctttagttattcagaccccagcatcatcgtgttatatgccaagaataactctgcggactggattcagctagagaaaattagagccccttccaatgtcagcacaatcatccatatcctctaccttcctgaggacgccaaaggggagaatgtccaatttcagtggaagcaggaaaatcttcgtgtaggtgaagtgtatgaagcctgctgggccttagataacatcttgatcatcaattcagctcacagacaagtcgttttagaagatagtctcgacccagtggacacaggcaactggcttttcttcccaggagctacagttaagcatagctgtcagtcagatgggaactccatttatttccatggaaatgaaggcagcgagttcaattttgccaccaccagggatgtagatctttccacagaagatattcaagagcaatggtcagaagaatttgagagccagcctacaggatgggatgtcttgggagctgtcattggtacagaatgtggaacgatagaatcaggcttatcaatggtcttcctcaaagatggagagaggaaattatgcactccatccatggacactaccggttatgggaacctgaggttttactttgtgatgggaggaatttgtgaccctggaaattctcatgaaaatgacataatcctgtatgcaaaaattgaaggaagaaaagagcatataacactggataccctttcctattcctcatataaggttccgtctttggtttctgtggtcatcaatcctgaacttcagactcctgctaccaaattttgtctcaggcaaaagaaccatcaaggacataataggaatgtctgggctgtagactttttccatgtcttgcctgttctcccttctacaatgtctcacatgatacagttttccatcaatctgggatgtggaacgcatcagcctggtaacagtgtcagcttggaattttctaccaaccatgggcgctcctggtccctccttcacactgaatgcttacctgagatctgtgctggaccccacctcccccacagcactgtctactcctctgaaaactacagtgggtggaaccgaataacaattccccttcctaacgcagcactaacccggaacaccaggattcgctggagacaaacaggaccaatccttggaaacatgtgggcaattgataatgtttatattggcccgtcatgtctcaaattctgttctggcagaggacagtgcactagacatggttgcaagtgtgaccctggattttctggcccagcttgtgagatggcatcccagacattcccaatgtttatttctgaaagctttggcagttccaggctctcctcttaccataacttttactctatccgtggtgctgaagtcagctttggttgtggtgtcttggccagtggtaaggccctggttttcaacaaagaagggcggcgtcagctaattacatctttccttgacagctcacaatccaggtttctccagttcacactgagactggggagcaaatctgttctgagcacgtgcagagcccctgatcagcctggtgaaggagttttgctgcattattcttatgataatgggataacttggaaactcctggagcattattcatatctcagctatcatgagcccagaataatctccgtagaactaccaggtgatgcaaagcagtttggaattcagttcagatggtggcaaccgtatcattcttcccagagagaagatgtatgggctattgatgagattatcatgacatctgtgcttttcaacagcattagtcttgactttaccaatcttgtggaggtcactcagtctctgggattctaccttggaaatgttcagccatactgtggccacgactggaccctttgttttacaggagattctaaacttgcctcaagtatgcgctatgtggaaacacaatcaatgcagataggagcatcctatatgattcagttcagtttggtgatgggatgtggccagaaatacaccccacacatggacaaccaggtgaagctggagtactcaaccaaccacggccttacctggcacctcgtccaagaagaatgccttccaagtatgccaagttgtcaggaatttacatcagcaagtatttaccatgccagtgagtttacacagtggaggagagtcatagtgcttcttccccagaaaacttggtccagtgctacccgtttccgctggagccagagctattacacagctcaagacgagtgggctttggacagcatttacattgggcagcagtgccccaacatgtgcagtgggcatggctcatgcgatcatggcatatgcaggtgtgaccaggggtaccaaggcactgaatgccacccagaagctgcccttccgtccacaattatgtcagattttgagaaccagaatggctgggagtctgactggcaagaagttattgggggagaaattgtaaaaccagaacaagggtgtggtgtcatctcttctggatcatctctgtacttcagcaaggctgggaaaagacagctggtgagttgggacctggatacttcttgggtggactttgtccagttctacatccagataggcggagagagtgcttcatgcaacaagcctgacagcagagaggagggcgtcctccttcagtacagcaacaatgggggcatccagtggcacctgctagcagagatgtacttttcagacttcagcaaacccagatttgtctatctggagcttccagctgctgccaagaccccttgcaccaggttccgctggtggcagcccgtgttctcaggggaggactatgaccagtgggcagtcgatgacatcatcattctgtccgagaagcagaagcagatcatcccagttatcaatccaactttacctcagaacttttatgagaagccagcttttgattaccctatgaatcagatgagtgtgtggttgatgttggctaatgaaggaatggttaaaaatgaaaccttctgtgctgccacaccatcagcaatgatatttggaaaatcagatggagatcgatttgcagtaactcgagatttgaccctgaaacctggatatgtgctacagttcaagctaaacataggttgtgccaatcaattcagcagtactgctccagttcttcttcagtactctcatgatgctggtatgtcctggtttctggtgaaagaaggctgttacccggcttctgcaggcaaaggatgcgaaggaaactccagagaactaagtgagcccaccatgtatcacacaggggactttgaagaatggacaagaatcaccattgttattccaaggtctcttgcatccagcaagaccagattccgatggatccaggagagcagctcacagaaaaacgtgcctccatttggtttagatggagtgtacatatccgagccttgtcccagttactgcagtggccatggggactgcatttcaggagtgtgtttctgtgacctgggatatactgctgcacaaggaacctgtgtgtcaaatgtccccaatcacaatgagatgttcgataggtttgaggggaagctcagccctctgtggtacaagataacaggtgcccaggttggaactggctgtggaacacttaacgatggcaaatctctctacttcaatggccctgggaaaagggaagcccggacggtccctctggacaccaggaatatcagacttgttcaattttatatacaaattggaagcaaaacttcaggcattacctgcatcaaaccaagaactagaaatgaagggcttattgttcagtattcaaatgacaatgggatactctggcatttgcttcgagagttggacttcatgtccttcctggaaccacagatcatttccattgacctgccacaggacgcgaagacacctgcaacggcatttcgatggtggcaaccgcaacatgggaagcattcagcccagtgggctttggatgatgttcttataggaatgaatgacagctctcaaactggatttcaagacaaatttgatggctctatagatttgcaagccaactggtatcgaatccaaggaggtcaagttgatattgactgtctctctatggatactgctctgatattcactgaaaacataggaaaacctcgttatgctgagacctgggattttcatgtgtcagcatctacctttttgcagtttgaaatgagcatgggctgtagcaagcccttcagcaactcccacagtgtacagctccagtattctctgaacaatggcaaggactggcatcttgtcaccgaagagtgtgttcctccaaccattggctgtctgcattacacggaaagttcaatttacacctcggaaagattccagaattggaagcggatcactgtctaccttccactctccaccatttctcccaggacccggttcagatggattcaggccaactacactgtgggggctgattcctgggcgattgataatgttgtactggcctcagggtgcccttggatgtgctcaggacgagggatttgtgatgctggacgctgtgtgtgtgaccggggctttggtggaccctattgtgttcctgttgttcctctgccctcgattcttaaagacgatttcaatgggaatttacatcctgacctttggcctgaagtgtatggtgcagagagggggaatctgaatggtgaaaccatcaaatctggaacatctctaatttttaaaggggaaggactaaggatgcttatttcaagagatctagattgtacaaatacaatgtatgtccagttttcacttagatttatagcaaaaagtaccccagagagatctcactctattctgttacaattctccatcagtggaggaatcacttggcacctgatggatgaattttactttcctcaaacaacgaatatacttttcatcaatgttcccttgccatacactgcccaaaccaatgctacaagattcagactctggcaaccttataataacggtaagaaagaagaaatctggattgttgatgacttcattatcgatggaaataatgtaaacaaccctgtgatgctcttggatacatttgattttgggcccagagaagacaattggtttttctatcctggtggtaacatcggtctttattgtccatattcttcaaagggggcacctgaagaagattcagctatggtgtttgtttcaaatgaagttggtgagcattccattaccacccgtgacctaaatgtgaatgagaacaccatcatacaatttgagatcaacgttggctgttcgactgatagctcatccgcggatccagtgagactggaattttcaagggacttcggggcgacctggcaccttctgctgcccctctgctaccacagcagcagccacgtcagctctttatgctccaccgagcaccaccccagcagcacctactacgcaggaaccatgcagggctggaggagggaggtcgtgcactttgggaagctgcacctttgtggatctgtccgtttcagatggtaccagggattttaccctgccggctctcagccagtgacatgggccattgataatgtctacatcggtccccagtgtgaggagatgtgtaatggacaggggagctgtatcaatggaaccaaatgtatatgtgaccctggctactcaggtccaacctgtaaaataagcaccaaaaatcctgattttctcaaagatgatttcgaaggtcagctagaatctgatagattcttattaatgagtggtgggaaaccatctcgaaagtgtggaatcctttctagtggaaacaacctctttttcaatgaagatggcttgcgcatgttgatgacacgagacctggatttatcacatgctagatttgtgcagttcttcatgagactgggatgtggtaaaggcgttcctgaccccaggagtcaacccgtgctcctacagtattctctcaacggtggcctctcgtggagtcttcttcaggagttccttttcagcaattccagcaatgtgggcaggtacattgccctggagatacccttgaaagcccgttctggttctactcgccttcgctggtggcaaccgtctgagaatgggcacttctacagcccctgggttatcgatcagattcttattggaggaaatatttctggtaatacggtcttggaagatgatttcacaacccttgatagtaggaaatggctgcttcacccaggaggcaccaagatgcccgtgtgtggctctactggtgatgccctggtcttcattgaaaaggccagcacccgttacgtggtcagcacagacgttgccgtgaatgaggattccttcctacagatagacttcgctgcctcctgctcagtcacagactcttgttatgcgattgaattggaatactcagtagatcttggattgtcatggcacccattggtaagggactgtctgcctaccaatgtggaatgcagtcgctatcatctgcaacggatcctggtgtcagacactttcaacaagtggactagaatcactctgcctctccctccttataccaggtcccaagccactcgtttccgttggcatcaaccagctccttttgacaagcagcagacatgggcaatagataatgtctatatcggggatggctgcatagacatgtgcagtggccatgggagatgcatccagggaaactgcgtctgtgatgaacagtggggtggcctgtactgtgatgaccccgagacctctcttccaacccaactcaaagacaacttcaatcgagctccatccagtcagaactggctgactgtgaacggagggaaattgagtacagtgtgtggagccgtggcgtcgggaatggctctccatttcagtgggggttgtagtcgattattagtcactgtggatctaaacctcactaatgctgagttcatccaattttacttcatgtatgggtgcctgattacaccaaacaaccgtaaccaaggtgttctcttggaatattctgtcaatggaggcattacctggaacctgctcatggagattttctatgaccagtacagtaagcccggatttgtgaatatccttctccctcctgatgctaaagagattgccactcgcttccgctggtggcagccaagacatgacggcctggatcagaacgactgggccattgacaatgtcctcatctcaggctctgctgaccaaaggaccgttatgctggacaccttcagcagcgccccagtaccccagcacgagcgctcccctgcagatgccggccctgtcgggaggatcgcctttgacatgtttatggaagacaaaacttcagtgaatgagcactggctattccatgatgattgtacagtagaaagattctgtgactcccctgatggtgtgatgctctgtggcagtcatgatggacgggaggtgtatgcagtgacccatgacctgactcccactgaaggctggattatgcaattcaagatctcagttggatgtaaggtgtctgaaaaaattgcccagaatcaaattcatgtgcagtattctactgacttcggtgtgagttggaattatctggtccctcagtgcttgcctgctgacccaaaatgctctggaagtgtttctcagccatctgtattctttccaactaaagggtggaaaaggatcacctacccacttcctgaaagcttagtgggaaatccggtaaggtttaggttctatcagaagtactcagacatgcagtgggcaatcgataatttctacctgggccctggatgcttggacaactgcaggggccatggagattgcttaagggaacagtgcatctgtgatccgggatactcagggccaaactgctacttgacccacactctgaagactttcctgaaggaacgctttgacagtgaagaaatcaaacctgacttatggatgtccttagaaggtggaagtacttgcactgagtgtggaattcttgccgaggacactgcactctattttgggggatccactgtgagacaagcggttacacaagatttggatcttcgaggtgcaaagttcctgcaatactgggggcgcatcggtagtgagaacaacatgacctcttgccatcgtcccatctgccggaaggaaggcgtgctgttggactactctaccgatggaggaattacctggactttgctccatgagatggattaccagaaatacatttctgttagacacgactacatacttcttcctgaagatgccctcaccaacacaactcgacttcgctggtggcagccttttgtgatcagcaatggaattgtggtctctggggtggagcgtgctcagtgggcactggacaacattttgattggtggagcagaaatcaatcccagccaattggtggacacttttgatgatgttaggcgatacccatgaagaatcaaaaagtttattttttttcttccaacatgtgatgtgttgctctccattcttttaaatctcgcactacatctgatatcaggaaatatctgtgaaggacttggtgattacctgaaagcccttctcaagaccgagtgtacaccactttcccacactgtgaactaatgacaagtgacttatttgctcataagtaaatgtcttcatgttgatgtgtccgtgaaagttgtgatctgttgtaatatcagttacagtggcagtattgacaataagaaacagtttaacagaaaaatgaaatttaagcacaaaaaatttaagagattttatgtttaaaatggcatttagcacagtatttaacattcttggtcacaaagctatttaagtggactgtatttcagctatgtctcatgttttatatgattaaattatcattgtttgtcctttatgtattctcttctacaatacaacacattgaaactgtatttacttgttatgttgtaatattttgctgctgaatttggggctacttatattctgcagaaaattaattgaaatacctattcaagaagatagttgtaaagatattgtatctcctttaatatactccttaaaaatgtatgttggtttagcgttgttttgtggataagaaaaatgcttgaccctgaaatattttctactttaaattgtggatgaagaccctatctcccacaaataagttcccatttccttgtctaaagatctttttttaagtgttctgtggctgatttactaacagtaactgccattttttgtctgtgataacagagtgatttgtaaaacagtggttgttttttcattgtgttttcttcgtggattgttttttctgcgggtcatattcataccttctgatgaagttgtacaacaccagcaacattataatggccctgtagctctgaatgctatttgtgtaactgaaaggttgcactctagggtgaaccaagctataaaagcccatgcttaaataaaaattatgtccaaaagcca

SEQ ID NO: 23895 - DNA, 6910 bp, Homo sapiens
  misc_feature (144)..(144): n is a, c, g, or t
cacgcgtgggctcggcgggggcccgctcccaggcccgctcccgagcccgttccgctcccgtccgccttcttctcgccttctctccgcgtggctcctccgtcccggcgtctccaaaactgaatgagcgagcggcgcgtagggcgncggcggcggcggcggcggcggcggcggcggcatggagcgcagtggctgggcccggcagactttcctcctagcgctgttgctgggggcgacgctgagggcgcgcgcggcggctggctattacccccgcttttcgcccttctttttcctgtgcacccaccacggggagctggaaggggatggggagcagggcgaggtgctcatttccctgcatattgcgggcaaccccacctactacgttccgggacaagaataccatgtgacaatttcaacaagcaccttttttgacggcttgctggtgacaggactatacacatctacaagtgttcaggcatcacagagcattggaggttccagtgctttcggatttgggatcatgtctgaccaccagtttggtaaccagtttatgtgcagtgtggtagcctctcacgtgagtcacctgcccacaaccaacctcagtttcatctggattgctccacctgcgggcacaggctgtgtgaatttcatggctacagcaacacaccggggccaggttattttcaaagatgctttagcccagcagttgtgtgaacaaggagctccaacagatgtcactgtgcacccacatctagctgaaatacatagtgacagcattatcctgagagatgactttgactcctaccaccaactgcaattaaatccaaatatatgggttgaatgtaacaactgtgagactggagaacagtgtggcgcgattatgcatggcaatgccgtcaccttctgtgaaccatatggcccacgagaactgattaccacaggccttaatacaacaacagcttctgtcctccaattttccattgggtcaggttcatgtcgctttagttattcagaccccagcatcatcgtgttatatgccaagaataactctgcggactggattcagctagagaaaattagagccccttccaatgtcagcacaatcatccatatcctctaccttcctgaggacgccaaaggggagaatgtccaatttcagtggaagcaggaaaatcttcgtgtaggtgaagtgtatgaagcctgctgggccttagataacatcttgatcatcaattcagctcacagacaagtcgttttagaagatagtctcgacccagtggacacaggcaactggcttttcttcccaggagctacagttaagcatagctgtcagtcagatgggaactccatttatttccatggaaatgaaggcagcgagttcaattttgccaccaccagggatgtagatctttccacagaagatattcaagagcaatggtcagaagaatttgagagccagcctacaggatgggatgtcttgggagctgtcattggtacagaatgtggaacgatagaatcaggcttatcaatggtcttcctcaaagatggagagaggaaattatgcactccatccatggacactaccggttatgggaacctgaggttttactttgtgatgggaggaatttgtgaccctggaaattctcatgaaaatgacataatcctgtatgcaaaaattgaaggaagaaaagagcatataacactggataccctttcctattcctcatataaggttccgtctttggtttctgtggtcatcaatcctgaacttcagactcctgctaccaaattttgtctcaggcaaaagaaccatcaaggacataataggaatgtctgggctgtagactttttccatgtcttgcctgttctcccttctacaatgtctcacatgatacagttttccatcaatctgggatgtggaacgcatcagcctggtaacagtgtcagcttggaattttctaccaaccatgggcgctcctggtccctccttcacactgaatgcttacctgagatctgtgctggaccccacctcccccacagcactgtctactcctctgaaaactacagtgggtggaaccgaataacaattccccttcctaacgcagcactaacccggaacaccaggattcgctggagacaaacaggaccaatccttggaaacatgtgggcaattgataatgtttatattggcccgtcatgtctcaaattctgttctggcagaggacagtgcactagacatggttgcaagtgtgaccctggattttctggcccagcttgtgagatggcatcccagacattcccaatgtttatttctgaaagctttggcagttccaggctctcctcttaccataacttttactctatccgtggtgctgaagtcagctttggttgtggtgtcttggccagtggtaaggccctggttttcaacaaagaagggcggcgtcagctaattacatctttccttgacagctcacaatccaggtttctccagttcacactgagactggggagcaaatctgttctgagcacgtgcagagcccctgatcagcctggtgaaggagttttgctgcattattcttatgataatgggataacttggaaactcctggagcattattcatatctcagctatcatgagcccagaataatctccgtagaactaccaggtgatgcaaagcagtttggaattcagttcagatggtggcaaccgtatcattcttcccagagagaagatgtatgggctattgatgagattatcatgacatctgtgcttttcaacagcattagtcttgactttaccaatcttgtggaggtcactcagtctctgggattctaccttggaaatgttcagccatactgtggccacgactggaccctttgttttacaggagattctaaacttgcctcaagtatgcgctatgtggaaacacaatcaatgcagataggagcatcctatatgattcagttcagtttggtgatgggatgtggccagaaatacaccccacacatggacaaccaggtgaagctggagtactcaaccaaccacggccttacctggcacctcgtccaagaagaatgccttccaagtatgccaagttgtcaggaatttacatcagcaagtatttaccatgccagtgagtttacacagtggaggagagtcatagtgcttcttccccagaaaacttggtccagtgctacccgtttccgctggagccagagctattacacagctcaagacgagtgggctttggacagcatttacattgggcagcagtgccccaacatgtgcagtgggcatggctcatgcgatcatggcatatgcaggtgtgaccaggggtaccaaggcactgaatgccacccagaagctgcccttccgtccacaattatgtcagattttgagaaccagaatggctgggagtctgactggcaagaagttattgggggagaaattgtaaaaccagaacaagggtgtggtgtcatctcttctggatcatctctgtacttcagcaaggctgggaaaagacagctggtgagttgggacctggatacttcttgggtggactttgtccagttctacatccagataggcggagagagtgcttcatgcaacaagcctgacagcagagaggagggcgtcctccttcagtacagcaacaatgggggcatccagtggcacctgctagcagagatgtacttttcagacttcagcaaacccagatttgtctatctggagcttccagctgctgccaagaccccttgcaccaggttccgctggtggcagcccgtgttctcaggggaggactatgaccagtgggcagtcgatgacatcatcattctgtccgagaagcagaagcagatcatcccagttatcaatccaactttacctcagaacttttatgagaagccagcttttgattaccctatgaatcagatgagtgtgtggttgatgttggctaatgaaggaatggttaaaaatgaaaccttctgtgctgccacaccatcagcaatgatatttggaaaatcagatggagatcgatttgcagtaactcgagatttgaccctgaaacctggatatgtgctacagttcaagctaaacataggttgtgccaatcaattcagcagtactgctccagttcttcttcagtactctcatgatgctggtatgtcctggtttctggtgaaagaaggctgttacccggcttctgcaggcaaaggatgcgaaggaaactccagagaactaagtgagcccaccatgtatcacacaggggactttgaagaatggacaagaatcaccattgttattccaaggtctcttgcatccagcaagaccagattccgatggatccaggagagcagctcacagaaaaacgtgcctccatttggtttagatggagtgtacatatccgagccttgtcccagttactgcagtggccatggggactgcatttcaggagtgtgtttctgtgacctgggatatactgctgcacaaggaacctgtgtgtcaaatgtccccaatcacaatgagatgttcgataggtttgaggggaagctcagccctctgtggtacaagataacaggtgcccaggttggaactggctgtggaacacttaacgatggcaaatctctctacttcaatggccctgggaaaagggaagcccggacggtccctctggacaccaggaatatcagacttgttcaattttatatacaaattggaagcaaaacttcaggcattacctgcatcaaaccaagaactagaaatgaagggcttattgttcagtattcaaatgacaatgggatactctggcatttgcttcgagagttggacttcatgtccttcctggaaccacagatcatttccattgacctgccacaggacgcgaagacacctgcaacggcatttcgatggtggcaaccgcaacatgggaagcattcagcccagtgggctttggatgatgttcttataggaatgaatgacagctctcaaactggatttcaagacaaatttgatggctctatagatttgcaagccaactggtatcgaatccaaggaggtcaagttgatattgactgtctctctatggatactgctctgatattcactgaaaacataggaaaacctcgttatgctgagacctgggattttcatgtgtcagcatctacctttttgcagtttgaaatgagcatgggctgtagcaagcccttcagcaactcccacagtgtacagctccagtattctctgaacaatggcaaggactggcatcttgtcaccgaagagtgtgttcctccaaccattggctgtctgcattacacggaaagttcaatttacacctcggaaagattccagaattggaagcggatcactgtctaccttccactctccaccatttctcccaggacccggttcagatggattcaggccaactacactgtgggggctgattcctgggcgattgataatgttgtactggcctcagggtgcccttggatgtgctcaggacgagggatttgtgatgctggacgctgtgtgtgtgaccggggctttggtggaccctattgtgttcctgttgttcctctgccctcgattcttaaagacgatttcaatgggaatttacatcctgacctttggcctgaagtgtatggtgcagagagggggaatctgaatggtgaaaccatcaaatctggaacatctctaatttttaaaggggaaggactaaggatgcttatttcaagagatctagattgtacaaatacaatgtatgtccagttttcacttagatttatagcaaaaagtaccccagagagatctcactctattctgttacaattctccatcagtggaggaatcacttggcacctgatggatgaattttactttcctcaaacaacgaatatacttttcatcaatgttcccttgccatacactgcccaaaccaatgctacaagattcagactctggcaaccttataataacggtaagaaagaagaaatctggattgttgatgacttcattatcgatggaaataatgtaaacaaccctgtgatgctcttggatacatttgattttgggcccagagaagacaattggtttttctatcctggtggtaacatcggtctttattgtccatattcttcaaagggggcacctgaagaagattcagctatggtgtttgtttcaaatgaagttggtgagcattccattaccacccgtgacctaaatgtgaatgagaacaccatcatacaatttgagatcaacgttggctgttcgactgatagctcatccgcggatccagtgagactggaattttcaagggacttcggggcgacctggcaccttctgctgcccctctgctaccacagcagcagccacgtcagctctttatgctccaccgagcaccaccccagcagcacctactacgcaggaaccatgcagggctggaggagggaggtcgtgcactttgggaagctgcacctttgtgggtaaggacccgctgcttgacgccacatttgtttctcctttgacagtttattcctgaagtcatcgttcacttgccactttatcatggggaaatttccacctgacgtttcttcctctgttctcaagcagatcagtggatatttaaaatgtaggacacggagctgacataactactaatttctagttggaaggtagatttgaacaggacaccatgggctgcaccctgtagtggggttcacatccttgtgaaattctgttagatcaattagaacacaacaaaaataaggttttccacgcgttcctcctgcctactcccacctgacaatataaatgcagctagaatattatgactttcaaacacctgcctatgtctgtcatgcagggagagtgtatatagggagcatagaagcccacagaatattcctggtgtctcat

SEQ ID NO: 23896 - DNA, 3717 bp, Homo sapiens
  misc_feature (144)..(144): n is a, c, g, or t
cacgcgtgggctcggcgggggcccgctcccaggcccgctcccgagcccgttccgctcccgtccgccttcttctcgccttctctccgcgtggctcctccgtcccggcgtctccaaaactgaatgagcgagcggcgcgtagggcgncggcggcggcggcggcggcggcggcggcggcatggagcgcagtggctgggcccggcagactttcctcctagcgctgttgctgggggcgacgctgagggcgcgcgcggcggctggctattacccccgcttttcgcccttctttttcctgtgcacccaccacggggagctggaaggggatggggagcagggcgaggtgctcatttccctgcatattgcgggcaaccccacctactacgttccgggacaagaataccatgtgacaatttcaacaagcaccttttttgacggcttgctggtgacaggactatacacatctacaagtgttcaggcatcacagagcattggaggttccagtgctttcggatttgggatcatgtctgaccaccagtttggtaaccagtttatgtgcagtgtggtagcctctcacgtgagtcacctgcccacaaccaacctcagtttcatctggattgctccacctgcgggcacaggctgtgtgaatttcatggctacagcaacacaccggggccaggttattttcaaagatgctttagcccagcagttgtgtgaacaaggagctccaacagatgtcactgtgcacccacatctagctgaaatacatagtgacagcattatcctgagagatgactttgactcctaccaccaactgcaattaaatccaaatatatgggttgaatgtaacaactgtgagactggagaacagtgtggcgcgattatgcatggcaatgccgtcaccttctgtgaaccatatggcccacgagaactgattaccacaggccttaatacaacaacagcttctgtcctccaattttccattgggtcaggttcatgtcgctttagttattcagaccccagcatcatcgtgttatatgccaagaataactctgcggactggattcagctagagaaaattagagccccttccaatgtcagcacaatcatccatatcctctaccttcctgaggacgccaaaggggagaatgtccaatttcagtggaagcaggaaaatcttcgtgtaggtgaagtgtatgaagcctgctgggccttagataacatcttgatcatcaattcagctcacagacaagtcgttttagaagatagtctcgacccagtggacacaggcaactggcttttcttcccaggagctacagttaagcatagctgtcagtcagatgggaactccatttatttccatggaaatgaaggcagcgagttcaattttgccaccaccagggatgtagatctttccacagaagatattcaagagcaatggtcagaagaatttgagagccagcctacaggatgggatgtcttgggagctgtcattggtacagaatgtggaacgatagaatcaggcttatcaatggtcttcctcaaagatggagagaggaaattatgcactccatccatggacactaccggttatgggaacctgaggttttactttgtgatgggaggaatttgtgaccctggaaattctcatgaaaatgacataatcctgtatgcaaaaattgaaggaagaaaagagcatataacactggataccctttcctattcctcatataaggttccgtctttggtttctgtggtcatcaatcctgaacttcagactcctgctaccaaattttgtctcaggcaaaagaaccatcaaggacataataggaatgtctgggctgtagactttttccatgtcttgcctgttctcccttctacaatgtctcacatgatacagttttccatcaatctgggatgtggaacgcatcagcctggtaacagtgtcagcttggaattttctaccaaccatgggcgctcctggtccctccttcacactgaatgcttacctgagatctgtgctggaccccacctcccccacagcactgtctactcctctgaaaactacagtgggtggaaccgaataacaattccccttcctaacgcagcactaacccggaacaccaggattcgctggagacaaacaggaccaatccttggaaacatgtgggcaattgataatgtttatattggcccgtcatgtctcaaattctgttctggcagaggacagtgcactagacatggttgcaagtgtgaccctggattttctggcccagcttgtgagatggcatcccagacattcccaatgtttatttctgaaagctttggcagttccaggctctcctcttaccataacttttactctatccgtggtgctgaagtcagctttggttgtggtgtcttggccagtggtaaggccctggttttcaacaaagaagggcggcgtcagctaattacatctttccttgacagctcacaatccaggtttctccagttcacactgagactggggagcaaatctgttctgagcacgtgcagagcccctgatcagcctggtgaaggagttttgctgcattattcttatgataatgggataacttggaaactcctggagcattattcatatctcagctatcatgagcccagaataatctccgtagaactaccaggtgatgcaaagcagtttggaattcagttcagatggtggcaaccgtatcattcttcccagagagaagatgtatgggctattgatgagattatcatgacatctgtgcttttcaacagcattagtcttgactttaccaatcttgtggaggtcactcagtctctgggattctaccttggaaatgttcagccatactgtggccacgactggaccctttggctggagtgcaatggtgcgatctcaactcactgcaacctctgcctcccgggctcaaacgacacattttctatttgatagcctcagatgcttgtttttacagatgttctttcttagtcctggagactttaaagaagataaacgattaaagcaaagaaggtgtaaagatgtagaacaaaatgagatttcttagaattttatgcttctgaacatttaaattgacctgaattgacagtaattcaaactgatcatgtaccgtaaactatatccttcaagtttgtatagaagagttttttcctaacacttctaatataacaaagaatcatatcatgaatgcaagtcctgtatcatgtttattttcataaatagttagcatctgctcagataaatgcaaaagttgctgagcattttaatttaacacttgcattgaatgcatgataacagcagtttaatttctgtgctttgatcaaaaccctaagaacaatatcccttcacacaagtctgatgaatattcttaacccaccaccgctttaattggtggagatacatttactttgtgaaagtacaatcacagtaattatagaaaaaccataagaaaacataaataattgtacaatccccatgggcaccttgagcagcaccataggagttttattaacaaccacatgtgagcaatcgatttgactttctgatcttctctgaagcaaaaaggagttgtcttggttatgaaacaacagagagtataccctggtggtgataatgagactagagaaacacattaaccactttaataaggacatgaaaaatgcttgcttctcattaaagtgaaacaacatggaaga

SEQ ID NO: 23897 - DNA, 565 bp, Homo sapiens
gaaggcacttcccatgaagaaaactggagtttttaccctaatgctgtaaggacagcaggattttgtggcaatccatcctttcacctctattggccaaataaaaagaaggacaagactcacaatgctctctcctcccgagaactcattatacagccaggatacatgatgcagtttaaagtaaggaaaagtggctctttaaaacagaaagtagcattgcatttggggcctcgagggagaatggttagtcagacaactataaggaaatgactgatattattcattaaaaaagactttatcttatgaataaaagaggtcatcttttgcaaagacctttattcaagtatgattacttgaggatagataaaatccctgaaaatgttgggacatagcaagaaatgtaactattaggctggtgcaaaagtaattgcaggccgggtgcagtggaaccatgcctataatcccaccactttgggaggctggggcaggaggatcacttgaggccaagaggccaggagctccagactagcctggccaacacggcaaaaccttgtctctataaaaaaat

SEQ ID NO: 23898 - DNA, 278 bp, Homo sapiens
gaaaacaatcatttaggaaacagcatctttaaaaaattttacactgtttttacagttgtttaatgtacttaaccagagttgaaaatttcatttgatttgttatctttaccctccccaccttttgtgtgtgcttgttctggttttattagtgtcagcttggaattttctaccaaccatgggcgctcctggtccctccttcacactgaatgcttacctgagatctgtgctggaccccacctcccccacagcactgtctactcctctgaaaactacagtgg

SEQ ID NO: 23899 - DNA, 11540 bp, Homo sapiens
  misc_feature (144)..(144): n is a, c, g, or t
cacgcgtgggctcggcgggggcccgctcccaggcccgctcccgagcccgttccgctcccgtccgccttcttctcgccttctctccgcgtggctcctccgtcccggcgtctccaaaactgaatgagcgagcggcgcgtagggcgncggcggcggcggcggcggcggcggcggcggcatggagcgcagtggctgggcccggcagactttcctcctagcgctgttgctgggggcgacgctgagggcgcgcgcggcggctggctattacccccgcttttcgcccttctttttcctgtgcacccaccacggggagctggaaggggatggggagcagggcgaggtgctcatttccctgcatattgcgggcaaccccacctactacgttccgggacaagaataccatgtgacaatttcaacaagcaccttttttgacggcttgctggtgacaggactatacacatctacaagtgttcaggcatcacagagcattggaggttccagtgctttcggatttgggatcatgtctgaccaccagtttggtaaccagtttatgtgcagtgtggtagcctctcacgtgagtcacctgcccacaaccaacctcagtttcatctggattgctccacctgcgggcacaggctgtgtgaatttcatggctacagcaacacaccggggccaggttattttcaaagatgctttagcccagcagttgtgtgaacaaggagctccaacagatgtcactgtgcacccacatctagctgaaatacatagtgacagcattatcctgagagatgactttgactcctaccaccaactgcaattaaatccaaatatatgggttgaatgtaacaactgtgagactggagaacagtgtggcgcgattatgcatggcaatgccgtcaccttctgtgaaccatatggcccacgagaactgattaccacaggccttaatacaacaacagcttctgtcctccaattttccattgggtcaggttcatgtcgctttagttattcagaccccagcatcatcgtgttatatgccaagaataactctgcggactggattcagctagagaaaattagagccccttccaatgtcagcacaatcatccatatcctctaccttcctgaggacgccaaaggggagaatgtccaatttcagtggaagcaggaaaatcttcgtgtaggtgaagtgtatgaagcctgctgggccttagataacatcttgatcatcaattcagctcacagacaagtcgttttagaagatagtctcgacccagtggacacaggcaactggcttttcttcccaggagctacagttaagcatagctgtcagtcagatgggaactccatttatttccatggaaatgaaggcagcgagttcaattttgccaccaccagggatgtagatctttccacagaagatattcaagagcaatggtcagaagaatttgagagccagcctacaggatgggatgtcttgggagctgtcattggtacagaatgtggaacgatagaatcaggcttatcaatggtcttcctcaaagatggagagaggaaattatgcactccatccatggacactaccggttatgggaacctgaggttttactttgtgatgggaggaatttgtgaccctggaaattctcatgaaaatgacataatcctgtatgcaaaaattgaaggaagaaaagagcatataacactggataccctttcctattcctcatataaggttccgtctttggtttctgtggtcatcaatcctgaacttcagactcctgctaccaaattttgtctcaggcaaaagaaccatcaaggacataataggaatgtctgggctgtagactttttccatgtcttgcctgttctcccttctacaatgtctcacatgatacagttttccatcaatctgggatgtggaacgcatcagcctggtaacagtgtcagcttggaattttctaccaaccatgggcgctcctggtccctccttcacactgaatgcttacctgagatctgtgctggaccccacctcccccacagcactgtctactcctctgaaaactacagtgggtggaaccgaataacaattccccttcctaacgcagcactaacccggaacaccaggattcgctggagacaaacaggaccaatccttggaaacatgtgggcaattgataatgtttatattggcccgtcatgtctcaaattctgttctggcagaggacagtgcactagacatggttgcaagtgtgaccctggattttctggcccagcttgtgagatggcatcccagacattcccaatgtttatttctgaaagctttggcagttccaggctctcctcttaccataacttttactctatccgtggtgctgaagtcagctttggttgtggtgtcttggccagtggtaaggccctggttttcaacaaagaagggcggcgtcagctaattacatctttccttgacagctcacaatccaggtttctccagttcacactgagactggggagcaaatctgttctgagcacgtgcagagcccctgatcagcctggtgaaggagttttgctgcattattcttatgataatgggataacttggaaactcctggagcattattcatatctcagctatcatgagcccagaataatctccgtagaactaccaggtgatgcaaagcagtttggaattcagttcagatggtggcaaccgtatcattcttcccagagagaagatgtatgggctattgatgagattatcatgacatctgtgcttttcaacagcattagtcttgactttaccaatcttgtggaggtcactcagtctctgggattctaccttggaaatgttcagccatactgtggccacgactggaccctttgttttacaggagattctaaacttgcctcaagtatgcgctatgtggaaacacaatcaatgcagataggagcatcctatatgattcagttcagtttggtgatgggatgtggccagaaatacaccccacacatggacaaccaggtgaagctggagtactcaaccaaccacggccttacctggcacctcgtccaagaagaatgccttccaagtatgccaagttgtcaggaatttacatcagcaagtatttaccatgccagtgagtttacacagtggaggagagtcatagtgcttcttccccagaaaacttggtccagtgctacccgtttccgctggagccagagctattacacagctcaagacgagtgggctttggacagcatttacattgggcagcagtgccccaacatgtgcagtgggcatggctcatgcgatcatggcatatgcaggtgtgaccaggggtaccaaggcactgaatgccacccagaagctgcccttccgtccacaattatgtcagattttgagaaccagaatggctgggagtctgactggcaagaagttattgggggagaaattgtaaaaccagaacaagggtgtggtgtcatctcttctggatcatctctgtacttcagcaaggctgggaaaagacagctggtgagttgggacctggatacttcttgggtggactttgtccagttctacatccagataggcggagagagtgcttcatgcaacaagcctgacagcagagaggagggcgtcctccttcagtacagcaacaatgggggcatccagtggcacctgctagcagagatgtacttttcagacttcagcaaacccagatttgtctatctggagcttccagctgctgccaagaccccttgcaccaggttccgctggtggcagcccgtgttctcaggggaggactatgaccagtgggcagtcgatgacatcatcattctgtccgagaagcagaagcagatcatcccagttatcaatccaactttacctcagaacttttatgagaagccagcttttgattaccctatgaatcagatgagtgtgtggttgatgttggctaatgaaggaatggttaaaaatgaaaccttctgtgctgccacaccatcagcaatgatatttggaaaatcagatggagatcgatttgcagtaactcgagatttgaccctgaaacctggatatgtgctacagttcaagctaaacataggttgtgccaatcaattcagcagtactgctccagttcttcttcagtactctcatgatgctggtatgtcctggtttctggtgaaagaaggctgttacccggcttctgcaggcaaaggatgcgaaggaaactccagagaactaagtgagcccaccatgtatcacacaggggactttgaagaatggacaagaatcaccattgttattccaaggtctcttgcatccagcaagaccagattccgatggatccaggagagcagctcacagaaaaacgtgcctccatttggtttagatggagtgtacatatccgagccttgtcccagttactgcagtggccatggggactgcatttcaggagtgtgtttctgtgacctgggatatactgctgcacaaggaacctgtgtgtcaaatgtccccaatcacaatgagatgttcgataggtttgaggggaagctcagccctctgtggtacaagataacaggtgcccaggttggaactggctgtggaacacttaacgatggcaaatctctctacttcaatggccctgggaaaagggaagcccggacggtccctctggacaccaggaatatcagacttgttcaattttatatacaaattggaagcaaaacttcaggcattacctgcatcaaaccaagaactagaaatgaagggcttattgttcagtattcaaatgacaatgggatactctggcatttgcttcgagagttggacttcatgtccttcctggaaccacagatcatttccattgacctgccacaggacgcgaagacacctgcaacggcatttcgatggtggcaaccgcaacatgggaagcattcagcccagtgggctttggatgatgttcttataggaatgaatgacagctctcaaactggatttcaagacaaatttgatggctctatagatttgcaagccaactggtatcgaatccaaggaggtcaagttgatattgactgtctctctatggatactgctctgatattcactgaaaacataggaaaacctcgttatgctgagacctgggattttcatgtgtcagcatctacctttttgcagtttgaaatgagcatgggctgtagcaagcccttcagcaactcccacagtgtacagctccagtattctctgaacaatggcaaggactggcatcttgtcaccgaagagtgtgttcctccaaccattggctgtctgcattacacggaaagttcaatttacacctcggaaagattccagaattggaagcggatcactgtctaccttccactctccaccatttctcccaggacccggttcagatggattcaggccaactacactgtgggggctgattcctgggcgattgataatgttgtactggcctcagggtgcccttggatgtgctcaggacgagggatttgtgatgctggacgctgtgtgtgtgaccggggctttggtggaccctattgtgttcctgttgttcctctgccctcgattcttaaagacgatttcaatgggaatttacatcctgacctttggcctgaagtgtatggtgcagagagggggaatctgaatggtgaaaccatcaaatctggaacatctctaatttttaaaggggaaggactaaggatgcttatttcaagagatctagattgtacaaatacaatgtatgtccagttttcacttagatttatagcaaaaagtaccccagagagatctcactctattctgttacaattctccatcagtggaggaatcacttggcacctgatggatgaattttactttcctcaaacaacgaatatacttttcatcaatgttcccttgccatacactgcccaaaccaatgctacaagattcagactctggcaaccttataataacggtaagaaagaagaaatctggattgttgatgacttcattatcgatggaaataatgtaaacaaccctgtgatgctcttggatacatttgattttgggcccagagaagacaattggtttttctatcctggtggtaacatcggtctttattgtccatattcttcaaagggggcacctgaagaagattcagctatggtgtttgtttcaaatgaagttggtgagcattccattaccacccgtgacctaaatgtgaatgagaacaccatcatacaatttgagatcaacgttggctgttcgactgatagctcatccgcggatccagtgagactggaattttcaagggacttcggggcgacctggcaccttctgctgcccctctgctaccacagcagcagccacgtcagctctttatgctccaccgagcaccaccccagcagcacctactacgcaggaaccatgcagggctggaggagggaggtcgtgcactttgggaagctgcacctttgtggatctgtccgtttcagatggtaccagggattttaccctgccggctctcagccagtgacatgggccattgataatgtctacatcggtccccagtgtgaggagatgtgtaatggacaggggagctgtatcaatggaaccaaatgtatatgtgaccctggctactcaggtccaacctgtaaaataagcaccaaaaatcctgattttctcaaagatgatttcgaaggtcagctagaatctgatagattcttattaatgagtggtgggaaaccatctcgaaagtgtggaatcctttctagtggaaacaacctctttttcaatgaagatggcttgcgcatgttgatgacacgagacctggatttatcacatgctagatttgtgcagttcttcatgagactgggatgtggtaaaggcgttcctgaccccaggagtcaacccgtgctcctacagtattctctcaacggtggcctctcgtggagtcttcttcaggagttccttttcagcaattccagcaatgtgggcaggtacattgccctggagatacccttgaaagcccgttctggttctactcgccttcgctggtggcaaccgtctgagaatgggcacttctacagcccctgggttatcgatcagattcttattggaggaaatatttctggtaatacggtcttggaagatgatttcacaacccttgatagtaggaaatggctgcttcacccaggaggcaccaagatgcccgtgtgtggctctactggtgatgccctggtcttcattgaaaaggccagcacccgttacgtggtcagcacagacgttgccgtgaatgaggattccttcctacagatagacttcgctgcctcctgctcagtcacagactcttgttatgcgattgaattggaatactcagtagatcttggattgtcatggcacccattggtaagggactgtctgcctaccaatgtggaatgcagtcgctatcatctgcaacggatcctggtgtcagacactttcaacaagtggactagaatcactctgcctctccctccttataccaggtcccaagccactcgtttccgttggcatcaaccagctccttttgacaagcagcagacatgggcaatagataatgtctatatcggggatggctgcatagacatgtgcagtggccatgggagatgcatccagggaaactgcgtctgtgatgaacagtggggtggcctgtactgtgatgaccccgagacctctcttccaacccaactcaaagacaacttcaatcgagctccatccagtcagaactggctgactgtgaacggagggaaattgagtacagtgtgtggagccgtggcgtcgggaatggctctccatttcagtgggggttgtagtcgattattagtcactgtggatctaaacctcactaatgctgagttcatccaattttacttcatgtatgggtgcctgattacaccaaacaaccgtaaccaaggtgttctcttggaatattctgtcaatggaggcattacctggaacctgctcatggagattttctatgaccagtacagtaagcccggatttgtgaatatccttctccctcctgatgctaaagagattgccactcgcttccgctggtggcagccaagacatgacggcctggatcagaacgactgggccattgacaatgtcctcatctcaggctctgctgaccaaaggaccgttatgctggacaccttcagcagcgccccagtaccccagcacgagcgctcccctgcagatgccggccctgtcgggaggatcgcctttgacatgtttatggaagacaaaacttcagtgaatgagcactggctattccatgatgattgtacagtagaaagattctgtgactcccctgatggtgtgatgctctgtggcagtcatgatggacgggaggtgtatgcagtgacccatgacctgactcccactgaaggctggattatgcaattcaagatctcagttggatgtaaggtgtctgaaaaaattgcccagaatcaaattcatgtgcagtattctactgacttcggtgtgagttggaattatctggtccctcagtgcttgcctgctgacccaaaatgctctggaagtgtttctcagccatctgtattctttccaactaaagggtggaaaaggatcacctacccacttcctgaaagcttagtgggaaatccggtaaggtttaggttctatcagaagtactcagacatgcagtgggcaatcgataatttctacctgggccctggatgcttggacaactgcaggggccatggagattgcttaagggaacagtgcatctgtgatccgggatactcagggccaaactgctacttgacccacactctgaagactttcctgaaggaacgctttgacagtgaagaaatcaaacctgacttatggatgtccttagaaggtggaagtacttgcactgagtgtggaattcttgccgaggacactgcactctattttgggggatccactgtgagacaagcggttacacaagatttggatcttcgaggtgcaaagttcctgcaatactgggggcgcatcggtagtgagaacaacatgacctcttgccatcgtcccatctgccggaaggaaggcgtgctgttggactactctaccgatggaggaattacctggactttgctccatgagatggattaccagaaatacatttctgttagacacgactacatacttcttcctgaagatgccctcaccaacacaactcgacttcgctggtggcagccttttgtgatcagcaatggaattgtggtctctggggtggagcgtgctcagtgggcactggacaacattttgattggtggagcagaaatcaatcccagccaattggtggacacttttgatgatgaaggcacttcccatgaagaaaactggagtttttaccctaatgctgtaaggacagcaggattttgtggcaatccatcctttcacctctattggccaaataaaaagaaggacaagactcacaatgctctctcctcccgagaactcattatacagccaggatacatgatgcagtttaaaattgtggtgggttgtgaagccacttcttgtggtgaccttcattccgtaatgctggaatacactaaggatgcaagatcggattcctggcagctcgtacagacccagtgccttccttcctcttctaacagcattggctgctcccctttccagttccatgaagccaccatctacaactctgtcaacagctcaagctggtgcaacacagttccgctggatccagaagggagaagaaactgagaagcaaagctgggcaattgaccacgtgtacattggagaggcttgccccaagctctgcagcgggcacggatactgcacgaccggtgccatctgcatctgcgacgagagcttccaaggtgatgactgctctgttttcagtcacgaccttcccagttatattaaagataattttgagtccgcaagagtcaccgaggcaaactgggagaccattcaaggtggagtcataggaagtggctgtgggcagctggccccctacgcccatggagactcactgtactttaatggctgtcagatcaggcaagcagctaccaagcctctggatctcactcgagcaagcaaaatcatgtttgttttgcaaattgggagcatgtcgcagacggacagctgcaacagtgacctgagtggcccccacgctgtggacaaggcagtgctgctgcaatacagcgtcaacaacgggatcacctggcatgtcatcgcccagcaccagccaaaggacttcacacaagctcagagagtgtcttacaatgtccccctggaggcacggatgaaaggagtcttactgcgctggtggcaaccacgccacaatggaacaggtcatgatcaatgggctttggaccatgtggaggtcgtcctagtaagcactcgcaaacaaaattacatgatgaatttttcacgacaacatgggctcagacatttctacaacagaagacgaaggtcacttaggcgatacccatgaagaatcaaaaagtttattttttttcttccaacatgtgatgtgttgctctccattcttttaaatctcgcactacatctgatatcaggaaatatctgtgaaggacttggtgattacctgaaagcccttctcaagaccgagtgtacaccactttcccacactgtgaactaatgacaagtgacttatttgctcataagtaaatgtcttcatgttgatgtgtccgtgaaagttgtgatctgttgtaatatcagttacagtggcagtattgacaataagaaacagtttaacagaaaaatgaaatttaagcacaaaaaatttaagagattttatgtttaaaatggcatttagcacagtatttaacattcttggtcacaaagctatttaagtggactgtatttcagctatgtctcatgttttatatgattaaattatcattgtttgtcctttatgtattctcttctacaatacaacacattgaaactgtatttacttgttatgttgtaatattttgctgctgaatttggggctacttatattctgcagaaaattaattgaaatacctattcaagaagatagttgtaaagatattgtatctcctttaatatactccttaaaaatgtatgttggtttagcgttgttttgtggataagaaaaatgcttgaccctgaaatattttctactttaaattgtggatgaagaccctatctcccacaaataagttcccatttccttgtctaaagatctttttttaagtgttctgtggctgatttactaacagtaactgccattttttgtctgtgataacagagtgatttgtaaaacagtggttgttttttcattgtgttttcttcgtggattgttttttctgcgggtcatattcataccttctgatgaagttgtacaacaccagcaacattataatggccctgtagctctgaatgctatttgtgtaactgaaaggttgcactctagggtgaaccaagctataaaagcccatgcttaaataaaaattatgtccaaaagcca

SEQ ID NO: 23900 - DNA, 2268 bp, Homo sapiens
tccaattttcctcaagagaataatatgccatattgcttccaattttccttaacagaaggcacttcccatgaagaaaactggagtttttaccctaatgctgtaaggacagcaggattttgtggcaatccatcctttcacctctattggccaaataaaaagaaggacaagactcacaatgctctctcctcccgagaactcattatacagccaggatacatgatgcagtttaaaattgtggtgggttgtgaagccacttcttgtggtgaccttcattccgtaatgctggaatacactaaggatgcaagatcggattcctggcagctcgtacagacccagtgccttccttcctcttctaacagcattggctgctcccctttccagttccatgaagccaccatctacaactctgtcaacagctcaagctggaaaagaatcaccatccagctgcctgaccatgtctcctctagtgcaacacagttccgctggatccagaagggagaagaaactgagaagcaaagctgggcaattgaccacgtgtacattggagaggcttgccccaagctctgcagcgggcacggatactgcacgaccggtgccatctgcatctgcgacgagagcttccaaggtgatgactgctctgttttcagtcacgaccttcccagttatattaaagataattttgagtccgcaagagtcaccgaggcaaactgggagaccattcaaggtggagtcataggaagtggctgtgggcagctggccccctacgcccatggagactcactgtactttaatggctgtcagatcaggcaagcagctaccaagcctctggatctcactcgagcaagcaaaatcatgtttgttttgcaaattgggagcatgtcgcagacggacagctgcaacagtgacctgagtggcccccacgctgtggacaaggcagtgctgctgcaatacagcgtcaacaacgggatcacctggcatgtcatcgcccagcaccagccaaaggacttcacacaagctcagagagtgtcttacaatgtccccctggaggcacggatgaaaggagtcttactgcgctggtggcaaccacgccacaatggaacaggtcatgatcaatgggctttggaccatgtggaggtcgtcctagtaagcactcgcaaacaaaattacatgatgaatttttcacgacaacatgggctcagacatttctacaacagaagacgaaggtcacttaggcgatacccatgaagaatcaaaaagtttattttttttcttccaacatgtgatgtgttgctctccattcttttaaatctcgcactacatctgatatcaggaaatatctgtgaaggacttggtgattacctgaaagcccttctcaagaccgagtgtacaccactttcccacactgtgaactaatgacaagtgacttatttgctcataagtaaatgtcttcatgttgatgtgtccgtgaaagttgtgatctgttgtaatatcagttacagtggcagtattgacaataagaaacagtttaacagaaaaatgaaatttaagcacaaaaaatttaagagattttatgtttaaaatggcatttagcacagtatttaacattcttggtcacaaagctatttaagtggactgtatttcagctatgtctcatgttttatatgattaaattatcattgtttgtcctttatgtattctcttctacaatacaacacattgaaactgtatttacttgttatgttgtaatattttgctgctgaatttggggctacttatattctgcagaaaattaattgaaatacctattcaagaagatagttgtaaagatattgtatctcctttaatatactccttaaaaatgtatgttggtttagcgttgttttgtggataagaaaaatgcttgaccctgaaatattttctactttaaattgtggatgaagaccctatctcccacaaataagttcccatttccttgtctaaagatctttttttaagtgttctgtggctgatttactaacagtaactgccattttttgtctgtgataacagagtgatttgtaaaacagtggttgttttttcattgtgttttcttcgtggattgttttttctgcgggtcatattcataccttctgatgaagttgtacaacaccagcaacattataatggccctgtagctctgaatgctatttgtgtaactgaaaggttgcactctagggtgaaccaagctataaaagcccatgcttaaataaaaattatgtccaaaagcca

SEQ ID NO: 23901 - DNA, 11640 bp, Homo sapiens
  misc_feature (144)..(144): n is a, c, g, or t
cacgcgtgggctcggcgggggcccgctcccaggcccgctcccgagcccgttccgctcccgtccgccttcttctcgccttctctccgcgtggctcctccgtcccggcgtctccaaaactgaatgagcgagcggcgcgtagggcgncggcggcggcggcggcggcggcggcggcggcatggagcgcagtggctgggcccggcagactttcctcctagcgctgttgctgggggcgacgctgagggcgcgcgcggcggctggctattacccccgcttttcgcccttctttttcctgtgcacccaccacggggagctggaaggggatggggagcagggcgaggtgctcatttccctgcatattgcgggcaaccccacctactacgttccgggacaagaataccatgtgacaatttcaacaagcaccttttttgacggcttgctggtgacaggactatacacatctacaagtgttcaggcatcacagagcattggaggttccagtgctttcggatttgggatcatgtctgaccaccagtttggtaaccagtttatgtgcagtgtggtagcctctcacgtgagtcacctgcccacaaccaacctcagtttcatctggattgctccacctgcgggcacaggctgtgtgaatttcatggctacagcaacacaccggggccaggttattttcaaagatgctttagcccagcagttgtgtgaacaaggagctccaacagatgtcactgtgcacccacatctagctgaaatacatagtgacagcattatcctgagagatgactttgactcctaccaccaactgcaattaaatccaaatatatgggttgaatgtaacaactgtgagactggagaacagtgtggcgcgattatgcatggcaatgccgtcaccttctgtgaaccatatggcccacgagaactgattaccacaggccttaatacaacaacagcttctgtcctccaattttccattgggtcaggttcatgtcgctttagttattcagaccccagcatcatcgtgttatatgccaagaataactctgcggactggattcagctagagaaaattagagccccttccaatgtcagcacaatcatccatatcctctaccttcctgaggacgccaaaggggagaatgtccaatttcagtggaagcaggaaaatcttcgtgtaggtgaagtgtatgaagcctgctgggccttagataacatcttgatcatcaattcagctcacagacaagtcgttttagaagatagtctcgacccagtggacacaggcaactggcttttcttcccaggagctacagttaagcatagctgtcagtcagatgggaactccatttatttccatggaaatgaaggcagcgagttcaattttgccaccaccagggatgtagatctttccacagaagatattcaagagcaatggtcagaagaatttgagagccagcctacaggatgggatgtcttgggagctgtcattggtacagaatgtggaacgatagaatcaggcttatcaatggtcttcctcaaagatggagagaggaaattatgcactccatccatggacactaccggttatgggaacctgaggttttactttgtgatgggaggaatttgtgaccctggaaattctcatgaaaatgacataatcctgtatgcaaaaattgaaggaagaaaagagcatataacactggataccctttcctattcctcatataaggttccgtctttggtttctgtggtcatcaatcctgaacttcagactcctgctaccaaattttgtctcaggcaaaagaaccatcaaggacataataggaatgtctgggctgtagactttttccatgtcttgcctgttctcccttctacaatgtctcacatgatacagttttccatcaatctgggatgtggaacgcatcagcctggtaacagtgtcagcttggaattttctaccaaccatgggcgctcctggtccctccttcacactgaatgcttacctgagatctgtgctggaccccacctcccccacagcactgtctactcctctgaaaactacagtgggtggaaccgaataacaattccccttcctaacgcagcactaacccggaacaccaggattcgctggagacaaacaggaccaatccttggaaacatgtgggcaattgataatgtttatattggcccgtcatgtctcaaattctgttctggcagaggacagtgcactagacatggttgcaagtgtgaccctggattttctggcccagcttgtgagatggcatcccagacattcccaatgtttatttctgaaagctttggcagttccaggctctcctcttaccataacttttactctatccgtggtgctgaagtcagctttggttgtggtgtcttggccagtggtaaggccctggttttcaacaaagaagggcggcgtcagctaattacatctttccttgacagctcacaatccaggtttctccagttcacactgagactggggagcaaatctgttctgagcacgtgcagagcccctgatcagcctggtgaaggagttttgctgcattattcttatgataatgggataacttggaaactcctggagcattattcatatctcagctatcatgagcccagaataatctccgtagaactaccaggtgatgcaaagcagtttggaattcagttcagatggtggcaaccgtatcattcttcccagagagaagatgtatgggctattgatgagattatcatgacatctgtgcttttcaacagcattagtcttgactttaccaatcttgtggaggtcactcagtctctgggattctaccttggaaatgttcagccatactgtggccacgactggaccctttgttttacaggagattctaaacttgcctcaagtatgcgctatgtggaaacacaatcaatgcagataggagcatcctatatgattcagttcagtttggtgatgggatgtggccagaaatacaccccacacatggacaaccaggtgaagctggagtactcaaccaaccacggccttacctggcacctcgtccaagaagaatgccttccaagtatgccaagttgtcaggaatttacatcagcaagtatttaccatgccagtgagtttacacagtggaggagagtcatagtgcttcttccccagaaaacttggtccagtgctacccgtttccgctggagccagagctattacacagctcaagacgagtgggctttggacagcatttacattgggcagcagtgccccaacatgtgcagtgggcatggctcatgcgatcatggcatatgcaggtgtgaccaggggtaccaaggcactgaatgccacccagaagctgcccttccgtccacaattatgtcagattttgagaaccagaatggctgggagtctgactggcaagaagttattgggggagaaattgtaaaaccagaacaagggtgtggtgtcatctcttctggatcatctctgtacttcagcaaggctgggaaaagacagctggtgagttgggacctggatacttcttgggtggactttgtccagttctacatccagataggcggagagagtgcttcatgcaacaagcctgacagcagagaggagggcgtcctccttcagtacagcaacaatgggggcatccagtggcacctgctagcagagatgtacttttcagacttcagcaaacccagatttgtctatctggagcttccagctgctgccaagaccccttgcaccaggttccgctggtggcagcccgtgttctcaggggaggactatgaccagtgggcagtcgatgacatcatcattctgtccgagaagcagaagcagatcatcccagttatcaatccaactttacctcagaacttttatgagaagccagcttttgattaccctatgaatcagatgagtgtgtggttgatgttggctaatgaaggaatggttaaaaatgaaaccttctgtgctgccacaccatcagcaatgatatttggaaaatcagatggagatcgatttgcagtaactcgagatttgaccctgaaacctggatatgtgctacagttcaagctaaacataggttgtgccaatcaattcagcagtactgctccagttcttcttcagtactctcatgatgctggtatgtcctggtttctggtgaaagaaggctgttacccggcttctgcaggcaaaggatgcgaaggaaactccagagaactaagtgagcccaccatgtatcacacaggggactttgaagaatggacaagaatcaccattgttattccaaggtctcttgcatccagcaagaccagattccgatggatccaggagagcagctcacagaaaaacgtgcctccatttggtttagatggagtgtacatatccgagccttgtcccagttactgcagtggccatggggactgcatttcaggagtgtgtttctgtgacctgggatatactgctgcacaaggaacctgtgtgtcaaatgtccccaatcacaatgagatgttcgataggtttgaggggaagctcagccctctgtggtacaagataacaggtgcccaggttggaactggctgtggaacacttaacgatggcaaatctctctacttcaatggccctgggaaaagggaagcccggacggtccctctggacaccaggaatatcagacttgttcaattttatatacaaattggaagcaaaacttcaggcattacctgcatcaaaccaagaactagaaatgaagggcttattgttcagtattcaaatgacaatgggatactctggcatttgcttcgagagttggacttcatgtccttcctggaaccacagatcatttccattgacctgccacaggacgcgaagacacctgcaacggcatttcgatggtggcaaccgcaacatgggaagcattcagcccagtgggctttggatgatgttcttataggaatgaatgacagctctcaaactggatttcaagacaaatttgatggctctatagatttgcaagccaactggtatcgaatccaaggaggtcaagttgatattgactgtctctctatggatactgctctgatattcactgaaaacataggaaaacctcgttatgctgagacctgggattttcatgtgtcagcatctacctttttgcagtttgaaatgagcatgggctgtagcaagcccttcagcaactcccacagtgtacagctccagtattctctgaacaatggcaaggactggcatcttgtcaccgaagagtgtgttcctccaaccattggctgtctgcattacacggaaagttcaatttacacctcggaaagattccagaattggaagcggatcactgtctaccttccactctccaccatttctcccaggacccggttcagatggattcaggccaactacactgtgggggctgattcctgggcgattgataatgttgtactggcctcagggtgcccttggatgtgctcaggacgagggatttgtgatgctggacgctgtgtgtgtgaccggggctttggtggaccctattgtgttcctgttgttcctctgccctcgattcttaaagacgatttcaatgggaatttacatcctgacctttggcctgaagtgtatggtgcagagagggggaatctgaatggtgaaaccatcaaatctggaacatctctaatttttaaaggggaaggactaaggatgcttatttcaagagatctagattgtacaaatacaatgtatgtccagttttcacttagatttatagcaaaaagtaccccagagagatctcactctattctgttacaattctccatcagtggaggaatcacttggcacctgatggatgaattttactttcctcaaacaacgaatatacttttcatcaatgttcccttgccatacactgcccaaaccaatgctacaagattcagactctggcaaccttataataacggtaagaaagaagaaatctggattgttgatgacttcattatcgatggaaataatgtaaacaaccctgtgatgctcttggatacatttgattttgggcccagagaagacaattggtttttctatcctggtggtaacatcggtctttattgtccatattcttcaaagggggcacctgaagaagattcagctatggtgtttgtttcaaatgaagttggtgagcattccattaccacccgtgacctaaatgtgaatgagaacaccatcatacaatttgagatcaacgttggctgttcgactgatagctcatccgcggatccagtgagactggaattttcaagggacttcggggcgacctggcaccttctgctgcccctctgctaccacagcagcagccacgtcagctctttatgctccaccgagcaccaccccagcagcacctactacgcaggaaccatgcagggctggaggagggaggtcgtgcactttgggaagctgcacctttgtggatctgtccgtttcagatggtaccagggattttaccctgccggctctcagccagtgacatgggccattgataatgtctacatcggtccccagtgtgaggagatgtgtaatggacaggggagctgtatcaatggaaccaaatgtatatgtgaccctggctactcaggtccaacctgtaaaataagcaccaaaaatcctgattttctcaaagatgatttcgaaggtcagctagaatctgatagattcttattaatgagtggtgggaaaccatctcgaaagtgtggaatcctttctagtggaaacaacctctttttcaatgaagatggcttgcgcatgttgatgacacgagacctggatttatcacatgctagatttgtgcagttcttcatgagactgggatgtggtaaaggcgttcctgaccccaggagtcaacccgtgctcctacagtattctctcaacggtggcctctcgtggagtcttcttcaggagttccttttcagcaattccagcaatgtgggcaggtacattgccctggagatacccttgaaagcccgttctggttctactcgccttcgctggtggcaaccgtctgagaatgggcacttctacagcccctgggttatcgatcagattcttattggaggaaatatttctggtaatacggtcttggaagatgatttcacaacccttgatagtaggaaatggctgcttcacccaggaggcaccaagatgcccgtgtgtggctctactggtgatgccctggtcttcattgaaaaggccagcacccgttacgtggtcagcacagacgttgccgtgaatgaggattccttcctacagatagacttcgctgcctcctgctcagtcacagactcttgttatgcgattgaattggaatactcagtagatcttggattgtcatggcacccattggtaagggactgtctgcctaccaatgtggaatgcagtcgctatcatctgcaacggatcctggtgtcagacactttcaacaagtggactagaatcactctgcctctccctccttataccaggtcccaagccactcgtttccgttggcatcaaccagctccttttgacaagcagcagacatgggcaatagataatgtctatatcggggatggctgcatagacatgtgcagtggccatgggagatgcatccagggaaactgcgtctgtgatgaacagtggggtggcctgtactgtgatgaccccgagacctctcttccaacccaactcaaagacaacttcaatcgagctccatccagtcagaactggctgactgtgaacggagggaaattgagtacagtgtgtggagccgtggcgtcgggaatggctctccatttcagtgggggttgtagtcgattattagtcactgtggatctaaacctcactaatgctgagttcatccaattttacttcatgtatgggtgcctgattacaccaaacaaccgtaaccaaggtgttctcttggaatattctgtcaatggaggcattacctggaacctgctcatggagattttctatgaccagtacagtaagcccggatttgtgaatatccttctccctcctgatgctaaagagattgccactcgcttccgctggtggcagccaagacatgacggcctggatcagaacgactgggccattgacaatgtcctcatctcaggctctgctgaccaaaggaccgttatgctggacaccttcagcagcgccccagtaccccagcacgagcgctcccctgcagatgccggccctgtcgggaggatcgcctttgacatgtttatggaagacaaaacttcagtgaatgagcactggctattccatgatgattgtacagtagaaagattctgtgactcccctgatggtgtgatgctctgtggcagtcatgatggacgggaggtgtatgcagtgacccatgacctgactcccactgaaggctggattatgcaattcaagatctcagttggatgtaaggtgtctgaaaaaattgcccagaatcaaattcatgtgcagtattctactgacttcggtgtgagttggaattatctggtccctcagtgcttgcctgctgacccaaaatgctctggaagtgtttctcagccatctgtattctttccaactaaagggtggaaaaggatcacctacccacttcctgaaagcttagtgggaaatccggtaaggtttaggttctatcagaagtactcagacatgcagtgggcaatcgataatttctacctgggccctggatgcttggacaactgcaggggccatggagattgcttaagggaacagtgcatctgtgatccgggatactcagggccaaactgctacttgacccacactctgaagactttcctgaaggaacgctttgacagtgaagaaatcaaacctgacttatggatgtccttagaaggtggaagtacttgcactgagtgtggaattcttgccgaggacactgcactctattttgggggatccactgtgagacaagcggttacacaagatttggatcttcgaggtgcaaagttcctgcaatactgggggcgcatcggtagtgagaacaacatgacctcttgccatcgtcccatctgccggaaggaaggcgtgctgttggactactctaccgatggaggaattacctggactttgctccatgagatggattaccagaaatacatttctgttagacacgactacatacttcttcctgaagatgccctcaccaacacaactcgacttcgctggtggcagccttttgtgatcagcaatggaattgtggtctctggggtggagcgtgctcagtgggcactggacaacattttgattggtggagcagaaatcaatcccagccaattggtggacacttttgatgatgaaggcacttcccatgaagaaaactggagtttttaccctaatgctgtaaggacagcaggattttgtggcaatccatcctttcacctctattggccaaataaaaagaaggacaagactcacaatgctctctcctcccgagaactcattatacagccaggatacatgatgcagtttaaaattgtggtgggttgtgaagccacttcttgtggtgaccttcattccgtaatgctggaatacactaaggatgcaagatcggattcctggcagctcgtacagacccagtgccttccttcctcttctaacagcattggctgctcccctttccagttccatgaagccaccatctacaactctgtcaacagctcaagctggaaaagaatcaccatccagctgcctgaccatgtctcctctagtgcaacacagttccgctggatccagaagggagaagaaactgagaagcaaagctgggcaattgaccacgtgtacattggagaggcttgccccaagctctgcagcgggcacggatactgcacgaccggtgccatctgcatctgcgacgagagcttccaaggtgatgactgctctgttttcagtcacgaccttcccagttatattaaagataattttgagtccgcaagagtcaccgaggcaaactgggagaccattcaaggtggagtcataggaagtggctgtgggcagctggccccctacgcccatggagactcactgtactttaatggctgtcagatcaggcaagcagctaccaagcctctggatctcactcgagcaagcaaaatcatgtttgttttgcaaattgggagcatgtcgcagacggacagctgcaacagtgacctgagtggcccccacgctgtggacaaggcagtgctgctgcaatacagcgtcaacaacgggatcacctggcatgtcatcgcccagcaccagccaaaggacttcacacaagctcagagagtgtcttacaatgtccccctggaggcacggatgaaaggagtcttactgcgctggtggcaaccacgccacaatggaacaggtcatgatcaatgggctttggaccatgtggaggtcgtcctagtaagcactcgcaaacaaaattacatgatgaatttttcacgacaacatgggctcagacatttctacaacagaagacgaaggtcacttaggcgatacccatgaagaatcaaaaagtttattttttttcttccaacatgtgatgtgttgctctccattcttttaaatctcgcactacatctgatatcaggaaatatctgtgaaggacttggtgattacctgaaagcccttctcaagaccgagtgtacaccactttcccacactgtgaactaatgacaagtgacttatttgctcataagtaaatgtcttcatgttgatgtgtccgtgaaagttgtgatctgttgtaatatcagttacagtggcagtattgacaataagaaacagtttaacagaaaaatgaaatttaagcacaaaaaatttaagagattttatgtttaaaatggcatttagcacagtatttaacattcttggtcacaaagctatttaagtggactgtatttcagctatgtctcatgttttatatgattaaattatcattgtttgtcctttatgtattctcttctacaatacaacacattgaaactgtatttacttgttatgttgtaatattttgctgctgaatttggggctacttatattctgcagaaaattaattgaaatacctattcaagaagatagttgtaaagatattgtatctcctttaatatactccttaaaaatgtatgttggtttagcgttgttttgtggataagaaaaatgcttgaccctgaaatattttctactttaaattgtggatgaagaccctatctcccacaaataagttcccatttccttgtctaaagatctttttttaagtgttctgtggctgatttactaacagtaactgccattttttgtctgtgataacagagtgatttgtaaaacagtggttgttttttcattgtgttttcttcgtggattgttttttctgcgggtcatattcataccttctgatgaagttgtacaacaccagcaacattataatggccctgtagctctgaatgctatttgtgtaactgaaaggttgcactctagggtgaaccaagctataaaagcccatgcttaaataaaaattatgtccaaaagccaaccgtggactagtagccaccgtggactagtagccacgtggactagtagctaaccgtgac

SEQ ID NO: 23902 - DNA, 536 bp, Homo sapiens
ctggctgggtttggacctgggaggcataaaggtccagagatgccagaagcccttctgccaccacatagagccaaaatgaatgaagcagactggagatgaggagagagatcaaaccctgaagacccgtttgaaacttgggaccaagtaatgcttgggggcagtcggctctgggatgtctcagttactgggacaagtggctccctcttttgcctttaagcagtttcaagtggtttctacaacttgccactaaacagaaattcacaaaactctcctgacaaagaattttttcacttaagccagctcaagtgagtttctctcacttgtactcaaaagaatgccaaattaccagcctggtcaacatgatgaaatcctgtctctattaaaaatacaaaaattagccggacacggtggagtgtgcctgtagtcccaactacttgggaggctgaggcagaagaattgcttgaacctgggaggcagaggttgcagtgagcagagatcattcccccgggcaacagagtgaaactctgtctcaaaaa

SEQ ID NO: 23903 - DNA, 387 bp, Homo sapiens
gtgaaaacaggactttttgtgtattgtcacactcgaatgaagaagagctcctatacaactgccttttattgaattgaagacaccctcgattgaaaaatgtaccattattttttatacgactaagaaaggggagaaaaactactggttgagctaagataaaatgtttttttattacattaattatttcagacaggttataatatgaaaaagtgcacagtttagaatcaatgagccaggtatggtggtgtgcggtggtaatctggtggtaatgccagctgagatgggaggattacatgaccccaggaattcaggacaagcctgggcaacatagcaagattctcatctcagtttttaaaaataataaataaataaataaataaataaata

SEQ ID NO: 23904 - DNA, 801 bp, Homo sapiens
tcctgaaagcaccttgatagccttgagggcccagctctcctctgggcagtccatgaacgcatagccagtcttcaccaggaaggatcccaacactgggatcttggcgtccttgaagatactttctaggtccaaggggacggcgttctcgtggaggtttccgatatacagtttgttcattgtgaagaatggttgtttaaaaaaattaacgagaagaacgagaaattaaaaccacccatggtgatggatggatccagctggttttgttgctctcatcttctcacctttaaaatacacaaacacagaaagaaccaagcacaagaacaaggagtgaaaaatcagatccgaggcttgtttttccttgtcctagatatgttttaaaagagaaagaaaagaaaaagcctagctacaacccaaatgcatcaaccagtcttcctaagtctcgcttttgaataattttcaaatgagatgtacacctaaattttaagagtgtttgagtttgtgtttgctttagtggtgctttatatctgtctgattgtaagcataatgttcatggaaagagacttttggtaggaatcaaactgggactcttacaatggcttaagtccatcagaatagttctgatgctacttaggagcatcagaactcctttctttgcctgatttttcaacttatttcttaattggaaccccataaagaacatgaatggtcttctgatatccttaatgtcttagagttatatcaatattttgcttaccagtaatctgtatgaaaataaagtttatttagtaaacaaaagttgct

SEQ ID NO: 23905 - DNA, 195 bp, Homo sapiens
cagatccctcccgtgacacgtggcaattatggaaactacaattcaaggtgagacttggttggggacacagccaaaccatatcacttgtacggagttagttactgatagacacactcacatatcttatttactcctctcagttatcccaaggggatatgtatactgtgactccctttttattgatgagaattgagg

SEQ ID NO: 23906 - DNA, 562 bp, Homo sapiens
tgctttcccgtgtggttaaaaggctccaatgacagtgcctgagagtgtgtggacactggcagcctgtgagagcaggggcgggtgggaacaggtctccaaaaggactgacggggcctaggagacaggagagggacaggtgcttgaacaagggctgggggccaagacgggggaaagagcttctcaaaggaagtggagccatgggctggactgagatcccatctccaccttctccagggcttccacacccaggaaggagagcccacgggttgaagcttcgtcacctgggaagcaggagagcccgagggttggacagctgagcatgggaagctctgaaaggggccgggtgagggcaggcgaggatcagagttcgcggatgacagctgccaggccagggcagctacagggagccggggtcctggtccaagccccagctgccctccccctggcctgctccaactcctgcaagagcgctctctgccttatttggcttggaagagaaaccgataaacactcccgtgctagtgctttcgacggtgggcggggccgggcagaggaagagagg

SEQ ID NO: 23907 - DNA, 332 bp, Homo sapiens
tgctttcccgtgtggttaaaaggctccaatgacagtgcctgagagtgtgtggacactggcagcctgtgagagcaggggcgggtgggaacaggtctccaaaaggactgacggggcctaggagacaggagagggacaggtgcttgaacaagggctgggggccaagacgggggaaagagcttctcaaaggaagtggagccatgggctggactgagatcccatctccaccttctccagggcttccacacccaggaaggagagcccacgggttgaagcttcgtcacctgggaagcaggagagcccgagggttggagtccatgacctgggggttcctg

SEQ ID NO: 23908 - DNA, 507 bp, Homo sapiens
cagagaaaactggttgagataaaattcacttagatgctctgtctgtaggataatgccccactttcctcatttcttcatgagagtgaggcttagcacccctaacctgagtctcagtaagaggaggaagaggcagcggaaatggaattgaaaaaaatatgatgccagagattacaggttgcagaaaatgagaaaaacacagaagcctcaatgtcctagaggctagctccatgaatcaatggattaggaaccgaaattagaatcaaaatacctgtactcaagttctaattttctgttctctaattggattagtcaagtcacctaaatttcctgggcctctgttttcttcatctgtaaaatagacataatgatagctatcttatagtattattgtggggatcaaattagattttgaatgtgaagtatagtgtgataatttaaaaatgggctttggagtctactaaatatgagtatgcttattaattgtgcgactgtagacagcctaaaact

SEQ ID NO: 23909 - DNA, 561 bp, Homo sapiens
caaaacaaaactactaatttatactcttttaaaactacaagttgcctgtgttatgtaggagagatataagattgtgaaattttccaaaaatacctgccacacccctaacagacaggagatgataagagtaaaagagagaattgggaggctttagaagccctattgtaatatttcttaaaacacattatttattgctaaatatatttagtgtgagccatgtaaaaattgccatttttggaggtcaaaaaccgttgaatatcagcaatttagtatggttcaatttatgtggtttctaatcaaatgtacaaagtacaataatttggtttcatacttgattttttatttcttaggctgagtcattaaaagttgatcagtgatatatggcaaaattatttaaagtgcttgaggaattggggagacttgctgcttatgtgatcagatatacaaaaataaagtttttcatttcattaaatatttgattaaaactgctaagtttgaaaatgtttaccaagaaatagttttcagaaattttgctaacttgataaaggcttttgagcaata

SEQ ID NO: 23910 - DNA, 2637 bp, Homo sapiens
tgagccagactggagtacccaaatcactgttcccacactaacgttagatgttatcaactttttagaaaggattactatattgagtcgtattggcttttgacttcatattaattagaatgtatttgaacaccggtgggggtaaactattcgtaatgcaattttgttgagtaatatttgaaagagattgctctctcaacaagaatgataaatcatctctgtttcaaaaataacccctgttgaagttgacaagagcaggaagggatgaagtttgccaggtaatctaataggtgcttccatatacattttctcatttatgcaccagaacaatgcttctaagtatctgttattctccatttttacaatttataaattgcccaaggtaatgtcaaatccagccctgcctcctcgggtaaactttctcctgtgtctggcagaaattcacacatttagcaccataggtaggtttcctctgttttccatttttatttttaaggttggaatttgggttctttggaactcaaatttcttgagtcattttatagatttttgctgcctagctggccagttaaaatagagaactaagaaatgtttcttctttcttcatagaaacagtttcgcttgcctcaattatatgcagagttatattgtccttcacgttgctcaggtagacccagtgtaagttacagctagaaagttagaaaaacagcagcactattttccctcacctttattagtatattatgccagagttaactcttatcatttttaatttcaagtacatatttttgaagtaaatcaattgtatatattaactattcaactgtctcttggtcagtccattataataaccctattttaatttttctttcctttttaatgcacccaaagtcttttatttacttttttaactacagccacactttgagcaggtatggaacacaatcattgattaatctaatatatacaatagggagaaccgtaactacagatttacagattgtggagctgcagcagtttttcagtaacatgttggaggaacaccagaggatcagagttcatgccaacttacagacaataaagaatgaaaatctgaaaaacaagaagctaagtgccaggatagctgcgtggctaaggagaaacacatagcttgtggctatctttcagcactcctcttgcatattataatgtagtttgttcacagttttgtcttccaatactttgtgagtctggaaaaccacacattttatttgtatttcagtcacatttattactcagagtgccattcttctcatattgtcatgtttggccctgagggtgggtgattgctgacaattttgccaatgctgctgtatttctgggaaagatgtcacttcatgttgggttataatcccacagaatttactttaaatgtcacgtaaaaacaaattcacctaagatagtcttgcttattttgttgcgaaggccagtggaatataaaagtcaatggcattaatgaggagcacattctttgctgagggaaataacagtttttccaggccctagggtttatttagttcaacattgaagattgaaaagactaatgagaagataacatgacaatataaaaagacagaaactcaaaaagtatattcactagaagacagtggagccaaagaaaagcaagttgaaaaagaaagaggagacaatttaacgagccctaaaggcaagaagtgtgtcttctcctgcccatttctctctcccacagtacatcctgcattgaaccacgtgttgctggttactaaactttatggtgtcacaaaaagacaaatgattgtaggatccatggaagtgcacttaggcttgctgtggtggaggccatagtggagatgaaggctctgctctgaagctcttaattgtgtattcaccagtgggatggacaccctttcagcctaagcgtacgagtgaaaacaatgatgtcaaaagacaatagcaagtataggctactatttagggcaaaaggaatcttgaaatgaaagaaacagaactaaaaggctaactggagcataatccttacagttttgcactcaggggattaagtttgaaacatagtgtcttttggccaaattgaacctacttgtaatgtggaccaacttactttacacattttcatcagtcccaatgtatggaattagcttagttttctcatgcttgattaaaacaagacaactaaagctaatcattcctcttctagactttgtgtatatgatttaatcttttatttttatttttgtagaatgggggtaaaactacaaatctcctcctcagggtgatatttttaaagattaaggagtatgacatcaattaacagtctttaaagatgttacatacgctcaaagcaatgtgattaagactttttgcctatttcttgtataagttaaggcagccataaatgaaaatacaaaacaaacgtttgcttttgtatttgattcacaagaggattctccctgagtgtcaggggaggctgtgggacttcaccacgtggacaaacgaaagcacaggctactcagacttggccacaggtcataggtcagagaattttttcttcaaatgtagaaatgtaaattttcagcaataaaatatctgcatgcctacaaagtg

SEQ ID NO: 23911 - DNA, 627 bp, Homo sapiens
caagaatatcactggaaaaactttttgtaactgcgtgttggttgggccttgaagactgccttcagctgtcaaaagaacttttcgcaaaatgggtggatcatccagaaaatgaaataccttatccaattaaagatgtggttttatgttatggcattgccttgggaagtgataaagagtgggacatcttgttaaatacttacactaatacaacaaacaaagaagaaaagattcaacttgcttatgcaatgagctgcagcaaagacccatggatacttaacagatatatggagtatgccatcagcacatctccattcacttctaatgaaacaaatataattgaggttgtggcttcatctgaagttggccggtatgtcgcaaaagacttcttagtcaacaactggcaagctgtgagtaaaagagcattcatgggcatatgtctcacagtgacatgcaggcaagctcacagacatcgtctccacaccaaggcacatgttggagttgagtacatcgccaatagcagtgcaggaaccgctgctcctttcagccaggcccagaattcttcctagaaagcctaatctggaaatacattttggaatattagattaaataaaacaacttttggcttgg

SEQ ID NO: 23912 - DNA, 814 bp, Homo sapiens
caagaatatcactggaaaaactttttgtaactgcgtgttggttgggccttgaagactgccttcagctgtcaaaagaacttttcgcaaaatgggtggatcatccagaaaatgaaataccttatccaattaaagatgtggttttatgttatggcattgccttgggaagtgataaagagtgggacatcttgttaaatacttacactaatacaacaaacaaagaagaaaagattcaacttgcttatgcaatgagctgcagcaaagacccatggatacttaacagatatatggagtatgccatcagcacatctccattcacttctaatgaaacaaatataattgaggttgtggcttcatctgaagttggccggtatgtcgcaaaagacttcttagtcaacaactggcaagctgtgagtaaaaggtatggaacacaatcattgattaatctaatatatacaatagggagaaccgtaactacagatttacagattgtggaggctgaatttttattaggcagtctttttccttgtggagagaagcatagctccccacttatataatcctcagcactctcagttgcagaaggaaggatactttctcacagcttcaagagttcctgccccgaaaaaaagcactttgattggtcctacttgggtcagatgtaccaatcactgtgtccagggaagatggaatactctaattggtctaaccagggtcctgtggccacactaggagacagccccacccaagtcactggcactgggaaggggaaggggtagttctggaaggaaaaagggctgtaaccagaaagtaaaca

SEQ ID NO: 23913 - DNA, 2167 bp, Homo sapiens
caagaatatcactggaaaaactttttgtaactgcgtgttggttgggccttgaagactgccttcagctgtcaaaagaacttttcgcaaaatgggtggatcatccagaaaatgaaataccttatccaattaaagatgtggttttatgttatggcattgccttgggaagtgataaagagtgggacatcttgttaaatacttacactaatacaacaaacaaagaagaaaagattcaacttgcttatgcaatgagctgcagcaaagacccatggatacttaacagatatatggagtatgccatcagcacatctccattcacttctaatgaaacaaatataattgaggttgtggcttcatctgaagttggccggtatgtcgcaaaagacttcttagtcaacaactggcaagctgtgagtaaaagtcttttatttacttttttaactacagccacactttgagcaggtatggaacacaatcattgattaatctaatatatacaatagggagaaccgtaactacagatttacagattgtggagctgcagcagtttttcagtaacatgttggaggaacaccagaggatcagagttcatgccaacttacagacaataaagaatgaaaatctgaaaaacaagaagctaagtgccaggatagctgcgtggctaaggagaaacacatagcttgtggctatctttcagcactcctcttgcatattataatgtagtttgttcacagttttgtcttccaatactttgtgagtctggaaaaccacacattttatttgtatttcagtcacatttattactcagagtgccattcttctcatattgtcatgtttggccctgagggtgggtgattgctgacaattttgccaatgctgctgtatttctgggaaagatgtcacttcatgttgggttataatcccacagaatttactttaaatgtcacgtaaaaacaaattcacctaagatagtcttgcttattttgttgcgaaggccagtggaatataaaagtcaatggcattaatgaggagcacattctttgctgagggaaataacagtttttccaggccctagggtttatttagttcaacattgaagattgaaaagactaatgagaagataacatgacaatataaaaagacagaaactcaaaaagtatattcactagaagacagtggagccaaagaaaagcaagttgaaaaagaaagaggagacaatttaacgagccctaaaggcaagaagtgtgtcttctcctgcccatttctctctcccacagtacatcctgcattgaaccacgtgttgctggttactaaactttatggtgtcacaaaaagacaaatgattgtaggatccatggaagtgcacttaggcttgctgtggtggaggccatagtggagatgaaggctctgctctgaagctcttaattgtgtattcaccagtgggatggacaccctttcagcctaagcgtacgagtgaaaacaatgatgtcaaaagacaatagcaagtataggctactatttagggcaaaaggaatcttgaaatgaaagaaacagaactaaaaggctaactggagcataatccttacagttttgcactcaggggattaagtttgaaacatagtgtcttttggccaaattgaacctacttgtaatgtggaccaacttactttacacattttcatcagtcccaatgtatggaattagcttagttttctcatgcttgattaaaacaagacaactaaagctaatcattcctcttctagactttgtgtatatgatttaatcttttatttttatttttgtagaatgggggtaaaactacaaatctcctcctcagggtgatatttttaaagattaaggagtatgacatcaattaacagtctttaaagatgttacatacgctcaaagcaatgtgattaagactttttgcctatttcttgtataagttaaggcagccataaatgaaaatacaaaacaaacgtttgcttttgtatttgattcacaagaggattctccctgagtgtcaggggaggctgtgggacttcaccacgtggacaaacgaaagcacaggctactcagacttggccacaggtcataggtcagagaattttttcttcaaatgtagaaatgtaaattttcagcaataaaatatctgcatgcctacaaagtg

SEQ ID NO: 23914 - DNA, 775 bp, Homo sapiens
ggaactcaaatttcttgagtcattttatagatttttgctgcctagctggccagttaaaatagagaactaagaaatgtttcttctttcttcatagaaacagtttcgcttgcctcaattatatgcagagttatattgtccttcacgttgctcaggtagacccagtgtaagttacagctagaaagttagaaaaacagcagcactattttccctcacctttattagtatattatgccagagttaactcttatcatttttaatttcaagtacatatttttgaagtaaatcaattgtatatattaactattcaactgtctcttggtcagtccattataataaccctattttaatttttctttcctttttaatgcacccaaagtcttttatttacttttttaactacagccacactttgagcaggtaagtgtctgctgttttttcatagcaatacttcacagctattttaagatttttttttttctagatattcagggacactaaactagaggggaagtttccatgaccacgcctattgaaacaagcacagggagagccatggtgctcagccttcagggtcaccaacatttagagaacatcagaagatattaatcttctctccaaaaagcacgcataaatacaacatttttaaatacacgttcagggggctttagtcagcagttctgaaatggatcctctatgaactactgttttttaaggggcataatttatatatttatttattcccttagaaattgtattgatttgagacttgtgacat

SEQ ID NO: 23915 - DNA, 626 bp, Homo sapiens
ttggctaccacatgggtgaaatttcccttacatactatgccccaaaagagctgtgaccaacctggtggttttatggcacaccagggaagcagtcttggtttggagaagaaacccaccatagagaggaagcacctgaggctgtgtgttaggactcttctcttaatgcttgccatccaaagacacactgaaatccacctctcagggttgaggtgagaacaacaagttcatatatatggcgcgctctggactgtgctgaacacggcagctgtccgacatgtgtcactactcttctttaggctctgaattgaagcgtgtcacttggtttcttcatgccttaatgtctccaacctgcaaaatcgaggcagcaaaccaaaagggcagcagatggcccagtttactgtggcggggaaagagtcatttcctgttgagcagggcacttctactactccctggcacatgcagccaacctgggggcaggtacggcagaacgtggggctcctcccagtgccagtatagcagctggcctgggcacctcgactcctatcgggaagtacccttccctactttgctgggggatcttcttttgagaccttcctcaaaagcattcataaccctaatccacaatt

SEQ ID NO: 23916 - DNA, 202 bp, Homo sapiens
atcacctgcgcccaagaattcaaggctgtagtgtcctatgctagtgcctgtgaatagccactgcactccagcctgggcaacatagtgagatctcatctcttaaaaaaaaaaaaatgctgggcgcggtggctcacgccccaaacccggttaatttgtttcctttgggggggaggggggttccccactttggcccagggaaaaa

SEQ ID NO: 23917 - DNA, 414 bp, Homo sapiens
tcttttcctagagttcatctgaatttctagctcaagcgcatttccacacaataggaggggttttagttttagttttggcacttcctgataaatgtggccaaattcagtgatttctcattatttcccttctatattcagcatcagggttctactcctgcctcctctccctccacatcccgtccttgatcttaatgctatggggccctggatctttggaaaggggcttccagacactgatgttgatctccctccggcctgttctggcatctgcttaacgtagcttggggacgtcagccttcacctttcaggcctgcctctctaccacttctcctctgctcctgccacatcgcatagctgctgaacgacatgctccacatttctctggagttcacctgaaagcaaggcacagatcct

SEQ ID NO: 23918 - DNA, 560 bp, Homo sapiens
atccatttatctcagctcaaagtgaagaattgtggataaggggccattattgtaagaaatgtgtaggctttgtcagttgtatgttaattttgttagcttttactactttttctcttaagatcagaagtgaagatcgtaacatgcaaaggttcttagcaatttgtctttgagggcagcatggaagtggaaacaaggactataaggtcttcaggagagaaactccaaataataggcaaaggccatcaaaataaggccacactgggcagggcatggtggcttaagcttgtaatcccagcactttgggaggccaaggcgggtggatcatcgaggtcaggagttcaagaccagcctggccaacatggtgaaccccgtctctactaaaaatacaaaaattagctgggcgtggtggtgggcgcctgtagtcccagctgcttgggaggctgaggcaggagaattgcctgaaaccgggaggtggaggttgcagtgagctgagatcgtgccactgcgctccagcctgggcaacaagagtaaaactctgtctgaaaaaactctatctcaaa

SEQ ID NO: 23919 - DNA, 317 bp, Homo sapiens
tccatgagtactttttaaagtgtatttcttgtacttagtttaataattatataatgtgttgcctttttttcttttaggaaaaaaagcttttataaagtatttatttattgatttattggttgactgagacagagtctggctctgtcgccctcgctggagtgtggtagtgcaatcttgattcaccgcaacctccgcatctggggcaggagaattgcctgaaaccgggaggtggaggttgcagtgagctgagatcgtgccactgcgctccagcctgggcaacaagagtaaaactctgtctgaaaaaactctatctcaaa

SEQ ID NO: 23920 - DNA, 448 bp, Homo sapiens
atggtttggggccagatggggaaagctgtgttatggggcttgtcagtttctgccagccaaggcttcagcatagctgactgtaacaaagttgggaaggccttgcttttgagagccagaccaggagtacctgtgactaacaaggggtctgggaggatctgctgctcccatgccctcctttgtgtgttttaaatctgtttgagccttctgggctcctgtgaattagggagtggcagctcctcagtctaactcctattgtgaccaggttgcctaattggccctttggtttgggcacccactgtccttctgcgtggttggatagatgctgctcccaatgtccctgatctcttacagacccctctgattcttcactcttggctttgagagcccctgatgccctgcagtcttgactgagcttctaatggttgatcagacccttgaatgttgagct

SEQ ID NO: 23921 - DNA, 715 bp, Homo sapiens
tatgtacatggacatctttctaaaatctaaagtgaattacatattctacaaacatagtataatcaatagaaccctgtctttccttgatgagcaagagtcttcagtgtgcatacatacactgattactgtaaaaggagtatgtttagggaccagtaaagagaataatgcttttagtctctccattaaatgagaatacactgttattttaaaattaagcccttctattcttttgttatcatgtcatatttctctttttcatctttgtcaatgtgtcctcctccatttaatctgctgcccaatatttctcatggttgtatctcttgctcttttaccacagaaaatgcttgggggttcatgtcagccttttattctctattaaaaaggccatttctgctttctttccatttagagtgactgaaattactgggagtctgggttttttctcggcgggggtgggggtatattgagtgttacagtattttccactgtgtaaaaaaataaggggaaaattttaacttgctgaaataaattacagatgtacacaaggagaaagaggcttgaacaccttaatattctcaacctcatagccatggagccccataagtgtattaaaaaccacgaggggctgtggattattcatttgttatctggaggtggggagtgaggaaaggattcagagctgccattaaatttttaataaaatcttcatccccca

SEQ ID NO: 23922 - DNA, 392 bp, Homo sapiens
acttttttcttaagaaattttattttctggaatctaaatatgcatgtcagcaccccaggtaagtctattattcttctattagtaattgtagtatgcatgttatgttagcacaatgaaaaggcaaggaagcaggtaaacatccttcattgaacatccctctttctcctctcatttccattcataatttttattcagaaaaattttcaaggaaccttaaccaaagaatgctaccaaggtgtgaatgaatgaatataatttgcagcaaacaatttatatgttattgttggtttctctactagcaaaagttttcaacttcatacttctttttctatcagtagagtctaaaccattgcaggtttaatgatgcatgtgatctcttacgtctgttttat

SEQ ID NO: 23923 - DNA, 353 bp, Homo sapiens
tttttgttttagacagagtctcactttgtcacccaggctggagtgcagtggtgtgatcttggcccactgcaacctctgcctcccgggttcaagcggttctcctgcctcagccttctgagtagctggggttacaggcacatgccaccatgcccagctaattttttgtatttttagcagagatgaggtttcccatgttgctccagctggtctcaaactcctgagctcaggcaatctgcccacctcagcctcccaaagtgctaggattacaggcataaaatagattttatatagaagtagacaacaacctagacattgataattatattattggactctgagttggtataacttgg

SEQ ID NO: 23924 - DNA, 476 bp, Homo sapiens
gactgtggaactgggggcagctggtccctggggtctctgaaagtaagtgtctccctcaactgctcaatgccaagggtgtctctgcctctgcttctctgtgtccctcatcttcctcccacttcattctgactggcaagccctgtcctgcacagcttcttcccccacccctaggccttccccagacactccctctaactaggctggctgttctgttcccttcccgctaacactgtggcctggcccacctcccaggaaataggaaaggtgcagaaatcaccctggagttgccactcctgccaggcttcatctcgagccaatgttcccaggtcactaagagaatgagcttccactgtattcccatccagggctctttccctttgtgaggctgacctgtggacaagacaatgggacagggataggcagttcctccatccattcataattgccaggcaagatcttctggcctcctgcacaaa

SEQ ID NO: 23925 - DNA, 488 bp, Homo sapiens
aaatttatgatttctcacatggtttgccaaacaaatagccattattgtaatactatataacttcacgtatgtagactctttcatacctggttcaattctgatccacagaaatcagaataaggaaattttttgagaccttgtcttagctctcattaggcagactctactatgtgcaaggaataaagggctatgcctggatttttgtggaataaagagatggtggttaatttaagcatcagatggttaaaggcctctatggaataatgctccccacgctcacagtgcttggaacagaactacagtgacaccacaggaggccctctgaatccgattatggctttaacattatttagggtctaaaactacgaatgcatttgttttgatttctcaagtttgacgtgttgaagctgtttcaggtagtaaataaaaacaggagctatagctcagggtcagtgcactggaggaaggaaaggaggaaataaaagaaa

SEQ ID NO: 23926 - DNA, 872 bp, Homo sapiens
gtttttttgagagtctcactcagtcacccagactggagtacagtgacatgatcttggcttactgcaacctccaccccgccgggctcatatgaccctctcacctcagcctcctgagtagctgggacttcaggtgcattctaccatgcctgtctaatttttgtattgttttgtagagacagggttttgccatgttgccaagggtgagctgaagcaatctgccagtgttggtctcccaaagtgctacaattaccacacccggttttatgtgtatatttctatgtctatctgtttgtatattaaaatcataaattcatgctgatatgtccaattttgatacctgagagtttgttctttcttatgtgtaatccctcatttgacaccaagaaactgactctcattagccacaatatgttacttatttgctcaattttggaatacatttaaaggagttttagaattgttcacccctgccactcctaatttagtaaccagagtacaacatgtatttgcagctcttttattctttagcctgagacttggagtatgtagtcaaaatactgtgttccaaagttacttaggttagttcctccccaaactccttctctcccaccttcagtgtgattatgttattatttttgaaatacagttaagtttatttgtttctgtttgtattccattttgggtctcccatgtccttgttgattgattgatttcaccatgtgcaaaattaacatgtttctaaaaatcagaactaagggtgaggtatagtgtctaatgcctgtaatcccagcactttggtaggccaaagaggattgcctgagcccaggagttcaagaccagcctgggtaacatattgggaccccatctctata

SEQ ID NO: 23927 - DNA, 417 bp, Homo sapiens
ggacataaatagggaacataggataggagtcatttatcatcattaggatatatacaggtagaggtgtgtgtgtgtatattgtatgtatatatttttaacttatttgaaaggacataggctgagcatggtggcttacacctgtaatcctggcactttgagataccaaggtgggaggatctcttgagcccaggagtttgagaccagcttgggcaacatagtgagactccatctctatcaaaaaaaaaaaaaaaaaaaatttaaggtagctcggtgtggtggtgtgcacctatagtcccagctactcaggaggctgaggtgggagcgtcacttgggcccaggaagtcgaggctgcagtgagccatgtgtgtgccactgcactccagcctgggtgacagagcgagaccctgtctcaaatta

SEQ ID NO: 23928 - DNA, 3046 bp, Homo sapiens
cgcccgcggccgaggtggacggagcctcccggctcgctgctcccgccggcggagcgaggctgccctttcttcgcagcgtgatttattttcttctcctttttttctgaactcttcttccagggagaggctagtggtaacaggccgagctggatggatgggtatggggagaggggcaggacgttcagccctgggattctggccgaccctcgccttccttctctgcagcttccccgcagccacctccccgtgcaagatcctcaagtgcaactctgagttctggagcgccacgtcgggcagccacgccccagcctcagacgacacccccgagttctgtgcagccttgcgcagctacgccctgtgcacgcggcggacggcccgcacctgccggggtgacctggcctaccactcggccgtccatggcatagaggacctcatgagccagcacaactgctccaaggatggccccacctcgcagccacgcctgcgcacgctcccaccggccggagacagccaggagcgctcggacagccccgagatctgccattacgagaagagctttcacaagcactcggccacccccaactacacgcactgtggcctcttcggggacccacacctcaggactttcaccgaccgcttccagacctgcaaggtgcagggcgcctggccgctcatcgacaataattacctgaacgtgcaggtcaccaacacgcctgtgctgcccggctcagcggccactgccaccagcaagctcaccatcatcttcaagaacttccaggagtgtgtggaccagaaggtgtaccaggctgagatggacgagctcccggccgccttcgtggatggctctaagaacggtggggacaagcacggggccaacagcctgaagatcactgagaaggtgtcaggccagcacgtggagatccaggccaagtacatcggcaccaccatcgtggtgcgccaggtgggccgctacctgacctttgccgtccgcatgccagaggaagtggtcaatgctgtggaggactgggacagccagggtctctacctctgcctgcggggctgccccctcaaccagcagatcgacttccaggccttccacaccaatgctgagggcaccggtgcccgcaggctggcagccgccagccctgcacccacagcccccgagaccttcccatacgagacagccgtggccaagtgcaaggagaagctgccggtggaggacctgtactaccaggcctgcgtcttcgacctcctcaccacgggcgacgtgaacttcacactggccgcctactacgcgttggaggatgtcaagatgctccactccaacaaagacaaactgcacctgtatgagaggactcgggacctgccaggcagggcggctgcggggctgcccctggccccccggcccctcctgggcgccctcgtcccgctcctggccctgctccctgtgttctgctagacgcgtagatgtggagggaggcgcgggctccgtcctctcggcttccccatgtgtgggctgggaccgcccacggggtgcagatctcctggcgtgtccaccatggccccgcagaacgccagggaccgcctgctgccaagggctcaggcatggacccctccccttctagtgcacgtgacaaggttgtggtgactggtgccgtgatgtttgacagtagagctgtgtgagagggagagcagctcccctcgccccgcccctgcagtgtgaatgtgtgaaacatcccctcaggctgaagccccccacccccaccagagacacactgggaaccgtcagagtcagctccttccccctcgcaatgcactgaaaggcccggccgactgctgctcgccgatccgtggggccccctgtgcccgccacacgcacgcacacactcttacacgagagcacactcgatccccctaggccagcggggacaccccagccacacagggaggcatccttggggcttggccccaggcagggcaaccccggggcgctgcttggcaccttagcagactgctggaaccttttggccagtaggtcgtgcccgcctggtgccttctggcctgtggcctccctgcccatgttcacctggctgctgtgggtaccagtgcaggtcccggttttcaggcacctgctcagctgcccgtctctggcctgggcccctgccccttccaccctgtgcttagaaagtcgaagtgcttggttctaaatgtctaaacagagaagagatccttgacttctgttcctctccctcctgcagatgcaagagctcctgggcaggggtgcctgggccccagggtgtggcaggagacccagtggatggggccagctggcctgccctgatcctctgcttcctcctcacaaccccaagagcccccagcccggtccatccacgtctggagtctggggagaggagcagggtcttaggactctcagctctgagcatccctggcagggtcttcaacctctaatctcttcccttaagccctgtggccacacagccaggagagacttgccgctggctcccgcctcatttcagcccagggtgctcatccaggggcccagaacagtcccacctgtgctgctatgcccacagcacaaagccaggcttcactcccaaaagtgcagccaggccctggagggtgatcctgccagcagccctacagctccacaccctacccacccatcggcagcccctctgctgttccccagggacctctcatacactggccaggaggctgcagaacgtgtgtctccccctccctccaagaggtcctgctccctctgccagaaccgtgtgtgggcgggtgggagggcgctcggggcccggcccctccctctccctgctggttttagttggtccctatgttggaagtaaaaagtgaagcactttattttggttgtgtttgctcacgttctgcttggaagtggggacccctcactgcgtccacgtgtctgcgacctgtgtggagtgtcaccgcgtgtacatactgtaaattatttattaatggctaaatgcaagtaaagtttggtttttttgttatttgt

SEQ ID NO: 23929 - DNA, 396 bp, Homo sapiens
ccaggaggccagtggagccgatggagaaggtggcagtggtaaccaggtgctcactcagggccaggcgttgctgggcttccggcgccccaatgctcagctccacaccctacccacccatcggcagcccctctgctgttccccagggacctctcatacactggccaggaggctgcagaacgtgctccctctccctgctggttttagttggtccctatgttggaagtaaaaagtgaagcactttattttggttgtgtttgctcacgttctgcttggaagtggggacccctcactgcgtccacgtgtctgcgacctgtgtggagtgtcaccgcgtgtacatactgtaaattatttattaatggctaaatgcaagtaaagtttggtttttttgttatttgt

SEQ ID NO: 23930 - DNA, 2425 bp, Homo sapiens
cgcccgcggccgaggtggacggagcctcccggctcgctgctcccgccggcggagcgaggctgccctttcttcgcagcgtgatttattttcttctcctttttttctgaactcttcttccagggagaggctagtggtaacaggccgagctggatggatgggtatggggagaggggcaggacgttcagccctgggattctggccgaccctcgccttccttctctgcagcttccccgcagccacctccccgtgcaagatcctcaagtgcaactctgagttctggagcgccacgtcgggcagccacgccccagcctcagacgacacccccgagttctgtgcagccttgcgcagctacgccctgtgcacgcggcggacggcccgcacctgccggggtgacctggcctaccactcggccgtccatggcatagaggacctcatgagccagcacaactgctccaaggatggccccacctcgcagccacgcctgcgcacgctcccaccggccggagacagccaggagcgctcggacagccccgagatctgccattacgagaagagctttcacaagcactcggccacccccaactacacgcactgtggcctcttcggggacccacacctcaggactttcaccgaccgcttccagacctgcaaggtgcagggcgcctggccgctcatcgacaataattacctgaacgtgcaggtcaccaacacgcctgtgctgcccggctcagcggccactgccaccagcaagctcaccatcatcttcaagaacttccaggagtgtgtggaccagaaggtgtaccaggctgagatggacgagctcccggccgccttcgtggatggctctaagaacggtggggacaagcacggggccaacagcctgaagatcactgagaaggtgtcaggccagcacgtggagatccaggccaagtacatcggcaccaccatcgtggtgcgccaggtgggccgctacctgacctttgccgtccgcatgccagaggaagtggtcaatgctgtggaggactgggacagccagggtctctacctctgcctgcggggctgccccctcaaccagcagatcgacttccaggccttccacaccaatgctgagggcaccggtgcccgcaggctggcagccgccagccctgcacccacagcccccgagaccttcccatacgagacagccgtggccaagtgcaaggagaagctgccggtggaggacctgtactaccaggcctgcgtcttcgacctcctcaccacgggcgacgtgaacttcacactggccgcctactacgcgttggaggatgtcaagatgctccactccaacaaagacaaactgcacctgtatgagaggactcgggacctgccaggcagggcggctgcggggctgcccctggccccccggcccctcctgggcgccctcgtcccgctcctggccctgctccctgtgttctgctagacgcgtagatgtggagggaggcgcgggctccgtcctctcggcttccccatgtgtgggctgggaccgcccacggggtgcagatctcctggcgtgtccaccatggccccgcagaacgccagggaccgcctgctgccaagggctcaggcatggacccctccccttctagtgcacgtgacaaggttgtggtgactggtgccgtgatgtttgacagtagagctgtgtgagagggagagcagctcccctcgccccgcccctgcagtgtgaatgtgtgaaacatcccctcaggctgaagccccccacccccaccagagacacactgggaaccgtcagagtcagctccttccccctcgcaatgcactgaaaggcccggccgactgctgctcgccgatccgtggggccccctgtgcccgccacacgcacgcacacactcttacacgagagcacactcgatccccctaggccagcggggacaccccagccacacagggaggcatccttggggcttggccccaggcagggcaaccccggggcgctgcttggcaccttagcagactgctggaaccttttggccagtaggtcgtgcccgcctggtgccttctggcctgtggcctccctgcccatgttccccagggacctctcatacactggccaggaggctgcagaacgtgtgtctccccctccctccaagaggtcctgctccctctgccagaaccgtgtgtgggcgggtgggagggcgctcggggcccggcccctccctctccctgctggttttagttggtccctatgttggaagtaaaaagtgaagcactttattttggttgtgtttgctcacgttctgcttggaagtggggacccctcactgcgtccacgtgtctgcgacctgtgtggagtgtcaccgcgtgtacatactgtaaattatttattaatggctaaatgcaagtaaagtttggtttttttgttatttgt

SEQ ID NO: 23931 - DNA, 1776 bp, Homo sapiens
cgcccgcggccgaggtggacggagcctcccggctcgctgctcccgccggcggagcgaggctgccctttcttcgcagcgtgatttattttcttctcctttttttctgaactcttcttccagggagaggctagtggtaacaggccgagctggatggatgggtatggggagaggggcaggacgttcagccctgggattctggccgaccctcgccttccttctctgcagcttccccgcagccacctccccgtgcaagatcctcaagtgcaactctgagttctggagcgccacgtcgggcagccacgccccagcctcagacgacacccccgagttctgtgcagccttgcgcagctacgccctgtgcacgcggcggacggcccgcacctgccggggtgacctggcctaccactcggccgtccatggcatagaggacctcatgagccagcacaactgctccaaggatggccccacctcgcagccacgcctgcgcacgctcccaccggccggagacagccaggagcgctcggacagccccgagatctgccattacgagaagagctttcacaagcactcggccacccccaactacacgcactgtggcctcttcggggacccacacctcaggactttcaccgaccgcttccagacctgcaaggtgcagggcgcctggccgctcatcgacaataattacctgaacgtgcaggtcaccaacacgcctgtgctgcccggctcagcggccactgccaccagcaagctcaccatcatcttcaagaacttccaggagtgtgtggaccagaaggtgtaccaggctgagatggacgagctcccggccgccttcgtggatggctctaagaacggtggggacaagcacggggccaacagcctgaagatcactgagaaggtgtcaggccagcacgtggagatccaggccaagtacatcggcaccaccatcgtggtgcgccaggtgggccgctacctgacctttgccgtccgcatgccagaggaagtggtcaatgctgtggaggactgggacagccagggtctctacctctgcctgcggggctgccccctcaaccagcagatcgacttccaggccttccacaccaatgctgagggcaccggtgcccgcaggctggcagccgccagccctgcacccacagcccccgagaccttcccatacgagacagccgtggccaagtgcaaggagaagctgccggtggaggacctgtactaccaggcctgcgtcttcgacctcctcaccacgggcgacgtgaacttcacactggccgcctactacgcgttggaggatgtcaagatgctccactccaacaaagacaaactgcacctgtatgagaggactcgggacctgccaggcagggcggctgcggggctgcccctggccccccggcccctcctgggcgccctcgtcccgctcctggccctgctccctgtgttctgctagacgcgtagatgtggagggaggcgcgggctccgtcctctcggcttccccatgtgtgggctgggaccgcccacggggtgcagatctcctggcgtgtccaccatgctccctctccctgctggttttagttggtccctatgttggaagtaaaaagtgaagcactttattttggttgtgtttgctcacgttctgcttggaagtggggacccctcactgcgtccacgtgtctgcgacctgtgtggagtgtcaccgcgtgtacatactgtaaattatttattaatggctaaatgcaagtaaagtttggtttttttgttatttgt

SEQ ID NO: 23932 - DNA, 3202 bp, Homo sapiens
cgagcgctggctgcgccgcccgagccgctgggccggggaagcactggccgttcgctcccgggccggctccgccaggcgctcgcaggcatgcagcccgggagcaggaggcgctccccgggccgctgctgagccggccggggcggcggggaccagcgccagcggagcccctcccaccttgccccggggcagacgagcggcgccccgacaccccctcttctcccgcagccccgccagcgccaccccccgcgggccgcaggggctcatgcagccgccaagggagaggctagtggtaacaggccgagctggatggatgggtatggggagaggggcaggacgttcagccctgggattctggccgaccctcgccttccttctctgcagcttccccgcagccacctccccgtgcaagatcctcaagtgcaactctgagttctggagcgccacgtcgggcagccacgccccagcctcagacgacacccccgagttctgtgcagccttgcgcagctacgccctgtgcacgcggcggacggcccgcacctgccggggtgacctggcctaccactcggccgtccatggcatagaggacctcatgagccagcacaactgctccaaggatggccccacctcgcagccacgcctgcgcacgctcccaccggccggagacagccaggagcgctcggacagccccgagatctgccattacgagaagagctttcacaagcactcggccacccccaactacacgcactgtggcctcttcggggacccacacctcaggactttcaccgaccgcttccagacctgcaaggtgcagggcgcctggccgctcatcgacaataattacctgaacgtgcaggtcaccaacacgcctgtgctgcccggctcagcggccactgccaccagcaagctcaccatcatcttcaagaacttccaggagtgtgtggaccagaaggtgtaccaggctgagatggacgagctcccggccgccttcgtggatggctctaagaacggtggggacaagcacggggccaacagcctgaagatcactgagaaggtgtcaggccagcacgtggagatccaggccaagtacatcggcaccaccatcgtggtgcgccaggtgggccgctacctgacctttgccgtccgcatgccagaggaagtggtcaatgctgtggaggactgggacagccagggtctctacctctgcctgcggggctgccccctcaaccagcagatcgacttccaggccttccacaccaatgctgagggcaccggtgcccgcaggctggcagccgccagccctgcacccacagcccccgagaccttcccatacgagacagccgtggccaagtgcaaggagaagctgccggtggaggacctgtactaccaggcctgcgtcttcgacctcctcaccacgggcgacgtgaacttcacactggccgcctactacgcgttggaggatgtcaagatgctccactccaacaaagacaaactgcacctgtatgagaggactcgggacctgccaggcagggcggctgcggggctgcccctggccccccggcccctcctgggcgccctcgtcccgctcctggccctgctccctgtgttctgctagacgcgtagatgtggagggaggcgcgggctccgtcctctcggcttccccatgtgtgggctgggaccgcccacggggtgcagatctcctggcgtgtccaccatggccccgcagaacgccagggaccgcctgctgccaagggctcaggcatggacccctccccttctagtgcacgtgacaaggttgtggtgactggtgccgtgatgtttgacagtagagctgtgtgagagggagagcagctcccctcgccccgcccctgcagtgtgaatgtgtgaaacatcccctcaggctgaagccccccacccccaccagagacacactgggaaccgtcagagtcagctccttccccctcgcaatgcactgaaaggcccggccgactgctgctcgccgatccgtggggccccctgtgcccgccacacgcacgcacacactcttacacgagagcacactcgatccccctaggccagcggggacaccccagccacacagggaggcatccttggggcttggccccaggcagggcaaccccggggcgctgcttggcaccttagcagactgctggaaccttttggccagtaggtcgtgcccgcctggtgccttctggcctgtggcctccctgcccatgttcacctggctgctgtgggtaccagtgcaggtcccggttttcaggcacctgctcagctgcccgtctctggcctgggcccctgccccttccaccctgtgcttagaaagtcgaagtgcttggttctaaatgtctaaacagagaagagatccttgacttctgttcctctccctcctgcagatgcaagagctcctgggcaggggtgcctgggccccagggtgtggcaggagacccagtggatggggccagctggcctgccctgatcctctgcttcctcctcacaaccccaagagcccccagcccggtccatccacgtctggagtctggggagaggagcagggtcttaggactctcagctctgagcatccctggcagggtcttcaacctctaatctcttcccttaagccctgtggccacacagccaggagagacttgccgctggctcccgcctcatttcagcccagggtgctcatccaggggcccagaacagtcccacctgtgctgctatgcccacagcacaaagccaggcttcactcccaaaagtgcagccaggccctggagggtgatcctgccagcagccctacagctccacaccctacccacccatcggcagcccctctgctgttccccagggacctctcatacactggccaggaggctgcagaacgtgtgtctccccctccctccaagaggtcctgctccctctgccagaaccgtgtgtgggcgggtgggagggcgctcggggcccggcccctccctctccctgctggttttagttggtccctatgttggaagtaaaaagtgaagcactttattttggttgtgtttgctcacgttctgcttggaagtggggacccctcactgcgtccacgtgtctgcgacctgtgtggagtgtcaccgcgtgtacatactgtaaattatttattaatggctaaatgcaagtaaagtttggtttttttgttatttgt

SEQ ID NO: 23933 - DNA, 1945 bp, Homo sapiens
cgcccgcggccgaggtggacggagcctcccggctcgctgctcccgccggcggagcgaggctgccctttcttcgcagcgtgatttattttcttctcctttttttctgaactcttcttccagggagaggctagtggtaacaggccgagctggatggatgggtatggggagaggggcaggacgttcagccctgggattctggccgaccctcgccttccttctctgcagcttccccgcagccacctccccgtgcaagatcctcaagtgcaactctgagttctggagcgccacgtcgggcagccacgccccagcctcagacgacacccccgagttctgtgcagccttgcgcagctacgccctgtgcacgcggcggacggcccgcacctgccggggtgacctggcctaccactcggccgtccatggcatagaggacctcatgagccagcacaactgctccaaggatggccccacctcgcagccacgcctgcgcacgctcccaccggccggagacagccaggagcgctcggacagccccgagatctgccattacgagaagagctttcacaagcactcggccacccccaactacacgcactgtggcctcttcggggacccacacctcaggactttcaccgaccgcttccagacctgcaaggtgcagggcgcctggccgctcatcgacaataattacctgaacgtgcaggtcaccaacacgcctgtgctgcccggctcagcggccactgccaccagcaagctcaccatcatcttcaagaacttccaggagtgtgtggaccagaaggtgtaccaggctgagatggacgagctcccggccgccttcgtggatggctctaagaacggtggggacaagcacggggccaacagcctgaagatcactgagaaggtgtcaggccagcacgtggagatccaggccaagtacatcggcaccaccatcgtggtgcgccaggtgggccgctacctgacctttgccgtccgcatgccagaggaagtggtcaatgctgtggaggactgggacagccagggtctctacctctgcctgcggggctgccccctcaaccagcagatcgacttccaggccttccacaccaatgctgagggcaccggtgcccgcaggctggcagccgccagccctgcacccacagcccccgagaccttcccatacgagacagccgtggccaagtgcaaggagaagctgccggtggaggacctgtactaccaggcctgcgtcttcgacctcctcaccacgggcgacgtgaacttcacactggccgcctactacgcgttggaggatgtcaagatgctccactccaacaaagacaaactgcacctgtatgagaggactcgggacctgccaggcagggcggctgcggggctgcccctggccccccggcccctcctgggcgccctcgtcccgctcctggccctgctccctgtgttctgctagacgcgtagatgtggagggaggcgcgggctccgtcctctcggcttccccatgtgtgggctgggaccgcccacggggtgcagatctcctggcgtgtccaccatggccccgcagaacgccagggaccgcctgctgccaagggctcaggcatggacccctccccttctagtgcacgtgacaaggttgtggtgactggtgccgtgatgtttgacagtagagctgtgtgagagggagagcagctcccctcgccccgcccctgcagtgtgaatgtgtgctccctctccctgctggttttagttggtccctatgttggaagtaaaaagtgaagcactttattttggttgtgtttgctcacgttctgcttggaagtggggacccctcactgcgtccacgtgtctgcgacctgtgtggagtgtcaccgcgtgtacatactgtaaattatttattaatggctaaatgcaagtaaagtttggtttttttgttatttgt

SEQ ID NO: 23934 - DNA, 1152 bp, Homo sapiens
cgcccgcggccgaggtggacggagcctcccggctcgctgctcccgccggcggagcgaggctgccctttcttcgcagcgtgatttattttcttctcctttttttctgaactcttcttccagggagaggctagtggtaacaggccgagctggatggatgggtatggggagaggggcaggacgttcagccctgggattctggccgaccctcgccttccttctctgcagcttccccgcagccacctccccgtgcaagatcctcaagtgcaactctgagttctggagcgccacgtcgggcagccacgccccagcctcagacgacacccccgagttctgtgcagccttgcgcagctacgccctgtgcacgcggcggacggcccgcacctgccggggtgacctggcctaccactcggccgtccatggcatagaggacctcatgagccagcacaactgctccaaggatggccccacctcgcagccacgcctgcgcacgctcccaccggccggagacagccaggagcgctcggacagccccgagatctgccattacgagaagagctttcacaagcactcggccacccccaactacacgcactgtggcctcttcggggacccacacctcaggactttcaccgaccgcttccagacctgcaaggtgcagggcgcctggccgctcatcgacaataattacctgaacgtgcaggtcaccaacacgcctgtgctgcccggctcagcggccactgccaccagcaagctcaccatcatcttcaagaacttccaggagtgtgtggaccagaaggtgtaccaggctgagatggacgagctcccggccgccttcgtggatggctctaagaacgtgtctccccctccctccaagaggtcctgctccctctgccagaaccgtgtgtgggcgggtgggagggcgctcggggcccggcccctccctctccctgctggttttagttggtccctatgttggaagtaaaaagtgaagcactttattttggttgtgtttgctcacgttctgcttggaagtggggacccctcactgcgtccacgtgtctgcgacctgtgtggagtgtcaccgcgtgtacatactgtaaattatttattaatggctaaatgcaagtaaagtttggtttttttgttatttgt

SEQ ID NO: 23935 - DNA, 325 bp, Homo sapiens
aggcatttgtggaatatccaagctgctttaatatggcttatgtatccagagagaaatgcggattttgtttctttgcctataattgttttatttttatttatttatcttttggagacagggtctcactctgtccatgctgtactgcagtggcctgatgtaataactcactgtggcctggaactcctgggctgaagcagtcgtcccacctcagcctcccaactactcgggaggctgagcatgggaatcgcttgaacccaggagatggaggttgccgtgagccaagatcacaccactgcactccagcctgggcaacagagcgagactc

SEQ ID NO: 23936 - DNA, 421 bp, Homo sapiens
tggtctcaatctcctgacctcgtgatccgcctgcctcggcctcccaaagtgctgggactacaggagcccgccatcacgcccggctaattttttgtatttttagtagagacggggcttcaccgtgttagccaggatggtctcgatctcctgacctcatgatctgccctcctcggcctcccaaagtgcttttcatttttactttaaaggctcgccacatggacaaaggccaggcggcttcacacactcagtcgactccaggtacagacccctgaccttttcagggctcttcgcatgttctggcctccctggcgtagtgccccccacaaaacaggggcatcatggccaggcgcggtggctcacgcctgtaatcccagcattttgggaggctgaggcgggaggatttcttgagcccaggagtttg

SEQ ID NO: 23937 - DNA, 292 bp, Homo sapiens
accactcccattactcagtactcagctcactactgtacttggcacctagccagatcatagcaagatcaccgtctgttgcattgacttgctgttgaggatagattcctatggtctttctcaatcatctcctttacaaacctccctgaagagccatatgcaggcatgaatgatgatcaatacacggtccctgccctcaagaaggtcacagtctagtactggattcaggcatacgcacaaataattgtgaaactctgtggtgttggtctatcaggaacatcacacgggatcgcca

SEQ ID NO: 23938 - DNA, 1357 bp, Homo sapiens
  misc_feature (2)..(2): n is a, c, g, or t
anataaaagaaaagaagaggaaaagataactctgttataccaattactaggtatgtgaaagagaaaacaaccaacagtgtataagggcgacagaatcaaggctgggatatggaaggaggggaggaagagaggaagagagaacagaaaatatttttccaagttgtggttcttgatccaagatctgaaaatataaggtttaacttgccaaagtagggcaatggcttgccaatgggacaacggctgctttgtaaaaccatttgctctgagttcagataagtaaaaactatttctcctattttccttgactctctcatgcatgatctcgggttctctgtattttccagttttggatgtcaccacctatatcagttagagtccacctgctatagtaaacaaccgacacaattacagtgatttaaataagtaaactctatttctgtatgtaataatagtcctgttagttccagttatcaggcagctttgacccaggaagacattcacaaaatcagacaattttccttctgggttcctactattcaatagtttgtgcccttgtgtattcagtcaaaaataaactgcttccacatcttcattccaacccatgggagggggaaaaagactcacccatacaaaaaagcttaacttgaatcatccagaagtagcatccaatatctccactcacacacattgttccaaacatgaggtacatatgcacacctagccagaggaaagccagggacatacaggttttagctggatggtcaaatgtttagataaagatatatttatagggaataaaggaaatgaatttagggagaaaagcactacctgtctgatttctgatttcttcaagttaccttctgttcaagttggctttggctatgcagtcagtggtttgctttcattatgcatttcctgaccttagtcctatccctggttccatttttatcatcccattactatctttcatcctctcatgtatgcctttttctttattttctgattccactcccacctctcaacccaaaattttgctgtaacctctttcagcagtatattttggtacctggtacagtcaacgtgctgagtgttagggttccattaaaggaaaaatatacattttacataatttcataaagaaagatttcttacagttaagtaaattaaacaggatatcatgtacataatgcatttgatttagaagttgagttttatgatgtttagaaactgtaacaataaggataaaagataattctagaaaaattcatacattcaaaaaatactattgtaataaaagtataaaatttctataataaagagaaagtaatgcactttgttggattttgtgcatgcaata

SEQ ID NO: 23939 - DNA, 1322 bp, Homo sapiens
  misc_feature (2)..(2): n is a, c, g, or t
anataaaagaaaagaagaggaaaagataactctgttataccaattactaggtatgtgaaagagaaaacaaccaacagtgtataagggcgacagaatcaaggctgggatatggaaggaggggaggaagagaggaagagagaacagaaaatatttttccaagttgtggttcttgatccaagatctgaaaatataaggtttaacttgccaaagtagggcaatggcttgccaatgggacaacggctgctttgtaaaaccatttgctctgagttcagataagtaaaaactatttctcctattttccttgactctctcatgcatgatctcgggttctctgtattttccagttttggatgtcaccacctatatcagttagagtccacctgctatagtaaacaaccgacacaattacagtgatttaaataagtaaactctatttctgtatgtaataatagtcctgttagttccagttatcaggcagctttgacccaggaagacattcacaaaatcagacaattttccttctgggttcctactattcaatagtttgtgcccttgtgtattcagtcaaaaataaactgcttccacatcttcattccaacccatgggagggggaaaaagactcacccatacaaaaaagcttaacttgaatcatccagaagtagcatccaatatctccactcacacacattgttccaaacatgaggtacatatgcacacctagccagaggaaagccagggacatacaggttttagctggatggtcaaatgtttagataaagatatatttatagggaataaaggaaatgaatttagggagaaaagcactacctgtctgatttctgatttcttcaagttaccttctgttcaagttggctttggctatgcagtcagtggtttgctttcattatgcatttcctgaccttagtcctatccctggttccatttttatcatcccattactatctttcatcctctcatgtatgcctttttctttattttctgattccactcccacctctcaacccaaaattttgctgtaacctctttcagcagtatattttggtacctggtacagtcaacgtgctgagtgttagggttccattaaaggaaaaatatacattttacataatttcataaagaaagatttcttacagttaagtaaattaaacaggatatcatgtacataatgcatttgatttagaagttgagttttatgatgtttagaaactgtaacaataaggataaaagataattctagaaaaattcatacattcaaaaaatactattgtaataaaagtataaaatttctataataaagagaa

SEQ ID NO: 23940 - DNA, 388 bp, Homo sapiens
gccacaattggagttctaaaccccttataataagcacatatattagatatagtcatgtgttgattcaataacctgatttcttccctcctttggctttatcacatttgtcatataactgtcaagtctccctgagtatttgcccaacatccattgagcacatggcaaggagaaaatgtggaggattttatggagatggtttgaaaggggattcccatgccttctgtccacgtttctgtggccaacagtcagtcacatgatcccacttagatgcaaggggttctatataatgtagtccctggctcaggggatgccccagagacagttctatactctaaaagaggagtatgaatccttagtagacagttttccaactgtaccactctgtgtg

SEQ ID NO: 23941 - DNA, 5634 bp, Homo sapiens
  misc_feature (5625)..(5626): n is a, c, g, or t
  misc_feature (5628)..(5628): n is a, c, g, or t
  misc_feature (5631)..(5631): n is a, c, g, or t
ggagcacaaaccctattgtgaactatgcatgcgagtaatgtaggttgcccgctccttgtgagaatctaattaatgcctgattatctgaggtggaacagtttcatcctggtctgtggaaaaattgtcttccacgaaactagtccctggtgccaaaaatcttggagactgctgacctagagaacccctaccagagttcttgggaaatctgtatctgattagagataagtttttcaaacaaagcacagtgaccgtagaagggaagtttttcagctcatgaataatgtcaagaatgcagaagagcaaaagacaaggatacgtacatagagatttgatggaccgctttaagctcagcccatgtgccactcttcctctctcccctaaacacaccacagtctgtgctttgaccatgaatcaggcgatactttgctgtggggctgaagtgggggaagtccttcagttttattgtcagctctcttttccagtcatgtgtctagtggtatgggcatgagttctgaggatgacaaagatggtctgtgcttagatcttggccctgacagtagcttactgtgtgccttgagggagacacttaacctgtaagcctcaatgaactcatctgtaaaatgagggtcatagcactcatctagaagagtggtgaagttcatatgaattgagaaatagcagctgcccaataaatgatcctttctatgtcctttcccagggccatttgctgaggaaaaaaggaccttaccatggctaccagctatttcaggataggtatctttacccattcctattcctcagtgccacctcatcccccttggaattcagtaccaaacccgaacaggttgcttttcactggagtgtttcctgagctgccagatgtgcccctgagtggagatgggaatcagtgttatcttccccagggatgctgattctactccaggctggcaggagacattgtggtcctgacatggcagccaaccagatagcaatggtcttggcacccccaaagcttactgagagtaggacattctatagttgaagatgaggggagcatcttcaactgctgaaaccacaccttggcctggctgtacctgctcctatcttgaggccaaaataggagggagcacaaaagaacatggtggggtagatctgtgtgcacgtgacaccagtgaggtgctggagtgggccgtgagagtctttagtgagaatatgttggctcatgttttggaaacctttgaaaattgtcctgtggtaagggaatgagaacagtacctctctctttgtgctgttgacaggatgagttcatgtctgtcaggtgttttagaacagtgactcccatagtgctcagtaagtgtttccaagctagcagctctggctcagcaattccagtttgtacatgtcccccaaggaaatgactaagtatgtgcagaaagcattctttataacagggttagaattggaaacaacctaaatttccaacaaaaggggagattggctgattgattcatgggatggaatagtatgtgatcacgaaataagtcattttaagacaaagattttatggtaaatttattaagtgaataaacaaaggttttaaaacaatacagaatggaatatgcttttttttttttttttttttcctcctagagacaggatctccatatgttgcccaggctggtcttgtgcgccaccatgtctgggtaaagaatggatctatttttaaaaggaaactttttattttggagtaattttaagtttacagaaaggttctaaaaatagtatagagagtttctgtatatacttcacctagtttcctctaatgttaacattttacttaagtatggtacatttgtcaaaactaagagattaacattggtatattactagactgactatatttggttttcagtagtttttctactaatgtcttttctatccaggctccaaccctttataccacattgcattttttttttttttatttaaaagtgtatgtacatagaaaagcatccgggtgcatatagatgaaaatgttaacaatgatcatagctgagtggttgaattaagggagatttttgttttaaagttcttagtatgtcttctaatttttctatgtttaacatgtcacataattttaaaacacaaaactaacaattcaggctgagttggtgccctctgattaccccttgtatggctatactgtgtatgtttagctgagtcttttcaacactcagctaaagacggcaaatgaataagtctgcctcatccctctttccctatcatgcagcccagggcccggcacagaggaggcactgataatatctagttgaataatgggtgaagtcagagaagtttattgctaccaactctcggagataaactagtcttagcactctttttcagcttaaggaaacccaggcttatgtttccccagtttagtgaccccagcaggacaggacctgtttttaaagtttgcagtctcagggctgacttttatgcccatcgctgaattagttgctgtggccaggagcatggaatatgcctcttggccaggcttgggtccactgaccaggcctttagatggcttcccaaagaaaagtcagggttctgctatccaaaggaggtaagatggatactgaggaagttaaatacaacatcagagccatcccctaaacacaggcattttaatctctaattccttttgccatactatatgtcatgcttgggctccctgatgagaatagtaccacattaatgctattcatcattaaatcctagcatccagcacagtgcttgtatgtagcagggacctagtcaacatacaagtgaataaatacatttcttggtgacctaaacaaaatcatttaactagatgtttaaatcagaatgctttgagttgtaaataacagaaaactggctcaataaaggacatttgttgactcatgcaactgaaaagtctagtggagcccagcagtcaggcatggtgtggtcaggacttcacttatgtgccagtctctgactgcccccttggtatcatcaggcttgtctctctcatggtagcaaaatgactgcagcagttccagacgtgacatctgtactccgcaacatccagaacaagagaaaatacagagaccctgtatcacagaattcccagcaaaagtcctgagagtcactgtgaactgaataagattacatgcccacctctgaatcagcaattagtggcaagggttgtttactggcttagcctagatcatgtacctcacccttagaactggggagataggggagggagagagtagaatcagcttccctgaaactacatggattcctgatgggaactgagactttggggaaggggaaagcagtccggatcctgaggatgtaaccaataggaatccagctcaattgaataccctgaattgtgtggcataaacaagggctgcaggagttagagggcaatgagtgaaggttgcatcagtcagagcagggaggcttcatggaggagaatgagagactggagccaaaccctgaagagataaaagatttgggcaatggggtagggaggtggaaaggaaggaacattgcccatgtgctgtgccagacatcatactaaaccctctgtatgccgggcgtggtggctcacgcctgtaatcccaacactttgggaggctgagacaggtggatcacctgaggtcaggagttcgagacaagattggccaacatggagaaaccccgtctctacaaaaatacaaaaattagtcaggcatggtggtgcactcctttagtcccagctactcaggagactgaggtgggggcattgcctgaacccgggaggcagaggttgcggtgagccgagattgtgcctctgcactgcagcctgggtgataaagcaaaactccatctcaaaaaaaaaaaaaaaattctctgtatgcattatctcagttaacccttacaatgacctgcaagtttggtatcatcattatccccattttacagttgagaaactgaaacccaggggtcacacagtaagtgttgaggttgagacttggacccagcttgtctggctgagaagcttgtgcctggagctatgacgctggtgagtaaagtagacagtggtcacctgggaagtttgcattagtgtgaagtaagtggcctgacctcaggtcatcacagaggtagtgcagaatgtgaagttcttccctcagctgtgctgtttttggggcagcggggatcagaaccaaagcacaattcctttgaaagtttgccaaactttgaccttaaccatgtgaaaccttgtgcctttcctgctcaccagatggattcttcagacaaggcctaggtgctggttctgctccttactaggtggccttgaatgtatcattcacagtctttgagcctcagtttccctatttgcaaaatagacacagtaataccacatttattgattgaacagatttactcttgccttatctttgctgggcctgggagaccaagaaacaaagatgaatgagacagtgcctgcccccaaggacctcccagtctagcagaggagatggatataaaatcagagagacttatggagagcagtggaaaacatagatcagggagcgatcaacttagcttaagtggatctgggaaggcctcaaagtaggggacatctgagccacaccttgaatggttagtaagagtttgccaggcagccacttggggcagagttttgtgagaatcagataagctgtgtcaaagtaaatgttttataaattgggctgcctttcccttctaggttcatacctcagcttgcattgctgctgtaggaaacataagaaatgccctagaaacccctccctgggctgagagttcctagaattaggggccggggaagagttttgaatgcatgctaaagtctaggctcatcatcttgccacacaaggcctgtttggcttcatctttctcttaattttatgctcacgcaaaacaaccacctagagttccatgaaatcattacctccctgtttctcctcctatgtcttcttcttctccacacccacctggcaacctctaatttgtttcctggaaatgtgattgacccacactccactcacgcagcctcagcacccttttatttgtaaatacatggactcatcttctccaggggactggggctccttcaaagacaaagagtaggtctcaatctctaccctgccacacctagcaccaactgatcagagctgcatctctgatgcagggataggtagttgggagtctcacttcttccacaaacattgagcttctgccacaggcctgctggcgtcaagtcaggcaaaaaggattcaggaagcaaagggtacaatccaaccctggaagcagtcacagtccagagagaaactcacatgtaaacagtccattgtaatactgggtgatgtgtgctgggatgaaaggatatctggaacatgaaggggacacaggagagatcaactactttgggcacacgggaaattgagcaggaatctgctgggtggtgaaagacagacactagagcttgtacgaggcatggaagcatgaaaaagcacagcaggttccagggtcagtgagtatgcgtatggctgaaggaacatgggaagnntngangca

SEQ ID NO: 23942 - DNA, 512 bp, Homo sapiens
gttttcaggcatctgagggcagcaggcacctggaaatccagacttctaagacccctgtggccattttcagaaatgaagcaggtcccccaggcatgaaaggtacctggagattcaagagtatgactgcccctgggcctctgtggcttgaaaatattatcagagcaaaacttgtcattccttattcagagctaaagtgctcactgcacatactcctgggagaagtaacaggacagtcagctctgacgtgactgacacaggcagaagtgatttgtggaagcaggcttggacgggggagcaattctggatatttcatggggaaaacaaagagctggaagaaggaggtagtgcagaggccctcagaaggggaaggacctgggacccacacaaagacaggctttgcttctttcatgttttacttggggccaaacttactttctcctgtgtagctgattctctggtttgtgtgcagaaacactgccaatgctgccatttaaataaggatttcaggaagt

SEQ ID NO: 23943 - DNA, 399 bp, Homo sapiens
gctgtgagcctgaatgcgagtccggttggttgtgcagttatgaacctgtgtgtacatctgtgtgcctaagacgctgggcaactgtacccacatgaccgatgtgtgtgaacgactgtgtgcctgtgtgtctggatctgcgcgtgggtgtagttcgtgtggctgtgtaaaccgcatgcataggtatacatgtacctatgtctcaggctgtgtgcgtcctactgcgatggtacgagagtgtgggtgtgatggtgtatgtgatcctgtgtctgcgtgtccgtacatttgagtgggtgttgtgcgtgtgactgtgtaaactgcgaacatgtacgtgtgcccgcccgtaggtattaccgtgtacgtgtgtctccgtgtgcctgtgaggggtggggtctgcgcggg

SEQ ID NO: 23944 - DNA, 1134 bp, Homo sapiens
gtactaaagtaattgtggtctttgccgttaaaagtagtaaatccatggagaatgggttaaataaatgatagtttatgtatacacacaaataccatgtggctggtaaaaatgatggtgtaaattatatttacagactgataaacgtaaaaagtatctgggacatagcattattgaaaagaaagcaggctagtgaatactataattattttgtaaaagtctcttatggacataagttatatatttacatggccatattttgcacaggaaatatgaaaaagtatatatatcaaacagtaatggcttatttttatcttctgggagttttgcaggtgcttccctctttacaccattatatgtcatctgaagttttgttctgattctgtattatttcatttctaaaagaaaagccccaaaaccaagtgctgttttcctggtctgtggaaacagagtctccgaggaattaggctagacatggtaagaacaaagttctgttgtgataaaagctttggcctgaggttccaaccattcagtttgccagctcagacttgatcttgaatgaaggcggggttctgtgactggagaccatttctctccttttgtatttgttggtgtgtccaaaaacctcagatctcccagcttcaggcttctttgagggcagtgctaaattggttgaaaccttatttgaggcagttcctgaaaagggtaggtgaaatttcctgctgataaaaggcatcttgtgtcttgttcatccttagcaaattgccaattagcaaagaagagagggcagatgaagtaccagccaatttgaaattggtgtggacttccatcaaggtatattaattcactttacctagatgattcgaaattagttgcttttttcttttaatcctaaaaggataattttcttcatgttcttcttgtcatgtcagccaaatcctatagtgtcaactttcagtaaatgtatcttagatataactatggaccaatctagatctttctctctctatcatctatacagtttagagattttaaaactcttaccacttagtttgaaattttattttaatttataaaatgatatattcttatgtaaaaaattcagacaataaagatgtatttaaagtaaaaggcaaa

SEQ ID NO: 23945 - DNA, 381 bp, Homo sapiens
ccagtcctgcctgtctttgctggtggggacccagttcttggatctagaaaggggccatgagagatttgacaaaaggggtgatattttaatgggccaccaaggttttgtttaagacctgtgaatatttgaaaacaaagagaaggaactcaatagagagggagacactaatgatgaagaggcagaggggagcacaggacttgaggcagaagtggaagggttcatcttcaataatatgaggtgaaatccttcttcctctgaattaagacaaaggaaatagtaaatgaggctgggtcccaagattcttaagttggaagagacgtgagtaggagaagcttatagtaagtggtctggatctttttagcaatacagaaagccaggtgg

SEQ ID NO: 23946 - DNA, 347 bp, Homo sapiens
aaacaagaaccatgacaaccctggccccagcgatgcgcttggtccagggagcgagaataaagttagtggagaatggagtcacaagttgggattcattctccatgtccccactccccgaacgcatctcctggtaatgagctggtgcttgtgctaaacgcctgagaattcttggaggccggtgtctttccccctcactccccgtacttaccgcaggcactttaaattgaacctgcgcattttgtttctttactcctaggacttggatttcagacctttgtcctgctcccggtccccccagatgggtccccgggggggcgttgggggctgtcgctgggctttgcgggcag

SEQ ID NO: 23947 - DNA, 458 bp, Homo sapiens
tcctgtctgcccttgatggagccactggtggggttacttgctggcggtcggccactttcgcccctccctcgccagcccgccagctccctaaggttttgtggttttttgtcaccaccacacctcagtgttgagctaagtgaggacgtccccccagcaaatgtattggacggaaggaaacggtgtgcgggaggaggcggaggaaagtaggccacccggggctcaagtgagaacaagcaccaagccctgtggatttcagaagaactccacctccacggagtcctcaaagatcttctcctgaactccgcactccccagccttgagaggagacacaggagctggaggaagcagctttatccctcactttgtggttcagtccagcctgttttccaaggagtaaagggcagtggaaggataactaagaaaataataataacaaatgaaagcatctctgtggagct

SEQ ID NO: 23948 - DNA, 891 bp, Homo sapiens
aaaaaaataaaataaaataaataataaataataaaattgtcttcatcttgatccaaggaaaccaaagttcacatattgcattaggttttgtttcttgagtcttaatccagagcagcatttactctatttacttgtggggtgggagcatttactagttaaggaaacagttgcatgtatgtcctacttcttggatttgtttgtttcctattaatgcgtttaacttgtttcgatatagcagtagttctcaacggaggacaattttgtctccctctcttccaggggacatttgacaatgtctagagagatttttagtcatcacaatctagtgagtagaggccagggatgttattaaacatctacaatgcacagaacagcccccaccacaaataatttcctggtttctaatgtcaatagtgctgagattgagaaactgtcagcctatcccatgtatttcctgaagaatggaagttagcactaaaagcttggttagagtcaagataactctttttgcttaaaatagttaaattgcccaggagtgccggtattctgttttgatctgggtgttggttacaagagtatatcattttgtgaaaatttatatgtgagctctacactttaaaaaatgtgtgttatttttaattttaaaagtttacattaaaaaaagaaacctctttattgtgttgggtcccttcctctttttgtctgctacttcacacttcttaaatagttgaataaatctttaaagcctcactcccttttaaagttccttaatactcttttttttttttttttcccaatgtgagagactggtagagatgggggaaaaaatgggtgccttttgaactcattgttgggatggttgagtgtctgttagggaagtcagagtgctgg

SEQ ID NO: 23949 - DNA, 1020 bp, Homo sapiens
  misc_feature (36)..(36): n is a, c, g, or t
  misc_feature (41)..(41): n is a, c, g, or t
  misc_feature (46)..(46): n is a, c, g, or t
  misc_feature (61)..(61): n is a, c, g, or t
  misc_feature (69)..(69): n is a, c, g, or t
  misc_feature (72)..(72): n is a, c, g, or t
  misc_feature (81)..(81): n is a, c, g, or t
  misc_feature (87)..(87): n is a, c, g, or t
  misc_feature (94)..(94): n is a, c, g, or t
  misc_feature (98)..(98): n is a, c, g, or t
  misc_feature (110)..(110): n is a, c, g, or t
  misc_feature (118)..(118): n is a, c, g, or t
  misc_feature (122)..(122): n is a, c, g, or t
  misc_feature (140)..(140): n is a, c, g, or t
  misc_feature (142)..(142): n is a, c, g, or t
  misc_feature (153)..(153): n is a, c, g, or t
  misc_feature (163)..(163): n is a, c, g, or t
  misc_feature (180)..(180): n is a, c, g, or t
taaccgaagccgacaccagttgaatttcagtattantttcnagtangccggcaaagctttnagctcctngcnagatcttantggagncatcacnagtnggtagtcagggntcctttanctgnaccactggggacttaggngnaaagaaaaganctcaaaagangggtaaaggaaggcaantggcaccagtaatagtactctctcggggcccggattagacagcaaaccagggaagcgcagtcggaccccttctaatgatgggaaaagcaaagataagcctccaaagcggaagaaggcagacactgagggaaagtctccatctcatagttcttctaacagaccttttaccccacctaccagtacaggtggatctaaatcgccaggcagtgcaggaagatctcagactcccccaggtgttgccacaccacccatttcccaaaatcactattcagattcctaagggaacagtgatggtgggcaagccttcctctcacagtcagtataccagcagtggttctgtgtcttcctcaggcagcaaaagccaccatagccattcttcctcctcttcctcatctgcttccacctcagggaagatgaaaagcagtaaatcagaaggttcatcaagttccaagttaagtagcagtatgtattctagccaggggtcttctggatctagccagtccaaaaattcatcccagtctggggggaagccaggctcctctcccataaccaagcatggactgagcagtggctctagcagcaccaagatgaaacctcaaggaaagccatcatcacttatgaatccttctttaagtaaaccaaacatatccccttctcattcaaggccacctgggaggctctgacaagctttgcctctccaatgaagcctgttcctggaactcctccatcctctaaagccaagtcccctatcagttcaggttctggtggttctcatatgtctggaactagttcaagctctggctagacccaggggaaataccaaggttgagggcaaaatga

SEQ ID NO: 23950 - DNA, 861 bp, Homo sapiens
ttcacgcttaattcactttatttttcttgtataaaaaccctatgttgtagccacagctggagcctgagtccgctgcacggagactctggtgtgggtcttgacgaggtggtcagtgaactcctgatagggagacttggtgaatacagtctccttccagaggtcgggggtcaggtagctgtaggtcttagaaatggcatcaaaggtggccttggcgaagttgcccagggtggcagtgcagccccgggctgatggtgtagcagtcatcgataccagccatcatgagcagcttcttaggcacaggtgcggagacgatgccagtgcccctgggtgcagggatgaggcgtaccagcagtggttctgtgtcttcctcaggcagcaaaagccaccatagccattcttcctcctcttcctcatctgcttccacctcagggaagatgaaaagcagtaaatcagaaggttcatcaagttccaagttaagtagcagtatgtattctagccaggggtcttctggatctagccagtccaaaaattcatcccagtctggggggaagccaggctcctctcccataaccaagcatggactgagcagtggctctagcagcaccaagatgaaacctcaaggaaagccatcatcacttatgaatccttctttaagtaaaccaaacatatccccttctcattcaaggccacctgggaggctctgacaagctttgcctctccaatgaagcctgttcctggaactcctccatcctctaaagccaagtcccctatcagttcaggttctggtggttctcatatgtctggaactagttcaagctctggctagacccaggggaaataccaaggttgagggcaaaatga

SEQ ID NO: 23951 - DNA, 817 bp, Homo sapiens
  misc_feature (1)..(2): n is a, c, g, or t
  misc_feature (4)..(4): n is a, c, g, or t
  misc_feature (6)..(9): n is a, c, g, or t
nncncnnnnagggttcccaaatctggccagtctttctgccctttcccttgcgggtcgcaccccgcccaggcccctctcccgccccaggtctctcagtcttttttctcagggcgtgtagcttcctgcacacccggaagcagatcgcgcggggaaaagatcacagcgctgcgcgtcagtttccgtctacctggactaaacatttgcttcgccccgtctgcctgaatcgaacgtgcacttggcagtcttcccttgtccatacccgtttcctggggatcgctacggaccttaaaataccagcaacagccccttcgccccaaggtcttgctctgtcagactagagtacagtgccatgatctccgctcactgcagcctcaacctcctgggctcaagcagtctttctgcctcagagtgctgggattacagacgggagccaccacgccaggcctacgagatttgacttgtaaagaattaattatattgactgagagagaagcccagaagaggaagaagaggaaagaaaaggagtcagggatggctcttacacagggacctttgacattcagggatgtagccatagaattctctcaggaggagtggaaatccctggaccctgtgcagaaagctttgtactgggatgtgatgttggagaactacaggaacctggtcttcctgggtaaggataattttgctctagaagttaagatctgccctcgtgtatttttgtattttctctgttgtctttcttgggagcccttccattatttgactgagactgaagccttgttgactcacaaataaaaagcttcataatgctgaa

SEQ ID NO: 23952 - DNA, 845 bp, Homo sapiens
  misc_feature (1)..(2): n is a, c, g, or t
  misc_feature (4)..(4): n is a, c, g, or t
  misc_feature (6)..(9): n is a, c, g, or t
nncncnnnnagggttcccaaatctggccagtctttctgccctttcccttgcgggtcgcaccccgcccaggcccctctcccgccccaggtctctcagtcttttttctcagggcgtgtagcttcctgcacacccggaagcagatcgcgcggggaaaagatcacagcgctgcgcgtcagtttccgtctacctggactaaacatttgcttcgccccgtctgcctgaatcgaacgtgcacttggcagtcttcccttgtccatacccgtttcctggggatcgctacggaccttaaaataccagcaacagccccttcgccccaaggtcttgctctgtcagactagagtacagtgccatgatctccgctcactgcagcctcaacctcctgggctcaagcagtctttctgcctcagagtgctgggattacagacgggagccaccacgccaggcctacgagatttgacttgtaaagaattaattatattgactgagagagaagcccagaagaggaagaagaggaaagaaaaggagtcagggatggctcttacacagggacctttgacattcagggatgtagccatagaattctctcaggaggagtggaaatccctggaccctgtgcagaaagctttgtactgggatgtgatgttggagaactacaggaacctggtcttcctgggtatccttcctaaatgtatgaccaaggaattaccaccaatagggaacagtaatacaggagaaaaatgccaaacagtgacgctggaaagacatgaatgttatgatgttgaaaatttttacttaagggaaatccagaaaaatctacaggaccttgagtttcaatggaaagatgg

SEQ ID NO: 23953 - DNA, 748 bp, Homo sapiens
  misc_feature (1)..(2): n is a, c, g, or t
  misc_feature (4)..(4): n is a, c, g, or t
  misc_feature (6)..(9): n is a, c, g, or t
nncncnnnnagggttcccaaatctggccagtctttctgccctttcccttgcgggtcgcaccccgcccaggcccctctcccgccccaggtctctcagtcttttttctcagggcgtgtagcttcctgcacacccggaagcagatcgcgcggggaaaagatcacagcgctgcgcgtcagtttccgtctacctggactaaacatttgcttcgccccgtctgcctgaatcgaacgtgcacttggcagtcttcccttgtccatacccgtttcctggggatcgctacggaccttaaaataccagcaacagccccttcgccccaaggtcttgctctgtcagactagagtacagtgccatgatctccgctcactgcagcctcaacctcctgggctcaagcagtctttctgcctcagagtgctgggattacagacgggagccaccacgccaggcctacgagatttgacttgtaaagaattaattatattgactgagagagaagcccagaagaggaagaagaggaaagaaaaggagtcagggatggctcttacacagtgcctaaatgaagacgtatgggtcttttactgttttttgctgttacaaagaatgtcaccgtggctgcctgtatgcatgctatctttaccacagatgtctgaagtttcctccaggttgggcagtttaaagagtgagtgcctcttttaggatggcataccacaaaagcaaaaataaataaatgttttcctttatctttttctgg

SEQ ID NO: 23954 - DNA, 496 bp, Homo sapiens
gctgtatcccttcgcataggctgagtcaaaaggcatctagaaagtgcctacccggaactgtgagctcccacctcacttctggaccatgctctgagaactcagcaccctggatttcctggaccaaatgactctgaggccccctacacaggactcaaccccaggcctgtattcatgagagtggactctgactgatgtacacacacgctagaccctgattttgtgtaagggatttgtagactgagcttggatgtgcaggctagaatgtgagacaccttgaagtatgggccaacaccaggcatgggaagagacgagggagtctctgtcatcttgcccaggccccataaataatataggaacctactttattccaatggttctaaatctcttagggagtcaccatcaggttcagaatgtcacccatgggactaactcttctttttattgagacagagtctccttctgtcacccagactggagtgcagtggcacgatcttgg

SEQ ID NO: 23955 - DNA, 565 bp, Homo sapiens
gtcttccttgttgatcaaggttctcgtgactaaatggcattagtttgtgttctcacagataggataggaaaaggaattatacatattgattatgtactatatgtcagaccacttatgtaccttgtttggctctatgattctgaattttttatcaccctatcatcacttctgttcagcccttttcttcccttcccaagttgtttattctgtttgatttttgttctctgctggtagtcagataatctcccaaaaataatagttatcattgattggccacttcctgtgtgtcaagaactgttttatactcttcacatagatggttctcttttgatcctcaaccctgtgagcttatcacttaataaatattgttaagctgcaaaaaaaaaaaggatccaaaaaacagcagattaaacaacaaattactggctttatttttctcaccttaaaaagtctagaggtgagcagtccaatgccactagtgcagctccatagtggcctcagggacccagatgtctcctggttttctgctcttccatacttcgtattggtgttcaccctcgcatct

SEQ ID NO: 23956 - DNA, 388 bp, Homo sapiens
tcaagaccatgccattgcactccagcctgggcaacaaagtgagactctgcttaaaaaaaaaaaaaaaggcagatgtaaaaaaagtaaaattgtgatttcaggaagcccctatcttttctttcaaggcccttatctcaccctataattaagcatatttatgtatttttatttatttagttttgagacatgatcttgctttgtcacccaggctggagtgcagtggcatgatcatggttcactgcagccttagactcctgggctcaagtgatccttccacctcagcctcctgagtggctgggaccacaggcaggcaccaccacacctggctgactttcgtatttttttttggagagatggggtcttgccacgttgcccaggctggtcttga

SEQ ID NO: 23957 - DNA, 395 bp, Homo sapiens
tgtaggagagatgttagccatgtcttgctcagccatcaaagtcttggcagaagacaccttgctcttgtggaatagcatgccctgtgagcagggagttattctaagagagtttctagatgtagtgccaattttggaaagacagctggcaggaattgggcaaagggtcgtcattgacctatatgggtgggagcatttggcttcacagagccctaagcatagattatattccaaaaataatgttatggatgcaacaccatgaaaatcacatgtcatgtcataaccaccatgatgaaatgttggatccatatttagcaattattgtggtctctgctataatactcagttccttacacaagaacttgtctaggattcagcagtttatactgaggtgttca

SEQ ID NO: 23958 - DNA, 180 bp, Homo sapiens
agacagaggagatgttgtgcattgaccattgaatgcaattgggatgggaaggggtgttactaaaagcacaggccatgtcaggcaacctagcgtctggggatctgttttctcatttgcaagacaggaaaaggggccacacctttccccactgggctattacaaggattaactgaggcaggg

SEQ ID NO: 23959 - DNA, 413 bp, Homo sapiens
ccaggaaacatctttttttaaacctgggctttccatgaagaggcttttggattaagtcactattgaaataagtatgccattggaaattcaatggccagaaggtgaatcttttaaattagattcctacatttttttaaaaaagacctttgagatctctcattctaaacaattaatgggaagatcaaattcaaagaaagacatgcaatagtgtcatggccagccctaggaaatcctcttgacataattaagagcaaaaatctaacctaatttaaaatctttgtcagctcaaattgcctgctttaggattccccgcaggatttaaaatggaatgttgctccacctgttgtccggtagttccaatttcacactttcatagccatggcctgggtgtgatttctgctcagggaaccagt

SEQ ID NO: 23960 - DNA, 317 bp, Homo sapiens
  misc_feature (109)..(109): n is a, c, g, or t
  misc_feature (202)..(202): n is a, c, g, or t
  misc_feature (230)..(230): n is a, c, g, or t
  misc_feature (270)..(270): n is a, c, g, or t
caaatatgtgttcgacaattattggacaggtacagaaagctatatgtagaagtacattcatcagagtgtttgcagtgtgggccaggtgcgacggattacaggcgtgacnaccatgcccggccaaagttattattttttttaatgtaaactctgcaggagccagaatcttgtctcaggttcactgttgtattccctgagcctncaatagagcttgatgtataaccgaaacncagccccagaatttgtggtggacgaatgaataaaaagacnccagtgtccggcacatataatgcaggttactaactggtaatgtacta

SEQ ID NO: 23961 - DNA, 252 bp, Homo sapiens
agaaaatacaaattcatacagacaaaaagtacagtagtggttagctaggggtgggaacagggattattgcaaatgggcataagagagcttactgaggggatgaaaatgttctaaaattgattaatggaaatggtagtgccactcagtaataaattaaaaatcactgacttatacacttgaaatgagtgagtttcataatacataaagtatatcttgataaagctgttttaaaagaaaacttgtaagatatag

SEQ ID NO: 23962 - DNA, 323 bp, Homo sapiens
tgaaactggatcctcatctcttaccttacataaaaattaactcaagatggaacaaaaacttaaatctaagacctgaaaccacacagattctagaagataaaattggaaaaagtcttctagacattggcttaggcaaagacttcatgaccaggaacccaaaagcaaatgcaacaaaaacaaagatagacatatgggactcaattaaactaaaaagcttctgcacaacaaaagaaatcatcagcagagttaacagataaccacagagtgggagaaaatctttacaatctatacatcttacaaaggactaatatccagaatctaag

SEQ ID NO: 23963 - DNA, 480 bp, Homo sapiens
agaagaattgtgctttaagatgttaagcaaattgcccaaagtgcaaaaccagtgtgttggagcttgaattccaaaccagatctgcctgagtcaagcttttcttttatgttcttatttactaaaggcttcttgaacagaagtatgtgagagttgggcacatgcagcttggtcaattctatgtaaacccggtcagattctgagtagtgtagatctgataaagtcaatgtgaatttcttatcattcgttgcaagagacttaatgtagcaaaaatcagtatcataggaaacgagatgttactgtggtaggcacactgttctctctcagctacctcatttttgttttattgggtggtggctattgctctggcaactacaaaggcagcatttacttgacacggcgtgtatgcttaaggcagaacactgactgcttttcattgctggcaaatccggacttcatcagtactggctacctgtaaggaat

SEQ ID NO: 23964 - DNA, 403 bp, Homo sapiens
gggcattccaactgcaatgggatacagagctagagatgagtagaggagagagatcaaataagatgaagacaaaaggtcaaggaaacaatggacttagccctcacctgtgggagggggcctgtgtattcaggcagataaagatgatgacaccctttactccaactccctgggactcctttcccacactcctcagaagttgctcccccaccatgcaaacacagcccctacaagctgccctgttcccagtaggaacctatttaattaaatggtttgaatcacctggatttcatcaaaagcatatctctttaatgtttttttgtgtgttgttgacaaaactctgagatactctggtgaccaaagtaaaaacactcttaatccacttaacaataaacagattccagtg

SEQ ID NO: 23965 - DNA, 436 bp, Homo sapiens
agagacctttaatctgtataaggtcctgtgacgttcaatggaactgattttcctgaggagttaggaaattggctctgtgacaatctccatagagaagttctttggacaactgtagcagtgataatttccttgaaagaaatacacaacaaaccaagtaaaaacactgtgaagggcttcacttattgatgtatgtgatgggctgaatatgtcccccagaattcatatgttgaaacttaatcaccaatgtgatagtattaagaggtggagcctttaggaagtgattaagtcataaggctagagctctcatgaatgggattagtgaccttataaaagaggtggaaaggagggtcttaggcctgttttgttttgtttttggctttccacctctgccatgtgaagacacagtgttgtcccttgtgtactttttgcccctcct

SEQ ID NO: 23966 - DNA, 765 bp, Homo sapiens
tatcacatgctatggcatgggggaacctgtaggaaattatggtagatgaaataagccagtcacaaagggacaaatactgtataatttcacttatatgaagtataaaaggtaatcaaattcggccggacacagtggctcacgcctgtaatcccagcactttgggaggctgaggtgagtggatcacctgaagtcaggagttcaagaccagcttggccaacatggtgaaaccccatctctaccaaaaatacaaaaattagccaggcgtggtggcgcacacctgtaatcccagctattcaggaagctgagacaggagaatcgcctgaacccaggagacagaggttgcagtgagctgagatcacgccactgcactccagcctgggcaacagagcaagactccatcttaaaaaaaaaggagtcaaattcatagaaacagaaagtaaaatagagattgctggggctgcagggaagggataaggggagttgtttactggatagttttggtttcacaagatgaaaaaagttctggagctatttcataacaatgtgaatgaatatacttaacactactgaactgaacacttaaaaacagttaagataataaatgttgtatgtttttttaccacagtaaaaaaaatatttttgaccacacacagtggctcatgcccataaatcccagcactctgggaggccaaggcagaagaatggcttgaacctaggagttcaagaccagtctaggcaacacagcaagacctcatctctacaaaa

SEQ ID NO: 23967 - DNA, 940 bp, Homo sapiens
ccagggccctgggtggggccggccggtgctcctggggacggagaggccgcaggagagaattcgctccgcgagccctgcgcggacccagctagtccgggccaagccttggcaccgccacccccggctgcgggcagggccggggcgtcctcacgcgccgcgccacccccagtcttcgtgctcgaatactacctggacacactgtggaaggggatgctgctcttcatcatcagcgtggtcctggtcagcttcagctccctgagagaggtgtgagcccctgggcccgacccccaccgccctcctcccctgagggccggccccgcgccgctcagactctccgcgtggcgcccgcaggtgcagaagcaagagacctgggtcttcctcgtgtacggcgtgggcgtgggcctgtggctcgtgatctcgtcgctgccgcggcgccgcctggtgctgaaccacacgcgcggcgtgtaccacttctccatccagggccgcaccgtgtgccagggccccttgcatctggtctacgtgcgcctggcgctcagctccgatgcccacggaaggtgcttcttccacctggtcctcggcggccacaggttggagcccctggtgctggtgcagctgtcggagcactacgagcaaatggaatacttgggccgttacatcgcccggaaactcaacatcaactacttcgactacctggccacctcctaccggcacgtggttcgccactggccaccccctggcgctggcactgtgatgggcaagagccccatgggtcacaagcccagctcctctcagtccagcctggaggtgtgactctgagggcctcccccacctcgggactgtgttctcggtaacctcccagccccactctggggcagatcaaatgtgagtcccactcactggccttcctttcaataaagctgcctcagcttcaaaagga

SEQ ID NO: 23968 - DNA, 428 bp, Homo sapiens
caaatttctacagcaccattttcagaatttcaagatggtttggaggtagtagaatatgtagattaacagggtgactcaggagacagatcggaattaaattttggctccactgtatataagatgtgtaactttggattaaaaaataaacaaaagaaattaatctccttaagcttgttttcacattttttaaatgattagaacagaatacttatctgattgagttattatgatggctggaaataatttaaatgcttttagcaaaatgataggtacatagcactctatttgttaaattgtcagtattatgagcatgatcatgtattctcaactaagaattctgttttccatcttgcctttagagagtcttcaattccccacagagaaattttaaacataaaatcagccattagaaaacatgaccatattat

SEQ ID NO: 23969 - DNA, 1067 bp, Homo sapiens
cttgattactctgcaagtaacaaaactaaagtaaataggtcattcagtttgtattggaatgcttcacattaggataggcagctatgattttaagacaattttagttctttgtgtataagaagtttttgggttttttgaacatttattaacttacaaaggtttgctctaaggcagaatttcttaattacatggagaaacaccttattcttctcttttcaacttattttgtttaaagttttggaagaagattttagttcactgatagaatttcagaacaaaaagagaacaaaaaggataaaatgagaagtagagtctaatcagtgtttagtatttcagttcatgcataaatctgttttgctcgtaaaccacagagaatacagtcccaaagacttgcaggcactcattgcattcagttgtttgcagacgtttcacacccttctttccctctgcttgtgcccacctaacctcagcagcagccaagctgttctggttgatagcaacatctagtgggcaacacagggaggaatatgattagttctgtttttcccccagcagcatcattctgttcttctgcctgagggcatttgccccctctttcttatctggagacattgtttcttagctactttcattcttatcttctctcttatacttagtgcctaggtagttggctccgattaatttttctttatgacctttatgcttccaaaagtgacagattattgactgttaaaatattagtgaatatatacacttggatatacatccaagcagataatattaaatttttgaaggaaaattacacatttttagagccagtaccatcatcttctaatgtaagtatctagaaacccgtgtctgcattaaaaaaaaaaaaaactgcacacgctcctcattcttttctcagtagggttccttttcaagtatgttatgagtcgtgtagttaccttgaaaaacaaaacttttcataagaaaaaaatccctgagttcagacaaccaactttaagcatttagggcaccttattaatatttgtaagtcaggatatgccttcattcataaaatcagg

SEQ ID NO: 23970 - DNA, 509 bp, Homo sapiens
aggtagaggaggtttgtaaggaatagtggtttaatatcacagagctagaagctagtttcagcagaaccagaattagaatctggacttctgtgccttactaagttttattagcattcattgtgtcttactcttttgacttatttaattcactaatggattttaatggtttattggattgtatgctggtgcagttctttgatcttgagcctagctttctctttctccttttttgggaactttattgtgtatgttgtggcatgtttacacacacatcttgctgccttgggttcttgcaagttgtgtgcgtgttttatctgcccctactagcttttaggtgtcttgagagcatgactctggcttactcatctgtctattccagaagaccttgtctgttcttggcatttattaactaattttctaagactgggttgaagtagttgcatgtcaagtttatatcagctgttaaatacctttctggaaaaactggctgtaaaataaactcaaccagg

SEQ ID NO: 23971 - DNA, 778 bp, Homo sapiens
aggtagaggaggtttgtaaggaatagtggtttaatatcacagagctagaagctagtttcagcagaaccagaattagaatctggacttctgtgccttactaagttttattagcattcattgtgtcttactcttttgacttatttaattcactaatggattttaatggtttattggattgtatgctggtgcagttctttgatcttgagcctagctttctctttctccttttttgggaactttattgtgtatgttgtggcatgtttacacacacatcttgctgccttgggttcttgcaagttgtgtgcgtgttttatctgcccctactagcttttaggtgtcttgagagcatgactctggcttactcatctgtctattccagaagaccttgtctgttcttggcatttattaactaattttctaagactgggttgaagtagttgcatgtcaagtttatatcagctgttaaatacctttctggaaaaactggctgtaaaataaactcaaccaggaaaaaaaaaaaaaaacaacaacccgatttttaatagtgtctatccaaccttttttttttaagttgcaagggatccaccagatggaattaagagaactaagcttttatcatctgctggatataatgtgattttgtaaccattattggattggtgttggtttagacagtttattttcagctgactatatagttaattccgggactcttataaagttttttttaaaaagagaaaaagagaagatcaaaagcactggaactcaacgagtaaat

SEQ ID NO: 23972 - DNA, 426 bp, Homo sapiens
aaatattattgtatttttaaaagaacacttcatgaaattacccacagaatagtttaaaattgtgcttttgatacctttctgccctatacgttaagtgacagcagaggaaaagaggtcattcctctgtagcctttgttcttttttgtaaactttacctttgtttctttccctttatgtcatctcccttcatgtaaataattaagaatcaaattcactttaaagataaaattagacttactgtattaatgtattaatcgaggccaggcacggtggctcatgcctgcaatcaatcccagtacttttggaggctgaggcaggcggatcacctgaggtcagaagttcaaggccagcctggccaacatggtgaaaccctgtctctattaatagtacatgggttaggccagggcgcggtggctcatgcctgta

SEQ ID NO: 23973 - DNA, 753 bp, Homo sapiens
ggagagaacagctgaatatgtgtagttcaaaaaagctcatcagaattgttcttaaaagtccccttgcctgcaaaaatattctagaatgctttgtggtgtttttgtttggttggttttgttttgcttttaaatcaattttatagaggtatagtgcacaaacattaaaatacacccattttaagtgtacagttggagttttgataaatgtatttacctatgtaactaccataatcagtacacagaacatgttcatctgctagaaaaattctgtcaggcttctttgttgtcatactccccacaccaccccaggatgaggaaatcactggtctcattatagattagtttcactcattctacaattttatataaatggtctcttacagtatgtactactgtgtatctgcctcccttcctttagcataatgtctttaagattcattcatgttgtttggattcacactttatttttattgtgtgttttatggctgtacaacaatttatccgtttacctgttgaagtataaagcgttgagctcaacgctttatacttcaattttattgttgggaatctacaattgccaagtggttcaaagtcatttcttataccacttcacaatacacacacagatttaggaaacttaaaaaaagttctttaaaaaattctaataggatttaccctattttactggccaagtgtaaacaaataaaccctcaaatgtgcctttctctaattttccttgtacatcttattgac

SEQ ID NO: 23974 - DNA, 420 bp, Homo sapiens
ctcttagtggtattaaatctattcatttatcaaatagattagatttattatttatttgtattattagctacatagtatagaaggtactggggagacttgtaatatggtggggtttgcccacattaggaacacatgtttttcctcatgtttaattttttttgggggggtgtcctttaactatctcgcgtttcagtacatatgccatttcctgtcccaaaggagcacataagtctagtcctaatcttggtgcttgaacccgcagttccagagaaaagcaactggcactgaatgctctctggctcatctttccatccaggatctgtcagctagccaacaggtgtgggaggtgtgttttccaagtttaatgttgctgttagtgggatacaaaagaaataaaagttactatctttggcctcagaa

SEQ ID NO: 23975 - DNA, 363 bp, Homo sapiens
ccaggtttgaagtgctctgctcaccttctacagatagtcttaaccaagctgatgattcaggcttggtggattaaaaagactgtgtcctttcattaagccatacatagtgctccaactgtttcctaaccagggtttccagttcttcagtttgtaatcatttgcaaggacttaaaacttttctttctaaacaaatctaactgtatgggaagatctatcaacaacaggagaggaaaactgctgacttatgggtaacacgacaataacaaatgggccacagggctgtgtgcccaagactcatctttttttttaaagcttgaaaatgaattcctcctgtcttgcacactcaggagggtttactagcag

SEQ ID NO: 23976 - DNA, 677 bp, Homo sapiens
gtcacatcttgcatggcagcagggaagagagagtttgtgtaggggaacacccctttaaaaaaccatcagatcttgtgacactcattcactgtcacgagaacagcacgggaaagacccgcccccatgattcaattacctcccatgacacaagggaagtataggagctacaattcacaatgagatctgggtggggacacagacaaaccatgtcaccgcctaaaaccaactcaatagtctaaggaatttgactggggagaatctggagaggatttaattaatttggcaaaaggattagcaattgaatctaagtgagaaaagagaattcttggaggaaaaaaagatgtttagttacactgagaaattaaaacctgaagtaattgcctttgagatttttttcaggaaatgagtattgattgcctactgtgtgtcaaattatgtgtttcatgtcaaagactccaaagtagataagatataggcccagccttggggagctcattgagtcacagagaaagtttgaatgtttcagaggaatcatcaagaacaggggatcagcaatctattatattttaattgcgtcttttcatgattataaaagcaatgcgtgcgtgctgaagagaatttggaaaaaaaaagaagaaattaaaaatcgtctctgatcctgccaccagaaataacca

SEQ ID NO: 23977 - DNA, 441 bp, Homo sapiens
ggcgacagagtgagcaagatccatctctaaataaataaaaataaattattctattgaatttagaattactttattttttttaatatggaacacttcacaaattttcatgtcatccttgtgcagggaccgtgctaatctctgtatcattccagttttagtatatgtgctgctgaaatgagcatgattgaatccatggtgtctgttttgaattttttaaacttcccatttaaaaaatgtattgatttctgctttgatatttattatttcctttttatctacttactttcagttttacttactcttctttttctagtttcttaagttggaaactgagatcatggattttggaccttttttttttgaaatggagtcttactctgtcgcccaggctggagtgcagtggcacgatctcatccactgcaacctccacctcccaggttt

SEQ ID NO: 23978 - DNA, 203 bp, Homo sapiens
acttcctcagcctctggtgttatcaatattttgcaccaaagtggtacatttattacaacctataaaccttcattggtacaccattatcccccaaagtccatagtttacattagggttcactcttggtgttgtatattctatggagttggacaaatatgtagtgatgtgtctacattatagtgtcatacaagagagtttcactg

SEQ ID NO: 23979 - DNA, 2622 bp, Homo sapiens
gcagggagcgggaggcggaagtgccgcgggctgccgcctccgtcccggctgcggcccctgccggttacataactcgttgcgggctccgcgcggtcccacttcccggctcccttcgcctccaggatgcgctgagccctacaacacccccagcggccgccggctcccccacgaggtgtgaatgacagaggtggtgccatccagcgcgctcagcgaggtcagcctgcgcctcctctgccacgatgacatagacactgtgaagcacctgtgtggcgactggttccccatcgagtacccagactcatggtatcgtgatatcacatccaacaagaagttcttttcccttgctgcaacctacagaggtgccattgtgggaatgatagtagctgaaattaagaacaggaccaaaatacataaagaggatggagatattctagcatccaacttctctgttgacacacaagtcgcgtacatcctaagtctgggcgtcgtgaaagagttcaggaagcacggcataggttccctcttacttgaaagtttaaaggatcacatatcaaccaccgcccaggaccactgcaaagccatttacctgcatgtcctcaccaccaacaacacagcaataaacttctatgaaaacagagacttcaagcagcaccactatctcccctattactactccattcgaggggtcctcaaagatggcttcacctatgtcctctacatcaacggcgggcaccctccctggacgattttggactacatccagcacctgggctctgcactagccagcctgagcccctgctccattccgcacagagtctaccgccaggcccacagcctgctctgcagcttcctgccatggtcgggcatctcttccaagagtggcatcgagtacagccggaccatgtgatgtcggctgggcagccgccaccaggccccacccttcagccgcccgcagagcccgccttcctgtccatctgaccccttctgttttctgcaaggagctgccagccatctaactgggctcgtcggcctgccccagctgcaggcccggtgctacacgggctcgggaacagaacatcgtgggcatgcgcagagcatgcccatccgtggcaggtacgccacagcagacacaaaggctcttcagctcccctccctgcttctggaaacctctgcctgctgccctggccctgcccccctgcgcatgcaccatccccagggctgacccagtgtggctgcattcactgggaggggcctgccctcactgggcctctcccactccgctgcctgttcttgcagctccttcctggaaagctggaggggactttctcctgcaagggaggaacgcaagtattatggacacacttgaccgtaaaggcacaggagcctcggaacaagggggcgcaataaagggaatggcccgtccccttccagaaccagcccaaagaagcctggggggtgaggagtggcccccactcctccatgaggggctgatgaggggtgggcagcctgggggaggctttcctcgcaagcacagagctctgaggctcagccccctggcacaggcggtcacgcatcaggacggttcctactcctcagcaccttccgtgcagttaccagtgccctgggaggtcacactgcccgtcggaccttggcatgctccattcagctgacctgctgaggacaggcatcgccgagactccttgggtcctccccgccctccctcatgctgccacaagctgctgctccaaggcctggccacatgcagacaggaggaagctgagctcgacattaggcctcaaggctgccatctgtcttgtagggcctggccttgtgggcagggggcagtcctgtgccttgtgggccctcagcctctgagggcagagatgctgtcagtgccgcaggtgcatcacatacttctagcatcctctccaccctgcattccaaatgctgcttgctgcctgccctgccctccgatgcaggggtggggtggggggcggagtcccgcccagcatagctgcagtgtcacaaagccatggcagagggtcctagcggcgccaccctgccccagcctgaggaggagggagagggaggaacaaccctgggcagacggggtctcagggacctgtgtccttccgcctccagagctgcccagccacgggctctcagggtgctggggcagccccaggtcccctcttgaactcagctggggccaggggccctcagaatgaaggcaggcaccaggcaggagcagcatccccctccttgacggtgctggcaggagggccgcgccatgctgactgcttgaacctctgctgacctgacagtgctggcgggagggccgcaccatgctgactgcctgaatctctgctgaggctgcctgcctgccgggcccagctcagcgccctctccactgcgaatcagtggcgatcatgtgatttctatttctgccccacagggtaagggacgagtcttctggaaggctctgccatggacatttgtcctcgggctcagaggccccaccctgccccacacctgcccctaatcactgcagtgtccagcccagtgttgaacagattgtagcgttctgtctcattacgagcaaataaatagactttcattgga

SEQ ID NO: 23980 - DNA, 803 bp, Homo sapiens
  misc_feature (703)..(703): n is a, c, g, or t
  misc_feature (767)..(767): n is a, c, g, or t
  misc_feature (771)..(771): n is a, c, g, or t
gcagggagcgggaggcggaagtgccgcgggctgccgcctccgtcccggctgcggcccctgccggttacataactcgttgcgggctccgcgcggtcccacttcccggctcccttcgcctccaggatgcgctgagccctacaacacccccagcggccgccggctcccccacgaggtgtgaatgacagaggtggtgccatccagcgcgctcagcgaggtcagcctgcgcctcctctgccacgatgacatagacactgtgaagcacctgtgtggcgactggttccccatcgagtacccagactcatggtatcgtgatatcacatccaacaagaagttcttttcccttgctgcaacctacagaggtgccattgtgggaatgatagtagctgaaattaagaacaggaccaaaatacataaagaggatggagatattctagcatccaacttctctgttgacacacaagtcgcgtacatcctaagtctgggcgtcgtgaaagagttcaggaagcacggcataggttccctcttacttgaaagtttaaaggatcacatatcaaccaccgcccaggaccactgcaaagccatttacctgcatgtcctcaccaccaacaacacagcaataaacttctatgaaaacagagacttcaagcagcaccactatctcccctattactactccattccaaaggggttcctccaaaaaatnggcttccaccctaatgttcctccttacattcaaaccggggggggggcaacccctccccttgggnaacnaatttttggggaacttaacattcccaagccaa

SEQ ID NO: 23981 - DNA, 164 bp, Homo sapiens
aattcaagcttctaacgatgtacggggacatggacatttgtcctcgggctcagaggccccaccctgccccacacctgcccctaatcactgcagtgtccagcccagtgttgaacagattgtagcgttctgtctcattacgagcaaataaatagactttcattgga

SEQ ID NO: 23982 - DNA, 2600 bp, Homo sapiens
gcagggagcgggaggcggaagtgccgcgggctgccgcctccgtcccggctgcggcccctgccggttacataactcgttgcgggctccgcgcggtcccacttcccggctcccttcgcctccaggatgcgctgagccctacaacacccccagcggccgccggctcccccacgaggtgtgaatgacagaggtggtgccatccagcgcgctcagcgaggtcagcctgcgcctcctctgccacgatgacatagacactgtgaagcacctgtgtggcgactggttccccatcgagtacccagactcatggtatcgtgatatcacatccaacaagaagttcttttcccttgctgcaacctacagaggtgccattgtgggaatgatagtagctgaaattaagaacaggaccaaaatacataaagaggatggagatattctagcatccaacttctctgttgacacacaagtcgcgtacatcctaagtctgggcgtcgtgaaagagttcaggaagcacggcataggttccctcttacttgaaagtttaaaggatcacatatcaaccaccgcccaggaccactgcaaagccatttacctgcatgtcctcaccaccaacaacacagcaataaacttctatgaaaacagagacttcaagcagcaccactatctcccctattactactccattcgaggggtcctcaaagatggcttcacctatgtcctctacatcaacggcgggcaccctccctggacgattttggactacatccagcacctgggctctgcactagccagcctgagcccctgctccattccgcacagagtctaccgccaggcccacagcctgctctgcagcttcctgccatggtcgggcatctcttccaagagtggcatcgagtacagccggaccatgtgatgtcggctgggcagccgccaccaggccccacccttcagccgcccgcagagcccgccttcctgtccatctgaccccttctgttttctgcaaggagctgccagccatctaactgggctcgtcggcctgccccagctgcaggcccggtgctacacgggctcgggaacagaacatcgtgggcatgcgcagagcatgcccatccgtggcaggctcttcagctcccctccctgcttctggaaacctctgcctgctgccctggccctgcccccctgcgcatgcaccatccccagggctgacccagtgtggctgcattcactgggaggggcctgccctcactgggcctctcccactccgctgcctgttcttgcagctccttcctggaaagctggaggggactttctcctgcaagggaggaacgcaagtattatggacacacttgaccgtaaaggcacaggagcctcggaacaagggggcgcaataaagggaatggcccgtccccttccagaaccagcccaaagaagcctggggggtgaggagtggcccccactcctccatgaggggctgatgaggggtgggcagcctgggggaggctttcctcgcaagcacagagctctgaggctcagccccctggcacaggcggtcacgcatcaggacggttcctactcctcagcaccttccgtgcagttaccagtgccctgggaggtcacactgcccgtcggaccttggcatgctccattcagctgacctgctgaggacaggcatcgccgagactccttgggtcctccccgccctccctcatgctgccacaagctgctgctccaaggcctggccacatgcagacaggaggaagctgagctcgacattaggcctcaaggctgccatctgtcttgtagggcctggccttgtgggcagggggcagtcctgtgccttgtgggccctcagcctctgagggcagagatgctgtcagtgccgcaggtgcatcacatacttctagcatcctctccaccctgcattccaaatgctgcttgctgcctgccctgccctccgatgcaggggtggggtggggggcggagtcccgcccagcatagctgcagtgtcacaaagccatggcagagggtcctagcggcgccaccctgccccagcctgaggaggagggagagggaggaacaaccctgggcagacggggtctcagggacctgtgtccttccgcctccagagctgcccagccacgggctctcagggtgctggggcagccccaggtcccctcttgaactcagctggggccaggggccctcagaatgaaggcaggcaccaggcaggagcagcatccccctccttgacggtgctggcaggagggccgcgccatgctgactgcttgaacctctgctgacctgacagtgctggcgggagggccgcaccatgctgactgcctgaatctctgctgaggctgcctgcctgccgggcccagctcagcgccctctccactgcgaatcagtggcgatcatgtgatttctatttctgccccacagggtaagggacgagtcttctggaaggctctgccatggacatttgtcctcgggctcagaggccccaccctgccccacacctgcccctaatcactgcagtgtccagcccagtgttgaacagattgtagcgttctgtctcattacgagcaaataaatagactttcattgga

SEQ ID NO: 23983 - DNA, 2771 bp, Homo sapiens
gggggtctcctccgtgagctccgggcctgtttgcctgctgaagtagagtcttagggtgaccccaggggacgtaatgtttccgagaagaaggacagaaagaagactgggagacaccggaactcgaaagaaaatcgatggtactgccttttaaggtctattacttaaacataagtatggctctggttcttaccgcctttaccgtatccttcatgggaagttgatactgatcggaaactgacacagagccttctcacctacactaagggggcctagcatacagaaaggctgtacctggaggaaggaagtgcggagccagcctgagttgggagaagagctccagagagtgtgaatgacagaggtggtgccatccagcgcgctcagcgaggtcagcctgcgcctcctctgccacgatgacatagacactgtgaagcacctgtgtggcgactggttccccatcgagtacccagactcatggtatcgtgatatcacatccaacaagaagttcttttcccttgctgcaacctacagaggtgccattgtgggaatgatagtagctgaaattaagaacaggaccaaaatacataaagaggatggagatattctagcatccaacttctctgttgacacacaagtcgcgtacatcctaagtctgggcgtcgtgaaagagttcaggaagcacggcataggttccctcttacttgaaagtttaaaggatcacatatcaaccaccgcccaggaccactgcaaagccatttacctgcatgtcctcaccaccaacaacacagcaataaacttctatgaaaacagagacttcaagcagcaccactatctcccctattactactccattcgaggggtcctcaaagatggcttcacctatgtcctctacatcaacggcgggcaccctccctggacgattttggactacatccagcacctgggctctgcactagccagcctgagcccctgctccattccgcacagagtctaccgccaggcccacagcctgctctgcagcttcctgccatggtcgggcatctcttccaagagtggcatcgagtacagccggaccatgtgatgtcggctgggcagccgccaccaggccccacccttcagccgcccgcagagcccgccttcctgtccatctgaccccttctgttttctgcaaggagctgccagccatctaactgggctcgtcggcctgccccagctgcaggcccggtgctacacgggctcgggaacagaacatcgtgggcatgcgcagagcatgcccatccgtggcaggctcttcagctcccctccctgcttctggaaacctctgcctgctgccctggccctgcccccctgcgcatgcaccatccccagggctgacccagtgtggctgcattcactgggaggggcctgccctcactgggcctctcccactccgctgcctgttcttgcagctccttcctggaaagctggaggggactttctcctgcaagggaggaacgcaagtattatggacacacttgaccgtaaaggcacaggagcctcggaacaagggggcgcaataaagggaatggcccgtccccttccagaaccagcccaaagaagcctggggggtgaggagtggcccccactcctccatgaggggctgatgaggggtgggcagcctgggggaggctttcctcgcaagcacagagctctgaggctcagccccctggcacaggcggtcacgcatcaggacggttcctactcctcagcaccttccgtgcagttaccagtgccctgggaggtcacactgcccgtcggaccttggcatgctccattcagctgacctgctgaggacaggcatcgccgagactccttgggtcctccccgccctccctcatgctgccacaagctgctgctccaaggcctggccacatgcagacaggaggaagctgagctcgacattaggcctcaaggctgccatctgtcttgtagggcctggccttgtgggcagggggcagtcctgtgccttgtgggccctcagcctctgagggcagagatgctgtcagtgccgcaggtgcatcacatacttctagcatcctctccaccctgcattccaaatgctgcttgctgcctgccctgccctccgatgcaggggtggggtggggggcggagtcccgcccagcatagctgcagtgtcacaaagccatggcagagggtcctagcggcgccaccctgccccagcctgaggaggagggagagggaggaacaaccctgggcagacggggtctcagggacctgtgtccttccgcctccagagctgcccagccacgggctctcagggtgctggggcagccccaggtcccctcttgaactcagctggggccaggggccctcagaatgaaggcaggcaccaggcaggagcagcatccccctccttgacggtgctggcaggagggccgcgccatgctgactgcttgaacctctgctgacctgacagtgctggcgggagggccgcaccatgctgactgcctgaatctctgctgaggctgcctgcctgccgggcccagctcagcgccctctccactgcgaatcagtggcgatcatgtgatttctatttctgccccacagggtaagggacgagtcttctggaaggctctgccatggacatttgtcctcgggctcagaggccccaccctgccccacacctgcccctaatcactgcagtgtccagcccagtgttgaacagattgtagcgttctgtctcattacgagcaaataaatagactttcattgga

SEQ ID NO: 23984 - DNA, 2632 bp, Homo sapiens
gggggtctcctccgtgagctccgggcctgtttgcctgctgaagtagagtcttagggtgaccccaggggacgtaatgtttccgagaagaaggacagaaagaagactgggagacaccggaactcgaaagaaaatcgcatacagaaaggctgtacctggaggaaggaagtgcggagccagcctgagttgggagaagagctccagagagtgtgaatgacagaggtggtgccatccagcgcgctcagcgaggtcagcctgcgcctcctctgccacgatgacatagacactgtgaagcacctgtgtggcgactggttccccatcgagtacccagactcatggtatcgtgatatcacatccaacaagaagttcttttcccttgctgcaacctacagaggtgccattgtgggaatgatagtagctgaaattaagaacaggaccaaaatacataaagaggatggagatattctagcatccaacttctctgttgacacacaagtcgcgtacatcctaagtctgggcgtcgtgaaagagttcaggaagcacggcataggttccctcttacttgaaagtttaaaggatcacatatcaaccaccgcccaggaccactgcaaagccatttacctgcatgtcctcaccaccaacaacacagcaataaacttctatgaaaacagagacttcaagcagcaccactatctcccctattactactccattcgaggggtcctcaaagatggcttcacctatgtcctctacatcaacggcgggcaccctccctggacgattttggactacatccagcacctgggctctgcactagccagcctgagcccctgctccattccgcacagagtctaccgccaggcccacagcctgctctgcagcttcctgccatggtcgggcatctcttccaagagtggcatcgagtacagccggaccatgtgatgtcggctgggcagccgccaccaggccccacccttcagccgcccgcagagcccgccttcctgtccatctgaccccttctgttttctgcaaggagctgccagccatctaactgggctcgtcggcctgccccagctgcaggcccggtgctacacgggctcgggaacagaacatcgtgggcatgcgcagagcatgcccatccgtggcaggctcttcagctcccctccctgcttctggaaacctctgcctgctgccctggccctgcccccctgcgcatgcaccatccccagggctgacccagtgtggctgcattcactgggaggggcctgccctcactgggcctctcccactccgctgcctgttcttgcagctccttcctggaaagctggaggggactttctcctgcaagggaggaacgcaagtattatggacacacttgaccgtaaaggcacaggagcctcggaacaagggggcgcaataaagggaatggcccgtccccttccagaaccagcccaaagaagcctggggggtgaggagtggcccccactcctccatgaggggctgatgaggggtgggcagcctgggggaggctttcctcgcaagcacagagctctgaggctcagccccctggcacaggcggtcacgcatcaggacggttcctactcctcagcaccttccgtgcagttaccagtgccctgggaggtcacactgcccgtcggaccttggcatgctccattcagctgacctgctgaggacaggcatcgccgagactccttgggtcctccccgccctccctcatgctgccacaagctgctgctccaaggcctggccacatgcagacaggaggaagctgagctcgacattaggcctcaaggctgccatctgtcttgtagggcctggccttgtgggcagggggcagtcctgtgccttgtgggccctcagcctctgagggcagagatgctgtcagtgccgcaggtgcatcacatacttctagcatcctctccaccctgcattccaaatgctgcttgctgcctgccctgccctccgatgcaggggtggggtggggggcggagtcccgcccagcatagctgcagtgtcacaaagccatggcagagggtcctagcggcgccaccctgccccagcctgaggaggagggagagggaggaacaaccctgggcagacggggtctcagggacctgtgtccttccgcctccagagctgcccagccacgggctctcagggtgctggggcagccccaggtcccctcttgaactcagctggggccaggggccctcagaatgaaggcaggcaccaggcaggagcagcatccccctccttgacggtgctggcaggagggccgcgccatgctgactgcttgaacctctgctgacctgacagtgctggcgggagggccgcaccatgctgactgcctgaatctctgctgaggctgcctgcctgccgggcccagctcagcgccctctccactgcgaatcagtggcgatcatgtgatttctatttctgccccacagggtaagggacgagtcttctggaaggctctgccatggacatttgtcctcgggctcagaggccccaccctgccccacacctgcccctaatcactgcagtgtccagcccagtgttgaacagattgtagcgttctgtctcattacgagcaaataaatagactttcattgga

SEQ ID NO: 23985 - DNA, 3005 bp, Homo sapiens
gcagggagcgggaggcggaagtgccgcgggctgccgcctccgtcccggctgcggcccctgccggttacataactcgttgcgggctccgcgcggtcccacttcccggctcccttcgcctccaggatgcgctgagccctacaacacccccagcggccgccggctcccccacgaggtgtgaatgacagaggtggtgccatccagcgcgctcagcgaggtcagcctgcgcctcctctgccacgatgacatagacactgtgaagcacctgtgtggcgactggttccccatcgagtacccagactcatggtatcgtgatatcacatccaacaagaagttcttttcccttgctgcaacctacagaggtgccattgtgggaatgatagtagctgaaattaagaacaggaccaaaatacataaagaggatggagatattctagcatccaacttctctgttgacacacaagtcgcgtacatcctaagtctgggcgtcgtgaaagagttcaggaagcacggcataggttccctcttacttgaaagtttaaaggatcacatatcaaccaccgcccaggaccactgcaaagccatttacctgcatgtcctcaccaccaacaacacagcaataaacttctatgaaaacagagacttcaagcagcaccactatctcccctattactactccattcgaggggtcctcaaagatggcttcacctatgtcctctacatcaacggcgggcaccctccctggacgattttggactacatccagcacctgggctctgcactagccagcctgagcccctgctccattccgcacagagtctaccgccaggcccacagcctgctctgcagcttcctgccatggtcgggcatctcttccaagagtggcatcgagtacagccggaccatgtgatgtcggctgggcagccgccaccaggccccacccttcagccgcccgcagagcccgccttcctgtccatctgaccccttctgttttctgcaaggagctgccagccatctaactgggctcgtcggcctgccccagctgcaggcccggtgctacacgggctcgggaacagaacatcgtgggcatgcgcagagcatgcccatccgtggcaggtacgccacagcagacacaaaggtatgggagcttggtgcctccagccacaaaagcggaaggccctggatgggcacagagaacggcagagccggaaggggccgtggggactgcagagtccaccaccttatgcaccagcacagcccagaggtttggtgacttgtgccaagctaacacagcaggctccatggcaactgggctgtgcacccgactttggatccatcagtgcctttatttgtgtggggaccgagaggcgcctagtggctgcaggcagacaccatggcctggagaagggctcatgctcctggagcacccaggcccagctgtgtggcccataggcagggtgtggggtgggcagagtgtctccgccgggccttcaccctgccctgctcttctctttcccacaggctcttcagctcccctccctgcttctggaaacctctgcctgctgccctggccctgcccccctgcgcatgcaccatccccagggctgacccagtgtggctgcattcactgggaggggcctgccctcactgggcctctcccactccgctgcctgttcttgcagctccttcctggaaagctggaggggactttctcctgcaagggaggaacgcaagtattatggacacacttgaccgtaaaggcacaggagcctcggaacaagggggcgcaataaagggaatggcccgtccccttccagaaccagcccaaagaagcctggggggtgaggagtggcccccactcctccatgaggggctgatgaggggtgggcagcctgggggaggctttcctcgcaagcacagagctctgaggctcagccccctggcacaggcggtcacgcatcaggacggttcctactcctcagcaccttccgtgcagttaccagtgccctgggaggtcacactgcccgtcggaccttggcatgctccattcagctgacctgctgaggacaggcatcgccgagactccttgggtcctccccgccctccctcatgctgccacaagctgctgctccaaggcctggccacatgcagacaggaggaagctgagctcgacattaggcctcaaggctgccatctgtcttgtagggcctggccttgtgggcagggggcagtcctgtgccttgtgggccctcagcctctgagggcagagatgctgtcagtgccgcaggtgcatcacatacttctagcatcctctccaccctgcattccaaatgctgcttgctgcctgccctgccctccgatgcaggggtggggtggggggcggagtcccgcccagcatagctgcagtgtcacaaagccatggcagagggtcctagcggcgccaccctgccccagcctgaggaggagggagagggaggaacaaccctgggcagacggggtctcagggacctgtgtccttccgcctccagagctgcccagccacgggctctcagggtgctggggcagccccaggtcccctcttgaactcagctggggccaggggccctcagaatgaaggcaggcaccaggcaggagcagcatccccctccttgacggtgctggcaggagggccgcgccatgctgactgcttgaacctctgctgacctgacagtgctggcgggagggccgcaccatgctgactgcctgaatctctgctgaggctgcctgcctgccgggcccagctcagcgccctctccactgcgaatcagtggcgatcatgtgatttctatttctgccccacagggtaagggacgagtcttctggaaggctctgccatggacatttgtcctcgggctcagaggccccaccctgccccacacctgcccctaatcactgcagtgtccagcccagtgttgaacagattgtagcgttctgtctcattacgagcaaataaatagactttcattgga

SEQ ID NO: 23986 - DNA, 2893 bp, Homo sapiens
gcagggagcgggaggcggaagtgccgcgggctgccgcctccgtcccggctgcggcccctgccggttacataactcgttgcgggctccgcgcggtcccacttcccggctcccttcgcctccaggatgcgctgagccctacaacacccccagcggccgccggctcccccacgaggtgtgaatgacagaggtggtgccatccagcgcgctcagcgaggtcagcctgcgcctcctctgccacgatgacatagacactgtgaagcacctgtgtggcgactggttccccatcgagtacccagactcatggtatcgtgatatcacatccaacaagaagttcttttcccttgctgcaacctacagaggtgccattgtgggaatgatagtagctgaaattaagaacaggaccaaaatacataaagaggatggagatattctagcatccaacttctctgttgacacacaagtcgcgtacatcctaagtctgggcgtcgtgaaagagttcaggaagcacggcataggttccctcttacttgaaagtttaaaggatcacatatcaaccaccgcccaggaccactgcaaagccatttacctgcatgtcctcaccaccaacaacacagcaataaacttctatgaaaacagagacttcaagcagcaccactatctcccctattactactccattcgaggggtcctcaaagatggcttcacctatgtcctctacatcaacggcgggcaccctccctggacgattttggactacatccagcacctgggctctgcactagccagcctgagcccctgctccattccgcacagagtctagccccacccttcagccgcccgcagagcccgccttcctgtccatctgaccccttctgttttctgcaaggagctgccagccatctaactgggctcgtcggcctgccccagctgcaggcccggtgctacacgggctcgggaacagaacatcgtgggcatgcgcagagcatgcccatccgtggcaggtacgccacagcagacacaaaggtatgggagcttggtgcctccagccacaaaagcggaaggccctggatgggcacagagaacggcagagccggaaggggccgtggggactgcagagtccaccaccttatgcaccagcacagcccagaggtttggtgacttgtgccaagctaacacagcaggctccatggcaactgggctgtgcacccgactttggatccatcagtgcctttatttgtgtggggaccgagaggcgcctagtggctgcaggcagacaccatggcctggagaagggctcatgctcctggagcacccaggcccagctgtgtggcccataggcagggtgtggggtgggcagagtgtctccgccgggccttcaccctgccctgctcttctctttcccacaggctcttcagctcccctccctgcttctggaaacctctgcctgctgccctggccctgcccccctgcgcatgcaccatccccagggctgacccagtgtggctgcattcactgggaggggcctgccctcactgggcctctcccactccgctgcctgttcttgcagctccttcctggaaagctggaggggactttctcctgcaagggaggaacgcaagtattatggacacacttgaccgtaaaggcacaggagcctcggaacaagggggcgcaataaagggaatggcccgtccccttccagaaccagcccaaagaagcctggggggtgaggagtggcccccactcctccatgaggggctgatgaggggtgggcagcctgggggaggctttcctcgcaagcacagagctctgaggctcagccccctggcacaggcggtcacgcatcaggacggttcctactcctcagcaccttccgtgcagttaccagtgccctgggaggtcacactgcccgtcggaccttggcatgctccattcagctgacctgctgaggacaggcatcgccgagactccttgggtcctccccgccctccctcatgctgccacaagctgctgctccaaggcctggccacatgcagacaggaggaagctgagctcgacattaggcctcaaggctgccatctgtcttgtagggcctggccttgtgggcagggggcagtcctgtgccttgtgggccctcagcctctgagggcagagatgctgtcagtgccgcaggtgcatcacatacttctagcatcctctccaccctgcattccaaatgctgcttgctgcctgccctgccctccgatgcaggggtggggtggggggcggagtcccgcccagcatagctgcagtgtcacaaagccatggcagagggtcctagcggcgccaccctgccccagcctgaggaggagggagagggaggaacaaccctgggcagacggggtctcagggacctgtgtccttccgcctccagagctgcccagccacgggctctcagggtgctggggcagccccaggtcccctcttgaactcagctggggccaggggccctcagaatgaaggcaggcaccaggcaggagcagcatccccctccttgacggtgctggcaggagggccgcgccatgctgactgcttgaacctctgctgacctgacagtgctggcgggagggccgcaccatgctgactgcctgaatctctgctgaggctgcctgcctgccgggcccagctcagcgccctctccactgcgaatcagtggcgatcatgtgatttctatttctgccccacagggtaagggacgagtcttctggaaggctctgccatggacatttgtcctcgggctcagaggccccaccctgccccacacctgcccctaatcactgcagtgtccagcccagtgttgaacagattgtagcgttctgtctcattacgagcaaataaatagactttcattgga

SEQ ID NO: 23987 - DNA, 2661 bp, Homo sapiens
gcagggagcgggaggcggaagtgccgcgggctgccgcctccgtcccggctgcggcccctgccggttacataactcgttgcgggctccgcgcggtcccacttcccggctcccttcgcctccaggatgcgctgagccctacaacacccccagcggccgccggctcccccacgaggtgtgaatgacagaggtggtgccatccagcgcgctcagcgaggtcagcctgcgcctcctctgccacgatgacatagacactgtgaagcacctgtgtggcgactggttccccatcgagtacccagactcatggtatcgtgatatcacatccaacaagaagttcttttcccttgctgcaacctacagaggtgccattgtgggaatgatagtagctgaaattaagaacaggaccaaaatacataaagaggatggagatattctagcatccaacttctctgttgacacacaagtcgcgtacatcctaagtctgggcgtcgtgaaagagttcaggaagcacggcataggttccctcttacttgaaagtttaaaggatcacatatcaaccaccgcccaggaccactgcaaagccatttacctgcatgtcctcaccaccaacaacacagcaataaacttctatgaaaacagagacttcaagcagcaccactatctcccctattactactccattcgaggggtcctcaaagatggcttcacctatgtcctctacatcaacggcgggcaccctccctggacgattttggactacatccagcacctgggctctgcactagccagcctgagcccctgctccattccgcacagagtctaccgccaggcccacagcctgctctgcagcttcctgccatggtcgggcatctcttccaagagtggcatcgagtacagccggaccatgtgatgtcggctgggcagccgccaccaggccccacccttcagccgcccgcagagcccgccttcctgtccatctgaccccttctgttttctgcaaggagctgccagccatctaactgggctcgtcggcctgccccagctgcaggcccggtgctacacgggctcgggaacagaacatcgtgggcatgcgcagagcatgcccatccgtggcaggctcttcagctcccctccctgcttctggaaacctctgcctgctgccctggccctgcccccctgcgcatgcaccatccccagggctgacccagtgtggctgcattcactgggaggggcctgccctcactgggcctctcccactccgctgcctgttcttgcagctccttcctggaaagctggaggggactttctcctgcaagggaggaacgcaagtattatggacacacttgaccgtaaaggcacaggagcctcggaacaagggggcgcaataaagggaatggcccgtccccttccagaaccagcccaaagaagcctggggggtgaggagtggcccccactcctccatgaggggctgatgaggggtgggcagcctgggggaggctttcctcgcaagcacagagctctgaggctcagccccctggcacaggcggtcacgcatcaggacggttcctactcctcagcaccttccgtgcagttaccagtgccctgggaggtcacactgcccgtcggaccttggcatgctccattcagctgacctgctgaggacaggcatcgccgagactccttgggtcctccccgccctccctcatgctgccacaagctgctgctccaaggcctggccacatgcagacaggaggaagctgagctcgacattaggcctcaaggctgccatctgtcttgtagggcctggccttgtgggcagggggcagtcctgtgccttgtgggccctcagcctctgagggcagagatgctgtcagtgccgcaggtgcatcacatacttctagcatcctctccaccctgcattccaaatgctgcttgctgcctgccctgccctccgatgcaggggtggggtggggggcggagtcccgcccagcatagctgcagtgtcacaaagccatggcagagggtcctagcggcgccaccctgccccagcctgaggaggagggagagggaggaacaaccctgggcagacggggtctcagggacctgtgtccttccgcctccagagctgcccagccacgggctctcagggtgctggggcagccccaggtcccctcttgaactcagctggggccaggggccctcagaatgaaggcaggcaccaggcaggagcagcatccccctccttgacggtgctggcaggagggccgcgccatgctgactgcttgaacctctgctgacctgacagtgctggcgggagggccgcaccatgctgactgcctgaatctctgctgaggctgcctgcctgccgggcccagctcagcgccctctccactgcgaatcagtggcgatcatgtgatttctatttctgccccacagggtaagggacgagtcttctggaaggctctgccatggacatttgtcctcgggctcagaggccccaccctgccccacacctgcccctaatcactgcagtgtccagcccagtgttgaacagattgtagcgttctgtctcattacgagcaaataaatagactttcattggaaaaaaaaaccaaaaaaaattacaaacaaaaggggggggtctttgggggggggggaaaggga

SEQ ID NO: 23988 - DNA, 2360 bp, Homo sapiens
  misc_feature (29)..(29): n is a, c, g, or t
aaccttcactaattgtattttgcttggtnccgccgttctctttacgaggtacccagactcatggtatcgtgatatcacatccaacaagaagttcttttcccttgctgcaacctacagaggtgccattgtgggaatgatagtagctgaaattaagaacaggaccaaaatacataaagaggatggagatattctagcatccaacttctctgttgacacacaagtcgcgtacatcctaagtctgggcgtcgtgaaagagttcaggaagcacggcataggttccctcttacttgaaagtttaaaggatcacatatcaaccaccgcccaggaccactgcaaagccatttacctgcatgtcctcaccaccaacaacacagcaataaacttctatgaaaacagagacttcaagcagcaccactatctcccctattactactccattcgaggggtcctcaaagatggcttcacctatgtcctctacatcaacggcgggcaccctccctggacgattttggactacatccagcacctgggctctgcactagccagcctgagcccctgctccattccgcacagagtctaccgccaggcccacagcctgctctgcagcttcctgccatggtcgggcatctcttccaagagtggcatcgagtacagccggaccatgtgatgtcggctgggcagccgccaccaggccccacccttcagccgcccgcagagcccgccttcctgtccatctgaccccttctgttttctgcaaggagctgccagccatctaactgggctcgtcggcctgccccagctgcaggcccggtgctacacgggctcgggaacagaacatcgtgggcatgcgcagagcatgcccatccgtggcaggctcttcagctcccctccctgcttctggaaacctctgcctgctgccctggccctgcccccctgcgcatgcaccatccccagggctgacccagtgtggctgcattcactgggaggggcctgccctcactgggcctctcccactccgctgcctgttcttgcagctccttcctggaaagctggaggggactttctcctgcaagggaggaacgcaagtattatggacacacttgaccgtaaaggcacaggagcctcggaacaagggggcgcaataaagggaatggcccgtccccttccagaaccagcccaaagaagcctggggggtgaggagtggcccccactcctccatgaggggctgatgaggggtgggcagcctgggggaggctttcctcgcaagcacagagctctgaggctcagccccctggcacaggcggtcacgcatcaggacggttcctactcctcagcaccttccgtgcagttaccagtgccctgggaggtcacactgcccgtcggaccttggcatgctccattcagctgacctgctgaggacaggcatcgccgagactccttgggtcctccccgccctccctcatgctgccacaagctgctgctccaaggcctggccacatgcagacaggaggaagctgagctcgacattaggcctcaaggctgccatctgtcttgtagggcctggccttgtgggcagggggcagtcctgtgccttgtgggccctcagcctctgagggcagagatgctgtcagtgccgcaggtgcatcacatacttctagcatcctctccaccctgcattccaaatgctgcttgctgcctgccctgccctccgatgcaggggtggggtggggggcggagtcccgcccagcatagctgcagtgtcacaaagccatggcagagggtcctagcggcgccaccctgccccagcctgaggaggagggagagggaggaacaaccctgggcagacggggtctcagggacctgtgtccttccgcctccagagctgcccagccacgggctctcagggtgctggggcagccccaggtcccctcttgaactcagctggggccaggggccctcagaatgaaggcaggcaccaggcaggagcagcatccccctccttgacggtgctggcaggagggccgcgccatgctgactgcttgaacctctgctgacctgacagtgctggcgggagggccgcaccatgctgactgcctgaatctctgctgaggctgcctgcctgccgggcccagctcagcgccctctccactgcgaatcagtggcgatcatgtgatttctatttctgccccacagggtaagggacgagtcttctggaaggctctgccatggacatttgtcctcgggctcagaggccccaccctgccccacacctgcccctaatcactgcagtgtccagcccagtgttgaacagattgtagcgttctgtctcattacgagcaaataaatagactttcattgga

SEQ ID NO: 23989 - DNA, 2263 bp, Homo sapiens
  misc_feature (17)..(17): n is a, c, g, or t
tgatctagaggatctgnatcacgtgccattgtgggaatgatagtagctgaaattaagaacaggaccaaaatacataaagaggatggagatattctagcatccaacttctctgttgacacacaagtcgcgtacatcctaagtctgggcgtcgtgaaagagttcaggaagcacggcataggttccctcttacttgaaagtttaaaggatcacatatcaaccaccgcccaggaccactgcaaagccatttacctgcatgtcctcaccaccaacaacacagcaataaacttctatgaaaacagagacttcaagcagcaccactatctcccctattactactccattcgaggggtcctcaaagatggcttcacctatgtcctctacatcaacggcgggcaccctccctggacgattttggactacatccagcacctgggctctgcactagccagcctgagcccctgctccattccgcacagagtctaccgccaggcccacagcctgctctgcagcttcctgccatggtcgggcatctcttccaagagtggcatcgagtacagccggaccatgtgatgtcggctgggcagccgccaccaggccccacccttcagccgcccgcagagcccgccttcctgtccatctgaccccttctgttttctgcaaggagctgccagccatctaactgggctcgtcggcctgccccagctgcaggcccggtgctacacgggctcgggaacagaacatcgtgggcatgcgcagagcatgcccatccgtggcaggctcttcagctcccctccctgcttctggaaacctctgcctgctgccctggccctgcccccctgcgcatgcaccatccccagggctgacccagtgtggctgcattcactgggaggggcctgccctcactgggcctctcccactccgctgcctgttcttgcagctccttcctggaaagctggaggggactttctcctgcaagggaggaacgcaagtattatggacacacttgaccgtaaaggcacaggagcctcggaacaagggggcgcaataaagggaatggcccgtccccttccagaaccagcccaaagaagcctggggggtgaggagtggcccccactcctccatgaggggctgatgaggggtgggcagcctgggggaggctttcctcgcaagcacagagctctgaggctcagccccctggcacaggcggtcacgcatcaggacggttcctactcctcagcaccttccgtgcagttaccagtgccctgggaggtcacactgcccgtcggaccttggcatgctccattcagctgacctgctgaggacaggcatcgccgagactccttgggtcctccccgccctccctcatgctgccacaagctgctgctccaaggcctggccacatgcagacaggaggaagctgagctcgacattaggcctcaaggctgccatctgtcttgtagggcctggccttgtgggcagggggcagtcctgtgccttgtgggccctcagcctctgagggcagagatgctgtcagtgccgcaggtgcatcacatacttctagcatcctctccaccctgcattccaaatgctgcttgctgcctgccctgccctccgatgcaggggtggggtggggggcggagtcccgcccagcatagctgcagtgtcacaaagccatggcagagggtcctagcggcgccaccctgccccagcctgaggaggagggagagggaggaacaaccctgggcagacggggtctcagggacctgtgtccttccgcctccagagctgcccagccacgggctctcagggtgctggggcagccccaggtcccctcttgaactcagctggggccaggggccctcagaatgaaggcaggcaccaggcaggagcagcatccccctccttgacggtgctggcaggagggccgcgccatgctgactgcttgaacctctgctgacctgacagtgctggcgggagggccgcaccatgctgactgcctgaatctctgctgaggctgcctgcctgccgggcccagctcagcgccctctccactgcgaatcagtggcgatcatgtgatttctatttctgccccacagggtaagggacgagtcttctggaaggctctgccatggacatttgtcctcgggctcagaggccccaccctgccccacacctgcccctaatcactgcagtgtccagcccagtgttgaacagattgtagcgttctgtctcattacgagcaaataaatagactttcattgga

SEQ ID NO: 23990 - DNA, 2296 bp, Homo sapiens
gcagggagcgggaggcggaagtgccgcgggctgccgcctccgtcccggctgcggcccctgccggttacataactcgttgcgggctccgcgcggtcccacttcccggctcccttcgcctccaggatgcgctgagccctacaacacccccagcggccgccggctcccccacgaggtgtgaatgacagaggtggtgccatccagcgcgctcagcgaggtcagcctgcgcctcctctgccacgatgacatagacactgtgaagcacctgtgtggcgactggttccccatcgagtacccagactcatggtatcgtgatatcacatccaacaagaagttcttttcccttgctgcaacctacagaggtgccattgtgggaatgatagtagctgaaattaagaacaggaccaaaatacataaagaggatggagatattctagcatccaacttctctgttgacacacaagtcgcgtacatcctaagtctgggcgtcgtgaaagagttcaggaagcacggcatagccgccaggcccacagcctgctctgcagcttcctgccatggtcgggcatctcttccaagagtggcatcgagtacagccggaccatgtgatgtcggctgggcagccgccaccaggccccacccttcagccgcccgcagagcccgccttcctgtccatctgaccccttctgttttctgcaaggagctgccagccatctaactgggctcgtcggcctgccccagctgcaggcccggtgctacacgggctcgggaacagaacatcgtgggcatgcgcagagcatgcccatccgtggcaggctcttcagctcccctccctgcttctggaaacctctgcctgctgccctggccctgcccccctgcgcatgcaccatccccagggctgacccagtgtggctgcattcactgggaggggcctgccctcactgggcctctcccactccgctgcctgttcttgcagctccttcctggaaagctggaggggactttctcctgcaagggaggaacgcaagtattatggacacacttgaccgtaaaggcacaggagcctcggaacaagggggcgcaataaagggaatggcccgtccccttccagaaccagcccaaagaagcctggggggtgaggagtggcccccactcctccatgaggggctgatgaggggtgggcagcctgggggaggctttcctcgcaagcacagagctctgaggctcagccccctggcacaggcggtcacgcatcaggacggttcctactcctcagcaccttccgtgcagttaccagtgccctgggaggtcacactgcccgtcggaccttggcatgctccattcagctgacctgctgaggacaggcatcgccgagactccttgggtcctccccgccctccctcatgctgccacaagctgctgctccaaggcctggccacatgcagacaggaggaagctgagctcgacattaggcctcaaggctgccatctgtcttgtagggcctggccttgtgggcagggggcagtcctgtgccttgtgggccctcagcctctgagggcagagatgctgtcagtgccgcaggtgcatcacatacttctagcatcctctccaccctgcattccaaatgctgcttgctgcctgccctgccctccgatgcaggggtggggtggggggcggagtcccgcccagcatagctgcagtgtcacaaagccatggcagagggtcctagcggcgccaccctgccccagcctgaggaggagggagagggaggaacaaccctgggcagacggggtctcagggacctgtgtccttccgcctccagagctgcccagccacgggctctcagggtgctggggcagccccaggtcccctcttgaactcagctggggccaggggccctcagaatgaaggcaggcaccaggcaggagcagcatccccctccttgacggtgctggcaggagggccgcgccatgctgactgcttgaacctctgctgacctgacagtgctggcgggagggccgcaccatgctgactgcctgaatctctgctgaggctgcctgcctgccgggcccagctcagcgccctctccactgcgaatcagtggcgatcatgtgatttctatttctgccccacagggtaagggacgagtcttctggaaggctctgccatggacatttgtcctcgggctcagaggccccaccctgccccacacctgcccctaatcactgcagtgtccagcccagtgttgaacagattgtagcgttctgtctcattacgagcaaataaatagactttcattgga

SEQ ID NO: 23991 - DNA, 2403 bp, Homo sapiens
gcagggagcgggaggcggaagtgccgcgggctgccgcctccgtcccggctgcggcccctgccggttacataactcgttgcgggctccgcgcggtcccacttcccggctcccttcgcctccaggatgcgctgagccctacaacacccccagcggccgccggctcccccacgaggtgtgaatgacagaggtggtgccatccagcgcgctcagcgaggtcagcctgcgcctcctctgccacgatgacatagacactgtgaagcacctgtgtggcgactggttccccatcgagtacccagactcatggtatcgtgatatcacatccaacaagaagttcttttcccttgctgcaacctacagaggtgccattgtgggaatgatagtagctgaaattaagaacaggaccaaaatacataaagaggatggagatattctagcatccaacttctctgttgacacacaagtcgcgtacatcctaagtctgggcgtcgtgaaagagttcaggaagcacggcataggttccctcttacttgaaagtttaaaggatcacatatcaaccaccgcccaggaccactgcaaagccatttacctgcatgtcctcaccaccaacaacacagcaataaacttctatgaaaacagagacttcaagcagcaccactatctcccctattactactccattcgaggggtcctcaaagatggcttcacctatgtcctctacatcaacggcgggcaccctccctggacgattttggactacatccagcacctgggctctgcactagccagcctgagcccctgctccattccgcacagagtctaccgccaggcccacagcctgctctgcagcttcctgccatggtcgggcatctcttccaagagtggcatcgagtacagccggaccatgtgatgtcggctgggcagccgccaccaggccccacccttcagccgcccgcagagcccgccttcctgtccatctgaccccttctgttttctgcaaggagctgccagccatctaactgggctcgtcggcctgccccagctgcaggcccggtgctacacgggctcgggaacagaacatcgtgggcatgcgcagagcatgcccatccgtggcaggctcttcagctcccctccctgcttctggaaacctctgcctgctgccctggccctgcccccctgcgcatgcaccatccccagggctgacccagtgtggctgcattcactgggaggggcctgccctcactgggcctctcccactccgctgcctgttcttgcagctccttcctggaaagctggaggggactttctcctgcaagggaggaacgcaagtattatggacacacttgaccgtaaaggcacaggagcctcggaacaagggggcgcaataaagggaatggcccgtccccttccagaaccagcccaaagaagcctggggggtgaggagtggcccccactcctccatgaggggctgatgaggggtgggcagcctgggggaggctttcctcgcaagcacagagctctgaggctcagccccctggcacaggcggtcacgcatcaggacggttcctactcctcagcaccttccgtgcagttaccagtgccctgggaggtcacactgcccgtcggaccttggcatgctccattcagctgacctgctgaggacaggcatcgccgagactccttgggtcctccccgccctccctcatgctgccacaagctgctgctccaaggcctggccacatgcagacaggaggaagctgagctcgacattaggcctcaaggctgccatctgtcttgtagggcctggccttgtgggcagggggcagtcctgtgccttgtgggccctcagcctctgagggcagagatgctgtcagtgccgcaggtgcatcacatacttctagcatcctctccaccctgcattccaaatgctgcttgctgcctgccctgccctccgatgcaggggtggggtggggggcggagtcccgcccagcatagctgcagtgtcacaaagccatggcagagggtcctagcggcgccaccctgccccagcctgaggaggagggagagggaggaacaaccctgggcagacggggtctcagggacctgtgtccttccgcctccagagctgcccagccacgggctctcagggtgctggggcagccccaggtcccctcttgaatcagcgccctctccactgcgaatcagtggcgatcatgtgatttctatttctgccccacagggtaagggacgagtcttctggaaggctctgccatggacatttgtcctcgggctcagaggccccaccctgccccacacctgcccctaatcactgcagtgtccagcccagtgttgaacagattgtagcgttctgtctcattacgagcaaataaatagactttcattgga

SEQ ID NO: 23992 - DNA, 2299 bp, Homo sapiens
gcagggagcgggaggcggaagtgccgcgggctgccgcctccgtcccggctgcggcccctgccggttacataactcgttgcgggctccgcgcggtcccacttcccggctcccttcgcctccaggatgcgctgagccctacaacacccccagcggccgccggctcccccacgaggtgtgaatgacagaggtggtgccatccagcgcgctcagcgaggtcagcctgcgcctcctctgccacgatgacatagacactgtgaagcacctgtgtggcgactggttccccatcgagtacccagactcatggtatcgtgatatcacatccaacaagaagttcttttcccttgctgcaacctacagaggtgccattgtgggaatgatagtagctgaaattaagaacaggaccaaaatacataaagaggatggagatattctagcatccaacttctctgttgacacacaagtcgcgtacatcctaagtctgggcgtcgtgaaagagttcaggaagcacggcataggttccctcttacttgaaagtttaaaggatcacatatcaaccaccgcccaggaccactgcaaagccatttacctgcatgtcctcaccaccaacaacacagcaataaacttctatgaaaacagagacttcaagcagcaccactatctcccctattactactccattcgaggggtcctcaaagatggcttcacctatgtcctctacatcaacggcgggcaccctccctggacgattttggactacatccagcacctgggctctgcactagccagcctgagcccctgctccattccgcacagagtctaccgccaggcccacagcctgctctgcagcttcctgccatggtcgggcatctcttccaagagtggcatcgagtacagccggaccatgtgatgtcggctgggcagccgccaccaggccccacccttcagccgcccgcagagcccgccttcctgtccatctgaccccttctgttttctgcaaggagctgccagccatctaactgggctcgtcggcctgccccagctgcaggcccggtgctacacgggctcgggaacagaacatcgtgggcatgcgcagagcatgcccatccgtggcaggctcttcagctcccctccctgcttctggaaacctctgcctgctgccctggccctgcccccctgcgcatgcaccatccccagggctgacccagtgtggctgcattcactgggaggggcctgccctcactgggcctctcccactccgctgcctgttcttgcagctccttcctggaaagctggaggggactttctcctgcaagggaggaacgcaagtattatggacacacttgaccgtaaaggcacaggagcctcggaacaagggggcgcaataaagggaatggcccgtccccttccagaaccagcccaaagaagcctggggggtgaggagtggcccccactcctccatgaggggctgatgaggggtgggcagcctgggggaggctttcctcgcaagcacagagctctgaggctcagccccctggcacaggcggtcacgcatcaggacggttcctactcctcagcaccttccgtgcagttaccagtgccctgggaggtcacactgcccgtcggaccttggcatgctccattcagctgacctgctgaggacaggcatcgccgagactccttgggtcctccccgccctccctcatgctgccacaagctgctgctccaaggcctggccacatgcagacaggaggaagctgagctcgacattaggcctcaaggctgccatctgtcttgtagggcctggccttgtgggcagggggcagtcctgtgccttgtgggccctcagcctctgagggcagagatgctgtcagtgccgcaggtgcatcacatacttctagcatcctctccaccctgcattccaaatgctgcttgctgcctgccctgccctccgatgcaggggtggggtggggggcggagtcccgcccagcatagctgcagtgtcacaaagccatggcagagggtcctagcgggccgcgccatgctgactgcttgaacctctgctgacctgacagtgctggcgggagggccgcaccatgctgactgcctgaatctctgctgaggctgcctgcctgccgggcccagctcagcgccctctccactgcgaatcagtggcgatcatgtgatttctatttctgcccctgccccacacctgcccctaatcactgcagtgtccagcccagtgttgaacagattgtagcgttctgtctcattacgagcaaataaatagactttcattgga

SEQ ID NO: 23993 - DNA, 2043 bp, Homo sapiens
gcagggagcgggaggcggaagtgccgcgggctgccgcctccgtcccggctgcggcccctgccggttacataactcgttgcgggctccgcgcggtcccacttcccggctcccttcgcctccaggatgcgctgagccctacaacacccccagcggccgccggctcccccacgaggtgtgaatgacagaggtggtgccatccagcgcgctcagcgaggtcagcctgcgcctcctctgccacgatgacatagacactgtgaagcacctgtgtggcgactggttccccatcgagtacccagactcatggtatcgtgatatcacatccaacaagaagttcttttcccttgctgcaacctacagaggtgccattgtgggaatgatagtagctgaaattaagaacaggaccaaaatacataaagaggatggagatattctagcatccaacttctctgttgacacacaagtcgcgtacatcctaagtctgggcgtcgtgaaagagttcaggaagcacggcataggttccctcttacttgaaagtttaaaggatcacatatcaaccaccgcccaggaccactgcaaagccatttacctgcatgtcctcaccaccaacaacacagcaataaacttctatgaaaacagagacttcaagcagcaccactatctcccctattactactccattcgaggggtcctcaaagatggcttcacctatgtcctctacatcaacggcgggcaccctccctggacgattttggactacatccagcacctgggctctgcactagccagcctgagcccctgctccattccgcacagagtctaccgccaggcccacagcctgctctgcagcttcctgccatggtcgggcatctcttccaagagtggcatcgagtacagccggaccatgtgatgtcggctgggcagccgccaccaggccccacccttcagccgcccgcagagcccgccttcctgtccatctgaccccttctgttttctgcaaggagctgccagccatctaactgggctcgtcggcctgccccagctgcaggcccggtgctacacgggctcgggaacagaacatcgtgggcatgcgcagagcatgcccatccgtggcaggctcttcagctcccctccctgcttctggaaacctctgcctgctgccctggccctgcccccctgcgcatgcaccatccccagggctgacccagtgtggctgcattcactgggaggggcctgccctcactgggcctctcccactccgctgcctgttcttgcagctccttcctggaaagctggaggggactttctcctgcaagggaggaacgcaagtattatggacacacttgaccgtaaaggcacaggagcctcggaacaagggggcgcaataaagggaatggcccgtccccttccagaaccagcccaaagaagcctggggggtgaggagtggcccccactcctccatgaggggctgatgaggggtgggcagcctgggggaggctttcctcgcaagcacagagctctgaggctcagccccctggcacaggcggtcacgcatcaggacggttcctactcctcagcaccttccgtgcagttaccagtgccctgggaggtcacactgcccgtcggaccttggcatgctccattcagctgacctgctgaggacaggcatcgccgagactccttgggtcctccccgccctccctcatgctgccacaagctgctgctccaaggcctggccacatgcagacaggaggaagctgagctcgacattaggcctcaaggctgccatctgtcttgtagggcctggccttgtgggcagggggcagtcctgtgccttgtgggccctcagcctctgagggcagagatgctgtcagtgccgcaggtgcatcacatacttctagcatcctctccaccctgcattccaaatgctgcttgctgcctgcccctgccccacacctgcccctaatcactgcagtgtccagcccagtgttgaacagattgtagcgttctgtctcattacgagcaaataaatagactttcattgga

SEQ ID NO: 23994 - DNA, 2052 bp, Homo sapiens
gcagggagcgggaggcggaagtgccgcgggctgccgcctccgtcccggctgcggcccctgccggttacataactcgttgcgggctccgcgcggtcccacttcccggctcccttcgcctccaggatgcgctgagccctacaacacccccagcggccgccggctcccccacgaggtgtgaatgacagaggtggtgccatccagcgcgctcagcgaggtcagcctgcgcctcctctgccacgatgacatagacactgtgaagcacctgtgtggcgactggttccccatcgagtacccagactcatggtatcgtgatatcacatccaacaagaagttcttttcccttgctgcaacctacagaggtgccattgtgggaatgatagtagctgaaattaagaacaggaccaaaatacataaagaggatggagatattctagcatccaacttctctgttgacacacaagtcgcgtacatcctaagtctgggcgtcgtgaaagagttcaggaagcacggcataggttccctcttacttgaaagtttaaaggatcacatatcaaccaccgcccaggaccactgcaaagccatttacctgcatgtcctcaccaccaacaacacagcaataaacttctatgaaaacagagacttcaagcagcaccactatctcccctattactactccattcgaggggtcctcaaagatggcttcacctatgtcctctacatcaacggcgggcaccctccctggacgattttggactacatccagcacctgggctctgcactagccagcctgagcccctgctccattccgcacagagtctaccgccaggcccacagcctgctctgcagcttcctgccatggtcgggcatctcttccaagagtggcatcgagtacagccggaccatgtgatgtcggctgggcagccgccaccaggccccacccttcagccgcccgcagagcccgccttcctgtccatctgaccccttctgttttctgcaaggagctgccagccatctaactgggctcgtcggcctgccccagctgcaggcccggtgctacacgggctcgggaacagaacatcgtgggcatgcgcagagcatgcccatccgtggcaggctcttcagctcccctccctgcttctggaaacctctgcctgctgccctggccctgcccccctgcgcatgcaccatccccagggctgacccagtgtggctgcattcactgggaggggcctgccctcactgggcctctcccactccgctgcctgttcttgcagctccttcctggaaagctggaggggactttctcctgcaagggaggaacgcaagtattatggacacacttgaccgtaaaggcacaggagcctcggaacaagggggcgcaataaagggaatggcccgtccccttccagaaccagcccaaagaagcctggggggtgaggagtggcccccactcctccatgaggggctgatgaggggtgggcagcctgggggaggctttcctcgcaagcacagagctctgaggctcagccccctggcacaggcggtcacgcatcaggacggttcctactcctcagcaccttccgtgcagttaccagtgccctgggaggtcacactgcccgtcggaccttggcatgctccattcagctgacctgctgaggacaggcatcgccgagactccttgggtcctccccgccctccctcatgctgccacaagctgctgctccaaggcctggccacatgcagacaggaggaagctgagctcgacattaggcctcaaggctgccatctgtcttgtagggcctggccttgtgggcagggggcagtcctgtgccttgtgggccctcagcctctgagggcagagatgctgtcagtgccgcagccacagggtaagggacgagtcttctggaaggctctgccatggacatttgtcctcgggctcagaggccccaccctgccccacacctgcccctaatcactgcagtgtccagcccagtgttgaacagattgtagcgttctgtctcattacgagcaaataaatagactttcattgga

SEQ ID NO: 23995 - DNA, 1497 bp, Homo sapiens
gcagggagcgggaggcggaagtgccgcgggctgccgcctccgtcccggctgcggcccctgccggttacataactcgttgcgggctccgcgcggtcccacttcccggctcccttcgcctccaggatgcgctgagccctacaacacccccagcggccgccggctcccccacgaggtgtgaatgacagaggtggtgccatccagcgcgctcagcgaggtcagcctgcgcctcctctgccacgatgacatagacactgtgaagcacctgtgtggcgactggttccccatcgagtacccagactcatggtatcgtgatatcacatccaacaagaagttcttttcccttgctgcaacctacagaggtgccattgtgggaatgatagtagctgaaattaagaacaggaccaaaatacataaagaggatggagatattctagcatccaacttctctgttgacacacaagtcgcgtacatcctaagtctgggcgtcgtgaaagagttcaggaagcacggcataggttccctcttacttgaaagtttaaaggatcacatatcaaccaccgcccaggaccactgcaaagccatttacctgcatgtcctcatgctgccacaagctgctgctccaaggcctggccacatgcagacaggaggaagctgagctcgacattaggcctcaaggctgccatctgtcttgtagggcctggccttgtgggcagggggcagtcctgtgccttgtgggccctcagcctctgagggcagagatgctgtcagtgccgcaggtgcatcacatacttctagcatcctctccaccctgcattccaaatgctgcttgctgcctgccctgccctccgatgcaggggtggggtggggggcggagtcccgcccagcatagctgcagtgtcacaaagccatggcagagggtcctagcggcgccaccctgccccagcctgaggaggagggagagggaggaacaaccctgggcagacggggtctcagggacctgtgtccttccgcctccagagctgcccagccacgggctctcagggtgctggggcagccccaggtcccctcttgaactcagctggggccaggggccctcagaatgaaggcaggcaccaggcaggagcagcatccccctccttgacggtgctggcaggagggccgcgccatgctgactgcttgaacctctgctgacctgacagtgctggcgggagggccgcaccatgctgactgcctgaatctctgctgaggctgcctgcctgccgggcccagctcagcgccctctccactgcgaatcagtggcgatcatgtgatttctatttctgccccacagggtaagggacgagtcttctggaaggctctgccatggacatttgtcctcgggctcagaggccccaccctgccccacacctgcccctaatcactgcagtgtccagcccagtgttgaacagattgtagcgttctgtctcattacgagcaaataaatagactttcattgga

SEQ ID NO: 23996 - DNA, 1651 bp, Homo sapiens
gcagggagcgggaggcggaagtgccgcgggctgccgcctccgtcccggctgcggcccctgccggttacataactcgttgcgggctccgcgcggtcccacttcccggctcccttcgcctccaggatgcgctgagccctacaacacccccagcggccgccggctcccccacgaggtgtgaatgacagaggtggtgccatccagcgcgctcagcgaggtcagcctgcgcctcctctgccacgatgacatagacactgtgaagcacctgtgtggcgactggttccccatcgagtacccagactcatggtatcgtgatatcacatccaacaagaagttcttttcccttgctgcaacctacagaggtgccattgtgggaatgatagtagctgaaattaagaacaggaccaaaatacataaagaggatggagatattctagcatccaacttctctgttgacacacaagtcgcgtacatcctaagtctgggcgtcgtgaaagagttcaggaagcacggcataggttccctcttacttgaaagtttaaaggatcacatatcaaccaccgcccaggaccactgcaaagccatttacctgcatgtcctcaccaccaacaacacagcaataaacttctatgaaaacagagacttcaagcagcaccactatctcccctattactactccattcgaggggtcctcaaagatggcttcacctatgtcctctacatcaacggcgggcaccctccctggacgattttatatccttaacttctgggggagagggactgtggcttcctgtccataaggtggcagagccagtgagcaagttggagctgtggtccccctcagatgatgttcaggtggccaagcttatggatgcttctctcccttacctgatcgtgttgtgggtaaacctgacacacatttgggtaaatcgagttgcacatattaccatgttgcccaggctggtctcgaactcctaagctcaaatgatccgcctgccgcagcctcccaaattactgggattataggcatgagccctgcacccagctggagagcctcctgctccacttgcactggggatcagcagtgcacaaaacggacaggatcccctgtcctcccagagcctgtgctagcagaggggaaacaagtgcggagagaagagatttttactttttttgaatacttgggttcaaaccttccttataggatgcatgacccaaaggtatgcccttccctgcttcttcctccttaactttcactggcccctgacaggtcagagggaagccaggaaactttataatagtcagaatgtggcccaaaaaaatgctgtgcgtgtgtgtgtgtgttttcaaattcatgagtctaggatttattcattacatagaataataagcaggaaagagaggggtgaccccacactccacaggccgtctagcttatgtgaagacaggcatccagggggtcagcactgttgaccccctccttgtcatatggacagggctctgtccctcttgctgccacaaaggttgagaatctagggagaaccagaagcacctgcccttctgccaggccccttccccaccccccgtgcatccctgggtgtggtgtccacatgcctgctgcctcactcagaaggcccttctgtccccagacccc

SEQ ID NO: 23997 - DNA, 580 bp, Homo sapiens
taccaggttgttcctccctctccctcctcctcaggctggggcaggggtggcgccgctaggacagatggggtctcagggacctgtgtccttccgcctccagagctgcccagccacgggctctcagggtgctggggcagccccaggtcccctcttgaactcagctggggccaggggccctcagaatgaaggcaggcaccaggcaggagcagcatccccctccttgacggtgctggcaggagggccgcgccatgctgactgcttgaacctctgctgacctgacagtgctggcgggagggccgcaccatgctgactgcctgaatctctgctgaggctgcctgcctgccgggcccagctcagcgccctctccactgcgaatcagtggcgatcatgtgatttctatttctgccccacagggtaagggacgagtcttctggaaggctctgccatggacatttgtcctcgggctcagaggccccaccctgccccacacctgcccctaatcactgcagtgtccagcccagtgttgaacagattgtagcgttctgtctcattacgagcaaataaatagactttcattgga

SEQ ID NO: 23998 - DNA, 786 bp, Homo sapiens
gcagggagcgggaggcggaagtgccgcgggctgccgcctccgtcccggctgcggcccctgccggttacataactcgttgcgggctccgcgcggtcccacttcccggctcccttcgcctccaggatgcgctgagccctacaacacccccagcggccgccggctcccccacgaggtgtgaatgacagaggtggtgccatccagcgcgctcagcgaggtcagcctgcgcctcctctgccacgatgacatagacactgtgaagcacctgtgtggcgactggttccccatcgagtacccagactcatggtatcgtgatatcacatccaacaagaagttcttttcccttgctgcaacctacagaggtgccattgtgggaatgatagtagctgaaattaagaacaggaccaaaatacataaagaggatggagatattctagcatccaacttctctgttgacacacaagtcgcgtacatcctaagtctgggcgtcgtgaaagagttcaggaagcacggcataggttccctcttacttgaaagtttaaaggatcacatatcaaccaccgcccaggaccactgcaaagccatttacctgcatgtcctcaccaccaacaacacatcccacagtactcccagcttaacttctttgatcaccaccaccaagtccaccccacacaatgcttcaagcttcacttctgtgagtgccaccacagggatcacgtcacgcagtactcccattttcacttcttcgatcccaccacctacacacctcacacatactcccacccacaa

SEQ ID NO: 23999 - DNA, 461 bp, Homo sapiens
gcactattgacattttgagccaaataattctttgttctggggcctgccctatgcattgtaggattaatgtttagcagcatccttggcctctgctaacttcttctcccctccccagttgtgacaataaacttgttgttcagacattgccaaatgttccaggggggcagggataaacctcctagggttgagaacctttatgtagtaaaatttcaccattcaaatgttccatgagagaatctaaattaaagattagaaagtaagtaaccacttcatgggggaagagttccttagcttctgggccactcccacccccatggcaccttgtgcttttccctgtcagagcactccacatacatattataaaggtgtctgtctattgttctcctggaggattgggactatataatcattgtatccattgtgtctagcaagtactcaataaattatatatttttgaatga

SEQ ID NO: 24000 - DNA, 433 bp, Homo sapiens
gatgaggggactctaaagagggatgatgatctgttatggcccaggaaatcaactacagcattgggactatagtttgtcttcttctcttgaaagtttcccgtggaaacaaaataagtagaatccttaagaagctgtttcccggcctgggcgcggtggcccacacctgtaatcccaccattttgggaggccgagcaggaggatcatgaggtcaggagatcaagaccatcctgaccaacatggtgagaccccgtctccactaaaatacaaaaaattagctgggtgtggtggtgcacgcctgtaatcccagctactcaggaggctgaggcaggggaatcgcttgaacccgggaggtggagattgcagtgagccgagatcgcaccactgcactccagcctggcaacaaaggtgaatccgtctcaaagaaaaaaaaaaa

SEQ ID NO: 24001 - DNA, 453 bp, Homo sapiens
gcccttttttctgatgatttgatttcttctgatttacctaaaaaagagagaaaacatagttctatttcaataatgcaaatgttttattccacataacactgatacattgtacatagtaattaatacaaaagccacctgatgttatattttaaaaaggtggctgggcgtcgtggctgggcacggtggctcacgcctgtaatcccagcactttgggaggccgaggcgggtggattgcctgaggtcaggagtttgagaccagtctggccaacatgggaaaccccgtctctactaaaaatacaaaaatattacccgggcctggtggtgtgagcctgtaatcccagccactcggaaggctaagacagaggaattgcttgaaccagggaggtggaggttgcagtgagctgaaatcactccactgcactccagcctgggcgacaaacaagactccgtctc

SEQ ID NO: 24002 - DNA, 311 bp, Homo sapiens
ggggaacgacacaatctggggtggggggcccaagcgggtctttgtaaaacttagatcacaccatgtcactcccgagcaatcctgtgttcataggacagagtcacatccccagtatcgcgttcaagtccttgaccctgccccacctccttcttccccatctccctcctgtcccccggctccagcccccaccatctgccgcacaccagtctgtcacacgatggcccctttgcacctgctctttcctcaccctggagctcccctccccagctttcaccccctgctgtactcaggctcacccaggcggcacagcc

SEQ ID NO: 24003 - DNA, 992 bp, Homo sapiens
acaaacctgacacgttctgcacatgtatcccagaacttaagtataataataaaaaaaaaacttgcaagattaaaaagaaaatcttaacaaaatccaaaaacactaaagtgagtcaataagaagacccaattatgtctgatctcttgaagttactctgctgaaatgctcaagtccaggttaacctcatcaatctaaatggattagcttaattcatttaaacttagaaatagttgaactactcatttttaggtctcatgcaatttacctgtgtgactcaacatcaaatctgtctgctaggttcatttggcatgttttgtccctaaggatatctgccaaaccaatgcaatcaacctctcaggaagcttttttcatatttaaggaactgcttttaatttctaaggccttcgccatgggtttctgtcatgtatttctcacaaatgacagctactgatatggcagcagctattgggtattgggagggagatgggactcaatgttatatagctatgtatcgttttgagattattatatgtacattacctaattctctcttcagaaacatcccgagagtattattactactattactatactcccccagagtagtattaatactatactattaataacagtgtactataatgctaatattattactatactatgaacagataaatcagtggaggcttaaggacattaaaggaatggaccacattgcgcccaggtgtggtggctcatgcctgtaatcttagcactttgggaggccgaggcaggtggatcacctgaggataaaattattcttttattctactaaaaattaaaaaaaaatatagccaggtgtggtggtgggctcttgtaattccagccacttgggaggctgaggcaggaggatcgcttgaacccaggaggtagaggttgcagtgagctgagatttgccactgcaccccagcccgggcaacagagtaagggtaagactgtctccaaaaaaaaaa

SEQ ID NO: 24004 - DNA, 642 bp, Homo sapiens
aatttttttaactgaagggtatatattttttaaaagaatatgcatgtttatcttttaataattcattctatgggccaaagaacctacttggatccatctttgatcattaaggatgcttcagttctggacttcaaaacctgtagcattaagaacatcatgtaaagtccacacagattagcatgacatgattatgtgtagtctctttgaacctgagtaagtttaaattcagtttcaagtcaattggaaagaagtgttttgcacaatcatgaagtgcaatgattacctggctgtgacttaaatggtgttctccatcaccagaacctgcagaagctctctcatgacagtggttctcaaccactagctgtatattggaatcaccagggagcttcagtgactaggttctgtcatgctgtcgggtgaacccctgattagttctcacgtgaagccaaggtggagaatgactaatttcaggcatttctggtggatatgaaggactaccatagagcagggctatccttactccttgaccttatgttccaggtgatacatttaaagaaagatttagaatcttttctctgaagaagttaaagaacagatgtcattgattcatattaagcaatagcctataagtcttatttccag

SEQ ID NO: 24005 - DNA, 371 bp, Homo sapiens
acacttccttcctgtgtcttttccacatgcaaacttgaggtatggcttcctgtctttagtcatttcatatagtttggtttgtgctatctttggtcatagaaattgttcttctaaaacctctccagatcatccttcatttctgtgttggacatgcatcctccatggctggttttactttacaaggggtgctccccctgaaaacagcactggcaggatggccatgcacagttgattgctgtgacagaggggcttgctgatcctgtggctttatctctatctggtgtctgctatgagtagagaaacatgggagagattgagctgcaaagcaaagccagtttatccagtgctttacagttgtggtttaaaaaaaa

SEQ ID NO: 24006 - DNA, 275 bp, Homo sapiens
ggatggaatggaatggaatgaatttaaaaacaatggaatggaatccaatggaatggaaaggccacgaatggaatggaatggaatggaatggactcgaatggaaaagattggagtttagtggaatggaatctaatggaatggaatggaatggattcgaatgtaatagaatggaatcgaatggaaaggaatgttctgtaatggaatggaatggaatggaatggaatcgaatgcaatggaatttaaaggactcgattgcaatggaatgtactcgaatg

SEQ ID NO: 24007 - DNA, 803 bp, Homo sapiens
cagcaggcccctggtggacatggtacttttcaataggcagagagcctccctctgcagcacatcgttggatcttgcttttaccatactccttgaagagctgaagaaataagagggcccagcaaggttaagtcaagtttccaagcctgttcaggaatatggtgactgaaaggaaactgcaatgagagtctctgactgaagaagatgctctttgcaaactgcctgtaaattcctgtcccctgacagggatggtctggtagaagcatgaactgtggatgcaagaggcagcggggaggagtggaggaagacaggaccagcacatggaatataatctagctgctgggactggcatagtcgatggaggcggtggtccagtgtaaaatgatcagtgaatgtaaattcaatatgttttcatttgggggtgcagagtcgtggctaaaggaatgttcaaatgagtctaccatgagcaagggatcagaggtcctagtggcactatctgttcattcatttttggtacaaccccagccagtcattgagaaggtacactgtgtaagaaaccatcactccagacttacccaaggtatttattgctagatctcaccaagcactgtcaaattcaaaggaggccctgtagtagaccctgggctgtccttacagggccaaaatgcagtgactcaggagcctaatagcacccggtccctccaaaacatgccttctaccaattccattaacagagacaggtgtcagtggaaggggtgggtctcctgttccagaccaccccggcccgggagcagcctgggggatct

SEQ ID NO: 24008 - DNA, 303 bp, Homo sapiens
gatacttaggtcactacaaaataatagtgggagactgcagcatgcccattgacagtattacagatcattgaggcagaaaactaacaaaaatattcagggcctgaatttgacatttgacaaaattgacctaatagacatctaaagaacactccacccaaaaacaacagaatatacattcctcttatctgcacataacacatattgtaaaattaatcacataatcagacatcaagcaatcctcagaaatttttttttaaaaaaatgaaatcataccaaccatgctttcagaccacaatgcaatgg

SEQ ID NO: 24009 - DNA, 611 bp, Homo sapiens
agcctcgcaagtagctgagattacaggcatgcaccactatgctgggctaattttttttatatttttagtagagacacggtttcaccatgttggccaggctggtctggaactcctgacctcaggtgattcaccagcctcagtctcccaaagtgctgggattacaggcgtgagcatctcaccccgctggtattatagcttttagtatacaccaagcatttctttcagtttgtttcattgtacttagttgctcacataattaatctgatgaatataaatagttttatgttctttatttgtactgagatcataccaagtttcagtatgtcgtagctattggaaaaaacttaatggtacctttgcaggctttacacctgcctgcatggtgacaattttctttagtattagctctttcaaaactctttaatttatcttgtttacaatgtgtatgactattaatttttatggtcaatgaaaattttagaaatttctaagtttttttgttacataccaaacaattgataggtaatgtgtgagtttattgttatgaaatttattaatcatagcttgaaaaatgtagacatgttttttaggttattcttagtttaaaataa

SEQ ID NO: 24010 - DNA, 1010 bp, Homo sapiens
atagtcactgaccctttcacgtatgtaataagatacgtctcgttcacacactatttcatttgatctttgtaagaacccagtgtagaataggaatatttaaaatcaacattacccacctccaaggccaacccagagtagtcttgaacctgagtcagcctcagtattgcttgcaaggaagagggaaggggctcattaaaggcctggctcaaaccttagtcttccagactgactagggacgtaagaagacccagggacccaccatgttctcaaaccatctattcagtccaggcctttcagcatagacataaagagcccacccgttactcagtcatgttgccaagtgcaaactgatttatccccagatgaatccctttactgtagcagatccctaatccctaaatttcagccaatttggtagttaattataggagtttattagctaaatgtatgttctgagtaaaagttttgactctttggggaaaatttattttgctgctagcatacaacatttgctatgtatataaacttaagtcaatgccagaaattttaaaaccagctcaaatttataatctgtaatgatcaaatcaaaacatactgtaaactcagagttggaaacgcctggtaatatggttaagtcatgtttaaatatgaatgcaatttaaatgacattggcaatgcctgagatttctttcattgtgaatgattaaaaggcagtccaatatatgaatggatttcatcttacctttctcccgttaatttactaggtgtaacatcttgagtgtaaagtcattcacaggcagttgggttgtggagctagaaagagcctcaaaaaaaaactttttggccagactcctacatcatgaacagggtttttgatgaataatatttattattatgtttctaaagtaatacagtgttggagaatgaaacagtttagtcctttcctcttctgatggaaaagaatcatagcgccgttgccatgacaataacaggatgtagaaagacccatg

SEQ ID NO: 24011 - DNA, 360 bp, Homo sapiens
  misc_feature (55)..(55): n is a, c, g, or t
  misc_feature (61)..(61): n is a, c, g, or t
  misc_feature (67)..(67): n is a, c, g, or t
  misc_feature (78)..(78): n is a, c, g, or t
  misc_feature (112)..(112): n is a, c, g, or t
  misc_feature (125)..(125): n is a, c, g, or t
tttggggggggggaggggggtttttcctttttttcccccccccttgggggcccangggggngggttncttttggcccnaaatttgagggaaacccggggaaaaaaaaaaaanccccttttttttnaaaaaaaaaaaaaaaaaaaaaaaaaaaattataaagaataggagactctgttagcattggatttacagtcataatgccacaagctaaaagacaaaggaaaaaggccttcaaaagtcagaagaggaataattctccccaaatcttttacctagccaaattgtcaagaaatgtgtgaggggaataaggatctttttagacacacagagtctcgtattccacctcctttctcaggaag

SEQ ID NO: 24012 - DNA, 739 bp, Homo sapiens
attgctgtgaagaagaaacattccaggaacgagtggctctcggatgttaccatctagagaagagacaagcccacagtggattgggaggcccttgaagaatcccctcccacagcactgacagacagagctggaagataggaaggatcaggaagtcagaggcgtagtctaggaaatctagcccctgataggagtttcagaaaaagaaaagtgtcccgggacccaaaggctttgcatttccaggttaaaaagtccaccagaaagtccgcccaagaatggaaattacccaaaccacaatgcatcgctgtgaaatttcacaattcctggattaaacaaaggccctgaaagcttccagagcaaacagatcacataaacagctcaccagactggggctgggcatggtagctcatgcctgtgatcccagcactatgggaggccaaggcaggaggatcacttgaggcccagagttcgaggtcagcctgggcaacatagcaagaccacatctctaaaaaaaaaaaaaaaaaaaaaaaaaaaattataaagaataggagactctgttagcattggatttacagtcataatgccacaagctaaaagacaaaggaaaaaggccttcaaaagtcagaagaggaataattctccccaaatcttttacctagccaaattgtcaagaaatgtgtgaggggaataaggatctttttagacacacagagtctcgtattccacctcctttctcaggaag

SEQ ID NO: 24013 - DNA, 449 bp, Homo sapiens
ataaatgcaaagaaaaatgtctgacttctgagaaatttaagctaagtgatctcgaacagtaattctgaaattactgtcttatatgacacctggggtccctgaagtaaaagactatttttattctaatatacaaaaattaaaagcttttcactctcacttttcagaagctacatgaaatgtgacacgtacctgtgtcatcttgagtctttgagaaatttctaaggtagaagtttagggtataatataatatataggtggtctcagagattagctcaatttgttctcagaacttttaactgacttcttaacagcaaatttaagttacacctattataacctgttatctcattatcatccaataaataattattttaaaatcctgaaatttctaaaaatatgctaacaaggccattcttttgactactttattttggaaaatatagttattt

SEQ ID NO: 24014 - DNA, 585 bp, Homo sapiens
actactactactaaattcgcggccgcgtcgaggtaatttataaataaaagaggtttaattaactcacagttcctcatggctggggaggcctcaggaaacttacaatcatggtggaaggggaagaggcatgtcttacatggtagcagatgagagagagtgagcaagattgaggaaaactgccttataaaaccatcagatcttatgagaactcactcactattttgagaacagcatgggggaaaatgcccccatgatccaatcacctcccatatggtacctccctcgacacgtggggattatagggattacaattcgagatgagatttgagtggggacacagaaccaaaccatatcaccaaagtaatgaatcctttctaagggagaaaaactcatatgaaatgtgtgacccacctcatctccaaccacagagaatgaaaatgtaaacttgacatgctaaactcaaacttttcaaagacaaagaagaggctgggaggagaaatgtactagggtggaaattctggctcccatcctccatttgttccctgagaagttagaactgaatgtaaaaaaaaaaaaacatgaagt

SEQ ID NO: 24015 - DNA, 654 bp, Homo sapiens
aaagcactgggattacaggcgtgagccaccacacctagcacatttaggaccgttatatggaattcttcatatcttctaagttttaaaaaaacaaaatctaccaaatattagagatttagtagttaaataaaatcattaggaaagagcaaagacttgcccagttttaggtggagtaaattctggaacttttaatacaaagataggctgggaaactgcaaagataactttgcggttcttcttgtatgcaaatctgtgatcatggatggagaagcctggaggagaatcggaaggcaaggtcaaactttatgggttgtgatccatttggttctttcagtaagaatccacaattgataaaatactagagtttgtgtttcttagctgagaatgcaggcgcgaggaagtaaaatgatttcttctcgtcagtagtagagccacctaaccccagtcttcggcctcaagctctttctgtgctttattaaatcagctgctttttaacagaaaaccgactttgcacaccagactataatgcaggtcttgctttgggaatatttacatggtaatcttatagtcacattatacactaaataaatgttagctgggccatttgtgtagaaatataacttgtgcaaaataaaaccgttaatgtgtaaaaca

SEQ ID NO: 24016 - DNA, 181 bp, Homo sapiens
gtcgcagttgagccaagatcgtgccactgcactccagcctggccagagagtgagaatccgtcccccccgttcccccccaacaaaaaaagaaagtgcttgcttgtattggcactggttctctttctctgcagccttggacttcgcagagcacatcaacatctgacctttcagatgtttgaag

SEQ ID NO: 24017 - DNA, 554 bp, Homo sapiens
cccacctcaagtctggagtagtatgactgccatccaacacccttccaggctgtgacccttctagctctcaggctgaatcaggtgaggtggctgattgtccccagctaatcataaggcatttgcaactggctaccgtgtgtagtggcccctccataggagccacaggccacaaatcaggaagctggccactttccacccagacaacaacagcaaggccttcctgtgcctaaaattgttatttctaactctggaaggtgaatccaatcctcaaactgaactagctcttcctaggcgacatataccatgatctctttatccagaaactgttcagaatagatagtaggggtgggggagtgggcttgggaatgttgaatagattcagagcccacttaggcagctttctcccaagaggagctttataacctagagccctgcagttgacttcatttgcctaagtttatatacatacatatctattctacatatctactgtacatcagtgctctcctggcctcactcacacattaaattctaatacctcttgaagtattaat

SEQ ID NO: 24018 - DNA, 920 bp, Homo sapiens
gcatttttaactgtctgctctgccagagtgacagggcctctgggtgggaggagaggttaggggaagactgtgagcctcaggcttagtgctttgagagccctttttaaagaatgaggctcctcctctgccagcactaccccccagctgtcccgcccccagggtctcagtgcaagagtcagccccacctggaggaaagttattttcccatcaaatcctgaatccaggtggaaaggcaaggttgatatggaatccagagcctcagttccctgccaatgggaagcaaactcactccttgattttcccatctgtgaaatgggaccacagccagtaattatgaggtgctatttgaactggtgggtaatctcttttattattatttatttatttatgtatttattttgaggcagagtcttgccctgtcaccaggctggagtgcagtggtgcgatctcggctcactgcaacctctgcctcctgggttcaagcgattcccctgcctcagcctccagaatagctgggactacaggtgtgcgccaccacgcccggctaattttttgtattttagtagaaacggggtttcaccatgttggccaagatagtcttgatctcctgacctcatggtccagctgccttcgagcatctctcagggagggttgagagcagcgagggatcagtctcaaaggaccacgcctgggcaacataggggactctgtcacgtctaccagacacacgagtagccaggaatggctggcgccatgcctgtagtctcagcctgcatgagcaggctgagctgcatacggatcggctttggccactcgggagcgccaagcgctgcagtgaggctgtcgcactagcacgtgcctgcacctctagtgcagtcagacgtgcagacccctgctcttaccccaaaccgacaccagcg

SEQ ID NO: 24019 - DNA, 471 bp, Homo sapiens
gcatttttaactgtctgctctgccagagtgacagggcctctgggtgggaggagaggttaggggaagactgtgagcctcaggcttagtgctttgagagccctttttaaagaatgaggctcctcctctgccagcactaccccccagctgtcccgcccccagggtctcagtgcaagagtcagccccacctggaggaaagttattttcccatcaaatcctgaatccaggtggaaaggcaaggttgatatggaatccagagcctcagttccctgccaatgggaagcaaactcactccttgattttcccatctgtgaaatgggaccacagccagtaattatgaggtgctatttgaactggtgggtaatctcttttattattatttatttatttatgtatttattttgaggcagagtcttgccctgtcaccactgcgctccagcctaggtgaaagagcaagactccatctcaaaaaaa

SEQ ID NO: 24020 - DNA, 147 bp, Homo sapiens
tggtttgccaattttccactcattctatttccactcaacaataccaactccttccagctattccacctttttctggcttttcagataacttagttattagaaaatgagagaaacttcactcaacttatgttgatgaccccttgcgcc

SEQ ID NO: 24021 - DNA, 761 bp, Homo sapiens
gggtcctgtaaaaatgaatacgattttgatgatagtaatgagtaaggacatttgagactgatagaagagtacatacaatatgtagtgatggggaaagataaggtactgtcaaaggacaatgtgttttctggtatgacagagaagtagaatgtgttaagggaagccgagtaccagaaagatccgggtgtcacagtttgtgtagggtgtttaaagctaaaccacagagtttaattttatccaatagaagaggagccacagaagagtttccatttattcattaatttattcatttattcaaaaaatatttgagtgcttattataagccaggtactatgccaggcacctgggataagacatagtcccttctgtcaagtctttacattgggtggatgtgggagggacagatgacagaacaatatgcattgagtgtaagtgctatggtataggaagctctgagtgggaggggcatggaagccgtggaagaccatggaaggcttcccaggagaagtgacgtctggactgatcctttggtcaagcaggagttaaagaggagaaaaggagagatatgggtgttcccgagagaggaagaagccttgtcccaggagcaaagtgagggtgattgttccagaaatgtgagtgattcttttaaggctcaagcaaagcatgtgattcttctttataccttctatttctttgctgagtgtttctgttcttttgtttcaagcatgctgcaattgctcattaaagcatgtttatgatgg

SEQ ID NO: 24022 - DNA, 589 bp, Homo sapiens
cgtggcagaactttgattgaacccattgtctatttgactttgaagctgttgttataacgactatatttcattatcttctaaacctctaactcagatctccttggttttagactgacatccaactacccactggatgtagctcaggtacttctgccttagtaggtattaaactaaattcatattacttgtccctcctttcaaccccttttctacccttcaattgtccctatttcaacaccgggcttttctcagatcacgtacgatgtctaatgacgctctgtcccaagattgaacccttgcggacagactggagaggatctctgtctcattgtaatgtatcgctggttaccaagtcaccacagaggcgtctctgaatgccagcccagccgccattcccctaagcttcataatagacttatgtgcctagtgagtttcctcgatgtgcagacgtttctcctcccctcttgttatagtgcctcagcttctccaagtatgctaatgtcatcaggccactacaccatgattatctcctaattgggcgttttcacctacgtagaatatatgagtttcatcgaggatcatcctcaga

SEQ ID NO: 24023 - DNA, 739 bp, Homo sapiens
cgtggcagaactttgattgaacccattgtctatttgactttgaagctgttgttataacgactatatttcattatcttctaaacctctaactcagatctccttggttttagactgacatccaactacccactggatgtagctcaggtacttctgccttagtaggtattaaactaaattcatattacttgtccctcctttcaaccccttttctacccttcaattgtccctatttcaacacctccttctctgatatttcttatttcttatcatgctttctcctttaatccaccccttaagaacactttggattttctctctccctcattgtaatttccgttggtctccaagtcaccacagaggcgtctctgcatcccagcgcagccggcattcccctctgcttcctaattgacctctgggctgctgagttcccaactgcagttggttctccctacagctgtcaaggttagcttttcaaaaaatcaatgtcatcattccactccacctaaaaatctccaatgggccttgtcacctccagagtcatttgtgttcttagaggatttcttgtgttcttagaggatttatagagacataaatggccgtgccttccttgcctgtcagacacatcatgaacatatgtgaataattacattttaagatatatgtagatacttcttatgctgaagaaaacaagtttcaaaatctttactaaattttaaataaattcattaaattaaaaatg

SEQ ID NO: 24024 - DNA, 431 bp, Homo sapiens
cacacattgtacttgtcaagccactgaaacattctatgcataaaatctgcataggaaactccaatatggagatggtgcctgcggttaggagggtggagatgaatggaggatctcctagcttgttgataaatgggaacagttaggtgtggaaatcctgtctgtgtccagaagatggtttccattatcacagccaaagaaaatcctggaagctacaaaaatctagaaaggaaattccaggtgggaggcctgccctgactcttgtggagcaagcctctgcatttcctggtggggttgattcctgctgcttccaccatgtctaccacggcttccctccggcaccagggtgcacaaaactcaagtcccttacttattttcgtcttagcacagctaaaacaagatggcattttcaaaagtaacaactttaaactctt

SEQ ID NO: 24025 - DNA, 3942 bp, Homo sapiens
  misc_feature (457)..(457): n is a, c, g, or t
  misc_feature (795)..(795): n is a, c, g, or t
tgttcgcagcgttatttgcagtggctttggggactcagcagtggcaagtccctgtgcataatgtgaacctgcagacttcaagatggggcccctcctgcacccactaacatgtctgcctttttttgtttttatcctggaacaagtggagaaatggcagagctggctgactctggggacccttccctttttcccatggcttcatttcttcctcaccacaactaattcggggagctgagaagtcacacagggtattcctctcccttctctgatgttattaattaatagaccagagaataaggttgcagatattacatttgttgtgtttttgtgttttgtttttttttttaaggaaaatcccaaacaaagcccagcatgatttgagaaaagaggatgttttcccagggaaaataatttttttaacctgcctgagaatgatttatttatttgttggaggccnttggtcagacagcctggagcttgggctgtggaagatttcaaaagcatagggctgtggtctctggaaacctattacagcctgcagctgtgagctgagccagtgacgaggtccctggaaactcaggaaggctgacaggtgggccttggggtattggtttgtggagaaggaagcattctttaggctgcggcactccttatagtttcccacccaccgagtgacattcaggcagaaattgagctcaggagacagccagccttcccacatcccacttcacttcccggtccacacgtaaagcagtgtgtctccaaggaggcagtgagcaattcccaaggtccccntgttgtgagaagcgcgctgctttctccctttgcagggaaaaaaaaaggctttcctggtgagatcatgagtccttccggcttcatttctcattgtgggtttaacttctaaaacgcaaatggagtttagagaggatgagcagaaccacaggacctgcccccatctctcactcactgcaattgcttctactctgggcacaagtagggtgtctgaagaccatgtttccctctggttctctagtttgcagataacacagaagacactggctagaaccttaagctttctgccaaaaagatgcagagagcagggcagtagctactggcagtggggtgtgaataaagagtcctttcacaaccaagttcactgaggatttggagcaccagcttcccagcagtatcgaggggtggagaggtgtacattcaggtggaggggtacatctaggggtggagaggtgtacattctagaaacagctgttaacacactccactttaaagacagcaagctagacctgcaggatcaaagccacacactgtggtaggggttacaaatgtttatggggcccagaatactagcatagatgcgtgaaatggttggtgtgaggcaaaagggcatggtgggggcaaggatggggactgtggtcttactggcatgcacgtgacctacccagaatgagcagctgctactcagccccaacctgtcattgtttgtaaaaatgtaagcacagtgtagtggaatcttccaatttggaagggaagccggaaatccagatttaatggaaaaaatctgatttttcaacgtcgggttttttgtttgtttgtttttgttttttttaacagatagtgggcaaagaaaaattccactgttccacgtgtacactgccagcaacctctgctctctggagaggtggtttaaagtgagattatgcattgccctggtagaagaggaaaaaagccagcatcaggtcagggcaaaaataacagcccatgttgaactcggaatggggacctcttgctaagtcattccactcctcaagagaccattccacagaggggggatggatcattcagctctcctggtcccaagattgtgctgaagggaagaaggaatagaatctggagatctggactgctgccccttagatatgcagaggtccacatctgcctggggctacagcttgtgggactccatcaaaccaggccgaaatggcaaagacagtctaggaggaggaggaggtagggtgtgaaacagccaggctctctccaaatcccaagtgttgacacagccatcttgtcccatccctggaagcctctttggaaaccacatagagctgtgctggctcacgggatgtcctgtttgcttctgcctcagttaccttactttgcccatgggtctaccacaggcgctacctcattgtgtctgctgagaagtttacctgggaggggggaacaaagttgtccaaatctgcttgagctgaatgtatgatctatgcaaattctctctctcctctctctcttcctctctggctctcttagaagtttttttgttttgttttgttttgttttgtgtttaccttgcaaacaagatactgtataggaccctcttaagatggaggagggctttcttgcgccacctgtgtctacccctcacgttgtctttggctctggtcttaccaggcgtatgcagggagaaagtgacctctcttccctctccacttggctgggaatattccaactgcctctgcctacagataccaccagaaagcgggttctgcaccttgtcatccccctccctaacgtcatctactccatccctcatgttcctccaacttgcttctcccatccctccttcaaaaacaaaacaaaacaaaacaaaagccttaggtttctcctttttgaaatgtggccttaacattatttttgggaagctgaccatccatcctttccctcccatctccaccaacatcagagaagacagcatcgtgaagcttctgtggcagcctcctaaggaaggggctgccaatctgtagttggcagatgctataggaattgcttacaaatgtcgtctttaagaaaaatgttcttatatttttcctatgggcaaaatgaaggcttgggtgctcatctaaagctcagccaactcctgaagcactctctcagagcatactgctgctgtaatgggctggcttaattatcggcagagtgcttgaaaaggctttgcagacctcccctgcccccaagactgggtgactttatatgtacttcattcaagggtaaatcaggagacgttctccatttatctcttcgtccttcctgcctggaaagtgatagcactaaatattcccagcagatgggtagtgttctcaaaggaatcaccctttccctaccttcagactctattctttacccttccattgctccagtgctgatggaggccaaagacaaccccagggttttcataggaaattcactggaattgtgcgcaattgtctttgtagtccttttgccttttttttttttaaatattatgttgtcaatagcatttgtttgggtatttgttttagaggcctcactctaagttattaccgtccccttcattgttttcaaagacatgtggtgatatagtttttaaaaataactattttgttatagatcataatatgcataaaactgtacagaaatattttgtaatgtgttgattttaaaaaaagaatctgtaaataaagttttaaaaaaagaattcaaatggcacacgctgaaatatgtagatattttgctatttatttaaaggagtattttaagagatattgaactatctgaaattgaccagtaatcaaagttccaatcatctgaatgcttttccttgaggtagaatgtgagtctcagaaatgactgcattacctgcccttttttgcaccttttctgtctttttattttgcagaacaacaacaacaacaaaattgtgccttagctgtatttttttgtctaggggagtttgtttctgtctgacaaagcaacattttttgcagaaaacagtggatgtattaaatactgtatcataccaaaaacactgcaggtgtatatagatgctttctgtcatactgtgttttcagatgcagaattttaaaattaaaaaaacactgcctttatgga

SEQ ID NO: 24026 - DNA, 4427 bp, Homo sapiens
  misc_feature (457)..(457): n is a, c, g, or t
  misc_feature (795)..(795): n is a, c, g, or t
tgttcgcagcgttatttgcagtggctttggggactcagcagtggcaagtccctgtgcataatgtgaacctgcagacttcaagatggggcccctcctgcacccactaacatgtctgcctttttttgtttttatcctggaacaagtggagaaatggcagagctggctgactctggggacccttccctttttcccatggcttcatttcttcctcaccacaactaattcggggagctgagaagtcacacagggtattcctctcccttctctgatgttattaattaatagaccagagaataaggttgcagatattacatttgttgtgtttttgtgttttgtttttttttttaaggaaaatcccaaacaaagcccagcatgatttgagaaaagaggatgttttcccagggaaaataatttttttaacctgcctgagaatgatttatttatttgttggaggccnttggtcagacagcctggagcttgggctgtggaagatttcaaaagcatagggctgtggtctctggaaacctattacagcctgcagctgtgagctgagccagtgacgaggtccctggaaactcaggaaggctgacaggtgggccttggggtattggtttgtggagaaggaagcattctttaggctgcggcactccttatagtttcccacccaccgagtgacattcaggcagaaattgagctcaggagacagccagccttcccacatcccacttcacttcccggtccacacgtaaagcagtgtgtctccaaggaggcagtgagcaattcccaaggtccccntgttgtgagaagcgcgctgctttctccctttgcagggaaaaaaaaaggctttcctggtgagatcatgagtccttccggcttcatttctcattgtgggtttaacttctaaaacgcaaatggagtttagagaggatgagcagaaccacaggacctgcccccatctctcactcactgcaattgcttctactctgggcacaagtagggtgtctgaagaccatgtttccctctggttctctagtttgcagataacacagaagacactggctagaaccttaagctttctgccaaaaagatgcagagagcagggcagtagctactggcagtggggtgtgaataaagagtcctttcacaaccaagttcactgaggatttggagcaccagcttcccagcagtatcgaggggtggagaggtgtacattcaggtggaggggtacatctaggggtggagaggtgtacattctagaaacagctgttaacacactccactttaaagacagcaagctagacctgcaggatcaaagccacacactgtggtaggggttacaaatgtttatggggcccagaatactagcatagatgcgtgaaatggttggtgtgaggcaaaagggcatggtgggggcaaggatggggactgtggtcttactggcatgcacgtgacctacccagaatgagcagctgctactcagccccaacctgtcattgtttgtaaaaatgtaagcacagtgtagtggaatcttccaatttggaagggaagccggaaatccagatttaatggaaaaaatctgatttttcaacgtcgggttttttgtttgtttgtttttgttttttttaacagatagtgggcaaagaaaaattccactgttccacgtgtacactgccagcaacctctgctctctggagaggtggtttaaagtgagattatgcattgccctggtagaagaggaaaaaagccagcatcaggtcagggcaaaaataacagcccatgttgaactcggaatggggacctcttgctaagtcattccactcctcaagagaccattccacagaggggggatggatcattcagctctcctggtcccaagattgtgctgaagggaagaaggaatagaatctggagatctggactgctgccccttagatatgcagaggtccacatctgcctggggctacagcttgtgggactccatcaaaccaggccgaaatggcaaagacagtctaggaggaggaggaggtagggtgtgaaacagccaggctctctccaaatcccaagtgttgacacagccatcttgtcccatccctggaagcctctttggaaaccacatagagctgtgctggctcacgggatgtcctgtttgcttctgcctcagttaccttactttgcccatgggtctaccacaggcgctacctcattgtgtctgctgagaagtttacctgggaggggggaacaaagttgtccaaatctgcttgagctgaatgtatgatctatgcaaattctctctctcctctctctcttcctctctggctctcttagaagtttttttgttttgttttgttttgttttgtgtttaccttgcaaacaagatactgtataggaccctcttaagatggaggagggctttcttgcgccacctgtgtctacccctcacgttgtctttggctctggtcttaccaggcgtatgcagggagaaagtgacctctcttccctctccacttggctgggaatattccaactgcctctgcctacagataccaccagaaagcgggttctgcaccttgtcatccccctccctaacgtcatctactccatccctcatgttcctccaacttgcttctcccatccctccttcaaaaacaaaacaaaacaaaacaaaagccttaggtttctcctttttgaaatgtggccttaacattatttttgggaagctgaccatccatcctttccctcccatctccaccaacatcagagaagacagcatcgtgaagcttctgtggcagcctcctaaggaaggggctgccaatctgtagttggcagatgctataggaattgcttacaaatgtcgtctttaagaaaaatgttcttatatttttcctatgggcaaaatgaaggcttgggtgctcatctaaagctcagccaactcctgaagcactctctcagagcatactgctgctgtaatgggctggcttaattatcggcagagtgcttgaaaaggctttgcagacctcccctgcccccaagactgggtgactttatatgtacttcattcaagggtaaatcaggagacgttctccatttatctcttcgtccttcctgcctggaaagtgatagcactaaatattcccagcagatgggtagtgttctcaaaggaatcaccctttccctaccttcagactctattctttacccttccattgctccagtgctgatggaggccaaagacaaccccagggttttcataggaaattcactggaattgtgcgcaattgtctttgtagtccttttgccttttttttttttaaatattatgttgtcaatagcatttgtttgggtatttgttttagaggcctcactctaagttattaccgtccccttcattgttttcaaagacatgtggtgatatagtttttaaaaataactattttgttatagatcataatatgcataaaactgtacagaaatattttgtaatgtgttgattttaaaaaaagaatctgtaaataaagttttaaaaaaagaattcaaatggcacacgctgaaatatgtagatattttgctatttatttaaaggagtattttaagagatattgaactatctgaaattgaccagtaatcaaagttccaatcatctgaatgcttttccttgaggtagaatgtgagtctcagaaatgactgcattacctgcccttttttgcaccttttctgtctttttattttgcagaacaacaacaacaacaaaattgtgccttagctgtatttttttgtctaggggagtttgtttctgtctgacaaagcaacattttttgcagaaaacagtggatgtattaaatactgtatcataccaaaaacactgcaggtgtatatagatgctttctgtcatactgtgttttcagatgcagaattttaaaattaaaaaaacactgcctttatggaacagtgactatatgtggcttcttttcagcaacattgtgcatctttacacaatctcatattctcttctgtcatctgcatggtgaagacaggatgactatataatttatcatccaaactgggatacttttgagagttaaaggaagcaccacgtggatgggatgctgagactgcaggcataaatggcctatcctgggaaaacctgggtgtgtggacacatttccctcataaaaactgctgtcatcttctaactggattatagcaacaacctcctataagtacctcctggttgaggcagaagtatatgatttttaaacccgtactgagtagagaataacaagaagggactgccatggaaagttgcagtttcctatacccaactggttggttggttggcaaacgtgttttcctttcctctttaccacagagactacatttcccagactgccttgctcttagctgtgaccatgtgaccaggccaatggaac

SEQ ID NO: 24027 - DNA, 1205 bp, Homo sapiens
  misc_feature (7)..(7): n is a, c, g, or t
  misc_feature (9)..(9): n is a, c, g, or t
ctcgcangnggaggacgagggagaagacagcatcgtgaagcttctgtggcagcctcctaaggaaggggctgccaatctgtagttggcagatgctataggaattgcttacaaatgtcgtctttaagaaaaatgttcttatatttttcctatgggcaaaatgaaggcttgggtgctcatctaaagctcagccaactcctgaagcactctctcagagcatactgctgctgtaatgggctggcttaattatcggcagagtgcttgaaaaggctttgcagacctcccctgcccccaagactgggtgactttatatgtacttcattcaagggtaaatcaggagacgttctccatttatctcttcgtccttcctgcctggaaagtgatagcactaaatattcccagcagatgggtagtgttctcaaaggaatcaccctttccctaccttcagactctattctttacccttccattgctccagtgctgatggaggccaaagacaaccccagggttttcataggaaattcactggaattgtgcgcaattgtctttgtagtccttttgccttttttttttttaaatattatgttgtcaatagcatttgtttgggtatttgttttagaggcctcactctaagttattaccgtccccttcattgttttcaaagacatgtggtgatatagtttttaaaaataactattttgttatagatcataatatgcataaaactgtacagaaatattttgtaatgtgttgattttaaaaaaagaatctgtaaataaagttttaaaaaaagaattcaaatggcacacgctgaaatatgtagatattttgctatttatttaaaggagtattttaagagatattgaactatctgaaattgaccagtaatcaaagttccaatcatctgaatgcttttccttgaggtagaatgtgagtctcagaaatgactgcattacctgcccttttttgcaccttttctgtctttttattttgcagaacaacaacaacaacaaaattgtgccttagctgtatttttttgtctaggggagtttgtttctgtctgacaaagcaacattttttgcagaaaacagtggatgtattaaatactgtatcataccaaaaacactgcaggtgtatatagatgctttctgtcatactgtgttttcagatgcagaattttaaaattaaaaaaacactgcctttatgga

SEQ ID NO: 24028 - DNA, 3613 bp, Homo sapiens
  misc_feature (457)..(457): n is a, c, g, or t
  misc_feature (795)..(795): n is a, c, g, or t
  misc_feature (3302)..(3302): n is a, c, g, or t
  misc_feature (3563)..(3563): n is a, c, g, or t
tgttcgcagcgttatttgcagtggctttggggactcagcagtggcaagtccctgtgcataatgtgaacctgcagacttcaagatggggcccctcctgcacccactaacatgtctgcctttttttgtttttatcctggaacaagtggagaaatggcagagctggctgactctggggacccttccctttttcccatggcttcatttcttcctcaccacaactaattcggggagctgagaagtcacacagggtattcctctcccttctctgatgttattaattaatagaccagagaataaggttgcagatattacatttgttgtgtttttgtgttttgtttttttttttaaggaaaatcccaaacaaagcccagcatgatttgagaaaagaggatgttttcccagggaaaataatttttttaacctgcctgagaatgatttatttatttgttggaggccnttggtcagacagcctggagcttgggctgtggaagatttcaaaagcatagggctgtggtctctggaaacctattacagcctgcagctgtgagctgagccagtgacgaggtccctggaaactcaggaaggctgacaggtgggccttggggtattggtttgtggagaaggaagcattctttaggctgcggcactccttatagtttcccacccaccgagtgacattcaggcagaaattgagctcaggagacagccagccttcccacatcccacttcacttcccggtccacacgtaaagcagtgtgtctccaaggaggcagtgagcaattcccaaggtccccntgttgtgagaagcgcgctgctttctccctttgcagggaaaaaaaaaggctttcctggtgagatcatgagtccttccggcttcatttctcattgtgggtttaacttctaaaacgcaaatggagtttagagaggatgagcagaaccacaggacctgcccccatctctcactcactgcaattgcttctactctgggcacaagtagggtgtctgaagaccatgtttccctctggttctctagtttgcagataacacagaagacactggctagaaccttaagctttctgccaaaaagatgcagagagcagggcagtagctactggcagtggggtgtgaataaagagtcctttcacaaccaagttcactgaggatttggagcaccagcttcccagcagtatcgaggggtggagaggtgtacattcaggtggaggggtacatctaggggtggagaggtgtacattctagaaacagctgttaacacactccactttaaagacagcaagctagacctgcaggatcaaagccacacactgtggtaggggttacaaatgtttatggggcccagaatactagcatagatgcgtgaaatggttggtgtgaggcaaaagggcatggtgggggcaaggatggggactgtggtcttactggcatgcacgtgacctacccagaatgagcagctgctactcagccccaacctgtcattgtttgtaaaaatgtaagcacagtgtagtggaatcttccaatttggaagggaagccggaaatccagatttaatggaaaaaatctgatttttcaacgtcgggttttttgtttgtttgtttttgttttttttaacagatagtgggcaaagaaaaattccactgttccacgtgtacactgccagcaacctctgctctctggagaggtggtttaaagtgagattatgcattgccctggtagaagaggaaaaaagccagcatcaggtcagggcaaaaataacagcccatgttgaactcggaatggggacctcttgctaagtcattccactcctcaagagaccattccacagaggggggatggatcattcagctctcctggtcccaagattgtgctgaagggaagaaggaatagaatctggagatctggactgctgccccttagatatgcagaggtccacatctgcctggggctacagcttgtgggactccatcaaaccaggccgaaatggcaaagacagtctaggaggaggaggaggtagggtgtgaaacagccaggctctctccaaatcccaagtgttgacacagccatcttgtcccatccctggaagcctctttggaaaccacatagagctgtgctggctcacgggatgtcctgtttgcttctgcctcagttaccttactttgcccatgggtctaccacaggcgctacctcattgtgtctgctgagaagtttacctgggaggggggaacaaagttgtccaaatctgcttgagctgaatgtatgatctatgcaaattctctctctcctctctctcttcctctctggctctcttagaagtttttttgttttgttttgttttgttttgtgtttaccttgcaaacaagatactgtataggaccctcttaagatggaggagggctttcttgcgccacctgtgtctacccctcacgttgtctttggctctggtcttaccaggcgtatgcagggagaaagtgacctctcttccctctccacttggctgggaatattccaactgcctctgcctacagataccaccagaaagcgggttctgcaccttgtcatccccctccctaacgtcatctactccatccctcatgttcctccaacttgcttctcccatccctccttcaaaaacaaaacaaaacaaaacaaaagccttaggtttctcctttttgaaatgtggccttaacattatttttgggaagctgaccatccatcctttccctcccatctccaccaacatcagagaagacagcatcgtgaagcttctgtggcagcctcctaaggaaggggctgccaatctgtagttggcagatgctataggaattgcttacaaatgtcgtctttaagaaaaatgttcttatatttttcctatgggcaaaatgaaggcttgggtgctcatctaaagctcagccaactcctgaagcactctctcagagcatactgctgctgtaatgggctggcttaattatcggcagagtgcttgaaaaggctttgcagacctcccctgcccccaagactgggtgactttatatgtacttcattcaagggtaaatcaggagacgttctccatttatctcttcgtccttcctgcctggaaagtgatagcactaaatattcccagcagatgggtagtgttctcaaaggaatcaccctttccctaccttcagacacacaaaaccttcgtcaattgcacaccggtgctgttgggagtgaccaaaccacatgaaccagacttttcccgtccaggaaatagcatttcagatttggcttttaatttcatgcccttncgccacaggcttaacgggacatgcaacataaaaatgggaaggttatttaaacaacaaaaaacagtatgatttaaagtgtgaagtaccacgaacctcaaagggtttcttgccacgagccccctggagtgtcaatccttgtcccaagaatgtgcttaaaggaagaaggaataggatcttgagaactggactgctgccccctagatatgctgattgagcccaagaccatctcacggtttcataggaaaatcacctgcaatgtgngcaaatggctttggaggcccttttgcctttttttttaaaaatatagtgga

SEQ ID NO: 24029 - DNA, 315 bp, Homo sapiens
gcagcaaccttaacagctcatgtctatccaacctttacacagcttaccattttatttttagaaaaatgactcttgttttctgcactcatatttcagcactttttgtaacatttaaattacgtaattataatttcaaattacactaacataaatagatttgaggaaacgtctagaaaagctctagaatagcttattggtgtgagagttcctgtacttcaggcagcctgactgtgttttcagggggaataaagagtgtcccttaagctggtgagtggattaggtggaattttgtgaaaggacttcaactatactgag

SEQ ID NO: 24030 - DNA, 2966 bp, Homo sapiens
tgcattttataaattagtgattattgttagttgaatgatctataagtaaaatccttgcacatgcattcaacagaatacactaggatagaaaatttctgaaaggtataccagaagctatacatggtggtccctagagagtgcagctaggtgtggggaggaagcagacttattttactttatgccagttagtgccctttgaaatggtcttaaacagaaatagtgtattactgtaataattatagtgaagtactgcacttgggcaggatattcccttccagggctcctaccctctcctgattttgcatccagggacgtcctctgtgcttttgaatgtattaaggagtgacgtacggctggattcactctgatctcattcactgacagtggtgggagagcccagagctgagtagaaactggttctggggcatcgtgtggctagggtgccaaagccgagaaaggtcccgtagtccctgtgtggtcagcagggaaggcagcagtgctctgtcagtattgattcttcaggggcaggctgcccacttaccaaagttatgcttagcagaggggctctggctcactccccgtccctcatcctaccaggtgtgaggctgccaggagccgatcgcacaaggcttggcaaggcagatgctccccagctcctgacatcagagagaagggctgggattgtggcctgcggttggtgggcaggagagcctggtctgatgacagcaaccaccctttgactaccttctctgtggctgttactgtctgattccaaccttccactgttgaacagacctcctaccactttcctactactccccctaatgataacatactgaactcacttttatgaatttgttgagaccttaccacttttcaagtgtgtgttcaggaacagcaaacttttgtcttgcttggatccacccacatacccaaatcaccatgggtatcagacacactgggtagctgagtgctcagaggaagatgcgaggtattcagggaaagtgtcagtggggtctcccagtgcctgtttggtccacagttaggagaggccctgcttgcacttctaatacagtcccggaaagacggggccagaacttaggaggggagcgctttgcagcaacttttcaagaaaaggggaaaatttaagcaccatactgttatgtggtccttgtacccagaggccctgttcagctccagtgatcagctctcttagggcacaccctccaaggtgcctaaatgccatcccaggattggttccagtgtctattatctgtttgactccaaatggccaaacacctgacttcctctctggtagcctggcttttatcttctaggacatccagggcccctctctttgccttcccctctttcttccttctactgcttcagcagacatcatgtgaccttgaggatggatgtcacatgctggaggaaacagaaggccgaaaccctgatgacttcacagagctgccaaaacagttcctgactgtttattccgggtctttaacaaagtgatgaaaagaaatccttgcagtatgaaaacaacttttctattccatggagccaaacctcattataacagataacgtgaccctcagcgatatcccaagtattttcctgttctcatctatactatggcaaaggggcaaatacctctcagtaaagaaagaaataacaacttctatcttgggcgaggcatttcttctgttagaactttgtacacggaataaaatagatctgtttgtgcttatctttctccttagaattattgaatttgaagtctttcccagggtgggggtggagtgaagctggggtttcataagcacatagatagtagtgtctcttagcttccgtttaaatatgggggtagcgatgtggagggcccagaagtatcagagaggagagacaggctgctctgattgcctttgtaaaatgcacatttgagcttgtgcaaagccctgggcctgagctcagaaaaagcaaggccaggaatgaggctcttggttcagttcccctgcacaccctgggcggggaggggttgttagagtcatggaacccctattttttttttttttttgaccgggtcttgcttggtcacccagccagagtgcagaggtatgtgcacagctcactgcagcctcaacttcctgggctcaagcgatcttcctgcctcagcccccagagttgctggagctacagccccatgccactacacctgtctaacttttgtactttttgtagagacagggttttgtcatatcgcccaggctgctctcgaactcctgagcttaagaccaggttgctcaagtgatccacccacgtcggcctcccagggtgctaggattacaggcatgatctacccctcctggtttatctttcttaagcttggagtcatctttttaaaacagccacaatgaggtataattgatatacaatacactgcttatatttaaagtggataatttgataagttttgccatatgtttacatctgtgaaactgtcaccacaatcaacagggggatcatatccatcacccacaaaagttttcttaggcctcttccccctgagaaaaccctctctctggcagccactgaactgctttctgtccctgcagattcgtttgcattttcttaagttttatataaatggaatcatagagtacgtgctcttcttttgtctgtcttctttcacgcagcataattattttttagattcttgtgtcttgtgtgtgtcaattcttttctttttattgatgaataacattccattgtatggatataccacatctgtacagtttgtttaatccattcacctgtcgatggacatttggatcacttccaatatttggctattaaaataaagctactctgaacatttgtgtatgtgcctttgtgttattcttgggtatatatccagcagtagaatgctagatcatgtggtaggttttttgggtttttttttt

SEQ ID NO: 24031 - DNA, 574 bp, Homo sapiens
cgccccattaagtggatggagtcccctcatagggccgcccggtctttccctattagccgcggaccggtattttgtggggaatgtgtggggactgcatttgtcccaggaacatttttgcccctatttggccgagctcgcaattgaccccccgttaaggaccccaatctgatgtcccccccggggggggcccctctaggcgtgttggtccccccgggtgcgaggtttgggcccggggagagagagagatggagagagagagagagagagagagagagagagagacagagaaaaagagagataatgatctcattgtttattaacctgtattctgtttacatgtctttaaaacagtggttcttaaattgtaagctcaggttcaaagtgttggtaatgcctgattcacaactttgagaaggtagcactggagagaattggaatgggtggcggtaattggtgatacttctttgaatgtagatttccaatcacatctttagtgtctgaatatatccaaatgttttaggatgtatgttacttcttagagagaaataaagcatttttgggaagaatatatcta

SEQ ID NO: 24032 - DNA, 1727 bp, Homo sapiens
ttaaaaaaaaaaaaacaacgaactccatctgggatagcaataacctgtgaaaatgctcccccggctaatttgtatcaatgattatgaacaacatgctaaatcagtacttccaaagtctatatatgactattacaggtctggggcaaatgatgaagaaactttggctgataatattgcagcattttccagatggaagctgtatccaaggatgctccggaatgttgctgaaacagatctgtcgacttctgttttaggacagagggtcagcatgccaatatgtgtgggggctacggccatgcagcgcatggctcatgtggacggcgagcttgccactgtgagagcctgtcagtccctgggaacgggcatgatgttgagttcctgggccacctcctcaattgaagaagtggcggaagctggtcctgaggcacttcgttggctgcaactgtatatctacaaggaccgagaagtcaccaagaagctagtgcggcaggcagagaagatgggctacaaggccatatttgtgacagtggacacaccttacctgggcaaccgtctggatgatgtgcgtaacagattcaaactgccgccacaactcaggatgaaaaattttgaaaccagtactttatcattttctcctgaggaaaattttggagacgacagtggacttgctgcatatgtggctaaagcaatagacccatctatcagctgggaagatatcaaatggctgagaagactgacatcattgccaattgttgcaaagggcattttgagaggtgatgatgccagggaggctgttaaacatggcttgaatgggatcttggtgtcgaatcatggggctcgacaactcgatggggtgccagccactattgatgttctgccagaaattgtggaggctgtggaagggaaggtggaagtcttcctggacgggggtgtgcggaaaggcactgatgttctgaaagctctggctcttggcgccaaggctgtgtttgtggggagaccaatcgtttggggcttagctttccagggggagaaaggtgttcaagatgtcctcgagatactaaaggaagaattccggttggccatggctctgagtgggtgccagaatgtgaaagtcatcgacaagacattggtgaggaaaaatcctttggccgtttccaagatctgacagtgcacaatattttcccatctgtattattttttttcagcatgtattacttgacaaagagacactgtgcagagggtgaccacagtctgtaattccccacttcaatacaaagggtgtcgttcttttccaacaaaatagcaatcccttttatttcattgcttttgacttttcaatgggtgtcctaggaaccttttagaaagaaatggactttcatcctggaaatatattaactgttaaaaagaaaacattgaaaatgtgtttagacaacgtcatcccctggcaggctaaagtgctgtatcctttagtaaaattggaggtagcaaacactaaggtgaaaagataatgatctcattgtttattaacctgtattctgtttacatgtctgattcacaactttgagaaggtagcactggagagaattggaatgggtggcggtaattggtgatacttctttgaatgtagatttccaatcacatctttagtgtctgaatatatccaaatgttttaggatgtatgttacttcttagagagaaataaagcatttttgggaagaatatatcta

SEQ ID NO: 24033 - DNA, 1142 bp, Homo sapiens
ctgtcgccacacctcaggatgagaaattttgaaaccagtactttatcattttctcctgaggtatcactgggaagatatcaaatggctgagaagactgacatcattgccaattgttgcaaagggcattttgagaggtgatgatgccagggaggctgttaaacatggcttgaatgggatcttggtgtcgaatcatggggctcgacaactcgatggggtgccagccactattgatgttctgccagaaattgtggaggctgtggaagggaaggtggaagtcttcctggacgggggtgtgcggaaaggcactgatgttctgaaagctctggctcttggcgccaaggctgtgtttgtggggagaccaatcgtttggggcttagctttccagggggagaaaggtgttcaagatgtcctcgagatactaaaggaagaattccggttggccatggctctgagtgggtgccagaatgtgaaagtcatcgacaagacattggtgaggaaaaatcctttggccgtttccaagatctgacagtgcacaatattttcccatctgtattattttttttcagcatgtattacttgacaaagagacactgtgcagagggtgaccacagtctgtaattccccacttcaatacaaagggtgtcgttcttttccaacaaaatagcaatcccttttatttcattgcttttgacttttcaatgggtgtcctaggaaccttttagaaagaaatggactttcatcctggaaatatattaactgttaaaaagaaaacattgaaaatgtgtttagacaacgtcatcccctggcaggctaaagtgctgtatcctttagtaaaattggaggtagcaaacactaaggtgaaaagataatgatctcattgtttattaacctgtattctgtttacatgtctttaaaacagtggttcttaaattgtaagctcaggttcaaagtgttggtaatgcctgattcacaactttgagaaggtagcactggagagaattggaatgggtggcggtaattggtgatacttctttgaatgtagatttccaatcacatctttagtgtctgaatatatccaaatgttttaggatgtatgttacttcttagagagaaataaagcatttttgggaagaatatatcta

SEQ ID NO: 24034 - DNA, 1781 bp, Homo sapiens
ttaaaaaaaaaaaaacaacgaactccatctgggatagcaataacctgtgaaaatgctcccccggctaatttgtatcaatgattatgaacaacatgctaaatcagtacttccaaagtctatatatgactattacaggtctggggcaaatgatgaagaaactttggctgataatattgcagcattttccagatggaagctgtatccaaggatgctccggaatgttgctgaaacagatctgtcgacttctgttttaggacagagggtcagcatgccaatatgtgtgggggctacggccatgcagcgcatggctcatgtggacggcgagcttgccactgtgagagcctgtcagtccctgggaacgggcatgatgttgagttcctgggccacctcctcaattgaagaagtggcggaagctggtcctgaggcacttcgttggctgcaactgtatatctacaaggaccgagaagtcaccaagaagctagtgcggcaggcagagaagatgggctacaaggccatatttgtgacagtggacacaccttacctgggcaaccgtctggatgatgtgcgtaacagattcaaactgccgccacaactcaggatgaaaaattttgaaaccagtactttatcattttctcctgaggaaaattttggagacgacagtggacttgctgcatatgtggctaaagcaatagacccatctatcagctgggaagatatcaaatggctgagaagactgacatcattgccaattgttgcaaagggcattttgagaggtgatgatgccagggaggctgttaaacatggcttgaatgggatcttggtgtcgaatcatggggctcgacaactcgatggggtgccagccactattgatgttctgccagaaattgtggaggctgtggaagggaaggtggaagtcttcctggacgggggtgtgcggaaaggcactgatgttctgaaagctctggctcttggcgccaaggctgtgtttgtggggagaccaatcgtttggggcttagctttccagggggagaaaggtgttcaagatgtcctcgagatactaaaggaagaattccggttggccatggctctgagtgggtgccagaatgtgaaagtcatcgacaagacattggtgaggaaaaatcctttggccgtttccaagatctgacagtgcacaatattttcccatctgtattattttttttcagcatgtattacttgacaaagagacactgtgcagagggtgaccacagtctgtaattccccacttcaatacaaagggtgtcgttcttttccaacaaaatagcaatcccttttatttcattgcttttgacttttcaatgggtgtcctaggaaccttttagaaagaaatggactttcatcctggaaatatattaactgttaaaaagaaaacattgaaaatgtgtttagacaacgtcatcccctggcaggctaaagtgctgtatcctttagtaaaattggaggtagcaaacactaaggtgaaaagataatgatctcattgtttattaacctgtattctgtttacatgtctttaaaacagtggttcttaaattgtaagctcaggttcaaagtgttggtaatgcctgattcacaactttgagaaggtagcactggagagaattggaatgggtggcggtaattggtgatacttctttgaatgtagatttccaatcacatctttagtgtctgaatatatccaaatgttttaggatgtatgttacttcttagagagaaataaagcatttttgggaagaatatatcta

SEQ ID NO: 24035 - DNA, 1812 bp, Homo sapiens
tcgcatcggtaaccgttcgtacgagaatcgctgtcctctccttgcggccgccagtgtggtggaattcgcaataacctgtgaaaatgctcccccggctaatttgtatcaatgattatgaacaacatgctaaatcagtacttccaaagtctatatatgactattacaggtctggggcaaatgatgaagaaactttggctgataatattgcagcattttccagatggaagctgtatccaaggatgctccggaatgttgctgaaacagatctgtcgacttctgttttaggacagagggtcagcatgccaatatgtgtgggggctacggccatgcagcgcatggctcatgtggacggcgagcttgccactgtgagagcctgtcagtccctgggaacgggcatgatgttgagttcctgggccacctcctcaattgaagaagtggcggaagctggtcctgaggcacttcgttggctgcaactgtatatctacaaggaccgagaagtcaccaagaagctagtgcggcaggcagagaagatgggctacaaggccatatttgtgacagtggacacaccttacctgggcaaccgtctggatgatgtgcgtaacagattcaaactgccgccacaactcaggatgaaaaattttgaaaccagtactttatcattttctcctgaggaaaattttggagacgacagtggacttgctgcatatgtggctaaagcaatagacccatctatcagctgggaagatatcaaatggctgagaagactgacatcattgccaattgttgcaaagggcattttgagaggtgatgatgccagggaggctgttaaacatggcttgaatgggatcttggtgtcgaatcatggggctcgacaactcgatggggtgccagccactattgatgttctgccagaaattgtggaggctgtggaagggaaggtggaagtcttcctggacgggggtgtgcggaaaggcactgatgttctgaaagctctggctcttggcgccaaggctgtgtttgtggggagaccaatcgtttggggcttagctttccagggggagaaaggtgttcaagatgtcctcgagatactaaaggaagaattccggttggccatggctctgagtgggtgccagaatgtgaaagtcatcgacaagacattggtgaggaaaaatcctttggccgtttccaagatctgacagtgcacaatattttcccatctgtattattttttttcagcatgtattacttgacaaagagacactgtgcagagggtgaccacagtctgtaattccccacttcaatacaaagggtgtcgttcttttccaacaaaatagcaatcccttttatttcattgcttttgacttttcaatgggtgtcctaggaaccttttagaaagaaatggactttcatcctggaaatatattaactgttaaaaagaaaacattgaaaatgtgtttagacaacgtcatcccctggcaggctaaagtgctgtatcctttagtaaaattggaggtagcaaacactaaggtgaaaagataatgatctcattgtttattaacctgtattctgtttacatgtctttaaaacagtggttcttaaattgtaagctcaggttcaaagtgttggtaatgcctgattcacaactttgagaaggtagcactggagagaattggaatgggtggcggtaattggtgatacttctttgaatgtagatttccaatcacatctttagtgtctgaatatatccaaatgttttaggatgtatgttacttcttagagagaaataaagcatttttgggaagaatatatcta

SEQ ID NO: 24036 - DNA, 3386 bp, Homo sapiens
tcggctccgccgccgcgaaggacagcctttccgcgcgggactccggggcgccacgggggccatgtaagcagctatcttccagagggccacactgggcatggacacccttttccctgcctggaggagcacaggtgatagtgtaattttccagtcacgaaactgctaaggccatctcaggggcgtgtgcgccaggataggcaggcggcgtccgaggaccacatagccatgccttttggtctgaagctccgccggacacggcgctacaacgtcctgagcaagaactgctttgtcacacggattcgcctgctggacagcaatgttatcgagtgcacgctgtcggtggaaagcacagggcaagaatgcctggaggctgtggcccagaggctggagctgcgagagacgcactactttggcctttggtttctcagcaagagccagcaagcacgatgggtggagctggagaaacctctgaagaaacatctggacaaattcgctaatgagcctttgcttttctttggagtcatgttctatgtgccaaatgtgtcatggcttcagcaagaggccacaagatatcagtattacctgcaagtcaaaaaagatgtgcttgaagggcgattacgatgtacattggaccaggtgattcggctagccggcctagctgtgcaagctgattttggagactataatcagtttgattctcaagatttcctcagagagtatgtgctatttcctatggatttggccctggaagaggctgttctggaggagctgacccagaaggtagcccaagaacacaaagcccacagtggaatcctgccagcagaagctgaactgatgtacatcaatgaagttgaacgtttggatggatttggacaggaaatcttccctgtaaaggacaatcatggaaactgtgtacaccttggcattttctttatggggattttcgtgaggaacagaattggaagacaagcggtaatatacaggtggaatgacatggggaatatcactcataacaagtcgaccattctagtggagctcatcaacaaagaagagactgccctctttcacacggatgatatcgaaaatgccaagtatatttctcggttgtttgccacacgacacaagttttacaaacaaaacaaaatctgcactgaacagtcaaattctccaccccccatcagacgccagcccacctggagccgatcctctctgcccaggcagcagccgtacatcctgcctcccgttcacgtccagtgtggtgagcactactcggaaacgcacacctcgcaagacagcatttttcatgggaatgaagaagccttgtattgcaactctcacaacagcctggacttaaattatttaaatggcactgtcaccaatggcagcgtgtgtagcgttcacagcgtcaactccctcaactgctcgcaaagtttcatccaggcctcccctgtatcctccaacctcagtatccctgggagtgacatcatgcgggccgactacatcccgagccaccggcacagcgcgatcatcgtgccctcgtacaggccaacccccgattatgagacagtcatgcgccagatgaagagggggatcctgcatacagacagccagagccagtctctgagaaacctcaacattatcaacacccatgcctacaaccagccagaggatctggtgtacagccaaccggagatgcgggagaggcacccctacactgtcccttatgggccacagggggtctacagcaacaaacttgtcagtccatctgaccagaggaacccaaagaataatgtggtaccaagcaagccgggggcaagcgccatctcgcacacggtgagcaccccagagctggccaacatgcagctgcagggcagccataactacagcacggcccacatgcttaagaactatctcttcaggccaccgcccccctacccacggccacgacctgccaccagcaccccagacctggccagccaccgccacaagtacgtcagcggcagcagcccggacctggtgacccggaaggtgcagctctcggtgaagaccttccaagaggacagctctccggtggttcatcagtctctccaggaggtgagcgagcccctcacggccaccaagcaccacggcactgtgaacaagcgccacagcctggaggtgatgaacagcatggtgcggggcatggaggccatgacgctcaagtcgctccacctccccatggctcgccgcaacacgctccgggagcagggaccgcccgaggaggggtcaggcagccacgaggtcccccagctccctcagtatcaccacaagaagaccttctctgatgccactatgctaatccacagcagcgagagtgaggaggaggaggaggaggctccagaatcggtgccccagatccccatgctccgggagaagatggagtacagtgcccagctgcaggcggccctggcccgcatccccaacaagcccccgcctgagtaccccggtccaaggaagagtgtgagcaatggggctctgaggcaggaccaagccagccttcctcccgccatggccagagccagggtgctgaggcatgggccagccaaggccatcagcatgtctcggactgacccgccggctgtcaacggggcctctctcggcccatccatctcggaacccgacctgactagtgtgaaggagcgggtcaaaaaagagcctgtgaaggagagacctgtgtctgaaatgttttccctggaagacagcattatagagagagagatgatgatcaggaatctagagaagcagaagatggcaggcctggaggcacagaagaggccgctgatgttggcagcattgaatgggctctcggtggctcgagtctcagggcgggaagagaatcgagttgatgccacccgggttcccatggacgagaggttcagaaccctgaagaagaaactagaagagggaatggtgttcacagaatatgagcaaattccaaagaaaaaggcgaatggcattttcagcacagcagctctgccagaaaacgccgagcgcagccgaatccgtgaagttgtcccctatgaggagaatcgagtagagctgataccaaccaaagaaaataacacaggatacattaatgcctcccacatcaaggtggtggttggcggggcagaatggcactacatagccacccaggggcccctgccacacacgtgccacgacttctggcagatggtgtgggagcagggagtgaatgtgattgccatggtcactgcagaggagtgatctttccactggaatttgggagtctcaggctgctctgggcaaatcgacatagacgcccaactccaggcacccagctccacatgccatcatccttatcagctgaaaagagaccagaagccgtt

SEQ ID NO: 24037 - DNA, 483 bp, Homo sapiens
ttgccttctcttgtacctggacatgggcagtgggtgagtgcttcctgaatgagggaatgaggaatgctcaaagggaagcctcctgtctcaggaccttgtgctttctctcttttcttgcagaaggtggaagtgcccatgatgctgaggctcctcagggagcagaggatgttcatgatccagactatcgctcagtacaagtttgtctaccaagtcctcatccagttcctccaaaactccagactcatttaatcaccccaatccagctcctggaggagggacccagctccatcgcgctggaggagagtcacctccagacaacatctgctccccccacaggggtgcaggtggctggcagcaaacaggctctctgaagacagtagccaagattattcacacataccatgtattattttatatgagataatttatttttttcccctttggaataacttttgtgaattattataatgcagtttccctagt

SEQ ID NO: 24038 - DNA, 485 bp, Homo sapiens
ggcatgagccaccacgcccagcctcctaacactttcttgagtggacagcattgcatagtgaaaaacgcatgtgaactgaagttacgtagacattggtttaaattctggcattgccatttacactgtgcacctgtgaatgaatgctttaatctctttgaatcttcctttcttcaactgtaaagtagcttttatcgtatcacccttgtaagataaggcatagggcatgggctctgccaagacacttaggaactccagaacttgcagcttatcaaacctgagtgttgatctgtttggcggggtgggggggggggggggcttctgtgtgtgtggaatatggtaccattgataggtcccttctggagcatgaccatggcatttcttttgcatttacagctatcttccagagggccacactgggcatggacacccttttccctgcctggaggagcacaggtgatagtgtaattttccagtcacgaaactgc

SEQ ID NO: 24039 - DNA, 5503 bp, Homo sapiens
  misc_feature (5278)..(5279): n is a, c, g, or t
  misc_feature (5283)..(5284): n is a, c, g, or t
  misc_feature (5296)..(5296): n is a, c, g, or t
  misc_feature (5299)..(5299): n is a, c, g, or t
  misc_feature (5315)..(5315): n is a, c, g, or t
  misc_feature (5318)..(5318): n is a, c, g, or t
  misc_feature (5330)..(5330): n is a, c, g, or t
  misc_feature (5340)..(5340): n is a, c, g, or t
tcggctccgccgccgcgaaggacagcctttccgcgcgggactccggggcgccacgggggccatgtaagcagctatcttccagagggccacactgggcatggacacccttttccctgcctggaggagcacaggtgatagtgtaattttccagtcacgaaactgctaaggccatctcaggggcgtgtgcgccaggataggcaggcggcgtccgaggaccacatagccatgccttttggtctgaagctccgccggacacggcgctacaacgtcctgagcaagaactgctttgtcacacggattcgcctgctggacagcaatgttatcgagtgcacgctgtcggtggaaagcacagggcaagaatgcctggaggctgtggcccagaggctggagctgcgagagacgcactactttggcctttggtttctcagcaagagccagcaagcacgatgggtggagctggagaaacctctgaagaaacatctggacaaattcgctaatgagcctttgcttttctttggagtcatgttctatgtgccaaatgtgtcatggcttcagcaagaggccacaagatatcagtattacctgcaagtcaaaaaagatgtgcttgaagggcgattacgatgtacattggaccaggtgattcggctagccggcctagctgtgcaagctgattttggagactataatcagtttgattctcaagatttcctcagagagtatgtgctatttcctatggatttggccctggaagaggctgttctggaggagctgacccagaaggtagcccaagaacacaaagcccacagtggaatcctgccagcagaagctgaactgatgtacatcaatgaagttgaacgtttggatggatttggacaggaaatcttccctgtaaaggacaatcatggaaactgtgtacaccttggcattttctttatggggattttcgtgaggaacagaattggaagacaagcggtaatatacaggtggaatgacatggggaatatcactcataacaagtcgaccattctagtggagctcatcaacaaagaagagactgccctctttcacacggatgatatcgaaaatgccaagtatatttctcggttgtttgccacacgacacaagttttacaaacaaaacaaaatctgcactgaacagtcaaattctccaccccccatcagacgccagcccacctggagccgatcctctctgcccaggcagcagccgtacatcctgcctcccgttcacgtccagtgtggtgagcactactcggaaacgcacacctcgcaagacagcatttttcatgggaatgaagaagccttgtattgcaactctcacaacagcctggacttaaattatttaaatggcactgtcaccaatggcagcgtgtgtagcgttcacagcgtcaactccctcaactgctcgcaaagtttcatccaggcctcccctgtatcctccaacctcagtatccctgggagtgacatcatgcgggccgactacatcccgagccaccggcacagcgcgatcatcgtgccctcgtacaggccaacccccgattatgagacagtcatgcgccagatgaagagggggatcctgcatacagacagccagagccagtctctgagaaacctcaacattatcaacacccatgcctacaaccagccagaggatctggtgtacagccaaccggagatgcgggagaggcacccctacactgtcccttatgggccacagggggtctacagcaacaaacttgtcagtccatctgaccagaggaacccaaagaataatgtggtaccaagcaagccgggggcaagcgccatctcgcacacggtgagcaccccagagctggccaacatgcagctgcagggcagccataactacagcacggcccacatgcttaagaactatctcttcaggccaccgcccccctacccacggccacgacctgccaccagcaccccagacctggccagccaccgccacaagtacgtcagcggcagcagcccggacctggtgacccggaaggtgcagctctcggtgaagaccttccaagaggacagctctccggtggttcatcagtctctccaggaggtgagcgagcccctcacggccaccaagcaccacggcactgtgaacaagcgccacagcctggaggtgatgaacagcatggtgcggggcatggaggccatgacgctcaagtcgctccacctccccatggctcgccgcaacacgctccgggagcagggaccgcccgaggaggggtcaggcagccacgaggtcccccagctccctcagtatcaccacaagaagaccttctctgatgccactatgctaatccacagcagcgagagtgaggaggaggaggaggaggctccagaatcggtgccccagatccccatgctccgggagaagatggagtacagtgcccagctgcaggcggccctggcccgcatccccaacaagcccccgcctgagtaccccggtccaaggaagagtgtgagcaatggggctctgaggcaggaccaagccagccttcctcccgccatggccagagccagggtgctgaggcatgggccagccaaggccatcagcatgtctcggactgacccgccggctgtcaacggggcctctctcggcccatccatctcggaacccgacctgactagtgtgaaggagcgggtcaaaaaagagcctgtgaaggagagacctgtgtctgaaatgttttccctggaagacagcattatagagagagagatgatgatcaggaatctagagaagcagaagatggcaggcctggaggcacagaagaggccgctgatgttggcagcattgaatgggctctcggtggctcgagtctcagggcgggaagagaatcgagttgatgccacccgggttcccatggacgagaggttcagaaccctgaagaagaaactagaagagggaatggtgttcacagaatatgagcaaattccaaagaaaaaggcgaatggcattttcagcacagcagctctgccagaaaacgccgagcgcagccgaatccgtgaagttgtcccctatgaggagaatcgagtagagctgataccaaccaaagaaaataacacaggatacattaatgcctcccacatcaaggtggtggttggcggggcagaatggcactacatagccacccaggggcccctgccacacacgtgccacgacttctggcagatggtgtgggagcagggagtgaatgtgattgccatggtcactgcagaggaggagggtggacgaaccaaaagccaccgatactggcccaaactaggttcaaagcacagctcagccacctatggcaagttcaaggtcaccacgaagtttcgaacggattctgtttgctatgcaaccacgggcttgaaggtcaagcaccttttgtctgggcaagaaaggacggtgtggcatttacaatatactgactggccagatcacggctgtccagaggatgtccaaggatttttatcctacttggaggagatccagtcggtccgtcgccataccaacagcatgctggaaggcaccaagaaccggcacccgcccatcgtggtccactgtagtgctggggtgggaaggaccggcgtgctcattctttctgagctgatgatctactgcttggaacataacgaaaaggtggaagtgcccatgatgctgaggctcctcagggagcagaggatgttcatgatccagactatcgctcagtacaagtttgtctaccaagtcctcatccagttcctccaaaactccagactcatttaatcaccccaatccagctcctggaggagggacccagctccatcgcgctggaggagagtcacctccagacaacatctgctccccccacaggggtgcaggtggctggcagcaaacaggctctctgaagacagtagccaagattattcacacataccatgtattattttatatgagataatttatttttttcccctttggaataacttttgtgaattattataatgcagtttccctagtaatatagtacttttcatttgaaccacatcttgactgatctgtattgtaatatatgtcagcaggtaaggttgcctgctggatcattttgaggacagaggcatgagggagcacatctcttgtgaagttgcagccagatttgtaaccaaccctgaaattcatcagcttaattcatttatcagcttgattcattcatcattcattgcttatatccaaagcaaagacggtaagaaaatgaattcatcctgaaatataaagaaaagggtctgaaggaacaaacacgattctcttatattttggggctcatgagccttgatagacagtttcctctcgtcttcatttccacccctcatcctcagtagtctcctctcccccacgccccaccccaacttcccccccaagcttgagttaaagacagaatagctaaagacagtgctgcctttacaatgcagtaattgccatctttggggccgaaagacaagctctgtgttgtgcttttcttgaccaccccttatcctgggctctggagcttgtgtttccctgctggcgactgtaccttgggtatttgttgctacctctcctgtttgctcagtaggaccctgtctggtggcattgaggctctggaccagaccatctgtgcagttaaggctctaccctgattgagagaggatagcagacctagaaagagaaaggagttgggcagggcctttgaggattgtgtttttcaggcagggccttgatgatcattgttttttatttaaataagatgtgtgtgctggacagagacctaaaagttgaggtcactaagtcattggaaaggccatcaaggaaacagatggggaagctgatttatgggagctgtaaggcatttagctacataacaggggtcctggccaggaaacacatcaaatgtgacccccgctgtgctgatatcatcttcaggctttggtctgcaagatcagaattaatcccactcgggaccccatagtccaaacttggggccacttgatgaacgatggtagaattgtcattggcagagccctgtgcttctttccttttcttcataaaatccactcgctggtcagttatcttcactttgaagcccagttcttagtttcttcctatggcttcattggtcagtgtccttctgaatttccaaggatggtacacaataaatcatgttttgtacttttttcctcttactgcattttggggatttatcattctatgtctacttttcttgatcagttgattgacnntgtnntgtgtggagtcnagngtccttctgttattgngcnatttctgttttngttggaaagngggggaagctggatgccacaggtgttcagaaaacgtgtaaaatgtgtccaggacggggcacgtgccagtgtagaaggggatgttcagtgtaaaggcaagtagacctaaaaaaagggtgtgtcccgggggggcaaacaaggacttccgtgacggctcgagtttt

SEQ ID NO: 24040 - DNA, 557 bp, Homo sapiens
gagaagatggagtacagtgcccagctgcaggcggccctggcccgcatccccaacaagcccccgcctgagtaccccggtccaaggaagagtgtgagcaatggggctctgaggcaggaccaagccagccttcctcccgccatggccagagccagggtgctgaggcatgggccagccaaggccatcagcatgtctcggactgacccgccggctgtcaacggggcctctctcggcccatccatctcggaacccgacctgactagtgtgaaggagcgggtcaaaaaagagcctgtgaaggagagacctgtgtctgaaatgttttccctggaagacagcattatagagagagagatgatgatcagggtgagtgtcctcctctcccagggcattttccagtgtgaaagcacatgcttcaggcactgagcaaggggcagggcttatgcagggaacgtggtaggtttttaaggaatcattgagcatttaaaaggtagtactttattacacaaaatgttgagtttttgccctttcagataaatcttccattctcatttgtggcttct

SEQ ID NO: 24041 - DNA, 2672 bp, Homo sapiens
gatggttgggtagttaagtgaataagctagaaagacatgtttataaagctatttgatgacaatctcaggcatatttatacagagatgttcttaactgtttgctacaaaaacatgaagatcaaaaactttcttgaagcttacgcttaacttatttggggaaacaaaactccagcccttcttgtgtatgttctgatatccctttgctctacttttagaggagtgaaccctaataggatggtagcagcattcttgtttctttatatctctcctctgtgattgtataccgttttttcaacttaaagcaacttcagctggaaatatgtagaggttggccaaggtgaactaaatagtctgtaacattgattagatatcaagcaacgtgagcatggtagcaaaagcactaactgaagccagtgatttaatttttaattctgattctgataattgatgatatagctcctcgaactttgttttttgttaaaacttggaaaatatatttgtattattttggacaaattatttgaactctctggaccttgattcaatttatatataaggtaaaggcattatactggattatcctgcaatttctttgagttgttagaatataatgtagcttattaatagcaatattagcagtgtagtagattctgactgcaaaacctagccttttctattgattcattagtggtagtaaaggtattatctgatttatcctttttaataggcagtgctttgatcaagtgggaaatagtaatggacaaataaaatcaatgatcattatctaacttgatgcctgcttttcaaaaagtgagcaaatttcacatcttcacccttagacattaattcatggcacctactataagtactcatcctcttcttacctatcttcttttctataggagataaagtggttattcagaccccccaatacaattttttggtttgttttcacagctacttaaaagattaaaataactattcttgcagatatttctaggaatatttttagaaataatatgaaatacagggataataggccaattatgatctttatttttaatttctacagaaaagtactagagaatatatctatagaaacttctttcagataaccctaaagatgatactagaatgtttataaaattattgagaagattatttgtgttataaagcttatttgtaccatagtaaaggatgtttttgttcctcttcattctgggctaatctgtcaatactgaagtccagtcttttcccccttttcttaccagctcaaccttgattcctgtgacccattctttctgatctttcgtagttcatagtcaccaggcatgagtaccttggatagccctctgaagtctgttaccacccagatttccaactcgggttaattggtactaattctattagctggtataaataatccaaaatctgtgcagactctgggagcaaaatgttctactcagtttggaatactgtgccttaaaatatatttcattgtaacagcaccttgtatatatagttggccaaggacagagttgttacaagttacgtggaactttcatagcaaatcttgacagtaaataccttgttcttgtattaggtctatatcctgaattgacctttagcaagaatctttagatctgctggagggctgggatggcttttggacttcagtgaaaaagaatttctgctactcattgttgataacgcttcagtactgtataaatgtttatccttttccacgtaatttgttttctatgatatgagaacttttattataatttgcctcagtcttgatagaatcttaacaaaaataaaatctgtggtcgtctgaggtattctccatgctataacccagtttagctgatgcatttggagcttgggtgctgaaattaaatataacctatttgagttaaggatttattactagtgctccagtggtcacaggaacaataaaaaaggaacaacgatagaaatacgtgatctaggaaagaaggcaactgaaaaacctgaaagaaaaaaaatgaaagattaaaagtatacgatattctattttgatttagcaattacttgttttctagtgttctgtcaatttttggtgacttttataattacattaaaactaagatgctgaattaaaaaaaagtttctcttttattcaagcaccaacattcacttatattacctatatattgcatcaagttttgagccttcaatcccagaagcattgattgactgtctactgtggttcaagtactgtgcataaagatgaataaatattctgtccttggcttagtctaatagtaaaggcactcttagaggagggacaaatattttgcctagataagatttgagagatagtaagtgcggaatttctcttcataaaaatggtagtgttagttgtttagagggagaagtccagctatgtaaggtgaaagtggggcttataaaagtggatctgttgtttaaaaattagtactttgctcctaaaatttttacctaagtgttacatccaacaacagatgaaagtaattcgacagtagcatctgctttattcatttcatatttccagtgcctgacatattgcttggcatatagtagtttagtggatgtgtttgatgaatgaatgagtaaaaattatttttcatgttaaaataaaactttgaatt

SEQ ID NO: 24042 - DNA, 638 bp, Homo sapiens
cctgtgaagcacagtaattgaggtacaataagcgcttagtaaatattagctactatcatcaattattactttctgcaatccaggacttcttatcaaagcatttgtagaagaggattttctagttccctactgttgccttaccacttcccttagtaactcaatgagctgtccaccccaacacagtctgccagtaattataatattaaaaacagcatagctgctatttattgacattcttcaaattattagaatctgaaactacagatcaaacatcatcccggttacccttacaataaccagttaggcagatgttattatctatgttttaaagatgatgccactctgcctcccggattcatctataatcctgtaaacagtggagccacagtgcttctcagagaaagagctcaagacccttgtatgggttgaatacctcttaaaatactggcctggaagaagagtttgaacttcagttacacacagaggaagaaacacacttctacctctgttctttccctaacacctactaaaatgacagagaaatgataagaaagcagaaaactacaaaggaaaaaagaaccaatgagaagacaatagcattttggaactataaagcagatggacaagaaataattgac

SEQ ID NO: 24043 - DNA, 429 bp, Homo sapiens
aaaggctacaaactatatgattccatttatatgccattcttgaaatggacaaactatagagacagaaaaccagtcaacagttaccaggagctagatatggggaagggttgtctacaaaagagtatggcagaattttgggggatgatagagctgttctatataaagcagtccgcatttatctgtggttttgctttcctcagtgtttcagttacccacagtcaactgaggtccaaaaatattaattggaaaattccagaaataagcaatttgtaagttttaaactgcatgccattctgaataacatgataaaatctcatgccattggattcagtcccgccctgtccccacctgggaatcattcctttgtctagcatatcaacgctgtatttaccacatgccctttagtcactgagtagccctctcaattat

SEQ ID NO: 24044 - DNA, 336 bp, Homo sapiens
ataattaaagtcctctaaatcctcatagaaaaccagaaatgtctgacagcaacatataaatgagtgcttcacaaagccactgtgacttctctttccatcgctccttgtaccaggatgtgtattagtttcctatggctgctatgataaatttctacaggcttagtggcttaaaacaacacacattaattttcttatagttgcagaggccaggtgtcagaaattggtttcactgggctaaagtcaaagtgttggtagagctgattccttctgggggagacaggggagaatctgtttccttacctttcctggcatctgcaggcctcctgcgttccttgg

SEQ ID NO: 24045 - DNA, 316 bp, Homo sapiens
agcacttgccctgcacaggctctctcccccatctccactcctccatacagatcccatccagtcttgtggctttaagtatcacctatgtactgccagcccccaaatttaaatcccaagtctcaacctctcacccgactccagtagcctacacagcatctcaactttcatctcaactttcctgtctgtcagacaacccccctcaacttgccctgatcttcctccccaaacctgctccacccagtttctcttcttgagcggcaactccatccttctagttgttcagggcacaaatgttggcgtcactcttgggtcccct

SEQ ID NO: 24046 - DNA, 291 bp, Homo sapiens
ttactgtttattggatgactactatgtgtcagccatggattctgtgtattaatcccttccatcctcatgacaaccttataaggtagatgctagaacagctggggggaactgaggcttagagcacttaagcaatttgtccactgttacatggttagaaagcggcagacctgggctataaagtcaggctctagagttttaaattcttaactatgatgctgtcttacctctcagtaaatgagtatctgattaacaaagaatttttcatgaaataaaatgcagcagaaattactg

SEQ ID NO: 24047 - DNA, 3809 bp, Homo sapiens
tgtgccccagcctggatattcgctcagaggtggcagagcttcgtcagctggagaactgcagcgtggtggagggccacctgcagatcctgctcatgttcacagccaccggggaggacttccgcggcctcagcttccctcgcctcacccaggtcaccgactacctgctgctcttccgtgtctacggactggagagcctgcgcgacctcttccccaacctagcagtcatccgcgggacgcgcctcttcctgggctatgcactggtcatctttgagatgccacatctgcgtgacgtggcactgcctgcacttggggccgtgctgcgtggggctgtgcgtgtggagaagaaccaggagctctgccacctctccaccattgactggggactgctgcagccagcacctggcgccaaccacatcgtgggcaacaagctgggcgaggagtgtgctgacgtgtgccctggtgtgctgggtgctgctggtgagccctgtgccaagaccaccttcagcgggcacactgactacagatgctggacctccagccactgccagagagtgtgcccctgcccccatgggatggcttgcacagcgaggggcgagtgctgccacaccgaatgcctggggggctgcagccagccagaagaccctcgtgcctgtgtagcttgccgccacctctacttccagggtgcctgcctgtgggcctgcccgccaggcacctaccagtatgagtcctggcgctgtgtcacagctgagcgctgtgccagcctgcactctgtgcccggccgtgcctccaccttcggcatacaccagggcagttgcctggcccagtgcccttctggcttcacccgtaatagcagcagcatattctgccacaagtgcgaggggctgtgccctaaagagtgcaaggtaggcaccaagaccatcgactccatccaggcggcacaggatcttgtgggctgcacgcatgtggagggaagcctcatcctcaaccttcgccagggctacaacctggagccacagctgcagcacagcctggggctggtagaaaccattactggcttcctcaaaatcaagcactcctttgccctcgtgtccctgggctttttcaagaacctcaaactaatccggggagacgccatggtggatgggaactacactctctacgtgctggacaaccagaacctacaacagctagggtcctgggtggccgcggggctcaccattcccgtgggcaagatctacttcgccttcaacccgcgcctctgcttggaacacatctaccgactggaggaggtgacaggcacgcgaggtcggcagaacaaggctgagatcaacccccgcaccaacggagaccgcgccgcctgccagactcgcaccctgcgcttcgtgtccaacgtgacggaggcagaccgcatcctgctacgctgggagcgctatgagccactggaggcccgcgacctgctcagcttcatcgtgtactacaaggagtccccattccagaacgccacagagcacgtgggtccagatgcttgtggaacccagagctggaacctgctggatgtggagctgcccctaagccgcacccaggagccaggggtgaccctagcctccctcaagccttggacacagtacgcagtgtttgtgcgggccatcacgctaaccactgaggaggacagccctcatcaaggagcccagagtcccatcgtctacctccgaacgctgcctgcagctcccacggtgccccaagacgtcatctccacgtccaactcctcctcccacctcctggtgcgctggaagccaccgacccagcgcaatgggaacctcacctactacctggtgctgtggcagcggctggcagaggacggcgacctctacctcaatgactactgccaccgcggcttgcggctgcccaccagcaacaacgatccgcgcttcgacggcgaagacggggatcctgaggccgagatggagtccgactgctgcccttgccagcacccacctcctggtcaggttctgcccccgctggaggcgcaagaggcctcgttccagaagaagtttgaaaactttctacacaacgcgatcaccatccccatatccccttggaaggtgacgtccatcaacaagagcccccaaagggactcagggcggcaccgccgggcagctgggcccctccggctggggggcaacagctcggatttcgagatccaggaggacaaggtgccccgtgagcgagcggtgctgagcggcctgcgccacttcacggaataccggatcgacatccatgcctgcaaccacgcggcgcacaccgtgggctgcagcgccgccaccttcgtctttgcgcgcaccatgccccacagagaggctgatggtattccaggaaaggtggcctgggaggcctccagcaagaacagtgtccttctgcgctggctcgagccaccagaccccaacggactcatcctcaagtacgaaatcaagtaccgccgcttgggagaggaggccacagtgctgtgtgtgtcccgtcttcgatatgcgaagtttgggggagtccacctggccctgctgccccctggaaactactctgccagggttagggcaacctcactggctggcaatggctcttggacagacagtgttgccttctacatccttggcccagaggaggaggatgctggggggctgcatgtcctcctcactgccacccctgtggggctcacgctgctcatcgttcttgctgcccttggtttcttctacggcaagaagagaaacagaaccctgtatgcttctgtgaatccagagtacttcagcgcctctgatatgtatgtccctgatgaatgggaggtgcctcgggagcagatctcgataatccgggaactgggccagggctcttttgggatggtatatgaggggctggcacgaggacttgaggctggagaggagtccacacccgtggccctgaagacggtgaatgagctggccagcccacgggaatgcattgagttcctcaaggaagcttctgtcatgaaagccttcaagtgtcaccatgtggtgcgtctcctgggtgtggtatctcagggccagccaactctggtcatcatggagttaatgacccgtggggacctcaagagccatcttcgatctttgcggcctgaggcagagaacaaccctgggctcccacagccagcattgggggaaatgatccaaatggctggtgagattgcagacggcatggcctaccttgctgccaacaagtttgtgcaccgagatctagcagcccgcaactgcatggtgtcccaggacttcaccgtcaagatcggggacttcgggatgactcgggacgtgtatgagacagactattaccgcaagggtgggaaggggctgctgcccgtgcgctggatggcccccgagtccctcaaagatgggatcttcaccacccactcggatgtctggtcctttggcgtggtactctgggagattgtgaccctggcagaacaaccctaccagggcctgtccaatgagcaggtgctgaagttcgtcatggatggcggggtcctggaggagctggagggctgtccccttcagctgcaggagctgatgagccgctgctggcagccgaacccacgcctgcgcccatctttcacacacattctggacagcatacaggaggagctgcggccctccttccgcctcctctccttctactacagcccggaatgccggggggcccggggctccctgcctaccaccgatgcagagcctgactcctcacccactccaagagactgcagccctcaaaatgggggtccagggcactga

SEQ ID NO: 24048 - DNA, 4041 bp, Homo sapiens
tgtgccccagcctggatattcgctcagaggtggcagagcttcgtcagctggagaactgcagcgtggtggagggccacctgcagatcctgctcatgttcacagccaccggggaggacttccgcggcctcagcttccctcgcctcacccaggtcaccgactacctgctgctcttccgtgtctacggactggagagcctgcgcgacctcttccccaacctagcagtcatccgcgggacgcgcctcttcctgggctatgcactggtcatctttgagatgccacatctgcgtgacgtggcactgcctgcacttggggccgtgctgcgtggggctgtgcgtgtggagaagaaccaggagctctgccacctctccaccattgactggggactgctgcagccagcacctggcgccaaccacatcgtgggcaacaagctgggcgaggagtgtgctgacgtgtgccctggtgtgctgggtgctgctggtgagccctgtgccaagaccaccttcagcgggcacactgactacagatgctggacctccagccactgccagagagtgtgcccctgcccccatgggatggcttgcacagcgaggggcgagtgctgccacaccgaatgcctggggggctgcagccagccagaagaccctcgtgcctgtgtagcttgccgccacctctacttccagggtgcctgcctgtgggcctgcccgccaggcacctaccagtatgagtcctggcgctgtgtcacagctgagcgctgtgccagcctgcactctgtgcccggccgtgcctccaccttcggcatacaccagggcagttgcctggcccagtgcccttctggcttcacccgtaatagcagcagcatattctgccacaagtgcgaggggctgtgccctaaagagtgcaaggtaggcaccaagaccatcgactccatccaggcggcacaggatcttgtgggctgcacgcatgtggagggaagcctcatcctcaaccttcgccagggctacaacctggagccacagctgcagcacagcctggggctggtagaaaccattactggcttcctcaaaatcaagcactcctttgccctcgtgtccctgggctttttcaagaacctcaaactaatccggggagacgccatggtggatgggaactacactctctacgtgctggacaaccagaacctacaacagctagggtcctgggtggccgcggggctcaccattcccgtgggcaagatctacttcgccttcaacccgcgcctctgcttggaacacatctaccgactggaggaggtgacaggcacgcgaggtcggcagaacaaggctgagatcaacccccgcaccaacggagaccgcgccgcctgccagactcgcaccctgcgcttcgtgtccaacgtgacggaggcagaccgcatcctgctacgctgggagcgctatgagccactggaggcccgcgacctgctcagcttcatcgtgtactacaaggagtccccattccagaacgccacagagcacgtgggtccagatgcttgtggaacccagagctggaacctgctggatgtggagctgcccctaagccgcacccaggagccaggggtgaccctagcctccctcaagccttggacacagtacgcagtgtttgtgcgggccatcacgctaaccactgaggaggacagccctcatcaaggagcccagagtcccatcgtctacctccgaacgctgcctgcagctcccacggtgccccaagacgtcatctccacgtccaactcctcctcccacctcctggtgcgctggaagccaccgacccagcgcaatgggaacctcacctactacctggtgctgtggcagcggctggcagaggacggcgacctctacctcaatgactactgccaccgcggcttgcggctgcccaccagcaacaacgatccgcgcttcgacggcgaagacggggatcctgaggccgagatggagtccgactgctgcccttgccagcacccacctcctggtcaggttctgcccccgctggaggcgcaagaggcctcgttccagaagaagtttgaaaactttctacacaacgcgatcaccatccccatatccccttggaaggtgacgtccatcaacaagagcccccaaagggactcagggcggcaccgccgggcagctgggcccctccggctggggggcaacagctcggatttcgagatccaggaggacaaggtgccccgtgagcgagcggtgctgagcggcctgcgccacttcacggaataccggatcgacatccatgcctgcaaccacgcggcgcacaccgtgggctgcagcgccgccaccttcgtctttgcgcgcaccatgccccacagtaggtgatccacacacacaccttctacccccatcaccgaccccaaggaccctgtgcaaaggtttggggtttgacttctcgctaaccccagagcctcgctttgcttgcccctctcagttcccataatcccaaagctttccccacctcccagctcagcccagtttagcttgggtttgaacataaggtgagatgaaccacttttggcccggctgctggatgccccttcccgcaggagaggctgatggtattccaggaaaggtggcctgggaggcctccagcaagaacagtgtccttctgcgctggctcgagccaccagaccccaacggactcatcctcaagtacgaaatcaagtaccgccgcttgggagaggaggccacagtgctgtgtgtgtcccgtcttcgatatgcgaagtttgggggagtccacctggccctgctgccccctggaaactactctgccagggttagggcaacctcactggctggcaatggctcttggacagacagtgttgccttctacatccttggcccagaggaggaggatgctggggggctgcatgtcctcctcactgccacccctgtggggctcacgctgctcatcgttcttgctgcccttggtttcttctacggcaagaagagaaacagaaccctgtatgcttctgtgaatccagagtacttcagcgcctctgatatgtatgtccctgatgaatgggaggtgcctcgggagcagatctcgataatccgggaactgggccagggctcttttgggatggtatatgaggggctggcacgaggacttgaggctggagaggagtccacacccgtggccctgaagacggtgaatgagctggccagcccacgggaatgcattgagttcctcaaggaagcttctgtcatgaaagccttcaagtgtcaccatgtggtgcgtctcctgggtgtggtatctcagggccagccaactctggtcatcatggagttaatgacccgtggggacctcaagagccatcttcgatctttgcggcctgaggcagagaacaaccctgggctcccacagccagcattgggggaaatgatccaaatggctggtgagattgcagacggcatggcctaccttgctgccaacaagtttgtgcaccgagatctagcagcccgcaactgcatggtgtcccaggacttcaccgtcaagatcggggacttcgggatgactcgggacgtgtatgagacagactattaccgcaagggtgggaaggggctgctgcccgtgcgctggatggcccccgagtccctcaaagatgggatcttcaccacccactcggatgtctggtcctttggcgtggtactctgggagattgtgaccctggcagaacaaccctaccagggcctgtccaatgagcaggtgctgaagttcgtcatggatggcggggtcctggaggagctggagggctgtccccttcagctgcaggagctgatgagccgctgctggcagccgaacccacgcctgcgcccatctttcacacacattctggacagcatacaggaggagctgcggccctccttccgcctcctctccttctactacagcccggaatgccggggggcccggggctccctgcctaccaccgatgcagagcctgactcctcacccactccaagagactgcagccctcaaaatgggggtccagggcactga

SEQ ID NO: 24049 - DNA, 2860 bp, Homo sapiens
tttcacacacactttcttgttttatttattcaatgcaagattttttcaatattcattgaaactagaacttgatattccctgctaaggatgaggagctatatcattacaaatttcactgacacagatatcacagtccctcccctcctccgcccccccttgccaaggtctaacaggtggctggagtcatggctttgccctcatgcatactggaaggacaatgacagtcctggggtgattcagagcgggggtgccagaacttgagggtggggttgaatgacccctcagctctggggatgggtgttcagcccattccagaacgccacagagcacgtgggtccagatgcttgtggaacccagagctggaacctgctggatgtggagctgcccctaagccgcacccaggagccaggggtgaccctagcctccctcaagccttggacacagtacgcagtgtttgtgcgggccatcacgctaaccactgaggaggacagccctcatcaaggagcccagagtcccatcgtctacctccgaacgctgcctgcagctcccacggtgccccaagacgtcatctccacgtccaactcctcctcccacctcctggtgcgctggaagccaccgacccagcgcaatgggaacctcacctactacctggtgctgtggcagcggctggcagaggacggcgacctctacctcaatgactactgccaccgcggcttgcggctgcccaccagcaacaacgatccgcgcttcgacggcgaagacggggatcctgaggccgagatggagtccgactgctgcccttgccagcacccacctcctggtcaggttctgcccccgctggaggcgcaagaggcctcgttccagaagaagtttgaaaactttctacacaacgcgatcaccatccccatatccccttggaaggtgacgtccatcaacaagagcccccaaagggactcagggcggcaccgccgggcagctgggcccctccggctggggggcaacagctcggatttcgagatccaggaggacaaggtgccccgtgagcgagcggtgctgagcggcctgcgccacttcacggaataccggatcgacatccatgcctgcaaccacgcggcgcacaccgtgggctgcagcgccgccaccttcgtctttgcgcgcaccatgccccacagtaggtgatccacacacacaccttctacccccatcaccgaccccaaggaccctgtgcaaaggtttggggtttgacttctcgctaaccccagagcctcgctttgcttgcccctctcagttcccataatcccaaagctttccccacctcccagctcagcccagtttagcttgggtttgaacataaggtgagatgaaccacttttggcccggctgctggatgccccttcccgcaggagaggctgatggtattccaggaaaggtggcctgggaggcctccagcaagaacagtgtccttctgcgctggctcgagccaccagaccccaacggactcatcctcaagtacgaaatcaagtaccgccgcttgggagaggaggccacagtgctgtgtgtgtcccgtcttcgatatgcgaagtttgggggagtccacctggccctgctgccccctggaaactactctgccagggttagggcaacctcactggctggcaatggctcttggacagacagtgttgccttctacatccttggcccagaggaggaggatgctggggggctgcatgtcctcctcactgccacccctgtggggctcacgctgctcatcgttcttgctgcccttggtttcttctacggcaagaagagaaacagaaccctgtatgcttctgtgaatccagagtacttcagcgcctctgatatgtatgtccctgatgaatgggaggtgcctcgggagcagatctcgataatccgggaactgggccagggctcttttgggatggtatatgaggggctggcacgaggacttgaggctggagaggagtccacacccgtggccctgaagacggtgaatgagctggccagcccacgggaatgcattgagttcctcaaggaagcttctgtcatgaaagccttcaagtgtcaccatgtggtgcgtctcctgggtgtggtatctcagggccagccaactctggtcatcatggagttaatgacccgtggggacctcaagagccatcttcgatctttgcggcctgaggcagagaacaaccctgggctcccacagccagcattgggggaaatgatccaaatggctggtgagattgcagacggcatggcctaccttgctgccaacaagtttgtgcaccgagatctagcagcccgcaactgcatggtgtcccaggacttcaccgtcaagatcggggacttcgggatgactcgggacgtgtatgagacagactattaccgcaagggtgggaaggggctgctgcccgtgcgctggatggcccccgagtccctcaaagatgggatcttcaccacccactcggatgtctggtcctttggcgtggtactctgggagattgtgaccctggcagaacaaccctaccagggcctgtccaatgagcaggtgctgaagttcgtcatggatggcggggtcctggaggagctggagggctgtccccttcagctgcaggagctgatgagccgctgctggcagccgaacccacgcctgcgcccatctttcacacacattctggacagcatacaggaggagctgcggccctccttccgcctcctctccttctactacagcccggaatgccggggggcccggggctccctgcctaccaccgatgcagagcctgactcctcacccactccaagagactgcagccctcaaaatgggggtccagggcactga

SEQ ID NO: 24050 - DNA, 355 bp, Homo sapiens
gtcatcaaaagggctaattagaaacttccaatccccaggagcactcaagtagaagacggatagaagacacttcttagagcaacactgctgctttggtccgactgtgcctatgaaggaactgggttttgcctggtctccatagataccgccttcttcactgactttatcttagactcacactacttgtttccaatacgagatagcaaagcatatgaatagaaaatgaagagaggtgacctgattggactgaggaaggcaaggccccttgaggagacagacagtttggtgttttgttagaaagtgatatgcatgggaggaagagggagagagagaactattcagagaactgtgtgag

SEQ ID NO: 24051 - DNA, 809 bp, Homo sapiens
cattcccctacacaactgtggggatggtccagctacacatagacaggaagcccagagaaacgctcgatgtgagggtccccgcaagcccgtcgggctctttcggcacctggcccccccaaagctcctcaacgaggagtagagactgccaagcccttccactcattcatcatcataaaaatgtaacttgctatggcagcctcttggccattaagggctatactttgtgacctctgtccttgagatctttgctctgacaagttctatagccttctcagtgctgctatcgtgacgcagtgtccctgctgtggctaagtaacctttcgttttgatcaagatttgtccacgcagactcctacctctgcgcctttgcccgtgccgttcccactacctggaaggtctccccgttgctctccagctttgaggtggagacagagcatctcacacttccttttggtgtctcctgacccttttgctccctgctggacttggcgatgtcctcttctgggctcccctagtccttgttttggttgtgagcgaccgcaccagggagcaaaaccttctatggccccggccacaggagcagcaagcactgggcagtgccccagacggaaggaccatcgcgagaataaaggcactgagatgtctggcatcttgcccaaatggccacttatcaccgtgattgaggcacgtcttaacttgctgaagtggaaacagggtaactcaatgcacgcctctgcaccatccctggaaaccaatccagatctatgagaagaaaactggtcatcatagcactggtgattcaacggcac

SEQ ID NO: 24052 - DNA, 656 bp, Homo sapiens
ttttttttcatgtcagacaacgtgcagacattaataaggtttgagggtagtacacctcacacatgcacatgaaaatccaatcatcgtgctatggactacaaaatgactacatactattactcattttagagaaggcatttagaaattaagcaacttgcttaaagttatccagttattaagtggcagagactggcagactctgcagtctggctccagagtccatactctttaccactacgttgcactggagacttagagaccacagcatctgagtaagagagcctcatgcagcacaggagctcaaaaatgaatttactcaaaccttatatgatgtattatctccctcctcctcccaagggagaaaaagagggaaattcctctaagcctaaaatttatatcttaatacatatttttgggtaccattgcatttacaaaggactagggaacttaatgggataagaggagaaatatctgaattctagcccaattcagcctcctaatagccatttaacttggacaaatcaactaataaggctatccatctttcacttttctcaactataagtaggtatgataatccctgattcacctaatttgcagtaagccgagattgcaccattgtactccagcctgggcaagtgacggagtgaaactcc

SEQ ID NO: 24053 - DNA, 398 bp, Homo sapiens
  misc_feature (13)..(13): n is a, c, g, or t
  misc_feature (32)..(32): n is a, c, g, or t
  misc_feature (36)..(36): n is a, c, g, or t
  misc_feature (38)..(39): n is a, c, g, or t
gtggtgaagtagngagggtggctttggggtgngggngnngctatgtggatgtctcttggggtgacactgctacaaatgaattttctgacaaattttagcaaatttgtcatttggcaaattatttgataaatggactgttaaacagacctattgcctgctcatattctctttcctttggaattatttcccaatcattttcattcatagtgactcttttctaatcccgttcacattctctctctgaactgcactgtccattgtggtatgctgtgctattcgccaattatggatgctacataatgatcatgtttatgatgtagttcatgaaaatgatagccctgtacaaataaagtgctaaattctacagttacacgattagaaaacaatgtagtatatga

SEQ ID NO: 24054 - DNA, 435 bp, Homo sapiens
gttagactcctcaaatgtctatcaatctgggctaccaatctcacagtttagacacctgtgtccctttctgctcctggctatgtggatgtctcttggggtgacactgctacaaatgaattttctgacaaattttagcaaatttgtcatttggcaaattatttgataaatggactgttaaacagacctattgcctgctcatattctctttcctttggaattatttcccaatcattttcattcatagtgactcttttctaatcccgttcacattctctctctgaactgcactgtccattgtggtatgctgtgctattcgccaattatggatgctacataatgatcatgtttatgatgtagttcatgaaaatgatagccctgtacaaataaagtgctaaattctacagttacacgattagaaaacaatgtagtatatga

SEQ ID NO: 24055 - DNA, 380 bp, Homo sapiens
gttagcccaagaaactcctctgcactgtgcctctcttccctctctttggcttcttggtttaagaagcagtagtctggtgccaggaaagggattgggttttagtaggagtgtccaatatgtccagtatattacttcactatttgggggtgacagatgcataatgcccaatctgggtacatgtacaatctggtacatgataggtgctcaatcagtacaagttcccttacaccatcctcgcatttataaaatgagagcattgagctcctaatctctaaagctcctttccatgctgatttctgaacctctgtatagaaagttcaccatttctgcaaaccatatgaccctaagatacatctgatgactctcccccagaaattcca

SEQ ID NO: 24056 - DNA, 273 bp, Homo sapiens
cttgaggtcaggagttggagatcagcctggccgacatggtgaaaccccgtctctactaaaaatacgaaaattagctgggcgtggtgccacacgcctatagtcccagctactcgggaggctgaggcaggagaatcgcttgaacccgagaggtggaagttgcagtgagccaagattgcaccgctgctttccagcctgggagacagagtgagactctcataaagaaagagatacatttggaaatctccgtgaaaccttactgtgctccgtggccgg

SEQ ID NO: 24057 - DNA, 235 bp, Homo sapiens
ggaacatggcctcttttacactcaatggctatccaaggctaaggcctgctggctacacagatatgttcatttcactgcagagacagggagggtgtcagtaaatggcttcattttgtatcccttgtatctgcaggccacagaggaaaggctctacacccagacacacaaggaataaagcagtgtgtgcctcccagagtgggtggaaagccaatgatcggacaatcaaatggggtca

SEQ ID NO: 24058 - DNA, 459 bp, Homo sapiens
gccctttggccctgaataaccagcggtgatacccaagtaatacgctgtgggccttgggtgagactctgagtcttgctggctccagatgcgacttagcacattcccatctgtggtggctatggggcaacactcctgcttaagaaaagtggagggacaaggaaaggggactttgccttgcacattaggtaccagctcggccacagtggggaaggggtctttggaaaggggagggaagagtgggaagggctgcatctcatggcttgagtgccagctcagccacagtacactagaacaccaagtagacttctaaggtttttgactgcagtccctggctcccagacagcacctctagacctgcccacggcctgggggaacttgctacagaggttacactgagccgagatcatgccactgcactccagcctgggcgatacagcgagactgcatctcaaaaaaaaa

SEQ ID NO: 24059 - DNA, 320 bp, Homo sapiens
tggggaaatgaaaacttccacatttgtgatgatggctgcacagctctgtgaatataggacactaaaacccactgatttgtatgctttaaatgagtgggttatatctcaataaagctgtgtgcatgtgaccaaaaaaagattatgaaacaagagccctcagggcttacacgggaatggggcttctgcactcatgtcaatattataaaaagccttacgtgccctgtggctaaccaggctgcacacagaatcctaaccacatgagtttctttgccatggggctgggattgtattaactcccaggagtaacactggttcttgag

SEQ ID NO: 24060 - DNA, 370 bp, Homo sapiens
caaatagaagttttaattttaagcattccttatgatattttttaagcctaaaaaccattcaaattgcttgacaaaattatttcatggtgaattttataaggttgatagaagtaaaagctatttttcccaaaacaaacaaaataccatacatagttttttgggtttggtttgttgatgtcatgccaatttccaagcaccaactggttaccacaaacatgggaatatttagtgatatctttgtagtcatcgttaaaattcctgggaaaaaaagaaaaagtttacgtcaaaggaaaattcacctcccacaaggaaagtctgagatgttcatcctgacatttgcgttcctgattatttgtggacatttcttcat

SEQ ID NO: 24061 - DNA, 356 bp, Homo sapiens
tgccataaaactttctctgttacttgcagtgtagtctagattctgtgtctcatattacagactcacatggtcccagtatgcacgtccacattttttttgttgttttttaagagacagggtcttgctctctgccacccatgctagagtacattggtgtgatcatggctcactgcagcttcaaacttctgggctcaaatgatcctcccgccttggcctcccaacgtgctgggattataggcatgagctaccacacccgaccccagatcaattttttaaactaaaacaagataataaatcatttaatttagctaaaacaggttatcagtttcttttattaagctcgtttggaacacatg

SEQ ID NO: 24062 - DNA, 779 bp, Homo sapiens
ggtaaggatccattatgggctcaagggggtccacaactttaaaagtttcaattactactattttaggggctttcctatttaaataactaaaacataaaactaaatataaaggatcgcaaaggaaactgatcatgttaaaataaagttgatattttcaaagttttatgatccagtaacatacatattctgttaacacaaaataagactgcatggtggttctaaaattactataattcaaattcatatcttgaaatatctaacaactgtaatatatctaaatgtctcatttctattggtgacaaagtcacaggtactctgatcctactgtggactgtttcctatattcgtaattgaaggaaatgttatatttcagttagaagttggtgaaaagaaagatttaaaatttttcccatccaagttcaccagacccctggtttagaggttgtcttaattttacttttgtcattttaagagtaaattattttgttttcttgttcaattctcaattatttgggcttattttactgcctcttgcatgcttttttatgcttgaatggtttttgcagtgttagaacagtaataattgaagacttgggtggaaaaaaatcagcacctgattgaaaatgaaaggtttcaacaaaagctcttgataatgttacctccaggtgtaccatcatgccaccattattggtgctacaaatctgttaatttatttatgcttaagtatgtaaactttaataaaacttggatcatctgcattaaaaaataatgctatcttg

SEQ ID NO: 24063 - DNA, 725 bp, Homo sapiens
ggtaaggatccattatgggctcaagggggtccacaactttaaaagtttcaattactactattttaggggctttcctatttaaataactaaaacataaaactaaatataaaggatcgcaaaggaaactgatcatgttaaaataaagttgatattttcaaagttttatgatccagtaacatacatattctgttaacacaaaataagactgcatggtggttatctaaatgtctcatttctattggtgacaaagtcacaggtactctgatcctactgtggactgtttcctatattcgtaattgaaggaaatgttatatttcagttagaagttggtgaaaagaaagatttaaaatttttcccatccaagttcaccagacccctggtttagaggttgtcttaattttacttttgtcattttaagagtaaattattttgttttcttgttcaattctcaattatttgggcttattttactgcctcttgcatgcttttttatgcttgaatggtttttgcagtgttagaacagtaataattgaagacttgggtggaaaaaaatcagcacctgattgaaaatgaaaggtttcaacaaaagctcttgataatgttacctccaggtgtaccatcatgccaccattattggtgctacaaatctgttaatttatttatgcttaagtatgtaaactttaataaaacttggatcatctgcattaaaaaataatgctatcttg

SEQ ID NO: 24064 - DNA, 438 bp, Homo sapiens
gccattgagctttttagtgatccagtgaagcctgtggaccccctctcatagtaatgttttcaaagcataaaactaaatataaaggatcgcaaaggaaactgatcatgttaaaataaagttgatattttcaaagttttatgatccagtaacatacatattctgttaacacaaaataagactgcatggtggttctaaaattactataattcaaattcatatcttgaaatatctaacaactgtaatatatctaaatgtctcatttctattggtgacaaagtcacaggtactctgatcctactgtggactgtttcctatattcgtaattgaaggaaatgttatatttcagttagaagttggtgaaaagaaagatttaaaatttttcccatccaagttcaccagacccctggtttagaggttgtcttaattttacttttgtca

SEQ ID NO: 24065 - DNA, 1346 bp, Homo sapiens
aacttacaactattgaatctgtacctttatgccagtaactatgccagtgaagttcctattacttcttatgattgggagcttagaattgtgttctttactgtaaacctttaagatgatttcacaggaataatccctttaacttaacaaatgaactaactcccagatgagatgaaactttttaattttttttgcttctaagtctgtatttaagacactcaacaaatgagttgtgtgaatcttacttgtgcttgttcggatactgaacctacaacagtataggtttaaaataagttaagcgccttgagttccaaaacttgtaccacagtgcacagtgtggtcgattttaaagtcctgactcttaatttggaatggcctgtaaaaacgaaacagtggtcctggttatgtggcttttgtatgaaattttatttgctaagtattctattgtatattgaggtaagtaaacagtaaattgaaatatctaaaattggaaactgcggaagtcccaacacgaagccagtcaaatatttaaaattgtacactgttgcctatgttgcctatcatattgaaacttaaaacttagctggtttttcttcatatttttaccatgagtatttttattagtagtagcagtaggactttccattgtattggcatgtctttcctccatagaagataaatttccggttattaactactgaatgtaatttatatgcacatgtagaagtttgagatatactaggaaatgttgcttacttttgaggttggctgtttttatgaaccagggacattgtagtttgaatttgtgggtgatatttttatctgttcttctctagggaaggcgatttcaagcaagaaggtatgccacagataaccatgactgaggtggcaatgtaattaggcagtgtaatggaaagtataataaaaccaaatcatttagccttcaattgtagtaaagaggtgcaaattagttctaataaaaaatgtctttaacaaaatgtgaatacgtgactaagatgggaaagtaggtagcagtaatataaatatggaacaatgtagactactaattggaatagtaaagggagccattttaccaaataaaattaaaatgtaagattctgcagtcagaaacaaaactttaaaaactccgaacagtggttacctctgacagcatatggactgggaaggggcaaaaggaatgctttttgcatctcagcatagtgagaccttgtctctacaaacaataaagcagccaggagaatcacctgaacctggcaggtggaggttgtagtgagctgagatcgtgccactgcattcctgcctgggcgacagagtgagactctgtctca

SEQ ID NO: 24066 - DNA, 1779 bp, Homo sapiens
  misc_feature (1526)..(1526): n is a, c, g, or t
ttggtgtgtattgaatctgattcagccatgagtcagatacatgtggttatttagttcagtagtccttcattgtacctcaaggttgtgatgaaattttaatgaattaagttgaatagctcaaaagtatatacttcgtaacactcagtttcagttacagtcactgactgatgtagttctgctggcacctgacagctctcagttactaagcttctgcgatatgctaggcactgtgctggatgataagacagcacccctgccctctagaagctcgggcagttaaaatggagcagagggaagcaacggagactcagaaaataactatacacactaagggagagcttggtctggggctggtgaataggaatctgttagggaagtgacagatgcaaagctggaaatgttaatcagatggctaaattcaggccaaaatttaaatatcttcaattttcaactcaagaaaggcatttggcagaaaccatgtttggaaaagaaattaaaatttacaagaatttttattaagcactttgcctagcaaaagatttttgttaaaaaaaaaaaaaaaaacttgtcatccctactttcagggagtagaatcctggaatttttgaagcatactgtaagatggtgattatatctcagaaggggttccgtggtgtctgtaccctctctgccacaggcaatactgagcaccataggcttgagtatgccatttaactgtttggttttgtttctatttgtcactttatacaatgtttgataatatctcctcattgaactgggctatttcagtcaaggttctccagagaaacagaaccaagagaacgtacatgtgtgcgtgtgtctgtgtgtgtgtatgcacatacacacacacatatatatagagagagagatttattggctgaatttcagaaattggcttgtgtgattgtagggcttggcaagtctgaaatttgtaggacaggctagcaggctggaaactcaggcaggatttctgtgttacagtcctgaagcagaaacctcagcttttgctcttaaggtcttcacttgattggatgagatctacgaatattactaagattaatctttacttaaaatcaggtaattttagatgttaatcacatctacaaaataccctcacagcaacatctagagtagtgtttgatggaacaactggggaccatagcccagccaagttgacacataatattcattgtcacatggtgtgaagacctatcaatcaatttttgttaaacaagtaaatcaggaaaaatattttttgtcattattacattaagaaaatttattatccaggtgacagtacatactggagtttttggaagaagtgaggagccatgacctaaaaaagcttgtgtttcctgccagcagcacatcttaaccaaagatgttccagctaagttaacccagaatattagacaggaaagaaatctgaaaacagatgatgcacttgcaaattgtgcaaggcttgttctgtaatgcaaataggatgtcttctttgaaatgtaaangcactgagcctaagcatgaggaattttaatgtctaatgatgaagctatagagagaaatttcagttaatgaccaggtaggtataagatggtgtccttagataattctgatatcagaactgatgttaattgtagtttaagacaactctcctgagacaggagaaccgcttgaacccgggaggcagaggttggggtgagccgagatcgcgccattgcactccagcctggacaacgaaagcgaaactctgtcccagga

SEQ ID NO: 24067 - DNA, 259 bp, Homo sapiens
aaggaccactcacatacatccatttgatattttttggtatcaagaaagtctttaaacaatcagtaccaccaatagcagtaaaaagacaaaactgtctgaaagtacctatctgtttaaaactttaattagctttatccatccattaaatagttattgaatataaaactgtatcattcactcttctacactctgaggaaatagtggtaaataaagcagatattgtccctactatcaggaaatttacattttagtagtaata

SEQ ID NO: 24068 - DNA, 427 bp, Homo sapiens
tcccacaaccttctcctcaggctcaattaatttgcaagagcggctcacagaactcggagaaacactctacttacatttactggtttattaataaagcatatgataaaggatagaaatgaaaagccagacagagttgcgtagaacaaagtgtggggaagggacacagagcttccatgcacactccaggaacatccacgtgtccagcaatcggaagctctctgaaccccttccttttgggtgtttatggaggattcattgcatagacatgattgattacatcattggccactggtgatcaaattaaccttcaggccctctttcctgcctggaagttagaggaggggggtgttgaaagtcccaaccctctaatcctgtcttggtctttctagtgaccggcccccatcctgaagctaccaaggatctgcca

SEQ ID NO: 24069 - DNA, 261 bp, Homo sapiens
agcagcatgttttataatcctttaggtatataccctttctcaatgaacttccaaagaatatagttcaggccagacacagtggctcacgcctgtagtcccagcactatgggaggctgaggtaggagtactgcttgagtccaggagttcgaaaccagcttgggcaacatagtgagaccttgcctctacaaaaatgcctaaaaaattagccaggcatggtggcacttccctgtagtcccagctactccagaggctgggactctc

SEQ ID NO: 24070 - DNA, 601 bp, Homo sapiens
gagacagagtctcgcactgtcgcccgggctggagtgcaatagcacgatctctgctcactgcaacctccgcctcccaggttcaagagattctcctgcttcagcctcctgagtagctgagattacagatgcccaccaccatgcccagctaattttttgtatttttagtagagatggggtttcattatgttggtcaggctggtcttgaactcctgacctcgtgatccacctgcctcggcctcccaaagtgctgggattataggcatgagccaccacgctcagcctatactctgcttatatatttttaaaaagtttaaaatcataggtataaactaaaaataatacatttaatattctaatcaatggaataaatatggacaactgaaaaaaactaaagctaaaagttgttttattttgaaaggtaaaaaattgataaaactttagcaagattgatcaagaaaaagttaaaaacacaaattactaatactagaaatatgagggatgtcaccacagatcatacaaatatagtgttctgaacaacgtaataaaaatcaattcagtaactgagataacatgaaaaatctcaaaaaattaatttttttat

SEQ ID NO: 24071 - DNA, 566 bp, Homo sapiens
atcaatccatacagtcagtgtaattccattcaatgcccaaccagcaccccccacctgccccgcattttttttggtaagaattaataagctagtcctgaaattcaaatagaaatgcaaagggtgacactcctatttggcagccatttctcttaaagctcagtggttctggacctgcagtatctgctgagttaggagggacaggagagtagcagctaggtcggtggcaaatagcccgcaacattccctttagttacaatgagtttacccctcaatctcaaatatttcctcagtggattaacaggagagccagtgatggtgaagcttaagtgggaatggagtataagggctacctggtatctgtagatggctatatgaacatgcagcttgcagatacagaattcataaatgaggcattgcctggacatctaggtgaagttttaataaggtgtaataatgtcctttatatcagagatgtggaagaagaggaaatggggaaatgagtgaatagcatcttttgaagaggattttttaaatatgtatttctagacaataaagatttgtttttc

SEQ ID NO: 24072 - DNA, 302 bp, Homo sapiens
cccctgacaatctctccatattgcacctagtacaacagatgtacctgtggatccactgggcttttattgggttttgggaatactgatgttatttcacttaaaaactaatccaagcttaatgttttgatgaaaatgaaaatatatccacagggaagcaaatatccacagccacccagtcctctaaatgccacacacatctcattttatctaaagtgttttttcttcccttccaattacaaaataattcagtttactcctaggaagatcttcctattcactgtttttagtcatgctagcacatc

SEQ ID NO: 24073 - DNA, 450 bp, Homo sapiens
tacccacttatgttctgtccatttttctaataggtctttttcttcactgttactgataaggtagaattcctttatatactatggatattaacccttcattagacatatacgtctgactttattcgcagagtctgtaccttgtgttggcttttgtttaaagtgtattttttatatatctgtatttgaaaattttaacatggtaagatttgtaattgggtgttttgctctaaaggcctcccaatcaccaatatcatacagatgtcttcccatattttcttctaaaagtttagaaatgttcctttaaaataggattaaatggctttaattcatctagaatttacaggaatatatttttatcatactgtcccaccactacttcttaaatagccatcaatacttttgaattactgacttgtatacaatgtcaaaaacaagttcccgtgcatgtgg

SEQ ID NO: 24074 - DNA, 1260 bp, Homo sapiens
tccccggagctgagctggggaagggagaccagggttcaccacgttagcattcgcattcctgggaggatgcagccctcgcctggacctgggcgatagacgccttcttctgtttttatttttggaggggagcgccctgtaattgtcctgaacacatgcttcccccccttcctccagccacccgcggaggagagagtcccccttttttgcatttatcttttccttcccctttctttattaaaggtccgggagtggcggcggccaatcagcgcgcggcttccattttgtgagttcaactccgaggctcccgggcttcgcgaggacgcgtttgcagccccctctgccgctcctctctggcggccgaggcgcaggagccgcctcgccggggctcggagctggtgtagctcatattggggctcttttcggggtttgtaatttggccgtgggtaggtaattggctggagcagggcggcagggcgcggcagccaatcagcgcgcggcttctatagggcttgagttattagacgctgatctcaaaacatccttcatcagacacgaaggagaggccaacagatgagggaagccatttttctgcaatggaattaaatggccaaagcagtaaacagtcctcagcgaagccgcctttttgcctacccaaccctggaaagtttgcagaagtggaaggagcagaacgtgagggtgtaacttacaaaaaggttctgggccggagaaggggcgacgttcgggcaccccccgaatggacaatctttccttctgtcaacggcaggggcaggcctagtttgactctgacagtcctcccactaaggaattcctggtgactggaagggggagtgactcaggccctcaacctctagcaggtaagggtgctacctcctgggtgggcatgcccagttcctcagtgggcccagcgcggcccagcctccgaggaagctctgagcagctggcttggctccgaggtatttttagctacagatccagcccccctccatcaccacaacagtcgagtccaaatcaaacgcgctccaggcaggtggggctggggttctgccagcgctgggttacccaccctactttccctgcctgccctccagtgctgccaggcctagtgtgccagccagcgctcagccttcagtaaagggttcccctgcttccaacctccattgcactgcttcccctaagactgtgacctcctggaaggctggagcacaactgcctctcaataaacgtgttgcaaaaaaggaa

SEQ ID NO: 24075 - DNA, 686 bp, Homo sapiens
cagaagagcggggtcggggccggctgaccaggaacctgggcgagcagcggcgggggcccgaggggttctgggccggagaaggggcgacgttcgggcaccccccgaatggacaatctttccttctgtcaacggcaggggcaggcctagtttgactctgacagtcctcccactaaggaattcctggtgactggaagggggagtgactcaggccctcaacctctagcagagtgccttggctccctcctgtcgtcctggggaacctcggccccagccctgcctccccagccagtcacagctcctccctggtcaccctgagggagctcagggcccggctggtagctgggttgctctgcttctgtccccgactcctgtggagcctggcaggcaactccatgatctgaccccggttaccttgacagccctgcctggcctcccctctcatggcccagccaccccagaacctgaagaggttttctagctgccgtgcatttgccaggctgggttacccaccctactttccctgcctgccctccagtgctgccaggcctagtgtgccagccagcgctcagccttcagtaaagggttcccctgcttccaacctccattgcactgcttcccctaagactgtgacctcctggaaggctggagcacaactgcctctcaataaacgtgttgcaaaaaaggaa

SEQ ID NO: 24076 - DNA, 1158 bp, Homo sapiens
gagacagagtttcgctcttgttgcccaggcaatggtgtgatctgggctcaccgcaacctccgcctccagggttcaagcgattctcctgcctcagcctccgagtagctgggattacaggcatgcgccaccacgcccggataattttgtatttttagtagagacagggtttctccatgttggtcaggctggtctcaaactgacctcaggtgatccgcccacctcggcctcccaaagtgctgggattacaggcatgagccactgcgcctggccggacaataatgttttgagctgttgctgagtctggcttttgtgacgggaacttttagcactcaaggagtggccttgtctctggcctgtcccccagtgctcatgggcagccaaggcctggggactgctcaggcagggtagatgtatttgccaggccagctcccgtccctgggacctcagggagtagcttcatccctgaaggctgagtgtcttctgcctcatgtgggtggcccctctgcagggttctcaggcatccagggaagtgggtgccacagcgttgcctccagcctcactggggctggctggactttgctctgacaacacagcagtggctgggcccctgcaactctccagggctcagtttccctgttggccgcactatggcataggcccctgtgtggacaccgatgagctgaccccacaaatgccacccggccgctcccccaggcttcagtggcctaacagctgttgtgtcaggaaccagcttaaagaatctttcttgctttctcaaactctccaggaattcctggtgactggaagggggagtgactcaggccctcaacctctagcaggtaagggtgctacctcctgggtgggcatgcccagttcctcagtgggcccagcgcggcccagcctccgaggaagctctgagcaccaccccagaacctgaagaggttttctagctgccgtgcatttgccaggctgggttacccaccctactttccctgcctgccctccagtgctgccaggcctagtgtgccagccagcgctcagccttcagtaaagggttcccctgcttccaacctccattgcactgcttcccctaagactgtgacctcctggaaggctggagcacaactgcctctcaataaacgtgttgcaaaaaaggaa

SEQ ID NO: 24077 - DNA, 1226 bp, Homo sapiens
tgtgcctcttctgccccaagggcgagaagacgggcttcgcagcgaccctcgggggtccatggagccgcctgccttcgccccctcgctcttcccaggtctgaacctggatggggagaagaaattgaagtgctttggagacgggggggcttaaaacactagggagcctcatcgcccagccttgggcccactttcctttcgatcgtgaggattccgcaccccgaagccgtcttctcggggctccggggcgcgcctgcgctggcaacgcgaaggaggacaaaaggccggcgtccatgttggcaccatgacgcagcatctccgcccgcagcccggagctgctgtcctcccggccgcgctcgctcctcctcccaaacaccagttttctttacaggcttcgagcccgtcgcggctgggccgggctggtctggcaggcgggcccagccgggcagggctgctttgctaatggcggcggctctctttccttccttcctcctttcctccgtccccccggtcgtggggagcccggagcaggaggcgggcccgcggccaggtcgggccccgagagcccgcggggcgcagcgctggcgaccgggtgtcgggggccgtttcgggggccgtgggcctcgggggcgtcgcgcgccgcgcctcccgcgctcgcctcagccgggcgcggcggcctgatgggcgccatttcgcgcgctgcccgtggctggggcggtggcggccgccgcgcgccgggcgggaggagcggcaggggtagggggctgggcgacccggcggcccacgcgggcaccaggaggcctcgccccggaccgcttccctctttcgtctttgtcctgcgcgggcgcccgcagccgagggccacggggtcggcggggcttcgaggccgccccgggtcccaccggctcctccggaagccgcggaccggcctggccctgaccccaggccgccccccgctgcccacccagctctgggcgcccaggtccgacctcccagtcgccctctgagagccgagtcagcgcggggcggggggtcgccccctttgtcctcactcagggcgggaggccctcggggtggccgcagacgccccgttgggcagccctccagcccagctctccaggcaggaggtgggggaagcctgggaaagcggagggggggccccgggatcccccgaggcgcggggctcccggcgaagcctcagatctccggcccttcccggggagggtgcg

SEQ ID NO: 24078 - DNA, 2775 bp, Homo sapiens
tccccggagctgagctggggaagggagaccagggttcaccacgttagcattcgcattcctgggaggatgcagccctcgcctggacctgggcgatagacgccttcttctgtttttatttttggaggggagcgccctgtaattgtcctgaacacatgcttcccccccttcctccagccacccgcggaggagagagtcccccttttttgcatttatcttttccttcccctttctttattaaaggtccgggagtggcggcggccaatcagcgcgcggcttccattttgtgagttcaactccgaggctcccgggcttcgcgaggacgcgtttgcagccccctctgccgctcctctctggcggccgaggcgcaggagccgcctcgccggggctcggagctggtgtagctcatattggggctcttttcggggtttgtaatttggccgtgggtaggtaattggctggagcagggcggcagggcgcggcagccaatcagcgcgcggcttctatagggcttgagttattagacgctgatctcaaaacatccttcatcagacacgaaggagaggccaacagatgagggaagccatttttctgcaatggaattaaatggccaagcccaaggactcacagttggaagactggagaagactttttaaaaagatctggatttttccttatgacttggaatccatctttgtcttgtataactaggtcatagcacaccattcatgtcagcagttaacagttttgaattccaaaaaaacctaagtaaatgacatattttttttcctctttttgttctatgggtgggtggggggagcttggagctgtcttaatctgtattctcttgactgaacaataaatttttaaatatatctagtttcctctattaaacacttaaacctggccatcttattaactccttctctctttttaacaaggtaatgttttaaatgtatatagctttaggactagcgaaatggcagcaacaaaaaattgtgagcagttgttactcttttagtttttaaaaaaccttttacattgtaagtacccaatccattctgtcctgacgcagtacagttttgatgttaatgttgctgagatgtccttaattttccgaaccttcatctgcatgtatgtctttgtctctcttgtctaatataagccagttaagatgcttgagacgatcttgctttataaagctaaggttctagctttatgcttttgaaaatgtttacagcactaaatgctagtcagctttcttccccgtagcttgtacactttctttgaaaatcgatctatttgaagaaaaacagccctgtttttctcgtctttggtgttgggggttggggggagctggtgggtgagggaaaggaagaccttttctttgtgtagagagactaaagccgtcacaggaaactagattaaaactggaaaacaagtcctagctggttccagcaaacaccaacgttaagtggggggtattttctatggtggttgggcggctggtgcgtcttgtgccttttgtttgatttgactgtattttcgccttttgtctcttaatgacgatcacaccattgctatatccagagcagtaaacagtcctcagcgaagccgcctttttgcctacccaaccctggaaagtttgcagaagtggaaggagcagaacgtgagggtgtaacttacaaaaaggttctgggccggagaaggggcgacgttcgggcaccccccgaatggacaatctttccttctgtcaacggcaggggcaggcctagtttgactctgacagtcctcccactaaggaattcctggtgactggaagggggagtgactcaggccctcaacctctagcaggtaagggtgctacctcctgggtgggcatgcccagttcctcagtgggcccagcgcggcccagcctccgaggaagctctgagcagctggcttggctccgaggtatttttagctacagatccagcccccctccatcaccacaacagtcgagtccaaatcaaacgcgctccaggcaggtggggctggggttctgccagcctcctggccagcaggggtgggtgggcagactggggccagtatcagctgttctgcctggacccaggccgggctgggaaggcacacttgtgcttatttcccgcctccacttctgtgcaagcttgtgctgtcataagcagagatcacagccccatttcttggatggagaaagtggacactgaggtctgaggcttttgaggacagtcaggagccctcctatgggctccagtgatgcactcaccagcttctggtcctcttcttccacctcttagagtgccttggctccctcctgtcgtcctggggaacctcggccccagccctgcctccccagccagtcacagctcctccctggtcaccctgagggagctcagggcccggctggtagctgggttgctctgcttctgtccccgactcctgtggagcctggcaggcaactccatgatctgaccccggttaccttgacagccctgcctggcctcccctctcatggcccagccaccccagaacctgaagaggttttctagctgccgtgcatttgccaggctgggttacccaccctactttccctgcctgccctccagtgctgccaggcctagtgtgccagccagcgctcagccttcagtaaagggttcccctgcttccaacctccattgcactgcttcccctaagactgtgacctcctggaaggctggagcacaactgcctctcaataaacgtgttgcaaaaaaggaa

SEQ ID NO: 24079 - DNA, 2869 bp, Homo sapiens
tccccggagctgagctggggaagggagaccagggttcaccacgttagcattcgcattcctgggaggatgcagccctcgcctggacctgggcgatagacgccttcttctgtttttatttttggaggggagcgccctgtaattgtcctgaacacatgcttcccccccttcctccagccacccgcggaggagagagtcccccttttttgcatttatcttttccttcccctttctttattaaaggtccgggagtggcggcggccaatcagcgcgcggcttccattttgtgagttcaactccgaggctcccgggcttcgcgaggacgcgtttgcagccccctctgccgctcctctctggcggccgaggcgcaggagccgcctcgccggggctcggagctggtgtagctcatattggggctcttttcggggtttgtaatttggccgtgggtaggtaattggctggagcagggcggcagggcgcggcagccaatcagcgcgcggcttctatagggcttgagttattagacgctgatctcaaaacatccttcatcagacacgaaggagaggccaacagatgagggaagccatttttctgcaatggaattaaatggccaagtgggtttttcctttgttgcaaatggggaatgtttttcctttgactctaccatccagttcaggacgtctcagtgtgtttaacatttgtcaacaggcccaaggactcacagttggaagactggagaagactttttaaaaagatctggatttttccttatgacttggaatccatctttgtcttgtataactaggtcatagcacaccattcatgtcagcagttaacagttttgaattccaaaaaaacctaagtaaatgacatattttttttcctctttttgttctatgggtgggtggggggagcttggagctgtcttaatctgtattctcttgactgaacaataaatttttaaatatatctagtttcctctattaaacacttaaacctggccatcttattaactccttctctctttttaacaaggtaatgttttaaatgtatatagctttaggactagcgaaatggcagcaacaaaaaattgtgagcagttgttactcttttagtttttaaaaaaccttttacattgtaagtacccaatccattctgtcctgacgcagtacagttttgatgttaatgttgctgagatgtccttaattttccgaaccttcatctgcatgtatgtctttgtctctcttgtctaatataagccagttaagatgcttgagacgatcttgctttataaagctaaggttctagctttatgcttttgaaaatgtttacagcactaaatgctagtcagctttcttccccgtagcttgtacactttctttgaaaatcgatctatttgaagaaaaacagccctgtttttctcgtctttggtgttgggggttggggggagctggtgggtgagggaaaggaagaccttttctttgtgtagagagactaaagccgtcacaggaaactagattaaaactggaaaacaagtcctagctggttccagcaaacaccaacgttaagtggggggtattttctatggtggttgggcggctggtgcgtcttgtgccttttgtttgatttgactgtattttcgccttttgtctcttaatgacgatcacaccattgctatatccagagcagtaaacagtcctcagcgaagccgcctttttgcctacccaaccctggaaagtttgcagaagtggaaggagcagaacgtgagggtgtaacttacaaaaaggttctgggccggagaaggggcgacgttcgggcaccccccgaatggacaatctttccttctgtcaacggcaggggcaggcctagtttgactctgacagtcctcccactaaggaattcctggtgactggaagggggagtgactcaggccctcaacctctagcaggtaagggtgctacctcctgggtgggcatgcccagttcctcagtgggcccagcgcggcccagcctccgaggaagctctgagcagctggcttggctccgaggtatttttagctacagatccagcccccctccatcaccacaacagtcgagtccaaatcaaacgcgctccaggcaggtggggctggggttctgccagcctcctggccagcaggggtgggtgggcagactggggccagtatcagctgttctgcctggacccaggccgggctgggaaggcacacttgtgcttatttcccgcctccacttctgtgcaagcttgtgctgtcataagcagagatcacagccccatttcttggatggagaaagtggacactgaggtctgaggcttttgaggacagtcaggagccctcctatgggctccagtgatgcactcaccagcttctggtcctcttcttccacctcttagagtgccttggctccctcctgtcgtcctggggaacctcggccccagccctgcctccccagccagtcacagctcctccctggtcaccctgagggagctcagggcccggctggtagctgggttgctctgcttctgtccccgactcctgtggagcctggcaggcaactccatgatctgaccccggttaccttgacagccctgcctggcctcccctctcatggcccagccaccccagaacctgaagaggttttctagctgccgtgcatttgccaggctgggttacccaccctactttccctgcctgccctccagtgctgccaggcctagtgtgccagccagcgctcagccttcagtaaagggttcccctgcttccaacctccattgcactgcttcccctaagactgtgacctcctggaaggctggagcacaactgcctctcaataaacgtgttgcaaaaaaggaa

SEQ ID NO: 24080 - DNA, 1953 bp, Homo sapiens
tccccggagctgagctggggaagggagaccagggttcaccacgttagcattcgcattcctgggaggatgcagccctcgcctggacctgggcgatagacgccttcttctgtttttatttttggaggggagcgccctgtaattgtcctgaacacatgcttcccccccttcctccagccacccgcggaggagagagtcccccttttttgcatttatcttttccttcccctttctttattaaaggtccgggagtggcggcggccaatcagcgcgcggcttccattttgtgagttcaactccgaggctcccgggcttcgcgaggacgcgtttgcagccccctctgccgctcctctctggcggccgaggcgcaggagccgcctcgccggggctcggagctggtgtagctcatattggggctcttttcggggtttgtaatttggccgtgggtaggtaattggctggagcagggcggcagggcgcggcagccaatcagcgcgcggcttctatagggcttgagttattagacgctgatctcaaaacatccttcatcagacacgaaggagaggccaacagatgagggaagccatttttctgcaatggaattaaatggccaagcccaaggactcacagttggaagactggagaagactttttaaaaagatctggatttttccttatgacttggaatccatctttgtcttgtataactaggtcatagcacaccattcatgtcagcagttaacagttttgaattccaaaaaaacctaaagcagtaaacagtcctcagcgaagccgcctttttgcctacccaaccctggaaagtttgcagaagtggaaggagcagaacgtgagggtgtaacttacaaaaaggttctgggccggagaaggggcgacgttcgggcaccccccgaatggacaatctttccttctgtcaacggcaggggcaggcctagtttgactctgacagtcctcccactaaggaattcctggtgactggaagggggagtgactcaggccctcaacctctagcaggtaagggtgctacctcctgggtgggcatgcccagttcctcagtgggcccagcgcggcccagcctccgaggaagctctgagcagctggcttggctccgaggtatttttagctacagatccagcccccctccatcaccacaacagtcgagtccaaatcaaacgcgctccaggcaggtggggctggggttctgccagcctcctggccagcaggggtgggtgggcagactggggccagtatcagctgttctgcctggacccaggccgggctgggaaggcacacttgtgcttatttcccgcctccacttctgtgcaagcttgtgctgtcataagcagagatcacagccccatttcttggatggagaaagtggacactgaggtctgaggcttttgaggacagtcaggagccctcctatgggctccagtgatgcactcaccagcttctggtcctcttcttccacctcttagagtgccttggctccctcctgtcgtcctggggaacctcggccccagccctgcctccccagccagtcacagctcctccctggtcaccctgagggagctcagggcccggctggtagctgggttgctctgcttctgtccccgactcctgtggagcctggcaggcaactccatgatctgaccccggttaccttgacagccctgcctggcctcccctctcatggcccagccaccccagaacctgaagaggttttctagctgccgtgcatttgccaggctgggttacccaccctactttccctgcctgccctccagtgctgccaggcctagtgtgccagccagcgctcagccttcagtaaagggttcccctgcttccaacctccattgcactgcttcccctaagactgtgacctcctggaaggctggagcacaactgcctctcaataaacgtgttgcaaaaaaggaa

SEQ ID NO: 24081 - DNA, 1799 bp, Homo sapiens
tccccggagctgagctggggaagggagaccagggttcaccacgttagcattcgcattcctgggaggatgcagccctcgcctggacctgggcgatagacgccttcttctgtttttatttttggaggggagcgccctgtaattgtcctgaacacatgcttcccccccttcctccagccacccgcggaggagagagtcccccttttttgcatttatcttttccttcccctttctttattaaaggtccgggagtggcggcggccaatcagcgcgcggcttccattttgtgagttcaactccgaggctcccgggcttcgcgaggacgcgtttgcagccccctctgccgctcctctctggcggccgaggcgcaggagccgcctcgccggggctcggagctggtgtagctcatattggggctcttttcggggtttgtaatttggccgtgggtaggtaattggctggagcagggcggcagggcgcggcagccaatcagcgcgcggcttctatagggcttgagttattagacgctgatctcaaaacatccttcatcagacacgaaggagaggccaacagatgagggaagccatttttctgcaatggaattaaatggccaaagcagtaaacagtcctcagcgaagccgcctttttgcctacccaaccctggaaagtttgcagaagtggaaggagcagaacgtgagggtgtaacttacaaaaaggttctgggccggagaaggggcgacgttcgggcaccccccgaatggacaatctttccttctgtcaacggcaggggcaggcctagtttgactctgacagtcctcccactaaggaattcctggtgactggaagggggagtgactcaggccctcaacctctagcaggtaagggtgctacctcctgggtgggcatgcccagttcctcagtgggcccagcgcggcccagcctccgaggaagctctgagcagctggcttggctccgaggtatttttagctacagatccagcccccctccatcaccacaacagtcgagtccaaatcaaacgcgctccaggcaggtggggctggggttctgccagcctcctggccagcaggggtgggtgggcagactggggccagtatcagctgttctgcctggacccaggccgggctgggaaggcacacttgtgcttatttcccgcctccacttctgtgcaagcttgtgctgtcataagcagagatcacagccccatttcttggatggagaaagtggacactgaggtctgaggcttttgaggacagtcaggagccctcctatgggctccagtgatgcactcaccagcttctggtcctcttcttccacctcttagagtgccttggctccctcctgtcgtcctggggaacctcggccccagccctgcctccccagccagtcacagctcctccctggtcaccctgagggagctcagggcccggctggtagctgggttgctctgcttctgtccccgactcctgtggagcctggcaggcaactccatgatctgaccccggttaccttgacagccctgcctggcctcccctctcatggcccagccaccccagaacctgaagaggttttctagctgccgtgcatttgccaggctgggttacccaccctactttccctgcctgccctccagtgctgccaggcctagtgtgccagccagcgctcagccttcagtaaagggttcccctgcttccaacctccattgcactgcttcccctaagactgtgacctcctggaaggctggagcacaactgcctctcaataaacgtgttgcaaaaaaggaa

SEQ ID NO: 24082 - DNA, 2311 bp, Homo sapiens
tccccggagctgagctggggaagggagaccagggttcaccacgttagcattcgcattcctgggaggatgcagccctcgcctggacctgggcgatagacgccttcttctgtttttatttttggaggggagcgccctgtaattgtcctgaacacatgcttcccccccttcctccagccacccgcggaggagagagtcccccttttttgcatttatcttttccttcccctttctttattaaaggtccgggagtggcggcggccaatcagcgcgcggcttccattttgtgagttcaactccgaggctcccgggcttcgcgaggacgcgtttgcagccccctctgccgctcctctctggcggccgaggcgcaggagccgcctcgccggggctcggagctggtgtagctcatattggggctcttttcggggtttgtaatttggccgtgggtaggtaattggctggagcagggcggcagggcgcggcagccaatcagcgcgcggcttctatagggcttgagttattagacgctgatctcaaaacatccttcatcagacacgaaggagaggccaacagatgagggaagccatttttctgcaatggaattaaatggccaagcccaaggactcacagttggaagactggagaagactttttaaaaagatctggatttttccttatgacttggaatccatctttgtcttgtataactaggtcatagcacaccattcatgtcagcagttaacagttttgaattccaaaaaaacctaagtaaatgacatattttttttcctctttttgttctatgggtgggtggggggagcttggagctgtcttaatctgtattctcttgactgaacaataaatttttaaatatatctagtttcctctattaaacacttaaacctggccatcttattaactccttctctctttttaacaaggtaatgttttaaatgtatatagctttaggactagcgaaatggcagcaacaaaaaattgtgagcagttgttactcttttagtttttaaaaaaccttttacattgtaagtacccaatccattctgtcctgacgcagtacagttttgatgttaatgttgctgagatgtccttaattttccgaaccttcatctgcatgtatgtctttgtctctcttgtctaatataagccagttaagatgcttgagacgatcttgctttataaagctaaggttctagctttatgcttttgaaaatgtttacagcactaaatgctagtcagctttcttccccgtagcttgtacactttctttgaaaatcgatctatttgaagaaaaacagccctgtttttctcgtctttggtgttgggggttggggggagctggtgggtgagggaaaggaagaccttttctttgtgtagagagactaaagccgtcacaggaaactagattaaaactggaaaacaagtcctagctggttccagcaaacaccaacgttaagtggggggtattttctatggtggttgggcggctggtgcgtcttgtgccttttgtttgatttgactgtattttcgccttttgtctcttaatgacgatcacaccattgctatatccagagcagtaaacagtcctcagcgaagccgcctttttgcctacccaaccctggaaagtttgcagaagtggaaggagcagaacgtgagggtgtaacttacaaaaaggttctgggccggagaaggggcgacgttcgggcaccccccgaatggacaatctttccttctgtcaacggcaggggcaggcctagtttgactctgacagtcctcccactaaggaattcctggtgactggaagggggagtgactcaggccctcaacctctagcagagtgccttggctccctcctgtcgtcctggggaacctcggccccagccctgcctccccagccagtcacagctcctccctggtcaccctgagggagctcagggcccggctggtagctgggttgctctgcttctgtccccgactcctgtggagcctggcaggcaactccatgatctgaccccggttaccttgacagccctgcctggcctcccctctcatggcccagccaccccagaacctgaagaggttttctagctgccgtgcatttgccaggctgggttacccaccctactttccctgcctgccctccagtgctgccaggcctagtgtgccagccagcgctcagccttcagtaaagggttcccctgcttccaacctccattgcactgcttcccctaagactgtgacctcctggaaggctggagcacaactgcctctcaataaacgtgttgcaaaaaaggaa

SEQ ID NO: 24083 - DNA, 2943 bp, Homo sapiens
tccccggagctgagctggggaagggagaccagggttcaccacgttagcattcgcattcctgggaggatgcagccctcgcctggacctgggcgatagacgccttcttctgtttttatttttggaggggagcgccctgtaattgtcctgaacacatgcttcccccccttcctccagccacccgcggaggagagagtcccccttttttgcatttatcttttccttcccctttctttattaaaggtccgggagtggcggcggccaatcagcgcgcggcttccattttgtgagttcaactccgaggctcccgggcttcgcgaggacgcgtttgcagccccctctgccgctcctctctggcggccgaggcgcaggagccgcctcgccggggctcggagctggtgtagctcatattggggctcttttcggggtttgtaatttggccgtgggtaggtaattggctggagcagggcggcagggcgcggcagccaatcagcgcgcggcttctatagggcttgagttattagacgctgatctcaaaacatccttcatcagacacgaaggagaggccaacagatgagggaagccatttttctgcaatggaattaaatggccaagcccaaggactcacagttggaagactggagaagactttttaaaaagatctggatttttccttatgacttggaatccatctttgtcttgtataactaggtcatagcacaccattcatgtcagcagttaacagttttgaattccaaaaaaacctaagtaaatgacatattttttttcctctttttgttctatgggtgggtggggggagcttggagctgtcttaatctgtattctcttgactgaacaataaatttttaaatatatctagtttcctctattaaacacttaaacctggccatcttattaactccttctctctttttaacaaggtaatgttttaaatgtatatagctttaggactagcgaaatggcagcaacaaaaaattgtgagcagttgttactcttttagtttttaaaaaaccttttacattgtaagtacccaatccattctgtcctgacgcagtacagttttgatgttaatgttgctgagatgtccttaattttccgaaccttcatctgcatgtatgtctttgtctctcttgtctaatataagccagttaagatgcttgagacgatcttgctttataaagctaaggttctagctttatgcttttgaaaatgtttacagcactaaatgctagtcagctttcttccccgtagcttgtacactttctttgaaaatcgatctatttgaagaaaaacagccctgtttttctcgtctttggtgttgggggttggggggagctggtgggtgagggaaaggaagaccttttctttgtgtagagagactaaagccgtcacaggaaactagattaaaactggaaaacaagtcctagctggttccagcaaacaccaacgttaagtggggggtattttctatggtggttgggcggctggtgcgtcttgtgccttttgtttgatttgactgtattttcgccttttgtctcttaatgacgatcacaccattgctatatccagagcagtaaacagtcctcagcgaagccgcctttttgcctacccaaccctggaaagtttgcagaagtggaaggagcagaacgtgagggtgtaacttacaaaaaggttctgggccggagaaggggcgacgttcgggcaccccccgaatggacaatctttccttctgtcaacggcaggggcaggcctagtttgactctgacagtcctcccactaaggaattcctggtgactggaagggggagtgactcaggccctcaacctctagcaggtaagggtgctacctcctgggtgggcatgcccagttcctcagtgggcccagcgcggcccagcctccgaggaagctctgagcagctggcttggctccgaggtatttttagctacagatccagcccccctccatcaccacaacagtcgagtccaaatcaaacgcgctccaggcaggtggggctggggttctgccagcctcctggccagcaggggtgggtgggcagactggggccagtatcagctgttctgcctggacccaggccgggctgggaaggcacacttgtgcttatttcccgcctccacttctgtgcaagcttgtgctgtcataagcagagatcacagccccatttcttggatggagaaagtggacactgaggtctgaggcttttgaggacagtcaggagccctcctatgggctccagtgatgcactcaccagcttctggtcctcttcttccacctcttagagtgccttggctccctcctgtcgtcctggggaacctcggccccagccctgcctccccagccagtcacagctcctccctggtcaccctgagggagctcagggcccggctggtagctgggttgctctgcttctgtccccgactcctgtggagcctggcaggcaactccatgatctgaccccggttaccttgacagccctgcctggcctcccctctcatggcccagccaccccagaacctgaagaggttttctagctgccgtgcatttgccaggctgggttacccaccctactttccctgcctgccctccagtgctgccaggcctagtgtgccagccagcgctcagccttcagtaaagggttcccctgcttccaacctccattgcactgcttcccctaagactgtgacctcctggaaggctggagcacaactgcctctcaataaacgtgttgcaaaaaaggaaaaaaaaaaagaagacaaacatgaaaagcaaaaagtgcccagcaagcatgtagaacacagcaaccaaggaagcgcaagacaggccggaaatgaaggtgtccagccagacatcaaccggaccgcgcaggcacagaaacaggacaccgggcatgcggacggaaggaagaaa

SEQ ID NO: 24084 - DNA, 3151 bp, Homo sapiens
tccccggagctgagctggggaagggagaccagggttcaccacgttagcattcgcattcctgggaggatgcagccctcgcctggacctgggcgatagacgccttcttctgtttttatttttggaggggagcgccctgtaattgtcctgaacacatgcttcccccccttcctccagccacccgcggaggagagagtcccccttttttgcatttatcttttccttcccctttctttattaaaggtccgggagtggcggcggccaatcagcgcgcggcttccattttgtgagttcaactccgaggctcccgggcttcgcgaggacgcgtttgcagccccctctgccgctcctctctggcggccgaggcgcaggagccgcctcgccggggctcggagctggtgtagctcatattggggctcttttcggggtttgtaatttggccgtgggtaggtaattggctggagcagggcggcagggcgcggcagccaatcagcgcgcggcttctatagggcttgagttattagacgctgatctcaaaacatccttcatcagacacgaaggagaggccaacagatgagggaagccatttttctgcaatggaattaaatggccaagcccaaggactcacagttggaagactggagaagactttttaaaaagatctggatttttccttatgacttggaatccatctttgtcttgtataactaggtcatagcacaccattcatgtcagcagttaacagttttgaattccaaaaaaacctaagtaaatgacatattttttttcctctttttgttctatgggtgggtggggggagcttggagctgtcttaatctgtattctcttgactgaacaataaatttttaaatatatctagtttcctctattaaacacttaaacctggccatcttattaactccttctctctttttaacaaggtaatgttttaaatgtatatagctttaggactagcgaaatggcagcaacaaaaaattgtgagcagttgttactcttttagtttttaaaaaaccttttacattgtaagtacccaatccattctgtcctgacgcagtacagttttgatgttaatgttgctgagatgtccttaattttccgaaccttcatctgcatgtatgtctttgtctctcttgtctaatataagccagttaagatgcttgagacgatcttgctttataaagctaaggttctagctttatgcttttgaaaatgtttacagcactaaatgctagtcagctttcttccccgtagcttgtacactttctttgaaaatcgatctatttgaagaaaaacagccctgtttttctcgtctttggtgttgggggttggggggagctggtgggtgagggaaaggaagaccttttctttgtgtagagagactaaagccgtcacaggaaactagattaaaactggaaaacaagtcctagctggttccagcaaacaccaacgttaagtggggggtattttctatggtggttgggcggctggtgcgtcttgtgccttttgtttgatttgactgtattttcgccttttgtctcttaatgacgatcacaccattgctatatccagagcagtaaacagtcctcagcgaagccgcctttttgcctacccaaccctggaaagtttgcagaagtggaaggagcagaacgtgagggtgtaacttacaaaaaggttctgggccggagaaggggcgacgttcgggcaccccccgaatggacaatctttccttctgtcaacggcaggggcaggcctagtttgactctgacagtcctcccactaaggaattcctggtgactggaagggggagtgactcaggccctcaacctctagcaggtaagggtgctacctcctgggtgggcatgcccagttcctcagtgggcccagcgcggcccagcctccgaggaagctctgagcagctggcttggctccgaggtatttttagctacagatccagcccccctccatcaccacaacagtcgagtccaaatcaaacgcgctccaggcaggtggggctggggttctgccagcctcctggccagcaggggtgggtgggcagactggggccagtatcagctgttctgcctggacccaggccgggctgggaaggcacacttgtgcttatttcccgcctccacttctgtgcaagcttgtgctgtcataagcagagatcacagccccatttcttggatggagaaagtggacactgaggtctgaggcttttgaggacagtcaggagccctcctatgggctccagtgatgcactcaccagcttctggtcctcttcttccacctcttagagtgccttggctccctcctgtcgtcctggggaacctcggccccagccctgcctccccagccagtcacagctcctccctggtcaccctgagggagctcagggcccggctggtagctgggttgctctgcttctgtccccgactcctgtggagcctggcaggcaactccatgatctgaccccggttaccttgacagccctgcctggcctcccctctcatggcccagccaccccagaacctgaagaggttttctagctgccgtgcatttgccaggctgggttacccaccctactttccctgcctgccctccagtgctgccaggcctagtgtgccagccagcgctcagccttcagtaaagggttcccctgcttccaacctccattgcactgcttcccctaagactgtgacctcctggaaggctggagcacaactgcctctcaataaacgtgttgcaaaaaaggaaaaaaaaaaaaaaaaaaaaaaaaaaaaaaaaaaaaaaaaggggggggccgcaaaaaatttccccccgaggggggcgcaagatttgggggttaccaagatttgttttgtaaacaaggggggggcccataatatgaggctggcaattacttagagcgcacagagggaccgctgggcgccgctttttaaaagagtttgtgaagggcggaaaaactgctcgcgcgggggggcatcttgggaaaaagaaacccaaaacaggggggggggggaaccatagtgggcaatcatacctacgggaaattttaacagctcagaggaaatatagacttgtaacgctgtatagtgggcttaacccaaggcggcatggtactgttgcgtta

SEQ ID NO: 24085 - DNA, 1169 bp, Homo sapiens
tgtgcctcttctgccccaagggcgagaagacgggcttcgcagcgaccctcgggggtccatggagccgcctgccttcgccccctcgctcttcccaggtctgaacctggatggggagaagaaattgaagtgctttggagacgggggggcttaaaacactagggagcctcatcgcccagccttgggcccactttcctttcgatcgtgaggattccgcaccccgaagccgtcttctcggggctccggggcgcgcctgcgctggcaacgcgaaggaggacaaaaggccggcgtccatgttggcaccatgacgcagcatctccgcccgcagcccggagctgctgtcctcccggccgcgctcgctcctcctcccaaacaccagttttctttacaggcttcgagcccgtcgcggctgggccgggctggtctggcaggcgggcccagccgggcagggctgctttgctaatggcggcggctctctttccttccttcctcctttcctccgtccccccggtcgtggggagcccggagcaggaggcgggcccgcggccaggttctgggccggagaaggggcgacgttcgggcaccccccgaatggacaatctttccttctgtcaacggcaggggcaggcctagtttgactctgacagtcctcccactaaggaattcctggtgactggaagggggagtgactcaggccctcaacctctagcagagtgccttggctccctcctgtcgtcctggggaacctcggccccagccctgcctccccagccagtcacagctcctccctggtcaccctgagggagctcagggcccggctggtagctgggttgctctgcttctgtccccgactcctgtggagcctggcaggcaactccatgatctgaccccggttaccttgacagccctgcctggcctcccctctcatggcccagccaccccagaacctgaagaggttttctagctgccgtgcatttgccaggctgggttacccaccctactttccctgcctgccctccagtgctgccaggcctagtgtgccagccagcgctcagccttcagtaaagggttcccctgcttccaacctccattgcactgcttcccctaagactgtgacctcctggaaggctggagcacaactgcctctcaataaacgtgttgcaaaaaaggaa

SEQ ID NO: 24086 - DNA, 2236 bp, Homo sapiens
tccccggagctgagctggggaagggagaccagggttcaccacgttagcattcgcattcctgggaggatgcagccctcgcctggacctgggcgatagacgccttcttctgtttttatttttggaggggagcgccctgtaattgtcctgaacacatgcttcccccccttcctccagccacccgcggaggagagagtcccccttttttgcatttatcttttccttcccctttctttattaaaggtccgggagtggcggcggccaatcagcgcgcggcttccattttgtgagttcaactccgaggctcccgggcttcgcgaggacgcgtttgcagccccctctgccgctcctctctggcggccgaggcgcaggagccgcctcgccggggctcggagctggtgtagctcatattggggctcttttcggggtttgtaatttggccgtgggtaggtaattggctggagcagggcggcagggcgcggcagccaatcagcgcgcggcttctatagggcttgagttattagacgctgatctcaaaacatccttcatcagacacgaaggagaggccaacagatgagggaagccatttttctgcaatggaattaaatggccaagcccaaggactcacagttggaagactggagaagactttttaaaaagatctggatttttccttatgacttggaatccatctttgtcttgtataactaggtcatagcacaccattcatgtcagcagttaacagttttgaattccaaaaaaacctaagtaaatgacatattttttttcctctttttgttctatgggtgggtggggggagcttggagctgtcttaatctgtattctcttgactgaacaataaatttttaaatatatctagtttcctctattaaacacttaaacctggccatcttattaactccttctctctttttaacaaggtaatgttttaaatgtatatagctttaggactagcgaaatggcagcaacaaaaaattgtgagcagttgttactcttttagtttttaaaaaaccttttacattgtaagtacccaatccattctgtcctgacgcagtacagttttgatgttaatgttgctgagatgtccttaattttccgaaccttcatctgcatgtatgtctttgtctctcttgtctaatataagccagttaagatgcttgagacgatcttgctttataaagctaaggttctagctttatgcttttgaaaatgtttacagcactaaatgctagtcagctttcttccccgtagcttgtacactttctttgaaaatcgatctatttgaagaaaaacagccctgtttttctcgtctttggtgttgggggttggggggagctggtgggtgagggaaaggaagaccttttctttgtgtagagagactaaagccgtcacaggaaactagattaaaactggaaaacaagtcctagctggttccagcaaacaccaacgttaagtggggggtattttctatggtggttgggcggctggtgcgtcttgtgccttttgtttgatttgactgtattttcgccttttgtctcttaatgacgatcacaccattgctatatccagagcagtaaacagtcctcagcgaagccgcctttttgcctacccaaccctggaaagtttgcagaagtggaaggagcagaacgtgagggtgtaacttacaaaaaggttctgggccggagaaggggcgacgttcgggcaccccccgaatggacaatctttccttctgtcaacggcaggggcaggcctagtttgactctgacagtcctcccactaaggaattcctggtgactggaagggggagtgactcaggccctcaacctctagcaggtaagggtgctacctcctgggtgggcatgcccagttcctcagtgggcccagcgcggcccagcctccgaggaagctctgagcagctggcttggctccgaggtatttttagctacagatccagcccccctccatcaccacaacagtcgagtccaaatcaaacgcgctccaggcaggtggggctggggttctgccagcgctgggttacccaccctactttccctgcctgccctccagtgctgccaggcctagtgtgccagccagcgctcagccttcagtaaagggttcccctgcttccaacctccattgcactgcttcccctaagactgtgacctcctggaaggctggagcacaactgcctctcaataaacgtgttgcaaaaaaggaa

SEQ ID NO: 24087 - DNA, 1564 bp, Homo sapiens
tccccggagctgagctggggaagggagaccagggttcaccacgttagcattcgcattcctgggaggatgcagccctcgcctggacctgggcgatagacgccttcttctgtttttatttttggaggggagcgccctgtaattgtcctgaacacatgcttcccccccttcctccagccacccgcggaggagagagtcccccttttttgcatttatcttttccttcccctttctttattaaaggtccgggagtggcggcggccaatcagcgcgcggcttccattttgtgagttcaactccgaggctcccgggcttcgcgaggacgcgtttgcagccccctctgccgctcctctctggcggccgaggcgcaggagccgcctcgccggggctcggagctggtgtagctcatattggggctcttttcggggtttgtaatttggccgtgggtaggtaattggctggagcagggcggcagggcgcggcagccaatcagcgcgcggcttctatagggcttgagttattagacgctgatctcaaaacatccttcatcagacacgaaggagaggccaacagatgagggaagccatttttctgcaatggaattaaatggccaagcccaaggactcacagttggaagactggagaagactttttaaaaagatctggatttttccttatgacttggaatccatctttgtcttgtataactaggtcatagcacaccattcatgtcagcagttaacagttttgaattccaaaaaaacctaaagcagtaaacagtcctcagcgaagccgcctttttgcctacccaaccctggaaagtttgcagaagtggaaggagcagaacgtgagggtgtaacttacaaaaagaacagaaccagagaaaagacaacagtaacagagcaccccccgaatgggacaaactattcctacagacaacaacaaaaacaaaccaataaaaacacaaacaaaccacccacaaagaaaaaccaaaaacaaaaataaaacaaacacaagccctcaacctctagcaggtaagggtgctacctcctgggtgggcatgcccagttcctcagtgggcccagcgcggcccagcctccgaggaagctctgagcagctggcttggctccgaggtatttttagcgtggaggaagaccaacgcccccaccaacagcacaacaaacaaaaccaaaacaaacacacaccaaacaaaaaaacaaaaaacaaccaaccaccaaccaacaaaaaaaaacagacgaaaaccagaacaagaaaacaacctaagatccctaagttctcagttgtaattgaaagtatctactcgtaagatcgggaaaagtgcccgggcggaccgcaggcgaaaagcaaagccagaggactgagtgcaaaagggccgtaaaaagacagaggtcccagggggcaagggagagatgagaagtgaggatcgtcgaaatgggcaaaaggcgtgttaaaatgaacgggtcgaagaaggtgtacgaaagatgtggccagggagagcacgggcagcagggggatagggccggcgtggagctactgtcgtagaggg

SEQ ID NO: 24088 - DNA, 2047 bp, Homo sapiens
tccccggagctgagctggggaagggagaccagggttcaccacgttagcattcgcattcctgggaggatgcagccctcgcctggacctgggcgatagacgccttcttctgtttttatttttggaggggagcgccctgtaattgtcctgaacacatgcttcccccccttcctccagccacccgcggaggagagagtcccccttttttgcatttatcttttccttcccctttctttattaaaggtccgggagtggcggcggccaatcagcgcgcggcttccattttgtgagttcaactccgaggctcccgggcttcgcgaggacgcgtttgcagccccctctgccgctcctctctggcggccgaggcgcaggagccgcctcgccggggctcggagctggtgtagctcatattggggctcttttcggggtttgtaatttggccgtgggtaggtaattggctggagcagggcggcagggcgcggcagccaatcagcgcgcggcttctatagggcttgagttattagacgctgatctcaaaacatccttcatcagacacgaaggagaggccaacagatgagggaagccatttttctgcaatggaattaaatggccaagtgggtttttcctttgttgcaaatggggaatgtttttcctttgactctaccatccagttcaggacgtctcagtgtgtttaacatttgtcaacaggcccaaggactcacagttggaagactggagaagactttttaaaaagatctggatttttccttatgacttggaatccatctttgtcttgtataactaggtcatagcacaccattcatgtcagcagttaacagttttgaattccaaaaaaacctaaagcagtaaacagtcctcagcgaagccgcctttttgcctacccaaccctggaaagtttgcagaagtggaaggagcagaacgtgagggtgtaacttacaaaaaggttctgggccggagaaggggcgacgttcgggcaccccccgaatggacaatctttccttctgtcaacggcaggggcaggcctagtttgactctgacagtcctcccactaaggaattcctggtgactggaagggggagtgactcaggccctcaacctctagcaggtaagggtgctacctcctgggtgggcatgcccagttcctcagtgggcccagcgcggcccagcctccgaggaagctctgagcagctggcttggctccgaggtatttttagctacagatccagcccccctccatcaccacaacagtcgagtccaaatcaaacgcgctccaggcaggtggggctggggttctgccagcctcctggccagcaggggtgggtgggcagactggggccagtatcagctgttctgcctggacccaggccgggctgggaaggcacacttgtgcttatttcccgcctccacttctgtgcaagcttgtgctgtcataagcagagatcacagccccatttcttggatggagaaagtggacactgaggtctgaggcttttgaggacagtcaggagccctcctatgggctccagtgatgcactcaccagcttctggtcctcttcttccacctcttagagtgccttggctccctcctgtcgtcctggggaacctcggccccagccctgcctccccagccagtcacagctcctccctggtcaccctgagggagctcagggcccggctggtagctgggttgctctgcttctgtccccgactcctgtggagcctggcaggcaactccatgatctgaccccggttaccttgacagccctgcctggcctcccctctcatggcccagccaccccagaacctgaagaggttttctagctgccgtgcatttgccaggctgggttacccaccctactttccctgcctgccctccagtgctgccaggcctagtgtgccagccagcgctcagccttcagtaaagggttcccctgcttccaacctccattgcactgcttcccctaagactgtgacctcctggaaggctggagcacaactgcctctcaataaacgtgttgcaaaaaaggaa

SEQ ID NO: 24089 - DNA, 1763 bp, Homo sapiens
gagacagagtttcgctcttgttgcccaggcaatggtgtgatctgggctcaccgcaacctccgcctccagggttcaagcgattctcctgcctcagcctccgagtagctgggattacaggcatgcgccaccacgcccggataattttgtatttttagtagagacagggtttctccatgttggtcaggctggtctcaaactgacctcaggtgatccgcccacctcggcctcccaaagtgctgggattacaggcatgagccactgcgcctggccggacaataatgttttgagctgttgctgagtctggcttttgtgacgggaacttttagcactcaaggagtggccttgtctctggcctgtcccccagtgctcatgggcagccaaggcctggggactgctcaggcagggtagatgtatttgccaggccagctcccgtccctgggacctcagggagtagcttcatccctgaaggctgagtgtcttctgcctcatgtgggtggcccctctgcagggttctcaggcatccagggaagtgggtgccacagcgttgcctccagcctcactggggctggctggactttgctctgacaacacagcagtggctgggcccctgcaactctccagggctcagtttccctgttggccgcactatggcataggcccctgtgtggacaccgatgagctgaccccacaaatgccacccggccgctcccccaggcttcagtggcctaacagctgttgtgtcaggaaccagcttaaagaatctttcttgctttctcaaactctccaggaattcctggtgactggaagggggagtgactcaggccctcaacctctagcaggtaagggtgctacctcctgggtgggcatgcccagttcctcagtgggcccagcgcggcccagcctccgaggaagctctgagcagctggcttggctccgaggtatttttagctacagatccagcccccctccatcaccacaacagtcgagtccaaatcaaacgcgctccaggcaggtggggctggggttctgccagcctcctggccagcaggggtgggtgggcagactggggccagtatcagctgttctgcctggacccaggccgggctgggaaggcacacttgtgcttatttcccgcctccacttctgtgcaagcttgtgctgtcataagcagagatcacagccccatttcttggatggagaaagtggacactgaggtctgaggcttttgaggacagtcaggagccctcctatgggctccagtgatgcactcaccagcttctggtcctcttcttccacctcttagagtgccttggctccctcctgtcgtcctggggaacctcggccccagccctgcctccccagccagtcacagctcctccctggtcaccctgagggagctcagggcccggctggtagctgggttgctctgcttctgtccccgactcctgtggagcctggcaggcaactccatgatctgaccccggttaccttgacagccctgcctggcctcccctctcatggcccagccaccccagaacctgaagaggttttctagctgccgtgcatttgccaggctgggttacccaccctactttccctgcctgccctccagtgctgccaggcctagtgtgccagccagcgctcagccttcagtaaagggttcccctgcttccaacctccattgcactgcttcccctaagactgtgacctcctggaaggctggagcacaactgcctctcaataaacgtgttgcaaaaaaggaa

SEQ ID NO: 24090 - DNA, 3177 bp, Homo sapiens
gcgcccggcaggcgttcagggaagcgcggccacgcctgggccggccaccatttcccgggcgccgcggcggcgccgactcgcgggcagcggcccctcagtgcgcccagccgggcccccgaacgccgggagcatgagcgcgggctcggagcgcggggcggcggcaacccccgggggtttgcccgcgccctgcgcctcgaaggtggagctgcggctcagctgccggcacctgctggaccgcgacccgctcaccaagtccgaccccagcgtggcgttgctgcagcaggcgcagggccagtgggtgcaggtgggcagaaccgaggtggtccggagcagcctgcatcccgtgttctccaaggtcttcacggtggactactacttcgaggaggtgcagaggctgcgctttgaggtgtacgacacgcatgggcccagcggcttcagctgtcaggaggacgatttcctggggggcatggagtgcaccctggggcagccagcccaaaagtggcttctgcaagtcgtgatgagagtgtctgttgatgtgctgggccctgctggacactgcgctaagcacttcctgtgctgcacggaatcctcacaccttgccaggacgggtccttcttttttattgaggtatgatgacctctgcctcccctgggcgactgctggcgccgtgaggtggtggacgtgcaggggtggccacacgcagggatggcagattgtggcccagaagaaggtgacccgcccgctgctgctcaagtttggcaggaacgctggcaagtccaccatcacggtgatcgccgaggacatctcggggaacaacggctacgtggagctctccttccgggccaggaagctggacgacaaggacctcttcagcaagtccgaccccttcctggagctctacagggtcaacgacgaccagggcttgcagctggtgtacaggacggaggtggtgaagaacaacctgaacccggtgtgggaggccttcaaagtctctctgagttccctctgcagctgcgaggagacaaggcctctaaagtgcctggtctgggattacgactctcgaggaaagcacgacttcatcggagaattctctaccaccttcgaggagatgcagaaggcctttgaggaggggcaggcccagtgggactgtgtgaaccccaaatacaagcagaagagacgcagttataagaactcaggagtggtcgtcctggctgacctcaagttccacagggtgtactccttcctggactatatcatgggcggctgccagatccacttcaccgtggccattgacttcaccgcctccaatggagacccgcggaacagctgctccctgcactacatcaacccctaccagccgaacgagtacctgaaggcactggtgtccgtgggcgagatctgccaggactatgacagtgacaagaggttttccgctttggggtttggagcccggatccctcccaagtatgaggtgtcccatgactttgccatcaatttcaaccctgaggacgatgagtgtgaaggcatccagggcgtggtggaggcctaccagaactgcctgcccagggtccagctctacggccccaccaacgtggcgcccatcatctccaaggtggcacgcgtggcggcggccgaggagagcaccgggaaagcctctcaatactacatcctgctgatcctgacggacggcgtggtgaccgacatggccgacacacgggaggccattgtgcgtgcctcacgcctgcccatgtccatcatcatcgtgggcgtgggcaacgccgacttcaccgacatgcaggtcctggacggcgacgacggcgtcctgcgctccccacggggtgagcccgcgctccgggacatcgtacagttcgtgcccttccgggagctcaagaacgcatcccctgcggcgctggccaagtgcgtgctggccgaggtcccgaagcaggtggtggagtactacagccacagaggcctgcccccgagaagcctgggtgtccctgccggagaggccagcccaggctgcacaccgtgaagatgtggagggcgtagggtgggggcagtgaggaatgggtccgtacagcctctgtctgcaacatgcttggggtcccttaagctccctccgacctcccagaagcctccagtccccaccaggccccactcccagtcctcctgggatcctgctggcttgggcccggctctggggcccccaaggccgaagggtgacaaaatacaggcccccatgcctggccctgcctgagccaggtgggtggagggagggagatcatgagggacttggagggagctgggagttcatccacgggagaccctgccccgatgagaaggggcagggactgggggctctgctttgcgtctaacctttgtgggggagggccagcaaggcagtccccccacgcccgagaaagcctgggggacccagacacctgtccccacagtcaaagcctggggacccagacatcctgtccccacagtcagcctcctgtccctgctggtgcccccacacccacctaccctgtgctttttgccgtcgggcctctgcacctgggtccatggggtctgcggggtctgcggggtctgcctggcctgtgggttctgccggtggggcttcaggagtaataaagtgtcaccctaaaaaaaaaaaaaaaaaaaaaaaaaaaaaaaaaaaaaaaaaaaaaaaaaaaaaaaaaaaacgggggcgcggcgcgcacacaaagataccccgcgggggggggcgcacatatatcagcagcaccccgcaaattttgtgaacaagaaggggcgccccaataacaggaggagcgcgcctaataaaaacacacgacaccgacgagaggcggcggcgatacacaagacgcggggagcggcgggaacaacacgcgtacagaggaggaaaccatgtcgggaggaaagaggccggcccatacaatgatggagggggggggggacaccgaaaacgtggggaacaacaactccccctctacgaggaagttattgtagctgcgtccagcgagggatataataatacacaacttgtcaagaagagtaaataatattggtgggtacaaaaccacacgtagataaattagtatgtgtagtgtgagcaaaaattggggtaacaggggagtgagtgttagtcaaaaaactttttttcccgaggcg

SEQ ID NO: 24091 - DNA, 2952 bp, Homo sapiens
gcgcccggcaggcgttcagggaagcgcggccacgcctgggccggccaccatttcccgggcgccgcggcggcgccgactcgcgggcagcggcccctcagtgcgcccagccgggcccccgaacgccgggagcatgagcgcgggctcggagcgcggggcggcggcaacccccgggggtttgcccgcgccctgcgcctcgaaggtggagctgcggctcagctgccggcacctgctggaccgcgacccgctcaccaagtccgaccccagcgtggcgttgctgcagcaggcgcagggccagtgggtgcaggtgggcagaaccgaggtggtccggagcagcctgcatcccgtgttctccaaggtcttcacggtggactactacttcgaggaggtgcagaggctgcgctttgaggtgtacgacacgcatgggcccagcggcttcagctgtcaggaggacgatttcctggggggcatggagtgcaccctggggcagattgtggcccagaagaaggtgacccgcccgctgctgctcaagtttggcaggaacgctggcaagtccaccatcacggtgatcgccgaggacatctcggggaacaacggctacgtggagctctccttccgggccaggaagctggacgacaaggacctcttcagcaagtccgaccccttcctggagctctacagggtcaacgacgaccagggcttgcagctggtgtacaggacggaggtggtgaagaacaacctgaacccggtgtgggaggccttcaaagtctctctgagttccctctgcagctgcgaggagacaaggcctctaaagtgcctggtctgggattacgactctcgaggaaagcacgacttcatcggagaattctctaccaccttcgaggagatgcagaaggcctttgaggaggggcaggcccagtgggactgtgtgaaccccaaatacaagcagaagagacgcagttataagaactcaggagtggtcgtcctggctgacctcaagttccacagggtgtactccttcctggactatatcatgggcggctgccagatccacttcaccgtggccattgacttcaccgcctccaatggagacccgcggaacagctgctccctgcactacatcaacccctaccagccgaacgagtacctgaaggcactggtgtccgtgggcgagatctgccaggactatgacagtgacaagaggttttccgctttggggtttggagcccggatccctcccaagtatgaggtgtcccatgactttgccatcaatttcaaccctgaggacgatgagtgtgaaggcatccagggcgtggtggaggcctaccagaactgcctgcccagggtccagctctacggccccaccaacgtggcgcccatcatctccaaggtggcacgcgtggcggcggccgaggagagcaccgggaaagcctctcaatactacatcctgctgatcctgacggacggcgtggtgaccgacatggccgacacacgggaggccattgtgcgtgcctcacgcctgcccatgtccatcatcatcgtgggcgtgggcaacgccgacttcaccgacatgcaggtcctggacggcgacgacggcgtcctgcgctccccacggggtgagcccgcgctccgggacatcgtacagttcgtgcccttccgggagctcaagaacgcatcccctgcggcgctggccaagtgcgtgctggccgaggtcccgaagcaggtggtggagtactacagccacagaggcctgcccccgagaagcctgggtgtccctgccggagaggccagcccaggctgcacaccgtgaagatgtggagggcgtagggtgggggcagtgaggaatgggtccgtacagcctctgtctgcaacatgcttggggtcccttaagctccctccgacctcccagaagcctccagtccccaccaggccccactcccagtcctcctgggatcctgctggcttgggcccggctctggggcccccaaggccgaagggtgacaaaatacaggcccccatgcctggccctgcctgagccaggtgggtggagggagggagatcatgagggacttggagggagctgggagttcatccacgggagaccctgccccgatgagaaggggcagggactgggggctctgctttgcgtctaacctttgtgggggagggccagcaaggcagtccccccacgcccgagaaagcctgggggacccagacacctgtccccacagtcaaagcctggggacccagacatcctgtccccacagtcagcctcctgtccctgctggtgcccccacacccacctaccctgtgctttttgccgtcgggcctctgcacctgggtccatggggtctgcggggtctgcggggtctgcctggcctgtgggttctgccggtggggcttcaggagtaataaagtgtcaccctaaaaaaaaaaaaaaaaaaaaaaaaaaaaaaaaaaaaaaaaaaaaaaaaaaaaaaaaaaaacgggggcgcggcgcgcacacaaagataccccgcgggggggggcgcacatatatcagcagcaccccgcaaattttgtgaacaagaaggggcgccccaataacaggaggagcgcgcctaataaaaacacacgacaccgacgagaggcggcggcgatacacaagacgcggggagcggcgggaacaacacgcgtacagaggaggaaaccatgtcgggaggaaagaggccggcccatacaatgatggagggggggggggacaccgaaaacgtggggaacaacaactccccctctacgaggaagttattgtagctgcgtccagcgagggatataataatacacaacttgtcaagaagagtaaataatattggtgggtacaaaaccacacgtagataaattagtatgtgtagtgtgagcaaaaattggggtaacaggggagtgagtgttagtcaaaaaactttttttcccgaggcg

SEQ ID NO: 24092 - DNA, 1583 bp, Homo sapiens
tgatcagctgagccctcggtccctctcctggacacgaagctcccgccctagtggggccccacgcaatactacatcctgctgatcctgacggacggcgtggtgaccgacatggccgacacacgggaggccattgtgcgtgcctcacgcctgcccatgtccatcatcatcgtgggcgtgggcaacgccgacttcaccgacatgcaggtcctggacggcgacgacggcgtcctgcgctccccacggggtgagcccgcgctccgggacatcgtacagttcgtgcccttccgggagctcaagaacgcatcccctgcggcgctggccaagtgcgtgctggccgaggtcccgaagcaggtggtggagtactacagccacagaggcctgcccccgagaagcctgggtgtccctgccggagaggccagcccaggctgcacaccgtgaagatgtggagggcgtagggtgggggcagtgaggaatgggtccgtacagcctctgtctgcaacatgcttggggtcccttaagctccctccgacctcccagaagcctccagtccccaccaggccccactcccagtcctcctgggatcctgctggcttgggcccggctctggggcccccaaggccgaagggtgacaaaatacaggcccccatgcctggccctgcctgagccaggtgggtggagggagggagatcatgagggacttggagggagctgggagttcatccacgggagaccctgccccgatgagaaggggcagggactgggggctctgctttgcgtctaacctttgtgggggagggccagcaaggcagtccccccacgcccgagaaagcctgggggacccagacacctgtccccacagtcaaagcctggggacccagacatcctgtccccacagtcagcctcctgtccctgctggtgcccccacacccacctaccctgtgctttttgccgtcgggcctctgcacctgggtccatggggtctgcggggtctgcggggtctgcctggcctgtgggttctgccggtggggcttcaggagtaataaagtgtcaccctaaaaaaaaaaaaaaaaaaaaaaaaaaaaaaaaaaaaaaaaaaaaaaaaaaaaaaaaaaaacgggggcgcggcgcgcacacaaagataccccgcgggggggggcgcacatatatcagcagcaccccgcaaattttgtgaacaagaaggggcgccccaataacaggaggagcgcgcctaataaaaacacacgacaccgacgagaggcggcggcgatacacaagacgcggggagcggcgggaacaacacgcgtacagaggaggaaaccatgtcgggaggaaagaggccggcccatacaatgatggagggggggggggacaccgaaaacgtggggaacaacaactccccctctacgaggaagttattgtagctgcgtccagcgagggatataataatacacaacttgtcaagaagagtaaataatattggtgggtacaaaaccacacgtagataaattagtatgtgtagtgtgagcaaaaattggggtaacaggggagtgagtgttagtcaaaaaactttttttcccgaggcg

SEQ ID NO: 24093 - DNA, 975 bp, Homo sapiens
actagcccgacagccccgactagcccgacaggcccccatgcctggccctgcctgagccaggtgggtggagggagggagatcatgagggacttggagggagctgggagttcatccacgggagaccctgccccgatgagaaggggcagggactgggggctctgctttgcgtctaacctttgtgggggagggccagcaaggcagtccccccacgcccgagaaagcctgggggacccagacacctgtccccacagtcaaagcctggggacccagacatcctgtccccacagtcagcctcctgtccctgctggtgcccccacacccacctaccctgtgctttttgccgtcgggcctctgcacctgggtccatggggtctgcggggtctgcggggtctgcctggcctgtgggttctgccggtggggcttcaggagtaataaagtgtcaccctaaaaaaaaaaaaaaaaaaaaaaaaaaaaaaaaaaaaaaaaaaaaaaaaaaaaaaaaaaaacgggggcgcggcgcgcacacaaagataccccgcgggggggggcgcacatatatcagcagcaccccgcaaattttgtgaacaagaaggggcgccccaataacaggaggagcgcgcctaataaaaacacacgacaccgacgagaggcggcggcgatacacaagacgcggggagcggcgggaacaacacgcgtacagaggaggaaaccatgtcgggaggaaagaggccggcccatacaatgatggagggggggggggacaccgaaaacgtggggaacaacaactccccctctacgaggaagttattgtagctgcgtccagcgagggatataataatacacaacttgtcaagaagagtaaataatattggtgggtacaaaaccacacgtagataaattagtatgtgtagtgtgagcaaaaattggggtaacaggggagtgagtgttagtcaaaaaactttttttcccgaggcg

SEQ ID NO: 24094 - DNA, 509 bp, Homo sapiens
gagtgcaggggggccgggctcaccccctgccccccacaggcatccagggcgtggtggaggcctaccagaactgcctgcccagggtccagctctacggccccaccaacgtggcgcccatcatctccaaggtggcacgcgtggcggcggccgaggagagcaccgggaaagcctctgtaggtgcccggggggtgtggtgcatgcttggtgtggggtcggctgtgtgtgcaccagcgcgtggacgtcagggaggcacctggcagagggaacagccagcgcagaggcccccaggcaggacagagctcaggagggcgggggcccagctggttgactacgtctccctcaaaggtgcaggtgtctcgggcacagggctgtccatcgcctcacacggtcacggccatggctgcagcgaggctgcccctctcctcttcctctgggcaccacaaggccgcgcacatgtctactgtttggctgtgtgtgtatcgtcattttgtttacatgtgtctttcctt

SEQ ID NO: 24095 - DNA, 259 bp, Homo sapiens
ggaacagccagcgcagaggcccccaggcaggacagagctcaggagggcgggggcccagctggttgactacgtctccctcaaaggtgcaggtgtctcgggcacagggctgtccatcgcctcacacggtcacggccatggctgcagcgaggctgcccctctcctcttcctctgggcaccacaaggccgcgcacatgtctactgtttggctgtgtgtgtatcgtcattttgtttacatgtgtctttccttgcacaaatgata

SEQ ID NO: 24096 - DNA, 2818 bp, Homo sapiens
gcgcccggcaggcgttcagggaagcgcggccacgcctgggccggccaccatttcccgggcgccgcggcggcgccgactcgcgggcagcggcccctcagtgcgcccagccgggcccccgaacgccgggagcatgagcgcgggctcggagcgcggggcggcggcaacccccgggggtttgcccgcgccctgcgcctcgaaggtggagctgcggctcagctgccggcacctgctggaccgcgacccgctcaccaagtccgaccccagcgtggcgttgctgcagcaggcgcagggccagtgggtgcaggtgggcagaaccgaggtggtccggagcagcctgcatcccgtgttctccaaggtcttcacggtggactactacttcgaggaggtgcagaggctgcgctttgaggtgtacgacacgcatgggcccagcggcttcagctgtcaggaggacgatttcctggggggcatggagtgcaccctggggcagattgtggcccagaagaaggtgacccgcccgctgctgctcaagtttggcaggaacgctggcaagtccaccatcacggtgatcgccgaggacatctcggggaacaacggctacgtggagctctccttccgggccaggaagctggacgacaaggacctcttcagcaagtccgaccccttcctggagctctacagggtcaacgacgaccagggcttgcagctggtgtacaggacggaggtggtgaagaacaacctgaacccggtgtgggaggccttcaaagtctctctgagttccctctgcagctgcgaggagacaaggcctctaaagtgcctggtctgggattacgactctcgaggaaagcacgacttcatcggagaattctctaccaccttcgaggagatgcagaaggcctttgaggaggggcaggcccagtgggactgtgtgaaccccaaatacaagcagaagagacgcagttataagaactcaggagtggtcgtcctggctgacctcaagttccacagggtgtactccttcctggactatatcatgggcggctgccagatccacttcaccgtggccattgacttcaccgcctccaatggagacccgcggaacagctgctccctgcactacatcaacccctaccagccgaacgagtacctgaaggcactggtgtccgtgggcgagatctgccaggactatgacagtgacaagaggttttccgctttggggtttggagcccggatccctcccaagtatgaggtgtcccatgactttgccatcaatttcaaccctgaggacgatgagtgtgaagcaatactacatcctgctgatcctgacggacggcgtggtgaccgacatggccgacacacgggaggccattgtgcgtgcctcacgcctgcccatgtccatcatcatcgtgggcgtgggcaacgccgacttcaccgacatgcaggtcctggacggcgacgacggcgtcctgcgctccccacggggtgagcccgcgctccgggacatcgtacagttcgtgcccttccgggagctcaagaacgcatcccctgcggcgctggccaagtgcgtgctggccgaggtcccgaagcaggtggtggagtactacagccacagaggcctgcccccgagaagcctgggtgtccctgccggagaggccagcccaggctgcacaccgtgaagatgtggagggcgtagggtgggggcagtgaggaatgggtccgtacagcctctgtctgcaacatgcttggggtcccttaagctccctccgacctcccagaagcctccagtccccaccaggccccactcccagtcctcctgggatcctgctggcttgggcccggctctggggcccccaaggccgaagggtgacaaaatacaggcccccatgcctggccctgcctgagccaggtgggtggagggagggagatcatgagggacttggagggagctgggagttcatccacgggagaccctgccccgatgagaaggggcagggactgggggctctgctttgcgtctaacctttgtgggggagggccagcaaggcagtccccccacgcccgagaaagcctgggggacccagacacctgtccccacagtcaaagcctggggacccagacatcctgtccccacagtcagcctcctgtccctgctggtgcccccacacccacctaccctgtgctttttgccgtcgggcctctgcacctgggtccatggggtctgcggggtctgcggggtctgcctggcctgtgggttctgccggtggggcttcaggagtaataaagtgtcaccctaaaaaaaaaaaaaaaaaaaaaaaaaaaaaaaaaaaaaaaaaaaaaaaaaaaaaaaaaaaacgggggcgcggcgcgcacacaaagataccccgcgggggggggcgcacatatatcagcagcaccccgcaaattttgtgaacaagaaggggcgccccaataacaggaggagcgcgcctaataaaaacacacgacaccgacgagaggcggcggcgatacacaagacgcggggagcggcgggaacaacacgcgtacagaggaggaaaccatgtcgggaggaaagaggccggcccatacaatgatggagggggggggggacaccgaaaacgtggggaacaacaactccccctctacgaggaagttattgtagctgcgtccagcgagggatataataatacacaacttgtcaagaagagtaaataatattggtgggtacaaaaccacacgtagataaattagtatgtgtagtgtgagcaaaaattggggtaacaggggagtgagtgttagtcaaaaaactttttttcccgaggcg

SEQ ID NO: 24097 - DNA, 1230 bp, Homo sapiens
  misc_feature (1168)..(1168): n is a, c, g, or t
gcgcccggcaggcgttcagggaagcgcggccacgcctgggccggccaccatttcccgggcgccgcggcggcgccgactcgcgggcagcggcccctcagtgcgcccagccgggcccccgaacgccgggagcatgagcgcgggctcggagcgcggggcggcggcaacccccgggggtttgcccgcgccctgcgcctcgaaggtggagctgcggctcagctgccggcacctgctggaccgcgacccgctcaccaagtccgaccccagcgtggcgttgctgcagcaggcgcagggccagtgggtgcaggtgggcagaaccgaggtggtccggagcagcctgcatcccgtgttctccaaggtcttcacggtggactactacttcgaggaggtgcagaggctgcgctttgaggtgtacgacacgcatgggcccagcggcttcagctgtcaggaggacgatttcctggggggcatggagtgcaccctggggcagattgtggcccagaagaaggtgacccgcccgctgctgctcaagtttggcaggaacgctggcaagtccaccatcacggtgatcgccgaggacatctcggggaacaacggctacgtggagctctccttccgggccaggaagctggacgacaaggacctcttcagcaagtccgaccccttcctggagctctacagggtcaacgacgaccagggcttgcagctggtgtacaggacggaggtggtgaagaacaacctgaacccggtgtgggaggccttcaaagtctctctgagttccctctgcagctgcgaggagacaaggcctctaaagtgcctggtctgggattacgactctcgaggaaagcacgacttcatcggagaattctctaccaccttcgaggagatgcagaaggcctttgaggaggggcaggcccagtgggactgtgtgaaccccaaatacaagcagaagagacgcagttataagaactcaggagtggtcgtcctggctgacctcaagttccacagggtgtactccttcctggactatatcatgggcggctgccagatccacttcaccacaaaacgtgaacgaggagaaactggagtgagcgtttgaaccagccacagtctctacgtgtcatccaaggagcccggcacagaccccgtgtcacccccatgtcacccgcanaccccgcgtcacccatagatacgcacaccccgtgtcacccccatgtcacccgcgtgtcaccc

SEQ ID NO: 24098 - DNA, 662 bp, Homo sapiens
  misc_feature (238)..(238): n is a, c, g, or t
ccccaaatacaagcagaagagacgcagttataagaactcaggagtggtcgtcctggctgacctcaagttccacagggtgtactccttcctggactatatcatgggcggctgccagatccacttcaccacaaaacgtgaacgaggagaaactggagtgagcgtttgaaccagccacagtctctacgtgtcatccaaggagcccggcacagaccccgtgtcacccccatgtcacccgcanaccccgcgtcacccatagatacgcacaccccgtgtcacccccatgtcacccgcgtgtcacccacagatacacggcccccgtgtcacccgcgtgtcacccacagatacacggcccccgtgtcacccgcgtgtcacccacagatacacggcccccgtgtcacccgcgtgtcacacccacagatacacggcccccgtgtcacccgcgtgtcacccacagatacacggcccccgtgtcacccgcgtgttatttgcagatgcgctggttcgtgttttgttgaacgagccccagaatggctttgggagaagccagcaagtgggaaacgtggggggacccagaccaggcttggtccacttaggccctgccggggagggtggtagaggggttgggcggccactaagaaggatgggcggggcccccacaaggc

SEQ ID NO: 24099 - DNA, 246 bp, Homo sapiens
aaagagagaatagatctcagaggatagtcagactcaaatatgttagaaacaagtttcagatgaatttcaaggattacagatggatgcattgaatgcatagtggatggaaaagtggctaacaagttcatggatgagtggatgttgagtaaatgagtagatatgtagacattgaacttgttatggaagacaagtataatatccaattatacttttcatttaaaagttaaagtaaaaattacaacattg

SEQ ID NO: 24100 - DNA, 462 bp, Homo sapiens
gtagaaatggggtctcactatgttgcttaggctggtctcaaactcctggactcaagctatcccctgctttggcctctggagtagctgggactataggcaagcgccaccatacccttcaggtttttaatttattttatgaaaatccctccaaagcaacaatcctcaattctcctgcttgaaagtaatcactaataatcaggtactgtgtgatctgatccttgatgttcatattattgcctttaactgagtagcaatgttaaaatttaatcatttaaattagaaaacatatattgaaaagtcttcatagaagtccggcattataagaactcatcagaccatctagttatcctagaagtattgtttgctacttaaaaagcctatgtggaaagattgtaccatattccttggtaatagtttccaatgtctttttttctctaatagggcctttaaaacactctactt

SEQ ID NO: 24101 - DNA, 482 bp, Homo sapiens
attcctgccccatattagatgagagaagactttaattctttgcaattgagacatttttttttttttgagacagagtcttgctctgtcgcccaggctggagttctccgctcactgtaacctccgccaaccaggttcgagtggttctcctgcctcagcctcccaagtaactgggactacaggcacacgccaccacaccagactaatttttgtatttttagtaatcttagcactttaggagtccaaggcaggaggatcactcgagcccaggcatttgagaccagcctggacaacaaagtcagaccctgtctctacaaaacataaaaaataaataaaaattattcaggcatggtggcatttgcctttagtcccagctacttgggaggctaaggcgggaggattgcttgagcccaggagctgaaggccgcagtgagccatgattatgccactgcactgtagcctgggtgacagtgaaacctcatctc

SEQ ID NO: 24102 - DNA, 447 bp, Homo sapiens
cctggccccaattataaggaactttgaaagtcactgtacttacagaattagccttggtttcagaaatcacaacttggataggcagtatgggtggcagttaacaatattcaactccagtcctgcagaatttagtttggtctatagaaaaatccaagagatggtgcttttttcctgtgaggcttttggtttgaggagctaagacttagtcgtagtcctctcttccagaactttacttaacgtagaaccagtttgaaaccacaagtacctctgtggctacaagttttttagttttgttttaaaatttttcctctgctggctgggtgcaatagcgtgacgcttataatcccagcattttgggaagctgagtgggaagatcacttgagcccaagagtttgagactagcctgggcaacactagggagaccctgtctctacaaaatgaaacaat

SEQ ID NO: 24103 - DNA, 483 bp, Homo sapiens
ttcgagctcggtaccctcgtcttttgataggacagcagactttgtaaatgtaaacctaatttaacttagtttccctcttttatttaaaaagttttggctcaggtcaattccaaatttaagatactaggctaataaagaatgctattgctagcattctacctctgctataaaataacagttgtattaaaggaaaaaagtgtatttaaataaggaacttaagaatgtccatgctttctctgtaaatgtttacatttcaagttaacatttaatttttttcttgtataatccaaatgtcctatgctatctgctataaataacataaatttgaaagataaagggcaaggattatatcacgcctatcaaaagacgaattttcaagtttctaccatacaatttatgggtgatttcctttatttcctctttctggggacaaaaattgagttgtcttgtgtgagacactttatttaattccatgaccccaaa

SEQ ID NO: 24104 - DNA, 401 bp, Homo sapiens
  misc_feature (364)..(364): n is a, c, g, or t
  misc_feature (372)..(372): n is a, c, g, or t
ttcgagctcggtaccctcgtcttttgataggacagcagactttgtaaatgtaaacctaatttaacttagtttccctcttttatttaaaaagttttggctcaggtcaattccaaatttaagatactaggctaataaagaatgctattgctagcattctacctctgctataaaataacagttgtattaaaggaaaaaagtgtatttaaataaggaacttaagaatgtccatgctttctctgtaaatgtttacatttcaagttaacatttaatttttttcttgtataatccaaatgtcctatgctatctgctataaataacataaatttgaaagataaagggcaaggattatatcacgcctctctanacgccgantttatcctctagagtcagctatgacgatg

SEQ ID NO: 24105 - DNA, 390 bp, Homo sapiens
aactttgcagtggtagcagtattctagggccctttgaaacaataaatagcatatttttcatgcaataaaatggaagagtttcattagttaagattttggttttttgtttttcaagagcacaaatggttattctgtatatggaggaaaaagacttattctgtttgttgagattatggaatttttatgcttgtaacccttctcttcaatccttatattcagaagcgattattggaagccatggagacatgtaaccactccctcaaaaaggaagagaggaaaagaaaccaacatagtgagtgcctaatgtgctggtatgatagagacacagagtttatctatccttctccatggccagaaaagttccgttgagccgtcgggtcctctgccagc

SEQ ID NO: 24106 - DNA, 5880 bp, Homo sapiens
ttgacttcaaatattaaaatagagaaaagaaagattctacctgtcatatgaaggtgatgagatttcaggacttgaggttttttggtttttttgtaggctgggatcactatggaagcaactatgcattgggggcaggtgagatccttaagatttctctatttgtgcccaagcttttctctcacaagggacaatttcatgacccttttattttttttataaatataattgcaaatattcctaaaacttgtatcagcatatgatattagtagtagtattcctccttttcaggcccagtataatgataaattccattccgtgtggatagtcccacacagtccctaggaaaggatcctgaggttgaatgttgtaaggaagagtaattataggtgaagtaagtgtaggccttttgccaaaggggaaaaaaaaagcccaaaaaggctagcagaaggaggtctcaaatttcagagctttgatgataccattttactaaaagaaaaattttccttggtttttaacagctaatataatgccttcgtcgtctcatctctttggctcaatgccatggggaccatcggtgccagttcctgggaagcccttccatcatactttatattctgggaccatgcccatggctgggggaataccagggggtgtgcacaatcagtttatacctctgcaggttactaaaaaaagggttgcaaacaaaaagaactttgagaataaggaagcccagagttctcaagccactccagttcagactagccagccagattcttccaacattgtcaaagtaagtccacgggagagctcatcagcttctttgaagtcctctccgattgctcaacctgcatcttcttttcaagttgaaactgcctctcaaggccatagtatatctcaccataagtcaacaccaatctcttcttcaagaagaaaatcaagaaaactggctgttaattttggtgtttctaaaccttctgagtaaatttggctcttagaattaagttaatttcttctctttccatctacctttttataaatacatatctatgtctcataaaaattagaatgtactattttaaaataatatgtgtaaattgaaatttttttcatttttaagttatcaggcacttttcatgctgtttaaaagactgtgtatcaaattgtgcactttaagtatgtgcagtttgttgtatgtcaattatacctcaataaatctgtaataaaaaactaaattaaaccttgcattaaaataatatcacagtatcagtggactaaacattaaaatgtaccactctaatcattggcctcatgattgaagcatcctgaactatgaattagacatcagttagcaataataagcattttttacactatcattgaggaataattacatggagcatgaaatttgggcctccagtataacttactgaatgtggattttatttctctttttaatgatgtaagaaaattgtcaggagaatggctcttatttatgtgtgttttaacttatgctttgttgcctctgagggtctttagacctgctgtgaaaggatcacatttgttgtggtgctgccagttttgctttattctaaattttgtaccaaagcaactttagaataatcagaatatttcatctaactgcttagaactataaatagcattctaaatttgagtaaatacaattttttaggttactcaagaaccagcattagtaatttctagtaaaattgtttcaaaatctacagggtacaatgattacaaattaatcttctaacaaaataaaatatgaaatattagtcatgttaattaataaactgtattattttgtatagctttttatttgcttacctgacattttatgagagcttcatagttggtcggtatgtagtgcttcttgggactgaagaaattctaattgttgtttaagttccaaggtgtgctacaatataggaggcacagtcatcagtttgtgacatacattatttactgcctatttcattctgattctatatttttagctttatgctgaactgttcaatgatgctgggattctctctttgcatgtcatatgtgaatgtgtggttcaagctgtaactgttgaaattattttagaatttatgacgatttctcagcagggcctatgtttatatatatatatatatttattctttagtttttgtgatatgcttatatttttaaggaagtaagttatagcatacttttttaaaagtaggaaccacaatctttatatggagcagcttgttatatctgattttcatgtaactcattggaaactctgccatgactcttaaagtagtcttacttgttttttaaaatgctggtattaaactaaatggactcctttcactaactgctgatttcagagtttaaatgttagcaggatatttgtgtattagcagtgccttcagtataagagagaaatattcattatctgtcatttatcatagtcgtataagtttccatgattttattttctgttattttcataagttcagatgtttatcagttcccaacattgtttctttatctgtagtgggatcttgagtaatgaggctcaagtaaatcctcaatgtgtataattattgcctcataaactctctctttgtttttaaaggaaacatctattatggtaatacaaagaaaagttaaattgtgacagtaatgttatattaacctcttcctactttaaagtgtgaaatgtttcacctcagctgtacaaactccagcattgagaatttgcctcactcattactcctgtgtgacagttatataaatagcatgcagctcacatctgttttagagcatagaagaagcggcacctgccatcttctgaaaactccaaagggaaatttcagtagacatagtgcactaaacccataaggatacttgaccaatatttgagcacagcaagctgacagttctatacagataggcagtgaaagagttttattttccagccaggcgcagtggctcaaatcccagcacttcgggaggctaaggcaggcggatcacttgaggtccggagttccagacaagcctggccaacatgatgaagccctgtctctactaaaaatacaaaaattagccgggcgtgatggcacatgcctttagtcccagctactcgggaggctgaggcatgagaatcatttgaacccgcgaggcagagtctgcagtgagccgagattgcaccactgcactccagcctggagagcagagcaagactctgtctcaaaaaaaagaaaaaagttttattatccttactttttttttaacattattattctaaaggtcaaaactgagaagagattaagataggagagagctccataatggctggatagtggtcaggcattctctattcttttccccctgtagacccattctaaatgtgggcctgaggtcaatgggagatgtgccctccctatggaggatgtaagaagcagaggccatttctgccccatgttgaggaaacaatctgttgatagacctggaatttagagtatatctgaaaagcagttggacttcaagaaatttaaaattctctctttgagatggggtggactaagaccacccccaaagtttaaaaatatgctcattcaacttgaatcttctgaggactttttgtgaaaatggtggactgtttagggcataggacagattccccaaattgctttatgcttccacataactagagcacttcaatctatttaagcctttgtctcctaactgaaacattatttctaaatatttctattcaataagttttttcttttttgagcaacttaagtgaattttgaagattgctccttccagtctcgttccttttcacattttcctgcattacctaataattacctcagcgttagaatttgaatgtattaattgatttaaacatcatgtagactaaagtcttaaacatctaagactcagttgtagttgcagaaaaaaattaaagtcacctctactgaaccttggtttcaatttaagatttttcttgcttttcaaaggggtaactaataaagattgaagggtttttttcccgattggtggaggaatgaagaactattgatgcaagtttttttattgtttctttctatgatcaggtacctgctttcattttagactgctacttccaaactaagctagattcttggttttaatgagaggaggcagagagagggaggcagatggaagaagaaaaacagttaaataagacatacccagtcactgcatttttggactataccgtatctttctagcacaaggaaatagataaactgtaaggtcttttttactcactttttatttatgtgttctatttgtgttagtcataactgtttatagtggttgtctaatttttacttttattatatgagatagagctgtgcagatcttcactcaagttagttctgtcacgcttcttcccattatttagagcacagttttttaaagcaactgtacaatttctcagccttatgagcttgctgtatttcttggtatcatgttgcttccaaattttgtttttactgtagaagacaattaatttattgtagagaagtggctgtgaaagtcgttctctgtctttaaaaatcaattgcagaagttcatttgtcatttttctagagataaattatagtactcaaactggcagtgctcagtatatacattttgtaagctttgtcagtgaaaccatcagttttgcaggagcttcctttcctagtcaagataaagcttaaaattccagaaattaatgtcgttcggactgactttattcatatttccatcaaacttctccaatacagtaagagatagtgttgaaccagcatcaagtctccagaaacatggcagagcagacaggccgttaagtttcacagacatcatagatccttttcttaaagaagaaaaacatgtataaaatagttttagtagtccaaaatgtcaactatctgtagctgcttttgtgtgtgtgtcagtgaacaaataataatgccttgctcaatcaatgcattcagccatctcaagtgcaatttgtgaaggagactatggtttccaaaagatacatttttttacaaagttaaacctgtaaaaagtctttttttttttccctccagccgtacaccaactgcacttggttgtttcagcagttggtatactattaaattgtccaggccaaataggtttctgtagctgttttagtaatttgaagccaaattctcatgctgtttctcattaaaaagaatgagaatttggtccatagttagctttaagttctctcttcctttctttcccttacagttaagggtttggtgggggatggggaggttgttttcgttttttggatttttttgtcttttggctttaagtatcatattttcttttgcctgtatccaactgcttctttgagtattttcatctagtttaatgtgagtaatagatgctgtgctgtcattgaagtgttcaacattttgttcatttaaacaaaagtgtaattcatacatatatagatacatatcttaattgatttctcaactattttataagtaactggaatttttcattagatcttatacagagaagtattttattaaaaattcaaaagggaagacttttatgtgctcattttgtaatttttgattttaaatatctttacattgtctgccaattaaagtgttttaaacttgcattggaatggactccgaatgtatttttgtggtgttacgttatccgtagatttctagcatgaagttagcctcacgatgctgtgcaaaggattttaaaatatgagagtcactgaaagagtttaaacatctgttcatgttaaatgctctatggattttaattaaagacttgagaatgatt

SEQ ID NO: 24107 - DNA, 5947 bp, Homo sapiens
ttcaaacacttccatcatggaggctgaagggaacacggatgcttaaagaaattctaaaaattgatggctctaacactgtggaccataagaatgaaatcaaacagattgctaatgaaatccctgtttcctctaacagaagagatgaatatggattaccctctcagcctaaacaaaataagaaattagcatcttatatgaacaagcctcacagtgctaatgagtaccataatgttcagtctatggacaatatgtgttggcctgcccccagccagatccctcctgtatccacaccagtaactgaactttctcgaatttgttcccttgttggaatgccacaacctgatttctcctttcttaggatgccacagacaatgaccgtttgccaagtaaaattatctaatggcttactggtacatgggccacagtgccactctgaaaatgaagccaaagagaaagctgcactttttgctttacaacagttgggctccttaggcatgaatttccctttgccttcacaagtatttgcaaattatccttcagctgtaccacctggaaccattcctccagcctttcccccacctactgctaatataatgccttcgtcgtctcatctctttggctcaatgccatggggaccatcggtgccagttcctgggaagcccttccatcatactttatattctgggaccatgcccatggctgggggaataccagggggtgtgcacaatcagtttatacctctgcaggttactaaaaaaagggttgcaaacaaaaagaactttgagaataaggaagcccagagttctcaagccactccagttcagactagccagccagattcttccaacattgtcaaagtaagtccacgggagagctcatcagcttctttgaagtcctctccgattgctcaacctgcatcttcttttcaagttgaaactgcctctcaaggccatagtatatctcaccataagtcaacaccaatctcttcttcaagaagaaaatcaagaaaactggctgttaattttggtgtttctaaaccttctgagtaaatttggctcttagaattaagttaatttcttctctttccatctacctttttataaatacatatctatgtctcataaaaattagaatgtactattttaaaataatatgtgtaaattgaaatttttttcatttttaagttatcaggcacttttcatgctgtttaaaagactgtgtatcaaattgtgcactttaagtatgtgcagtttgttgtatgtcaattatacctcaataaatctgtaataaaaaactaaattaaaccttgcattaaaataatatcacagtatcagtggactaaacattaaaatgtaccactctaatcattggcctcatgattgaagcatcctgaactatgaattagacatcagttagcaataataagcattttttacactatcattgaggaataattacatggagcatgaaatttgggcctccagtataacttactgaatgtggattttatttctctttttaatgatgtaagaaaattgtcaggagaatggctcttatttatgtgtgttttaacttatgctttgttgcctctgagggtctttagacctgctgtgaaaggatcacatttgttgtggtgctgccagttttgctttattctaaattttgtaccaaagcaactttagaataatcagaatatttcatctaactgcttagaactataaatagcattctaaatttgagtaaatacaattttttaggttactcaagaaccagcattagtaatttctagtaaaattgtttcaaaatctacagggtacaatgattacaaattaatcttctaacaaaataaaatatgaaatattagtcatgttaattaataaactgtattattttgtatagctttttatttgcttacctgacattttatgagagcttcatagttggtcggtatgtagtgcttcttgggactgaagaaattctaattgttgtttaagttccaaggtgtgctacaatataggaggcacagtcatcagtttgtgacatacattatttactgcctatttcattctgattctatatttttagctttatgctgaactgttcaatgatgctgggattctctctttgcatgtcatatgtgaatgtgtggttcaagctgtaactgttgaaattattttagaatttatgacgatttctcagcagggcctatgtttatatatatatatatatttattctttagtttttgtgatatgcttatatttttaaggaagtaagttatagcatacttttttaaaagtaggaaccacaatctttatatggagcagcttgttatatctgattttcatgtaactcattggaaactctgccatgactcttaaagtagtcttacttgttttttaaaatgctggtattaaactaaatggactcctttcactaactgctgatttcagagtttaaatgttagcaggatatttgtgtattagcagtgccttcagtataagagagaaatattcattatctgtcatttatcatagtcgtataagtttccatgattttattttctgttattttcataagttcagatgtttatcagttcccaacattgtttctttatctgtagtgggatcttgagtaatgaggctcaagtaaatcctcaatgtgtataattattgcctcataaactctctctttgtttttaaaggaaacatctattatggtaatacaaagaaaagttaaattgtgacagtaatgttatattaacctcttcctactttaaagtgtgaaatgtttcacctcagctgtacaaactccagcattgagaatttgcctcactcattactcctgtgtgacagttatataaatagcatgcagctcacatctgttttagagcatagaagaagcggcacctgccatcttctgaaaactccaaagggaaatttcagtagacatagtgcactaaacccataaggatacttgaccaatatttgagcacagcaagctgacagttctatacagataggcagtgaaagagttttattttccagccaggcgcagtggctcaaatcccagcacttcgggaggctaaggcaggcggatcacttgaggtccggagttccagacaagcctggccaacatgatgaagccctgtctctactaaaaatacaaaaattagccgggcgtgatggcacatgcctttagtcccagctactcgggaggctgaggcatgagaatcatttgaacccgcgaggcagagtctgcagtgagccgagattgcaccactgcactccagcctggagagcagagcaagactctgtctcaaaaaaaagaaaaaagttttattatccttactttttttttaacattattattctaaaggtcaaaactgagaagagattaagataggagagagctccataatggctggatagtggtcaggcattctctattcttttccccctgtagacccattctaaatgtgggcctgaggtcaatgggagatgtgccctccctatggaggatgtaagaagcagaggccatttctgccccatgttgaggaaacaatctgttgatagacctggaatttagagtatatctgaaaagcagttggacttcaagaaatttaaaattctctctttgagatggggtggactaagaccacccccaaagtttaaaaatatgctcattcaacttgaatcttctgaggactttttgtgaaaatggtggactgtttagggcataggacagattccccaaattgctttatgcttccacataactagagcacttcaatctatttaagcctttgtctcctaactgaaacattatttctaaatatttctattcaataagttttttcttttttgagcaacttaagtgaattttgaagattgctccttccagtctcgttccttttcacattttcctgcattacctaataattacctcagcgttagaatttgaatgtattaattgatttaaacatcatgtagactaaagtcttaaacatctaagactcagttgtagttgcagaaaaaaattaaagtcacctctactgaaccttggtttcaatttaagatttttcttgcttttcaaaggggtaactaataaagattgaagggtttttttcccgattggtggaggaatgaagaactattgatgcaagtttttttattgtttctttctatgatcaggtacctgctttcattttagactgctacttccaaactaagctagattcttggttttaatgagaggaggcagagagagggaggcagatggaagaagaaaaacagttaaataagacatacccagtcactgcatttttggactataccgtatctttctagcacaaggaaatagataaactgtaaggtcttttttactcactttttatttatgtgttctatttgtgttagtcataactgtttatagtggttgtctaatttttacttttattatatgagatagagctgtgcagatcttcactcaagttagttctgtcacgcttcttcccattatttagagcacagttttttaaagcaactgtacaatttctcagccttatgagcttgctgtatttcttggtatcatgttgcttccaaattttgtttttactgtagaagacaattaatttattgtagagaagtggctgtgaaagtcgttctctgtctttaaaaatcaattgcagaagttcatttgtcatttttctagagataaattatagtactcaaactggcagtgctcagtatatacattttgtaagctttgtcagtgaaaccatcagttttgcaggagcttcctttcctagtcaagataaagcttaaaattccagaaattaatgtcgttcggactgactttattcatatttccatcaaacttctccaatacagtaagagatagtgttgaaccagcatcaagtctccagaaacatggcagagcagacaggccgttaagtttcacagacatcatagatccttttcttaaagaagaaaaacatgtataaaatagttttagtagtccaaaatgtcaactatctgtagctgcttttgtgtgtgtgtcagtgaacaaataataatgccttgctcaatcaatgcattcagccatctcaagtgcaatttgtgaaggagactatggtttccaaaagatacatttttttacaaagttaaacctgtaaaaagtctttttttttttccctccagccgtacaccaactgcacttggttgtttcagcagttggtatactattaaattgtccaggccaaataggtttctgtagctgttttagtaatttgaagccaaattctcatgctgtttctcattaaaaagaatgagaatttggtccatagttagctttaagttctctcttcctttctttcccttacagttaagggtttggtgggggatggggaggttgttttcgttttttggatttttttgtcttttggctttaagtatcatattttcttttgcctgtatccaactgcttctttgagtattttcatctagtttaatgtgagtaatagatgctgtgctgtcattgaagtgttcaacattttgttcatttaaacaaaagtgtaattcatacatatatagatacatatcttaattgatttctcaactattttataagtaactggaatttttcattagatcttatacagagaagtattttattaaaaattcaaaagggaagacttttatgtgctcattttgtaatttttgattttaaatatctttacattgtctgccaattaaagtgttttaaacttgcattggaatggactccgaatgtatttttgtggtgttacgttatccgtagatttctagcatgaagttagcctcacgatgctgtgcaaaggattttaaaatatgagagtcactgaaagagtttaaacatctgttcatgttaaatgctctatggattttaattaaagacttgagaatgatt

SEQ ID NO: 24108 - DNA, 2021 bp, Homo sapiens
tcgttctagaggatccccgaacatgtcgagcttatcagatggagaaactaagttttacttggaagaacctccaggaacacagaagctttattcaggaagaactgccccaccatctaaagtggttcatcttggagataaagaacaatctaactgggcaaaagaagtacaaggaatttcagaacactacctgagaagaaaaggaataataataaatgaaacatctgcagttgtgtatgctcagttactcacaggtcgtaaatatcaaataaatcaaaatggtgaagttcgtctagagaaacagtggtcaaaacaagttgttccttttgtttatcaaactattgtcaaggacatccgagctttcgactcccgtttctccaatatcaaaacattggatgatttgtttcctctgagaagtatggtctttatgctgggaactccctattatggctgcactggagaagttcaggattcaggtgatgtgattacagaaggtaggattcgtgtgattttcagcattccatgtgaacccaatcttgatgctttaatacagaaccagcataaatattctataaagtacaacccaggatatgtgttggccagtcgccttggagtgagtggataccttgtttcaaggtttacaggaagtatttttattggaagaggatctaggagaaaccctcatggagaccataaagcaaatgtgggtttaaatctcaaattcaacaagaaaaatgaggaggtacctggatatactaagaaagttggaagtgaatggatgtattcatctgcagcagaacaacttctggcagagtacttagagagagctccagaactatttagttatatagccaaaaatagccaagaggatgtgttctatgaagatgacatttggcctggagaaaatgagaatggtgctgaaaaagttcaagaaattattacttggctaaaaggacatcctgtcagtactttatctcgttcttcttgtgatttacaaattctggatgcagctattgttgagaaaattgaggaagaagtcgaaaagtgcaagcaaagaaagaataataagaaggtgcgagtaacagtgaaaccccatttgctatacagacctttagaacagcaacatggagtcattcctgatcgggatgcagaattttgtctttttgaccgtgttgtaaatgtgagagaaaacttctcagttccagttggccttcgaggcaccatcataggaataaaaggagctaatagagaagccgatgtactatttgaagtattatttgatgaagaatttcctggagggttaacaataagatgctcacctggtagaggttatcgactgccaacaagtgccttggtgaacctttctcatgggagtcgctctgaaactggaaatcagaagttgacagccatcgtaaaaccacaaccagctgtacatcaacatagctcaagttcatcagtttcctctgggcatttgggagccctcaaccattcccctcaatcactttttgttcctactcaagtaagactctcagtctttaacttctcctctaccccttttacaaatcacaaatcacagcagactttgtaaatgtaaacctaatttaacttagtttccctcttttatttaaaaagttttggctcaggtcaattccaaatttaagatactaggctaataaagaatgctattgctagcattctacctctgctataaaataacagttgtattaaaggaaaaaagtgtatttaaataaggaacttaagaatgtccatgctttctctgtaaatgtttacatttcaagttaacatttaatttttttcttgtataatccaaatgtcctatgctatctgctataaataacataaatttgaaagataaagggcaaggattatatcacgcctatcaaaagacgaattttcaagtttctaccatacaatttatgggtgatttcctttatttcctctttctggggacaaaaattgagttgtcttgtgtgagacactttatttaattccatgaccccaaa

SEQ ID NO: 24109 - DNA, 1618 bp, Homo sapiens
tcgttctagaggatccccgaacatgtcgagcttatcagatggagaaactaagttttacttggaagaacctccaggaacacagaagctttattcaggaagaactgccccaccatctaaagtggttcatcttggagataaagaacaatctaactgggcaaaagaagtacaaggaatttcagaacactacctgagaagaaaaggaataataataaatgaaacatctgcagttgtgtatgctcagttactcacaggtcgtaaatatcaaataaatcaaaatggtgaagttcgtctagagaaacagtggtcaaaacaagttgttccttttgtttatcaaactattgtcaaggacatccgagctttcgactcccgtttctccaatatcaaaacattggatgatttgtttcctctgagaagtatggtctttatgctgggaactccctattatggctgcactggagaagttcaggattcaggtgatgtgattacagaaggtaggattcgtgtgattttcagcattccatgtgaacccaatcttgatgctttaatacagaaccagcataaatattctataaagtacaacccaggatatgtgttggccagtcgccttggagtgagtggataccttgtttcaaggtttacaggaagtatttttattggaagaggatctaggagaaaccctcatggagaccataaagcaaatgtgggtttaaatctcaaattcaacaagaaaaatgaggaggtacctggatatactaagaaagttggaagtgaatggatgtattcatctgcagcagaacaacttctggcagagtacttagagagagctccagaactatttagttatatagccaaaaatagccaagaggatgtgttctatgaagatgacatttggcctggagaaaatgagaatggtgctgaaaaagttcaagaaattattacttggctaaaaggacatcctgtcagtactttatctcgttcttcttgtgatttacaaattctggatgcagctattgttgagaaaattgaggaagaagtcgaaaagtgcaagcaaagaaagaataataagaaggtgcgagtaacagtgaaaccccatttgctatacagacctttagaacagcaacatggagtcattcctgatcgggatgcagaattttgtctttttgaccgtgttgtaaatgtgagagaaaacttctcagttccagttggccttcgaggcaccatcataggaataaaaggagctaatagagaagccgatgtactatttgaagtattatttgatgaagaatttcctggagggttaacaataagatgctcacctggtagaggttatcgactgccaacaagtgccttggtgaacctttctcatgggagtcgctctgaaactggaaatcagaagttgacagccatcgtaaaaccacaaccagctgtacatcaacatagctcaagtacctactaaagatgatgatgaattctgcaacatttggcagtccttacagggatctggaaagatgcaatactttcagccaactatacaagagaaggttagtattccttgttttgatggacaattaatttaaagaaaatatatttttatatttttcttttaagactacaatga

SEQ ID NO: 24110 - DNA, 1293 bp, Homo sapiens
catttcggcttcatgttgaaggcagtgcagtggattttgcactattactatcatggagttcagtcctggagctggtattatccttatcattatgcacctttcctgtctgatatacacaacatcagtacactcaaaatccattttgaactaggaaaaccttttaagccatttgaacagcttcttgctgtacttccagcagccagcaaaaatttacttcctgcatgctaccagcatttgatgaccaatgaagactcaccaattatagaatattacccacctgattttaaaactgacctaaatgggaaacaacaggaatgggaagctgtggtgttaatcccttttattgatgagagcgattattggaagccatggagacatgtaaccactccctcaaaaaggaagagaggaaaagaaaccaacatagtgagtgcctaatgtgctggtatgatagagacacagagtttatctatccttctccatggccagaaaagttccctgccatagaacgatgttgtacaaggtataaaataatatccttagatgcttggcgtgtagacataaacaaaaacaaaataaccagaattgaccagaaagcattatatttctgtggatttcctactctgaaacacatcagacacaaattttttttgaagaaaagtggtgttcaagtattccagcaaagcagtcgtggagaaaacatgatgttggaaatcttagtggatgcagaatcagatgaacttaccgtagaaaatgtagcttcatcagtgcttggaaaatctgtctttgttaattggcctcaccttgaggaagctagagtcgtggctgtatcagatggagaaactaagttttacttggaagaacctccaggaacacagaagctttattcaggaagaactgccccaccatctaaagtggttcatcttggagataaagaacaatctaactgggcaaaagaagtacaaggaatttcagaacactacctgagaagaaaaggaataataataaatgaaacatctgcagttgtgtatgctcagttactcacaggtcgtaaatatcaaataaatcaaaatggtgaagttcgtctagagaaacagtggtcaaaacaagttgttccttttgtttatcaaactattgtcaaggacatccgagctttcgactcccgtttctccaatatcaaaacattggatgatttgtttcctctgagaagtatggtctttatgctgggaactccctattatggctgcactggagaagttcaggattcaggtgatgtctctcgaggggatcctctga

SEQ ID NO: 24111 - DNA, 251 bp, Homo sapiens
gtaagcttccttaaaatcaaatttctagttaccaattttttaatgcaattggtggctctgtagcattggactgaatttctcaaccttttcaaccaaatttataaggtgtgtggccagagggtcactgaagttaagctgacagtcacttggatgggaggttgtacacctaaagtcctggatttggaactagaggcacctgaaatcctgattctctcatttaatagttgggtggccttgagcaattcacttta

SEQ ID NO: 24112 - DNA, 637 bp, Homo sapiens
ccagtttccagtttctaaaattttaacaggttatatatgccaccagataccgtgcttcatttttcatctgtctctctaggtctgtgctcttttttatactatattgtcattttaatggattggagagggatggaagataagcatatacgttcagtttgctatatgtatcgaaaagtcctgcactcttcagaaagaaatggagttttgaaaattatcagaagatgcttttaatctattttaatttgttgtattgtggagtgctctagttttgttgtgaaaattagaaaactaacctatagataccatttttgtctatcagctgtcattttaatgaaagagagtagagtcagtaattgaagtttattataagtttatgacttgaaccttagccagtgggagttttttgagggtctaggagtactctgacttaccagtcttacactttctatcacttttaataatatcccttattaatattatagtagtcctcaataagctttatatgtttctttaggatctgaaattattatgtaggaagtttatccgaaattaaccatatatattttaagacaatatttttgtttgtttgaccagagctccagaactatttagttatatagccaaaaatagccaagag

SEQ ID NO: 24113 - DNA, 280 bp, Homo sapiens
tctgaaacacatcagacacaaagtcagtggctatttagttcagaattttttcactttattaagtgtgaagtgattatggagaaagaattaaaattaaattatttgaattcttttaaagttttttttgaagaaaagtggtgttcaagtattccagcaaagcagtcgtggagaaaacatgatgttggaaatcttagtggatgcagaatcagatgaacttgtaagtattttatttatcattcatttattagatgcctataatgtattaaactgtagctgctgg

SEQ ID NO: 24114 - DNA, 8470 bp, Homo sapiens
catttcggcttcatgttgaaggcagtgcagtggattttgcactattactatcatggagttcagtcctggagctggtattatccttatcattatgcacctttcctgtctgatatacacaacatcagtacactcaaaatccattttgaactaggaaaaccttttaagccatttgaacagcttcttgctgtacttccagcagccagcaaaaatttacttcctgcatgctaccagcatttgatgaccaatgaagactcaccaattatagaatattacccacctgattttaaaactgacctaaatgggaaacaacaggaatgggaagctgtggtgttaatcccttttattgatgagagcgattattggaagccatggagacatgtaaccactccctcaaaaaggaagagaggaaaagaaaccaacatagtgagtgcctaatgtgctggtatgatagagacacagagtttatctatccttctccatggccagaaaagttccctgccatagaacgatgttgtacaaggtataaaataatatccttagatgcttggcgtgtagacataaacaaaaacaaaataaccagaattgaccagaaagcattatatttctgtggatttcctactctgaaacacatcagacacaaattttttttgaagaaaagtggtgttcaagtattccagcaaagcagtcgtggagaaaacatgatgttggaaatcttagtggatgcagaatcagatgaacttaccgtagaaaatgtagcttcatcagtgcttggaaaatctgtctttgttaattggcctcaccttgaggaagctagagtcgtggctgtatcagatggagaaactaagttttacttggaagaacctccaggaacacagaagctttattcaggaagaactgccccaccatctaaagtggttcatcttggagataaagaacaatctaactgggcaaaagaagtacaaggaatttcagaacactacctgagaagaaaaggaataataataaatgaaacatctgcagttgtgtatgctcagttactcacaggtcgtaaatatcaaataaatcaaaatggtgaagttcgtctagagaaacagtggtcaaaacaagttgttccttttgtttatcaaactattgtcaaggacatccgagctttcgactcccgtttctccaatatcaaaacattggatgatttgtttcctctgagaagtatggtctttatgctgggaactccctattatggctgcactggagaagttcaggattcaggtgatgtgattacagaaggtaggattcgtgtgattttcagcattccatgtgaacccaatcttgatgctttaatacagaaccagcataaatattctataaagtacaacccaggatatgtgttggccagtcgccttggagtgagtggataccttgtttcaaggtttacaggaagtatttttattggaagaggatctaggagaaaccctcatggagaccataaagcaaatgtgggtttaaatctcaaattcaacaagaaaaatgaggaggtacctggatatactaagaaagttggaagtgaatggatgtattcatctgcagcagaacaacttctggcagagtacttagagagagctccagaactatttagttatatagccaaaaatagccaagaggatgtgttctatgaagatgacatttggcctggagaaaatgagaatggtgctgaaaaagttcaagaaattattacttggctaaaaggacatcctgtcagtactttatctcgttcttcttgtgatttacaaattctggatgcagctattgttgagaaaattgaggaagaagtcgaaaagtgcaagcaaagaaagaataataagaaggtgcgagtaacagtgaaaccccatttgctatacagacctttagaacagcaacatggagtcattcctgatcgggatgcagaattttgtctttttgaccgtgttgtaaatgtgagagaaaacttctcagttccagttggccttcgaggcaccatcataggaataaaaggagctaatagagaagccgatgtactatttgaagtattatttgatgaagaatttcctggagggttaacaataagatgctcacctggtagaggttatcgactgccaacaagtgccttggtgaacctttctcatgggagtcgctctgaaactggaaatcagaagttgacagccatcgtaaaaccacaaccagctgtacatcaacatagctcaagttcatcagtttcctctgggcatttgggagccctcaaccattcccctcaatcactttttgttcctactcaagtacctactaaagatgatgatgaattctgcaacatttggcagtccttacagggatctggaaagatgcaatactttcagccaactatacaagagaagggtgcagttctacctcaagaaataagccaagtaaatcaacatcataaatctggctttaatgacaacagtgttaaatatcagcaaagaaaacatgaccctcacagaaaatttaaagaagagtgtaagagtcctaaagctgagtgttggtcccaaaaaatgtccaataagcagcctaactctggaattgagaactttttagcatctttgaatatctccaaagaaaatgaagtacagtcatctcatcatggggagcctccaagtgaagagcatttgtcaccacagtcatttgccatgaagggaacacggatgcttaaagaaattctaaaaattgatggctctaacactgtggaccataagaatgaaatcaaacagattgctaatgaaatccctgtttcctctaacagaagagatgaatatggattaccctctcagcctaaacaaaataagaaattagcatcttatatgaacaagcctcacagtgctaatgagtaccataatgttcagtctatggacaatatgtgttggcctgcccccagccagatccctcctgtatccacaccagtaactgaactttctcgaatttgttcccttgttggaatgccacaacctgatttctcctttcttaggatgccacagacaatgaccgtttgccaagtaaaattatctaatggcttactggtacatgggccacagtgccactctgaaaatgaagccaaagagaaagctgcactttttgctttacaacagttgggctccttaggcatgaatttccctttgccttcacaagtatttgcaaattatccttcagctgtaccacctggaaccattcctccagcctttcccccacctactgctaatataatgccttcgtcgtctcatctctttggctcaatgccatggggaccatcggtgccagttcctgggaagcccttccatcatactttatattctgggaccatgcccatggctgggggaataccagggggtgtgcacaatcagtttatacctctgcaggttactaaaaaaagggttgcaaacaaaaagaactttgagaataaggaagcccagagttctcaagccactccagttcagactagccagccagattcttccaacattgtcaaagtaagtccacgggagagctcatcagcttctttgaagtcctctccgattgctcaacctgcatcttcttttcaagttgaaactgcctctcaaggccatagtatatctcaccataagtcaacaccaatctcttcttcaagaagaaaatcaagaaaactggctgttaattttggtgtttctaaaccttctgagtaaatttggctcttagaattaagttaatttcttctctttccatctacctttttataaatacatatctatgtctcataaaaattagaatgtactattttaaaataatatgtgtaaattgaaatttttttcatttttaagttatcaggcacttttcatgctgtttaaaagactgtgtatcaaattgtgcactttaagtatgtgcagtttgttgtatgtcaattatacctcaataaatctgtaataaaaaactaaattaaaccttgcattaaaataatatcacagtatcagtggactaaacattaaaatgtaccactctaatcattggcctcatgattgaagcatcctgaactatgaattagacatcagttagcaataataagcattttttacactatcattgaggaataattacatggagcatgaaatttgggcctccagtataacttactgaatgtggattttatttctctttttaatgatgtaagaaaattgtcaggagaatggctcttatttatgtgtgttttaacttatgctttgttgcctctgagggtctttagacctgctgtgaaaggatcacatttgttgtggtgctgccagttttgctttattctaaattttgtaccaaagcaactttagaataatcagaatatttcatctaactgcttagaactataaatagcattctaaatttgagtaaatacaattttttaggttactcaagaaccagcattagtaatttctagtaaaattgtttcaaaatctacagggtacaatgattacaaattaatcttctaacaaaataaaatatgaaatattagtcatgttaattaataaactgtattattttgtatagctttttatttgcttacctgacattttatgagagcttcatagttggtcggtatgtagtgcttcttgggactgaagaaattctaattgttgtttaagttccaaggtgtgctacaatataggaggcacagtcatcagtttgtgacatacattatttactgcctatttcattctgattctatatttttagctttatgctgaactgttcaatgatgctgggattctctctttgcatgtcatatgtgaatgtgtggttcaagctgtaactgttgaaattattttagaatttatgacgatttctcagcagggcctatgtttatatatatatatatatttattctttagtttttgtgatatgcttatatttttaaggaagtaagttatagcatacttttttaaaagtaggaaccacaatctttatatggagcagcttgttatatctgattttcatgtaactcattggaaactctgccatgactcttaaagtagtcttacttgttttttaaaatgctggtattaaactaaatggactcctttcactaactgctgatttcagagtttaaatgttagcaggatatttgtgtattagcagtgccttcagtataagagagaaatattcattatctgtcatttatcatagtcgtataagtttccatgattttattttctgttattttcataagttcagatgtttatcagttcccaacattgtttctttatctgtagtgggatcttgagtaatgaggctcaagtaaatcctcaatgtgtataattattgcctcataaactctctctttgtttttaaaggaaacatctattatggtaatacaaagaaaagttaaattgtgacagtaatgttatattaacctcttcctactttaaagtgtgaaatgtttcacctcagctgtacaaactccagcattgagaatttgcctcactcattactcctgtgtgacagttatataaatagcatgcagctcacatctgttttagagcatagaagaagcggcacctgccatcttctgaaaactccaaagggaaatttcagtagacatagtgcactaaacccataaggatacttgaccaatatttgagcacagcaagctgacagttctatacagataggcagtgaaagagttttattttccagccaggcgcagtggctcaaatcccagcacttcgggaggctaaggcaggcggatcacttgaggtccggagttccagacaagcctggccaacatgatgaagccctgtctctactaaaaatacaaaaaaaaaaaagaaaaaagttttattatccttactttttttttaacattattattctaaaggtcaaaactgagaagagattaagataggagagagctccataatggctggatagtggtcaggcattctctattcttttccccctgtagacccattctaaatgtgggcctgaggtcaatgggagatgtgccctccctatggaggatgtaagaagcagaggccatttctgccccatgttgaggaaacaatctgttgatagacctggaatttagagtatatctgaaaagcagttggacttcaagaaatttaaaattctctctttgagatggggtggactaagaccacccccaaagtttaaaaatatgctcattcaacttgaatcttctgaggactttttgtgaaaatggtggactgtttagggcataggacagattccccaaattgctttatgcttccacataactagagcacttcaatctatttaagcctttgtctcctaactgaaacattatttctaaatatttctattcaataagttttttcttttttgagcaacttaagtgaattttgaagattgctccttccagtctcgttccttttcacattttcctgcattacctaataattacctcagcgttagaatttgaatgtattaattgatttaaacatcatgtagactaaagtcttaaacatctaagactcagttgtagttgcagaaaaaaattaaagtcacctctactgaaccttggtttcaatttaagatttttcttgcttttcaaaggggtaactaataaagattgaagggtttttttcccgattggtggaggaatgaagaactattgatgcaagtttttttattgtttctttctatgatcaggtacctgctttcattttagactgctacttccaaactaagctagattcttggttttaatgagaggaggcagagagagggaggcagatggaagaagaaaaacagttaaataagacatacccagtcactgcatttttggactataccgtatctttctagcacaaggaaatagataaactgtaaggtcttttttactcactttttatttatgtgttctatttgtgttagtcataactgtttatagtggttgtctaatttttacttttattatatgagatagagctgtgcagatcttcactcaagttagttctgtcacgcttcttcccattatttagagcacagttttttaaagcaactgtacaatttctcagccttatgagcttgctgtatttcttggtatcatgttgcttccaaattttgtttttactgtagaagacaattaatttattgtagagaagtggctgtgaaagtcgttctctgtctttaaaaatcaattgcagaagttcatttgtcatttttctagagataaattatagtactcaaactggcagtgctcagtatatacattttgtaagctttgtcagtgaaaccatcagttttgcaggagcttcctttcctagtcaagataaagcttaaaattccagaaattaatgtcgttcggactgactttattcatatttccatcaaacttctccaatacagtaagagatagtgttgaaccagcatcaagtctccagaaacatggcagagcagacaggccgttaagtttcacagacatcatagatccttttcttaaagaagaaaaacatgtataaaatagttttagtagtccaaaatgtcaactatctgtagctgcttttgtgtgtgtgtcagtgaacaaataataatgccttgctcaatcaatgcattcagccatctcaagtgcaatttgtgaaggagactatggtttccaaaagatacatttttttacaaagttaaacctgtaaaaagtctttttttttttccctccagccgtacaccaactgcacttggttgtttcagcagttggtatactattaaattgtccaggccaaataggtttctgtagctgttttagtaatttgaagccaaattctcatgctgtttctcattaaaaagaatgagaatttggtccatagttagctttaagttctctcttcctttctttcccttacagttaagggtttggtgggggatggggaggttgttttcgttttttggatttttttgtcttttggctttaagtatcatattttcttttgcctgtatccaactgcttctttgagtattttcatctagtttaatgtgagtaatagatgctgtgctgtcattgaagtgttcaacattttgttcatttaaacaaaagtgtaattcatacatatatagatacatatcttaattgatttctcaactattttataagtaactggaatttttcattagatcttatacagagaagtattttattaaaaattcaaaagggaagacttttatgtgctcattttgtaatttttgattttaaatatctttacattgtctgccaattaaagtgttttaaacttgcattggaatggactccgaatgtatttttgtggtgttacgttatccgtagatttctagcatgaagttagcctcacgatgctgtgcaaaggattttaaaatatgagagtcactgaaagagtttaaacatctgttcatgttaaatgctctatggattttaattaaagacttgagaatgatt

SEQ ID NO: 24115 - DNA, 7535 bp, Homo sapiens
tcgttctagaggatccccgaacatgtcgagcttatcagatggagaaactaagttttacttggaagaacctccaggaacacagaagctttattcaggaagaactgccccaccatctaaagtggttcatcttggagataaagaacaatctaactgggcaaaagaagtacaaggaatttcagaacactacctgagaagaaaaggaataataataaatgaaacatctgcagttgtgtatgctcagttactcacaggtcgtaaatatcaaataaatcaaaatggtgaagttcgtctagagaaacagtggtcaaaacaagttgttccttttgtttatcaaactattgtcaaggacatccgagctttcgactcccgtttctccaatatcaaaacattggatgatttgtttcctctgagaagtatggtctttatgctgggaactccctattatggctgcactggagaagttcaggattcaggtgatgtgattacagaaggtaggattcgtgtgattttcagcattccatgtgaacccaatcttgatgctttaatacagaaccagcataaatattctataaagtacaacccaggatatgtgttggccagtcgccttggagtgagtggataccttgtttcaaggtttacaggaagtatttttattggaagaggatctaggagaaaccctcatggagaccataaagcaaatgtgggtttaaatctcaaattcaacaagaaaaatgaggaggtacctggatatactaagaaagttggaagtgaatggatgtattcatctgcagcagaacaacttctggcagagtacttagagagagctccagaactatttagttatatagccaaaaatagccaagaggatgtgttctatgaagatgacatttggcctggagaaaatgagaatggtgctgaaaaagttcaagaaattattacttggctaaaaggacatcctgtcagtactttatctcgttcttcttgtgatttacaaattctggatgcagctattgttgagaaaattgaggaagaagtcgaaaagtgcaagcaaagaaagaataataagaaggtgcgagtaacagtgaaaccccatttgctatacagacctttagaacagcaacatggagtcattcctgatcgggatgcagaattttgtctttttgaccgtgttgtaaatgtgagagaaaacttctcagttccagttggccttcgaggcaccatcataggaataaaaggagctaatagagaagccgatgtactatttgaagtattatttgatgaagaatttcctggagggttaacaataagatgctcacctggtagaggttatcgactgccaacaagtgccttggtgaacctttctcatgggagtcgctctgaaactggaaatcagaagttgacagccatcgtaaaaccacaaccagctgtacatcaacatagctcaagttcatcagtttcctctgggcatttgggagccctcaaccattcccctcaatcactttttgttcctactcaagtacctactaaagatgatgatgaattctgcaacatttggcagtccttacagggatctggaaagatgcaatactttcagccaactatacaagagaagggtgcagttctacctcaagaaataagccaagtaaatcaacatcataaatctggctttaatgacaacagtgttaaatatcagcaaagaaaacatgaccctcacagaaaatttaaagaagagtgtaagagtcctaaagctgagtgttggtcccaaaaaatgtccaataagcagcctaactctggaattgagaactttttagcatctttgaatatctccaaagaaaatgaagtacagtcatctcatcatggggagcctccaagtgaagagcatttgtcaccacagtcatttgccatgaagagatgaatatggattaccctctcagcctaaacaaaataagaaattagacaatgaccgtttgccaagtaaaattatctaatggcttactggtacatgggccacagtgccactctgaaaatgaagccaaagagaaagctgcactttttgctttacaacagttgggctccttaggcatgaatttccctttgccttcacaagtatttgcaaattatccttcagctgtaccacctggaaccattcctccagcctttcccccacctactgctaatataatgccttcgtcgtctcatctctttggctcaatgccatggggaccatcggtgccagttcctgggaagcccttccatcatactttatattctgggaccatgcccatggctgggggaataccagggggtgtgcacaatcagtttatacctctgcaggttactaaaaaaagggttgcaaacaaaaagaactttgagaataaggaagcccagagttctcaagccactccagttcagactagccagccagattcttccaacattgtcaaagtaagtccacgggagagctcatcagcttctttgaagtcctctccgattgctcaacctgcatcttcttttcaagttgaaactgcctctcaaggccatagtatatctcaccataagtcaacaccaatctcttcttcaagaagaaaatcaagaaaactggctgttaattttggtgtttctaaaccttctgagtaaatttggctcttagaattaagttaatttcttctctttccatctacctttttataaatacatatctatgtctcataaaaattagaatgtactattttaaaataatatgtgtaaattgaaatttttttcatttttaagttatcaggcacttttcatgctgtttaaaagactgtgtatcaaattgtgcactttaagtatgtgcagtttgttgtatgtcaattatacctcaataaatctgtaataaaaaactaaattaaaccttgcattaaaataatatcacagtatcagtggactaaacattaaaatgtaccactctaatcattggcctcatgattgaagcatcctgaactatgaattagacatcagttagcaataataagcattttttacactatcattgaggaataattacatggagcatgaaatttgggcctccagtataacttactgaatgtggattttatttctctttttaatgatgtaagaaaattgtcaggagaatggctcttatttatgtgtgttttaacttatgctttgttgcctctgagggtctttagacctgctgtgaaaggatcacatttgttgtggtgctgccagttttgctttattctaaattttgtaccaaagcaactttagaataatcagaatatttcatctaactgcttagaactataaatagcattctaaatttgagtaaatacaattttttaggttactcaagaaccagcattagtaatttctagtaaaattgtttcaaaatctacagggtacaatgattacaaattaatcttctaacaaaataaaatatgaaatattagtcatgttaattaataaactgtattattttgtatagctttttatttgcttacctgacattttatgagagcttcatagttggtcggtatgtagtgcttcttgggactgaagaaattctaattgttgtttaagttccaaggtgtgctacaatataggaggcacagtcatcagtttgtgacatacattatttactgcctatttcattctgattctatatttttagctttatgctgaactgttcaatgatgctgggattctctctttgcatgtcatatgtgaatgtgtggttcaagctgtaactgttgaaattattttagaatttatgacgatttctcagcagggcctatgtttatatatatatatatatttattctttagtttttgtgatatgcttatatttttaaggaagtaagttatagcatacttttttaaaagtaggaaccacaatctttatatggagcagcttgttatatctgattttcatgtaactcattggaaactctgccatgactcttaaagtagtcttacttgttttttaaaatgctggtattaaactaaatggactcctttcactaactgctgatttcagagtttaaatgttagcaggatatttgtgtattagcagtgccttcagtataagagagaaatattcattatctgtcatttatcatagtcgtataagtttccatgattttattttctgttattttcataagttcagatgtttatcagttcccaacattgtttctttatctgtagtgggatcttgagtaatgaggctcaagtaaatcctcaatgtgtataattattgcctcataaactctctctttgtttttaaaggaaacatctattatggtaatacaaagaaaagttaaattgtgacagtaatgttatattaacctcttcctactttaaagtgtgaaatgtttcacctcagctgtacaaactccagcattgagaatttgcctcactcattactcctgtgtgacagttatataaatagcatgcagctcacatctgttttagagcatagaagaagcggcacctgccatcttctgaaaactccaaagggaaatttcagtagacatagtgcactaaacccataaggatacttgaccaatatttgagcacagcaagctgacagttctatacagataggcagtgaaagagttttattttccagccaggcgcagtggctcaaatcccagcacttcgggaggctaaggcaggcggatcacttgaggtccggagttccagacaagcctggccaacatgatgaagccctgtctctactaaaaatacaaaaattagccgggcgtgatggcacatgcctttagtcccagctactcgggaggctgaggcatgagaatcatttgaacccgcgaggcagagtctgcagtgagccgagattgcaccactgcactccagcctggagagcagagcaagactctgtctcaaaaaaaagaaaaaagttttattatccttactttttttttaacattattattctaaaggtcaaaactgagaagagattaagataggagagagctccataatggctggatagtggtcaggcattctctattcttttccccctgtagacccattctaaatgtgggcctgaggtcaatgggagatgtgccctccctatggaggatgtaagaagcagaggccatttctgccccatgttgaggaaacaatctgttgatagacctggaatttagagtatatctgaaaagcagttggacttcaagaaatttaaaattctctctttgagatggggtggactaagaccacccccaaagtttaaaaatatgctcattcaacttgaatcttctgaggactttttgtgaaaatggtggactgtttagggcataggacagattccccaaattgctttatgcttccacataactagagcacttcaatctatttaagcctttgtctcctaactgaaacattatttctaaatatttctattcaataagttttttcttttttgagcaacttaagtgaattttgaagattgctccttccagtctcgttccttttcacattttcctgcattacctaataattacctcagcgttagaatttgaatgtattaattgatttaaacatcatgtagactaaagtcttaaacatctaagactcagttgtagttgcagaaaaaaattaaagtcacctctactgaaccttggtttcaatttaagatttttcttgcttttcaaaggggtaactaataaagattgaagggtttttttcccgattggtggaggaatgaagaactattgatgcaagtttttttattgtttctttctatgatcaggtacctgctttcattttagactgctacttccaaactaagctagattcttggttttaatgagaggaggcagagagagggaggcagatggaagaagaaaaacagttaaataagacatacccagtcactgcatttttggactataccgtatctttctagcacaaggaaatagataaactgtaaggtcttttttactcactttttatttatgtgttctatttgtgttagtcataactgtttatagtggttgtctaatttttacttttattatatgagatagagctgtgcagatcttcactcaagttagttctgtcacgcttcttcccattatttagagcacagttttttaaagcaactgtacaatttctcagccttatgagcttgctgtatttcttggtatcatgttgcttccaaattttgtttttactgtagaagacaattaatttattgtagagaagtggctgtgaaagtcgttctctgtctttaaaaatcaattgcagaagttcatttgtcatttttctagagataaattatagtactcaaactggcagtgctcagtatatacattttgtaagctttgtcagtgaaaccatcagttttgcaggagcttcctttcctagtcaagataaagcttaaaattccagaaattaatgtcgttcggactgactttattcatatttccatcaaacttctccaatacagtaagagatagtgttgaaccagcatcaagtctccagaaacatggcagagcagacaggccgttaagtttcacagacatcatagatccttttcttaaagaagaaaaacatgtataaaatagttttagtagtccaaaatgtcaactatctgtagctgcttttgtgtgtgtgtcagtgaacaaataataatgccttgctcaatcaatgcattcagccatctcaagtgcaatttgtgaaggagactatggtttccaaaagatacatttttttacaaagttaaacctgtaaaaagtctttttttttttccctccagccgtacaccaactgcacttggttgtttcagcagttggtatactattaaattgtccaggccaaataggtttctgtagctgttttagtaatttgaagccaaattctcatgctgtttctcattaaaaagaatgagaatttggtccatagttagctttaagttctctcttcctttctttcccttacagttaagggtttggtgggggatggggaggttgttttcgttttttggatttttttgtcttttggctttaagtatcatattttcttttgcctgtatccaactgcttctttgagtattttcatctagtttaatgtgagtaatagatgctgtgctgtcattgaagtgttcaacattttgttcatttaaacaaaagtgtaattcatacatatatagatacatatcttaattgatttctcaactattttataagtaactggaatttttcattagatcttatacagagaagtattttattaaaaattcaaaagggaagacttttatgtgctcattttgtaatttttgattttaaatatctttacattgtctgccaattaaagtgttttaaacttgcattggaatggactccgaatgtatttttgtggtgttacgttatccgtagatttctagcatgaagttagcctcacgatgctgtgcaaaggattttaaaatatgagagtcactgaaagagtttaaacatctgttcatgttaaatgctctatggattttaattaaagacttgagaatgatt

SEQ ID NO: 24116 - DNA, 2901 bp, Homo sapiens
tcgttctagaggatccccgaacatgtcgagcttatcagatggagaaactaagttttacttggaagaacctccaggaacacagaagctttattcaggaagaactgccccaccatctaaagtggttcatcttggagataaagaacaatctaactgggcaaaagaagtacaaggaatttcagaacactacctgagaagaaaaggaataataataaatgaaacatctgcagttgtgtatgctcagttactcacaggtcgtaaatatcaaataaatcaaaatggtgaagttcgtctagagaaacagtggtcaaaacaagttgttccttttgtttatcaaactattgtcaaggacatccgagctttcgactcccgtttctccaatatcaaaacattggatgatttgtttcctctgagaagtatggtctttatgctgggaactccctattatggctgcactggagaagttcaggattcaggtgatgtgattacagaaggtaggattcgtgtgattttcagcattccatgtgaacccaatcttgatgctttaatacagaaccagcataaatattctataaagtacaacccaggatatgtgttggccagtcgccttggagtgagtggataccttgtttcaaggtttacaggaagtatttttattggaagaggatctaggagaaaccctcatggagaccataaagcaaatgtgggtttaaatctcaaattcaacaagaaaaatgaggaggtacctggatatactaagaaagttggaagtgaatggatgtattcatctgcagcagaacaacttctggcagagtacttagagagagctccagaactatttagttatatagccaaaaatagccaagaggatgtgttctatgaagatgacatttggcctggagaaaatgagaatggtgctgaaaaagttcaagaaattattacttggctaaaaggacatcctgtcagtactttatctcgttcttcttgtgatttacaaattctggatgcagctattgttgagaaaattgaggaagaagtcgaaaagtgcaagcaaagaaagaataataagaaggtgcgagtaacagtgaaaccccatttgctatacagacctttagaacagcaacatggagtcattcctgatcgggatgcagaattttgtctttttgaccgtgttgtaaatgtgagagaaaacttctcagttccagttggccttcgaggcaccatcataggaataaaaggagctaatagagaagccgatgtactatttgaagtattatttgatgaagaatttcctggagggttaacaataagatgctcacctggtagaggttatcgactgccaacaagtgccttggtgaacctttctcatgggagtcgctctgaaactggaaatcagaagttgacagccatcgtaaaaccacaaccagctgtacatcaacatagctcaagttcatcagtttcctctgggcatttgggagccctcaaccattcccctcaatcactttttgttcctactcaagtacctactaaagatgatgatgaattctgcaacatttggcagtccttacagggatctggaaagatgcaatactttcagccaactatacaagagaagggtgcagttctacctcaagaaataagccaagtaaatcaacatcataaatctggctttaatgacaacagtgttaaatatcagcaaagaaaacatgaccctcacagaaaatttaaagaagagtgtaagagtcctaaagctgagtgttggtcccaaaaaatgtccaataagcagcctaactctggaattgagaactttttagcatctttgaatatctccaaagaaaatgaagtacagtcatctcatcatggggagcctccaagtgaagagcatttgtcaccacagtcatttgccatgaagagatgaatatggattaccctctcagcctaaacaaaataagaaattagacaatgaccgtttgccaagtaaaattatctaatggcttactggtacatgggccacagtgccactctgaaaatgaagccaaagagaaagctgcactttttgctttacaacagttgggctccttaggcatgaatttccctttgccttcacaagtatttgcaaattatccttcagctgtaccacctggaaccattcctccagcctttcccccacctactgctaatataatgccttcgtcgtctcatctctttggctcaatgccatggggaccatcggtgccagttcctgggaagcccttccatcatactttatattctgggaccatgcccatggctgggggaataccagggggtgtgcacaatcagtttatacctctgcaggttactaaaaaaagggttgcaaacaaaaagaactttgagaataaggaagcccagagttctcaagccactccagttcagactagccagccagattcttccaacattgtcaaagtaagtccacgggagagctcatcagcttctttgaagtcctctccgattgctcaacctgcatcttcttttcaagttgaaactgcctctcaaggccatagtatatctcaccataagtcaacaccaatctcttcttcaagaagaaaatcaagaaaactggctgttaattttggtgtttctaaaccttctgagtaaatttggctcttagaattaagttaatttcttctctttccatctacctttttataaatacatatctatgtctcataaaaattagaatgtactattttaaaataatatgtgtaaattgaaatttttttcatttttaagttatcaggcacttttcatgctgtttaaaagactgtgtatcaaattgtgcactttaagtatgtgcagtttgttgtatgtcaattatacctcaataaatctgtaataaaaaactaaattaaaccttgcatt

SEQ ID NO: 24117 - DNA, 2609 bp, Homo sapiens
tcgttctagaggatccccgaacatgtcgagcttatcagatggagaaactaagttttacttggaagaacctccaggaacacagaagctttattcaggaagaactgccccaccatctaaagtggttcatcttggagataaagaacaatctaactgggcaaaagaagtacaaggaatttcagaacactacctgagaagaaaaggaataataataaatgaaacatctgcagttgtgtatgctcagttactcacaggtcgtaaatatcaaataaatcaaaatggtgaagttcgtctagagaaacagtggtcaaaacaagttgttccttttgtttatcaaactattgtcaaggacatccgagctttcgactcccgtttctccaatatcaaaacattggatgatttgtttcctctgagaagtatggtctttatgctgggaactccctattatggctgcactggagaagttcaggattcaggtgatgtgattacagaaggtaggattcgtgtgattttcagcattccatgtgaacccaatcttgatgctttaatacagaaccagcataaatattctataaagtacaacccaggatatgtgttggccagtcgccttggagtgagtggataccttgtttcaaggtttacaggaagtatttttattggaagaggatctaggagaaaccctcatggagaccataaagcaaatgtgggtttaaatctcaaattcaacaagaaaaatgaggaggtacctggatatactaagaaagttggaagtgaatggatgtattcatctgcagcagaacaacttctggcagagtacttagagagagctccagaactatttagttatatagccaaaaatagccaagaggatgtgttctatgaagatgacatttggcctggagaaaatgagaatggtgctgaaaaagttcaagaaattattacttggctaaaaggacatcctgtcagtactttatctcgttcttcttgtgatttacaaattctggatgcagctattgttgagaaaattgaggaagaagtcgaaaagtgcaagcaaagaaagaataataagaaggtgcgagtaacagtgaaaccccatttgctatacagacctttagaacagcaacatggagtcattcctgatcgggatgcagaattttgtctttttgaccgtgttgtaaatgtgagagaaaacttctcagttccagttggccttcgaggcaccatcataggaataaaaggagctaatagagaagccgatgtactatttgaagtattatttgatgaagaatttcctggagggttaacaataagatgctcacctggtagaggttatcgactgccaacaagtgccttggtgaacctttctcatgggagtcgctctgaaactggaaatcagaagttgacagccatcgtaaaaccacaaccagctgtacatcaacatagctcaagttcatcagtttcctctgggcatttgggagccctcaaccattcccctcaatcactttttgttcctactcaagtacctactaaagatgatgatgaattctgcaacatttggcagtccttacagggatctggaaagatgcaatactttcagccaactatacaagagaagggtgcagttctacctcaagaaataagccaagtaaatcaacatcataaatctggctttaatgacaacagtgttaaatatcagcaaagaaaacatgaccctcacagaaaatttaaagaagagtgtaagagtcctaaagctgagtgttggtcccaaaaaatgtccaataagcagcctaactctggaattgagaactttttagcatctttgaatatctccaaagaaaatgaagtacagtcatctcatcatggggagcctccaagtgaagagcatttgtcaccacagtcatttgccatgaagggaacacggatgcttaaagaaattctaaaaattgatggctctaacactgtggaccataagaatgaaatcaaacagattgctaatgaaatccctgtttcctctaacagaagagatgaatatggattaccctctcagcctaaacaaaataagaaattagcatcttatatgaacaagcctcacagtgctaatgagtaccataatgttcagtctatggacaatatgtgttggcctgcccccagccagatccctcctgtatccacaccagtaactgaactttctcgaatttgttcccttgttggaatgccacaacctgatttctcctttcttaggatgccacaggtatagtatactactgttctatttatataaattatttaacattaagcttaaataaattggttgaaaatgtttagctagaaaaaataaaatggggcctatttttcttaactttatgagcagcatagatttatgcttcttaccctagctctaatatttatacataaccaaagccctaagagaagctgacagggaggaactgggcagcaggtatcctggcaagattcctcaaactaatagagccagggatcttggcctacagtagcaattttcaaactttttggtctcagaaacttcacactttttttggaggaccccaaagagattttgtttacttatatccatatttactgtgtttgaaatt

SEQ ID NO: 24118 - DNA, 906 bp, Homo sapiens
tcgttctagaggatccccgaacatgtcgagcttatcagatggagaaactaagttttacttggaagaacctccaggaacacagaagctttattcaggaagaactgccccaccatctaaagtggttcatcttggagataaagaacaatctaactgggcaaaagaagtacaaggaatttcagaacactacctgagaagaaaaggaataataataaatgaaacatctgcagttgtgtatgctcagttactcacaggtcgtaaatatcaaataaatcaaaatggtgaagttcgtctagagaaacagtggtcaaaacaagttgttccttttgtttatcaaactattgtcaaggacatccgagctttcgactcccgtttctccaatatcaaaacattggatgatttgtttcctctgagaagtatggtctttatgctgggaactccctattatggctgcactggagaagttcaggattcaggtgatgtgattacagaaggtaggattcgtgtgattttcagcattccatgtgaacccaatcttgatgctttaatacagaaccagcataaatattctataaagtacaacccaggatatgtgttggccagtcgccttggagtgagtggataccttgtttcaaggtttacaggaagtatttttattggaagaggatctaggagaaaccctcatggagaccataaagcaaatgtgggtttaaatctcaaattcaacaagaaaaatgaggaggtacctggatatactaagaaagttggaagtgaatggatgtattcatctgcagcagaacaacttctggcagagtacttagagagagctccagaactatttagttatatagccaaaaatagccaagagcgactgacaggccaagagcgactgacaggaagagcgacagg

SEQ ID NO: 24119 - DNA, 930 bp, Homo sapiens
tctgccccctgagacagcctccagaagggatacgttcctccctcctttcggcgagctcggttgatcctcgcgggatttcagttaggctcttagtgcgggccctgtgggtgtggcaagaggaagaatgactgctcgctttgtgattcttgatccggaactttgtcacccaggaaccccggaagaggtagctcacgcgatagaaacgtgttcgctgcccagaagaagggaaggcgcgagtgaggaaaggaggtactgtagatgccctccaaatccttggttatggaatatttggctcatcccagtacactcggcttggctgttggagttgcttgtggcatgtgcctgggctggagccttcgagtatgctttgggatgctccccaaaagcaagacgagcaagacacacacagatactgaaagtgaagcaagcatcttgggagacagcggggagtacaagatgattcttgtggttcgaaatgacttaaagatgggaaaagggaaagtggctgcccagtgctctcatgctgctgtttcagcctacaagcagattcaaagaagaaatcctgaaatgctcaaacaatgggaatactgtggccagcccaaggtggtggtcaaagctcctgatgaagaaaccctgattgcattattggcccatgcaaaaatgctgggactgactgtaagtttaattcaagatgctggacgtactcagattgcaccaggctctcaaactgtcctagggattgggccaggaccagcagacctaattgacaaagtcactggtcacctaaaactttactaggtggactttgatatgacaacaacccctccatcacaagtgtttgaagcctgtcagattctaacaacaaaagctgaatttcttcacccaacttaaatgttcttgagatgaaaataaaacctattcccatgttct

SEQ ID NO: 24120 - DNA, 1029 bp, Homo sapiens
tctgccccctgagacagcctccagaagggatacgttcctccctcctttcggcgagctcggttgatcctcgcgggatttcagttaggctcttagtgcgggccctgtgggtgtggcaagaggaagaatgactgctcgctttgtgattcttgatccggaactttgtcacccaggaaccccggaagaggtagctcacgcgatagaaacgtgttcgctgcccagaagaagggaaggcgcgagtgaggaaaggaggtactgtagatgccctccaaatccttggttatggaatatttggctcatcccagtacactcggcttggctgttggagttgcttgtggcatgtgcctgggctggagccttcgagtatgctttgggatgctccccaaaagcaagacgagcaagacacacacagatactgaaagtgaagcaagcatcttgggagacagcggggagtacaagatgattcttgtggttcgaaatgacttaaagatgggaaaagggaaagtggctgcccagtgctctcatgctgctgtttcagcctacaagcagattcaaagaagaaatcctgaaatgctcaaacaatgggaatactgtggccagcccaaggtggtggtcaaagctcctgatgaagaaaccctgattgcattattggcccatgcaaaaatgctgggactgactgtaagtttaattcaagatgctggacgtactcagattgcaccaggctctcaaactgtcctagggattgggccaggaccagcagacctaattgacaaagtcactggtcacctaaaactttactaggtggactttgatatgacaacaacccctccatcacaagtgtttgaagcctgtcagattctaacaacaaaagctgaatttcttcacccaacttaaatgttcttgagatgaaaataaaacctattcccatgttctatggttggcagttgtcatcttgggcttaaaaacagtactgttggttaaatggtcttggtggttcaagtgagaggctgaaacagatatttaagatgagag

SEQ ID NO: 24121 - DNA, 685 bp, Homo sapiens
ggacgaatagtcatagcgttcgtgcaccggggttttactttcgtgcacgatgggctcggctcgtagttgcaggtaggaggttgcttgtggcatgtgcctgggctggagccttcgagtatgctttgggatgctccccaaaagcaagacgagcaagacacacacagatactgaaagtgaagcaagcatcttgggagacagcggggagtacaagatgattcttgtggttcgaaatgacttaaagatgggaaaagggaaagtggctgcccagtgctctcatgctgctgtttcagcctacaagcagattcaaagaagaaatcctgaaatgctcaaacaatgggaatactgtggccagcccaaggtggtggtcaaagctcctgatgaagaaaccctgattgcattattggcccatgcaaaaatgctgggactgactgtaagtttaattcaagatgctggacgtactcagattgcaccaggctctcaaactgtcctagggattgggccaggaccagcagacctaattgacaaagtcactggtcacctaaaactttactaggtggactttgatatgacaacaacccctccatcacaagtgtttgaagcctgtcagattctaacaacaaaagctgaatttcttcacccaacttaaatgttcttgagatgaaaataaaacctattcccatgttct

SEQ ID NO: 24122 - DNA, 1105 bp, Homo sapiens
  misc_feature (931)..(931): n is a, c, g, or t
  misc_feature (933)..(934): n is a, c, g, or t
  misc_feature (942)..(942): n is a, c, g, or t
  misc_feature (953)..(953): n is a, c, g, or t
tctgccccctgagacagcctccagaagggatacgttcctccctcctttcggcgagctcggttgatcctcgcgggatttcagttaggctcttagtgcgggccctgtgggtgtggcaagaggaagaatgactgctcgctttgtgattcttgatccggaactttgtcacccaggaaccccggaagaggtagctcacgcgatagaaacgtgttcgctgcccagaagaagggaaggcgcgagtgaggaaaggaggtactgtagatgccctccaaatccttggttatggaatatttggctcatcccagtacactcggcttggctgttggagttgcttgtggcatgtgcctgggctggagccttcgagtatgctttgggatgctccccaaaagcaagacgagcaagacacacacagatactgaaagtgaagcaagcatcttgggagacagcggggagtacaagatgattcttgtggttcgaaatgacttaaagatgggaaaagggaaagtggctgcccagtgctctcatgctgctgtttcagcctacaagcagattcaaagaagaaatcctgaaatgctcaaacaatgggaatactgtggccagcccaaggtggtggtcaaagctcctgatgaagaaaccctgattgcattattggcccatgcaaaaatgctgggactgactgtaagtttaattcaagatgctggacgtactcagattgcaccaggctctcaaactgtcctagggattgggccaggaccagcagacctaattgacaaagtcactggtcacctaaaactttactaggtggactttgatatgacaacaacccctccatcacaagtgtttgaagcctgtcagattctaacaacaaaagctgaatttcttcacccaacttaaatgttcttgagatgaaaataaaacctattcccatgttctnannaaaaaaanaaaaaaaaaanaaaaaacattggtgggccgcttgggccaattgaattttagattggacaaggtttatgcttcgggcccgaattcggggttatctggcccatttcgccatatagggagtcggataacaatacattggcggcggtttaacaaggtggtgacttgg

SEQ ID NO: 24123 - DNA, 262 bp, Homo sapiens
tccgactgcttcaccgacgtggcttctccgacgtactcagattgcaccaggctctcaaactgtcctagggattgggccaggaccagcagacctaattgacaaagtcactggtcacctaaaactttactaggtggactttgatatgacaacaacccctccatcacaagtgtttgaagcctgtcagattctaacaacaaaagctgaatttcttcacccaacttaaatgttcttgagatgaaaataaaacctattcccatgttct

SEQ ID NO: 24124 - DNA, 2245 bp, Homo sapiens
tctgccccctgagacagcctccagaagggatacgttcctccctcctttcggcgagctcggttgatcctcgcgggatttcagttaggctcttagtgcgggccctgtgggtgtggcaagaggaagaatgactgctcgctttgtgattcttgatccggaactttgtcacccaggaaccccggaagaggtagctcacgcgatagaaacgtgttcgctgcccagaagaagggaaggcgcgagtgaggaaaggaggtactgtagctacacttctggaaaattcagtatggacagtctccgacttaggatttttcaactttaggatggtgtgaaagagacacccattcagtagaaactgtacttcgagttttgcattttgatcttttcctggcctagtgataatgtggtacagtacactcttgtgatgctgggcagcggcagcgagccacagctcccagtcacccatgtgatcacgggaatcaacaacccatcctctaccgtgtactgtgttgtcagcttttttggatattgtgttttgtgttttcacattccatcatgtctacaaaatgtccatcagtgtctcctgtttctggtgagatgaagaagaggaaggcaattactcttgaaatgaaactcaagataattgcccagcatgaaggtggcaagccagtaatggccattgcacgtgagttaggactttggcaatccacgatttcaaccatcttttaagggataagaagcaaatcagtgatgcagcgaaatcgtcagcatcagttaaatccactgtcatcacaaagaaaagggctggaccaattgatgatatggaaaaattacttgttatgtggatggaagaccagatacagaagcgtataccacttagcctactgatgatccaggctaaggcaagaagtctttttaatatgctaaaagaccgtgccagtgatcctacatatacacaaatgtttaaagcaagtcatggatggttccagcgcttcaaaaggcgtcataattttcacaatgtaaagatcactggtgaggcagcacgtgctggtaatgaaggtgccatagcttttaaggaacagctgcataggataattatggctaaagatctttgcaataaggagctgattgcactggaggaagaaagaggtaaaggcgttgaggcagtggaagaagttacacccacggcacctagaaagttcacagcaaagaaactggcagaggcatttgctgctatcagcagtggcctacacgttagaagaaatggacgtcaattacgagagattcgccacagttgacaggcagatacaggatgctcttgcttgctacagagaaatatatagtgaaaagaagaaacaagctgtacggtcaaaacttggtatcttcctgaagaacaacactatgcttgctaaaccatcaactagtgttgatgtcccaatgccttctaccacctattctcgatgttcatcagaagagagagaaattgaggaccctgttgcatccccatcatccagcaattaattctatttcagtgcttcaaacatttttcaggaccactgtgctttcagctgtgtaaattatgccctccaaatccttggttatggaatatttggctcatcccagtacactcggcttggctgttggagttgcttgtggcatgtgcctgggctggagccttcgagtatgctttgggatgctccccaaaagcaagacgagcaagacacacacagatactgaaagtgaagcaagcatcttgggagacagcggggagtacaagatgattcttgtggttcgaaatgacttaaagatgggaaaagggaaagtggctgcccagtgctctcatgctgctgtttcagcctacaagcagattcaaagaagaaatcctgaaatgctcaaacaatgggaatactgtggccagcccaaggtggtggtcaaagctcctgatgaagaaaccctgattgcattattggcccatgcaaaaatgctgggactgactgtaagtttaattcaagatgctggacgtactcagattgcaccaggctctcaaactgtcctagggattgggccaggaccagcagacctaattgacaaagtcactggtcacctaaaactttactaggtggactttgatatgacaacaacccctccatcacaagtgtttgaagcctgtcagattctaacaacaaaagctgaatttcttcacccaacttaaatgttcttgagatgaaaataaaacctattcccatgttct

SEQ ID NO: 24125 - DNA, 1161 bp, Homo sapiens
  misc_feature (958)..(958): n is a, c, g, or t
  misc_feature (974)..(975): n is a, c, g, or t
  misc_feature (987)..(987): n is a, c, g, or t
  misc_feature (989)..(990): n is a, c, g, or t
  misc_feature (998)..(998): n is a, c, g, or t
  misc_feature (1009)..(1009): n is a, c, g, or t
tctgccccctgagacagcctccagaagggatacgttcctccctcctttcggcgagctcggttgatcctcgcgggatttcagttaggctcttagtgcgggccctgtgggtgtggcaagaggaagaatgactgctcgctttgtgattcttgatccggaactttgtcacccaggaaccccggaagaggtagctcacgcgatagaaacgtgttcgctgcccagaagaagggaaggcgcgagtgaggaaaggaggtactgtagatgccctccaaatccttggttatggaatatttggctcatcccagtacactcggcttggctgttggagttgcttgtggcatgtgcctgggctggagccttcgagtatgctttgggatgctccccaaaagcaagacgagcaagacacacacagatactgaaagtgaagcaagcatcttgggagacagcggggagtacaagatgattcttgtggttcgaaatgacttaaagatgggaaaagggaaagtggctgcccagtgctctcatgctgctgtttcagcctacaagcagattcaaagaagaaatcctgaaatgctcaaacaatgggaatactgtggccagcccaaggtggtggtcaaagctcctgatgaagaaaccctgattgcattattggcccatgcaaaaatgctgggactgactgtaagtttaattcaagatgctggacgtactcagattgcaccaggctctcaaactgtcctagggattgggccaggaccagcagacctaattgacaaagtcactggtcacctaaaactttactaggtggactttgatatgacaacaacccctccatcacaagtgtttgaagcctgtcagattctaacaacaaaagctgaatttcttcacccaacttaaatgttcttgagatgaaaataaaacctattcccatgttctaaaaaaaaaaaaaaaaaaaaaaaaaaanaaaaaaaaaaaaaaannaaaaaaaaaaanannaaaaaaanaaaaaaaaaanaaaaaacattggtgggccgcttgggccaattgaattttagattggacaaggtttatgcttcgggcccgaattcggggttatctggcccatttcgccatatagggagtcggataacaatacattggcggcggtttaacaaggtggtgacttgg

SEQ ID NO: 24126 - DNA, 389 bp, Homo sapiens
ctgaaaccagaggttcgcttgaggccgggagtccaagaccagcatcggcaaactagtaagaccccatctctacaaaaataaataaataaataaataaataaataaataaataataaatgaaaataaatgttagcttccagaggtaactactccctatacatttagacatatataaaatatgagaagttaagaaatttttcacaaataatagctaatgttagtggagtgttcacatttgttatttttttgtgcattaattcaatctttacaatagcccacttaagtaggtaatattgtccccattttacaaactgaggcttaacaaggttaagaaattttccttaaagttgggggcagtggctcacacctgtaatcctagcactttggga

SEQ ID NO: 24127 - DNA, 457 bp, Homo sapiens
ggtcacattccaagtttcagtactctttgataaattgtattggattctagtttcccaacatacgactctgctccttctgcttacttttcccaaattattttgccttctgtgcccaggcacacttagttccctgtctaggcaagagtggtcattattagacttcattttctttctactgtgcatatgtattgattagccatgggcacattgtgaacttgaaaagtcgatttagtcacattttaagtttcactatttgttggtattattctggcaagattttggaaggtttttattatttattcatttgtgtattttttgagacagagtctcattctgtctcctccgctgaagtgcagtggcgtgatcgtagcccaccgcaaccttgattgaactcctgggctcaagtgatcgtcctgcctcagcttctggagtggctgggactataggcgtgcaccac

SEQ ID NO: 24128 - DNA, 151 bp, Homo sapiens
tgcactgtaaagggagcacactcttatccatgaagtcatactgccctcactggctgtgaaatactgtgttcttcatttactcttgccggaatttgcaaattgtctgcaacctgctactttgtaagggctcctcccttgatgtgcagtaagt

SEQ ID NO: 24129 - DNA, 478 bp, Homo sapiens
aggtgggtgcttccttctttgtaactaatttcgtcagtgtagtagatttattttctcagccttttatcagtgggatgtgagctgtcctctgaaaactaacatagctcagactgttccccaggcaactgtgttccctgcggcagtgttgttgcacttgtacctccagtgcctatcagaccaacagttctagtctaaaagtggattgagaagacagtttgtgtagaactcgctctgggagagctgaagcaacgcctgccgaggcgggagctgctctggttctaagtgctgtctcctttgatcaggaattctttgagctgcttctccagcaagtactcctctgctttgacatgagccttctgtgagccgttgtgaaaagaaatgcatttcaccaaaactcggaagctgatctaggcctactgaccatgagagtctttgtagaacattaattgggaaatttgtaaattttgaaaatctcttt

SEQ ID NO: 24130 - DNA, 1443 bp, Homo sapiens
  misc_feature (16)..(16): n is a, c, g, or t
  misc_feature (21)..(21): n is a, c, g, or t
tgttgtcatggagacngcgtngtttacctctctgttctgcaagagctggaagctccagttggggtaaggaggctcccatcccgagcttgcgtagtggttctgtgtggcgctgaggaatttggaaacctcaaatggctaaactattacaacctccacccaagttcctgccctcagagtggcacattgctaacaagaaccagtaccacagagcagacgctcaaaggtcccgatcagaacgcctggtcgcagaaagccagaggcttgtggatgaaattgaaaagaccacaagaaaatctcaaagcgatgtgaacaagaaactagaacagagactcgaggaagtccagttctggaagaaggagttagatgacaaacttgagcagcttgtgaatgtaactgatgatctactcatatataagatcagattggaaaaagccctggagaccttgaaagagcccttgcacatcactgagacatgcctggcatacagggagaagcgcattggcattgacctggtgcacgacacagtggagcatgagctgataaaggaggctgagatcatccagggcattatggctctgctgacccgtaccttggaggaggcttccgagcagattcggatgaaccgctctgccaagtacaatcttgagaaggatttgaaggacaagtttgtggccctgaccatagatgatatctgcttctcgctcaacaacaactcaccaaacatcagatattctgagaacgccgtgaggattgagccaaactccgtgagtctggaagactggttggacttctccagcaccaatgtggagaaggctgacaagcagcggaacaactccctgatgctgaaagccctggtggatcgaatcctgtcccagacagccaatgatctgcgcaagcagtgtgatgtggtggacacggcattcaagaatgggctgaaggatacaaaggatgccagggacaagctggctgatcatctggccaaggtcatggaagagattgcttcccaggagaaaaatattacagctcttgaaaaggccatccttgaccaagaagggccagccaaggtggctcatacgcgcttggagaccaggacacaccggccgaacgtggagctgtgtcgtgatgtcgcacaatataggctaatgaaggaggttcaagagatcacccacaatgtcgcaagattgaaggaaactttagcccaagctcaggcagagctgaaagggctgcatcgcagacagcttgccctgcaggaggagatccaggtcaaagagaacaccatttatatcgacgaagtgctgtgtatgcagatgaggaaatccatcccacttcgggatggggaagaccatggggtctgggctgggggcctccgccctgatgctgtctgctaatagtagggctagttccaattctcattaaaccacattgtaaacagtaaaaaaagta

SEQ ID NO: 24131 - DNA, 825 bp, Homo sapiens
  misc_feature (16)..(16): n is a, c, g, or t
  misc_feature (21)..(21): n is a, c, g, or t
tgttgtcatggagacngcgtngtttacctctctgttctgcaagagctggaagctccagttggggtaaggaggctcccatcccgagcttgcgtagtggttctgtgtggcgctgaggaatttggaaacctcaaatggctaaactattacaacctccacccaagttcctgccctcagagtggcacattgctaacaagaaccagtaccacagagcagacgctcaaaggtcccgatcagaacgcctggtcgcagaaagccagaggcttgtggatgaaattgaaaagaccacaagaaaatctcaaagcgatgtgaacaagaaactagggagaagcgcattggcattgacctggtgcacgacacagtggagcatgagctgataaaggaggctgagatcatccagggcattatggctctgctgacccgtaccttggaggaggcttccgagcagattcggatgaaccgctctgccaagtacaatcttgagaaggatttgaaggacaagtttgtggccctgaccatagatgatatctgcttctcgctcaacaacaactcaccaaacatcagatattctgagaacgccgtgaggattgagccaaagtgagtgggccttgccgtcttcctcctcgcgggtgacccagtgcttctcagataggcaagacctagcggctcgtccttgcagctggctgagagcttggaagtggtgggcttggggcaaaggcagcattgaatggtgaccttgacattgggcccagaggctcctgattctccaggttaggctcactaactaagaaagtctgacataaaacctttaaacctttaaagaataaa

SEQ ID NO: 24132 - DNA, 1168 bp, Homo sapiens
  misc_feature (16)..(16): n is a, c, g, or t
  misc_feature (21)..(21): n is a, c, g, or t
tgttgtcatggagacngcgtngtttacctctctgttctgcaagagctggaagctccagttggggtaaggaggctcccatcccgagcttgcgtagtggttctgtgtggcgctgaggaatttggaaacctcaaatggctaaactattacaacctccacccaagttcctgccctcagagtggcacattgctaacaagaaccagtaccacagagcagacgctcaaaggtcccgatcagaacgcctggtcgcagaaagccagaggcttgtggatgaaattgaaaagaccacaagaaaatctcaaagcgatgtgaacaagaaactagaacagagactcgaggaagtccagttctggaagaaggagttagatgacaaacttgagcagcttgtgaatgtaactgatgatctactcatatataagatcagattggaaaaagccctggagaccttgaaagagcccttgcacatcactgagacatgcctggcatacagggagaagcgcattggcattgacctggtgcacgacacagtggagcatgagctgataaaggaggctgagatcatccagggcattatggctctgctgacccgtaccttggaggaggcttccgagcagattcggatgaaccgctctgccaagtacaatcttgagaaggatttgaaggacaagtttgtggccctgaccatagatgatatctgcttctcgctcaacaacaactcaccaaacatcagatattctgagaacgccgtgaggattgagccaaactccgtgagtctggaagactggttggacttctccagcaccaatgtggagaaggctgacaagcagcggaacaactccctgatgctgaaagccctggtggatcgaatcctgtcccagacagccaatgatctgcgcaagcagtgtgatattgaaggaaactttagcccaagctcaggcagagctgaaagggctgcatcgcagacagcttgccctgcaggaggagatccaggtcaaagagaacaccatttatatcgacgaagtgctgtgtatgcagatgaggaaatccatcccacttcgggatggggaagaccatggggtctgggctgggggcctccgccctgatgctgtctgctaatagtagggctagttccaattctcattaaaccacattgtaaacagtaaaaaaagta

SEQ ID NO: 24133 - DNA, 678 bp, Homo sapiens
  misc_feature (16)..(16): n is a, c, g, or t
  misc_feature (21)..(21): n is a, c, g, or t
tgttgtcatggagacngcgtngtttacctctctgttctgcaagagctggaagctccagttggggtaaggaggctcccatcccgagcttgcgtagtggttctgtgtggcgctgaggaatttggaaacctcaaatggctaaactattacaacctccacccaagttcctgccctcagagtggcacattgctaacaagaaccagtaccacagagcagacgctcaaaggtcccgatcagaacgcctggtcgcagaaagccagaggcttgtggatgaaattgaaaagaccacaagaaaatctcaaagcgatgtgaacaagaaactaggtaagacaacatgcttggcatattcgtgaacatgctaggatgaggctgttgagtttagctatagtgtcatgttcagatgtggcaacatattatttttgaatattagagaaaatcatgtgtattctccaggttctatgtttaagttcactgccctaagatagacacaaggtaacccagcctgattttcagccacccatcattcatttatttgttgatttgatgcacagttattgagcatctatgggcatctatgtactacacactaggcatatcacagggaatgatcagaatctctgctttttaggggcttctaacttgaagaggataaagatacaaaaattaatcatcagaatacag

SEQ ID NO: 24134 - DNA, 1221 bp, Homo sapiens
aaaagaaaaagagagagagaaaaaaaagtccatttggcatgtttcagaccaagtgaccagtcatcaatcaatttttcttcattgtgtttggatattttgaagtcacatagacaccaactaatatctgtcacccactgtgtcatcggatggatcgggtgacactcaaatcagtcgtgcagatagttctgagtgtgcagccattagccaatgttgagtcacctcatgttgcacgtgttggctgactggctgcctttccccctgccagggagaagcgcattggcattgacctggtgcacgacacagtggagcatgagctgataaaggaggctgagatcatccagggcattatggctctgctgacccgtaccttggaggaggcttccgagcagattcggatgaaccgctctgccaagtacaatcttgagaaggatttgaaggacaagtttgtggccctgaccatagatgatatctgcttctcgctcaacaacaactcaccaaacatcagatattctgagaacgccgtgaggattgagccaaactccgtgagtctggaagactggttggacttctccagcaccaatgtggagaaggctgacaagcagcggaacaactccctgatgctgaaagccctggtggatcgaatcctgtcccagacagccaatgatctgcgcaagcagtgtgatgtggtggacacggcattcaagaatgggctgaaggatacaaaggatgccagggacaagctggctgatcatctggccaaggtcatggaagagattgcttcccaggagaaaaatattacagctcttgaaaaggccatccttgaccaagaagggccagccaaggtggctcatacgcgcttggagaccaggacacaccggccgaacgtggagctgtgtcgtgatgtcgcacaatataggctaatgaaggaggttcaagagatcacccacaatgtcgcaagattgaaggaaactttagcccaagctcaggcagagctgaaagggctgcatcgcagacagcttgccctgcaggaggagatccaggtcaaagagaacaccatttatatcgacgaagtgctgtgtatgcagatgaggaaatccatcccacttcgggatggggaagaccatggggtctgggctgggggcctccgccctgatgctgtctgctaatagtagggctagttccaattctcattaaaccacattgtaaacagtaaaaaaagta

SEQ ID NO: 24135 - DNA, 561 bp, Homo sapiens
tctgaaactttttgagtacccatatgatgccacaagtggaaaacttcacacctcacctcgtgatgagttggagtcaaaacactggtgtacaacatagtttattcagtgttcctaagagaagaaagcttccccccgccctctagctgtaagatgatcttttccaggcatacccagattctctcatgcgagcatgcccacaaagcgtaatacagtggcacatgtgcaggccagatggcgccaagggcaggttccccatgatgctccacgtggggccaagactcatgtgctttacttgctgtgttttttttccttcttttctgctctgttatatgaagatttgttgaaaatgttaaaaagtcctgcagaggcccagcgtgttggctcacacctgtaataccgactcacctctattttgtcagttcatagttgaagattttgttttatttcaaaaacaaagtacatttttgaaataatgtttcagaataaaataatctcacttttaaattaagtgatccattttaaaatttgtaattcaataaagttttttttgttgttaaacat

SEQ ID NO: 24136 - DNA, 661 bp, Homo sapiens
tctgaaactttttgagtacccatatgatgccacaagtggaaaacttcacacctcacctcgtgatgagttggagtcaaaacactggtgtacaacatagtttattcagtgttcctaagagaagaaagcttccccccgccctctagctgtaagatgatcttttccaggcatacccagattctctcatgcgagcatgcccacaaagcgtaatacagtggcacatgtgcaggccagatggcgccaagggcaggttccccatgatgctccacgtggggccaagactcatgtgctttacttgctgtgttttttttccttcttttctgctctgttatatgaagatttgttgaaaatgttaaaaagtcctgcagaggcccagcgtgttggctcacacctgtaatactggcactttcggaggctgaggtcggcagatcacctgaggtcaggagttcgagaccagccgggccaacgtggtgaaatctcctctctaccgaaaatataaaaattagtctggtgtggtggcacatgcctgtattcccagctacttggaaggctgaggcacgggaatcacttgaacccgggagttggaggttgcagtgagctgagatcacgccactgcactgcagcctgggcaacagagaaagactattgtctcaaaaaaaaaaaa

SEQ ID NO: 24137 - DNA, 353 bp, Homo sapiens
aaaagcctaggactcattattgataccactctttctctcatattagaaaaccttttaaaatacagcaagaatcggccgggcctggtggctcacacctgtaatcccagcactttgggaggccaagtgggtggatcatgaggtcaggagatcgagaccatcctgtctaacacggtgaaaccccatctctactgaaaatacaaaaaattagccaggcgcagtggcaggcacctgtagtcccagctacttgggaggctgaggtaggagaatggtgtgaacctgggaggtggaggttgcagtgagccgagattgtgccactgcattccagcctgggcaacagagcgagactccatctc

SEQ ID NO: 24138 - DNA, 430 bp, Homo sapiens
ctggtttcgaactcctgacctcaaatgatccacccacctcggcctccccgagtgttgggattacaggtgtgagccacctcacctggcccatattcttgaagggtggaggaatacaatcattttaaagctgtgtgacaaattctctttttgtactgtcttgctcagtctcttaatctggctcctctttcctcctcttctcccagccctcttacatgttaacagtattccctagtgttctgatttgggtctaccccttccaagttctgttcttggttcctaaaatgttcttgatttcagcaccttctccttttattttttacctttgattgaggactgaatctcttgccaacattagcctttactggtctctttgccttcagttttttttgttgttgttttgtttttcctgtctttcatttattctgtatat

SEQ ID NO: 24139 - DNA, 551 bp, Homo sapiens
aaaaatttctgttgagcttctccaaaaaagggcttccagaattaggaagtcatatttgcccatagactaagaagaaaataaaacatgaatattcttttaatgcatttcaggtgtgcactttttttttttggagacagagtctcactcctgttgcccaggctggagttcagtggtgtaatcatggctcactgcagtcttgacttcccgggctcaggtgattctcccacctcagcctcccaagtagctgggactacaggcacgtgccaccacgcccggcatttgtacttttagtagagaaggggtttcaccatattgtccaggctggtctcgaatccctgggctcaagtgatcgcctacgctggcctcccaaagtgctgggattacagacatgaactaccgcgcctggcctaggtttgcccttttaataactatattataatattcgcattaaaagtttattaataaagctatccaaatttttggacaaaaacaaaaatcagactattttaaaagaccaaaaaaaataccccaaagtgagcccatttcaactg

SEQ ID NO: 24140 - DNA, 418 bp, Homo sapiens
actctgccttggcccagttttgtcttaatgggctgcttcccacttctgccatttccacttcctctgcttgaattctccttttcctttgccctgtgatttccatattcaaaatttaatggttcctacatttgagttagtttttatgactttctttggagtgtggggagagccagcaagccatagtttctcaggcagaaaaaggcacaagaggcttggggggttatattatggactacaaataatgtgagttgcaaaaagatctttaaatacagattcaaaaaattggcaaaattaaaaatgttcttcctagcatgcttaaaattgtttttttaaattgttgaaatatttcccctatatccttatatttacctaggtgaattactatacattttattatggttataatcataacaaagac

SEQ ID NO: 24141 - DNA, 497 bp, Homo sapiens
gagagacttacataatacacatgtgagacagtcacaagtgcgagaagccatgtctgctcatttgtgcttgtcaagataatttcacacagtccctgaatctgtgaggccatgcagctctttgggaagatgctttgaagacaaaacaggatggaccacatggctcccacaccacttgcctgagtcactatgctccttaaaagatgaatgaccctagccttgacttttcctacacagaagataacgtttgacagggttagtgactatgcctctgtaattcattactaaatgcattttagtcatctataaccagatatactctggcacccagactttgacgtgattttgcacgtactgaaccttcaccacccgtccataaactgtgagctgaaacaccacattggagcctctgatggaactgctcccgggctgtagacctccatctacagtcttcggtaaggcttctgaataaaactaactttaattctttaaaaaattga

SEQ ID NO: 24142 - DNA, 3419 bp, Homo sapiens
cagatatttaacagatcctacatttattagctatataacagactctacattttcctaagtgcctaagaccaatcctggtagtcacttaagtacaaaagactcactttaactggcttggtctgaaggggtcaatcctttactgcctgtacaagatctgggcagttttgctctgtgtcttgtgatgacccagctgaatgtgaaaagcctatgagttattgagcaaccagaggtccctgcattccaagttgcagtttagctctggggaaactctggctttctctttcctcaagtgtccaccactgcccatcatttgcagaaagacttggccctgcctttagcaacttccctatctccttagagtagacaagaaagaaacagatttgtgcacattttacaaagtgccttcctctatttttttttaaagttttcattttgcaaggaaaaatgtattgattagaaagtaacatttgccttatagggattatatatatatatagatatagatatagatatgtatgaatggagagatgagaagaagccagaaagggcacaacaaaatggtctaagggccaaccagcaatgttcagtgaatgtttacgtattgtttaattgaatcaacacagagctgttgtgaatagtgtgacttactttgcctgataagaaattgaggctggctgtgatttggggataaacctgccaccctgtgatttgagactctccataccaaaacttattgatacatttttgaatgtcattggcttacatgcctaaacctgaagagaacaatgcatgcacattggaactttgtacacaaacagaaaaatataaatgactttgaattaccatcccaagcattgctaacgtagatgtgccattgacgaaagtctcatgtgttcttgagtgaacaaatttccttttcttcctttttggctcaagcacaataatgctgtcactgagacagtgactgagcactcaatgtccaagactaaatcacatcaccacgactaagtaggcactatgtcctgggatgagtcttttaaactctggccatcaggttccttacttgttaaataagtaggttggcctaaaaggtttctaagacctctcatgatctaggtaaaatccagggtttcaggtcagtgtccctggtgcagtgcaagaaagccttgctgacacacccttggcctgaagcagtgagcacatgagattgtgtgacaacgcttcagagaaaaacagagatctgttcctccaactcagattgatttaacatccttgcttctccttttccttcctggctttacatatttgtagggtttttactccttctccagagcctactattttcctaagagttagtagcaaccataggatccacaagaaatgaaattattcatcaacaataactttggcactgcaaaagactgagtcaaaggttaaatcagtcacacagatatccaaggccaagttgaagatcacaagtatatcccatttagagatttgcatacttagagattaagcccatgttcattaattatttagttaattcaaaagccattaataaatccatgcccagcctacgcaacatagtaagacccagtctctacaaaaattttaaaaattagccagccatggtgacacgtacctgtagtcctacacacttgggaagctgaagccagaggattgcttgagcccaggaggtcgaggctgcagtgaaccgtgattgtgtcactgcactccagcctgggtgagagagcaagaccttgtctcaataaataaacccaagttacttcgatgactagatactggaggtctgaaggagaagctttaaaaatacagattgattgcttcagagaaatcctatttataattatgatctgaacttattctatgattagcaaatatatcatctgaaaataaaacaggagttctctccccagacttttgtttttcaggatggtgagttttggtctgggaccctcatggcacccattttgataaaaggaaaaagatagtaaaacaggaaataggaagtttccagagatttgggcatctcaggattccatgaaatgctgagactaacccactaaatccaaattttattggctatggtaaatctaaatctgttcagtgttctgaacagattttatgagtttatgtctaagagtttatgtctaagagaggtacataattcacaaacactatcatgctggcagctgttttgtccacatcaattcccttgatttaatgctctgatttcaatttagaaagtactgagacatgtaaagtctcaaaataggaaaaacctatcctgtttataaggtgtggtcaataaatagaccacagataatcttagtctattaattaactctcagatcatcttagactattaattaacattctgcttgctgctgattaaaaagaaaaaaaccctaaaaccttcagcaactgaagtagtaatataaaaaataacctttaatagttatggtcaaattacgcttcacttggataaacctcaaaatgtagtctgagtttttttgtgcacacttcacaaatcctgggggaaaaatcttttttccacgttatctgaaaaactatatggcgaagataccgctgaaaaataatttgttttatgaaattcctgaaaagctaattttgaattttttaaagtaactacctcccttttgtgtcctaatgtccttccttcaaagctgcttatagtttagaaatgaaagatgtcatgtctcatgctttgactggttttcggtggcatatttgatgtatttgccaagtggcattactgactttacagtaactgttacattattttgtactatattgctttatgtggttcaaaaatagtatatgccatattgaaatatgtaatcctcatgttgtgaaactcatcatgtaatacaaatgaaaatcattacttaataacttacaatttatccatatgtagtttcaatatgattgtgtctatgactgtaaaacaaaactgaaaaaatatgtaatgtatttctgttgaaagcgtgaatgtactaattttttcctaatctttgtctagaagaaagattctatgtcattcattgtacagctgctctggggtgttacacatttaaagtacaatccaacagttgtttgaaagtcagcctctcggctttgtttcatgtgactgctgacacttctcaagtgttctttgcataatgaggctggattttgtgcttcatcgttcattttaaacaattgaaaagtctcatgtggaaaccaaagcaatctagaaccagcctgttgggtgactgtgtcttctgtaaagccatattgaagtgaagttatacataatagcataaggttccacattttcaaagctaccactacctctgcttttcctctttccctagaaaatgccaagcaaaattccc

SEQ ID NO: 24143 - DNA, 573 bp, Homo sapiens
gcggccgcctactactactactactgctcgaattcaagcttctaacgatgtacggggacatgtaatacaaatgaaaatcattacttaataacttacaatttatccatatgtagtttcaatatgattgtgtctatgactgtaaaacaaaactgaaaaaatatgtaatgtatttctgttgaaagcgtgaatgtactaattttttcctaatctttgtctagaagaaagattctatgtcattcattgtacagctgctctggggtgttacacatttaaagtacaatccaacagttgtttgaaagtcagcctctcggctttgtttcatgtgactgctgacacttctcaagtgttctttgcataatgaggctggattttgtgcttcatcgttcattttaaacaattgaaaagtctcatgtggaaaccaaagcaatctagaaccagcctgttgggtgactgtgtcttctgtaaagccatattgaagtgaagttatacataatagcataaggttccacattttcaaagctaccactacctctgcttttcctctttccctagaaaatgccaagcaaaattccc

SEQ ID NO: 24144 - DNA, 673 bp, Homo sapiens
taaaatcaggcagaagctgtctgcagagatgttgcaggtgctctaaaaggtgctctaaacaaccaccaaatgcatacggcaaccaggcaaatgcctgatagaggaaagccatcttcaagcccgcaggaaagttttgtggcacatggtggcaacccagttcccagttcccagttcccttcctcaagctgcagggagcagaccagacatgatttgttctagtctagctgattcatacctgaaggattgatcctcatctccatctcacataacatgcaaggtgggcaagaaaaagaggtgggcacagctcatgaaagccacagagaggcaattaaggtaaaaatagataaattgcactatatacaaattaaagacttcagtgcatcaaaggatacagtcaacagagtgaaaagcaatctatggagtaggagaaattatttgcaaataacgggttaatcttcacaatatataaagaactcctgcaactcaacaacaaaaaaaaaaccccagtttcaaactgagcaaagaacttgaataaacatttcttcaaaaaagatgatataaatgtccaataggcaaatgaaaagatgcttaacattactaatcattaggaagatgcaaatcaaaaccacaatgagatagcacctcagcacctcacacccattatgattgctac

SEQ ID NO: 24145 - DNA, 429 bp, Homo sapiens
actaatgctttcatattagtagattttgttcagaggccatagaatgctaagaaactgaagttagagactgaaacacagtttatactggggatatactataaatcaaaagaaagcattagctgaaaagcagtaaagatttcagattgaacagataaagttatcttcttttttaatcagaatctcataggaaaggcagaaagtgtctaagatagggaatagattcataacaacttgaaaaatatttttaaaaatcatcagtagcggccgggcgtggtggctcatgcctgtaatcccaacactttgggaagctgagcgggggtggatcacgaggtcaggagttcgagaacagcctggccaacatagtgaaaccccatctctactaaaaatacaaaaattagctgggcatggtggcatgtgcttggagtccca

SEQ ID NO: 24146 - DNA, 594 bp, Homo sapiens
caggtgtctcgggggcagatggtggagcccaggtgaaccccctaggttgtctctgtcccatcatccttgatcctctttgttttttgagacggggtctcacaatgttgctcaggctggagtgcagtggtgcagtcatggcccattgcaccctcaaccttgtgggctcaagggatcctctcacctcagctcctggagtagctgggactacaggcatgcaccaccatgtctggcttatttcttaattttcttgtggagacggggtcttgctatattgcccaggctagcctcaagcttgagggctcaaagtgatcttcctgcctccacctcctaggtgttgagactataggtatgagccactgggcctggccccttgattccctttgcatgatagaacttcaacccttggagccccagaggatccaggcagtatcaagtcaccatccatgttatagatgagaccatgtataacatcaccatctttaacaccaccatccagccttcagatgagatcacagccctgactgcaacctctctgaccacagctcagagagggcatgtggcatgctcacaaacagtctgttaggggcttcccct

SEQ ID NO: 24147 - DNA, 487 bp, Homo sapiens
caaggcctggcccagtagacttgaggcaggataggtggttgaatgaggtggcatgctgtgtagaacttcactcacatgggcagtggagaatttgccctggccttgatcttggcgcccctcccccttggtgttgcttcttgacaccgctgtcaacaactagagccctggaaaagagcactttattccttcagctgttatctgccaggtgcttattatgtgccaggtagtatttttggtgcttagaattcattcagcagtaaagaagagaagagccctacttgtaaggaggagggttagataataaacaagtaaactaaaaaattgataattttagataatgatggagcctataaaaaatataaaataagggaagtgacagaaaatgactggggtggtagaataggggtggaggggctacttcatatagagtgtcagggaaggcctctctgcggagatagtatttcagcaaagactaaaatgattttta

SEQ ID NO: 24148 - DNA, 520 bp, Homo sapiens
ctcaatatgacaacagtcaggatcttgatggcagatctcatgagagaacttcaaaaaagtttgcatcccaaacttctgaattatgtctttgggccctctaattttgatgctggagacatagctctgtgaccccctgtggtccctctccaaccctcaagtgctgcaactatgcaggcagaaccaagacgaagcctatctcttggaaagccaccctcttttctccatccctgccaccttctccttggttttgccccttcctatttcttgtcaaaatatacacaactgagattcatgctactattcttgcctctccacctcatcggatcacttttccatatcactcttaactctggcttttgcattatactgagacaacattttaaacatatttcctgccacaattgagggtggtagaatgatttcaggggactgcatcagagcaaatttctgtggcaaattatagtattttagatgacacaggggaataaactgagaagtttctgtgtcatctaccaaaaaa

SEQ ID NO: 24149 - DNA, 523 bp, Homo sapiens
ttgtggagattagctagatttgctaaagtgcttgtaggttagaaagtgctgtcattcctgagaactggcattaacagaagagagctgtgtgcagcacggaggaagtggagtctaaggaatacaacagcaacaactcaccaagcagagaatacaatggttcttcatcactatataaaactaacacttttccttcaaaggtctatgtataattttcttcaatgattagctttttaatgagacaactcctttcatccagacattcagatgctttatataagttggcaattttcctgttaaccaaactgaattttattaaatgtttattaaaatgcacccagaaaacttgtctcctcctgatgcctgaggggtttgcatgcctgatcccaagctgcattttttcagaatgcgtgcatgatgccccagttctgtactcatgatcaccaggtggcgttctgaaatccactactggggaaagatttttaacagatattagtgagattagagttggtgtcatttccattga

SEQ ID NO: 24150 - DNA, 123 bp, Homo sapiens
gtttcattttttatcattttgatttacagttctcagttgacattaatagactcgaaggcaagaatagcaaacatacttctaagccctagctaggggcccacttgtaacatgctatattttaca

SEQ ID NO: 24151 - DNA, 480 bp, Homo sapiens
tacttttcacagggcagggctaacaaaatggatggggtgaaaaatgggaacagttagaaggattcagtgtttcccaataagatttaccagatgcatgaggttataactgaacaaaaaggaatacaaagagaacaagctggaggaaaagaaaaacttattttttgacagattgagtctgatgttgcctaaagcacatcagcatcagggtagttatatcccctgggctggtaaaaatcgggcccaaagtttaggaaaatgaggtcagggttggaaccctgggaggtgacgttatcatacaaggaaagcaaacagtgaaagggctgagaaggtaccaccaacatttaagagaaagaaagaagaaataaaatgaaaatggaagaggagctctgcaacatcacatactgagaaacaggtacagtgatggagctggaactagaaaaaagtaatagccttagcaaaagtcacccctaaggaaaacca

SEQ ID NO: 24152 - DNA, 4343 bp, Homo sapiens
cactttcccgctggaggcgcagaggatgccccttgagccagacctggagaaatagccccagggcccggcaggaggagccttggtggcgagaaaggaaatccaggctcccctttccttaaagccactgcagcagctgggaaggcgcccacagagcgggcgcgccaagcgggacgcgggagtcgcagagagggaccccgggcgcctgctgagctcagctggcagagtttgcaagtggcggagacccttcaggtggcatccctgagtcctgatgcctgactggatggaggcccaccagcttctgttcccatgaggtagaaaggccaagcttggtcttcagctggggaagaggccagaaacaaggcccccagtgaaataacccagatccattggcctgaggagcagagaaagggcaagaagtgaactgcagctgctggtaaccctcagaaaccttctccaagtgctattctcacagttctttaggaacactctgaagtgaagaacaatatgtaggaaaatgggaccaacttatgtgtgttctgagcctcaaaacccccttgttggcccaaagaagctcaccttcagtttgggagggctggtaagctccatcctttctcatggcctcagccaagcattgaacttgccctccccttctggccttggtgatcactttttcaggaagagtgagactgaggacccccaagtgttccatccctaaggaaagcttgggaaaccaagccccttccatcctctcccaagcaccccagccaagccccagagagccagtccggaatgatcccactatggccaagctctggttcaaattccagcggtacttccgccggaaacctgtgcgcttctttaccttcctggcactctacctgactgctgggagccttgtcttccttcactctggctttgtgggccagcccgctgtctcggggaaccaggcgaaccccgctgctgcaggaggcccagctgagggtgctgagctgtccttcttgggtgacatgcatctgggcagaggtttccgggacacaggtgaagcctcaagcattgctcgcaggtacggaccctggttcaagggcaaggatgggaatgagagagccaagcttggcgactacggtggagcctggagccgagccctcaaggggagggttgtccgggagaaggaggaagagcgagccaagtacatcggctgctacctggatgacacccagagtcgggcccttcgaggagtgtccttttttgactacaaaaagatgaccatcttccgttgccaggacaactgtgctgaacggggttacctgtatggcgggctggagttcggcgccgagtgctactgcggccacaagatccaggcgacgaacgtgagcgaggcagagtgcgacatggagtgcaagggcgagcgaggcagcgtgtgcggcggcgccaaccgcctctctgtctaccggctgcagctggcccaggagtcggcccgcaggtatggaagtgcagtgttccggggctgcttccgcaggcccgacaacctttccctggccttacccgtgacagctgccatgctgaacatgtctgtggacaaatgcgtggacttctgcactgagaaggagtacccgctggcagctcttgcaggcaccgcctgccactgtgggtttcccaccacccgattcccgctccatgacagagaggatgagcagctctgtgcccagaagtgcagcgcggaggagtttgagagctgcgggactcctagttacttcattgtgtaccagacacaagtccaagacaaccgttgcatggacagaaggttcctgccaggcaagtccaagcagctcattgctttggccagcttcccaggtgctggcaacacgtgggctcgccacctcattgaattggccacaggcttctacactggcagctactacttcgatggctccctctacaacaaagggtttaaaggtgagcgggaccactggcgcagcggacggaccatctgcatcaagacgcacgaaagcggccagaaagagatcgaggccttcgacgccgccatcctgctcatccgcaacccctacaaagccctcatggctgagttcaaccgcaagtacggcggccacataggctttgctgcgcatgcccactggaagggcaaaggagccgtaccaggatctttgcaaatcttatttcgctcgatttgcacagcatctgtaggagagtggccagagttcgtgaggaactatgccccgtggtgggccactcacacactggactggctcaagtttggcaagaaggtgctggtggtgcactttgaggacctgaagcaggacctctttgtccagctgggccggatggtcagcctgctgggcgtggctgtcagggaggaccggctgctctgtgtggagagccagaaggatggcaacttcaagcgctcagggctccggaagctcgagtatgacccctatactgcggacatgcagaagaccatctctgcctacatcaagatggtggatgcagccctcaaagggcggaacctaacgggtgtccccgatgactactacccaagatgatgcgtccacacagggggagggtagactgggagtcctgaccacgcaggccctggggactcaagacccctggttacccccactcatctgtcctctctttggtctggggacaatccccttggctgctctttgccttcaatgagtttcctgcatgacagaggaggctcaagggaagagattgcccaggcactaccactctgctcacatgttccccccttggcaatgtggggcatcttgtttagggggttctagttacatggactcttttctgtctcctgggtctctgcccccaccactctgggttccatttgtgggagggagggctcatccacatcatggagacttgctggatgccccatggcaattgtcaaggctcttgatgcaagagcccagggggctattgtaaaaacttggccccagatgcttgtcccttctgggctgagatttcgcagcccccttctcatctccacccaagaagtgctggcaccgatgtttaactcaggccaccttctgttctaaagaaagattgctgggaagtttctccgtggccttaggtttctgacatcctggatagtgtggggaggtaatggtgctcacagtaggttaattggagacaccatgtggggccattggtgttatgagccccccaggccacactgcttctcagaaatgagctgcttgcctttccacctccagggcatgaaccctgcccctttctatccatgctgtgtccaggaggtgaccttgagatcctgataccaccttcaaggaacctcaggcaccaacagtgagcccacgaggatggtcacatgccatgtgcagaatttgacttaagagagagccccagtgacacatctctccatggtgggctccagtcagtcttacactgcccttctgacccctacaaatgggtcctttgctatccaggtgagacagcaaaagtgttcttaatcagatggaaccacacccaaaatggacccccactaccttcccagaccatatatctccccttgatcatagtccaacagggccagcttcccttgggggccctttaaggaatggggtgaatgaaattgtgtcatttctatacaaacactgctctcttgatgctgaaatgccaaaccgaaggatttctgaggacctaaatcacggagcatcaatcttacaaagtgttggtccagagtcccatctcttccccaaccctggataccagtagcttcccacccagtccaaacctgcaccatccatcattatgtagatgaaaaagccataggtcatagcctctttgctattctattggagtagcctccctaggcagtccctctgaagccttggagtgcaggtaaatgctcattcccaagtagcaaagagaccatggagaaggtgcgtgtaaagagatatatttttgtaagaggaatatgattaatacattccgccccttggaacctggccatgcaaagcaagggcacagggattagacctgtggcacacttccccaattccctcatctgtaggatttgggctgccccaggcccacccagggggctctgaatgtattttgtaccgtgtttctttcccccaggagaatttttagtcttctttcatgaagcagtggaggggttggcctcccttctactgggaggttgactctctctgggagactcttggtccaagacctgggtcagttctttgctggtggtcccctctgaccacaagcttctgcctgaagattcctcaggtcaacaccatcattaaatgcgagttttgttgatgattctaaatgtggta

SEQ ID NO: 24153 - DNA, 4283 bp, Homo sapiens
cactttcccgctggaggcgcagaggatgccccttgagccagacctggagaaatagccccagggcccggcaggaggagccttggtggcgagaaaggaaatccaggctcccctttccttaaagccactgcagcagctgggaaggcgcccacagagcgggcgcgccaagcgggacgcgggagtcgcagagagggaccccgggcgcctgctgagctcagctggcagagtttgcaagtggcggagacccttcaggtggcatccctgagtcctgatgcctgactggatggaggcccaccagcttctgttcccatgaggtagaaaggccaagcttggtcttcagctggggaagaggccagaaacaaggcccccagtgaaataacccagatccattggcctgaggagcagagaaagggcaagaagtgaactgcagctgctggtaaccctcagaaaccttctccaagtgctattctcacagttctttaggaacactctgaagtgaagaacaatatgtaggaaaatgggaccaacttatgtgtgttctgagcctcaaaacccccttgttggcccaaagaagctcaccttcagtttgggagggctggtaagctccatcctttctcatggcctcagccaagcattgaacttgccctccccttctggccttggtgatcactttttcaggaagagtgagactgaggacccccaagtgttccatccctaaggaaagcttgggaaaccaagccccttccatcctctcccaagcaccccagccaagccccagagagccagtccggaatgatcccactatggccaagctctggttcaaattccagcggtacttccgccggaaacctgtgcgcttctttaccttcctggcactctacctgactgctgggagccttgtcttccttcactctggctttgtgggccagcccgctgtctcggggaaccaggcgaaccccgctgctgcaggaggcccagctgagggtgctgagctgtccttcttgggtgacatgcatctgggcagaggtttccgggacacaggtgaagcctcaagcattgctcgcaggtacggaccctggttcaagggcaaggatgggaatgagagagccaagcttggcgactacggtggagcctggagccgagccctcaaggggagggttgtccgggagaaggaggaagagcgagccaagtacatcggctgctacctggatgacacccagagtcgggcccttcgaggagtgtccttttttgactacaaaaagatgaccatcttccgttgccaggacaactgtgctgaacggggttacctgtatggcgggctggagttcggcgccgagtgctactgcggccacaagatccaggcgacgaacgtgagcgaggcagagtgcgacatggagtgcaagggcgagcgaggcagcgtgtgcggcggcgccaaccgcctctctgtctaccggctgcagctggcccaggagtcggcccgcaggtatggaagtgcagtgttccggggctgcttccgcaggcccgacaacctttccctggccttacccgtgacagctgccatgctgaacatgtctgtggacaaatgcgtggacttctgcactgagaaggagtacccgctggcagctcttgcaggcaccgcctgccactgtgggtttcccaccacccgattcccgctccatgacagagaggatgagcagctctgtgcccagaagtgcagcgcggaggagtttgagagctgcgggactcctagttacttcattgtgtaccagacacaagtccaagacaaccgttgcatggacagaaggttcctgccaggcaagtccaagcagctcattgctttggccagcttcccaggtgctggcaacacgtgggctcgccacctcattgaattggccacaggcttctacactggcagctactacttcgatggctccctctacaacaaagggtttaaaggtgagcgggaccactggcgcagcggacggaccatctgcatcaagacgcacgaaagcggccagaaagagatcgaggccttcgacgccgccatcctgctcatccgcaacccctacaaagccctcatggctgagttcaaccgcaagtacggcggccacataggctttgctgcgcatgcccactggaagggcaaagagtggccagagttcgtgaggaactatgccccgtggtgggccactcacacactggactggctcaagtttggcaagaaggtgctggtggtgcactttgaggacctgaagcaggacctctttgtccagctgggccggatggtcagcctgctgggcgtggctgtcagggaggaccggctgctctgtgtggagagccagaaggatggcaacttcaagcgctcagggctccggaagctcgagtatgacccctatactgcggacatgcagaagaccatctctgcctacatcaagatggtggatgcagccctcaaagggcggaacctaacgggtgtccccgatgactactacccaagatgatgcgtccacacagggggagggtagactgggagtcctgaccacgcaggccctggggactcaagacccctggttacccccactcatctgtcctctctttggtctggggacaatccccttggctgctctttgccttcaatgagtttcctgcatgacagaggaggctcaagggaagagattgcccaggcactaccactctgctcacatgttccccccttggcaatgtggggcatcttgtttagggggttctagttacatggactcttttctgtctcctgggtctctgcccccaccactctgggttccatttgtgggagggagggctcatccacatcatggagacttgctggatgccccatggcaattgtcaaggctcttgatgcaagagcccagggggctattgtaaaaacttggccccagatgcttgtcccttctgggctgagatttcgcagcccccttctcatctccacccaagaagtgctggcaccgatgtttaactcaggccaccttctgttctaaagaaagattgctgggaagtttctccgtggccttaggtttctgacatcctggatagtgtggggaggtaatggtgctcacagtaggttaattggagacaccatgtggggccattggtgttatgagccccccaggccacactgcttctcagaaatgagctgcttgcctttccacctccagggcatgaaccctgcccctttctatccatgctgtgtccaggaggtgaccttgagatcctgataccaccttcaaggaacctcaggcaccaacagtgagcccacgaggatggtcacatgccatgtgcagaatttgacttaagagagagccccagtgacacatctctccatggtgggctccagtcagtcttacactgcccttctgacccctacaaatgggtcctttgctatccaggtgagacagcaaaagtgttcttaatcagatggaaccacacccaaaatggacccccactaccttcccagaccatatatctccccttgatcatagtccaacagggccagcttcccttgggggccctttaaggaatggggtgaatgaaattgtgtcatttctatacaaacactgctctcttgatgctgaaatgccaaaccgaaggatttctgaggacctaaatcacggagcatcaatcttacaaagtgttggtccagagtcccatctcttccccaaccctggataccagtagcttcccacccagtccaaacctgcaccatccatcattatgtagatgaaaaagccataggtcatagcctctttgctattctattggagtagcctccctaggcagtccctctgaagccttggagtgcaggtaaatgctcattcccaagtagcaaagagaccatggagaaggtgcgtgtaaagagatatatttttgtaagaggaatatgattaatacattccgccccttggaacctggccatgcaaagcaagggcacagggattagacctgtggcacacttccccaattccctcatctgtaggatttgggctgccccaggcccacccagggggctctgaatgtattttgtaccgtgtttctttcccccaggagaatttttagtcttctttcatgaagcagtggaggggttggcctcccttctactgggaggttgactctctctgggagactcttggtccaagacctgggtcagttctttgctggtggtcccctctgaccacaagcttctgcctgaagattcctcaggtcaacaccatcattaaatgcgagttttgttgatgattctaaatgtggta

SEQ ID NO: 24154 - DNA, 4480 bp, Homo sapiens
cactttcccgctggaggcgcagaggatgccccttgagccagacctggagaaatagccccagggcccggcaggaggagccttggtggcgagaaaggaaatccaggctcccctttccttaaagccactgcagcagctgggaaggcgcccacagagcgggcgcgccaagcgggacgcgggagtcgcagagagggaccccgggcgcctgctgagctcagctggcagagtttgcaagtggcggagacccttcaggtggcatccctgagtcctgatgcctgactggatggaggcccaccagcttctgttcccatgaggtagaaaggccaagcttggtcttcagctggggaagaggccagaaacaaggcccccagtgaaataacccagatccattggcctgaggagcagagaaagggcaagaagtgaactgcagctgctggtaaccctcagaaaccttctccaagtgctattctcacagttctttaggaacactctgaagtgaagaacaatatgtaggaaaatgggaccaacttatgtgtgttctgagcctcaaaacccccttgttggcccaaagaagctcaccttcagtttgggagggctggtaagctccatcctttctcatggcctcagccaagcattgaacttgccctccccttctggccttggtgatcactttttcaggaagagtgagactgaggacccccaagtgttccatccctaaggaaagcttgggaaaccaagccccttccatcctctcccaagcaccccagccaagccccagagagccagtccggaatgatcccactatggccaagctctggttcaaattccagcggtacttccgccggaaacctgtgcgcttctttaccttcctggcactctacctgactgctgggagccttgtcttccttcactctggctttgtgggccagcccgctgtctcggggaaccaggcgaaccccgctgctgcaggaggcccagctgagggtgctgagctgtccttcttgggtgacatgcatctgggcagaggtttccgggacacaggtgaagcctcaagcattgctcgcaggtacggaccctggttcaagggcaaggatgggaatgagagagccaagcttggcgactacggtggagcctggagccgagccctcaaggggagggttgtccgggagaaggaggaagagcgagccaagtacatcggctgctacctggatgacacccagagtcgggcccttcgaggagtgtccttttttgactacaaaaagatgaccatcttccgttgccaggacaactgtgctgaacggggttacctgtatggcgggctggagttcggcgccgagtgctactgcggccacaagatccaggcgacgaacgtgagcgaggcagagtgcgacatggagtgcaagggcgagcgaggcagcgtgtgcggcggcgccaaccgcctctctgtctaccggctgcagctggcccaggagtcggcccgcaggtatggaagtgcagtgttccggggctgcttccgcaggcccgacaacctttccctggccttacccgtgacagctgccatgctgaacatgtctgtggacaaatgcgtggacttctgcactgagaaggagtacccgctggcagctcttgcaggcaccgcctgccactgtgggtttcccaccacccgattcccgctccatgacagagaggatgagcagctctgtgcccagaagtgcagcgcggaggagtttgagagctgcgggactcctagttacttcattgtgtaccagacacaagtccaaggtgagctaggcccttccccagtggaccccagatgcactcccagtggcttccctcccagacgtgttcctgccagtccatcccacacagcctgcagcaaggagaaaaccatgcaagccagagggcagggctgatgaactccaccaggcttagagttcctggatgggcaacagaaggaattcccagggtgggaagcgttctgatgacccatctctatccctcatcactgaggacccttggtggctcctgtagtgagactgaatgagaagagagactgagtctcccactggctgcaacacagattcactgtgttatcccggacaagtcatttcccctttctgggcctcagtttttccatctgtaaaatgaagctgtagactgttggcctccagtgttccttccaattctaagattttgtcattttatctataagttcttccttcttctctctccctgtctcactcatcctttccacttctagtcttcttcctttgctagcggaatccacacttactgttatctcctcttctgtctcctggggctaccagacatgatgataatgatggtgatgatgatgatgatgatgatgatggtgatgattatgatgatggtgatgatcataatgatggtgatgattatgacgatggtgatgatgataatggtgatgatagtgataagagtgacgctgatagtgctgatgatagtgatgatgaaagtgatgatgacgatgatggtgatgagaaggaggaagaggaggaggcagcaacacttggagtttcttgaggtcttactctgtgccagactcagtgttgcatccttcatatacatgttttcattaaatcccctcaactctctatgagttgggaacagtcattatgccctctttactgtggggcgggggaggggattgagactcagaacagttgaggaacttaccttaagtcatactgtttataaactttcccaataaaacccgtttctcctgaccgaggtatcatgaagggtgggtggcacttggatggggattggggggcatcccttgctaggacactcagcccaaaggaagcccctgaaggatcacctcaatatctgaatatattgaccatctactatgtaccagtccttatgccgagcctcatctcattcagtgatgtgaagtccacagtaaacctatgatcagggcagtatcatccccactttacagatgacagaactaaaattcagagagattgggaactggccacagttatacatctacaaaagcaatttgttttcaggtgtctgactccaaagcccctgctagaaacctttgcccatgctccagtgacactccccacagtctggagagccaagaaaacaccacttggctagacctcctccttctcatttcccagtcaccaagctgccatatgtggtagagcaggttgagcattgcactggcacagccaacagaaaaagtggtgcctaaaagccagccacatgttgtgtgccctggatggcagaacatctgtccagaggaaggagtgggcacctttttctgatttgcacaaaagtgctgtatgagctagtggcagccccaccaatagcctgtccctgtttgactgatggggtaccagtggtgatcaactgtggctgtttctatggtagctaaagtccttctgagagcctagtgagcatgtggctcttggacctatttacagtccgatggggaaggatgggtttttgttagctttcggggaagtgctggttagtctgtgcagagctgtgctgccttagcctgcaggggaaagtcatacacagattaattaccctgtgatcatgaatggctttgaggtggccagaacagacactggagccttttcaacgcagataacaattccctaattgatgaatttgctcattcccagtgccctacccccaggccattactagggcttccattttgccacgtcactcttgcagtttctacacactggggaggtttgacagttatgtggctcatcagcctgccaagagcctggcccaccaggactgacatttattgagcacctactgtgtgctaagccctgatgccccttatgggataattattgaacacttgctctgtgccaggctctgtcaaatcttttacctgccttaaatcatctaatcatccaaacagtccagttgcataagcactgttattaccattttacaaatgaggtaacttggcacagggaggttgagtaacttggccaaagtcaaacagctctgacatggcagtgtagggatgcaaacccaggcaatctaggtcccaagactgcactgtcaaccctagcttctcaaaatacattgtgaaaaattcacactcattatcccacataattgtgtaaggtttattagccctgttttataggtgaggaaactgaggcttagtgaggggaaagccttgttccatgtcacacaggtaggccatgacagttctggatggaaacccaggtcggtctgattccaaaactgcatataatactgcctgcaacagttgcttaatgtatggggcttaggaaccaaatcaactttctttatagcattgaaaaccacaacttttaccttcgggttggccttggcctcccaggaaatatttgaatagagaattctgttttggggggacattaaggagcctggtctgccccacccgacctatcaacccaacattttgctctgg

SEQ ID NO: 24155 - DNA, 465 bp, Homo sapiens
tgcaaatggagctgtattaggtcccacaaacttggtggcctaaaatgcatcagaagcttactctctcacagttctggaggccagaagtttcaaatcaaggtgttggcagagctgagtttcctctggaggctctagaggagaatccatccttgcctcttccagctcctggttgccccaggcgttccgtggcttgtggtaacaaaattccaaactctttctctgtcttcccatgggccttcctctctgtatgtctctgtgtccaaatttccccctcctttctcttacaaagatgtgagtattaggatttcgagcccaccctaaatccaggggagaactcatcttgagctcttaggatctctgcaaatctgcgaagactctttttcgaaatcaggtcacattcacaggttccagagggtaggacttagatatatctatcttttgggggggccactattcaacccacca

SEQ ID NO: 24156 - DNA, 365 bp, Homo sapiens
gaatcagatagcatagttctaattctggtgctactaatgactagatttgagactttcgttaagtcattctaaacctcagtttttgtgtgtgtgtgaaattggaataatgcttacctattcgccaaggttgttatgaggccccaaagggttttgtaaatgtttaaacagagttagattgtttcaaaagtctcttaaagtggtttctctgcttgtttttttgtcctcagacatcgtttctcctcatggtagctagagtaattttttcaaaatgcaaaatcatattgtgctgttggttacaaccttacaatggttttccattattgtatttgagtaatatcctcattatgctataggtaccactcttg

SEQ ID NO: 24157 - DNA, 420 bp, Homo sapiens
accccatggtaaaacatattagcatagctaccttcaaatgacatgggttccctgactggcatttgtgtagtagagatgttcaatgattgaaacaattttagggccttgaatatcatgatagccttactactttaaaaaacaagaatttgacattgccagactaatattcctgtatggaattcactaaaagaacattctcctttagaatgaaaaatgactctgcaaagtagtcttttaatatggttagttcttctgtgtcttactagggtaagaatttcagtcatcaaaagggaaagaaattttctaaataatggattatttcaacacaggaaaaggccagatattttatctggcaaacagttttttttttttcccctgcaatttcatctgtaaaaaacaggtaaagttttattattagat

SEQ ID NO: 24158 - DNA, 331 bp, Homo sapiens
tactcaatattataaataacttatcactgtatgtctttttatataaattgcatctgtgacaatttcctgaaattgctggttgaaaggaaaggctcatttttaaagctatgttttgccatgttggcttctagaaggattgacccagtttgtactttagcctgtagcggatacaaatgtctatttcacataactgcatttcatatttttttaaatatccttggcattttgagaatcaaaaattagtatctaggctgaggcggatggatcatgaggtcaggagatcaagaccatcctggctaacatggtgaaaccccatctctaccaaaaaaaa

SEQ ID NO: 24159 - DNA, 1095 bp, Homo sapiens
aggatacttatttccataaaagtattcgagaccttaaaatcagttaccaaaaaatgtcatttccatccattccttgagctaattctgcatctctaaagaaaaactcaagcgcaagactttctattcttgatgttgagggcatgtctctgtttaaatgaaactagtgcttcagatgcttttattacattatctcacagtgactcaaataatgtgtatatgttggggatggccttatgatcatagacgatcagccattgaactcaataaggtgagaatttttaagtgggggatcaattaaatgttgaaaactgttaataataagccagtttgcaaagtagtagtcaaatgccacaggtcactttctttttctaattttctcccggttacatttttgtctctggaaaattagaatggaaatatctgcagatccctaaagaatcctatatagtacaggcttggattccttaattagtgccttggaagccagctcagcccttcttcaacttaactctttaaaaaaagaagtctttttaattcgtactacactcagaatggagggcagtccacttttcaacaagaaataggtatcattgaattctaacagatacataagcacagataatatcacattcttcatttcatctcctttataaatttctaagctagcagtctttcttggatactctccagcatcttttaaacataggccatttatcatatttcatagttggaatgctttctgttgtctgttctaggtagattccccttaatcttagattctaaaatggtgatgtttccaattaaacaatacccagaataataggtacatagtgactggcaatagtcagtgatgctgtgtgtgattgtgtgttccccttctatcatttttttaatgtttgtttaatgccatttattttttaagatgggatatatattttaattagctgggcgtcgtggcgggtgcctgtggtcccagctactcaggaggctgaggcaggggaatgccgtgaacccggagggcagagcttgcagtgaaccgagatcacaccactgcactccagcctgggcgaccgagtgagactccatctcaaaaaa

SEQ ID NO: 24160 - DNA, 790 bp, Homo sapiens
aggatacttatttccataaaagtattcgagaccttaaaatcagttaccaaaaaatgtcatttccatccattccttgagctaattctgcatctctaaagaaaaactcaagcgcaagactttctattcttgatgttgagggcatgtctctgtttaaatgaaactagtgcttcagatgcttttattacattatctcacagtgactcaaataatgtgtatatgttggggatggccttatgatcatagacgatcagccattgaactcaataaggtgagaatttttaagtgggggatcaattaaatgttgaaaactgttaataataagccagtttgcaaagtagtagtcaaatgccacaggtcactttctttttctaattttctcccggttacatttttgtctctggaaaattagaatggaaatatctgcagatccctaaagaatcctatatagtacaggcttggattccttaattagtgccttggaagccagctcagcctcctgagtagctggggttacaggcatgcaccaccacgcctggctaattttgttttttgttttttgtttttgtgtagacagggtttctctgtgttggtcaggctggtctcgaactcctgacctcaggtgatctgcccgcctcaggctcccaaagtgctgggattacaggcgtgagccaccttgccctgcctaagatgggattttttttaaagctgttcatttgtggaatgtggatgttctagaagttgtagaacagtgatgttcatgtatacaatcctgtcaaacaatggcagtttg

SEQ ID NO: 24161 - DNA, 453 bp, Homo sapiens
tgagatggagtctcacactgtcgccaggctggagtgcagtggcacgatctcagctcactgcaacctccacctcctgggttcaagtgattctcctgcctcagcctcccgagtagctgggattacaggtgcccgccaccacacccagctgatttttgtatctttagtagagatggggtttcaccatgttggcaggctggtctcaaactcctgacctcaagtgatccgcccacgtcagcctcccaaagtgctgggattacagatgtgagccaccgcaccacgctgagtcataatttttaagattttatcagaaaaacttaaacacaatgaattctcctgtgtcctaaaagcttaatatgttgattattacatactggattatagggttataatttgataggatttggcactagctgtctgatttggactgtttttaagatgttccttatatgtgta

SEQ ID NO: 24162 - DNA, 294 bp, Homo sapiens
gaactcctgacctcagttgatccacccacctcagccttccagagtgctgggattacaggtgtgagccaccgcacccggctgtgtgttttttttaatcctaattcttcctttctctccttagaacaaaccccatcatgaaatttgtggatgcccttcaggtctgtgctttttatgcttgtattacattttacatccatgaaaacaatagatagtattatttttgcgtattttttaataaaaaaagtattgcatatattctgcaacttctcttttttttaaactgaagattatatt

SEQ ID NO: 24163 - DNA, 661 bp, Homo sapiens
gaagaaactgagtcagaccaagtggtttacccaaggtcacacagctagtaaatggcacagttggaatttgaaccagccagtgtttcatctgctatattatgccatattatgcttgcgttctctctgaaaggacaaaactctcacatgaaacaatgaagacactcaatgtggtgttcactattaggttgaaccacatgcaggtgccatttttgtaggtcagtgtggtcaattatcagcagtgtcccatgggtcagcctaatacagcagcagccggggttcggacagggaaacctctctgcgcaggaatggtcagtagaggtttcatggcggagctgggaatggagcagggccttgaaggctctgtagactctggatggatagaaatgaggtgggagaggctgggtgcggtggctcagcgtctgttaatcccagcacattgagagtgcgaggcgggcagatcacttgaggtcaggaattcaagactagcctcaccaacatggtgaaaccccgtctctactaaaaatacaaaaatttgccaggtgtggttgcgcatgcctgtaatcccagctactcaggaggctgaggcacaagaatcacttgaacacgggaggtggagtttgcagtgagctgagattgtgccagtgcacttcagcttgggcga

SEQ ID NO: 24164 - DNA, 351 bp, Homo sapiens
gacaaagaattagctgggcgtggtggtggatgcctctaattctttgtatttttaatagagacggggtttcaccatgttggccaggctggtcttgaactcctgatctcgggtgatccacccgcctcgttctcccaaagtgctgggattacaggcataagccaccgcaccgggctggcagtttcttaaaaagttaaacagccattctacttctagatgtatacccaagagaaagaacatatatattcacacagacttgtgtgtgaatgttcatagcagctttatttgtaacagcaaaaaaactgcagatgatccaaaaatccatcaacattttaaaggtagaaagctgagaaa

SEQ ID NO: 24165 - DNA, 608 bp, Homo sapiens
tagaacatatttagaaatactgttcctctgtttacagttcaaaattaaaacttaagaaaaatttttccatgtttattaccgaatataaattaaaaactataattatatttgtatagcacttagaggttggaaggtgattttgctgttacatttaatcactatattatgggaaatgagcattaaatgtgaattttaaataaggcaagacatgaaaaatgtatgagtgattgaaatcaaagtagctaagtaaagttgcagagttatccaaaatgttaacccacagttctggttggagtgaatttacattattctaattcaatttgtcataccatctgttaggaatttgataaggagaataaacccattaaactctgagctttggatttatcgttttaacaaggggacagtgtctgctgtttataaataattttcaattaatgtatcttatttctggtagctctttgctgttactgtctgagttgtacaacagtaaggcaaaataatgatttgtgtgtacccataaatctgaatctcaaaatgaaagcgctgtggttgatttcaccataattttaaacatattccttcaataaatactaactgagcaacta

SEQ ID NO: 24166 - DNA, 330 bp, Homo sapiens
cttctccgtatgtctctctatgtgtgctgtttgggcttcctaacaatatggtgactgggttttaaaagtaagtatcctaaaagcgcaagaaaaaaacgcacggctatttgtgattctgcttcagaaatcattaaaaaaaaaaatagggtctcattgtgttgctcagggtagtctcaaactcgtgtgttcaaacaatcatccccctcacctctacccccacctgggcctcccggaaaaaccaggattccaggtatgggccaccatgcctgggggcatcactttaaccatactctattggtcaaggctgtcacacagatctgcctagattca

SEQ ID NO: 24167 - DNA, 304 bp, Homo sapiens
agtttcactgctgaaaacattctgactcttgttagaacagaattttcctcctccaagagagatggttatttagacatgacattgtttgaaattagggcaaaatcatgtagtgttttaaaaaagtactcaaatatacagtgaaaagaaagccaagctgtaacgcattaatcagaacttattcatgctggctgggcagggtggctcaggcctgtaatcccagcactttgggaggtccaagtaggcggattgcctgaggtcaggagtttgagaccagcctggccaacatggtgaaaccccaactcta

SEQ ID NO: 24168 - DNA, 394 bp, Homo sapiens
gtgcttgacaacaaaactcatgctatatttcttccctaatcttagtttaaatacatataatcattgtattgttatctttcctacaagtacttgtttcaagtaaggtaacatattttttttgctgcctgagatataatgtcaaatacagagtaccaggagcctggggactttctatctactctaaaagaacatattctactcttcactatggatttggtaacatttcctttattaaagagttgcctcctttatcttgactttaattcactttcaattcatccatccctacaaaatattcaagaaagaaccatttctgtatagaaattaaacacaaattattatcaatactggaacggctattttctaccttcataaatgtctaaggttgtgattt

SEQ ID NO: 24169 - DNA, 226 bp, Homo sapiens
ccaagataaaggcagacagagagaatgagagagatgagacagagacacgcagaaactaacaagggggtcagagaatgaaagagagacagaaggacacaggagctcccaaaggccaaatccaggaagatcagagcatcaaaatacatgatgataggaatggcttaaatgcgtctttgctgacgatcagaaatgcagtcatcgccacataatgacagtggtcccataa

SEQ ID NO: 24170 - DNA, 1491 bp, Homo sapiens
ccatttttgttagaactttctgatggctttactaagatgtcaggttttgtttgaggactgaatttgacatatatgcaagatatttatttactgctgctgccttgggtctccaggttctacctaggaggtatttgctgttccattgcagcatagggaaactgttcaagcacacaatgtgaatgttgagatcatgtgcagagaggccagtaccaaaacttcagtatctggcccaatggcaagaggctactgttaggtttgcatttgggcagttagaacctcacagataccagctcccaagttgctagtccatcagtgtaaactgaacacaattctctcttgctttctctctctctactccctcacacatttggaccttgtcacttggtgtttaagcaccttgcctatcaacaaaatctgatgagcagccccatggactctcctgtaataaggaacttgctctactattttattcttttaatgttttagtatttgatattggactcaaatgaaagggatctcattctgtggctgaaaaatcagacttcatatgttgaagagagcaaacttggggactcaactcagaagacatgtgttgcctgaaacctgcatataataatttttgatttgatttagtaagtgtggatttttcttaatctacagatttggggtttggggtttagatcatgagaacaccgtttataccttcacagccaatgatttatttttagtcttgaaatatttctccatatctgtttttgtgtcacctgtgggttttatcctaggggttgggatcctgattttaacattttgtacttgtccaaaaaagagttcaaatgctgggtttgttcccccagcctcggccaaggggttctcagaagattctaaccaaagctggagataggtctgctcattttccttctgcccagaagtggatgttggccaggaaaattacaccttgtgtcttctctgatgctccaaccagggacctctccagattactatctagcacagactagtgctacatctgcctaggtatgggctttctctggcagcaggggtctctctagggaggctgagagacccatgggtctcccttcaggggaagtgttcaggggagttcaaactgaacacttctctccagctctattcctatcttcctaatctaatggctctacaagatagtcatttccagtgctacagatgcaccagggcaccacctctttttttttctaggtagaccttgttctgtagctgctgtgaagaagctgcagccctgaactcaggtcatactcaggaacagcagcaggggtgtgggtggggtttgagggaaggtactctgaattcaccttcatgtttaacctgttccatctgacttgggtttcttcattatattgttccctcccactcaccttcacttctgtattacaacaatatagactttactctaaagccaatttcatggaagttattaaatgctacttgaatgtgtgt

SEQ ID NO: 24171 - DNA, 337 bp, Homo sapiens
taggcagagctgcccactcctgccactggcaccgcttgccccaggggacctaagctgcagatgtgcatggtgattgaatcatttctgcacaccactgctcacacagctccccggggacccccacttgcctgtgcaagctgtcatgagatgtgtgtgctcaagtgcatctgtgttggcatccagcatgtgcacatacctgctgtgaagtatgcaaggggtcacatgtgtatgtgcctatgcacacgtgtgctgtgcagacgcctctctctgggtgcgtgtgcattatgtggactgatgaactagtgaggcctcaaaggtgggaaataaaacacttgtg

SEQ ID NO: 24172 - DNA, 526 bp, Homo sapiens
agggtgatcagcccttcacccatcaggcctttgcctcagggaagcttgaccccacctttagaccccatgttgggcctgagtagtccaaaggcatatcccattcccctggccagggattagtttagggatagacatgtgaccaaattcagctcaataaaatgtgagtctgcaggggcaatctagaaaaagtgtcctcttccctaagagaaagccacaggagggtaaaaaaatgtctcagaacattgtcctgcctaaacatgatgcctcggacattctgcttctgtcttgctacctgcagcacaaggaaatccaacactgaggggtcacagcagagggacggaaagcacctggatcttacaacattgttgagctcttttgtctcttgacttctagttatgagatgtaattttcttactgttaaagtcatttctgttccttgcaaccaaaagcattcattgatacactgaatatagtacaatatttattcaatcaataaatgcctggcaaattacccaagtatgagtaa

SEQ ID NO: 24173 - DNA, 554 bp, Homo sapiens
acacaccatacaatttacttacttaaagttcaaaattcagtggtttttagtatatccacagagccgtgctaacagcaccacaattacaaacatcaccacaattcattttaaacattttcattaccccaaaaagaaatcctgcagccatttgccgtcagggcccattttccctcagtcacccgtatccctagggcaaccactgatctgctttctgtcaccgtagatttgcatgtcctggacattccatataaatagaaccatataatatgtagtcttttgtgactggctatatgggtttttgcacttaggataatgtttcaaggtttgcccatattataacatttatctcatttcttattatggccaaataatattccattataggataacaccacattttatttatccattcatcagttgatgaatggataaatatggatgatatttaggttactttcactttaaactcttattatcaataatactgaacatttgtgtacaagtttttgtgtagacatactgttttcatttctcttgggtactggcagtggaat

SEQ ID NO: 24174 - DNA, 151 bp, Homo sapiens
gctacttcaagatatatacacttatgaatgttcatagcactgctattcataatagcccaaaggtggaaactgtccaaatacccatcaatagaagaatattaataaatagtgggatagtcacgtagtagaatattacacaatgaaaatgaat

SEQ ID NO: 24175 - DNA, 146 bp, Homo sapiens
cttttggtttcttatttatttgaaagtgctctttggtatcaattaaccttttctctgtgataacacctacaattatttccccccggtttgttacttgccttttgatttgcttctagtatttatttttactatgaaagagacttttt

SEQ ID NO: 24176 - DNA, 390 bp, Homo sapiens
gagaagaccaaaatacatcctcatgatgtattactatgatgcaatgatatttatcaataatatgggaaaattcttacagatattataaagtatataaaattgtacatgtgtgtattgtacatatatatacacaaattacaattattatataaaacaaagcaaaaacctgtgaatacaaagaagagactggcataaaatataccaaaatattatagatagtggattttttgtgtatttcctctttaaaatcttcttaaggatcatatattttagatagaacaaaataaattaatcaaactattcagaatatgaacaatgtccctaatttacctagtaggctttcccttcagaatgtttccatgtatttttattcaaaatttattttaaaaa

SEQ ID NO: 24177 - DNA, 328 bp, Homo sapiens
ccctgtgaaaaaaacttatatttttttttcctgaaaaacaatggaattcaatgaaaagttatacgggataagaggagaaatctagatccctaaacaacattcagaaatggcttccagctgttgtaaatatcacctataagttgtttacaaagctagatgtaatattttgctcccttgtaatgacagtgatttttttttttgcccagtctttctcagaatgaacatggtgttgatttgttattactcttttactacttaatttttgaggtatatgatacaaaaaagcaatcaatgtagcaataaactagctttatcaaatattaataga

SEQ ID NO: 24178 - DNA, 451 bp, Homo sapiens
aactagtaaaaaacagaataacctgaaagttggttaatttcttatagacccacaatgtggccattatgtttttaaagaatttttaatagcataggaaggaagaaatacaaaaagtatgagaaagagcaatacagagtatcatgaatgctacagtttcactggttgtaaaactgcttttcaaatgcatagaatatgctatgcatatatcctaccagacatacatgaattgtctttaagaaataaataaaaattaggtatgtagcatagaggaagaagacctaaaaactaggaggatagcaaatcattagaatatttactaagtgaaagcagaagaaaaatagtatttgtgctttagttcataggtgaaatttgttgaggaacaaaaccattgcccaatatttttctttgtatggagaatcttcctggtacattttttggatgaagtatagtt

SEQ ID NO: 24179 - DNA, 577 bp, Homo sapiens
ctctcatgtttactgcgggactactcacaatcgccaaaatacggaatcagcctctgagttcatcagcggatgatggataaacagaacgtggtgtgtatacacagtggaatattattcagccatacagaggaacgacagcctgttatttgtacaagatggaactagggatcattatgttaagtgaaataagccaagcacagaaagacaaacattgaatgttctctcccacctactaaaaaagtagctctcgtgaagacagagggtagacgcgtggttaccagaggtggggaaatgtagcggggagagggggagaaagagaagttgattgaagggtacaaatacgtggtttgatagaaggaataagacctagtgttacatagatcatagttggcaattgcctactgtatatttcaaaatggctagaagagaagaatcggaacggttctagcataaagcaaaaacaaatatttaaggcgatagatattccaagtaggctgatttgattttcacaattatatgaatgcattaaactatcacatgtaccctgaaactatgtacatctattatgcatcagtga

SEQ ID NO: 24180 - DNA, 435 bp, Homo sapiens
ctctcatgtttactgcgggactactcacaatcgccaaaatacggaatcagcctctgagttcatcagcggatgatggataaacagaacgtggtgtgtatacacagtggaatattattcagccatacagaggaacgacagcctgttatttgtacaagatggaactagggatcattatgttaagtgaaataagccaagcacagaaagacaaacattgaatgttctctcccacctactaaaaaagtagctctcgtgaagacagagggtagacgcgtggttaccagaggtggggaaatgtagcggggagagggggagaaagagaagttgattgaagggtacaaatacgtggtttgatagaaggaataagacgggccgggcgcggtggctcacgcctggaatcccagcactttgggaggccgaggtgggtcagaacataag

SEQ ID NO: 24181 - DNA, 2308 bp, Homo sapiens
gctggatgaggggctgattcatgtcctgggcatgacagagcgggaggcacaaggtttcatcacactattcacaatggcgagcaagttaaaacggatttcccatttaatttaattttcagacttcagttgaccatgagtaaccgaaaccacagaaagtgaagctggggatatttcagaaattcttttctaatcagaaattctaatcaaacataagtttccaactatgtgttctcttggtcctcagaagtgtttgaatagaaaagtaacaactaacttcccatctttctggtggaagagttaattctgcctggagggttctgcctgggagacatgacagcatgtgtgtgactcctgtgtctgtttctgtggggtcatccctttcgtttcattttgccagggcctggctcaggattttttatggcagtgcctgtgaagacaagcctggccctccatccagtcacacaggaaatccacagagagcatgctgagagcagccagcggctgggctgccatcaggcctggtttatgatgccacaagtgaatggcacgtttgttcctctttatctctgagcattgaaggacttttggttaaaaaaaaaaattaagttcagagtaatccttttcatggaagaatcttcaggtcaccaaagaattgaaattttaagccccagattgtactgagctgtacctgtgggaaaaggaatggccagggtattgatgatggaaaagattcaaatgaggagttagaaggcaagccctctgtgggcagccgtcttccagaaacctcgaacttatgtctgtctccacctgagaaaggagaagaaaagctggtggtgacccctgctcctgctgggccatgccatggctctgaagatgccccgtgttcttaggaggtgctcacccctggcacctaaagacatttccttctggttgttgctctttaaaaacaaaataagcccctgaacgtgcttgcaggccagtttgtgtgcctgcacttgacgaattaccttgaccaacgggccaaaggcacagagctccaaggcatcatctttccttaaaatcctgagtgtttattaaaaagggacatggtctctaggtatcttattacatttgtatttcttacatttgaaatatcctaaccgctcccttcggtttcttcttaagaacatttacatctaattatttttcgtgcaagtcttgtaggacccacatgttttcctagctttggaaatcgatttttttcattcctcttatgaggatttccctatgtcagtaaacattaactttctatttcttccatttttgctcatttgaaacccctgctgcttctagatctatttctttgcacttgtataactttgaaataaattcctcatcccttagactaagagagtgggtgtctgtgaaaattgttttctccttcataatacctaaattctagtttgtcagtaaaatatttgtgtttggttaacaagctcttatttaagccattgagttagtataatctttattacctttgaaaaaccagagagctgaattttttgtcattctaagttgtaagtaacactgcagtcaagtcttctgatgaaatttccatatatcaaattgaaaataaagcaaaatatatttattactcataactaatatactttcacatttctctgattatttgtaagacatttcagcatgtggatgtggggaagggtgagcctgccccagaaacatctccctgctgccaccatggccacggctcggcagtctcccttcactgactcctgaaactccacgtaaatctaccatcacccaccccttctttgaccgttccctgcaccttcttgctcacagaaagctggtgtttcccccattcctcggtgcatagagccgacacccctcacattcttggcctgtttccaggctgttgtagttgcttcagcacgtggtggtgcacaacacccattcgatcgtgctcatagattctgggcgttgagtccaggcaaggcatggcaggcaccacctgtcccggctcccacgtctgggcttggctggaagacctggagtcagacgagtcttcgttctcgcctgtatctggctcatgctggctcttagatggggcttgtgtctctccatgtgagcctctcattggtcctgaagactagttaactgataactggatggtaactggattctgaacacaagctttctaaaggctaaagagccaggtagaagccatgttactctttatagcccagcctccgaagtcacagcatccagcatctcttctgccatatcctgttcatcaaggcaaaca

SEQ ID NO: 24182 - DNA, 2254 bp, Homo sapiens
gctggatgaggggctgattcatgtcctgggcatgacagagcgggaggcacaaggtttcatcacactattcacaatggcgagcaagttaaaacggatttcccatttaatttaattttcagacttcagttgaccatgagtaaccgaaaccacagaaagtgaagctggggatatttcagaaattcttttctaatcagaaattctaatcaaacataagtttccaactatgtgttctcttggtcctcagaagtgtttgaatagaaaagtaacaactaacttcccatctttctggtggaagagttaattctgcctggagggttctgcctgggagacatgacagcatgtgtgtgactcctgtgtctgtttctgtggggtcatccctttcgtttcattttgccagggcctggctcaggattttttatggcagtgcctgtgaagacaagcctggccctccatccagtcacacaggaaatccacagagagcatgctgagagcagccagcggctgggctgccatcaggcctggtttatgatgccacaagtgaatggcacgtttgttcctctttatctctgagcattgaaggacttttggttaaaaaaaaaaattaagttcagagtaatccttttcatggaagaatcttcaggtcaccaaagaattgaaattttaagccccagattgtactgagctgtacctgtgggaaaaggaatggccagggtattgatgatggaaaaacctcgaacttatgtctgtctccacctgagaaaggagaagaaaagctggtggtgacccctgctcctgctgggccatgccatggctctgaagatgccccgtgttcttaggaggtgctcacccctggcacctaaagacatttccttctggttgttgctctttaaaaacaaaataagcccctgaacgtgcttgcaggccagtttgtgtgcctgcacttgacgaattaccttgaccaacgggccaaaggcacagagctccaaggcatcatctttccttaaaatcctgagtgtttattaaaaagggacatggtctctaggtatcttattacatttgtatttcttacatttgaaatatcctaaccgctcccttcggtttcttcttaagaacatttacatctaattatttttcgtgcaagtcttgtaggacccacatgttttcctagctttggaaatcgatttttttcattcctcttatgaggatttccctatgtcagtaaacattaactttctatttcttccatttttgctcatttgaaacccctgctgcttctagatctatttctttgcacttgtataactttgaaataaattcctcatcccttagactaagagagtgggtgtctgtgaaaattgttttctccttcataatacctaaattctagtttgtcagtaaaatatttgtgtttggttaacaagctcttatttaagccattgagttagtataatctttattacctttgaaaaaccagagagctgaattttttgtcattctaagttgtaagtaacactgcagtcaagtcttctgatgaaatttccatatatcaaattgaaaataaagcaaaatatatttattactcataactaatatactttcacatttctctgattatttgtaagacatttcagcatgtggatgtggggaagggtgagcctgccccagaaacatctccctgctgccaccatggccacggctcggcagtctcccttcactgactcctgaaactccacgtaaatctaccatcacccaccccttctttgaccgttccctgcaccttcttgctcacagaaagctggtgtttcccccattcctcggtgcatagagccgacacccctcacattcttggcctgtttccaggctgttgtagttgcttcagcacgtggtggtgcacaacacccattcgatcgtgctcatagattctgggcgttgagtccaggcaaggcatggcaggcaccacctgtcccggctcccacgtctgggcttggctggaagacctggagtcagacgagtcttcgttctcgcctgtatctggctcatgctggctcttagatggggcttgtgtctctccatgtgagcctctcattggtcctgaagactagttaactgataactggatggtaactggattctgaacacaagctttctaaaggctaaagagccaggtagaagccatgttactctttatagcccagcctccgaagtcacagcatccagcatctcttctgccatatcctgttcatcaaggcaaaca

SEQ ID NO: 24183 - DNA, 456 bp, Homo sapiens
agccactggattcatcctagtggagttaatatagagaattggataactcagaaattacctactgtgtagactggcctgttgttttaagacatattttttcaaatgtgggcaatttgatctttaagtagttatggaaatatatttgggcttcttaaaatctaaaatacccaacattatggaattcatgaacttcccccttttctcattctgatcagtgttgttttattgtactttgatgagcttgctaataatgtgataaaccaacttgaaaatgcattggaaaagaaatgatatataactagcatgcatccaggttggtgtaaaggtggcaaatactttccccagaaaaaagctcaaatggttattttaaaatatgggattgatgtgccactgaagtgattttcgtgtgattaaaaaccatattaagcatggtgtctatagagattgaaaaaaaaa

SEQ ID NO: 24184 - DNA, 344 bp, Homo sapiens
tggtcacccaggctggagtgttatggcatgatcttagctcactgcagcttcgacctccctggctcaagcattcctcccacctcagtcccccaagcagctggtactaccagcgtgcaccacaatgcctaattttttgtagagacagtgtctcaccacgttgcccaggctggtctcgaactcctgagcttaagcaatctgccgacctcagcctcccaaagtgctgggattacaggcgtgagccattactctcagctgggaatcttttttttttttccccgagatagagtctcactctgtcgcgcaggctggagtgcagtggctggcatgattagggctcactgcag

SEQ ID NO: 24185 - DNA, 407 bp, Homo sapiens
ctctacttcagtttttaaatttatgtcttctaaattttagcaatgttaaatcaagtttagcctaaagctgcctccttacatactttaagttcagcctccaggtttctctgtacatggtgaactataacctaaagggagttagactctagcctactcttgagccagttactgagttgtggtcaaaggtggccaactgttcaaactgtgttaaaataaggcagatgccaagctgtaaccaattcggctatttctgtacctcactttcgttttctgtatgtcactttcctttttcagtccataaatcttcctgcacgtggctgtgctggagtctctgggcctactctggctcagaaggctgccgaattcttgaatggttctttgctcaattaaactctgttaaatttaat

SEQ ID NO: 24186 - DNA, 506 bp, Homo sapiens
gccctagccacctgccttttgcttgctcttaggggtgcctgggaagggatgcataggtatatgccatggttagggttttggtaggcttctcgtggtttggtattgatggatgtcttgggcctctgtcagaggctgtttatgtaggacagtctttgcagtctggtcggtcattgctcgagatttcttatgagaaagttgtgtcctctgtaagtctgaggttggggtaaaggcttatcagactcttgttccatggtgtgaaaggccatttgcccaatgaaaagagcttctaagaaacttaagaggtttattgaaaaggatggttggatatactttatgtagattcagtagtttggcaagcatctgagtgttgaattaggctctgttggtccctgtgtctaaggagttcaagaattagctgataagtcagaatgtatgtgaaatggctagagaagaggcctaagacaatatataagcgtatttgtttggaatttattctatttactgag

SEQ ID NO: 24187 - DNA, 446 bp, Homo sapiens
agaagggtccagccagcagacccccaccccccaacccccggatccagggccgcttctggaatcacattagggagaggctggcctggttcagagctcgcccatcctaaacaagataaataaataattccccgctggcctcagtgtgggaggaatcaaagaaccagaacaaatacctcccacagcctccctgcccaccctccaccccatccccggacaggtggggaaagggctgctatgaccagctttgtggccttggtcaagtcacttcctccatccctttttgcctttataaacggagagccttgggctggaagccatggaagtcgctccagtggaaagacaggtcagagctgggaatgaatgggacgtaggagtcactccaaatgagaccaacccagatttggtgggtcagttaagctcatcccagaacattttggacctcgtag

SEQ ID NO: 24188 - DNA, 510 bp, Homo sapiens
tgaaatgacattgaaatctggggacctaaagtgctatgacctactcttgttagaatggggaggggtgtatgagactcagataattataataaatagagttctggcccagatttaactcacagtgtgtctctgttatcagagtcctttctctggttcctagttttgtaattggaatcaacatacatggtagttggcagaattctcaacttggctccttgaccagtttggttaagtgctttcctagtgggggaagatcaagtggaagcctctaaaactgtaccttccctcaccttggaagggacagcatttcttctagtttgggattaacacatattctggggtccacatgtttgctttttctgcccataagtccacagccagcaccactatctgagggacttacagagtgtttgatccactaatacgggatcttgagtaatattgtctcttaccaagagtcgcactttacaggaaagatgtgtagcagtgggccaaagttcatgaatccac

SEQ ID NO: 24189 - DNA, 256 bp, Homo sapiens
actgcaacctccacctcccaggttcaagcaattctcctgcttcagcctcccaagtagctgggattacaggcatgcaccaccgcgcccggctaatttttgtattttcagtagagacaggttttcgccatgttggccggactggtcttgaactcctgacctcaagtgacccatacaccttggcctcccaaaatgctgggattataagggtgttgtcttttaaataaattaagggaaacagctactcttcagtgtgttt

SEQ ID NO: 24190 - DNA, 7929 bp, Homo sapiens
tcactgcctatgacggcttcgttcagtacattccctttgatgatccacggttacgacattttaaactagctcagccccagggtttctgtgaagacataaagcttgacgataaatcatataactccagtcctgtcactgctcaagagccggctcatggaggaatgcagcctgatggtgccatttggaatccacagagcttaatacccccgtcgggggatgagagaggcctggtcttggccgattccagcccccggtggctgtggggccagccccccggggatggggaaaacagtggcctccccaaccagagagaccgctgtgtggcaaggggacagtggcctgatgtgagaggcagccagcacgggcacactggaagacaagtttcctccccttactcacagggcgagagcacctgcgaaactcaaaccaagctcaaaaagttccaaactgggactcggaccaagaaaagttcaaagaaaaaaatgaacgagactatattttgcttggtttctatcccagtgaaatcagaatcacatctgccagatagagatatggacaacaatgacttaaagcccagtgctgatcaaaagaatgggtctgataagagcccggctctgcaagaacagagtctgctgagcatgtcttccaccgacctggagctgcaggccctcacaggaagcatgggtgggagaacggagttccaaaaacaagatctaggggaaccagaagaagacagacaaacaaatgacctcagtttcatccaccttacaaagcacagagaactcaagcattctggctcttggccagggcaccggtacagagatcagcaaacacaaaccagtttctccgaggagccccaaagttcgcagctgctccctggtgcaaagctgggagggccgagtcgtgcagcattgagtccaaaatgttcagaccctgctgcctccgaagctcagacgcacacagcattccctaccggtgatcacaaacagaggccaagtgcccgtaacctgaaaggtcacaggtccctcagcccatccagcaacagtgcgttctcaaggacttccttgtccgtggaccaggcaccgacgccaaaagcaggccgaagtcagccctgcgtggatgtccacgggcttggagcccaccctgggcctaagcgggaggtggtgaagggggagcccacgggcccttgcaacagtaaacaactctttgggcagtttctcctgaaaccggtcagccgtcgtccctgggatttgatcagtcagttagaaagttttaacaaggagctccaggaagaggaagaaagcagcagtagcagcagcagcagcagcagcagcagtgaggagagtgaggcggagccgcagcaggagaaccgtgctcactgcagacaggaggatgtgggcttccgcggaaacagcccggaaatgagggttgagccacagccgaggatgtgggtgccggagagccctgtgtgtaggtcgggaagaggtgagagtaagtctgagagctggagtgaggagctgcagcctggccacccacgtgcctggcctccatccccgggccgctttcgcgtggaagaaggtggcggtgcacctttctgctcagcagatggaagcacgagtgcagagaagggacacctggaggttagcaacggaatggacgagctggcaggtagcccatttcctgtgacgagaatgtcttcaagatcaagtgacgcaaaaccactgcccgcgtcctatccagctgaacctagggagccccaggaaagtccgaaaatcaccagtgctttcagctctgtgaaaccaagtgaagcggtccctcggaagtttgacagtggtggagagaggggggcagggctcccactgtccctgtctaacaagaaccgagggctctcagctccagacttacggtctgtggggctcacccctgggcaagaacagggtgccagtgagctagaggggtctttgggtgaagcaagcacaatagaaatccccccaggtgagtccttgcaagccagggctgcaaggatcctgggcattgaggtggcggtggagtccctcctgccgggcatccggagagcgggacagaaccagcctgctgagcccgatgcaagtgcctgcaccccagagtccccccaggaagagttgctatctcgcccagcaccggcagatgtccccagggtgtccactgatgccttttatggcaggaggaagtgcggctggaccaagagccctctctttgtaggggacagggacagtgccaggcgggctcctcaggcttttgagcactcagatgtggacggggttgtcaccagcacagaccctgtccctgagcctgagcccagccccttggagtccaagttcttcgaacaaaaggatgtggaaacaaaaccacccttcaggtccactttattccattttgtagaaagaaccccaagtgtggcaggctctgaaaagagacttagaagcccttccaaagtgattgaaagtttacaagagaaactggcctccccgcctaggagagcagaccctgaccgcctgatgagaatgaaagaggtgagctcagtgtcacggatgagagtcctgagcttcaggaatgccgactcccaggaggacgccgaggaattgaaggccaccacaaggggccaggccgggctcccgggaggccttgtgtctcctggcagtggggaccgtgcccagagattgggccactcactctctgtgtccaaggacagcatctccagggaagagaaggagcatccggcagcacaaaaggagaagagcatggatcaagacttctggtgcccagattcctatgaccctagcagagtggagagggtgtgatgaaatgccggtggagcttgcattccgttgcgaattgagtattctcaagtagctggtagatttagtctatcagccccacttccccatgtagaagctggaagctgctgagtttttagcatcctgataacattctttaccactgccactaggaaacttgccatcctctcagaattgctttgtggcgataaagcaatcgtccgttgaaaccatctgtttttatagcatgaagatttaatgcctataattaggaaggagttttcacagaaaccctccctcatgacagatttgactaagctggtaaatagtttggtgttgctctcattctgggtgaagatttcaatgtggaagatctagcaaatgctttggaaaggcctgtgaatggtgtgctcccctctgtgtctccatggcctgcagtccatgctcttgtgaaggagtttgggacactggctgttgcccggtgtttcagcactttcagtttaggggaaatgtgaatcaataggtatgatccatttctaatcaatttggccttctgctgctggaagtaactttacttataagtaacttgccatcagagaataaaagcaatatcttttaagttcctgaaaaattaaaacttgtactgtaatatactaagagtattatttatctggcagtgaaatattttgatcatttgcaaacacgccattgtctgctttgcactcagtattatctatttttattttctgtatgggtatttagaaattctttatatgaaaaataattgctggtttaaaatagaccattttaacaaagtgactatatttctttttacgaaaatgctatttttctatgatgtaaacaattgttaggcggcagatttttaaggaagtattattttatttaagagtctgtatccctttgtgtgagaggaacccaaagagggttcacttttgctttaaagctctgtcccttacccactgacaactctgctacttttattttatcttagaaaatgtcaatatagacatatcacagggttaataaaagaaacttttcacaaagatttttgtacaagtgtagctatcaggttatatttgaaaataaccctctgaaaaccagccaacattgtcatgacaatttttgctgccgtatcaactagaattaccaaaaaacatagttttatctttgtatgtgtgtggggatctaccctgagaccatgcttttcttcccaccctgccaccccacccctttaaagaaatacgtatttttatctagaatgatcttgaattagtctctgcatatttttagaaagtgcttggggacattatatatatgccattacaaaagcattatgaggcctatgtattctactgtgtttaatactgcattaacctgcacaaagtttatgcattttttcatgcatttttttccttctttctaagtaaggtattcctgacaactaacattccctaaatcatttcccctccctccctccctcccttcctttcttccttccttctgtcctccctcccttgctacctcttgccctccttccttcaccctgtcctccttttcccttttattttttccccttctctttcattttcttttcttttagagaaaccaccttatctatttttagacatttcgaattcctaaaatgtgaaccgttgggtgatctgtcctttggccctaaaacggctggccgggctgtcccggcctgttctcatctgtaccgtatgattttatttcataataactttatgtatttggactgtaacaaacaaaacagaacctaagtcgccccgaaaaatctttccaagccttttcaaaacacttatctgcagtccagaattcagctcttatgaaaagtgagagtgcactccagttttcacagcagcaataagtgcgggaaacaaaaagatcctcttcccaggaaaagttgagtggggaagagttcagacactgttgtagctggtgaatcattgaagtcacctggtagtaccaaataagggctgaggcgcctggaggtctttgtggggtcttccctctttaaatgcaaacgtaagaaggtatatgtgtatatacatttatatacgtgcacatgtatactcgtacatgtatgcacacatacccatacatgtatatgaactccgttctgatttcctctgaaattttgttgataccatctaaatacctctttgaatcaaaataacttaattttagctcattcctcaagagaaagagaaggatccccaaggaagaaaaactgttgtaccttctgtgattctcaaaccaaaatgtgatgcgcttctgttttgttatcttaaattgttgtatcatatctttctgaaaccattctgaattaagttgaaattttcaacatttatactttaactgttctaaatttaagcctacatgtaaatcttttttggggggaaggtaacttgaaaagtttaacttgaaaatttgacctttaaactttcatattctaaggtaaataatagcctataaccaacaacagctttcccagaggtcttgaatttaacactaattgtttagttattgtttctatttctcatacatacataacttcgttttttgtggctggaagaaaaagtttctatattttgtatttgtctttgttcttctcatgcacacaatttactgttggtgtttaataatttggagctcataaaattaaaagttgtaattttgaccatttgggctaaaaattatatgagggattacatatgcaatggattagtatttcttgatttgcaaaagaagggaaaatgatggtaatttagctcaaattgcctttctttgaagaaaatttctgaatgactgaaaaccaaatatctatattatcactttcaacctcatgtttctgcaaagtacagaaaaactcctcactgacagtgcacccagcccctgactgggttttcaggattatgtccatgtgcataactgcttggatttcttcttttaaagtccctaaaacatgaatctgttctttgagatcctggtttccttagcagagttgtaggttgcgggtttcattcacgtggaaattctaagtagaacttttgctgccccattttactgttggtgaagggccgttgttaatggaagtttacgttttaaaactcagatgactcagaaaccagactgtgatcattttttgcagcagcaaaatgacttattctgacagcatctcggtttggggcttctgaagaaaaaggatgaagctgatctgttgaaacaactactttcccaactcggaggcaaaaggggctgatagaagataacattcacctaccatttcatcttgtgacccccagagatcacgtttgcgtgttctggctgagttttttattattgtttgttttaaatgattaaataatacacaattaaatgtcaggatagcatctcttgcaaagtgaccagtgcagcagaattgtctttctatccatatttgagcttagagaaacatttcccatgtcctaagttcttagaagcaattactttagcgttggggagcattgttctaccagacccatttatgcaggggagatgaagcttaaaagacgggatgtggggtgggagtgtgtttcttaagccgaagctgttgcaggctgggggatttttgcattttctttttgttttgtttttgactgcagattctgtacatctgtctgtgggaggagagttgctactcaggacaggatttaagagacacattccagtgacctttaagaatctgcatggcgggaggtccttctccaggagtgtgggttggtccactctgggacccaccacactaagaagggggagatgataaaataacattaaaggaagaatggcctccagcctgcaggttttgttggaaagaaataaaaagggagtcattaagaccataaattcagattgaggcctcttgaaaaggttgatgtgggctagcaacctgcctgtcgaaacagtccttggttcatcagcagtgtgggaaggcagccaaggctcctgcagattcctggcatcgaccttggaaagcctctgcgatacttgtgtgtacgaatacagcagaggacagggaggtccttgttctgtggtctctgtttagtgactgaaacttaaacccaaaggcaagcccagattgtctggccgttcatccccatgctttgataggggttaggaggaaccctttccgtatgaaagacaggccctactagggcttacaaccaagccaaaggaccatctcttctttcttccacctcccttcacccctgccccgcagcagagccgagatgtgagacattcattgtcacggagcaaggagacaaaggcaagttcaagttgagaagcatatggcagcaaacagaaatgaaaaccatatgtcccagcaaggggaaaagcagtcatttccagattataaaaatcaatgaagtactctccacctaggtcagctgaaattcgagccctcacagtcaggcctgtcagagaagttaagcagaaacatctcggggggacttctaaaatttagtgaagacaaggccttgcaactccaaagaaactttttttcccccccttgaaacagggtcttgctctgttgcccagcctggagtgcagtggtgcagtcacggctcactgcagcctcaagctcctgggctcaagcactatccccacctcaacctccttagtagctgggactacaggtgcacaccaccatgcccagctaaccacagaaactttcatctcttcattttttctttgggcaccattaatacctaagacaggtagaaagggtcccagaaagacaccattggtaatggccgattgccggctgcagtcatcgcccccagatcaggctggtacaggatgccttaaggtgatgagaggtgagggtgcatgaagaataatgagcacagggaagagagaagcaggacaaagtagcagataaaatgccggcaaagcacagatgaatgtcttcaagaagctcttgtatttctctgcacagtgtaaatatccttgctatttcaggatggcggctggcctgctcagtaacatacatgttccaaataaagattttgcatgaaagtaaaaaaaaacg

SEQ ID NO: 24191 - DNA, 7143 bp, Homo sapiens
tcactgcctatgacggcttcgttcagtacattccctttgatgatccacggttacgacattttaaactagctcagccccagggtttctgtgaagacataaagcttgacgataaatcatataactccagtcctgtcactgctcaagagccggctcatggaggaatgcagcctgatggtgccatttggaatccacagagcttaatacccccgtcgggggatgagagaggcctggtcttggccgattccagcccccggtggctgtggggccagccccccggggatggggaaaacagtggcctccccaaccagagagaccgctgtgtggcaaggggacagtggcctgatgtgagaggcagccagcacgggcacactggaagacaagtttcctccccttactcacagggcgagagcacctgcgaaactcaaaccaagctcaaaaagttccaaactgggactcggaccaagaaaagttcaaagaaaaaaatgaacgagactatattttgcttggtttctatcccagtgaaatcagaatcacatctgccagatagagatatggacaacaatgacttaaagcccagtgctgatcaaaagaatgggtctgataagagcccggctctgcaagaacagagtctgctgagcatgtcttccaccgacctggagctgcaggccctcacaggaagcatgggtgggagaacggagttccaaaaacaagatctaggggaaccagaagaagacagacaaacaaatgacctcagtttcatccaccttacaaagcacagagaactcaagcattctggctcttggccagggcaccggtacagagatcagcaaacacaaaccagtttctccgaggagccccaaagttcgcagctgctccctggtgcaaagctgggagggccgagtcgtgcagcattgagtccaaaatgttcagaccctgctgcctccgaagctcagacgcacacagcattccctaccggtgatcacaaacagaggccaagtgcccgtaacctgaaaggtcacaggtccctcagcccatccagcaacagtgcgttctcaaggacttccttgtccgtggaccaggcaccgacgccaaaagcaggccgaagtcagccctgcgtggatgtccacgggcttggagcccaccctgggcctaagcgggaggtggtgaagggggagcccacgggcccttgcaacagtaaacaactctttgggcagtttctcctgaaaccggtcagccgtcgtccctgggatttgatcagtcagttagaaagttttaacaaggagctccaggaagaggaagaaagcagcagtagcagcagcagcagcagcagcagcagtgaggagagtgaggcggagccgcagcaggagaaccgtgctcactgcagacaggaggatgtgggcttccgcggaaacagcccggaaatgagggttgagccacagccgaggatgtgggtgccggagagccctgtgtgtaggcgggctcctcaggcttttgagcactcagatgtggacggggttgtcaccagcacagaccctgtccctgagcctgagcccagccccttggagtccaagttcttcgaacaaaaggatgtggaaacaaaaccacccttcaggtccactttattccattttgtagaaagaaccccaagtgtggcaggctctgaaaagagacttagaagcccttccaaagtgattgaaagtttacaagagaaactggcctccccgcctaggagagcagaccctgaccgcctgatgagaatgaaagaggtgagctcagtgtcacggatgagagtcctgagcttcaggaatgccgactcccaggaggacgccgaggaattgaaggccaccacaaggggccaggccgggctcccgggaggccttgtgtctcctggcagtggggaccgtgcccagagattgggccactcactctctgtgtccaaggacagcatctccagggaagagaaggagcatccggcagcacaaaaggagaagagcatggatcaagacttctggtgcccagattcctatgaccctagcagagtggagagggtgtgatgaaatgccggtggagcttgcattccgttgcgaattgagtattctcaagtagctggtagatttagtctatcagccccacttccccatgtagaagctggaagctgctgagtttttagcatcctgataacattctttaccactgccactaggaaacttgccatcctctcagaattgctttgtggcgataaagcaatcgtccgttgaaaccatctgtttttatagcatgaagatttaatgcctataattaggaaggagttttcacagaaaccctccctcatgacagatttgactaagctggtaaatagtttggtgttgctctcattctgggtgaagatttcaatgtggaagatctagcaaatgctttggaaaggcctgtgaatggtgtgctcccctctgtgtctccatggcctgcagtccatgctcttgtgaaggagtttgggacactggctgttgcccggtgtttcagcactttcagtttaggggaaatgtgaatcaataggtatgatccatttctaatcaatttggccttctgctgctggaagtaactttacttataagtaacttgccatcagagaataaaagcaatatcttttaagttcctgaaaaattaaaacttgtactgtaatatactaagagtattatttatctggcagtgaaatattttgatcatttgcaaacacgccattgtctgctttgcactcagtattatctatttttattttctgtatgggtatttagaaattctttatatgaaaaataattgctggtttaaaatagaccattttaacaaagtgactatatttctttttacgaaaatgctatttttctatgatgtaaacaattgttaggcggcagatttttaaggaagtattattttatttaagagtctgtatccctttgtgtgagaggaacccaaagagggttcacttttgctttaaagctctgtcccttacccactgacaactctgctacttttattttatcttagaaaatgtcaatatagacatatcacagggttaataaaagaaacttttcacaaagatttttgtacaagtgtagctatcaggttatatttgaaaataaccctctgaaaaccagccaacattgtcatgacaatttttgctgccgtatcaactagaattaccaaaaaacatagttttatctttgtatgtgtgtggggatctaccctgagaccatgcttttcttcccaccctgccaccccacccctttaaagaaatacgtatttttatctagaatgatcttgaattagtctctgcatatttttagaaagtgcttggggacattatatatatgccattacaaaagcattatgaggcctatgtattctactgtgtttaatactgcattaacctgcacaaagtttatgcattttttcatgcatttttttccttctttctaagtaaggtattcctgacaactaacattccctaaatcatttcccctccctccctccctcccttcctttcttccttccttctgtcctccctcccttgctacctcttgccctccttccttcaccctgtcctccttttcccttttattttttccccttctctttcattttcttttcttttagagaaaccaccttatctatttttagacatttcgaattcctaaaatgtgaaccgttgggtgatctgtcctttggccctaaaacggctggccgggctgtcccggcctgttctcatctgtaccgtatgattttatttcataataactttatgtatttggactgtaacaaacaaaacagaacctaagtcgccccgaaaaatctttccaagccttttcaaaacacttatctgcagtccagaattcagctcttatgaaaagtgagagtgcactccagttttcacagcagcaataagtgcgggaaacaaaaagatcctcttcccaggaaaagttgagtggggaagagttcagacactgttgtagctggtgaatcattgaagtcacctggtagtaccaaataagggctgaggcgcctggaggtctttgtggggtcttccctctttaaatgcaaacgtaagaaggtatatgtgtatatacatttatatacgtgcacatgtatactcgtacatgtatgcacacatacccatacatgtatatgaactccgttctgatttcctctgaaattttgttgataccatctaaatacctctttgaatcaaaataacttaattttagctcattcctcaagagaaagagaaggatccccaaggaagaaaaactgttgtaccttctgtgattctcaaaccaaaatgtgatgcgcttctgttttgttatcttaaattgttgtatcatatctttctgaaaccattctgaattaagttgaaattttcaacatttatactttaactgttctaaatttaagcctacatgtaaatcttttttggggggaaggtaacttgaaaagtttaacttgaaaatttgacctttaaactttcatattctaaggtaaataatagcctataaccaacaacagctttcccagaggtcttgaatttaacactaattgtttagttattgtttctatttctcatacatacataacttcgttttttgtggctggaagaaaaagtttctatattttgtatttgtctttgttcttctcatgcacacaatttactgttggtgtttaataatttggagctcataaaattaaaagttgtaattttgaccatttgggctaaaaattatatgagggattacatatgcaatggattagtatttcttgatttgcaaaagaagggaaaatgatggtaatttagctcaaattgcctttctttgaagaaaatttctgaatgactgaaaaccaaatatctatattatcactttcaacctcatgtttctgcaaagtacagaaaaactcctcactgacagtgcacccagcccctgactgggttttcaggattatgtccatgtgcataactgcttggatttcttcttttaaagtccctaaaacatgaatctgttctttgagatcctggtttccttagcagagttgtaggttgcgggtttcattcacgtggaaattctaagtagaacttttgctgccccattttactgttggtgaagggccgttgttaatggaagtttacgttttaaaactcagatgactcagaaaccagactgtgatcattttttgcagcagcaaaatgacttattctgacagcatctcggtttggggcttctgaagaaaaaggatgaagctgatctgttgaaacaactactttcccaactcggaggcaaaaggggctgatagaagataacattcacctaccatttcatcttgtgacccccagagatcacgtttgcgtgttctggctgagttttttattattgtttgttttaaatgattaaataatacacaattaaatgtcaggatagcatctcttgcaaagtgaccagtgcagcagaattgtctttctatccatatttgagcttagagaaacatttcccatgtcctaagttcttagaagcaattactttagcgttggggagcattgttctaccagacccatttatgcaggggagatgaagcttaaaagacgggatgtggggtgggagtgtgtttcttaagccgaagctgttgcaggctgggggatttttgcattttctttttgttttgtttttgactgcagattctgtacatctgtctgtgggaggagagttgctactcaggacaggatttaagagacacattccagtgacctttaagaatctgcatggcgggaggtccttctccaggagtgtgggttggtccactctgggacccaccacactaagaagggggagatgataaaataacattaaaggaagaatggcctccagcctgcaggttttgttggaaagaaataaaaagggagtcattaagaccataaattcagattgaggcctcttgaaaaggttgatgtgggctagcaacctgcctgtcgaaacagtccttggttcatcagcagtgtgggaaggcagccaaggctcctgcagattcctggcatcgaccttggaaagcctctgcgatacttgtgtgtacgaatacagcagaggacagggaggtccttgttctgtggtctctgtttagtgactgaaacttaaacccaaaggcaagcccagattgtctggccgttcatccccatgctttgataggggttaggaggaaccctttccgtatgaaagacaggccctactagggcttacaaccaagccaaaggaccatctcttctttcttccacctcccttcacccctgccccgcagcagagccgagatgtgagacattcattgtcacggagcaaggagacaaaggcaagttcaagttgagaagcatatggcagcaaacagaaatgaaaaccatatgtcccagcaaggggaaaagcagtcatttccagattataaaaatcaatgaagtactctccacctaggtcagctgaaattcgagccctcacagtcaggcctgtcagagaagttaagcagaaacatctcggggggacttctaaaatttagtgaagacaaggccttgcaactccaaagaaactttttttcccccccttgaaacagggtcttgctctgttgcccagcctggagtgcagtggtgcagtcacggctcactgcagcctcaagctcctgggctcaagcactatccccacctcaacctccttagtagctgggactacaggtgcacaccaccatgcccagctaaccacagaaactttcatctcttcattttttctttgggcaccattaatacctaagacaggtagaaagggtcccagaaagacaccattggtaatggccgattgccggctgcagtcatcgcccccagatcaggctggtacaggatgccttaaggtgatgagaggtgagggtgcatgaagaataatgagcacagggaagagagaagcaggacaaagtagcagataaaatgccggcaaagcacagatgaatgtcttcaagaagctcttgtatttctctgcacagtgtaaatatccttgctatttcaggatggcggctggcctgctcagtaacatacatgttccaaataaagattttgcatgaaagtaaaaaaaaacg

SEQ ID NO: 24192 - DNA, 3433 bp, Homo sapiens
tcactgcctatgacggcttcgttcagtacattccctttgatgatccacggttacgacattttaaactagctcagccccagggtttctgtgaagacataaagcttgacgataaatcatataactccagtcctgtcactgctcaagagccggctcatggaggaatgcagcctgatggtgccatttggaatccacagagcttaatacccccgtcgggggatgagagaggcctggtcttggccgattccagcccccggtggctgtggggccagccccccggggatggggaaaacagtggcctccccaaccagagagaccgctgtgtggcaaggggacagtggcctgatgtgagaggcagccagcacgggcacactggaagacaagtttcctccccttactcacagggcgagagcacctgcgaaactcaaaccaagctcaaaaagttccaaactgggactcggaccaagaaaagttcaaagaaaaaaatgaacgagactatattttgcttggtttctatcccagtgaaatcagaatcacatctgccagatagagatatggacaacaatgacttaaagcccagtgctgatcaaaagaatgggtctgataagagcccggctctgcaagaacagagtctgctgagcatgtcttccaccgacctggagctgcaggccctcacaggaagcatgggtgggagaacggagttccaaaaacaagatctaggggaaccagaagaagacagacaaacaaatgacctcagtttcatccaccttacaaagcacagagaactcaagcattctggctcttggccagggcaccggtacagagatcagcaaacacaaaccagtttctccgaggagccccaaagttcgcagctgctccctggtgcaaagctgggagggccgagtcgtgcagcattgagtccaaaatgttcagaccctgctgcctccgaagctcagacgcacacagcattccctaccggtgatcacaaacagaggccaagtgcccgtaacctgaaaggtcacaggtccctcagcccatccagcaacagtgcgttctcaaggacttccttgtccgtggaccaggcaccgacgccaaaagcaggccgaagtcagccctgcgtggatgtccacgggcttggagcccaccctgggcctaagcgggaggtggtgaagggggagcccacgggcccttgcaacagtaaacaactctttgggcagtttctcctgaaaccggtcagccgtcgtccctgggatttgatcagtcagttagaaagttttaacaaggagctccaggaagaggaagaaagcagcagtagcagcagcagcagcagcagcagcagtgaggagagtgaggcggagccgcagcaggagaaccgtgctcactgcagacaggaggatgtgggcttccgcggaaacagcccggaaatgagggttgagccacagccgaggatgtgggtgccggagagccctgtgtgtaggtcgggaagaggtgagagtaagtctgagagctggagtgaggagctgcagcctggccacccacgtgcctggcctccatccccgggccgctttcgcgtggaagaaggtggcggtgcacctttctgctcagcagatggaagcacgagtgcagagaagggacacctggaggttagcaacggaatggacgagctggcaggtagcccatttcctgtgacgagaatgtcttcaagatcaagtgacgcaaaaccactgcccgcgtcctatccagctgaacctagggagccccaggaaagtccgaaaatcaccagtgctttcagctctgtgaaaccaagtgaagcggtccctcggaagtttgacagtggtggagagaggggggcagggctcccactgtccctgtctaacaagaaccgagggctctcagctccagacttacggtctgtggggctcacccctgggcaagaacagggtgccagtgagctagaggggtctttgggtgaagcaagcacaatagaaatccccccaggtgagtccttgcaagccagggctgcaaggatcctgggcattgaggtggcggtggagtccctcctgccgggcatccggagagcgggacagaaccagcctgctgagcccgatgcaagtgcctgcaccccagagtccccccaggaagagttgctatctcgcccagcaccggcagatgtccccagggtgtccactgatgccttttatggcaggaggaagtgcggctggaccaagagccctctctttgtaggggacagggacagtgccaggcgggctcctcaggcttttgagcactcagatgtggacggggttgtcaccagcacagaccctgtccctgagcctgagcccagccccttggagtccaagttcttcgaacaaaaggatgtggaaacaaaaccacccttcaggtccactttattccattttgtagaaagaaccccaagtgtggcaggctctgaaaagagacttagaagcccttccaaagtgattgaaagtttacaagagaaactggcctccccgcctaggagagcagaccctgaccgcctgatgagaatgaaagaggtgagctcagtgtcacggatgagagtcctgagcttcaggaatgccgactcccaggaggacgccgaggaattgaaggccaccacaaggggccaggccgggctcccgggaggccttgtgtctcctggcagtggggaccgtgcccagagattgggccactcactctctgtgtccaaggacagcatctccagggaagagaaggagcatccggcagcacaaaaggagaagagcatggatcaagacttctggtgcccagattcctatgaccctagcagagtggagagggtgtgatgaaatgccggtggagcttgcattccgttgcgaattgagtattctcaagtagctggtagatttagtctatcagccccacttccccatgtagaagctggaagctgctgagtttttagcatcctgataacattctttaccactgccactaggaaacttgccatcctctcagaattgctttgtggcgataaagcaatcgtccgttgaaaccatctgtttttatagcatgaagatttaatgcctataattaggaaggagttttcacagaaaccctccctcatgacagatttgactaagctggtaaatagtttggtgttgctctcattctgggtgaagatttcaatgtggaagatctagcaaatgctttggaaaggcctgtgaatggtgtgctcccctctgtgtctccatggcctgcagtccatgctcttgtgaaggagtttgggacactggctgttgcccggtgtttcagcactttcagtttaggggaaatgtgaatcaataggtatgatccatttctaatcaatttggccttctgctgctggaagtaactttacttataagtaacttgccatcagagaataaaagcaatatctttt

SEQ ID NO: 24193 - DNA, 7620 bp, Homo sapiens
tcactgcctatgacggcttcgttcagtacattccctttgatgatccacggttacgacattttaaactagctcagccccagggtttctgtgaagacataaagcttgacgataaatcatataactccagtcctgtcactgctcaagagccggctcatggaggaatgcagcctgatggtgccatttggaatccacagagcttaatacccccgtcgggggatgagagaggcctggtcttggccgattccagcccccggtggctgtggggccagccccccggggatggggaaaacagtggcctccccaaccagagagaccgctgtgtggcaaggggacagtggcctgatgtgagaggcagccagcacgggcacactggaagacaagtttcctccccttactcacagggcgagagcacctgcgaaactcaaaccaagctcaaaaagttccaaactgggactcggaccaagaaaagttcaaagaaaaaaatgaacgagactatattttgcttggtttctatcccagtgaaatcagaatcacatctgccagatagagatatggacaacaatgacttaaagcccagtgctgatcaaaagaatgggtctgataagagcccggctctgcaagaacagagtctgctgagcatgtcttccaccgacctggagctgcaggccctcacaggaagcatgggtgggagaacggagttccaaaaacaagatctaggggaaccagaagaagacagacaaacaaatgacctcagtttcatccaccttacaaagcacagagaactcaagcattctggctcttggccagggcaccggtacagagatcagcaaacacaaaccagtttctccgaggagccccaaagttcgcagctgctccctggtgcaaagctgggagggccgagtcgtgcagcattgagtccaaaatgttcagaccctgctgcctccgaagctcagacgcacacagcattccctaccggtgatcacaaacagaggccaagtgcccgtaacctgaaaggtcacaggtccctcagcccatccagcaacagtgcgttctcaaggacttccttgtccgtggaccaggcaccgacgccaaaagcaggccgaagtcagccctgcgtggatgtccacgggcttggagcccaccctgggcctaagcgggaggtggtgaagggggagcccacgggcccttgcaacagtaaacaactctttgggcagtttctcctgaaaccggtcagccgtcgtccctgggatttgatcagtcagttagaaagttttaacaaggagctccaggaagaggaagaaagcagcagtagcagcagcagcagcagcagcagcagtgaggagagtgaggcggagccgcagcaggagaaccgtgctcactgcagacaggaggatgtgggcttccgcggaaacagcccggaaatgagggttgagccacagccgaggatgtgggtgccggagagccctgtgtgtaggtcgggaagaggtgagagtaagtctgagagctggagtgaggagctgcagcctggccacccacgtgcctggcctccatccccgggccgctttcgcgtggaagaaggtggcggtgcacctttctgctcagcagatggaagcacgagtgcagagaagggtgccagtgagctagaggggtctttgggtgaagcaagcacaatagaaatccccccaggtgagtccttgcaagccagggctgcaaggatcctgggcattgaggtggcggtggagtccctcctgccgggcatccggagagcgggacagaaccagcctgctgagcccgatgcaagtgcctgcaccccagagtccccccaggaagagttgctatctcgcccagcaccggcagatgtccccagggtgtccactgatgccttttatggcaggaggaagtgcggctggaccaagagccctctctttgtaggggacagggacagtgccaggcgggctcctcaggcttttgagcactcagatgtggacggggttgtcaccagcacagaccctgtccctgagcctgagcccagccccttggagtccaagttcttcgaacaaaaggatgtggaaacaaaaccacccttcaggtccactttattccattttgtagaaagaaccccaagtgtggcaggctctgaaaagagacttagaagcccttccaaagtgattgaaagtttacaagagaaactggcctccccgcctaggagagcagaccctgaccgcctgatgagaatgaaagaggtgagctcagtgtcacggatgagagtcctgagcttcaggaatgccgactcccaggaggacgccgaggaattgaaggccaccacaaggggccaggccgggctcccgggaggccttgtgtctcctggcagtggggaccgtgcccagagattgggccactcactctctgtgtccaaggacagcatctccagggaagagaaggagcatccggcagcacaaaaggagaagagcatggatcaagacttctggtgcccagattcctatgaccctagcagagtggagagggtgtgatgaaatgccggtggagcttgcattccgttgcgaattgagtattctcaagtagctggtagatttagtctatcagccccacttccccatgtagaagctggaagctgctgagtttttagcatcctgataacattctttaccactgccactaggaaacttgccatcctctcagaattgctttgtggcgataaagcaatcgtccgttgaaaccatctgtttttatagcatgaagatttaatgcctataattaggaaggagttttcacagaaaccctccctcatgacagatttgactaagctggtaaatagtttggtgttgctctcattctgggtgaagatttcaatgtggaagatctagcaaatgctttggaaaggcctgtgaatggtgtgctcccctctgtgtctccatggcctgcagtccatgctcttgtgaaggagtttgggacactggctgttgcccggtgtttcagcactttcagtttaggggaaatgtgaatcaataggtatgatccatttctaatcaatttggccttctgctgctggaagtaactttacttataagtaacttgccatcagagaataaaagcaatatcttttaagttcctgaaaaattaaaacttgtactgtaatatactaagagtattatttatctggcagtgaaatattttgatcatttgcaaacacgccattgtctgctttgcactcagtattatctatttttattttctgtatgggtatttagaaattctttatatgaaaaataattgctggtttaaaatagaccattttaacaaagtgactatatttctttttacgaaaatgctatttttctatgatgtaaacaattgttaggcggcagatttttaaggaagtattattttatttaagagtctgtatccctttgtgtgagaggaacccaaagagggttcacttttgctttaaagctctgtcccttacccactgacaactctgctacttttattttatcttagaaaatgtcaatatagacatatcacagggttaataaaagaaacttttcacaaagatttttgtacaagtgtagctatcaggttatatttgaaaataaccctctgaaaaccagccaacattgtcatgacaatttttgctgccgtatcaactagaattaccaaaaaacatagttttatctttgtatgtgtgtggggatctaccctgagaccatgcttttcttcccaccctgccaccccacccctttaaagaaatacgtatttttatctagaatgatcttgaattagtctctgcatatttttagaaagtgcttggggacattatatatatgccattacaaaagcattatgaggcctatgtattctactgtgtttaatactgcattaacctgcacaaagtttatgcattttttcatgcatttttttccttctttctaagtaaggtattcctgacaactaacattccctaaatcatttcccctccctccctccctcccttcctttcttccttccttctgtcctccctcccttgctacctcttgccctccttccttcaccctgtcctccttttcccttttattttttccccttctctttcattttcttttcttttagagaaaccaccttatctatttttagacatttcgaattcctaaaatgtgaaccgttgggtgatctgtcctttggccctaaaacggctggccgggctgtcccggcctgttctcatctgtaccgtatgattttatttcataataactttatgtatttggactgtaacaaacaaaacagaacctaagtcgccccgaaaaatctttccaagccttttcaaaacacttatctgcagtccagaattcagctcttatgaaaagtgagagtgcactccagttttcacagcagcaataagtgcgggaaacaaaaagatcctcttcccaggaaaagttgagtggggaagagttcagacactgttgtagctggtgaatcattgaagtcacctggtagtaccaaataagggctgaggcgcctggaggtctttgtggggtcttccctctttaaatgcaaacgtaagaaggtatatgtgtatatacatttatatacgtgcacatgtatactcgtacatgtatgcacacatacccatacatgtatatgaactccgttctgatttcctctgaaattttgttgataccatctaaatacctctttgaatcaaaataacttaattttagctcattcctcaagagaaagagaaggatccccaaggaagaaaaactgttgtaccttctgtgattctcaaaccaaaatgtgatgcgcttctgttttgttatcttaaattgttgtatcatatctttctgaaaccattctgaattaagttgaaattttcaacatttatactttaactgttctaaatttaagcctacatgtaaatcttttttggggggaaggtaacttgaaaagtttaacttgaaaatttgacctttaaactttcatattctaaggtaaataatagcctataaccaacaacagctttcccagaggtcttgaatttaacactaattgtttagttattgtttctatttctcatacatacataacttcgttttttgtggctggaagaaaaagtttctatattttgtatttgtctttgttcttctcatgcacacaatttactgttggtgtttaataatttggagctcataaaattaaaagttgtaattttgaccatttgggctaaaaattatatgagggattacatatgcaatggattagtatttcttgatttgcaaaagaagggaaaatgatggtaatttagctcaaattgcctttctttgaagaaaatttctgaatgactgaaaaccaaatatctatattatcactttcaacctcatgtttctgcaaagtacagaaaaactcctcactgacagtgcacccagcccctgactgggttttcaggattatgtccatgtgcataactgcttggatttcttcttttaaagtccctaaaacatgaatctgttctttgagatcctggtttccttagcagagttgtaggttgcgggtttcattcacgtggaaattctaagtagaacttttgctgccccattttactgttggtgaagggccgttgttaatggaagtttacgttttaaaactcagatgactcagaaaccagactgtgatcattttttgcagcagcaaaatgacttattctgacagcatctcggtttggggcttctgaagaaaaaggatgaagctgatctgttgaaacaactactttcccaactcggaggcaaaaggggctgatagaagataacattcacctaccatttcatcttgtgacccccagagatcacgtttgcgtgttctggctgagttttttattattgtttgttttaaatgattaaataatacacaattaaatgtcaggatagcatctcttgcaaagtgaccagtgcagcagaattgtctttctatccatatttgagcttagagaaacatttcccatgtcctaagttcttagaagcaattactttagcgttggggagcattgttctaccagacccatttatgcaggggagatgaagcttaaaagacgggatgtggggtgggagtgtgtttcttaagccgaagctgttgcaggctgggggatttttgcattttctttttgttttgtttttgactgcagattctgtacatctgtctgtgggaggagagttgctactcaggacaggatttaagagacacattccagtgacctttaagaatctgcatggcgggaggtccttctccaggagtgtgggttggtccactctgggacccaccacactaagaagggggagatgataaaataacattaaaggaagaatggcctccagcctgcaggttttgttggaaagaaataaaaagggagtcattaagaccataaattcagattgaggcctcttgaaaaggttgatgtgggctagcaacctgcctgtcgaaacagtccttggttcatcagcagtgtgggaaggcagccaaggctcctgcagattcctggcatcgaccttggaaagcctctgcgatacttgtgtgtacgaatacagcagaggacagggaggtccttgttctgtggtctctgtttagtgactgaaacttaaacccaaaggcaagcccagattgtctggccgttcatccccatgctttgataggggttaggaggaaccctttccgtatgaaagacaggccctactagggcttacaaccaagccaaaggaccatctcttctttcttccacctcccttcacccctgccccgcagcagagccgagatgtgagacattcattgtcacggagcaaggagacaaaggcaagttcaagttgagaagcatatggcagcaaacagaaatgaaaaccatatgtcccagcaaggggaaaagcagtcatttccagattataaaaatcaatgaagtactctccacctaggtcagctgaaattcgagccctcacagtcaggcctgtcagagaagttaagcagaaacatctcggggggacttctaaaatttagtgaagacaaggccttgcaactccaaagaaactttttttcccccccttgaaacagggtcttgctctgttgcccagcctggagtgcagtggtgcagtcacggctcactgcagcctcaagctcctgggctcaagcactatccccacctcaacctccttagtagctgggactacaggtgcacaccaccatgcccagctaaccacagaaactttcatctcttcattttttctttgggcaccattaatacctaagacaggtagaaagggtcccagaaagacaccattggtaatggccgattgccggctgcagtcatcgcccccagatcaggctggtacaggatgccttaaggtgatgagaggtgagggtgcatgaagaataatgagcacagggaagagagaagcaggacaaagtagcagataaaatgccggcaaagcacagatgaatgtcttcaagaagctcttgtatttctctgcacagtgtaaatatccttgctatttcaggatggcggctggcctgctcagtaacatacatgttccaaataaagattttgcatgaaagtaaaaaaaaacg

SEQ ID NO: 24194 - DNA, 5919 bp, Homo sapiens
tcactgcctatgacggcttcgttcagtacattccctttgatgatccacggttacgacattttaaactagctcagccccagggtttctgtgaagacataaagcttgacgataaatcatataactccagtcctgtcactgctcaagagccggctcatggaggaatgcagcctgatggtgccatttggaatccacagagcttaatacccccgtcgggggatgagagaggcctggtcttggccgattccagcccccggtggctgtggggccagccccccggggatggggaaaacagtggcctccccaaccagagagaccgctgtgtggcaaggggacagtggcctgatgtgagaggcagccagcacgggcacactggaagacaagtttcctccccttactcacagggcgagagcacctgcgaaactcaaaccaagctcaaaaagttccaaactgggactcggaccaagaaaagttcaaagaaaaaaatgaacgagactatattttgcttggtttctatcccagtgaaatcagaatcacatctgccagatagagatatggacaacaatgacttaaagcccagtgctgatcaaaagaatgggtctgataagagcccggctctgcaagaacagagtctgctgagcatgtcttccaccgacctggagctgcaggccctcacaggaagcatgggtgggagaacggagttccaaaaacaagatctaggggaaccagaagaagacagacaaacaaatgacctcagtttcatccaccttacaaagcacagagaactcaagcattctggctcttggccagggcaccggtacagagatcagcaaacacaaaccagtttctccgaggagccccaaagttcgcagctgctccctggtgcaaagctgggagggccgagtcgtgcagcattgagtccaaaatgttcagaccctgctgcctccgaagctcagacgcacacagcattccctaccggtgatcacaaacagaggccaagtgcccgtaacctgaaaggtcacaggtccctcagcccatccagcaacagtgcgttctcaaggacttccttgtccgtggaccaggcaccgacgccaaaagcaggccgaagtcagccctgcgtggatgtccacgggcttggagcccaccctgggcctaagcgggaggtggtgaagggggagcccacgggcccttgcaacagtaaacaactctttgggcagtttctcctgaaaccggtcagccgtcgtccctgggatttgatcagtcagttagaaagttttaacaaggagctccaggaagaggaagaaagcagcagtagcagcagcagcagcagcagcagcagtgaggagagtgaggcggagccgcagcaggagaaccgtgctcactgcagacaggaggatgtgggcttccgcggaaacagcccggaaatgagggttgagccacagccgaggatgtgggtgccggagagccctgtgtgtaggtcgggaagaggtgagagtaagtctgagagctggagtgaggagctgcagcctggccacccacgtgcctggcctccatccccgggccgctttcgcgtggaagaaggtggcggtgcacctttctgctcagcagatggaagcacgagtgcagagaagggacacctggaggttagcaacggaatggacgagctggcaggtagcccatttcctgtgacgagaatgtcttcaagatcaagtgacgcaaaaccactgcccgcgtcctatccagctgaacctagggagccccaggaaagtccgaaaatcaccagtgctttcagctctgtgaaaccaagtgaagcggtccctcggaagtttgacagtggtggagagaggggggcagggctcccactgtccctgtctaacaagaaccgagggctctcagctccagacttacggtctgtggggctcacccctgggcaagaacagggtgccagtgagctagaggggtctttgggtgaagcaagcacaatagaaatccccccaggtgagtccttgcaagccagggctgcaaggatcctgggcattgaggtggcggtggagtccctcctgccgggcatccggagagcgggacagaaccagcctgctgagcccgatgcaagtgcctgcaccccagagtccccccaggaagagttgctatctcgcccagcaccggcagatgtccccagggtgtccactgatgccttttatggcaggaggaagtgcggctggaccaagagccctctctttgtaggggacagggacagtgccaggcgggctcctcaggcttttgagcactcagatgtggacggggttgtcaccagcacagaccctgtccctgagcctgagcccagccccttggagtccaagttcttcgaacaaaaggatgtggaaacaaaaccacccttcaggtccactttattccattttgtagaaagaaccccaagtgtggcaggctctgaaaagagacttagaagcccttccaaagtgattgaaagtttacaagagaaactggcctccccgcctaggagagcagaccctgaccgcctgatgagaatgaaagaggtgagctcagtgtcacggatgagagtcctgagcttcaggaatgccgactcccaggaggacgccgaggaattgaaggccaccacaaggggccaggccgggctcccgggaggccttgtgtctcctggcagtggggaccgtgcccagagattgggccactcactctctgtgtccaaggacagcatctccagggaagagaaggagcatccggcagcacaaaaggagaagagcatggatcaagacttctggtgcccagattcctatgaccctagcagagtggagagggtgtgatgaaatgccggtggagcttgcattccgttgcgaattgagtattctcaagtagctggtagatttagtctatcagccccacttccccatgtagaagctggaagctgctgagtttttagcatcctgataacattctttaccactgccactaggaaacttgccatcctctcagaattgctttgtggcgataaagcaatcgtccgttgaaaccatctgtttttatagcatgaagatttaatgcctataattaggaaggagttttcacagaaaccctccctcatgacagatttgactaagctggtaaatagtttggtgttgctctcattctgggtgaagatttcaatgtggaagatctagcaaatgctttggaaaggcctgtgaatggtgtgctcccctctgtgtctccatggcctgcagtccatgctcttgtgaaggagtttgggacactggctgttgcccggtgtttcagcactttcagtttaggggaaatgtgaatcaataggtatgatccatttctaatcaatttggccttctgctgctggaagtaactttacttataagtaacttgccatcagagaataaaagcaatatcttttaagttcctgaaaaattaaaacttgtactgtaatatactaagagtattatttatctggcagtgaaatattttgatcatttgcaaacacgccattgtctgctttgcactcagtattatctatttttattttctgtatgggtatttagaaattctttatatgaaaaataattgctggtttaaaatagaccattttaacaaagtgactatatttctttttacgaaaatgctatttttctatgatgtaaacaattgttaggcggcagatttttaaggaagtattattttatttaagagtctgtatccctttgtgtgagaggaacccaaagagggttcacttttgctttaaagctctgtcccttacccactgacaactctgctacttttattttatcttagaaaatgtcaatatagacatatcacagggttaataaaagaaacttttcacaaagatttttgtacaagtgtagctatcaggttatatttgaaaataaccctctgaaaaccagccaacattgtcatgacaatttttgctgccgtatcaactagaattaccaaaaaacatagttttatctttgtatgtgtgtggggatctaccctgagaccatgcttttcttcccaccctgccaccccacccctttaaagaaatacgtatttttatctagaatgatcttgaattagtctctgcatatttttagaaagtgcttggggacattatatatatgccattacaaaagcattatgaggcctatgtattctactgtgtttaatactgcattaacctgcacaaagtttatgcattttttcatgcatttttttccttctttctaagtaaggtattcctgacaactaacattccctaaatcatttcccctccctccctccctcccttcctttcttccttccttctgtcctccctcccttgctacctcttgccctccttccttcaccctgtcctccttttcccttttattttttccccttctctttcattttcttttcttttagagaaaccaccttatctatttttagacatttcgaattcctaaaatgtgaaccgttgggtgatctgtcctttggccctaaaacggctggccgggctgtcccggcctgttctcatctgtaccgtatgattttatttcataataactttatgtatttggactgtaacaaacaaaacagaacctaagtcgccccgaaaaatctttccaagccttttcaaaacacttatctgcagtccagaattcagctcttatgaaaagtgagagtgcactccagttttcacagcagcaataagtgcgggaaacaaaaagatcctcttcccaggaaaagttgagtggggaagagttcagacactgttgtagctggtgaatcattgaagtcacctggtagtaccaaataagggctgaggcgcctggaggtctttgtggggtcttccctctttaaatgcaaacgtaagaaggtatatgtgtatatacatttatatacgtgcacatgtatactcgtacatgtatgcacacatacccatacatgtatatgaactccgttctgatttcctctgaaattttgttgataccatctaaatacctctttgaatcaaaataacttaattttagctcattcctcaagagaaagagaaggatccccaaggaagaaaaactgttgtaccttctgtgattctcaaaccaaaatgtgatgcgcttctgttttgttatcttaaattgttgtatcatatctttctgaaaccattctgaattaagttgaaattttcaacatttatactttaactgttctaaatttaagcctacatgtaaatcttttttggggggaaggtaacttgaaaagtttaacttgaaaatttgacctttaaactttcatattctaaggtaaataatagcctataaccaacaacagctttcccagaggtcttgaatttaacactaattgtttagttattgtttctatttctcatacatacataacttcgttttttgtggctggaagaaaaagtttctatattttgtatttgtctttgttcttctcatgcacacaatttactgttggtgtttaataatttggagctcataaaatacaggtgcacaccaccatgcccagctaaccacagaaactttcatctcttcattttttctttgggcaccattaatacctaagacaggtagaaagggtcccagaaagacaccattggtaatggccgattgccggctgcagtcatcgcccccagatcaggctggtacaggatgccttaaggtgatgagaggtgagggtgcatgaagaataatgagcacagggaagagagaagcaggacaaagtagcagataaaatgccggcaaagcacagatgaatgtcttcaagaagctcttgtatttctctgcacagtgtaaatatccttgctatttcaggatggcggctggcctgctcagtaacatacatgttccaaataaagattttgcatgaaagtaaaaaaaaacg

SEQ ID NO: 24195 - DNA, 239 bp, Homo sapiens
acttcaccacagccgccaccaataactgcaccctaaccaaggaagccgcagataccactaacactgctaatagccaaataaaacatacagaggcttcactgctgcatgcctcagaagtaaatccaaagggccctacccaaccaacatcccagtcacatctccagtaaaaggtgccccccaacaacaaaagtaaaccccaaaacaagaaaaagcaactattacaccagatgtgcagaaag

SEQ ID NO: 24196 - DNA, 457 bp, Homo sapiens
aaaaaacttaaaaattagccaggtgtggtggtatgtgcctatagtcctagctactcgggaggctaagccaggaagactgcttaagcccaggagtttgaggatgcagtgagctgtgatcacatcactactctccagcctgggtaacagagcaagaccctgactgtaagaaaaaacaaactggcagggtatggtgtcatatgcctgtagtcccagctactcaggaggctgaggcaggagaatcacttgagctcaggagttcaaggccagcctgggcaacatagtgagatcttacctctaattacaacatttttaacacaaattttaaaaaatattttttttaaatctgccttataataacaggtaaagatgagtgttagaagtaagtgagagatacgaaggtagacgtcagaccatgaaagggtttaacttagacaagagagtttggatttcatctcaa

SEQ ID NO: 24197 - DNA, 416 bp, Homo sapiens
ttttttttggtagagatgggtctcgctttgttgcacaggctggtctcaaactcctaacttcaagcaaccctcctgccttgaactcccaaagtgctgagattacagatgtaagccaccatgcctggatagttttgtttttttttttctagttcccttacattgcacctgcccaaggttagccaggctatgggcagtgggcatttactggtggaatcatatccatgagtaaattattgaaagataagatgtcagtatctgctaatgagtgaatgaaaaaggtggggtttagccacgtggtggaatattactcagctatgaaaaggaagtgctgacacatgctgcaatgtggatgaatcttgaaaacatgatgctaagtgaaagaagccagtcacaaaaggccattaaaaatacaaaaa

SEQ ID NO: 24198 - DNA, 531 bp, Homo sapiens
ctacttcgcagaggaagtggataccatgctaaggaatttggaagcttattctagatcagggtgtacagctttttctataaagacccagatagtaagtattttaggcttttgcttgttacaaagtgcaggtcatacagaggaacctccttgtctctgtcattgtcatgtgaaagtagccatagacaatacaaaaagaatagctgtggccatgtgccaataaaactttatttgcaaaaacagaaagtgggctgggcatggtggctcacacctgtaatccagcactttgggaggcccaggagggtggctcacctgaagacaagagttcaagaccagcctggccaacatggtgaaaccctgtctctactaaaaatacaagaaaattagccgggcatggtggtgggtgcctataatctgagctactcaggaggctgaggcaggagaatcatttgaacccaggaggtggaggttgcagtgagccgagatcgtgccattgcactccagcctgggtgacaagagtgaaactccgtctca

SEQ ID NO: 24199 - DNA, 393 bp, Homo sapiens
ctacttcgcagaggaagtggataccatgctaaggaatttggaagcttattctagatcagggtgtacagctttttctataaagacccagatagtaagtattttaggcttttgcttgttacaaagtgcaggtcatacagaggaacctccttgtctctgtcattgtcatgtgaaagtagccatagacaatacaaaaagaatagctgtggccatgtgccaataaaactttatttgcaaaaacagaaagtgggctgggcatggtggctcacacctgtaatccagcactttgggaggcccaggagggtggctcacctgaagacaagagttcaagaccagcctggccaacatggtgaaaccatcccggctaattttcttgtatttttagtagagacaggg

SEQ ID NO: 24200 - DNA, 833 bp, Homo sapiens
aggaacgagcatttgtcccttttgtccttctgccatttgaggaagcaacaagaaggcccttaccagatgctggtgccttgatcttcaacttcccagccttcagaactgttgcgttcccccagtagacagacactgagatggaaatttgcataccgaaggtggattgaggattgtttatctgaaaaaaacatctatggtggagtaagaaaaatcacgactgggctatggagaaagctgaactgggatgcagaacagaagcttcagcctcactcgtggggagctctggcgctaaaaaaactcatcgaagatttcccaaattggaacaaggcctctgtactcctgcattgaccagtcatggaaagcaacagtgtgttcagcaagctggaactaaactgttcctgaatggagagttcccatcctgcctcagtggaatcaaagaaaagagaaaggctccaaaatgaacacaatgcgtgttatttgctaccataaactgtgcaactggtttctactgctgtgttgcaattgaatagtaatcaggagaagttacacgttgttcttagaaataatacaacgaatcctgtcaatcttaagtcctgacactgaatttaacgctctctgtttagtcctaccatcaaggatgatttgcaggtgaagaattcttgatagtcagatgcagactacgtcttcagatcctatggcctaaggttattaaggtgggagaagcaaaacaaatgcggttctcatccagtaataatggatttacaagaatttgaaacaaaactttccttccagctactgctttcatgtcagagaaataaaatacatgtacaaga

SEQ ID NO: 24201 - DNA, 747 bp, Homo sapiens
taggctctggtctcatcgcatactcagtctcaatgggatttccttaagagtcaaaaccccgacaattgcatgaagccggaagctcagcaatcttctgagggcatctatcttgttttctaagaagcattttggaggtttttctttacctggagaaagcactggctagagctatctggcatacaatgtaaagaagcttcacgaaaaataaaagaaaagtgaaaatatatttagctacaaatgattgtcctcttccctgaaaattacagaagaggaaagcaacagtgtgttcagcaagctggaactaaactgttcctgaatggagagttcccatcctgcctcagtggaatcaaagaaaagagaaaggctccaaaatgaacacaatgcgtgttatttgctaccataaactgtgcaactggtttctactgctgtgttgcaattgaatagtaatcaggagaagttacacgttgttcttagaaataatacaacgaatcctgtcaatcttaagtcctgacactgaatttaacgctctctgtttagtcctaccatcaaggatgatttgcaggtgaagaattcttgatagtcagatgcagactacgtcttcagatcctatggcctaaggttattaaggtgggagaagcaaaacaaatgcggttctcatccagtaataatggatttacaagaatttgaaacaaaactttccttccagctactgctttcatgtcagagaaataaaatacatgtacaaga

SEQ ID NO: 24202 - DNA, 1575 bp, Homo sapiens
  misc_feature (1560)..(1560): n is a, c, g, or t
  misc_feature (1567)..(1567): n is a, c, g, or t
ctcgagtagctgggactacagatgcgtgctaccacacaaggctaatattttgtattttagtagagacgggatttcaccatgttggccaggatggtctccgtctcctgacctcgtgatctgcctgccttggcctcccaaagtgttgggattacaggcataagccattgcgccatgctcaaggttcttaattacatctttaaaggccctttttccatgtacagtaacatattcaatggttctggggattaggacttggagccattattctacctacaacaattagtattggacttccatcattttctatcactcttgtaatcgagaaggactatttcactgggagtagcaagtcataatgtttgcgttggcatttgtgtgggggtttatcttcattcattaaataattgcatgtaaagaaaattcctgtcactatttcaaatgtttcatgtagttattatagtgcttcagaatccaaagggttatgtgttacttatgtaagatgagcagtctagggggtggagaacaggtcatcatagtgcagattcttcctagctgaagtgtgttttctctgggaacaaccaagtaggatttaatttgttttgcttccttttttgggaacttagacccatcttgcgatgtcctaagtctccaagcatcttatttgacctgcttatacacatttgactaaatagctaaatatgaccacattgacgtggtaaagctttaacacttttgtccagattgaatcactccatctgctatcagttaagcagtggaaaactgttatggaaaagcaaacatgttttgatagatttaatgtgtaaagaaggtatccatactctggaatgctgctgatcaaataaatgagctgcaagactttgttcgaaacaacactcaagcacaactgttttactttccataccaagtttggctgtgactgaatgaagaacatcagcattgatctttgctttgcacttgtacaagagactatttgcagagagccaaatatagcaacagaggatttaatatcttgccaaaaaatacaaaatctgttcccctttaagcatgacactctatcctttcttgtggatcttgctaaaaggaaaatatagctttaaactcccctattccttctgttgaaagcttaagaatctttttcaaatgagctatgtatggttttgtggtattttatgtttccaaaagaaaatggctacatgaaaaatctgtccagtgttatcatttttcttacaaaaaatacttctagttatggttgtattaattaatttgattgtgataatgattacacaatgtttacctatatcaaatcatcatatcgtataccttaaatatatataacttttatgtgtcaattataactcagtaagtctgggaaaatatcgttaagtcaaagattagagtcaacagaaataaagaaaaatcatactttgataacttcaggactaatcaaggatcaatgggtgacatgatatcatgctatgtgccattttgtgttaaacaaattacaccaacaataaaaaaaattggcttcaaaaaaaagtngacgcgnccgcgaat

SEQ ID NO: 24203 - DNA, 1196 bp, Homo sapiens
  misc_feature (1181)..(1181): n is a, c, g, or t
  misc_feature (1188)..(1188): n is a, c, g, or t
ctcgagtagctgggactacagatgcgtgctaccacacaaggctaatattttgtattttagtagagacgggatttcaccatgttggccaggatggtctccgtctcctgacctcgtgatctgcctgccttggcctcccaaagtgttgggattacaggcataagccattgcgccatgctcaaggttcttaattacatctttaaaggccctttttccatgtacagtaacatattcaatggttctggggattaggacttggagccattattctacctacaacaattagtattggacttccatcattttctatcactcttgtaatcgagaaggactatttcactgggagtagcaagtcataatgtttgcgttggcatttgtgtgggggtttatcttcattcattaaataattgcatgtaaagaaaattcctgtcactatttcaaatgtttcatgtagttattatagtgcttcagaatccaaagggttataatgagctgcaagactttgttcgaaacaacactcaagcacaactgttttactttccataccaagtttggctgtgactgaatgaagaacatcagcattgatctttgctttgcacttgtacaagagactatttgcagagagccaaatatagcaacagaggatttaatatcttgccaaaaaatacaaaatctgttcccctttaagcatgacactctatcctttcttgtggatcttgctaaaaggaaaatatagctttaaactcccctattccttctgttgaaagcttaagaatctttttcaaatgagctatgtatggttttgtggtattttatgtttccaaaagaaaatggctacatgaaaaatctgtccagtgttatcatttttcttacaaaaaatacttctagttatggttgtattaattaatttgattgtgataatgattacacaatgtttacctatatcaaatcatcatatcgtataccttaaatatatataacttttatgtgtcaattataactcagtaagtctgggaaaatatcgttaagtcaaagattagagtcaacagaaataaagaaaaatcatactttgataacttcaggactaatcaaggatcaatgggtgacatgatatcatgctatgtgccattttgtgttaaacaaattacaccaacaataaaaaaaattggcttcaaaaaaaagtngacgcgnccgcgaat

SEQ ID NO: 24204 - DNA, 508 bp, Homo sapiens
tacaaacctaaatttcctgtcactctaccatcaaacaagtggtttgctctatattttggtgacattcatactttctttctccatcacctgcctttttacttctactccccccaaacccctgcacacacacccctgaaatccctgtgctagatggaccatccaactctatttttgtttccaccaaatatttttgagcacctactggtgtcctcgcacaagattggatgtaaagcctaaaaccataaaaaccctagaagacaacctaggcaataccattcaggacataggcatgggcaaagacttcatgactaaaacaccaaaagcaatggcaacaaaagccaaaattgacaaatgggatctaattaaactaaacagcttctgcacagcaaaagaaactatcatcagagtaaataggcaactacagaatgggagaaaatttttgcagtctatccatctggcaaagggctaatatccagaatctacaaggaatttaaatttacaagaaaaa

SEQ ID NO: 24205 - DNA, 232 bp, Homo sapiens
tgtaagtttttagattaaacttgtcatattcatctctctgttctgttttttttttccttccccaagattctggtcataccatactactcagagttcttggaatatcgtaagctttttgaagcctttctgatattcctcaccaatgattattctgcctggaatattcttccctcttatctacctggcaaatttatactcatccttcaagacccaaatgaaacataagtgctcg

SEQ ID NO: 24206 - DNA, 418 bp, Homo sapiens
tttcccaatatgatctttgaaagaaagctgaaatcttactgaacttttgaaaagcaagtccccaacatgtatgcaggatcctaaaacaaacacgaaatgtaattttacaaggaagatgcaagttcaggaatgcttgacagtaaacattctcaatgttgtccttagcagttattccttactcttgacattttatgcattattattctctatcttaattagcagaactaatgacttaatagaacagaattgaactgtttaacagaattgtttacattttcaattactgaatggggaatcaagcacaagagagaggttttacactatttacacccaaaacattcacgtaataaccaacaaaaagtttaaacagaaaaatctaaaagcattaatatctctatttttaatataaaataattag

SEQ ID NO: 24207 - DNA, 556 bp, Homo sapiens
atcaaagggcgtgaaggaaggattttggtttcactgcagaaacataataagacaccgaagtgtgtgtttgtgtgtgcgtacatataattaaactacagaatataaaatagcatctaatatacatcaaaaatgagtttcatagaaaaattcattttacacatatgtctataaaataataaaatttattcagcctcacaattactttgtgaactggaaataacaatgagttgtcattttatccaaatctaaaaaaaaaaaacatacatacagtatcaagttctggttaaagtagtagatgaactttatgtggtacataagagtatctatacagtttgtgggctgcatcttgctagaatatattacattataaaatgcaccatttatttactctgcgatcaaacccccaacttgccccaagtggaggaaccctcagacatttgcagagcagtcagtgtgctagtaagcagcattctttacaaatctatgaacatcaaggtctccttggaacagatgttctgtgaacaatttataaaactccctcctgttagacacttag

SEQ ID NO: 24208 - DNA, 448 bp, Homo sapiens
tcataatgcttaagtcataagatggtggctggcattttttaatttattactaaaagctaagatatttgcattatattgtgcaaatttcacagaacaatgttgcattttctgagataaggctctaattttttaaatagtgctacatttagttgaaagtttcagtcagctagttagctgagttgaatgaaaaatatagaactgtatgtacatttatcaaatgataaaatatgttcatttttgtaagaaatcagaaaaattaagacgcaatggtgaagaacattagtacataaatatagcagaacattctccataaaatattctgttttcattctgctttgttatttttatccagttatgtttaatttttcaagggtgagagattatgtatagtactgtaccaattaaccttccacttttatacaataaataattcttactaaaagcaata

SEQ ID NO: 24209 - DNA, 391 bp, Homo sapiens
tttttcttttttgagacggagtctcaatctgttgctaggctagagtgcagtggcataatctcagctcactgcaacctctgcctcctgagttcaagcgattcttgtgcctcagcctccctagtagctgtgactacaggcacgtgccaccatgcctggctaatttttgtatttttagtagagacggggtttcaccatgttggccaggctggtcttgaactcctggcctcaagtgattttcctgcctctgcctccccaagtgctgggattacaggcgtaagccaccacgaccagcctccgggcattattcttactgcccaggtaatagtatttattaaacatctctttctacagcctagtaaagtaaaaatataacaagcacatttttagaaaa

SEQ ID NO: 24210 - DNA, 485 bp, Homo sapiens
tcatggaaaaatgtcaccaaatcaggaagtcttttgttgtagaagccactggaaggggcgtaaagcccacctttcttttcatactgtctcccggtatttcctctgaaagcaggagttcagctgcacttgagattcttactaccctgtggctggtatgaggtgccaaacagggaaaggattggtcacttcaccaacgtaatgacagctctctcttagagacacattacacaaatcctcaggttaacttttttgcaagtcctttaataaatacaagattattttcataaaataactgccatgttctgatttatcctagcaatagcacctacaccccatttagttacaaccaccacaaaaagctctgatgttccaaactcaagatagacagggtcctctttatctgaagatactttccccaagtccctgcagctacaagaccatttggagaagcaaaggtattcgtaatgataacatattcactaatg

SEQ ID NO: 24211 - DNA, 370 bp, Homo sapiens
ttagtatgaaggtaaagaatgaagttagaaaactgagggtaactaataagaaccttatcaaatgtaaattaaataattatttctacctatccttgatctcgtcatcttttatccaatcttctctttaaatttctttaatgaaaatctgcaaacttggcatctctcagctttattcttccgaattcagaaatactgccaccttgtgaatactattagatatgagagcgatcacaaattccggtataaatctgctgaactataaaactgatgatctgctcttaaccactctaggcacaagcaaatcagatttgcaaaatgaaaaccagtgcctgatgaccacatctgtaaattacaggacagtttaacagtt

SEQ ID NO: 24212 - DNA, 322 bp, Homo sapiens
gcttatttcctaatactgctcaaaccaggctacccaaaggacttgtaattcaagtttcattctccagcaagtaaaaaagtaagatgtgttttcaaggtgtcattttcacaaacaattgtccatggtaaaaattattctacaataaaactacccggtgtcattatttttttaatatcctgttttctagtgtatgtttacatacatcaacataaattaggcacttatgagtccctgatttatttcccaactttaacaagacgaaaacacttttttgtcttttgtaccagactataagcacccagagagcaaaaaacttaattaa

SEQ ID NO: 24213 - DNA, 199 bp, Homo sapiens
taaaaattcttattatggatctgtgtttcatttccctcctctttgattttcaaaagttgtagtttctcttatagcactgagtgggaggaaacagacaggaagttcatataggctttccggagttcatgaccccttagctaaacatgtaagagtcagttaagcagaaaaggaggtttccaaaatagaaggaacagcgtga

SEQ ID NO: 24214 - DNA, 517 bp, Homo sapiens
cagaggtttcagtgagctgaggtcacaccaccaccctccagcctgggtgagagtaagaccccagctcaaaacaaacaaacaaacaaacaaaaccccagaagacctgtataacaccataggccaaatagccctaacagatgtgttcagagcagtccaccgacagctgtagaatacacattcttctcaagtgatatggaactttctctgggatagatcaaatgttgtttttaccacatacaatgaagttttttaaaaaagaaagaaaatcataaaatataaactctctttctttgaggctcttgtcattcacctataacatcttttctttctacattgctatcatcttctgactacctggttgatcctgtttctttatttgaattttaagaatatggttgtctttctctctagtaaaagtgcaaacaagtattctgaatgaaattgtattagtctgttttcacactactgataaagacatacccaagactgggtaatttataaataaaaagaggtttaa

SEQ ID NO: 24215 - DNA, 498 bp, Homo sapiens
tgggctccagttctaccagccccatgttgacatcgtgtccaacaagacaccaagagaagcagggagtggctgaccttcattttccatatcaacacacagggggccctctgcacgcaccaacatctttgtctcctgaaaaatggcctttgtcagttatttttaaaaactggtgttaatcctgagacacggagatactcccaggaagacatccgagcctggacacactgagatgaaaccagaaacactccgagaggaaaatgacattgattccagccctcaaagcaacgggacaaaaaacaaacaggaggcttccctcccgccccaggggcagcggccggtgtctgcggctctgcgggaagggctctcactgtgaccagattgtggcttctgattgtattgtagaatttctggcccagcttttaaggttcaaggcttcctccctttgcttttatcttattttcttgtttaataaagatacgcctgtgtgagaagcattgc

SEQ ID NO: 24216 - DNA, 196 bp, Homo sapiens
gatctcctgacctcatgatccgcccgccttggcctcccaaagtgctgggattacaggcgtgagccactgcacccggaccgtgaacaatgtttttaatgcctacatttctggccttttatccatctcagtgcttctatatatcatttcccacccacagagacaggatgctgcatgtcagcaatctttgaagcaagta

SEQ ID NO: 24217 - DNA, 388 bp, Homo sapiens
ggggcttgcaacaaacacataactagtctcccatgtcatgtttcctgcccaagttgcatgggcaagaaagctaaagagtacgcttctagtttgcaaagataaaactgaacttcatctgtagtcttttgtagtgtttgtgggccaaaaagacagatactccagatcctaaattaaaagcctaggatggtcaccgtcaaggaaccatccttgaggatgagccttactaaggcttgggactgagccttactaggaagtgcagcccaaccctgacccagctcaattcctgggcaagtgaggagactgatcacatcagtccaatttttcctacagatggaaaggctgtgctctctctggtgggaaaatcatctggatcctttatggcactgcc

SEQ ID NO: 24218 - DNA, 513 bp, Homo sapiens
acataccctcaatatgatgtgttagaagtggccctatacctctgcattcttcttccttgaaatgcataactccagtctaatcatgagataaatatccttgaaacccataactctagtcaaatcatgagataaacatcagaaataccttaactgagggcccagtactcctcaaaattgttaaggttatcaaaaacaagaaagtctgagaaactgtcataaccaagaagaggctaaggagatatgacaactaaatgtaatatggtatcctggatgggatcctggaatggaaaaaaaagacattaggtaaaaactaagcgaatctgaataaaatacagattttagtttataatgggtttatcaattatgacagatgtacgatactgatgttggatgttaataatacgggaacctgagtgtggggtacacaagacctgtatactatcttcacagtttttttgtatgtcaagaactactctaaaatatagtttttaaaataaatcaaattgaaaaatt

SEQ ID NO: 24219 - DNA, 414 bp, Homo sapiens
ccttagattgattttggctccgagattgaggggcctgagtctggaagctgaggtttttgaggttggggaacttaatttgagaagattatctaattttggcaaagtctttagctttttagtgccgtattttttttttcatataaaggatagaatatttaggccgggcacggtggctcatgcctgtaatcccagcactttgggaggctgaggtgggtggatcacttgaggtcagtagttcaagaccatcctggccaacatggtgaaacctcatctgtactaaaatacaaaaagttagccgagcatggtggcacgcgcccgtagtcccagatactcgggaggctgaggcaggggaatcacttgaacccgggaggcggaggttgcagttagcggagattacgccactgcactccagcc

SEQ ID NO: 24220 - DNA, 191 bp, Homo sapiens
gctctcagtcttgtgatgaagataaatcccaggcccaagtgactggatagcaggatggagagtaattgttggcagggggtggcatggatgaggcgctgggggatttgagatgagagaagttatccttagcttgcggggggagcgggtcatgaaagcttcacaatagaagtggctcttgacttcagtattca

SEQ ID NO: 24221 - DNA, 509 bp, Homo sapiens
tatccatacatctgaaaaagtaatactataaaagttgaatactataaatggtttatagaaaccaattctattatataatcacaccacacatgctcaattttttcctcatctgatacatctgttgtcaacttaaaatcgatctaattaaataacttgttactgggaggtgcttgattaaaaattgtgggggagaagtctgaataaatgtgacctgttcttccagacttacagagtactcaccctatcatctttggatgctacagttaacagcaaagatttgtaaggcatgatatgtacactctgttacataactgttagaagcagtaattattatttcccaaaaagaggggcagaaaaaatatttttgaaatacacagagtaggatgggttgggtggctcatgcctgtaatcccagtactttgggtggctgaggcaggcagactgcttgagcccaggaaaccaggcttgagaccagcctgggcaacatggtgaaactccttctctacata

SEQ ID NO: 24222 - DNA, 882 bp, Homo sapiens
agagaatctgctcctataacgttttaaaaatccccaaagtcccagagattagcacttgctatggattttggaactatggttcaagtctaagacaaccaatatgaataagttcaatggagaaggaagaagtagcattcagcacaagaaactgtagattgtttctcccacttgttactgcatctttgttcatttcacccatagcattgcatttgatgtctgaagtaattaccacaaaataaaggtaaactacatcttccaagatgtaccaacagaaaacattcgtctaattttgtcaacattgaatttttaggatttaaatcttgtcttaatgaagactctagggctaaaattcatggtcagttccataaaatgcatctcactttatttctgaatttttcacaacccctctattttcttacattaaagaacatctggataagttagaatagtgccaacttgtttgatttgttatatgattttcttgttaatgtgttgagtatgggaaataagggctttctgtgtgtcttgactcacaggaaaactgaaactgccaagggaagcaacattaaaacaactgggatagattgaatacatttgaaaaaataatttctggaaaaacgctatacatgctttttatgtttatatcttctttcttattaagacatgaatcagatccatgtgggcattcaaaacaaatttattttgggttatattctttacaagtcataatttttacctaaaattgtggaatatgcatgtgaattacacatgtgtagtaataaactcaactattgaatttttcctgtttcatttctaaatgactgaactgatggtaaacaaatttaatgaagtcagctaccatgttgaaaataaggatattag

SEQ ID NO: 24223 - DNA, 214 bp, Homo sapiens
cccttaccatcctgaaaaattctaaactaaaaatatattaactgtgatgtgatattaatcatgtacctataaagttatctgtttcaggatacaaatgcagttgcttcctttagttgaagcaagtctatgggatcttttactctgtcatgcagcctatatccactcccttaaaggctcaaccctaggcgctattccaagagtccatcccatcaat

SEQ ID NO: 24224 - DNA, 330 bp, Homo sapiens
agtgcccttggctagcctcaccctagaattatctcatttgctttctggggaagttacccgcctccaaccctgaactgacaatgctcagggaagcttgggggcgctttagtcggctaatgatccctacacctcatcctgctcttttattcgctattcctaattagagcaccaggtagaaactgtgctggcctggtgaaaagatcttggataagaggaggcagtctgccctcttgtacacctactgtccctgtgcccctggatacatgatgaaacgtctctgtgcttcagttccttcatctgtaaaatgaaattaaaatgaacctcctttgc

SEQ ID NO: 24225 - DNA, 559 bp, Homo sapiens
cctcagcctagctgggactacaggcgtgtgccaccataccgggctaactttataacgattttttgtagagatggagtctcactatgttgcccaggctgatcttgaactcctaggcctcccaaggtgctaggattacagcagtggttcctactgctccagccctgtgtcattttaaatactctccgttattattattttttgagacagagtcttgctctgttgcccaggctggagtgcagtagtgtggtctcggctcactgcagcctttgcctcctaggttcaagtgattctcctgcctcagcctccccagtagctgggattacaggtgcccaccacgactcccggctaatttttgtatttttggtagagacaaggtttcaccatgttgaccaggctggtcttgagctcctgatctctggtgatctgcccacctcagcctcccaaaatgctgggattacaggcgtgagccactgcgcctggcctaaaaatactttattttttagagcagtgttaagttcacaacaaaattgagcagaaaatacagagagttcccatacac

SEQ ID NO: 24226 - DNA, 496 bp, Homo sapiens
aatctggggaaataacattctaggcagaggagatttctaatacaaagcacctaaagggagaatcatcttgacttgtaaaaggaacagaaagtcactttatgtaaaaatttgtaagtaaggctggggagttttaattttattctgtgtaaggatggtggatagagtggaagtgctagatcacttagtctctgcagtaatccaagtgacaaataatggtggcttggaataggggtatagcaggggagtctggaatgaagcaaacttttggggacttgtttaggaggtagtatcagtggtagctagctaatctgttttgtagcctgataatcttggacaatgtgtttataatcatggaaggttgtggtgcattagcaagagggtactggagtcagaactggggttcacttcctagccttgtgaccctggacgagatgtttcacctctcctgaaggcacagattcttttttttttttttgtaacggagtctctgttgccc

SEQ ID NO: 24227 - DNA, 785 bp, Homo sapiens
aatctggggaaataacattctaggcagaggagatttctaatacaaagcacctaaagggagaatcatcttgacttgtaaaaggaacagaaagtcactttatgtaaaaatttgtaagtaaggctggggagttttaattttattctgtgtaaggatggtggatagagtggaagtgctagatcacttagtctctgcagtaatccaagtgacaaataatggtggcttggaataggggtatagcaggggagtctggaatgaagcaaacttttggggacttgtttaggaggtagtatcagtggtagctagctaatctgttttgtagcgctgatcttgaactcctaggcctcccaaggtgctaggattacagcagtggttcctactgctccagccctgtgtcattttaaatactctccgttattattattttttgagacagagtcttgctctgttgcccaggctggagtgcagtagtgtggtctcggctcactgcagcctttgcctcctaggttcaagtgattctcctgcctcagcctccccagtagctgggattacaggtgcccaccacgactcccggctaatttttgtatttttggtagagacaaggtttcaccatgttgaccaggctggtcttgagctcctgatctctggtgatctgcccacctcagcctcccaaaatgctgggattacaggcgtgagccactgcgcctggcctaaaaatactttattttttagagcagtgttaagttcacaacaaaattgagcagaaaatacagagagttcccatacac

SEQ ID NO: 24228 - DNA, 812 bp, Homo sapiens
cagtgcgcaaccgttcgctaactgaaatgatggcgactggaacgccagagtctcaagcgcggttcggtcagtccgtgaaggggcttctcacggagaaggtgaccacctgtggtactgacgtaatcgcgctcaccaagcaggtgctgaaaggctcccggagctccgagctgctaggtcaggcagctcgaaacatggtactccaggaagatgccatcttgcactcagaagatagtttaaggaagatggcaataataacaacacatcttcaataccagcaagaagctattcagaagaatgttgaacagtcatcggatctacaggaccagttgaatcatctgttgaaatagaatgacattaactcagaggagatacgtgttttatttgtgatagcaaattcctaaatgaacattaggcaagtggtatcattatcaggccagctgcagcctcttgccttgacctgcattcctagaatttctttgttgctgtaattcttgattaagtgaccttgactttcattttgtaattttgctaatcatcagcaaattcacttgcatgacgttactgccaaatatgaaggcagttgaattattatgagtgattgtggcagaggtttgtgccatggtgaaaactttgatgtttgtctgtgttcattggatccatctttttaaatgacattaccatgagtctgtgtcaaacctaaatatctttgtttgaatttaaaatgggactctatattgtgtagttcaggtcttcattgactaagagatgagagaaatctgacataagaaaatattgttttcactgcaggaata

SEQ ID NO: 24229 - DNA, 780 bp, Homo sapiens
ggttgaattttggaagcacttcttgaatcggattaacccatgctcttattgaattttttcatctgctctgtttagtttgatattaaagcaaaattaagaggtcttagtttttcctatagaacttttaatatgtcaaaagctatattgtctaaatttcagtacttaagcaaatactgagtagtgttttaaattcagaaatagagcttctattatgaacacatgagaatgatttttttctcttaatcattattaaggaaatattttaatttcatggtcatataatggtgataagtaatacctgattgtttccttttctgttctagtaactcagaggagatacgtgttttatttgtgatagcaaattcctaaatgaacattaggcaagtggtatcattatcaggccagctgcagcctcttgccttgacctgcattcctagaatttctttgttgctgtaattcttgattaagtgaccttgactttcattttgtaattttgctaatcatcagcaaattcacttgcatgacgttactgccaaatatgaaggcagttgaattattatgagtgattgtggcagaggtttgtgccatggtgaaaactttgatgtttgtctgtgttcattggatccatctttttaaatgacattaccatgagtctgtgtcaaacctaaatatctttgtttgaatttaaaatgggactctatattgtgtagttcaggtcttcattgactaagagatgagagaaatctgacataagaaaatattgttttcactgcaggaata

SEQ ID NO: 24230 - DNA, 637 bp, Homo sapiens
cagtgcgcaaccgttcgctaactgaaatgatggcgactggaacgccagagtctcaagcgcggttcggtcagtccgtgaaggggcttctcacggagaaggtgaccacctgtggtactgacgtaatcgcgctcaccaagcaggtgctgaaaggctcccggagctccgagctgctaggtcaggcagctcgaaacatggtactccaggaagatgccatcttgcactcagaagatagtttaaggaagatggcaataataacaacacatcttcaataccagcaagaagctattcagaagaatgttgaacagtcatcggatctacaggaccagttgaatcatctgttgaaatagaatgacatgtaagagtgctgtaggactcctttgcctaatgctgaggagtaaataccttacacagctgtcctctgggtttggttttctattttcttctccaaaagttaatttgggaggccgaggcgggtggatcacgaggtcaggagttcgagaccagcctggccaagatggtgaaaccccgtctctactaaaaatacaaagaattagctgggcgtggtggcgggcgcctgtaatcccagctactcgggaagctgaggcaagagaatcgcttgaacccaggaggtggaggt

SEQ ID NO: 24231 - DNA, 718 bp, Homo sapiens
ggtcactaaaaaatgttttagttttcaaagtggatcctttggaggaattttttcccctcatacatggaagcaagtcatggaaatggtagttctttccatttccaaagctgaattccaaggcaaataaactttatattggtaatagttacaagagagatgatcatatttttatctaagtgctctacaaaacaaaacttgagcaacttatccaaagtttattgggatttttaaaagttctgttatctttttagtgtctagaaaaatgtccctcctactcataagattttggacttagtttcttactaacaacattctctcttatgtattccgaggtccaggatacagaggctgaaactctgactggttttttgaatggcattgagtggattcttgaagaagtggaatctaagcgtgcaagatgattctcttttcagatcttgggaactgaaaccatttgaaatttattactaaggtcgtgatgtgaatatttgctcagtcagcccaccttgtcctgcctttttgcagataggctttcatttggacagctataactgctgtgttttttatattatttttactctttaccataaatcaattacaagaaaagagtttcagtcctagtatttagccccaaaatgaacctttaaacatttttttggtaatttttatattttctgtctttttaaaaatattaaattctggaaaaaacaaaaatgtg

SEQ ID NO: 24232 - DNA, 2044 bp, Homo sapiens
ggaggctgacgcgctagcgtggctctaagacgcgtcacccacgctgcgggcaagccatggcgggaagcgagccgcgcagcggaacaaactcgccgccgccgcccttcagcgactggggccgcctggaggcggccatcctcagcggctggaagaccttctggcagtcagtgagcaaggagagggtggcgcgtacgacctcacgggaggaggtggatgaggcggccagcaccctgacgcggctgccggtgagcgtcggccgcaggccgcggaggacagtggggccggcccgggccggagggacctcccctggagccccccggggcctggggaactctcgcgccccggcctgggtctggctccgtccatgcagccattcctggcagtgtagtcaccgagaagctacagttgatcagaagcgtcttggcgtggaccctggtgctccgcagggggcccgaacatctcagggaagcaccttcatggggcccctggggaccctcccgatcgccctcaggttttccacccgccaaaacaggcacatgtgactaggacaccctgaatgtccggttacggaaatgagacagttcccaacttgctgattagcttgggaaagcattccagcgtccctgttcccagcgtctttgattccggatcactgtaccaaaacacttggagggccaaggtttttaccctctcaagaggacattgtgcctgtggctgttattgtgtatttgaagaaacaaaacggcccctcagttgaaaataaatgacttaagttacaagtgcctcaagttacatcaaggccacgagaatgacacacataacttattgttaaactttggggtagataggtaaatgaagagaacaaaaattattgaaaattattacaattctttgtctcatttggactattgacacctctctccaatgtgtatatcaacgtgaaagctgcaggtttagaatgcctccaagtttctccttgcagaggtttttcataacattttaatagattctgtagaggaactaagatgacaaatttacggccgggcgcggtggctcacgcctgtaatcccagcactttgggagacccaggtgggcggatcacgaggtcaggagatcaagaccatcctggctaacacggtgaaaccccgtctctactaaaaatataaaaaattagccgggcttggtggcaggcgcctgtagtcccagctacttgggaggctgaggcaggagcatggcgtgaacctgggagacggagcttgcagtgagccgagatcttgccactgcactccagcctgggcgacagagcgagactgtgtctcaaaaaagaaaaagacaaatgtacactctttgatttggtctgatgataaaatcagataaaggttgatatgggttttattttgaaggacaaattatttccttaactaatttatgtaactaactggtatatccaaatatctctgaggaaaaattaaaggaactggtgattttgctggaaaaatagcaagacagtggttgctttttcaggaatgtttcaggtgtttcagaaattaaatgtttaacaactacgaaactaaaatgttcagttatgatcctttgctgatagcaggaaaataatagatttaattattaatggtagatttagttattaaaaatactagtcagttgaccttttgttatttatttgttgattatgtggtttatcacccaaaaactattttcttcattcctttttcctacctgctgctttcttctgtttcagattgatgtacagctatatattttgtcctttctttcacctcatgatctgtgtcagttgggaagtacaaatcattattggaatgaaactgtaagagatccaattctgtggagatactttttgttgagggatcttccttcttggtcttctgttgactggaagtctcttccagatctagaaatcttaaaaaagcctatatctgaggtcactgatggtgcattttttgactacatggcagtgtaagtatctagttttatgaattaaaaagaagctattaaattttcctgt

SEQ ID NO: 24233 - DNA, 668 bp, Homo sapiens
ggatcctggtaaatttttgttccctcgctttgttagttttttattttattattttcaaaactattaaaagtaatgcaaattaagggttttgacttacattccttaggacatgaatggcaagatgaattttctcatattatggcaatgacagatccagcctttgggtcttcgggaagaccattgttggttttatcttgtatttctcaaggggatgtaaaaagaatgccctgtttttatttggctcatgagctgcatctgaatcttctaaatcacccatggctggtccaggatacagaggctgaaactctgactggttttttgaatggcattgagtggattcttgaagaagtggaatctaagcgtgcaagatgattctcttttcagatcttgggaactgaaaccatttgaaatttattactaaggtcgtgatgtgaatatttgctcagtcagcccaccttgtcctgcctttttgcagataggctttcatttggacagctataactgctgtgttttttatattatttttactctttaccataaatcaattacaagaaaagagtttcagtcctagtatttagccccaaaatgaacctttaaacatttttttggtaatttttatattttctgtctttttaaaaatattaaattctggaaaaaacaaaaatgtg

SEQ ID NO: 24234 - DNA, 699 bp, Homo sapiens
tgctgctgtctcaagggagatagaaacaaaagctgtcttaggggaggagcaggaattccacttgtaccaaggatcttgcactgatacaaattaaatgtttgctgactctggaggagaggcaggaaatttgcagtggagacctttctaccaatacagggcagaattcagcagtcatgctggaacactgagaaagcctgcagcactgaggctctggtgcacagggcctacctaaggcctgaggctggaatgagaaaactgagaaatctccatgtccctaccaattaaggagcaacagcagactactgcagggatgggggaagggtgtggagaggctctccttgcctcttccccataacccccatggcacagttaacaagataggctgaaagctgagaacaagtagaaactctgagaaagaaactctggtactccagtgctgttactgagaacaagataggcagcagcatgctgctggaagaatttaaagtctgtgtgttacaaagttaactatagcaataaaagccaaatccagctcaactacagactagtttgattcagcctactgcattaataccctgaccgaagtatgatgcctgtttttaggagtaaatcctttttccttcagtctttattgttcttctacataaaacacctaacattaaatctaaaaattatgagacactcacaaaatcagaatga

SEQ ID NO: 24235 - DNA, 1438 bp, Homo sapiens
ggaggctgacgcgctagcgtggctctaagacgcgtcacccacgctgcgggcaagccatggcgggaagcgagccgcgcagcggaacaaactcgccgccgccgcccttcagcgactggggccgcctggaggcggccatcctcagcggctggaagaccttctggcagtcaattgatgtacagctatatattttgtcctttctttcacctcatgatctgtgtcagttgggaagtacaaatcattattggaatgaaactgtaagagatccaattctgtggagatactttttgttgagggatcttccttcttggtcttctgttgactggaagtctcttccagatctagaaatcttaaaaaagcctatatctgaggtcactgatggtgcattttttgactacatggcagtctatagaatgtgctgtccatacacaagaagagcttcaaaatccagccgtcctatgtatggagctgtcacttcttttttacactccctgatcattcagaatgaaccacgatttgctatgtttggaccaggtttggaagaattgaatacctctttggtgttgagcttgatgtcttcagaggaactttgcccaacagctggtttgcctcagaggcagattgatggtattggatcaggagtcaattttcagttgaacaaccaacataaattcaacattctaatcttatattcaactaccagaaaggaaagagatagagcaagggaagagcatacaagtgcagttaacaagatgttcagtcgacacaatgaaggtgatgatcaacaaggaagccggtacagtgtgattccacagattcaaaaagtgtgtgaagttgtagatgggttcatctatgttgcaaatgctgaagctcataaaagacatgaatggcaagatgaattttctcatattatggcaatgacagatccagcctttgggtcttcgggaagaccattgttggttttatcttgtatttctcaaggggatgtaaaaagaatgccctgtttttatttggctcatgagctgcatctgaatcttctaaatcacccatggctggtccaggatacagaggctgaaactctgactggttttttgaatggcattgagtggattcttgaagaagtggaatctaagcgtgcaagatgattctcttttcagatcttgggaactgaaaccatttgaaatttattactaaggtcgtgatgtgaatatttgctcagtcagcccaccttgtcctgcctttttgcagataggctttcatttggacagctataactgctgtgttttttatattatttttactctttaccataaatcaattacaagaaaagagtttcagtcctagtatttagccccaaaatgaacctttaaacatttttttggtaatttttatattttctgtctttttaaaaatattaaattctggaaaaaacaaaaatgtg

SEQ ID NO: 24236 - DNA, 1607 bp, Homo sapiens
atttgattcaaaggtgtgttgtctgttatagataatctcagcaagtgctgctgtatctcacttgctaggcaatacctgtacaatagctaaccattgcatcaagtgtatatgaggctgtggaattagattttgcccagggaatagtaataatagtaactaccatttatggtcatataaagtacttatcatttttacaaccctgagttatttctttcttttcttttttttttttttgagacggagctttgctctgtcgcccaggctggagtgcagtggagcgatctcggctcactgcaggctccgctcctgggttcacgccattctcctgccttatcctcccgagtggctgggactggaggcgcccgccaccacgcctggctgattttttgtatttttggtagagacggggtttcaccgtgttacccaggatggtcttgatctcctgacctcgtgatccacccaccttggcctcccaaagtgctgggattacaggcgtgagccactgcgcccggccaaccctgagttatttctgttgctcaaataatacagatgaagaaactgaaattcagactctatagaatgtgctgtccatacacaagaagagcttcaaaatccagccgtcctatgtatggagctgtcacttcttttttacactccctgatcattcagaatgaaccacgatttgctatgtttggaccaggtttggaagaattgaatacctctttggtgttgagcttgatgtcttcagaggaactttgcccaacagctggtttgcctcagaggcagattgatggtattggatcaggagtcaattttcagttgaacaaccaacataaattcaacattctaatcttatattcaactaccagaaaggaaagagatagagcaagggaagagcatacaagtgcagttaacaagatgttcagtcgacacaatgaaggtgatgatcaacaaggaagccggtacagtgtgattccacagattcaaaaagtgtgtgaagttgtagatgggttcatctatgttgcaaatgctgaagctcataaaagacatgaatggcaagatgaattttctcatattatggcaatgacagatccagcctttgggtcttcgggaagaccattgttggttttatcttgtatttctcaaggggatgtaaaaagaatgccctgtttttatttggctcatgagctgcatctgaatcttctaaatcacccatggctggtccaggatacagaggctgaaactctgactggttttttgaatggcattgagtggattcttgaagaagtggaatctaagcgtgcaagatgattctcttttcagatcttgggaactgaaaccatttgaaatttattactaaggtcgtgatgtgaatatttgctcagtcagcccaccttgtcctgcctttttgcagataggctttcatttggacagctataactgctgtgttttttatattatttttactctttaccataaatcaattacaagaaaagagtttcagtcctagtatttagccccaaaatgaacctttaaacatttttttggtaatttttatattttctgtctttttaaaaatattaaattctggaaaaaacaaaaatgtg

SEQ ID NO: 24237 - DNA, 1340 bp, Homo sapiens
ggaggctgacgcgctagcgtggctctaagacgcgtcacccacgctgcgggcaagccatggcgggaagcgagccgcgcagcggaacaaactcgccgccgccgcccttcagcgactggggccgcctggaggcggccatcctcagcggctggaagaccttctggcagtcagtgagcaaggagagggtggcgcgtacgacctcacgggaggaggtggatgaggcggccagcaccctgacgcggctgccgattgatgtacagctatatattttgtcctttctttcacctcatgatctgtgtcagttgggaagtacaaatcattattggaatgaaactgtaagagatccaattctgtggagatactttttgttgagggatcttccttcttggtcttctgttgactggaagtctcttccagatctagaaatcttaaaaaagcctatatctgaggtcactgatggtgcattttttgactacatggcagtctatagaatgtgctgtccatacacaagaagagcttcaaaatccagccgtcctatgtatggagctgtcacttcttttttacactccctgatcattcagaatgaaccacgatttgctatgtttggaccaggtttggaagaattgaatacctctttggtgttgagcttgatgtcttcagaggaactttgcccaacagctggtttgcctcagaggcagattgatggtattggatcaggagtcaattttcagttgaacaaccaacataaattcaacattctaatcttatattcaactaccagaaaggaaagagatagagcaagggaagagcatacaagtgcagttaacaagatgttcagtcgacacaatgaaggtgatgatcaacaaggaagccggtacagtgtgattccacagattcaaaaagtgtgtgaagttgtagatgggttcatctatgttgcaaatgctgaagctcataaaagtccaggatacagaggctgaaactctgactggttttttgaatggcattgagtggattcttgaagaagtggaatctaagcgtgcaagatgattctcttttcagatcttgggaactgaaaccatttgaaatttattactaaggtcgtgatgtgaatatttgctcagtcagcccaccttgtcctgcctttttgcagataggctttcatttggacagctataactgctgtgttttttatattatttttactctttaccataaatcaattacaagaaaagagtttcagtcctagtatttagccccaaaatgaacctttaaacatttttttggtaatttttatattttctgtctttttaaaaatattaaattctggaaaaaacaaaaatgtg

SEQ ID NO: 24238 - DNA, 2374 bp, Homo sapiens
ggaggctgacgcgctagcgtggctctaagacgcgtcacccacgctgcgggcaagccatggcgggaagcgagccgcgcagcggaacaaactcgccgccgccgcccttcagcgactggggccgcctggaggcggccatcctcagcggctggaagaccttctggcagtcagtgagcaaggagagggtggcgcgtacgacctcacgggaggaggtggatgaggcggccagcaccctgacgcggctgccggtgagcgtcggccgcaggccgcggaggacagtggggccggcccgggccggagggacctcccctggagccccccggggcctggggaactctcgcgccccggcctgggtctggctccgtccatgcagccattcctggcagtgtagtcaccgagaagctacagttgatcagaagcgtcttggcgtggaccctggtgctccgcagggggcccgaacatctcagggaagcaccttcatggggcccctggggaccctcccgatcgccctcaggttttccacccgccaaaacaggcacatgtgactaggacaccctgaatgtccggttacggaaatgagacagttcccaacttgctgattagcttgggaaagcattccagcgtccctgttcccagcgtctttgattccggatcactgtaccaaaacacttggagggccaaggtttttaccctctcaagaggacattgtgcctgtggctgttattgtgtatttgaagaaacaaaacggcccctcagttgaaaataaatgacttaagttacaagtgcctcaagttacatcaaggccacgagaatgacacacataacttattgttaaactttggggtagataggtaaatgaagagaacaaaaattattgaaaattattacaattctttgtctcatttggactattgacacctctctccaatgtgtatatcaacgtgaaagctgcaggtttagaatgcctccaagtttctccttgcagaggtttttcataacattttaatagattctgtagaggaactaagatgacaaatttacggccgggcgcggtggctcacgcctgtaatcccagcactttgggagacccaggtgggcggatcacgaggtcaggagatcaagaccatcctggctaacacggtgaaaccccgtctctactaaaaatataaaaaattagccgggcttggtggcaggcgcctgtagtcccagctacttgggaggctgaggcaggagcatggcgtgaacctgggagacggagcttgcagtgagccgagatcttgccactgcactccagcctgggcgacagagcgagactgtgtctcaaaaaagaaaaagacaaatgtacactctttgatttggtctgatgataaaatcagataaaggttgatatgggttttattttgaaggacaaattatttccttaactaatttatgtaactaactggtatatccaaatatctctgaggaaaaattaaaggaactggtgattttgctggaaaaatagcaagacagtggttgctttttcaggaatgtttcaggtgtttcagaaattaaatgtttaacaactacgaaactaaaatgttcagttatgatcctttgctgatagcaggaaaataatagatttaattattaatggtagatttagttattaaaaatactagtcagttgaccttttgttatttatttgttgattatgtggtttatcacccaaaaactattttcttcattcctttttcctacctgctgctttcttctgtttcagattgatgtacagctatatattttgtcctttctttcacctcatgatctgtgtcagttgggaagtacaaatcattattggaatgaaactgtaagagatccaattctgtggagatactttttgttgagggatcttccttcttggtcttctgttgactggaagtctcttccagatctagaaatcttaaaaaagcctatatctgaggtcactgatggtgcattttttgactacatggcagttagagacggggtttcaccgtgttacccaggatggtcttgatctcctgacctcgtgatccacccaccttggcctcccaaagtgctgggattacaggcgtgagccactgcgcccggccaaccctgagttatttctgttgctcaaataatacagatgaagaaactgaaattcagactgtaagtggctcatataactaaaagtagtgaggcttggtcaggtctatccagcttcaaagttgttttgtgtttgttttttccccttcatgagttacaaggtttctaataaaaggattttgttaggttagtgattttgttaaccagcttgacttatttgaaggactttaggttttattttgatttgggcaacttttaatttttgata

SEQ ID NO: 24239 - DNA, 1516 bp, Homo sapiens
ggaggctgacgcgctagcgtggctctaagacgcgtcacccacgctgcgggcaagccatggcgggaagcgagccgcgcagcggaacaaactcgccgccgccgcccttcagcgactggggccgcctggaggcggccatcctcagcggctggaagaccttctggcagtcagtgagcaaggagagggtggcgcgtacgacctcacgggaggaggtggatgaggcggccagcaccctgacgcggctgccgattgatgtacagctatatattttgtcctttctttcacctcatgatctgtgtcagttgggaagtacaaatcattattggaatgaaactgtaagagatccaattctgtggagatactttttgttgagggatcttccttcttggtcttctgttgactggaagtctcttccagatctagaaatcttaaaaaagcctatatctgaggtcactgatggtgcattttttgactacatggcagtctatagaatgtgctgtccatacacaagaagagcttcaaaatccagccgtcctatgtatggagctgtcacttcttttttacactccctgatcattcagaatgaaccacgatttgctatgtttggaccaggtttggaagaattgaatacctctttggtgttgagcttgatgtcttcagaggaactttgcccaacagctggtttgcctcagaggcagattgatggtattggatcaggagtcaattttcagttgaacaaccaacataaattcaacattctaatcttatattcaactaccagaaaggaaagagatagagcaagggaagagcatacaagtgcagttaacaagatgttcagtcgacacaatgaaggtgatgatcaacaaggaagccggtacagtgtgattccacagattcaaaaagtgtgtgaagttgtagatgggttcatctatgttgcaaatgctgaagctcataaaagacatgaatggcaagatgaattttctcatattatggcaatgacagatccagcctttgggtcttcgggaagaccattgttggttttatcttgtatttctcaaggggatgtaaaaagaatgccctgtttttatttggctcatgagctgcatctgaatcttctaaatcacccatggctggtccaggatacagaggctgaaactctgactggttttttgaatggcattgagtggattcttgaagaagtggaatctaagcgtgcaagatgattctcttttcagatcttgggaactgaaaccatttgaaatttattactaaggtcgtgatgtgaatatttgctcagtcagcccaccttgtcctgcctttttgcagataggctttcatttggacagctataactgctgtgttttttatattatttttactctttaccataaatcaattacaagaaaagagtttcagtcctagtatttagccccaaaatgaacctttaaacatttttttggtaatttttatattttctgtctttttaaaaatattaaattctggaaaaaacaaaaatgtg

SEQ ID NO: 24240 - DNA, 1727 bp, Homo sapiens
ggaggctgacgcgctagcgtggctctaagacgcgtcacccacgctgcgggcaagccatggcgggaagcgagccgcgcagcggaacaaactcgccgccgccgcccttcagcgactggggccgcctggaggcggccatcctcagcggctggaagaccttctggcagtcagtgagcaaggagagggtggcgcgtacgacctcacgggaggaggtggatgaggcggccagcaccctgacgcggctgccgattgatgtacagctatatattttgtcctttctttcacctcatgatctgtgtcagttgggaagtacaaatcattattggaatgaaactgtaagagatccaattctgtggagatactttttgttgagggatcttccttcttggtcttctgttgactggaagtctcttccagatctagaaatcttaaaaaagcctatatctgaggtcactgatggtgcattttttgactacatggcagtctatagaatgtgctgtccatacacaagaagagcttcaaaatccagccgtcctatgtatggagctgtcacttcttttttacactccctgatcattcagaatgaaccacgatttgctatgtttggaccaggtttggaagaattgaatacctctttggtgttgagcttgatgtcttcagaggaactttgcccaacagctggtttgcctcagaggcagattgatggtattggatcaggagtcaattttcagttgaacaaccaacataaattcaacattctaatcttatattcaactaccagaaaggaaagagatagagcaagggaagagcatacaagtgcagttaacaagatgttcagtcgacacaatgaaggtgatgatcaacaaggaagccggtacagtgtgattccacagattcaaaaagtgtgtgaagttgtagatgggttcatctatgttgcaaatgctgaagctcataaaagtaagtactcatatgtacatttttaagcacattgttcttttcaaagcaaatggaaaatacctttttagactttactgtggcttcttaagaatatgatggcttattttatcaatgtgattttctgacccttactattaatagtgtgttctcacacttttgtgtgtattaggatcacctgggaagcttgttaaacatgttaacaagctgattcctaccctggtggattttattcctagatttgggttgtgtgaatcagatttgggcatctgttttttccaagcacccagggaattctgatgcattccaaagtttggtactagagctatacaatatttttttgctttatgcttctgcatttttttgatactgacattttgtctgcttctggctttattcaaataatctatgcaaataactatgaaaaattttatctttgttttatccaaatagtaaagagatgtgatggtagggtgttaagtagattagttgagaacactattcatatattctgaataattgccattcagaatgctatttttgtgtgaaatcaaaatatcattgggccatgagctagtattataatatctttcccaaatcctttgtgaacaaggtagaatataaatacataatatattgtatatatattatagttctctaatacactggtttgaatttctattcaatttattttccctgtgatctgttaggcatgaaagcagttgcaattactttctgttattacagggctatctataaaaagaaaacttagaagc

SEQ ID NO: 24241 - DNA, 1690 bp, Homo sapiens
ggaggctgacgcgctagcgtggctctaagacgcgtcacccacgctgcgggcaagccatggcgggaagcgagccgcgcagcggaacaaactcgccgccgccgcccttcagcgactggggccgcctggaggcggccatcctcagcggctggaagaccttctggcagtcagtgagcaaggagagggtggcgcgtacgacctcacgggaggaggtggatgaggcggccagcaccctgacgcggctgccgattgatgtacagctatatattttgtcctttctttcacctcatgatctgtgtcagttgggaagtacaaatcattattggaatgaaactgtaagagatccaattctgtggagatactttttgttgagggatcttccttcttggtcttctgttgactggaagtctcttccagatctagaaatcttaaaaaagcctatatctgaggtcactgatggtgcattttttgactacatggcagttagagacggggtttcaccgtgttacccaggatggtcttgatctcctgacctcgtgatccacccaccttggcctcccaaagtgctgggattacaggcgtgagccactgcgcccggccaaccctgagttatttctgttgctcaaataatacagatgaagaaactgaaattcagactctatagaatgtgctgtccatacacaagaagagcttcaaaatccagccgtcctatgtatggagctgtcacttcttttttacactccctgatcattcagaatgaaccacgatttgctatgtttggaccaggtttggaagaattgaatacctctttggtgttgagcttgatgtcttcagaggaactttgcccaacagctggtttgcctcagaggcagattgatggtattggatcaggagtcaattttcagttgaacaaccaacataaattcaacattctaatcttatattcaactaccagaaaggaaagagatagagcaagggaagagcatacaagtgcagttaacaagatgttcagtcgacacaatgaaggtgatgatcaacaaggaagccggtacagtgtgattccacagattcaaaaagtgtgtgaagttgtagatgggttcatctatgttgcaaatgctgaagctcataaaagacatgaatggcaagatgaattttctcatattatggcaatgacagatccagcctttgggtcttcgggaagaccattgttggttttatcttgtatttctcaaggggatgtaaaaagaatgccctgtttttatttggctcatgagctgcatctgaatcttctaaatcacccatggctggtccaggatacagaggctgaaactctgactggttttttgaatggcattgagtggattcttgaagaagtggaatctaagcgtgcaagatgattctcttttcagatcttgggaactgaaaccatttgaaatttattactaaggtcgtgatgtgaatatttgctcagtcagcccaccttgtcctgcctttttgcagataggctttcatttggacagctataactgctgtgttttttatattatttttactctttaccataaatcaattacaagaaaagagtttcagtcctagtatttagccccaaaatgaacctttaaacatttttttggtaatttttatattttctgtctttttaaaaatattaaattctggaaaaaacaaaaatgtg

SEQ ID NO: 24242 - DNA, 1497 bp, Homo sapiens
ggaggctgacgcgctagcgtggctctaagacgcgtcacccacgctgcgggcaagccatggcgggaagcgagccgcgcagcggaacaaactcgccgccgccgcccttcagcgactggggccgcctggaggcggccatcctcagcggctggaagaccttctggcagtcagtgagcaaggagagggtggcgcgtacgacctcacgggaggaggtggatgaggcggccagcaccctgacgcggctgccgattgatgtacagctatatattttgtcctttctttcacctcatgatctgtgtcagttgggaagtacaaatcattattggaatgaaactgtaagagatccaattctgtggagatactttttgttgagggatcttccttcttggtcttctgttgactggaagtctcttccagatctagaaatcttaaaaaagcctatatctgaggtcactgatggtgcattttttgactacatggcagtctatagaatgtgctgtccatacacaagaagagcttcaaaatccagccgtcctatgtatggagctgtcacttcttttttacactccctgatcattcagaatgaaccacgatttgctatgtttggaccaggtttggaagaattgaatacctctttggtgttgagcttgatgtcttcagaggaactttgcccaacagctggtttgcctcagaggcagattgatggtattggatcaggagtcaattttcagttgaacaaccaacataaattcaacattctaatcttatattcaactaccagaaaggaaagagatagagcaagggaagagcatacaagtgcagttaacaagatgttcagtcgacacaatgaaggtgatgatcaacaaggaagccggtacagtgtgattccacagattcaaaaagtgtgtgaagttgtagatgggttcatctatgttgcaaatgctgaagctcataaaaggcagaattcagcagtcatgctggaacactgagaaagcctgcagcactgaggctctggtgcacagggcctacctaaggcctgaggctggaatgagaaaactgagaaatctccatgtccctaccaattaaggagcaacagcagactactgcagggatgggggaagggtgtggagaggctctccttgcctcttccccataacccccatggcacagttaacaagataggctgaaagctgagaacaagtagaaactctgagaaagaaactctggtactccagtgctgttactgagaacaagataggcagcagcatgctgctggaagaatttaaagtctgtgtgttacaaagttaactatagcaataaaagccaaatccagctcaactacagactagtttgattcagcctactgcattaataccctgaccgaagtatgatgcctgtttttaggagtaaatcctttttccttcagtctttattgttcttctacataaaacacctaacattaaatctaaaaattatgagacactcacaaaatcagaatga

SEQ ID NO: 24243 - DNA, 372 bp, Homo sapiens
agcatttatattagaaatcaagaaagaggcaagctgcaggctatctaataataatacaaataataataactaacaattgcccctctcttccatccttagttcttagcagcctatgtttattctcaaagaaagtcctcttccttcatcttagtttatatggtaatagaaatgttagtttaaaaattgtgttctacaccacatgctgatgaaggtagttttagcattagatttacattaggaaagaagactcagaaacagggtactatgtaaccgtctctttcacatgttatctcatttatttctcatgggaatcctttaaggtccatattgttacccatttacttgtacaaatgtggaaaatgaagccctata

SEQ ID NO: 24244 - DNA, 366 bp, Homo sapiens
gatgagagcagatggacacccggtttccccatcctgtcctccctatctcagcacccagcagaggcgcgcttccacagctggcccccttgtcaccctttccagtttgcattttcctgccctttcgaaagaaccagcaggggtgaggtggtctattttcatgctgatgatcaactaactctgtggccaaggacagctgtgtcacctctcgctcccagactggcaggggaagcggcccctggatgaatgtccctttcgacaggtgaatctgcaactcttcaaactgcggaggcaccctcccctgaccctccttcagacccctgccagttcttctcaaaacagcttgtttagaaatttgggggctgggaa

SEQ ID NO: 24245 - DNA, 256 bp, Homo sapiens
ccttatgggatcaagatggatgcatcagataacatccacaacagtctttcagaaggtacataggcagatcttatttgactatttcttgtaaaaaaaaaaaaaaaaaaaagctcataaaagctaaagtccaactcagtaagagaagagtcttccaagttctaaatttagctataagagactagctttatcaaaggttaatacctgtgaaacccagaggagttggcaatgtatctcctatctagactcacttccataa

SEQ ID NO: 24246 - DNA, 498 bp, Homo sapiens
gggagttgacattagccattagtgtctgaatgacatggccatggtggcagaggtggaggtcctgcctgggtccaacaacatgggctctcactcaccgggaccgacttctgctactgctatgttcaacctgccagcaacagagactaatgcggagactccaaaatggcatgatacctcaaggagaccaactggacacttgaaggtctcatatgggctcacgtgctctgcttgagctcctctttcctgtgtcaccatctaaaaagtatccttggtcagaaagcttaatacctcctctgaagactgataatatacatcatcttcctggaccagtctacaagtgagggacagtgaatattttgaatggcagcttttagataacaaatcctcaaagagagatagagtcttactcatctctaacatgtgcttgactgtggaagactgccaattaataatgattgagtgatttgctaaataaataaaatctctgaacattgcagt

SEQ ID NO: 24247 - DNA, 436 bp, Homo sapiens
acattgggaatcgttgtcacagcaaggtagtttgcattccaaatcccagagccacacgttcactgtgtgtgcccatgctccagacactggtttagccatcatagagagctggactgtgccccaactccagagcagctcaaactgtgtggatatcaatattctcattcttagctgcccagctatttcacaggaatctgcaccttgattctgttaccaaggtggcagcagaggtgcatgtgccctgggcataagtgctgttactgccctgggtcccagaaccatgctccctccacacattcctgtgcttcacatctcagttctgcagccactccattggcaccactaatcaaatactcatgccactaccaatgcaagcaagctgacaagtcagacccggaaccaagagggattttatcagcaaaacttcctcactgag

SEQ ID NO: 24248 - DNA, 363 bp, Homo sapiens
ctccctccagtacaaatggctaggactagtttttgagtgtggtcaaacccacatcacctctctgaagagaatggctgactagtatggtcaaatgctcaattatcaagccatgggtaataagaaacttaactatttcctccagcatccccatgtattcagatcccacagggagataccaatgactataataattttggagtgtaaatgtgtttacccacaaaggcaagaaaacctttgtggtatataacctttggttatatagataactgccaaaaacttttttttaactgaaatgtttgagtaagtgactttaagatgagagtctgtccattaatgtatgtctattaaatgactttgaatcaa

SEQ ID NO: 24249 - DNA, 467 bp, Homo sapiens
acataattccctctcacttctaaggaacgctcttgctttgcttgtgaaatacgaacctctccccatctctcttcttttcctctctaccctctcttggctcccacattttagagaggacaagaactatcttactacagatctttttgtgagcattaataattgaaaataaatatttaggccaggcacagtggcttataactgtaataccagcactttaggaggctgaggcagggggatttaattgaactcaagagtttgagaccagtctggacaacatagtgagataccccactcatctctacaaaaaaatctaaaaattagccaggtgtggtggtgcacacccatagtcccagctatccaggaggctggggcaggaggattgcttgagcccaggagaacaaggctgcagtgagccatgatcataccactgcactccaggctgggtgacagagcaaaaccctgtctca

SEQ ID NO: 24250 - DNA, 498 bp, Homo sapiens
tatactgtgttaagccatcaagatacaggattatctaacttataaaatgggaagggttgttcctctcagaactttggatattcaatgagataatgactataagagctttgatctgtagagcacattacaaatttggtaaatttttgaaaaatgtcattaacagattcctccagtctgtatgaagctgtaaaatgttttagaatctttttccatttcacaactcctaaatattaggacaaattccagtatagtgaattttaaaggaacgtttaaattgtttttgaataaaagtaagaccttacttggaacttagggactgtttctttctttgtgttatttatgcatggtgagttattgaagggaagatagagctacaaagtgtctctctgctttcccttaagtatggttgtaatgaaatttgaactatattcaaattttcatggttaaaaacacttctagaacaattaggttgagatcagtctcaggaaaaaaaaaaaa

SEQ ID NO: 24251 - DNA, 305 bp, Homo sapiens
ctcaaatctcctttgtatcttggataagaccacttctctctcgggcttgtttcttatagtcaaaagcgcaggaatttagttgatctcccaagttactttggaccttaaattctgttttatggttgttcattttctatgtagtttagatttggttcattggactgatttgtgttctgtgtgcttttaaaattcaggaagatgtgactaggatagataaagcaaacatataaacactcagtttcattgacttaagtataaagactaacatgtttctcattagttataataaccttaaacttgatatg

SEQ ID NO: 24252 - DNA, 1446 bp, Homo sapiens
gttttttgaatgatctctgctccctggctctatgataggaattctcaacctgagtgaacaattcaaactgagattacttgtgtttagactcatatattttgataacatatgacttctccagtatgccccagaaagctgctaataacttgctcaacctgaaatttacagttttccaaattacaggttggcagagatactggattgataacaacatccacagttatcatataatcattcttatgctgtaaacaaaattattttggttagcagaatttaataattaactgttaactacatactaggcaatattgtagccactttatgtgcttcatgacaccttatgggataggtactattatcctcattttgcagatgaggaaactgaggtacaaggaggtattttctcaaggtcacacaactagggagtggtggcattagaatgggaacataggcagtctttctccaaagcctatgctgtgctgcctcttgttggagagtaaacctgttttacagtgtgtgtagtatggaagcagcataataataagaatagctgttccttattgagccattactgtggcagacaccgtactataagctgtggtatcaccattatctcatttgaatctcatagtagacctatcagttagaggtatgtaaatgcttcctcctctcccagcacctttacagatgaggatgctgagccctagaggtgaagaaagttgtctaatgacagagtgcttgtaagaggtaaagccaagacttgaagctctttcttgcagttactggatttctcctaatttacgggaactaatacagtacagtagctaaggatgcaagtactgaaaccagaaatcttgcctcaaatgccatttctgccacttgagctgtgtactttggacaaattaatctaatctttcccatttgaaagtcagacataatgtcttccctagaggcttgtgaggattaagtgaggcaagtgtatgtaaatgggctgagatcagagcttggctcacaacactcagtaatgatcactgccaattttttttggtatataaataaataaatacactatttcccccatgtttccaatttttaagacattgtatagtgaatttattgtatctttctcagattaacaattgcacacagtgcttgaaatttagaggtatttcacctgaaaagatgtctagagattgaaagaaaacatgctgggcatatgatttgaaaatataaataacatgctatttaaaaataagtttaccctatgttttctatcttttctggcacctagatataccatttaataagtaatagcaaggataatcatttttttaagccctggaaaatcttgattaaagaggacatttcagtattgcaaataaatgcatggtatttgtgtaacattgtggaaactaataaacacaaattgtattatagcaaaaaaaa

SEQ ID NO: 24253 - DNA, 636 bp, Homo sapiens
ttcctcggtgtcaacaccatccatctctgagggcgctggaccctgaggtggcccgagcttcacaggatcaccgccttggggtaggggcgcccgggcctggcatttcctcctaggaaggctcggtgagactgggatgggcatgcggctctccgctcgagcccaactccggtgccacctgcaccacggaggggtgaccccagggtcagggtcagagcggcttctcagaattcagcttgccacctctccgcggaccctgccttcatctcgtgcctcctcagagccctctgcgggcgcatgaagggcctttttttttttttttttttttttttttggcacaggtggaccaacggggggtgtgactgtgggcaccgtgcgcggaggcggaggctcatctggttcccaccctccgtgccgctggatgccccaggattttctccaaccggggtcccggcttggagccctccttggtgcgagctttggctcagcaatggggaaagcgggaatgggtctcgcccttgtggctgcctggtggaagcggcggttttgacacacgaatagtcgtggggagcagatccagagagggcgcatttgcaataataacgcttagtttatctctgccagaggggcgggaacagg

SEQ ID NO: 24254 - DNA, 372 bp, Homo sapiens
gttcccacccaacgctctctcgcccacttctactggggcccacttcctctcctgctctctctgtctcaacgtgattgactttcttgtgctgcccaggacttcttgcccacgtgcgccttcaaaacggtaagagctgcaactgaacgtgtgagacatggtgcagataggctgagaggcggcgggagagatgcccatgaactcaagtacccggacacgccctccacttctaccaccacgagtaacaccgcccccacgggaccgctctcgaggtcccccaagccaaggtgaggcaagtcccagttgaatgtcatcccgttcctcttgggcacggcggaccgctctcgcccttaaaggtgcgttgacgtggaaggt

SEQ ID NO: 24255 - DNA, 499 bp, Homo sapiens
agccaaaatgttggctataccaacacaaagcactaaatttttcatttttaacttggatattaaagcaaggatagatgatttggttaaggatgtatagaaaattattctactgtctttcattttcctctgtgtaaatgtataattcctaggaggaaaagaaaaatgttttctgcctacatatgtatcctctagtagcaaaagttgggcttagggtaggaataaggtggaaagacaaggagatatagagaaattagaaatttgtactatatgtttacatgcttatgtaaataaaattataaaagtgttgaaaatctgttcttaaaaatttcttgaattatatttataaatatgaaaatgtttgaagcagcacaatttgatggtttcacattaattcactgtgtaaacaaacctaaactaaattgaaaagcagtgttacatattattaaggtattgttgcttttgaaataaacttgcccacttcaaatgcttaaaaaaaaaa

SEQ ID NO: 24256 - DNA, 724 bp, Homo sapiens
tacaactagatcataagacccagcagcagggagctagttttattatatatttgtttctctagcacctaactaaatatccttatacacaataaatactaaagataatggtctgtgtaggtaacattgaggatatgaatagtatgaggtgatttcactagctgactactagtatgctagggctgttattacagaataccgtagactaaatggcttaagcaacagaaatttgttttcttacaattctggaaactggaagttgcaaatcaaggcaccggcaaggttatcctctctccttgtcttgcagatggtcacctttttgctgtgtccacacgagcttttctctgcgagtacactcctgatttctctttctcttataaggataccagtcctattggattagggccccagctttatgatctatttaacctcaattacctctgttaaaggccttctctccaaatagagtcacattgaggaattagggcttcaccatatgaatttttcagggagcaaaatttagcctgtaacaatgacctcctgaagataggtaggtatgccaagttgctaagatattaaatagaatccacactagatacttcagtaaagaaaatgatgtatagggaattgataaagcagatgctggagaactgaaatgcaaaatggaaaattgaagtaacaccaaggtaataacttcctgaatcagctacaaccccatgggctgggg

SEQ ID NO: 24257 - DNA, 436 bp, Homo sapiens
ctcttccagctctgttaatcaatggatcttttagaggtctggagggtcagccatacttcggccccactaggaagatggggcagtgggaaagggctttgagagatgtggcaaggtggcgcttccccattggttctttcatgacctgacttgctgacaattgcaccaggactttcctagtctcatgaagaatcagtgaaggtggccaggtgtgaagggaacaggagggacttgcttcttcaggaaacacttgagaccagagttcagcaacctctctgaccctgaaaggccgtcatctggaccaagcaggctcagagaggaccacaactaaactgaagtttatctgcaagggggaagaaaaaagtagagaggaaaagtcaggcaaggagaaaagaatgaggaagggaaggaggaaataatcacacttcaaccctcttcc

SEQ ID NO: 24258 - DNA, 463 bp, Homo sapiens
  misc_feature (42)..(42): n is a, c, g, or t
taaaataagaactcctataaaccttcactgataaaatccctntcagttttctccagttatcccaggtaacgtcctttatagcaaaaggatccggttcaggatcactcatacccagctgtcatatctttccagtctccttcattctagaagcattcttcattcttccttcatctttcatgacactgacacttttaattacaggccagctgatgtgtagaatgtccttccttttcttaggagatgttttctgtccttccttgaaaaccccactagtgttacctgccacgaggagagctaggcgctctgccccctaccccaagctggttgctctctcttacaacgcttcattaatcaagtacccttttttggagcattgatgatattcattcatccttttagccagtaaatattttttgatgtctattacgtgccaaatgggatacatttaagaacaaagcagacc

SEQ ID NO: 24259 - DNA, 315 bp, Homo sapiens
acattgagcctagtggtcatttattgactagacatcacagatgtactctgtgtcaacagaaaacccatacctctgttcaactttgggactttcagaactcacctgaaccaaccaatcagaacttagcttcatcaagtaattagaactaagcaagtttgaatccttcatttgcataaatggacttgagtgggaacccggacaggaacttttgctgtcaaaactgaaacctccttttgctccctggaaggaaccttcattttagaccacaggtcacatctccccattttgcaaactgcttagtggaataaagtctct

SEQ ID NO: 24260 - DNA, 534 bp, Homo sapiens
ggatgcatggctagagcccacgccaggtccctcctcagcctcctcacaaaggaccgaatgacttggctctgtgatcccatcccccagagactttggtgtgactgtggtgacccttggcatagcgcacccccccgactgcctcctcatctcaaaactttccaaaccatgacttttatagcagggctttaggaatcgcctggctctaccctctcacttcatggctacagatacttgtgccctgagagagcaagtgaatttcccaaagccaacagcaagccctctgattgctgctctaccaaaccaaaatgatttcagttctcatgaaacctaaggcctgactaaggaagattaagaaacctggtggtggtcgggtcctgtagtggggtgggaggaggggggagggatagtattaggagatatacctaatgtaaatgacgagttaatgagtgcagcacaccaacatggcacatgtatacatatgtaacaaacctgcaggttgtgcacatgtaccctagaacttaaagtataataaaa

SEQ ID NO: 24261 - DNA, 1861 bp, Homo sapiens
gatctcggctcactgcaagctccgcctcccgggttcatgccattctcctgcctcagcctcccgagtagctggtactacaggcgcctgccaccacgcctggctaatttttttgtattttcagtagagatggagtttcactgtgttagccaggacggtctcgatctcctgacctcgtgatcctcctgtctcggcctcccaaagtgctgggattacaggtgtgagccaccgtgcccggcctcttaagactaccttagaaagtagattgcaaaaaaactttaaacatgtatgtatttaaaaatttaataacaaaaccccccaaattctgtcatgatcttgatcattagaaagatttatgtaattggagaatttcagaaatatcttggtggcagaactagatgccttttgaggttcaatttaattctaacatcccgttaaaatttaatgtacaatatgtagagaaggacagcaactacacactgtacaccctaagactgatttttaaaaaagcaacatcaacttcaacatccaagtatcctatactttacacagtgcctggtatgtaatagttgcttaatgtttgctgaatgacagtgtgatcaaaggagtgttgttacatctgtcactctgaggtccttctggtgatgttgccatatcttataacatcaacaaatgttttcttaaaaatgaaattttcaggtgcattggctcacacctgtaatcccaacattttgggaggctgaagtgggagaattgcttgaggccaggagttcgacaccagcctgagcaacacagtgagacaccatctctaccaaaaaaattaaaaaattggctagtcatggtggtgtgtgcctttagtcctagctattcccaggagtttgaggttgcagggagtatgattgtgccactgcactccagcctgggtggcagagcaagactcggtctctatttttaaaaaaagaaagaaagaaaaatttgccttcactgccagttctacattgtggaggatactttgttttggcccctagagggagcgctagcctcctctataaatctcatcctcagcactctcctccagggttttcttacgctacattaaaagagaattgagaagaaactgttaaggtcaaaaacgtttcatgggcatgtttgtaggagcgtggatcaatccagtgagtgtggatcactgaaatcaatatgttgaatggatatctgtgctctcacgttcattacaacattcttcagaatcccaaatatacaatcaacctgtgttcatcaacagagatggatgaagaaaatgtggtatatatgaacaatagaatactattccacctaaacagggagaaattctgtcatttgtgataacgtggataaatctggaggacattatgctaagtgaaataagccaggtacagaaagacaaatacctcatgacctcacttatatgtggaatctaaaaaagtcaaactcacaaaagtagaaactagaatgctgattaccagaggctagggaggtggagaaggaggaaattgggagatgttgatcacaaaatacaaagtttgaacaaaaaaaaaaaaaaagaaaaaatacaaaatttcgacagacaggaggaataggttttgagatctattgcactattgattatagtcaataataatgtattctatatttcaaaataactgagtaaatttcaaatgtatcaccataaaaatgataggtaagtgaggtgatggatatgttatttggcatgatttatcattccacaaaatgtacatatattgaaacatcgcattgtatcccataactgtatgtaattatgatatgtcaatgaaaaataatattactaataaaaattttaattttc

SEQ ID NO: 24262 - DNA, 543 bp, Homo sapiens
cctgtatcagggagggaacaggcagatatatcgttacaaccagctcctctgtcccctgaatctttgctttccttgagtatcacctgttcactgtgtcctcttatgtggccaccctcaggaagtcccacaactgtcaaggcaggcaagccactacccttattgccagccacctctccaggaggaatgagtaggattgaggataattaacgagaaattaaataggcagctttagtaaataaccctataagtcattatcagtggagggaatgtcttttgtattatactaaaagttttcatgttttagacaaaaagccacagtgagatttcttcctagaaataacaatagccagttgtggcacggtttgagaaaccaggatgtaactttttttttttttttttatactttaagctttaaggtacatgtgcacaaagtgcaggttagttacatatgtatacatgtgccatgttggtgtgctgcacccatgaacgcgtcatttaacattaggtatatctccaaatgctatccctcccctctctccccac

SEQ ID NO: 24263 - DNA, 472 bp, Homo sapiens
tattataatgctaatagttttctagtagttacatattattcttttatatataatagttgtgacacaacttacctcactttcccctttgttgacctttattatgacattcaccaaaatttgaaaatgtatgtttctggttaatttttaatttatatttttttcatttataattcttttgaattattttgacctatttattggccagttttaataactgctgtaagaattccctattgtatttggtagggaatggacaatgatctactgcctaatatctcgagggcttagtatttttctcagtgactttgtgggttctttgtactgtgagattattaacactttattgatatttgattcagcatttgctccagtttgtggtttgtatgttgattttgaaaattcttttccatgttaagaatttgaacatttttatataataaaatatgttgcaaaatttttattaatgatttac

SEQ ID NO: 24264 - DNA, 359 bp, Homo sapiens
agaacacagagtacccataatatgtaattctaacacccattccccactaacctgccaatattgagttcactgccaaatcttaaaggcagacagccatttggctaatggtcagtaagcccaatttcctgccagatattagggcttgcttaagagtttgcctcatagtgtttgagaaatgatacgcaacctctccatggaacatgcattttgtaatagcaaaattatcaagagccttttcagtgctacaattgagatactagctgtgaatcaatgttcaaaaaaatcttaataaattgtttcagatgttactaggaaggatatttctggagtgtcaattagacacaattatagtttgagtt

SEQ ID NO: 24265 - DNA, 279 bp, Homo sapiens
ctcccaaagtgctgcgattacaggcgtgagccaccgcgcccggccaaacttgttgttttatagtcacacttcagttttgatcaaaacaatattcaccatctatcccttcacatttagtttttctctcaatgcctttgggtgcttaagggaaaaaaacaaagcaaatccatctgtaaaaggtaaagaatttaccctcctgaagaccctcaaagaatccaagggaggctcagaaggcagcactagaagagtcctccagtgttttgaatgatgattgcatgt

SEQ ID NO: 24266 - DNA, 751 bp, Homo sapiens
cttaggtgggggatggaaatgttctctaccttgattggaatagtggttaaataggtgtatgcatatgtcaacattcatggagtcatccacttaaaattgataattttaactgtacgtaaagtatttcttaaaaaagtaagttacatggttgaaaagactcaataagcaactaaaaagtggctgtcaaaattagttgctaattagacaattataaaagatgagtaaatataaaaattcgggaaaaatttacactcattttattttgcatgaatctttaaattcctaacacaatttagagaaatcagaactggaagtgagagatgttgtgttatgggtggaagatgaaagaaaaattattctgaactccatttaatgtactaacaaaataagcctttggccctatattacaaaatttggtgggaaaatatccactcagtgctttaaatttataaaatacttaacatatatcctagtttttatgattccctacctcatcccctatttcgaccagctattaatccatatcataacagctaaggggcttctactgaaccatttttctctgagactctatagccttcttctcccctctacctggaccacttgactgccacctctgttgctagccttgttaaggtttctaccaccagcagacaggcaaaagagattaagaaactgcaacccaaacctttaggatgccacagtgttggcttattatgtcttcctggctttttcagggatctttaggttg

SEQ ID NO: 24267 - DNA, 441 bp, Homo sapiens
gatatcccctttatcattttttattgcgtctatttgattcttctctcttttctgaagaagaaaatctttaaatgcaccatagttatatgatttgaaaagaaaatgtacactacaatgtagctgttcaataattcttaataaaacttctcattaccttgatttataaattggtaggatttgttctcatcagaatgttttaaaaaatctataaaaatagaagaaaagtatcctctcataaagctttatgggcactaacagcagttggaacttctcttactactgcctcatcactggttatatataagttttagtacaaagactataaatctggctgggctcatgctcataatctcagcactttcggaggcagaggcgggaggattgtttaaaggcaggatttagaaaccagcctgagcaacaaagtgagaccctgtcttaaaa

SEQ ID NO: 24268 - DNA, 459 bp, Homo sapiens
actgtgtacaaagacctgtgtctccagcctgagcagagcctaagactcagatgggggccagaccactctaggggaaagtccccaccacgtcccggcaactcacagcccccagacgtgttcgtttcttctgtggctgaaactacttctcaggccactgcttcagaagtacagaccaacagagatggtgaatgctgacagctgccgggagactcacgccttagtgacagtctccaggagaagactgtgaggccaccatttgggccacactgagaaattgtttttcatggttctataatgcatcttggcagaaaaaaacaaaaacccaaagctccttgtgctgaactcccaaaatgtagcaagtccagcccctgccataggcccaggcttcgtgctccccacccttggcaagttctccccacccccagccccacagtttattaaatgtttgattttcaaact

SEQ ID NO: 24269 - DNA, 472 bp, Homo sapiens
ttttgtttgaacccagaaatttgtggatagtgttgggaaatatagtgacctgatttatgctctcatagttcttagccatcatagaaacactataaagttaagagggctttatagacacttaggctgctataaaaaattatcccatttttatattcaagtcaatatgttttttcaagtctaaaacagtgtacagtatagaaaagggcaatgaagacagtctcttattttagtgataatcttctgtcctgataacttattaagtggaggggaatgcaagtttttaaaaaatactttgatatttttatttttattgaaaaaaatgttagagacagcatctccctcttgcccaagctcaactcttgggctcctgcaatcttcccaccccagcctcctgagtgtctgggaccacaggtgtgggccaccatgcccagcttatactttgatgtttttaatcaaaataaaagaattttgg

SEQ ID NO: 24270 - DNA, 2371 bp, Homo sapiens
taattaaaaaaaaaaaatagagacagggtctcagattttcattagatttggaaaccaagttagaatgttgactttggagccagacgaacagataccagttagctaggcatatgttcttccagggtctttggctagttaacattagtcatttgcttcgtgaaaattcaagaaccttttcagagccaagtacctggattaccttcccaatcaggtagaaattagacagggtccacagaagtagacacttaatgctgtggttcaataaatacttcccctaaatattaagtcttccctgagtctcagcaggtttgcattcacactgcttaagtaacttccagaacctggaagagtcgaaagagcacccctaggaaagagatgattccaaacagctttcattaacggcatgtaggcacaggtccctttcccaaaagtggattgttagtagtagttcattcaacctttgttaaggggtagctttccagaatgtgacattgtcctcagaaagatagacataggcttaaacataatggacatcctaaataggaattttcagattgtttttgaagtgaaaagtgttttaatgtctttaaatggaattgcataactaatggtatttaagtattttacatgttgctaataactttgaatatgattgttgcaattttatggaacctgggtctatgggactgctttttaagcagtttaaaaaaggttttcaaagtttaaaagccaatcttagcatgtataatccttatgggattcttaagttttatcctatcttgtttttgctcaagaacgctttatcagtgacgtttgttagaattttgttttttgttttttttttttaaattgtttttgggctagaaatgagtttctctagttttatttgttctccctgagttggagttatgcaatgaatggcatttttgtggtaaaatactaatcctaaaatctgttaactcactgttcatttaagtagggaatatctgtatacattaatgactaggtaaaacaggaaatacattttgaatatacagcctaaaggcaggcagttacagggtttttgatttctccgattttatagggtgcaagttcccagtggcaggatgccctgctgtgtgactgactacactgtgtcctgagcagtggtaatttcaatcacctctcatcagtttggccagccctacaaccaccattcctagccctgtgttgcttgacaggatacctgtgcttgaatggacataaggaaaagtccttactttctccccaatttacctctcaatcttagttcttccagaacacacttccctttcacaatgcaaataaactgaaagtgagatttgatacatggaattttgagaccaaccaactaaccttacacataatttgagggattcctggattcttctagtgatactgaaaagcacacttgactaaagcatagtgttttttgtttgttatggaaatacggtatacgttcatttaaaaataaatggacatacaaattgcatctccttaggagatacattttatatacatttcggtgcgtttttttccagtatggatttctatttgtttctctcttcctcttgttttttctgtgtcactcttgtatgtcctcatatctttcatacctcttgtgtagtctctagaagcagaacacctaagtcctgggtctggataatgaaaccctcagtctctggggcctctgaaaataaggaagcattggagctattgccatgttgagtaatgggcttcctagaactattgtcatctatcctgccagtgttttatgttgtagctgtttttctttgacaggtgagttccagctatgttgttagtcatgatcctgccattattttctgtgttctgtaggatgtctccaggctacttaaacatattttatgagtttgcaataaaattgttgaatcttgtatgatcaagtcactcctctgctcagaaatccacagtgacttcttagtaagcccctacattatatgcatacttgtttttttcttaactttactcccacttctacctaacagggacctcaacttaagtctcttcagttcttcaaggcctggccttgttcctgattcctcaaaaaatcttgactctaaggcctattttattgtctgtctctgaatccctataaagcttcaagtctgtatgacattcttaacgccaaattatatattgtcttgtactgttcctagctggtacatgtatattagtcttgtctccctcatgagaatgtaagctccttaagggcagggaccatgtcttaatttttgtatccaccacagtgcctagcacagtgcttggcacatgggtgctgaataaatacctttgtttattgatcaaaaaaaaa

SEQ ID NO: 24271 - DNA, 361 bp, Homo sapiens
aaattgcttttagagtttgactagtattccggagaataaagatctgatttaggccttaagcattcagtaatgaaaattaaaaagaaaaaaaatagtcaacttgttaatgcaagtgtctgtttggctgctgaatttttatagtgagggtaactttaactctgaaattatcccttatgtgtgagagtgaattaaatggtgacatataaaacagccattgctaagtagggatcgaagcctaacaagagtagagaaatcagtgagcacatagttgggctgaatgaattgtatcctggcctggccagattatttccttgggtccaaagagagcctgccatgaaaatcacccctcataggtaagtag

SEQ ID NO: 24272 - DNA, 436 bp, Homo sapiens
attgtatttaaggcaaataaaacaaagaaatcatttattcaacaaatatgtattaagggtctactaagaatgagcactgacctaggtattggggatacagtggtgaacaaaaggcccaaaatctgccttcctggaccttactttagtaatagagatatgcagacaacaaggaaaataaataagtaaaatatatggtatgttggaaggtaataagtgctaaaggagaaaacaaaaataaagcaggaaagagtagtataaaatgttgtggaagaggggcttaacatttcatacacagtggctagggaaggctttattgagaagggggcttctaagccaagccctgaaggaaataagagagataaccctgtagacattagaggaaaagcattccagacaaaaggaacaagtgcaaaggccctaaagtagaaggatgcct

SEQ ID NO: 24273 - DNA, 447 bp, Homo sapiens
ctttgattttaatttaggaatgaattttttaaaatgcatataaccagctcagggtctgtgcttcatcatcaccctggctttttttttgtgctaatttttcctcttactacttttatgagtaccagaaaattatccaaagctaagagaagaaataaaacactgtttttgctccttattaataatttgcttctaagtttttgttagagagtaggtaaaaacgtttggcaaagtagattgctcatagagtttagctatccatgctttgtttttacctttagtttagttttatggcaggggaataggacttgttgaagggagtgggaaagaagggatgcaggtcttcataataaggaatgtcggccaggcgcagtatctcacacctgtaatcccagcactttgggaggccaaggcaggcagatcactaggtcaggagttcgagaccagcct

SEQ ID NO: 24274 - DNA, 4341 bp, Homo sapiens
gtccgcctgccgcccgctggcctgctccctccggggcaagtcttgcttcttaagcgctcctttcacacacgcgcgcgctcgctgggccgtcccctcctctccggccctcctcctcctcctggtccttgctaacgctgccgtcggggaggattgatgtcccttcagcatcatgcagccgccgccgaggaaggacattcagtcagaagaaggctgctattgaaagagagtatgcacagggtatgcagaagttggctagtcaatacctgaagagagattggcctggagtaaaagctgatgatcggaatgattacaggagcatgtatcccgtttggaaatcttttctcgagggaacaatgcaggtagcccagtctcggatgaatatatgtgaaaactataaaaacttcatttctgagcctgcaaggacagtgagaagcttaaaagaacagcaactaaaaaggtgtgtggaccagttgacaaagatccaaactgaattacaagagacagtgaaagatttagctaaaggcaaaaagaaatactttgagactgaacagatggctcatgcagtacgagagaaagctgacatcgaggcaaaatctaaacttagtctttttcaatcaagaatcagtttacagaaggcaagtgtaaagttaaaagcccggcgatctgagtgtaattccaaagctacccacgcaaggaatgattatcttcttaccctagcggcagcaaatgcacatcaggatcgctactatcaaacagatttagttaacattatgaaggctcttgatggaaatgtgtatgatcatctcaaggattatttaatagccttcagccggactgagctagaaacatgccaagctgtgcagaacacattccagtttttattagaaaactccagcaaggtggtccgggactacaatcttcagctgtttttgcaagaaaacgctgtatttcacaaaccccagcccttccagttccagccttgtgacagtgatactagccgacagttagaatcagaaactgggaccacagaggagcacagtctaaataaggaagctcgaaaatgggccacacgtgtggcacgtgagcataaaaacattgttcaccaacaacgggttctaaatgatctggagtgtcatggagctgctgtatcagaacaaagccgagcagagctagaacagaaaatagatgaagctagagaaaatattcgtaaagcagagataattaaattgaaagctgaagcccggttggacctgctaaagcagattggtgtttctgtggacacatggctaaagagtgccatgaaccaagtaatggaagaactggaaaatgagcgatgggcccgccctcctgcagtgaccagtaatggcactttacactcgcttaatgcagataccgaaagagaagaaggcgaagagtttgaagataacatggatgttttcgatgacagcagttccagcccttctggcaccttaagaaattatccactcacctgcaaagttgtttattcctacaaggcttctcaaccagatgagttgaccattgaggaacatgaggtgttagaagtgattgaagatggagatatggaagactgggtaaaggctcgaaataaagttggccaagtgggttatgtgccagaaaagtacctacagtttcccacctcgaacagcctcctgagcatgctgcagtccctggccgctttggacagtcggtcacacacgtccagcaattccacggaagcagaactcgtttcaggcagcctcaacggagatgccagtgtatgttttgtgaaagcactttatgattatgagggccagacagatgatgagttatcttttcctgagggagcaataatccgtatcttgaacaaagaaaaccaagatgatgatggcttctgggaaggggaattcaatgggcgtattggagttttcccatcggtgctagtggaagaactttcagcctcagaaaatggtgacactccatggatgagagagattcagatctctccttcccccaagccacacgcctccctgcctccactgccgttgtacgaccagcctcccagcagcccctaccccagcccagataagaggagctccctgtactttccccggtctccttcagcaaacgaaaaaagccttcatgctgagtcaccaggattctcacaggcatcaaggcatactcctgagacctcatatggcaaactgcgacctgtccgggcagctccccctccacctacacagaatcaccgaaggccagcagagaagattgaagatgtggaaatcacactggtgtgatgatgggcttgcccatccattactgctacaatcaaggccaggcttggagtttggccagtcttgttttttaggcacctttgcatgatgatgactcttgaacagagcaaaaaacaaggaggattatgtgtgactgggtggcctggtagactcctcccacgttttgaatatttcgtgccttttttttttgttgtcattttctatgtcatttctcctaccatagcacaaatcctagcggaccctaggagcaaagaggggggcagccctcatgcctaacagtggtctgtttttatatgagactcaagaacaggcctcattccagggcacagtccctaaattactgatcatgtgcactcgtacagtatattactgtgaccacaaggatgtggcaaagattctcatctttcttcaagtggcttttgctcatctgattgagaattaatcagatcatgttggctacataaggaaacagaaggagggatttcaggagaggctggctcctccccaaggttagtccccagactgagaaagtgaaaccttattgggaaaaattggactgccctgaatttagcaccaattgcattaacgcacatctcttccacaactaacagacttaaaataacagtgtccttcgtattaatatctgtgccattcatttagaattagcagagctaatatggaggggctgaactagtagccacatcttgttcatcacatagactaatagaaaggaggctgtggctaaagcagaaatggaacttccggatctgaaattagccaatataatgttcttttgtatttgggtatttttcatcttaatttttacagcatatactcttcttaccagtatccttagaatccaaatgtctagataagttgaggacacatacctgcattgttgagcttctctactggggacgccccggcattattttattcccaagccagcagaccggcccagacagccaggctgtggctggtccagaccaactgctatggtggaaaatgcagcttccaggtcccactaccctgacatttccgtggaaggaagaacctggtggctcgtggaggaaaccagctttctatgagaaaggactgaaggattgcgcaccctgcacaagtacagattgaccaggaaaagacaagtgtcttctgtgtgtcacagggaaagccaggagtggccttctctgcaggccagcaagcctgcagcagcaggtgcccccacgtcaggtgctgactgtccgctgtccgctcctgtagaaggtagggagcacaatacctagggactaagggatgttcgccggttgtggtttgtttttttttttttttccttggttaagaaatcaaatttgcagaatttaatctacaagttgtattatgctttgaaaactccatccctcctaagaatcttaaaaaacttgaaatgctcgccaaatgtccccatgggatttttgaccaaaagtaaggtgataactgaagaaatttttagttctttgatcacttcagtgacaatacccattaatgaatcttctccatgatttggggttttttttcgttgttgttttttacacttcttaacctgttgatctatttgaggtcttttgtgtttatcaaacttattcttaagtttaaaaaagaaattaaaagggtggtttttttaagattttaaagtttgctaacatattaaaaatcttcaaatgcttattaaatagagcagttcttgccacccagtcttgtattctgtctttagctagccaaattgtccttgaatttgggttttccacaacctcaaagggttatttgaaatcttttgttgtattttaaaatattttttggaagagctgctaattttattttaaaaaacaaagttgtgaaaacatgcctcctttttaaaaaataacccctccatccaggatatggaatccagcaccacagtgcacaggtcagggctcggagggagcctctgtgcagatgtgctttctttacagtggctgtaaaaagtttgtatttattatgtataaaatgttgaataataaaaaaaatggaatta

SEQ ID NO: 24275 - DNA, 658 bp, Homo sapiens
gacgggtcctgcctcgtccccggctgaggggcgaggaggctgtcgtgctgtcttcagaaaagcgaggaccgggcccgggaggtgaaagttacacaagaactgaaaaacattcaagttgagcagatgacaaaacttcaagccaaacatcaagcagaatgtgatttgcttgaagatatgaggtaaggctatagtaaatagttcaaggacttctgtttgtctgtttcaaagaacctttgagttaccaagccccaggaactgatgatggaatttccttttggatttcctgctttaaggctgttagaactttgactcagctggaaattagaactggaactaacacaatacaaactttttccttcagtgggggacctataatgcacacatagtattcagaaaaaacaaggaccttaaaagtcttactagtcaaattataataattaaagattcttgtttaaataatctttccacggaattgtaacaatcattttattgaccttaacggttttacacagttagatttttaaaccaacacttgtggttaatggttaatatctgggggtgagccagtcaaccccagatggttatatgctctcactgggttagaacatgacaaatacaactttgtttttgagtgccaaatttagtgagaagtgtgttt

SEQ ID NO: 24276 - DNA, 611 bp, Homo sapiens
ctgagggtgactctagagagatccccccgaggaggtgaaagttacacaagaactgaaaaacattcaagttgagcagatgacaaaacttcaagccaaacatcaagcagaatgtgatttgcttgaagatatgaggtaaggctatagtaaatagttcaaggacttctgtttgtctgtttcaaagaacctttgagttaccaagccccaggaactgatgatggaatttccttttggatttcctgctttaaggctgttagaactttgactcagctggaaattagaactggaactaacacaatacaaactttttccttcagtgggggacctataatgcacacatagtattcagaaaaaacaaggaccttaaaagtcttactagtcaaattataataattaaagattcttgtttaaataatctttccacggaattgtaacaatcattttattgaccttaacggttttacacagttagatttttaaaccaacacttgtggttaatggttaatatctgggggtgagccagtcaaccccagatggttatatgctctcactgggttagaacatgacaaatacaactttgtttttgagtgccaaatttagtgagaagtgtgttt

SEQ ID NO: 24277 - DNA, 4238 bp, Homo sapiens
gggaagcagaatgtgatttgcttgaagatatgaggacattcagtcagaagaaggctgctattgaaagagagtatgcacagtattccattgtatggatataccacagtttatccattttcctgttgatggacatggtatgcagaagttggctagtcaatacctgaagagagattggcctggagtaaaagctgatgatcggaatgattacaggagcatgtatcccgtttggaaatcttttctcgagggaacaatgcaggtagcccagtctcggatgaatatatgtgaaaactataaaaacttcatttctgagcctgcaaggacagtgagaagcttaaaagaacagcaactaaaaaggtgtgtggaccagttgacaaagatccaaactgaattacaagagacagtgaaagatttagctaaaggcaaaaagaaatactttgagactgaacagatggctcatgcagtacgagagaaagctgacatcgaggcaaaatctaaacttagtctttttcaatcaagaatcagtttacagaaggcaagtgtaaagttaaaagcccggcgatctgagtgtaattccaaagctacccacgcaaggaatgattatcttcttaccctagcggcagcaaatgcacatcaggatcgctactatcaaacagatttagttaacattatgaaggctcttgatggaaatgtgtatgatcatctcaaggattatttaatagccttcagccggactgagctagaaacatgccaagctgtgcagaacacattccagtttttattagaaaactccagcaaggtggtccgggactacaatcttcagctgtttttgcaagaaaacgctgtatttcacaaaccccagcccttccagttccagccttgtgacagtgatactagccgacagttagaatcagaaactgggaccacagaggagcacagtctaaataaggaagctcgaaaatgggccacacgtgtggcacgtgagcataaaaacattgttcaccaacaacgggttctaaatgatctggagtgtcatggagctgctgtatcagaacaaagccgagcagagctagaacagaaaatagatgaagctagagaaaatattcgtaaagcagagataattaaattgaaagctgaagcccggttggacctgctaaagcagattggtgtttctgtggacacatggctaaagagtgccatgaaccaagtaatggaagaactggaaaatgagcgatgggcccgccctcctgcagtgaccagtaatggcactttacactcgcttaatgcagataccgaaagagaagaaggcgaagagtttgaagataacatggatgttttcgatgacagcagttccagcccttctggcaccttaagaaattatccactcacctgcaaagttgtttattcctacaaggcttctcaaccagatgagttgaccattgaggaacatgaggtgttagaagtgattgaagatggagatatggaagactgggtaaaggctcgaaataaagttggccaagtgggttatgtgccagaaaagtacctacagtttcccacctcgaacagcctcctgagcatgctgcagtccctggccgctttggacagtcggtcacacacgtccagcaattccacggaagcagaactcgtttcaggcagcctcaacggagatgccagtgtatgttttgtgaaagcactttatgattatgagggccagacagatgatgagttatcttttcctgagggagcaataatccgtatcttgaacaaagaaaaccaagatgatgatggcttctgggaaggggaattcaatgggcgtattggagttttcccatcggtgctagtggaagaactttcagcctcagaaaatggtgacactccatggatgagagagattcagatctctccttcccccaagccacacgcctccctgcctccactgccgttgtacgaccagcctcccagcagcccctaccccagcccagataagaggagctccctgtactttccccggtctccttcagcaaacgaaaaaagccttcatgctgagtcaccaggattctcacaggcatcaaggcatactcctgagacctcatatggcaaactgcgacctgtccgggcagctccccctccacctacacagaatcaccgaaggccagcagagaagattgaagatgtggaaatcacactggtgtgatgatgggcttgcccatccattactgctacaatcaaggccaggcttggagtttggccagtcttgttttttaggcacctttgcatgatgatgactcttgaacagagcaaaaaacaaggaggattatgtgtgactgggtggcctggtagactcctcccacgttttgaatatttcgtgccttttttttttgttgtcattttctatgtcatttctcctaccatagcacaaatcctagcggaccctaggagcaaagaggggggcagccctcatgcctaacagtggtctgtttttatatgagactcaagaacaggcctcattccagggcacagtccctaaattactgatcatgtgcactcgtacagtatattactgtgaccacaaggatgtggcaaagattctcatctttcttcaagtggcttttgctcatctgattgagaattaatcagatcatgttggctacataaggaaacagaaggagggatttcaggagaggctggctcctccccaaggttagtccccagactgagaaagtgaaaccttattgggaaaaattggactgccctgaatttagcaccaattgcattaacgcacatctcttccacaactaacagacttaaaataacagtgtccttcgtattaatatctgtgccattcatttagaattagcagagctaatatggaggggctgaactagtagccacatcttgttcatcacatagactaatagaaaggaggctgtggctaaagcagaaatggaacttccggatctgaaattagccaatataatgttcttttgtatttgggtatttttcatcttaatttttacagcatatactcttcttaccagtatccttagaatccaaatgtctagataagttgaggacacatacctgcattgttgagcttctctactggggacgccccggcattattttattcccaagccagcagaccggcccagacagccaggctgtggctggtccagaccaactgctatggtggaaaatgcagcttccaggtcccactaccctgacatttccgtggaaggaagaacctggtggctcgtggaggaaaccagctttctatgagaaaggactgaaggattgcgcaccctgcacaagtacagattgaccaggaaaagacaagtgtcttctgtgtgtcacagggaaagccaggagtggccttctctgcaggccagcaagcctgcagcagcaggtgcccccacgtcaggtgctgactgtccgctgtccgctcctgtagaaggtagggagcacaatacctagggactaagggatgttcgccggttgtggtttgtttttttttttttttccttggttaagaaatcaaatttgcagaatttaatctacaagttgtattatgctttgaaaactccatccctcctaagaatcttaaaaaacttgaaatgctcgccaaatgtccccatgggatttttgaccaaaagtaaggtgataactgaagaaatttttagttctttgatcacttcagtgacaatacccattaatgaatcttctccatgatttggggttttttttcgttgttgttttttacacttcttaacctgttgatctatttgaggtcttttgtgtttatcaaacttattcttaagtttaaaaaagaaattaaaagggtggtttttttaagattttaaagtttgctaacatattaaaaatcttcaaatgcttattaaatagagcagttcttgccacccagtcttgtattctgtctttagctagccaaattgtccttgaatttgggttttccacaacctcaaagggttatttgaaatcttttgttgtattttaaaatattttttggaagagctgctaattttattttaaaaaacaaagttgtgaaaacatgcctcctttttaaaaaataacccctccatccaggatatggaatccagcaccacagtgcacaggtcagggctcggagggagcctctgtgcagatgtgctttctttacagtggctgtaaaaagtttgtatttattatgtataaaatgttgaataataaaaaaaatggaatta

SEQ ID NO: 24278 - DNA, 4017 bp, Homo sapiens
gggaagcagaatgtgatttgcttgaagatatgaggacattcagtcagaagaaggctgctattgaaagagagtatgcacagtattccattgtatggatataccacagtttatccattttcctgttgatggacatggtatgcagaagttggctagtcaatacctgaagagagattggcctggagtaaaagctgatgatcggaatgattacaggagcatgtatcccgtttggaaatcttttctcgagggaacaatgcaggtagcccagtctcggatgaatatatgtgaaaactataaaaacttcatttctgagcctgcaaggacagtgagaagcttaaaagaacagcaactaaaaaggtgtgtggaccagttgacaaagatccaaactgaattacaagagacagtgaaagatttagctaaaggcaaaaagaaatactttgagactgaacagatggctcatgcagtacgagagaaagctgacatcgaggcaaaatctaaacttagtctttttcaatcaagaatcagtttacagaaggcaagtgtaaagttaaaagcccggcgatctgagtgtaattccaaagctacccacgcaaggaatgattatcttcttaccctagcggcagcaaatgcacatcaggatcgctactatcaaacagatttagttaacattatgaaggctcttgatggaaatgtgtatgatcatctcaaggattatttaatagccttcagccggactgagctagaaacatgccaagctgtgcagaacacattccagtttttattagaaaactccagcaaggtggtccgggactacaatcttcagctgtttttgcaagaaaacgctgtatttcacaaaccccagcccttccagttccagccttgtgacagtgatactagccgacagttagaatcagaaactgggaccacagaggagcacagtctaaataaggaagctcgaaaatgggccacacgtgtggcacgtgagcataaaaacattgttcaccaacaacgggttctaaatgatctggagtgtcatggagctgctgtatcagaacaaagccgagcagagctagaacagaaaatagatgaagctagagaaaatattcgtaaagcagagataattaaattgaaagctgaagcccggttggacctgctaaagcagattggtgtttctgtggacacatggctaaagagtgccatgaaccaagtaatggaagaactggaaaatgagcgatgggcccgccctcctgcagtgaccagtaatggcactttacactcgcttaatgcagataccgaaagagaagaaggcgaagagtttgaagataacatggatgttttcgatgacagcagttccagcccttctggcaccttaagaaattatccactcacctgcaaagttgtttattcctacaaggcttctcaaccagatgagttgaccattgaggaacatgaggtgttagaagtgattgaagatggagatatggaagactgggtaaaggctcgaaataaagttggccaagtgggttatgtgccagaaaagtacctacagtttcccacctcgaacagcctcctgagcatgctgcagtccctggccgctttggacagtcggtcacacacgtccagcaattccacggaagcagaactcgtttcaggcagcctcaacggagatgccagtgatctctccttcccccaagccacacgcctccctgcctccactgccgttgtacgaccagcctcccagcagcccctaccccagcccagataagaggagctccctgtactttccccggtctccttcagcaaacgaaaaaagccttcatgctgagtcaccaggattctcacaggcatcaaggcatactcctgagacctcatatggcaaactgcgacctgtccgggcagctccccctccacctacacagaatcaccgaaggccagcagagaagattgaagatgtggaaatcacactggtgtgatgatgggcttgcccatccattactgctacaatcaaggccaggcttggagtttggccagtcttgttttttaggcacctttgcatgatgatgactcttgaacagagcaaaaaacaaggaggattatgtgtgactgggtggcctggtagactcctcccacgttttgaatatttcgtgccttttttttttgttgtcattttctatgtcatttctcctaccatagcacaaatcctagcggaccctaggagcaaagaggggggcagccctcatgcctaacagtggtctgtttttatatgagactcaagaacaggcctcattccagggcacagtccctaaattactgatcatgtgcactcgtacagtatattactgtgaccacaaggatgtggcaaagattctcatctttcttcaagtggcttttgctcatctgattgagaattaatcagatcatgttggctacataaggaaacagaaggagggatttcaggagaggctggctcctccccaaggttagtccccagactgagaaagtgaaaccttattgggaaaaattggactgccctgaatttagcaccaattgcattaacgcacatctcttccacaactaacagacttaaaataacagtgtccttcgtattaatatctgtgccattcatttagaattagcagagctaatatggaggggctgaactagtagccacatcttgttcatcacatagactaatagaaaggaggctgtggctaaagcagaaatggaacttccggatctgaaattagccaatataatgttcttttgtatttgggtatttttcatcttaatttttacagcatatactcttcttaccagtatccttagaatccaaatgtctagataagttgaggacacatacctgcattgttgagcttctctactggggacgccccggcattattttattcccaagccagcagaccggcccagacagccaggctgtggctggtccagaccaactgctatggtggaaaatgcagcttccaggtcccactaccctgacatttccgtggaaggaagaacctggtggctcgtggaggaaaccagctttctatgagaaaggactgaaggattgcgcaccctgcacaagtacagattgaccaggaaaagacaagtgtcttctgtgtgtcacagggaaagccaggagtggccttctctgcaggccagcaagcctgcagcagcaggtgcccccacgtcaggtgctgactgtccgctgtccgctcctgtagaaggtagggagcacaatacctagggactaagggatgttcgccggttgtggtttgtttttttttttttttccttggttaagaaatcaaatttgcagaatttaatctacaagttgtattatgctttgaaaactccatccctcctaagaatcttaaaaaacttgaaatgctcgccaaatgtccccatgggatttttgaccaaaagtaaggtgataactgaagaaatttttagttctttgatcacttcagtgacaatacccattaatgaatcttctccatgatttggggttttttttcgttgttgttttttacacttcttaacctgttgatctatttgaggtcttttgtgtttatcaaacttattcttaagtttaaaaaagaaattaaaagggtggtttttttaagattttaaagtttgctaacatattaaaaatcttcaaatgcttattaaatagagcagttcttgccacccagtcttgtattctgtctttagctagccaaattgtccttgaatttgggttttccacaacctcaaagggttatttgaaatcttttgttgtattttaaaatattttttggaagagctgctaattttattttaaaaaacaaagttgtgaaaacatgcctcctttttaaaaaataacccctccatccaggatatggaatccagcaccacagtgcacaggtcagggctcggagggagcctctgtgcagatgtgctttctttacagtggctgtaaaaagtttgtatttattatgtataaaatgttgaataataaaaaaaatggaatta

SEQ ID NO: 24279 - DNA, 3437 bp, Homo sapiens
tgcaatctttactgggcagagtttaaaagccgcccaactggtggatattgagctctcccctgtcagtgctctgagaatgaccatagctgagagccgacagttagaatcagaaactgggaccacagaggagcacagtctaaataaggaagctcgaaaatgggccacacgtgtggcacgtgagcataaaaacattgttcaccaacaacgggttctaaatgatctggagtgtcatggagctgctgtatcagaacaaagccgagcagagctagaacagaaaatagatgaagctagagaaaatattcgtaaagcagagataattaaattgaaagctgaagcccggttggacctgctaaagcagattggtgtttctgtggacacatggctaaagagtgccatgaaccaagtaatggaagaactggaaaatgagcgatgggcccgccctcctgcagtgaccagtaatggcactttacactcgcttaatgcagataccgaaagagaagaaggcgaagagtttgaagataacatggatgttttcgatgacagcagttccagcccttctggcaccttaagaaattatccactcacctgcaaagttgtttattcctacaaggcttctcaaccagatgagttgaccattgaggaacatgaggtgttagaagtgattgaagatggagatatggaagactgggtaaaggctcgaaataaagttggccaagtgggttatgtgccagaaaagtacctacagtttcccacctcgaacagcctcctgagcatgctgcagtccctggccgctttggacagtcggtcacacacgtccagcaattccacggaagcagaactcgtttcaggcagcctcaacggagatgccagtgtatgttttgtgaaagcactttatgattatgagggccagacagatgatgagttatcttttcctgagggagcaataatccgtatcttgaacaaagaaaaccaagatgatgatggcttctgggaaggggaattcaatgggcgtattggagttttcccatcggtgctagtggaagaactttcagcctcagaaaatggtgacactccatggatgagagagattcagatctctccttcccccaagccacacgcctccctgcctccactgccgttgtacgaccagcctcccagcagcccctaccccagcccagataagaggagctccctgtactttccccggtctccttcagcaaacgaaaaaagccttcatgctgagtcaccaggattctcacaggcatcaaggcatactcctgagacctcatatggcaaactgcgacctgtccgggcagctccccctccacctacacagaatcaccgaaggccagcagagaagattgaagatgtggaaatcacactggtgtgatgatgggcttgcccatccattactgctacaatcaaggccaggcttggagtttggccagtcttgttttttaggcacctttgcatgatgatgactcttgaacagagcaaaaaacaaggaggattatgtgtgactgggtggcctggtagactcctcccacgttttgaatatttcgtgccttttttttttgttgtcattttctatgtcatttctcctaccatagcacaaatcctagcggaccctaggagcaaagaggggggcagccctcatgcctaacagtggtctgtttttatatgagactcaagaacaggcctcattccagggcacagtccctaaattactgatcatgtgcactcgtacagtatattactgtgaccacaaggatgtggcaaagattctcatctttcttcaagtggcttttgctcatctgattgagaattaatcagatcatgttggctacataaggaaacagaaggagggatttcaggagaggctggctcctccccaaggttagtccccagactgagaaagtgaaaccttattgggaaaaattggactgccctgaatttagcaccaattgcattaacgcacatctcttccacaactaacagacttaaaataacagtgtccttcgtattaatatctgtgccattcatttagaattagcagagctaatatggaggggctgaactagtagccacatcttgttcatcacatagactaatagaaaggaggctgtggctaaagcagaaatggaacttccggatctgaaattagccaatataatgttcttttgtatttgggtatttttcatcttaatttttacagcatatactcttcttaccagtatccttagaatccaaatgtctagataagttgaggacacatacctgcattgttgagcttctctactggggacgccccggcattattttattcccaagccagcagaccggcccagacagccaggctgtggctggtccagaccaactgctatggtggaaaatgcagcttccaggtcccactaccctgacatttccgtggaaggaagaacctggtggctcgtggaggaaaccagctttctatgagaaaggactgaaggattgcgcaccctgcacaagtacagattgaccaggaaaagacaagtgtcttctgtgtgtcacagggaaagccaggagtggccttctctgcaggccagcaagcctgcagcagcaggtgcccccacgtcaggtgctgactgtccgctgtccgctcctgtagaaggtagggagcacaatacctagggactaagggatgttcgccggttgtggtttgtttttttttttttttccttggttaagaaatcaaatttgcagaatttaatctacaagttgtattatgctttgaaaactccatccctcctaagaatcttaaaaaacttgaaatgctcgccaaatgtccccatgggatttttgaccaaaagtaaggtgataactgaagaaatttttagttctttgatcacttcagtgacaatacccattaatgaatcttctccatgatttggggttttttttcgttgttgttttttacacttcttaacctgttgatctatttgaggtcttttgtgtttatcaaacttattcttaagtttaaaaaagaaattaaaagggtggtttttttaagattttaaagtttgctaacatattaaaaatcttcaaatgcttattaaatagagcagttcttgccacccagtcttgtattctgtctttagctagccaaattgtccttgaatttgggttttccacaacctcaaagggttatttgaaatcttttgttgtattttaaaatattttttggaagagctgctaattttattttaaaaaacaaagttgtgaaaacatgcctcctttttaaaaaataacccctccatccaggatatggaatccagcaccacagtgcacaggtcagggctcggagggagcctctgtgcagatgtgctttctttacagtggctgtaaaaagtttgtatttattatgtataaaatgttgaataataaaaaaaatggaatta

SEQ ID NO: 24280 - DNA, 3466 bp, Homo sapiens
ttgagtttttgttatggttttattctgtttagttttttaaagtaaaacttcacctcattatgaaagttttacagcatttaaatttttatgttcaacatgtttctcaaaatcatttcaatattttgatccccagtttttgtcatgatcagctcacatctgctccttatctaacctttttaattttgtccatgaccatcctacactgcaggcttctcaaccagatgagttgaccattgaggaacatgaggtgttagaagtgattgaagatggagatatggaagactgggtaaaggtatattcctttgctcatatcgccctttcttgtgacatttttaggagtttgttttggtctttgttgtgccctgtctaaattgtgtgtgtaaacttgttttgtcacatgtcttttacccaggcgctcgaaataaagttggccaagtgggttatgtgccagaaaagtacctacagtttcccacctcgaacagcctcctgagcatgctgcagtccctggccgctttggacagtcggtcacacacgtccagcaattccacggaagcagaactcgtttcaggcagcctcaacggagatgccagtggtaaagactgaaacaaggcactctttatttggtcacgtttgacctaaactgtattgccctggagtaagccttcagtaggataaaaagcacaactttcctcctgtcctataatatgcttttctttatatggtcacgtttgtcctgcacagtagaaccctaaagttaatcattcatcagtgagtaaaaaaattacaactttaatcctattctgtatgatgctcttttagttgtcatgtgagcataggggtggttgcaaaagcaaccggctgttaattatcttaccagatttgtttttctcttgctccctagtatgttttgtgaaagcactttatgattatgagggccagacagatgatgagttatcttttcctgagggagcaataatccgtatcttgaacaaagaaaaccaagatgatgatggcttctgggaaggggaattcaatgggcgtattggagttttcccatcggtgctagtggaagaactttcagcctcagaaaatggtgacactccatggatgagagagattcagatctctccttcccccaagccacacgcctccctgcctccactgccgttgtacgaccagcctcccagcagcccctaccccagcccagataagaggagctccctgtactttccccggtctccttcagcaaacgaaaaaagccttcatgctgagtcaccaggattctcacaggcatcaaggcatactcctgagacctcatatggcaaactgcgacctgtccgggcagctccccctccacctacacagaatcaccgaaggccagcagagaagattgaagatgtggaaatcacactggtgtgatgatgggcttgcccatccattactgctacaatcaaggccaggcttggagtttggccagtcttgttttttaggcacctttgcatgatgatgactcttgaacagagcaaaaaacaaggaggattatgtgtgactgggtggcctggtagactcctcccacgttttgaatatttcgtgccttttttttttgttgtcattttctatgtcatttctcctaccatagcacaaatcctagcggaccctaggagcaaagaggggggcagccctcatgcctaacagtggtctgtttttatatgagactcaagaacaggcctcattccagggcacagtccctaaattactgatcatgtgcactcgtacagtatattactgtgaccacaaggatgtggcaaagattctcatctttcttcaagtggcttttgctcatctgattgagaattaatcagatcatgttggctacataaggaaacagaaggagggatttcaggagaggctggctcctccccaaggttagtccccagactgagaaagtgaaaccttattgggaaaaattggactgccctgaatttagcaccaattgcattaacgcacatctcttccacaactaacagacttaaaataacagtgtccttcgtattaatatctgtgccattcatttagaattagcagagctaatatggaggggctgaactagtagccacatcttgttcatcacatagactaatagaaaggaggctgtggctaaagcagaaatggaacttccggatctgaaattagccaatataatgttcttttgtatttgggtatttttcatcttaatttttacagcatatactcttcttaccagtatccttagaatccaaatgtctagataagttgaggacacatacctgcattgttgagcttctctactggggacgccccggcattattttattcccaagccagcagaccggcccagacagccaggctgtggctggtccagaccaactgctatggtggaaaatgcagcttccaggtcccactaccctgacatttccgtggaaggaagaacctggtggctcgtggaggaaaccagctttctatgagaaaggactgaaggattgcgcaccctgcacaagtacagattgaccaggaaaagacaagtgtcttctgtgtgtcacagggaaagccaggagtggccttctctgcaggccagcaagcctgcagcagcaggtgcccccacgtcaggtgctgactgtccgctgtccgctcctgtagaaggtagggagcacaatacctagggactaagggatgttcgccggttgtggtttgtttttttttttttttccttggttaagaaatcaaatttgcagaatttaatctacaagttgtattatgctttgaaaactccatccctcctaagaatcttaaaaaacttgaaatgctcgccaaatgtccccatgggatttttgaccaaaagtaaggtgataactgaagaaatttttagttctttgatcacttcagtgacaatacccattaatgaatcttctccatgatttggggttttttttcgttgttgttttttacacttcttaacctgttgatctatttgaggtcttttgtgtttatcaaacttattcttaagtttaaaaaagaaattaaaagggtggtttttttaagattttaaagtttgctaacatattaaaaatcttcaaatgcttattaaatagagcagttcttgccacccagtcttgtattctgtctttagctagccaaattgtccttgaatttgggttttccacaacctcaaagggttatttgaaatcttttgttgtattttaaaatattttttggaagagctgctaattttattttaaaaaacaaagttgtgaaaacatgcctcctttttaaaaaataacccctccatccaggatatggaatccagcaccacagtgcacaggtcagggctcggagggagcctctgtgcagatgtgctttctttacagtggctgtaaaaagtttgtatttattatgtataaaatgttgaataataaaaaaaatggaatta

SEQ ID NO: 24281 - DNA, 2285 bp, Homo sapiens
atagtgaagactaggttgaaagcacgtgctcacaacatttctgagacccctagggtgcccatgtccttggacagatgagtgattaggttttggggatgcttcagatactgagtcaggaactgactgacaaactacgtaattgtttcctgctcaggtccgggcagctccccctccacctacacagaatcaccgaaggccagcagagaagattgaagatgtggaaatcacactggtgtgatgatgggcttgcccatccattactgctacaatcaaggccaggcttggagtttggccagtcttgttttttaggcacctttgcatgatgatgactcttgaacagagcaaaaaacaaggaggattatgtgtgactgggtggcctggtagactcctcccacgttttgaatatttcgtgccttttttttttgttgtcattttctatgtcatttctcctaccatagcacaaatcctagcggaccctaggagcaaagaggggggcagccctcatgcctaacagtggtctgtttttatatgagactcaagaacaggcctcattccagggcacagtccctaaattactgatcatgtgcactcgtacagtatattactgtgaccacaaggatgtggcaaagattctcatctttcttcaagtggcttttgctcatctgattgagaattaatcagatcatgttggctacataaggaaacagaaggagggatttcaggagaggctggctcctccccaaggttagtccccagactgagaaagtgaaaccttattgggaaaaattggactgccctgaatttagcaccaattgcattaacgcacatctcttccacaactaacagacttaaaataacagtgtccttcgtattaatatctgtgccattcatttagaattagcagagctaatatggaggggctgaactagtagccacatcttgttcatcacatagactaatagaaaggaggctgtggctaaagcagaaatggaacttccggatctgaaattagccaatataatgttcttttgtatttgggtatttttcatcttaatttttacagcatatactcttcttaccagtatccttagaatccaaatgtctagataagttgaggacacatacctgcattgttgagcttctctactggggacgccccggcattattttattcccaagccagcagaccggcccagacagccaggctgtggctggtccagaccaactgctatggtggaaaatgcagcttccaggtcccactaccctgacatttccgtggaaggaagaacctggtggctcgtggaggaaaccagctttctatgagaaaggactgaaggattgcgcaccctgcacaagtacagattgaccaggaaaagacaagtgtcttctgtgtgtcacagggaaagccaggagtggccttctctgcaggccagcaagcctgcagcagcaggtgcccccacgtcaggtgctgactgtccgctgtccgctcctgtagaaggtagggagcacaatacctagggactaagggatgttcgccggttgtggtttgtttttttttttttttccttggttaagaaatcaaatttgcagaatttaatctacaagttgtattatgctttgaaaactccatccctcctaagaatcttaaaaaacttgaaatgctcgccaaatgtccccatgggatttttgaccaaaagtaaggtgataactgaagaaatttttagttctttgatcacttcagtgacaatacccattaatgaatcttctccatgatttggggttttttttcgttgttgttttttacacttcttaacctgttgatctatttgaggtcttttgtgtttatcaaacttattcttaagtttaaaaaagaaattaaaagggtggtttttttaagattttaaagtttgctaacatattaaaaatcttcaaatgcttattaaatagagcagttcttgccacccagtcttgtattctgtctttagctagccaaattgtccttgaatttgggttttccacaacctcaaagggttatttgaaatcttttgttgtattttaaaatattttttggaagagctgctaattttattttaaaaaacaaagttgtgaaaacatgcctcctttttaaaaaataacccctccatccaggatatggaatccagcaccacagtgcacaggtcagggctcggagggagcctctgtgcagatgtgctttctttacagtggctgtaaaaagtttgtatttattatgtataaaatgttgaataataaaaaaaatggaatta

SEQ ID NO: 24282 - DNA, 4184 bp, Homo sapiens
gggaagcagaatgtgatttgcttgaagatatgaggacattcagtcagaagaaggctgctattgaaagagagtatgcacagtattccattgtatggatataccacagtttatccattttcctgttgatggacatggtatgcagaagttggctagtcaatacctgaagagagattggcctggagtaaaagctgatgatcggaatgattacaggagcatgtatcccgtttggaaatcttttctcgagggaacaatgcaggtagcccagtctcggatgaatatatgtgaaaactataaaaacttcatttctgagcctgcaaggacagtgagaagcttaaaagaacagcaactaaaaaggtgtgtggaccagttgacaaagatccaaactgaattacaagagacagtgaaagatttagctaaaggcaaaaagaaatactttgagactgaacagatggctcatgcagtacgagagaaagctgacatcgaggcaaaatctaaacttagtctttttcaatcaagaatcagtttacagaaggcaagtgtaaagttaaaagcccggcgatctgagtgtaattccaaagctacccacgcaaggaatgattatcttcttaccctagcggcagcaaatgcacatcaggatcgctactatcaaacagatttagttaacattatgaaggctcttgatggaaatgtgtatgatcatctcaaggattatttaatagccttcagccggactgagctagaaacatgccaagctgtgcagaacacattccagtttttattagaaaactccagcaaggtggtccgggactacaatcttcagctgtttttgcaagaaaacgctgtatttcacaaaccccagcccttccagttccagccttgtgacagtgatactagccgacagttagaatcagaaactgggaccacagaggagcacagtctaaataaggaagctcgaaaatgggccacacgtgtggcacgtgagcataaaaacattgttcaccaacaacgggttctaaatgatctggagtgtcatggagctgctgtatcagaacaaagccgagcagagctagaacagaaaatagatgaagctagagaaaatattcgtaaagcagagataattaaattgaaagctgaagcccggttggacctgctaaagcagattggtgtttctgtggacacatggctaaagagtgccatgaaccaagtaatggaagaactggaaaatgagcgatgggcccgccctcctgcagtgaccagtaatggcactttacactcgcttaatgcagataccgaaagagaagaaggcgaagagtttgaagataacatggatgttttcgatgacagcagttccagcccttctggcaccttaagaaattatccactcacctgcaaagttgtttattcctacaaggcttctcaaccagatgagttgaccattgaggaacatgaggtgttagaagtgattgaagatggagatatggaagactgggtaaaggctcgaaataaagttggccaagtgggttatgtgccagaaaagtacctacagtttcccacctcgaacagcctcctgagcatgctgcagtccctggccgctttggacagtcggtcacacacgtccagcaattccacggaagcagaactcgtttcaggcagcctcaacggagatgccagtgtatgttttgtgaaagcactttatgattatgagggccagacagatgatgagttatcttttcctgagggagcaataatccgtatcttgaacaaagaaaaccaagatgatgatggcttctgggaaggggaattcaatgggcgtattggagttttcccatcggtgctagtggaagaactttcagcctcagaaaatggtgacactccatggatgagagagattcagatctctccttcccccaagccacacgcctccctgcctccactgccgttgtacgaccagcctcccagcagcccctaccccagcccagataagaggagctccctgtactttccccggtctccttcagcaaacgaaaaaagccttcatgctgagtcaccaggattctcacaggcatcaaggcatactcctgagacctcatatggcaaactgcgacctgtccgggcagctccccctccacctacacagaatcaccgaaggccagcagagaagattgaagatgtggaaatcacactggtgtgatgatgggcttgcccatccattactgctacaatcaaggccaggcttggagtttggccagtcttgttttttaggcacctttgcatgatgatgactcttgaacagagcaaaaaacaaggaggattatgtgtgactgggtggcctggtagactcctcccacgttttgaatatttcgtgccttttttttttgttgtcattttctatgtcatttctcctaccatagcacaaatcctagcggaccctaggagcaaagaggggggcagccctcatgcctaacagtggtctgtttttatatgagactcaagaacaggcctcattccagggcacagtccctaaattactgatcatgtgcactcgtacagtatattactgtgaccacaaggatgtggcaaagattctcatctttcttcaagtggcttttgctcatctgattgagaattaatcagatcatgttggctacataaggaaacagaaggagggatttcaggagaggctggctcctccccaaggttagtccccagactgagaaagtgaaaccttattgggaaaaattggactgccctgaatttagcaccaattgcattaacgcacatctcttccacaactaacagacttaaaataacagtgtccttcgtattaatatctgtgccattcatttagaattagcagagctaatatggaggggctgaactagtagccacatcttgttcatcacatagactaatagaaaggaggctgtggctaaagcagaaatggaacttccggatctgaaattagccaatataatgttcttttgtatttgggtatttttcatcttaatttttacagcatatactcttcttaccagtatccttagaatccaaatgtctagataagttgaggacacatacctgcattgttgagcttctctactggggacgccccggcattattttattcccaagccagcagaccggcccagacagccaggctgtggctggtccagaccaactgctatggtggaaaatgcagcttccaggtcccactaccctgacatttccgtggaaggaagaacctggtggctcgtggaggaaaccagctttctatgagaaaggactgaaggattgcgcaccctgcacaagtacagattgaccaggcaggccagcaagcctgcagcagcaggtgcccccacgtcaggtgctgactgtccgctgtccgctcctgtagaaggtagggagcacaatacctagggactaagggatgttcgccggttgtggtttgtttttttttttttttccttggttaagaaatcaaatttgcagaatttaatctacaagttgtattatgctttgaaaactccatccctcctaagaatcttaaaaaacttgaaatgctcgccaaatgtccccatgggatttttgaccaaaagtaaggtgataactgaagaaatttttagttctttgatcacttcagtgacaatacccattaatgaatcttctccatgatttggggttttttttcgttgttgttttttacacttcttaacctgttgatctatttgaggtcttttgtgtttatcaaacttattcttaagtttaaaaaagaaattaaaagggtggtttttttaagattttaaagtttgctaacatattaaaaatcttcaaatgcttattaaatagagcagttcttgccacccagtcttgtattctgtctttagctagccaaattgtccttgaatttgggttttccacaacctcaaagggttatttgaaatcttttgttgtattttaaaatattttttggaagagctgctaattttattttaaaaaacaaagttgtgaaaacatgcctcctttttaaaaaataacccctccatccaggatatggaatccagcaccacagtgcacaggtcagggctcggagggagcctctgtgcagatgtgctttctttacagtggctgtaaaaagtttgtatttattatgtataaaatgttgaataataaaaaaaatggaatta

SEQ ID NO: 24283 - DNA, 2013 bp, Homo sapiens
ttgagtttttgttatggttttattctgtttagttttttaaagtaaaacttcacctcattatgaaagttttacagcatttaaatttttatgttcaacatgtttctcaaaatcatttcaatattttgatccccagtttttgtcatgatcagctcacatctgctccttatctaacctttttaattttgtccatgaccatcctacactgcaggcttctcaaccagatgagttgaccattgaggaacatgaggtgttagaagtgattgaagatggagatatggaagactgggtaaaggtatattcctttgctcatatcgccctttcttgtgacatttttaggagtttgttttggtctttgttgtgccctgtctaaattgtgtgtgtaaacttgttttgtcacatgtcttttacccaggcgttggctacataaggaaacagaaggagggatttcaggagaggctggctcctccccaaggttagtccccagactgagaaagtgaaaccttattgggaaaaattggactgccctgaatttagcaccaattgcattaacgcacatctcttccacaactaacagacttaaaataacagtgtccttcgtattaatatctgtgccattcatttagaattagcagagctaatatggaggggctgaactagtagccacatcttgttcatcacatagactaatagaaaggaggctgtggctaaagcagaaatggaacttccggatctgaaattagccaatataatgttcttttgtatttgggtatttttcatcttaatttttacagcatatactcttcttaccagtatccttagaatccaaatgtctagataagttgaggacacatacctgcattgttgagcttctctactggggacgccccggcattattttattcccaagccagcagaccggcccagacagccaggctgtggctggtccagaccaactgctatggtggaaaatgcagcttccaggtcccactaccctgacatttccgtggaaggaagaacctggtggctcgtggaggaaaccagctttctatgagaaaggactgaaggattgcgcaccctgcacaagtacagattgaccaggaaaagacaagtgtcttctgtgtgtcacagggaaagccaggagtggccttctctgcaggccagcaagcctgcagcagcaggtgcccccacgtcaggtgctgactgtccgctgtccgctcctgtagaaggtagggagcacaatacctagggactaagggatgttcgccggttgtggtttgtttttttttttttttccttggttaagaaatcaaatttgcagaatttaatctacaagttgtattatgctttgaaaactccatccctcctaagaatcttaaaaaacttgaaatgctcgccaaatgtccccatgggatttttgaccaaaagtaaggtgataactgaagaaatttttagttctttgatcacttcagtgacaatacccattaatgaatcttctccatgatttggggttttttttcgttgttgttttttacacttcttaacctgttgatctatttgaggtcttttgtgtttatcaaacttattcttaagtttaaaaaagaaattaaaagggtggtttttttaagattttaaagtttgctaacatattaaaaatcttcaaatgcttattaaatagagcagttcttgccacccagtcttgtattctgtctttagctagccaaattgtccttgaatttgggttttccacaacctcaaagggttatttgaaatcttttgttgtattttaaaatattttttggaagagctgctaattttattttaaaaaacaaagttgtgaaaacatgcctcctttttaaaaaataacccctccatccaggatatggaatccagcaccacagtgcacaggtcagggctcggagggagcctctgtgcagatgtgctttctttacagtggctgtaaaaagtttgtatttattatgtataaaatgttgaataataaaaaaaatggaatta

SEQ ID NO: 24284 - DNA, 4293 bp, Homo sapiens
gggaagcagaatgtgatttgcttgaagatatgaggacattcagtcagaagaaggctgctattgaaagagagtatgcacagtattccattgtatggatataccacagtttatccattttcctgttgatggacatggtatgcagaagttggctagtcaatacctgaagagagattggcctggagtaaaagctgatgatcggaatgattacaggagcatgtatcccgtttggaaatcttttctcgagggaacaatgcaggtagcccagtctcggatgaatatatgtgaaaactataaaaacttcatttctgagcctgcaaggacagtgagaagcttaaaagaacagcaactaaaaaggtgtgtggaccagttgacaaagatccaaactgaattacaagagacagtgaaagatttagctaaaggcaaaaagaaatactttgagactgaacagatggctcatgcagtacgagagaaagctgacatcgaggcaaaatctaaacttagtctttttcaatcaagaatcagtttacagaaggcaagtgtaaagttaaaagcccggcgatctgagtgtaattccaaagctacccacgcaaggaatgattatcttcttaccctagcggcagcaaatgcacatcaggatcgctactatcaaacagatttagttaacattatgaaggctcttgatggaaatgtgtatgatcatctcaaggattatttaatagccttcagccggactgagctagaaacatgccaagctgtgcagaacacattccagtttttattagaaaactccagcaaggtggtccgggactacaatcttcagctgtttttgcaagaaaacgctgtatttcacaaaccccagcccttccagttccagccttgtgacagtgatactagccgacagttagaatcagaaactgggaccacagaggagcacagtctaaataaggaagctcgaaaatgggccacacgtgtggcacgtgagcataaaaacattgttcaccaacaacgggttctaaatgatctggagtgtcatggagctgctgtatcagaacaaagccgagcagagctagaacagaaaatagatgaagctagagaaaatattcgtaaagcagagataattaaattgaaagctgaagcccggttggacctgctaaagcagattggtgtttctgtggacacatggctaaagagtgccatgaaccaagtaatggaagaactggaaaatgagcgatgggcccgccctcctgcagtgaccagtaatggcactttacactcgcttaatgcagataccgaaagagaagaaggcgaagagtttgaagataacatggatgttttcgatgacagcagttccagcccttctggcaccttaagaaattatccactcacctgcaaagttgtttattcctacaaggcttctcaaccagatgagttgaccattgaggaacatgaggtgttagaagtgattgaagatggagatatggaagactgggtaaaggctcgaaataaagttggccaagtgggttatgtgccagaaaagtacctacagtttcccacctcgaacagcctcctgagcatgctgcagtccctggccgctttggacagtcggtcacacacgtccagcaattccacggaagcagaactcgtttcaggcagcctcaacggagatgccagtgtatgttttgtgaaagcactttatgattatgagggccagacagatgatgagttatcttttcctgagggagcaataatccgtatcttgaacaaagaaaaccaagatgatgatggcttctgggaaggggaattcaatgggcgtattggagttttcccatcggtgctagtggaagaactttcagcctcagaaaatggtgacactccatggatgagagagattcagatctctccttcccccaagccacacgcctccctgcctccactgccgttgtacgaccagcctcccagcagcccctaccccagcccagataagaggagctccctgtactttccccggtctccttcagcaaacgaaaaaagccttcatgctgagtcaccaggattctcacaggcatcaaggcatactcctgagacctcatatggcaaactgcgacctgtccgggcagctccccctccacctacacagaatcaccgaaggccagcagagaagattgaagatgtggaaatcacactggtgtgatgatgggcttgcccatccattactgctacaatcaaggccaggcttggagtttggccagtcttgttttttaggcacctttgcatgatgatgactcttgaacagagcaaaaaacaaggaggattatgtgtgactgggtggcctggtagactcctcccacgttttgaatatttcgtgccttttttttttgttgtcattttctatgtcatttctcctaccatagcacaaatcctagcggaccctaggagcaaagaggggggcagccctcatgcctaacagtggtctgtttttatatgagactcaagaacaggcctcattccagggcacagtccctaaattactgatcatgtgcactcgtacagtatattactgtgaccacaaggatgtggcaaagattctcatctttcttcaagtggcttttgctcatctgattgagaattaatcagatcatgttggctacataaggaaacagaaggagggatttcaggagaggctggctcctccccaaggttagtccccagactgagaaagtgaaaccttattgggaaaaattggactgccctgaatttagcaccaattgcattaacgcacatctcttccacaactaacagacttaaaataacagtgtccttcgtattaatatctgtgccattcatttagaattagcagagctaatatggaggggctgaactagtagccacatcttgttcatcacatagactaatagaaaggaggctgtggctaaagcagaaatggaacttccggatctgaaattagccaatataatgttcttttgtatttgggtatttttcatcttaatttttacagcatatactcttcttaccagtatccttagaatccaaatgtctagataagttgaggacacatacctgcattgttgagcttctctactggggacgccccggcattattttattcccaagccagcagaccggcccagacagccaggctgtggctggtccagaccaactgctatggtggaaaatgcagcttccaggtcccactaccctgacatttccgtggaaggaagaacctggtggctcgtggaggaaaccagctttctatgagaaaggactgaaggattgcgcaccctgcacaagtacagattgaccaggaaaagacaagtgtcttctgtgtgtcacagggaaagccaggagtggccttctctgcaggccagcaagcctgcagcagcaggtgcccccacgtcaggtgctgactgtccgctgtccgctcctgtagaaggtagggagcacaatacctagggactaagggatgttcgccggttgtggtttgtttttttttttttttccttggttaagaaatcaaatttgcagaatttaatctacaagttgtattatgctttgaaaactccatccctcctaagaatcttaaaaaacttgaaatgctcgccaaatgtccccatgggatttttgaccaaaagtaaggtgataactgaagaaatttttagttctttgatcacttcagtgacaatacccattaatgaatcttctccatgatttggggttttttttcgttgttgttttttacacttcttaacctgttgatctatttgaggtcttttgtgtttatcaaacttattcttaagtttaaaaaagaaattaaaagggtggtttttttaagattttaaagtttgctaacatattaaaaatcttcaaatgcttattaaatagagcagttcttgccacccagtcttgtattctgtctttagctagccaaattgtccttgaatttgggttttccacaacctcaaagggttatttgaaatcttttgttgtattttaaaatattttttggaagagctgctaattttattttaaaaaacaaagttgtgaaaacatgcctcctttttaaaaaataacccctccatccaggatatggaatccagcaccacagtgcacaggtcagggctcggagggagcctctgtgcagatgtgctttctttacagtggctgtaaaaagtttgtatttattatgtataaaatgttgaataataaaaaaaatggaattatgatttctaagttttaatatagaaaggtttgggtaaacagacctttccaaaaggc

SEQ ID NO: 24285 - DNA, 3359 bp, Homo sapiens
gggaagcagaatgtgatttgcttgaagatatgaggacattcagtcagaagaaggctgctattgaaagagagtatgcacagtattccattgtatggatataccacagtttatccattttcctgttgatggacatggtatgcagaagttggctagtcaatacctgaagagagattggcctggagtaaaagctgatgatcggaatgattacaggagcatgtatcccgtttggaaatcttttctcgagggaacaatgcaggtagcccagtctcggatgaatatatgtgaaaactataaaaacttcatttctgagcctgcaaggacagtgagaagcttaaaagaacagcaactaaaaaggtgtgtggaccagttgacaaagatccaaactgaattacaagagacagtgaaagatttagctaaaggcaaaaagaaatactttgagactgaacagatggctcatgcagtacgagagaaagctgacatcgaggcaaaatctaaacttagtctttttcaatcaagaatcagtttacagaaggcaagtgtaaagttaaaagcccggcgatctgagtgtaattccaaagctacccacgcaaggaatgattatcttcttaccctagcggcagcaaatgcacatcaggatcgctactatcaaacagatttagttaacattatgaaggctcttgatggaaatgtgtatgatcatctcaaggattatttaatagccttcagccggactgagctagaaacatgccaagctgtgcagaacacattccagtttttattagaaaactccagcaaggtggtccgggactacaatcttcagctgtttttgcaagaaaacgctgtatttcacaaaccccagcccttccagttccagccttgtgacagtgatactagccgacagttagaatcagaaactgggaccacagaggagcacagtctaaataaggaagctcgaaaatgggccacacgtgtggcacgtgagcataaaaacattgttcaccaacaacgggttctaaatgatctggagtgtcatggagctgctgtatcagaacaaagccgagcagagctagaacagaaaatagatgaagctagagaaaatattcgtaaagcagagataattaaattgaaagctgaagcccggttggacctgctaaagcagattggtgtttctgtggacacatggctaaagagtgccatgaaccaagtaatggaagaactggaaaatgagcgatgggcccgccctcctgcagtgaccagtaatggcactttacactcgcttaatgcagataccgaaagagaagaaggcgaagagtttgaagataacatggatgttttcgatgacagcagttccagcccttctggcaccttaagaaattatccactcacctgcaaagttgtttattcctacaaggcttctcaaccagatgagttgaccattgaggaacatgaggtgttagaagtgattgaagatggagatatggaagactgggtaaaggctcgaaataaagttggccaagtgggttatgtgccagaaaagtacctacagtttcccacctcgaacagcctcctgagcatgctgcagtccctggccgctttggacagtcggtcacacacgtccagcaattccacggaagcagaactcgtttcaggcagcctcaacggagatgccagtgtatgttttgtgaaagcactttatgattatgagggccagacagatgatgagttatcttttcctgagggagcaataatccgtatcttgaacaaagaaaaccaagatgatgatggcttctgggaaggggaattcaatgggcgtattggagttttcccatcggtgctagtggaagaactttcagcctcagaaaatggtgacactccatggatgagagagattcagatctctccttcccccaagccacacgcctccctgcctccactgccgttgtacgaccagcctcccagcagcccctaccccagcccagataagaggagctccctgtactttccccggtctccttcagcaaacgaaaaaagccttcatgctgagtcaccaggattctcacaggcatcaaggcatactcctgagacctcatatggcaaactgcgacctgtccgggcagctccccctccacctacacagaatcaccgaaggccagcagagaagattgaagatgtggaaatcacactggtgtgatgatgggcttgcccatccattactgctacaatcaaggccaggcttggagtttggccagtcttgttttttaggcacctttgcatgatgatgactcttgaacagagcaaaaaacaaggaggattatgtgtgactgggtggcctggtagactcctcccacgttttgaatatttcgtgccttttttttttgttgtcattttctatgtcatttctcctaccatagcacaaatcctagcggaccctaggagcaaagaggggggcagccctcatgcctaacagtggtctgtttttatatgagactcaagaacaggcctcattccagggcacagtccctaaattactgatcatgtgcactcgtacagtatattactgtgaccacaaggatgtggcaaagattctcatctttcttcaagtggcttttgctcatctgattgagaattaatcagatcatgttggctacataaggaaacagaaggagggatttcaggagaggctggctcctccccaaggttagtccccagactgagaaagtgaaaccttattgggaaaaattggactgccctgaatttagcaccaattgcattaacgcacatctcttccacaactaacagacttaaaataacagtgtccttcgtattaatatctgtgccattcatttagaattagcagagctaatatggaggggctgaactagtagccacatcttgttcatcacatagactaatagaaaggaggctgtggctaaagcagaaatggaacttccggatctgaaattagccaatataatgttcttttgtatttgggtatttttcatcttaatttttacagcatatactcttcttaccagtatccttagaatccaaatgtctagataagttgaggacacatacctgcattgttgagcttctctactggggacgccccggcattattttattcccaagccagcagaccggcccagacagccaggctgtggctggtccagaccaactgctatggtggaaaatgcagcttccaggtcccactaccctgacatttccgtggaaggaagaacctggtggctcgtggaggaaaccagctttctatgagaaaggactgaaggattgcgcaccggacagtcagatgacaggaaagaccaggggtccgggggccggcagaggggcctctggcc

SEQ ID NO: 24286 - DNA, 3327 bp, Homo sapiens
gggaagcagaatgtgatttgcttgaagatatgaggacattcagtcagaagaaggctgctattgaaagagagtatgcacagtattccattgtatggatataccacagtttatccattttcctgttgatggacatggtatgcagaagttggctagtcaatacctgaagagagattggcctggagtaaaagctgatgatcggaatgattacaggagcatgtatcccgtttggaaatcttttctcgagggaacaatgcaggtagcccagtctcggatgaatatatgtgaaaactataaaaacttcatttctgagcctgcaaggacagtgagaagcttaaaagaacagcaactaaaaaggtgtgtggaccagttgacaaagatccaaactgaattacaagagacagtgaaagatttagctaaaggcaaaaagaaatactttgagactgaacagatggctcatgcagtacgagagaaagctgacatcgaggcaaaatctaaacttagtctttttcaatcaagaatcagtttacagaaggcaagtgtaaagttaaaagcccggcgatctgagtgtaattccaaagctacccacgcaaggaatgattatcttcttaccctagcggcagcaaatgcacatcaggatcgctactatcaaacagatttagttaacattatgaaggctcttgatggaaatgtgtatgatcatctcaaggattatttaatagccttcagccggactgagctagaaacatgccaagctgtgcagaacacattccagtttttattagaaaactccagcaaggtggtccgggactacaatcttcagctgtttttgcaagaaaacgctgtatttcacaaaccccagcccttccagttccagccttgtgacagtgatactagccgacagttagaatcagaaactgggaccacagaggagcacagtctaaataaggaagctcgaaaatgggccacacgtgtggcacgtgagcataaaaacattgttcaccaacaacgggttctaaatgatctggagtgtcatggagctgctgtatcagaacaaagccgagcagagctagaacagaaaatagatgaagctagagaaaatattcgtaaagcagagataattaaattgaaagctgaagcccggttggacctgctaaagcagattggtgtttctgtggacacatggctaaagagtgccatgaaccaagtaatggaagaactggaaaatgagcgatgggcccgccctcctgcagtgaccagtaatggcactttacactcgcttaatgcagataccgaaagagaagaaggcgaagagtttgaagataacatggatgttttcgatgacagcagttccagcccttctggcaccttaagaaattatccactcacctgcaaagttgtttattcctacaaggcttctcaaccagatgagttgaccattgaggaacatgaggtgttagaagtgattgaagatggagatatggaagactgggtaaaggctcgaaataaagttggccaagtgggttatgtgccagaaaagtacctacagtttcccacctcgaacagcctcctgagcatgctgcagtccctggccgctttggacagtcggtcacacacgtccagcaattccacggaagcagaactcgtttcaggcagcctcaacggagatgccagtgtatgttttgtgaaagcactttatgattatgagggccagacagatgatgagttatcttttcctgagggagcaataatccgtatcttgaacaaagaaaaccaagatgatgatggcttctgggaaggggaattcaatgggcgtattggagttttcccatcggtgctagtggaagaactttcagcctcagaaaatggtgacactccatggatgagagagattcagatctctccttcccccaagccacacgcctccctgcctccactgccgttgtacgaccagcctcccagcagcccctaccccagcccagataagaggagctccctgtactttccccggtctccttcagcaaacgaaaaaagccttcatgctgagtcaccaggattctcacaggcatcaaggcatactcctgagacctcatatggcaaactgcgacctgtccgggcagctccccctccacctacacagaatcaccgaaggccagcagagaagattgaagatgtggaaatcacactggtgtgatgatgggcttgcccatccattactgctacaatcaaggccaggcttggagtttggccagtcttgttttttaggcacctttgcatgatgatgactcttgaacagagcaaaaaacaaggaggattatgtgtgactgggtggcctggtagactcctcccacgttttgaatatttcgtgccttttttttttgttgtcattttctatgtcatttctcctaccatagcacaaatcctagcggaccctaggagcaaagaggggggcagccctcatgcctaacagtggtctgtttttatatgagactcaagaacaggcctcattccagggcacagtccctaaattactgatcatgtgcactcgtacagtatattactgtgaccacaaggatgtggcaaagattctcatctttcttcaagtggcttttgctcatctgattgagaattaatcagatcatgttggctacataaggaaacagaaggagggatttcaggagaggctggctcctccccaaggttagtccccagactgagaaagtgaaaccttattgggaaaaattggactgccctgaatttagcaccaattgcattaacgcacatctcttccacaactaacagacttaaaataacagtgtccttcgtattaatatctgtgccattcatttagaattagcagagctaatatggaggggctgaactagtagccacatcttgttcatcacatagactaatagaaaggaggctgtggctaaagcagaaatggaacttccggatctgaaattagccaatataatgttcttttgtatttggatttgggttttccacaacctcaaagggttatttgaaatcttttgttgtattttaaaatattttttggaagagctgctaattttattttaaaaaacaaagttgtgaaaacatgcctcctttttaaaaaataacccctccatccaggatatggaatccagcaccacagtgcacaggtcagggctcggagggagcctctgtgcagatgtgctttctttacagtggctgtaaaaagtttgtatttattatgtataaaatgttgaataataaaaaaaatggaattatgatttctaagttttaatatagaaaggtttgggtaaacagacctttccaaaaggc

SEQ ID NO: 24287 - DNA, 1992 bp, Homo sapiens
gggaagcagaatgtgatttgcttgaagatatgaggacattcagtcagaagaaggctgctattgaaagagagtatgcacagtattccattgtatggatataccacagtttatccattttcctgttgatggacatggtatgcagaagttggctagtcaatacctgaagagagattggcctggagtaaaagctgatgatcggaatgattacaggagcatgtatcccgtttggaaatcttttctcgagggaacaatgcaggtagcccagtctcggatgaatatatgtgaaaactataaaaacttcatttctgagcctgcaaggacagtgagaagcttaaaagaacagcaactaaaaaggtgtgtggaccagttgacaaagatccaaactgaattacaagagacagtgaaagatttagctaaaggcaaaaagaaatactttgagactgaacagatggctcatgcagtacgagagaaagctgacatcgaggcaaaatctaaacttagtctttttcaatcaagaatcagtttacagaaggcaagtgtaaagttaaaagcccggcgatctgagtgtaattccaaagctacccacgcaaggaatgattatcttcttaccctagcggcagcaaatgcacatcaggatcgctactatcaaacagatttagttaacattatgaaggctcttgatggaaatgtgtatgatcatctcaaggattatttaatagccttcagccggactgagctagaaacatgccaagctgtgcagaacacattccagtttttattagaaaactccagcaaggtggtccgggactacaatcttcagctgtttttgcaagaaaacgctgtatttcacaaaccccagcccttccagttccagccttgtgacagtgatactagccgacagttagaatcagaaactgggaccacagaggagcacagtctaaataaggaagctcgaaaatgggccacacgtgtggcacgtgagcataaaaacattgttcaccaacaacgggttctaaatgatctggagtgtcatggagctgctgtatcagaacaaagccgagcagagctagaacagaaaatagatgaagctagagaaaatattcgtaaagcagagataattaaattgaaagctgaagcccggttggacctgctaaagcagattggtgtttctgtggacacatggctaaagagtgccatgaaccaagtaatggaagaactggaaaatgagcgatgggcccgccctcctgcagtgaccagtaatggcactttacactcgcttaatgcagataccgaaagagaagaaggcgaagagtttgaagataacatggatgttttcgatgacagcagttccagcccttctggcaccttaagaaattatccactcacctgcaaagttgtttattcctacaaggcttctcaaccagatgagttgaccattgaggaacatgaggtgttagaagtgattgaagatggagatatggaagactgggtaaaggctcgaaataaagttggccaagtgggttatgtgccagaaaagtacctacagtttcccacctcgaacagcctcctgagcatgctgcagtccctggccgctttggacagtcggtcacacacgtccagcaattccacggaagcagaactcgtttcaggcagcctcaacggagatgccagtgtatgttttgtgaaagcactttatgattatgagggccagacagatgatgagttatcttttcctgagggagcaataatccgtatcttgaacaaagaaaaccaagatgatgatggcttctgggaaggggaattcaatgggcgtattggagttttcccatcggtgctagtggaagaactttcagcctcagaaaatggtgacactccatggatgagagagattcagatctctccttcccccaagccacacgcctccctgcctccactgccgttgtacgaccagcctcccagcagccccatctgttaataaatatctcaactcca

SEQ ID NO: 24288 - DNA, 862 bp, Homo sapiens
gtccgcctgccgcccgctggcctgctccctccggggcaagtcttgcttcttaagcgctcctttcacacacgcgcgcgctcgctgggccgtcccctcctctccggccctcctcctcctcctggtccttgctaacgctgccgtcggggaggattgatgtcccttcagcatcatgcagccgccgccgaggaaggacattcagtcagaagaaggctgctattgaaagagagtatgcacagggtatgcagaagttggctagtcaatacctgaagagagattggcctggagtaaaagctgatgatcggaatgattacaggagcatgtatcccgtttggaaatcttttctcgagggaacaatgcaggtagcccagtctcggatgaatatatgtgaaaactataaaaacttcatttctgagcctgcaaggacagtgagaagcttaaaagaacagcaactaaaaaggtgtgtggaccagttgacaaagatccaaactgaattacaagagacagtgaaagatttagctaaaggcaaaaagaaatactttgagactgaacagatggctcatgcagtacgagagaaagctgacatcgaggcaaaatctaaacttagtctttttcaatcaagaatcagtttacagaaggcaagtgtaaagttaaaagcccggcgatctgagtgtaattccaaagctacccacgcaaggaatgattatcttcttaccctagcggcagcaaatgcacatcaggatcgctactatcaaacagatttagttaacattatgaaggtgcggcaaacatttgttatctagtggttattgatgtagaagatacaagagtgatgtaagaaataaaataatgactcaaactggga

SEQ ID NO: 24289 - DNA, 564 bp, Homo sapiens
aaaaaaaaaaaaaactctattctttcataacatgaaaaatgtaagtgcgaaagatagtcatttctatgcagagttaaaaggcaaattaacattttgaaacaatcaggttttaagtgtttttccggctttcaaccattttcttgaagtaaggaaactagccaatggtttctaatttttcttagcttaatgcagataccgaaagagaagaaggcgaagagtttgaagataacatggatgttttcgatgacagcagttccagcccttctggcaccttaagaaattatccactcacctgcaaagttgtttattcctacaaggtttgtatttctccaacataatgttattaaattctgattaactctgaagatacacatgactgtatccatccagtctctcaagctgtacttagcataaaattgttattaggttaatattggggcaacataacagaatggtgatgagtttaggctctgacttgacgtctttcacttgctactccgtctgcctagaactctttttttccccaaatctcagttggttgtcccctgctcctcattgaagctc

SEQ ID NO: 24290 - DNA, 848 bp, Homo sapiens
gggtatcaggcactcttaggctcccagcccccatccacactctgctcacctctcctggtggttaatgtctttgaatcttttttagaaatagaagacaggctcttttaaaactgtaggaagacctagacatggattgagcttgtgcatgaaatggaatgactggcagtttattttgcacgtctttagtttgtaatatttatagtcgtgtattttcatttaacctctgttcaggctatttggctttaatttttcattaaataagtatcttcaataaataaaactagatggcgaatattggatttatggccttcaggggagaggcgagcaagagacatattctgacagatgtattttcctgaagcaatttttttgggttaaatttgtaaaaagaccttcataaatatatggtatattttaggtgaaagttacacaagaactgaaaaacattcaagttgagcagatgacaaaacttcaagccaaacatcaagcagaatgtgatttgcttgaagatatgaggtaaggctatagtaaatagttcaaggacttctgtttgtctgtttcaaagaacctttgagttaccaagccccaggaactgatgatggaatttccttttggatttcctgctttaaggctgttagaactttgactcagctggaaattagaactggaactaacacaatacaaactttttccttcagtgggggacctataatgcacacatagtattcagaaaaaacaaggaccttaaaagtcttactagtcaaattataataattaaagattcttgtttaaataatctttccacggaattgtaacaatcattttattgaccttaacggttttacaca

SEQ ID NO: 24291 - DNA, 1870 bp, Homo sapiens
gggaagcagaatgtgatttgcttgaagatatgaggacattcagtcagaagaaggctgctattgaaagagagtatgcacagtattccattgtatggatataccacagtttatccattttcctgttgatggacatggtatgcagaagttggctagtcaatacctgaagagagattggcctggagtaaaagctgatgatcggaatgattacaggagcatgtatcccgtttggaaatcttttctcgagggaacaatgcaggtagcccagtctcggatgaatatatgtgaaaactataaaaacttcatttctgagcctgcaaggacagtgagaagcttaaaagaacagcaactaaaaaggtgtgtggaccagttgacaaagatccaaactgaattacaagagacagtgaaagatttagctaaaggcaaaaagaaatactttgagactgaacagatggctcatgcagtacgagagaaagctgacatcgaggcaaaatctaaacttagtctttttcaatcaagaatcagtttacagaaggcaagtgtaaagttaaaagcccggcgatctgagtgtaattccaaagctacccacgcaaggaatgattatcttcttaccctagcggcagcaaatgcacatcaggatcgctactatcaaacagatttagttaacattatgaaggctcttgatggaaatgtgtatgatcatctcaaggattatttaatagccttcagccggactgagctagaaacatgccaagctgtgcagaacacattccagtttttattagaaaactccagcaaggtggtccgggactacaatcttcagctgtttttgcaagaaaacgctgtatttcacaaaccccagcccttccagttccagccttgtgacagtgatactagccgacagttagaatcagaaactgggaccacagaggagcacagtctaaataaggaagctcgaaaatgggccacacgtgtggcacgtgagcataaaaacattgttcaccaacaacgggttctaaatgatctggagtgtcatggagctgctgtatcagaacaaagccgagcagagctagaacagaaaatagatgaagctagagaaaatattcgtaaagcagagataattaaattgaaagctgaagcccggttggacctgctaaagcagattggtgtttctgtggacacatggctaaagagtgccatgaaccaagtaatggaagaactggaaaatgagcgatgggcccgccctcctgcagtgaccagtaatggcactttacactcgcttaatgcagataccgaaagagaagaaggcgaagagtttgaagataacatggatgttttcgatgacagcagttccagcccttctggcaccttaagaaattatccactcacctgcaaagttgtttattcctacaaggcttctcaaccagatgagttgaccattgaggaacatgaggtgttagaagtgattgaagatggagatatggaagactgggtaaaggctcgaaataaagttggccaagtgggttatgtgccagaaaagtacctacagtttcccacctcgaacagcctcctgagcatgctgcagtccctggccgctttggacagtcggtcacacacgtccagcaattccacggaagcagaactcgtttcaggcagcctcaacggagatgccagtggtaaagactgaaacaaggcactctttatttggtcacgtttgacctaaactgtattgccctggagtaagccttcagtaggataaaaagcacaactttcctcctgtcctataatatgcttttctttatatggtcacgtttgtcctgcacagtagaaccctaaagttaatcattcatcagtgagtaaaaaaattacaact

SEQ ID NO: 24292 - DNA, 4010 bp, Homo sapiens
ggtaaaggccccaaggtactccggggcactgcacattttatcattgggttgaaaaaacacgtataaaaacttcatttctgagcctgcaaggacagtgagaagcttaaaagaacagcaactaaaaaggtgtgtggaccagttgacaaagatccaaactgaattacaagagacagtgaaagatttagctaaaggcaaaaagaaatactttgagactgaacagatggctcatgcagtacgagagaaagctgacatcgaggcaaaatctaaacttagtctttttcaatcaagaatcagtttacagaaggcaagtgtaaagttaaaagcccggcgatctgagtgtaattccaaagctacccacgcaaggaatgattatcttcttaccctagcggcagcaaatgcacatcaggatcgctactatcaaacagatttagttaacattatgaaggctcttgatggaaatgtgtatgatcatctcaaggattatttaatagccttcagccggactgagctagaaacatgccaagctgtgcagaacacattccagtttttattagaaaactccagcaaggtggtccgggactacaatcttcagctgtttttgcaagaaaacgctgtatttcacaaaccccagcccttccagttccagccttgtgacagtgatactagccgacagttagaatcagaaactgggaccacagaggagcacagtctaaataaggaagctcgaaaatgggccacacgtgtggcacgtgagcataaaaacattgttcaccaacaacgggttctaaatgatctggagtgtcatggagctgctgtatcagaacaaagccgagcagagctagaacagaaaatagatgaagctagagaaaatattcgtaaagcagagataattaaattgaaagctgaagcccggttggacctgctaaagcagattggtgtttctgtggacacatggctaaagagtgccatgaaccaagtaatggaagaactggaaaatgagcgatgggcccgccctcctgcagtgaccagtaatggcactttacactcgcttaatgcagataccgaaagagaagaaggcgaagagtttgaagataacatggatgttttcgatgacagcagttccagcccttctggcaccttaagaaattatccactcacctgcaaagttgtttattcctacaaggcttctcaaccagatgagttgaccattgaggaacatgaggtgttagaagtgattgaagatggagatatggaagactgggtaaaggctcgaaataaagttggccaagtgggttatgtgccagaaaagtacctacagtttcccacctcgaacagcctcctgagcatgctgcagtccctggccgctttggacagtcggtcacacacgtccagcaattccacggaagcagaactcgtttcaggcagcctcaacggagatgccagtgtatgttttgtgaaagcactttatgattatgagggccagacagatgatgagttatcttttcctgagggagcaataatccgtatcttgaacaaagaaaaccaagatgatgatggcttctgggaaggggaattcaatgggcgtattggagttttcccatcggtgctagtggaagaactttcagcctcagaaaatggtgacactccatggatgagagagattcagatctctccttcccccaagccacacgcctccctgcctccactgccgttgtacgaccagcctcccagcagcccctaccccagcccagataagaggagctccctgtactttccccggtctccttcagcaaacgaaaaaagccttcatgctgagtcaccaggattctcacaggcatcaaggcatactcctgagacctcatatggcaaactgcgacctgtccgggcagctccccctccacctacacagaatcaccgaaggccagcagagaagattgaagatgtggaaatcacactggtgtgatgatgggcttgcccatccattactgctacaatcaaggccaggcttggagtttggccagtcttgttttttaggcacctttgcatgatgatgactcttgaacagagcaaaaaacaaggaggattatgtgtgactgggtggcctggtagactcctcccacgttttgaatatttcgtgccttttttttttgttgtcattttctatgtcatttctcctaccatagcacaaatcctagcggaccctaggagcaaagaggggggcagccctcatgcctaacagtggtctgtttttatatgagactcaagaacaggcctcattccagggcacagtccctaaattactgatcatgtgcactcgtacagtatattactgtgaccacaaggatgtggcaaagattctcatctttcttcaagtggcttttgctcatctgattgagaattaatcagatcatgttggctacataaggaaacagaaggagggatttcaggagaggctggctcctccccaaggttagtccccagactgagaaagtgaaaccttattgggaaaaattggactgccctgaatttagcaccaattgcattaacgcacatctcttccacaactaacagacttaaaataacagtgtccttcgtattaatatctgtgccattcatttagaattagcagagctaatatggaggggctgaactagtagccacatcttgttcatcacatagactaatagaaaggaggctgtggctaaagcagaaatggaacttccggatctgaaattagccaatataatgttcttttgtatttgggtatttttcatcttaatttttacagcatatactcttcttaccagtatccttagaatccaaatgtctagataagttgaggacacatacctgcattgttgagcttctctactggggacgccccggcattattttattcccaagccagcagaccggcccagacagccaggctgtggctggtccagaccaactgctatggtggaaaatgcagcttccaggtcccactaccctgacatttccgtggaaggaagaacctggtggctcgtggaggaaaccagctttctatgagaaaggactgaaggattgcgcaccctgcacaagtacagattgaccaggaaaagacaagtgtcttctgtgtgtcacagggaaagccaggagtggccttctctgcaggccagcaagcctgcagcagcaggtgcccccacgtcaggtgctgactgtccgctgtccgctcctgtagaaggtagggagcacaatacctagggactaagggatgttcgccggttgtggtttgtttttttttttttttccttggttaagaaatcaaatttgcagaatttaatctacaagttgtattatgctttgaaaactccatccctcctaagaatcttaaaaaacttgaaatgctcgccaaatgtccccatgggatttttgaccaaaagtaaggtgataactgaagaaatttttagttctttgatcacttcagtgacaatacccattaatgaatcttctccatgatttggggttttttttcgttgttgttttttacacttcttaacctgttgatctatttgaggtcttttgtgtttatcaaacttattcttaagtttaaaaaagaaattaaaagggtggtttttttaagattttaaagtttgctaacatattaaaaatcttcaaatgcttattaaatagagcagttcttgccacccagtcttgtattctgtctttagctagccaaattgtccttgaatttgggttttccacaacctcaaagggttatttgaaatcttttgttgtattttaaaatattttttggaagagctgctaattttattttaaaaaacaaagttgtgaaaacatgcctcctttttaaaaaataacccctccatccaggatatggaatccagcaccacagtgcacaggtcagggctcggagggagcctctgtgcagatgtgctttctttacagtggctgtaaaaagtttgtatttattatgtataaaatgttgaataataaaaaaaatggaatta

SEQ ID NO: 24293 - DNA, 4669 bp, Homo sapiens
gggaagcagaatgtgatttgcttgaagatatgaggacattcagtcagaagaaggctgctattgaaagagagtatgcacagtattccattgtatggatataccacagtttatccattttcctgttgatggacatggtatgcagaagttggctagtcaatacctgaagagagattggcctggagtaaaagctgatgatcggaatgattacaggagcatgtatcccgtttggaaatcttttctcgagggaacaatgcaggtagcccagtctcggatgaatatatgtgaaaactataaaaacttcatttctgagcctgcaaggacagtgagaagcttaaaagaacagcaactaaaaaggtgtgtggaccagttgacaaagatccaaactgaattacaagagacagtgaaagatttagctaaaggcaaaaagaaatactttgagactgaacagatggctcatgcagtacgagagaaagctgacatcgaggcaaaatctaaacttagtctttttcaatcaagaatcagtttacagaaggcaagtgtaaagttaaaagcccggcgatctgagtgtaattccaaagctacccacgcaaggaatgattatcttcttaccctagcggcagcaaatgcacatcaggatcgctactatcaaacagatttagttaacattatgaaggctcttgatggaaatgtgtatgatcatctcaaggattatttaatagccttcagccggactgagctagaaacatgccaagctgtgcagaacacattccagtttttattagaaaactccagcaaggtggtccgggactacaatcttcagctgtttttgcaagaaaacgctgtatttcacaaaccccagcccttccagttccagccttgtgacagtgatactagccgacagttagaatcagaaactgggaccacagaggagcacagtctaaataaggaagctcgaaaatgggccacacgtgtggcacgtgagcataaaaacattgttcaccaacaacgggttctaaatgatctggagtgtcatggagctgctgtatcagaacaaagccgagcagagctagaacagaaaatagatgaagctagagaaaatattcgtaaagcagagataattaaattgaaagctgaagcccggttggacctgctaaagcagattggtgtttctgtggacacatggctaaagagtgccatgaaccaagtaatggaagaactggaaaatgagcgatgggcccgccctcctgcagtgaccagtaatggcactttacactcgcttaatgcagataccgaaagagaagaaggcgaagagtttgaagataacatggatgttttcgatgacagcagttccagcccttctggcaccttaagaaattatccactcacctgcaaagttgtttattcctacaaggcttctcaaccagatgagttgaccattgaggaacatgaggtgttagaagtgattgaagatggagatatggaagactgggtaaaggtatattcctttgctcatatcgccctttcttgtgacatttttaggagtttgttttggtctttgttgtgccctgtctaaattgtgtgtgtaaacttgttttgtcacatgtcttttacccaggcgctcgaaataaagttggccaagtgggttatgtgccagaaaagtacctacagtttcccacctcgaacagcctcctgagcatgctgcagtccctggccgctttggacagtcggtcacacacgtccagcaattccacggaagcagaactcgtttcaggcagcctcaacggagatgccagtggtaaagactgaaacaaggcactctttatttggtcacgtttgacctaaactgtattgccctggagtaagccttcagtaggataaaaagcacaactttcctcctgtcctataatatgcttttctttatatggtcacgtttgtcctgcacagtagaaccctaaagttaatcattcatcagtgagtaaaaaaattacaactttaatcctattctgtatgatgctcttttagttgtcatgtgagcataggggtggttgcaaaagcaaccggctgttaattatcttaccagatttgtttttctcttgctccctagtatgttttgtgaaagcactttatgattatgagggccagacagatgatgagttatcttttcctgagggagcaataatccgtatcttgaacaaagaaaaccaagatgatgatggcttctgggaaggggaattcaatgggcgtattggagttttcccatcggtgctagtggaagaactttcagcctcagaaaatggtgacactccatggatgagagagattcagatctctccttcccccaagccacacgcctccctgcctccactgccgttgtacgaccagcctcccagcagcccctaccccagcccagataagaggagctccctgtactttccccggtctccttcagcaaacgaaaaaagccttcatgctgagtcaccaggattctcacaggcatcaaggcatactcctgagacctcatatggcaaactgcgacctgtccgggcagctccccctccacctacacagaatcaccgaaggccagcagagaagattgaagatgtggaaatcacactggtgtgatgatgggcttgcccatccattactgctacaatcaaggccaggcttggagtttggccagtcttgttttttaggcacctttgcatgatgatgactcttgaacagagcaaaaaacaaggaggattatgtgtgactgggtggcctggtagactcctcccacgttttgaatatttcgtgccttttttttttgttgtcattttctatgtcatttctcctaccatagcacaaatcctagcggaccctaggagcaaagaggggggcagccctcatgcctaacagtggtctgtttttatatgagactcaagaacaggcctcattccagggcacagtccctaaattactgatcatgtgcactcgtacagtatattactgtgaccacaaggatgtggcaaagattctcatctttcttcaagtggcttttgctcatctgattgagaattaatcagatcatgttggctacataaggaaacagaaggagggatttcaggagaggctggctcctccccaaggttagtccccagactgagaaagtgaaaccttattgggaaaaattggactgccctgaatttagcaccaattgcattaacgcacatctcttccacaactaacagacttaaaataacagtgtccttcgtattaatatctgtgccattcatttagaattagcagagctaatatggaggggctgaactagtagccacatcttgttcatcacatagactaatagaaaggaggctgtggctaaagcagaaatggaacttccggatctgaaattagccaatataatgttcttttgtatttgggtatttttcatcttaatttttacagcatatactcttcttaccagtatccttagaatccaaatgtctagataagttgaggacacatacctgcattgttgagcttctctactggggacgccccggcattattttattcccaagccagcagaccggcccagacagccaggctgtggctggtccagaccaactgctatggtggaaaatgcagcttccaggtcccactaccctgacatttccgtggaaggaagaacctggtggctcgtggaggaaaccagctttctatgagaaaggactgaaggattgcgcaccctgcacaagtacagattgaccaggaaaagacaagtgtcttctgtgtgtcacagggaaagccaggagtggccttctctgcaggccagcaagcctgcagcagcaggtgcccccacgtcaggtgctgactgtccgctgtccgctcctgtagaaggtagggagcacaatacctagggactaagggatgttcgccggttgtggtttgtttttttttttttttccttggttaagaaatcaaatttgcagaatttaatctacaagttgtattatgctttgaaaactccatccctcctaagaatcttaaaaaacttgaaatgctcgccaaatgtccccatgggatttttgaccaaaagtaaggtgataactgaagaaatttttagttctttgatcacttcagtgacaatacccattaatgaatcttctccatgatttggggttttttttcgttgttgttttttacacttcttaacctgttgatctatttgaggtcttttgtgtttatcaaacttattcttaagtttaaaaaagaaattaaaagggtggtttttttaagattttaaagtttgctaacatattaaaaatcttcaaatgcttattaaatagagcagttcttgccacccagtcttgtattctgtctttagctagccaaattgtccttgaatttgggttttccacaacctcaaagggttatttgaaatcttttgttgtattttaaaatattttttggaagagctgctaattttattttaaaaaacaaagttgtgaaaacatgcctcctttttaaaaaataacccctccatccaggatatggaatccagcaccacagtgcacaggtcagggctcggagggagcctctgtgcagatgtgctttctttacagtggctgtaaaaagtttgtatttattatgtataaaatgttgaataataaaaaaaatggaatta

SEQ ID NO: 24294 - DNA, 3259 bp, Homo sapiens
ccacgcgtcgcccacgcgtcgcaacaacgggttctaaatgatctggagtgtcatggagctgctgtatcagaacaaagccgagcagagctagaacagaaaatagatgaagctagagaaaatattcgtaaagcagagataattaaattgaaagctgaagcccggttggacctgctaaagcagattggtgtttctgtggacacatggctaaagagtgccatgaaccaagtaatggaagaactggaaaatgagcgatgggcccgccctcctgcagtgaccagtaatggcactttacactcgcttaatgcagataccgaaagagaagaaggcgaagagtttgaagataacatggatgttttcgatgacagcagttccagcccttctggcaccttaagaaattatccactcacctgcaaagttgtttattcctacaaggcttctcaaccagatgagttgaccattgaggaacatgaggtgttagaagtgattgaagatggagatatggaagactgggtaaaggctcgaaataaagttggccaagtgggttatgtgccagaaaagtacctacagtttcccacctcgaacagcctcctgagcatgctgcagtccctggccgctttggacagtcggtcacacacgtccagcaattccacggaagcagaactcgtttcaggcagcctcaacggagatgccagtgtatgttttgtgaaagcactttatgattatgagggccagacagatgatgagttatcttttcctgagggagcaataatccgtatcttgaacaaagaaaaccaagatgatgatggcttctgggaaggggaattcaatgggcgtattggagttttcccatcggtgctagtggaagaactttcagcctcagaaaatggtgacactccatggatgagagagattcagatctctccttcccccaagccacacgcctccctgcctccactgccgttgtacgaccagcctcccagcagcccctaccccagcccagataagaggagctccctgtactttccccggtctccttcagcaaacgaaaaaagccttcatgctgagtcaccaggattctcacaggcatcaaggcatactcctgagacctcatatggcaaactgcgacctgtccgggcagctccccctccacctacacagaatcaccgaaggccagcagagaagattgaagatgtggaaatcacactggtgtgatgatgggcttgcccatccattactgctacaatcaaggccaggcttggagtttggccagtcttgttttttaggcacctttgcatgatgatgactcttgaacagagcaaaaaacaaggaggattatgtgtgactgggtggcctggtagactcctcccacgttttgaatatttcgtgccttttttttttgttgtcattttctatgtcatttctcctaccatagcacaaatcctagcggaccctaggagcaaagaggggggcagccctcatgcctaacagtggtctgtttttatatgagactcaagaacaggcctcattccagggcacagtccctaaattactgatcatgtgcactcgtacagtatattactgtgaccacaaggatgtggcaaagattctcatctttcttcaagtggcttttgctcatctgattgagaattaatcagatcatgttggctacataaggaaacagaaggagggatttcaggagaggctggctcctccccaaggttagtccccagactgagaaagtgaaaccttattgggaaaaattggactgccctgaatttagcaccaattgcattaacgcacatctcttccacaactaacagacttaaaataacagtgtccttcgtattaatatctgtgccattcatttagaattagcagagctaatatggaggggctgaactagtagccacatcttgttcatcacatagactaatagaaaggaggctgtggctaaagcagaaatggaacttccggatctgaaattagccaatataatgttcttttgtatttgggtatttttcatcttaatttttacagcatatactcttcttaccagtatccttagaatccaaatgtctagataagttgaggacacatacctgcattgttgagcttctctactggggacgccccggcattattttattcccaagccagcagaccggcccagacagccaggctgtggctggtccagaccaactgctatggtggaaaatgcagcttccaggtcccactaccctgacatttccgtggaaggaagaacctggtggctcgtggaggaaaccagctttctatgagaaaggactgaaggattgcgcaccctgcacaagtacagattgaccaggaaaagacaagtgtcttctgtgtgtcacagggaaagccaggagtggccttctctgcaggccagcaagcctgcagcagcaggtgcccccacgtcaggtgctgactgtccgctgtccgctcctgtagaaggtagggagcacaatacctagggactaagggatgttcgccggttgtggtttgtttttttttttttttccttggttaagaaatcaaatttgcagaatttaatctacaagttgtattatgctttgaaaactccatccctcctaagaatcttaaaaaacttgaaatgctcgccaaatgtccccatgggatttttgaccaaaagtaaggtgataactgaagaaatttttagttctttgatcacttcagtgacaatacccattaatgaatcttctccatgatttggggttttttttcgttgttgttttttacacttcttaacctgttgatctatttgaggtcttttgtgtttatcaaacttattcttaagtttaaaaaagaaattaaaagggtggtttttttaagattttaaagtttgctaacatattaaaaatcttcaaatgcttattaaatagagcagttcttgccacccagtcttgtattctgtctttagctagccaaattgtccttgaatttgggttttccacaacctcaaagggttatttgaaatcttttgttgtattttaaaatattttttggaagagctgctaattttattttaaaaaacaaagttgtgaaaacatgcctcctttttaaaaaataacccctccatccaggatatggaatccagcaccacagtgcacaggtcagggctcggagggagcctctgtgcagatgtgctttctttacagtggctgtaaaaagtttgtatttattatgtataaaatgttgaataataaaaaaaatggaatta

SEQ ID NO: 24295 - DNA, 4184 bp, Homo sapiens
gggaagcagaatgtgatttgcttgaagatatgaggacattcagtcagaagaaggctgctattgaaagagagtatgcacagtattccattgtatggatataccacagtttatccattttcctgttgatggacatggtatgcagaagttggctagtcaatacctgaagagagattggcctggagtaaaagctgatgatcggaatgattacaggagcatgtatcccgtttggaaatcttttctcgagggaacaatgcaggtagcccagtctcggatgaatatatgtgaaaactataaaaacttcatttctgagcctgcaaggacagtgagaagcttaaaagaacagcaactaaaaaggtgtgtggaccagttgacaaagatccaaactgaattacaagagacagtgaaagatttagctaaaggcaaaaagaaatactttgagactgaacagatggctcatgcagtacgagagaaagctgacatcgaggcaaaatctaaacttagtctttttcaatcaagaatcagtttacagaaggcaagtgtaaagttaaaagcccggcgatctgagtgtaattccaaagctacccacgcaaggaatgattatcttcttaccctagcggcagcaaatgcacatcaggatcgctactatcaaacagatttagttaacattatgaaggctcttgatggaaatgtgtatgatcatctcaaggattatttaatagccttcagccggactgagctagaaacatgccaagctgtgcagaacacattccagtttttattagaaaactccagcaaggtggtccgggactacaatcttcagctgtttttgcaagaaaacgctgtatttcacaaaccccagcccttccagttccagccttgtgacagtgatactagccgacagttagaatcagaaactgggaccacagaggagcacagtctaaataaggaagctcgaaaatgggccacacgtgtggcacgtgagcataaaaacattgttcaccaacaacgggttctaaatgatctggagtgtcatggagctgctgtatcagaacaaagccgagcagagctagaacagaaaatagatgaagctagagaaaatattcgtaaagcagagataattaaattgaaagctgaagcccggttggacctgctaaagcagattggtgtttctgtggacacatggctaaagagtgccatgaaccaagtaatggaagaactggaaaatgagcgatgggcccgccctcctgcagtgaccagtaatggcactttacactcgcttaatgcagataccgaaagagaagaaggcgaagagtttgaagataacatggatgttttcgatgacagcagttccagcccttctggcaccttaagaaattatccactcacctgcaaagttgtttattcctacaaggcttctcaaccagatgagttgaccattgaggaacatgaggtgttagaagtgattgaagatggagatatggaagactgggtaaaggctcgaaataaagttggccaagtgggttatgtgccagaaaagtacctacagtttcccacctcgaacagcctcctgagcatgctgcagtccctggccgctttggacagtcggtcacacacgtccagcaattccacggaagcagaactcgtttcaggcagcctcaacggagatgccagtgtatgttttgtgaaagcactttatgattatgagggccagacagatgatgagttatcttttcctgagggagcaataatccgtatcttgaacaaagaaaaccaagatgatgatggcttctgggaaggggaattcaatgggcgtattggagttttcccatcggtgctagtggaagaactttcagcctcagaaaatggtgacactccatggatgagagagattcagatctctccttcccccaagccacacgcctccctgcctccactgccgttgtacgaccagcctcccagcagcccctaccccagcccagataagaggagctccctgtactttccccggtctccttcagcaaacgaaaaaagccttcatgctgagtcaccaggattctcacaggcatcaaggcatactcctgagacctcatatggcaaactgcgacctgtccgggcagctccccctccacctacacagaatcaccgaaggccagcagagaagattgaagatgtggaaatcacactggtgtgatgatgggcttgcccatccattactgctacaatcaaggccaggcttggagtttggccagtcttgttttttaggcacctttgcatgatgatgactcttgaacagagcaaaaaacaaggaggattatgtgtgactgggtggcctggtagactcctcccacgttttgaatatttcgtgccttttttttttgttgtcattttctatgtcatttctcctaccatagcacaaatcctagcggaccctaggagcaaagaggggggcagccctcatgcctaacagtggtctgtttttatatgagactcaagaacaggcctcattccagggcacagtccctaaattactgatcatgtgcactcgtacagtatattactgtgaccacaaggatgtggcaaagattctcatctttcttcaagtggcttttgctcatctgattgagaattaatcagatcatgttggctacataaggaaacagaaggagggatttcaggagaggctggctcctccccaaggttagtccccagactgagaaagtgaaaccttattgggaaaaattggactgccctgaatttagcaccaattgcattaacgcacatctcttccacaactaacagacttagctaatatggaggggctgaactagtagccacatcttgttcatcacatagactaatagaaaggaggctgtggctaaagcagaaatggaacttccggatctgaaattagccaatataatgttcttttgtatttgggtatttttcatcttaatttttacagcatatactcttcttaccagtatccttagaatccaaatgtctagataagttgaggacacatacctgcattgttgagcttctctactggggacgccccggcattattttattcccaagccagcagaccggcccagacagccaggctgtggctggtccagaccaactgctatggtggaaaatgcagcttccaggtcccactaccctgacatttccgtggaaggaagaacctggtggctcgtggaggaaaccagctttctatgagaaaggactgaaggattgcgcaccctgcacaagtacagattgaccaggaaaagacaagtgtcttctgtgtgtcacagggaaagccaggagtggccttctctgcaggccagcaagcctgcagcagcaggtgcccccacgtcaggtgctgactgtccgctgtccgctcctgtagaaggtagggagcacaatacctagggactaagggatgttcgccggttgtggtttgtttttttttttttttccttggttaagaaatcaaatttgcagaatttaatctacaagttgtattatgctttgaaaactccatccctcctaagaatcttaaaaaacttgaaatgctcgccaaatgtccccatgggatttttgaccaaaagtaaggtgataactgaagaaatttttagttctttgatcacttcagtgacaatacccattaatgaatcttctccatgatttggggttttttttcgttgttgttttttacacttcttaacctgttgatctatttgaggtcttttgtgtttatcaaacttattcttaagtttaaaaaagaaattaaaagggtggtttttttaagattttaaagtttgctaacatattaaaaatcttcaaatgcttattaaatagagcagttcttgccacccagtcttgtattctgtctttagctagccaaattgtccttgaatttgggttttccacaacctcaaagggttatttgaaatcttttgttgtattttaaaatattttttggaagagctgctaattttattttaaaaaacaaagttgtgaaaacatgcctcctttttaaaaaataacccctccatccaggatatggaatccagcaccacagtgcacaggtcagggctcggagggagcctctgtgcagatgtgctttctttacagtggctgtaaaaagtttgtatttattatgtataaaatgttgaataataaaaaaaatggaatta

SEQ ID NO: 24296 - DNA, 3865 bp, Homo sapiens
gggaagcagaatgtgatttgcttgaagatatgaggacattcagtcagaagaaggctgctattgaaagagagtatgcacagtattccattgtatggatataccacagtttatccattttcctgttgatggacatggtatgcagaagttggctagtcaatacctgaagagagattggcctggagtaaaagctgatgatcggaatgattacaggagcatgtatcccgtttggaaatcttttctcgagggaacaatgcaggtagcccagtctcggatgaatatatgtgaaaactataaaaacttcatttctgagcctgcaaggacagtgagaagcttaaaagaacagcaactaaaaaggtgtgtggaccagttgacaaagatccaaactgaattacaagagacagtgaaagatttagctaaaggcaaaaagaaatactttgagactgaacagatggctcatgcagtacgagagaaagctgacatcgaggcaaaatctaaacttagtctttttcaatcaagaatcagtttacagaaggcaagtgtaaagttaaaagcccggcgatctgagtgtaattccaaagctacccacgcaaggaatgattatcttcttaccctagcggcagcaaatgcacatcaggatcgctactatcaaacagatttagttaacattatgaaggctcttgatggaaatgtgtatgatcatctcaaggattatttaatagccttcagccggactgagctagaaacatgccaagctgtgcagaacacattccagtttttattagaaaactccagcaaggtggtccgggactacaatcttcagctgtttttgcaagaaaacgctgtatttcacaaaccccagcccttccagttccagccttgtgacagtgatactagccgacagttagaatcagaaactgggaccacagaggagcacagtctaaataaggaagctcgaaaatgggccacacgtgtggcacgtgagcataaaaacattgttcaccaacaacgggttctaaatgatctggagtgtcatggagctgctgtatcagaacaaagccgagcagagctagaacagaaaatagatgaagctagagaaaatattcgtaaagcagagataattaaattgaaagctgaagcccggttggacctgctaaagcagattggtgtttctgtggacacatggctaaagagtgccatgaaccaagtaatggaagaactggaaaatgagcgatgggcccgccctcctgcagtgaccagtaatggcactttacactcgcttaatgcagataccgaaagagaagaaggcgaagagtttgaagataacatggatgttttcgatgacagcagttccagcccttctggcaccttaagaaattatccactcacctgcaaagttgtttattcctacaaggcttctcaaccagatgagttgaccattgaggaacatgaggtgttagaagtgattgaagatggagatatggaagactgggtaaaggctcgaaataaagttggccaagtgggttatgtgccagaaaagtacctacagtttcccacctcgaacagcctcctgagcatgctgcagtccctggccgctttggacagtcggtcacacacgtccagcaattccacggaagcagaactcgtttcaggcagcctcaacggagatgccagtgtatgttttgtgaaagcactttatgattatgagggccagacagatgatgagttatcttttcctgagggagcaataatccgtatcttgaacaaagaaaaccaagatgatgatggcttctgggaaggggaattcaatgggcgtattggagttttcccatcggtgctagtggaagaactttcagcctcagaaaatggtgacactccatggatgagagagattcagatctctccttcccccaagccacacgcctccctgcctccactgccgttgtacgaccagcctcccagcagcccctaccccagcccagataagaggagctccctgtactttccccggtctccttcagcaaacgaaaaaagccttcatgctgagtcaccaggattctcacaggcatcaaggcatactcctgagacctcatatggcaaactgcgacctgtccgggcagctccccctccacctacacagaatcaccgaaggccagcagagaagattgaagatgtggaaatcacactggtgtgatgatgggcttgcccatccattactgctacaatcaaggccaggcttggagtttggccagtcttgttttttaggcacctttgcatgatgatgactcttgaacagagcaaaaaacaaggaggattatgtgtgactgggtggcctggtagactcctcccacgttttgaatatttcgtgccttttttttttgttgtcattttctatgtcatttctcctaccatagcacaaatcctagcggaccctaggagcaaagaggggggcagccctcatgcctaacagtggtctgtttttatatgagactcaagaacaggcctcattccagggcacagtccctaaattactgatcatgtgcactcgtacagtatattactgtgaccacaaggatgtggcaaagattctcatctttcttcaagtggcttttgctcatctgattgagaattaatcagatcatgttggctacataaggaaacagaaggagggatttcaggagaggctggctcctccccaaggttagtccccagactgagaaagtgaaaccttattgggaaaaattggactgccctgaatttagcaccaattgcattaacgcacatctcttccacaactaacagacttaaaataacagtgtccttcgtattaatatctgtgccattcatttagaattagcagagctaatatggaggggctgaactagtagccacatcttgttcatcacatagactaatagaaaggaggctgtggctaaagcagaaatggaacttccggatctgaaattagccaatataatgttcttttgtatttgggtatttttcatcttaatttttacagcatatactcttcttaccagtatccttagaatccaaatgtctagataagttgaggacacatacctgcattgttgagcttctctactggggacgccccggcattattttattcccaagccagcagaccggcccagacagccaggctgtggctggtccagaccaactgctatggtggaaaatgcagcttccaggtcccactaccctgacatttccgtggaaggaagaacctggtggctcgtggaggaaaccagctttctatgagaaaggactgaaggattgcgcaccctgcacaagtacagattgaccaggaaaagacaagtgtcttctgtgtgtcacagggaaagccaggagtggccttctctgcaggccagcaagcctgcagcagcaggtgcccccacgtcaggtgctgactgtccgctgtccgctcctgtagaaggtagggagcacaatacctagggactaagggatgttcgccggttgtggtttgtttttttttttttttccttggttaagaaatcaaatttgcagaatttaatctacaagttgtattatgctttgaaaactccatccctcctaagaatcttaaaaaacttgaaatgctcgccaaatgtccccatgggatttttgaccaaaagtaaggtgataactgaagaaatttttagttctttgatcacttcagtgacaatacccattaatgaatcttctccatccaggatatggaatccagcaccacagtgcacaggtcagggctcggagggagcctctgtgcagatgtgctttctttacagtggctgtaaaaagtttgtatttattatgtataaaatgttgaataataaaaaaaatggaatta

SEQ ID NO: 24297 - DNA, 3320 bp, Homo sapiens
gggaagcagaatgtgatttgcttgaagatatgaggacattcagtcagaagaaggctgctattgaaagagagtatgcacagtattccattgtatggatataccacagtttatccattttcctgttgatggacatggtatgcagaagttggctagtcaatacctgaagagagattggcctggagtaaaagctgatgatcggaatgattacaggagcatgtatcccgtttggaaatcttttctcgagggaacaatgcaggtagcccagtctcggatgaatatatgtgaaaactataaaaacttcatttctgagcctgcaaggacagtgagaagcttaaaagaacagcaactaaaaaggtgtgtggaccagttgacaaagatccaaactgaattacaagagacagtgaaagatttagctaaaggcaaaaagaaatactttgagactgaacagatggctcatgcagtacgagagaaagctgacatcgaggcaaaatctaaacttagtctttttcaatcaagaatcagtttacagaaggcaagtgtaaagttaaaagcccggcgatctgagtgtaattccaaagctacccacgcaaggaatgattatcttcttaccctagcggcagcaaatgcacatcaggatcgctactatcaaacagatttagttaacattatgaaggctcttgatggaaatgtgtatgatcatctcaaggattatttaatagccttcagccggactgagctagaaacatgccaagctgtgcagaacacattccagtttttattagaaaactccagcaaggtggtccgggactacaatcttcagctgtttttgcaagaaaacgctgtatttcacaaaccccagcccttccagttccagccttgtgacagtgatactagccgacagttagaatcagaaactgggaccacagaggagcacagtctaaataaggaagctcgaaaatgggccacacgtgtggcacgtgagcataaaaacattgttcaccaacaacgggttctaaatgatctggagtgtcatggagctgctgtatcagaacaaagccgagcagagctagaacagaaaatagatgaagctagagaaaatattcgtaaagcagagataattaaattgaaagctgaagcccggttggacctgctaaagcagattggtgtttctgtggacacatggctaaagagtgccatgaaccaagtaatggaagaactggaaaatgagcgatgggcccgccctcctgcagtgaccagtaatggcactttacactcgcttaatgcagataccgaaagagaagaaggcgaagagtttgaagataacatggatgttttcgatgacagcagttccagcccttctggcaccttaagaaattatccactcacctgcaaagttgtttattcctacaaggcttctcaaccagatgagttgaccattgaggaacatgaggtgttagaagtgattgaagatggagatatggaagactgggtaaaggctcgaaataaagttggccaagtgggttatgtgccagaaaagtacctacagtttcccacctcgaacagcctcctgagcatgctgcagtccctggccgctttggacagtcggtcacacacgtccagcaattccacggaagcagaactcgtttcaggcagcctcaacggagatgccagtgtatgttttgtgaaagcactttatgattatgagggccagacagatgatgagttatcttttcctgagggagcaataatccgtatcttgaacaaagaaaaccaagatgatgatggcttctgggaaggggaattcaatgggcgtattggagttttcccatcggtgctagtggaagaactttcagcctcagaaaatggtgacactccatggatgagagagattcagatctctccttcccccaagccacacgcctccctgcctccactgccgttgtacgaccagcctcccagcagcccctaccccagcccagataagaggagctccctgtactttccccggtctccttcagcaaacgaaaaaagccttcatgctgagtcaccaggattctcacaggcatcaaggcatactcctgagacctcatatggcaaactgcgacctgtccgggcagctccccctccacctacacagaatcaccgaaggccagcagagaagattgaagatgtggaaatcacactggtgtgatgatgggcttgcccatccattactgctacaatcaaggccaggcttggagtttggccagtcttgttttttaggcacctttgcatgatgatgactcttgaacagagcaaaaaacaaggaggattatgtgtgactgggtggcctggtagactcctcccacgttttgaatatttcgtgccttttttttttgttgtcattttctatgtcatttctcctaccatagcacaaatcctagcggaccctaggagcaaagaggggggcagccctcatgcctaacagtggtctgtttttatatgagactcaagaacaggcctcattccagggcacagtccctaaattactgatcatgtgcactcgtacagtatattactgtgaccacaaggatgtggcaaagattctcatctttcttcaagtggcttttgctcatctgattgagaattaatcagatcatgttggctacataaggaaacagaaggagggatttcaggagaggctggctcctccccaaggttagtccccagactgagaaagtgaaaccttattgggaaaaattggactgccctgaatttagcaccaattgcattaacgcacatctcttccacaactaacagacttaaaataacagtgtccttcgtattaatatctgtgccattcatttagaattagcagagctaatatggaggggctgaactagtagccacatcttgttcatcacatagactaatagaaaggaggctgtggctaaagcagaaatggaacttccggatctgaaattagccaatataatgttcttttgtatttgggtatttttcatcttaatttttacagcatatactcttcttaccagtatcatttgggttttccacaacctcaaagggttatttgaaatcttttgttgtattttaaaatattttttggaagagctgctaattttattttaaaaaacaaagttgtgaaaacatgcctcctttttaaaaaataacccctccatccaggatatggaatccagcaccacagtgcacaggtcagggctcggagggagcctctgtgcagatgtgctttctttacagtggctgtaaaaagtttgtatttattatgtataaaatgttgaataataaaaaaaatggaatta

SEQ ID NO: 24298 - DNA, 2809 bp, Homo sapiens
gggaagcagaatgtgatttgcttgaagatatgaggacattcagtcagaagaaggctgctattgaaagagagtatgcacagtattccattgtatggatataccacagtttatccattttcctgttgatggacatggtatgcagaagttggctagtcaatacctgaagagagattggcctggagtaaaagctgatgatcggaatgattacaggagcatgtatcccgtttggaaatcttttctcgagggaacaatgcaggtagcccagtctcggatgaatatatgtgaaaactataaaaacttcatttctgagcctgcaaggacagtgagaagcttaaaagaacagcaactaaaaaggtgtgtggaccagttgacaaagatccaaactgaattacaagagacagtgaaagatttagctaaaggcaaaaagaaatactttgagactgaacagatggctcatgcagtacgagagaaagctgacatcgaggcaaaatctaaacttagtctttttcaatcaagaatcagtttacagaaggcaagtgtaaagttaaaagcccggcgatctgagtgtaattccaaagctacccacgcaaggaatgattatcttcttaccctagcggcagcaaatgcacatcaggatcgctactatcaaacagatttagttaacattatgaaggctcttgatggaaatgtgtatgatcatctcaaggattatttaatagccttcagccggactgagctagaaacatgccaagctgtgcagaacacattccagtttttattagaaaactccagcaaggtggtccgggactacaatcttcagctgtttttgcaagaaaacgctgtatttcacaaaccccagcccttccagttccagccttgtgacagtgatactagccgacagttagaatcagaaactgggaccacagaggagcacagtctaaataaggaagctcgaaaatgggccacacgtgtggcacgtgagcataaaaacattgttcaccaacaacgggttctaaatgatctggagtgtcatggagctgctgtatcagaacaaagccgagcagagctagaacagaaaatagatgaagctagagaaaatattcgtaaagcagagataattaaattgaaagctgaagcccggttggacctgctaaagcagattggtgtttctgtggacacatggctaaagagtgccatgaaccaagtaatggaagaactggaaaatgagcgatgggcccgccctcctgcagtgaccagtaatggcactttacactcgcttaatgcagataccgaaagagaagaaggcgaagagtttgaagataacatggatgttttcgatgacagcagttccagcccttctggcaccttaagaaattatccactcacctgcaaagttgtttattcctacaaggcttctcaaccagatgagttgaccattgaggaacatgaggtgttagaagtgattgaagatggagatatggaagactgggtaaaggctcgaaataaagttggccaagtgggttatgtgccagaaaagtacctacagtttcccacctcgaacagcctcctgagcatgctgcagtccctggccgctttggacagtcggtcacacacgtccagcaattccacggaagcagaactcgtttcaggcagcctcaacggagatgccagtgtatgttttgtgaaagcactttatgattatgagggccagacagatgatgagttatcttttcctgagggagcaataatccgtatcttgaacaaagaaaaccaagatgatgatggcttctgggaaggggaattcaatgggcgtattggagttttcccatcggtgctagtggaagaactttcagcctcagaaaatggtgacactccatggatgagagagattcagatctctccttcccccaagccacacgcctccctgcctccactgccgttgtacgaccagcctcccagcagcccctaccccagcccagataagaggagctccctgtactttccccggtctccttcagcaaacgaaaaaagccttcatgctgagtcaccaggattctcacaggcatcaaggcatactcctgagacctcatatggcaaactgcgacctgtccgggcagctccccctccacctacacagaatcaccgaaggccagcagagaagattgaagatgtggaaatcacactggtgtgatgatgggcttgcccatccattactgctacaatcaaggccaggcttggagtttggccagtcttgttttttaggcacctttgcatgatgatgactcttgaacagagcaaaaaacaaggaggattatgtgtgactgggtggcctggtagactcctcccacgttttgaatatttcgtgccttttttttttgttgtcattttctatgtcatttctcctaccatagcacaaatcctagcggaccctaggagcaaagaggggggcagccctcatgcctaacagtggtctgtttttatatgagactcaagaacaggcctcattccagggcacagtccctaaattactgatcatgtgcactcgtacagtatattactgtgaccacaaggatgtggcaaagattctcatctttcttcaagtggcttttgctcatctgattgagaattaatcagatcatgttggctacataaggaaacagaaggagggatttcaggagaggctggctcctccccaaggttagtccccagactgagaaagtgaaaccttattgggataacgaattaaataacatgccctcgattaatatcgggccttcatttgaattacaaagctattgggggggtggaa

SEQ ID NO: 24299 - DNA, 7066 bp, Homo sapiens
gcgagctgagctgacagcgcggagctggcgctgtggagcgcagggagccttgccggttcctccgaccggcgtctgcgagtacagcggcggctaacctgccccggcttcaggatttacacagacgtggggcgatgcttgtgaccctgcagctcctcaaaggcccctagaagcctgtttctccgtacagtccaggacctccagccccatggagcccccgatcccacagagcgcccccttgactcccaactcagtcatggtccagccccttcttgacagccggatgtcccacagccggctccagcacccactcaccatcctacccattgaccaggtgaagaccagccatgtggagaatgactacatagacaaccctagcctggccctgaccaccggcccaaagcggacccggggcggggccccagagctggccccgacgcccgcccgctgtgaccaggatgtcacccaccattggatctccttcagcgggcgcccctgctctgctacctgcctgccaccggctgcgtgaagctggcccagcgtggctacgaccgtctgcgccgccctggttgccgctgcaagcacacgaacagcgtcatctgcaaagcagccagcggggatgccaagaccagcaggcccgacaagcctttctgacagtttgtgtcgaagccccagtgctctgcctggaaacctggttctcttctgacatctaagaagactgcagcaaggtcagaggttttagcctcctgaggctgaccttgctagtctgcccactccctacccccagcttcggaaaatacagagaccaccaccacgtaccctgtattccccaaggtgatgaagaagcactttggggctttttttcagggtcctgaaactttgtgtcaaacagacaatgcaggggcagggtgtggtttggggggaaatttttctttttcagaagacagaacacagatgtggacacatatccggaaactgcagctgcttgaatgccttcccagcccctccttctccctccctccctccgccccccccttcctcttttccattgtctttggctctcacaggagctagctgcctgggaggaattgttaactgagtaccagggtacctttaaagaagacccttggagtcttctataccttcttctccttccccatctcactccaccccactttgtccctgatgtcttggggaaggtgtagaacaccctagcagttcctattgtatatacttgggagccactgagaacagaggacggccagtgagtccaagcctcgttcctccttctgcctccccggagccacaggatggatttaggagccactgctcagtgcacttctcccttccaactgcatcaactaactctcgggggtgttctgctcaccacaccgtccttcggttcttactgagtcacagactcgcctgcccactacgtgtcctgggttctctactcagatcccttccagaaactttatatgggtagaggaagccagggcggcaaatgcgagaccaaatatcattttgccaatgagtctgaggctgtggtctctggatccagtcattatgtttttatagaataattaaaccggatgctaacggtgttttaaaaaataataataaaacaacttgtttccttttggccacccccaggaagggctgatttcaaaatctgggggcgagcaacctcaaggaacacaatttccctccctatcaacaagaggattttaacagcaaagaagagaggcagcacctcccattggcagaatgaccgctgagccaggctgggtttgggtttcttctcttctgattctgctgctcactgtcatagccttttgtgtatagtgatgtgtctgtatctttaatgtaaatagagagatgatgaaaaaagagtctattttagtgttaggaagccccagcaggggagtcggaagagcttggaagagctggggagagggtaggggaaaggtttttccaggggccactgggtttgagccctgcttctgtgcacagccacaccaccctctcccgacagccctcaaagacgtagcaactctttctctcaaggtgctaaaggactcagaaggtgcagcacgtccagtgggtaggtacttgttgcatgcaaaagctgtagtgtatctggtccttcctccccagcttttgtgtggggttcttgctttgtgtggtattttgttttcccctctaatgagagggcatggcctgagtcagaagagctaccccaggtgaaactggaagtgcatgaggcagagcgtccgtagcatttccagtttgttctgtataggacagaggtgcctccgggaaggaggcagcgaggtaggtagctatgataggcacctaatgcttctcaaggacttattttttccttcttgaagactagtagtaacatcttatgatttagagtaagttgattgtaaccataggtatttattgattggaggaagggagggtcatattattttcggctttatttatgtaacatttgctagcttataaaaggcgaatgtgaaatattgcatctgcattttccaaggctgattcgtgtagctacccttgccacagttgtgacggatgtatggatgttcttgaacatttcagaaggagtggtagaaaaaaacacacattcagccaaccacttatatgaattgaatgtatcagaagtgtactgaagggactggagatggttttcctcagatgagggggccccaaaattgatagtgcacatctgcacgctttctgcgaggcctcagaacttttcccagggcccctccctcaaattgtctccatgggaaacttgacccagtggcaagttgcactttggtgatcttggtggtctacacacccgttctgtggagagtcgatttacataagctgtgtatacacacacacacacacacacacacacacacacacacacacccctaccccacactgactgtctaccgacaaagaccctatttcctggcaaacggcctcctgaaccctgactttttgtgtacatacttgtaaacacggatttttctgggttttggtttgctttttccttttttccccctgcccctgttctagcttgttcttcttggtttgctttcaacctgcttgatggatgtctgcagagtgctctctaagagtccacctcagtgcctcgtgtgctcagtggtcatgggaaggagcgaaggaaccatccttggttctcccagcttggttgtgtagcaatccctcagcattgtttttctcagcttcttggcaaaaattaaaacaacaacaacaacaacaacaacaacaacaaacagaaggataaactggcttgcctgtggaccctccccggctctggggccagtcgagagccactgagggacccagcactcagagacacaacacacatgtgtagctgcttctggctgagtgtgtttcctgtcaccaatggcctgtttggctggacgatgcctcggcttgaccttttttgaaaagtgctggttagttcccgcccctggtaaacctggggtaggtgggggttctgtcttaactcgaggggcacctgggatccaggacgcttctagggggctctggctgcccgtgttaatgaaggacagcgcttccgcgagcaccctgggaactgggtcttgggtagcaaagccctcccagagaaaagatgggcacaactaaggctttcctgagcaggaagggggtgaagaccaatcccttcctttggtcctttggtacgcaccccctcagagctgagatggaagacatggctagttcttttcagccttgtggagcctgtcagtcgccatcatacctcgagtgaggcccagctagataatgacttgtccaagatggcacacgtggaaagttgatctgcaccagaacccggatgactgtcaccttgaagcgtcctgttctccttctgtgctgtcccaggaagtgtctggcgggcgtgggcagcacagctctacactgtacgattcactagggcatcctgcgagcctcactagccttctggttcatgcctttgacaagcatttttgtgccccctctgcttactgtgacagtcgatgatgaatcttgcgttgccattttctgctgtgggtaactgcgtgcagtgtcttgccttgctttctcttcttactgtcccacagcttggtttcatgttacaaacagaaaagctcgaggctcccaccccgccacatcccaacttcatttccccctcactgtagcccatttccaccccaccacaaagttgccacaggttttctttgtatagaatatttattttgaagctctattttaatagtatttattttagaaagtctactattgtaagagttcttctgtttgtgaagaaaaaaacaagttaaaaactgaatgtactgatttagaaaatatatataaatatatattgttaaatatacacgggactgccgtttttgattgcgccactgcactccagccttggcgaccagactaagacgctgtctcaaaaaaaaacaaaaacgacaaaaaaaaaacaaaacagaaaaaataaactaaggcaatgacagtccctggcaaatgctgggagggaggcagcagtggtcagggaaggtaaccctgaagcaggacttgtaaagcaaataagattgggaggccaaggtgggtggatcacgaggtcaggagttcgagaccagcctggccaacatagtgaaaccccgtctttactaaaaatacaaaaaaattagccaggtgtggtggtgggtgcctgtagtcccagctacttgggaggctgaggcaggagaatctcgaacccaggaggcggaggttacagtcagctgagaccgcaccattgcactccagcctgggtgacagagcaagattccgtctcaaaaaaaaaaaaaaaaaaaaaaaccaagaagaaaaggaatgaattagaacttcttctgcttggacttaagggcatcatcaggcaggttttgggtaggatagcaggggaggcagagacatagtcggggtcagtggtcatgagtgtggctttgagcccaaaaacttggtttctgttccctactttgccactcagtagtgcatgactttggccaaatttcttaaattcatgaagcaagtttccgggtgaatgaaatggggataaaaatagtgttcaaacctatccgttggtttgtgtgaaactgaaatgaatagtatcgtgcaggtacttgtgagcaaggggagctgctgtttcctgtccctttatgatgggaaatatctagacaagttcccaaccctctgcactgcaggctgcatggcacggagggtcttgtaacacagctggggctggccttcttttaggagcttcagtggttctgaaaacttttatttgtttgtttgttttagtagatgtggggtctttctgtgttgtccggactggtctcaaacttctggactcaagtgatcctcccccgctcaacctcccaaagtgttgggattacaggtgtgagccactgtgcccagccttgaaaactttttcaggttcttccagggttactgggcaattaaatatttctatttcattataagtcagtttttcaaagttatattatcttaattaccttttttatatgtattagtgtagagtagcattttatattttgatatcctccttatgcatagtttttcactttttattcctagtttttcgtttttaataagactttcaagaaatttattttattggccttttgaaaaaagcagctttagataaagtaagcagttctgctttcattttataatttatttctacttttgtttcattaatcttttcctccggcatgccttggattttgttgtgttactctttttctagaggctcgcattgtgtgtctggttcacttatgatcacgcttgcctacttttaagaatggaagaggggaggtggagggtggctgcacagtcgagggtgtgaggcagtcttgctctagccccaccatgccctcagcccgctgtggccacgctggttcctcaattgctggggcgtgcagtgtctgtaagggaggctactgatgccatccgaggaagatgtaaggtttcgtgtgggcagcgagagcctagcaggcatgtggggtgcccagcaaagggtaacagtggacagttgttgcctcattccacagagttttgattttttttttttttttaatggtcactccatcaacatcccccatggccagagcctgagctggtccccagagacacaggcattcagctgacagcctcgccttcacgctgctgctgttctcatgggggacaggcctcaggtggcaatgcacaaatcattagttaagggcagttgtgacagttaccaaggagtgtagcccccgcccgagtgaaaacagccctaaccaggggtggggaccttggggctctgacccgaagggtaggagaagctggaaggacagcattcctgtctgcgaaggcaggagcaaagctgccaggctatgaaggaaatggctggagcctgaagtcatgcaagctggggctggcagggacagggccaacttccaggcctgggggccaccatgaggattcaggacgtgacccccagggcacatgaaggccttccatctgtatttaagaaaagactttatcagacgagtatggtgctcacgcctgtaatcttagcactttgggaggctgaggcaggtggatcacgaggtcaggagttcaagaccagcctggccaatatggtaaaccccatctctactaaactacaaaatagccaggcatggtggcgcacgcctgtagtcccagctactcgggaggctgaggcagaagaatcacttgaacccgggaggtggaggttacagtgagccaagatcgcgccactacactccagcctgggtgacagagtgagactccgtctcaaaaaaaccaaaagactttatcttatttcctatatgtttgtggtttcagtcctgatgtataatttgaccctagttagaatggttatctgaggaagtggcctgtacgatttctgcttttttaaatgtgtggctccctttcttcattgattaacgtatgattattt

SEQ ID NO: 24300 - DNA, 4496 bp, Homo sapiens
gcgagctgagctgacagcgcggagctggcgctgtggagcgcagggagccttgccggttcctccgaccggcgtctgcgagtacagcggcggctaacctgccccggcttcaggatttacacagacgtggggcgatgcttgtgaccctgcagctcctcaaaggcccctagaagcctgtttctccgtacagtccaggacctccagccccatggagcccccgatcccacagagcgcccccttgactcccaactcagtcatggtccagccccttcttgacagccggatgtcccacagccggctccagcacccactcaccatcctacccattgaccaggtgaagaccagccatgtggagaatgactacatagacaaccctagcctggccctgaccaccggcccaaagcggacccggggcggggccccagagctggccccgacgcccgcccgctgtgaccaggatgtcacccaccattggatctccttcagcgggcgcccctgctctgctacctgcctgccaccggctgcgtgaagctggcccagcgtggctacgaccgtctgcgccgccctggttgccgctgcaagcacacgaacagcgtcatctgcaaagcagccagcggggatgccaagaccagcaggcccgacaagcctttctgacagtttgtgtcgaagccccagtgctctgcctggaaacctggttctcttctgacatctaagaagactgcagcaaggtcagaggttttagcctcctgaggctgaccttgctagtctgcccactccctacccccagcttcggaaaatacagagaccaccaccacgtaccctgtattccccaaggtgatgaagaagcactttggggctttttttcagggtcctgaaactttgtgtcaaacagacaatgcaggggcagggtgtggtttggggggaaatttttctttttcagaagacagaacacagatgtggacacatatccggaaactgcagctgcttgaatgccttcccagcccctccttctccctccctccctccgccccccccttcctcttttccattgtctttggctctcacaggagctagctgcctgggaggaattgttaactgagtaccagggtacctttaaagaagacccttggagtcttctataccttcttctccttccccatctcactccaccccactttgtccctgatgtcttggggaaggtgtagaacaccctagcagttcctattgtatatacttgggagccactgagaacagaggacggccagtgagtccaagcctcgttcctccttctgcctccccggagccacaggatggatttaggagccactgctcagtgcacttctcccttccaactgcatcaactaactctcgggggtgttctgctcaccacaccgtccttcggttcttactgagtcacagactcgcctgcccactacgtgtcctgggttctctactcagatcccttccagaaactttatatgggtagaggaagccagggcggcaaatgcgagaccaaatatcattttgccaatgagtctgaggctgtggtctctggatccagtcattatgtttttatagaataattaaaccggatgctaacggtgttttaaaaaataataataaaacaacttgtttccttttggccacccccaggaagggctgatttcaaaatctgggggcgagcaacctcaaggaacacaatttccctccctatcaacaagaggattttaacagcaaagaagagaggcagcacctcccattggcagaatgaccgctgagccaggctgggtttgggtttcttctcttctgattctgctgctcactgtcatagccttttgtgtatagtgatgtgtctgtatctttaatgtaaatagagagatgatgaaaaaagagtctattttagtgttaggaagccccagcaggggagtcggaagagcttggaagagctggggagagggtaggggaaaggtttttccaggggccactgggtttgagccctgcttctgtgcacagccacaccaccctctcccgacagccctcaaagacgtagcaactctttctctcaaggtgctaaaggactcagaaggtgcagcacgtccagtgggtaggtacttgttgcatgcaaaagctgtagtgtatctggtccttcctccccagcttttgtgtggggttcttgctttgtgtggtattttgttttcccctctaatgagagggcatggcctgagtcagaagagctaccccaggtgaaactggaagtgcatgaggcagagcgtccgtagcatttccagtttgttctgtataggacagaggtgcctccgggaaggaggcagcgaggtaggtagctatgataggcacctaatgcttctcaaggacttattttttccttcttgaagactagtagtaacatcttatgatttagagtaagttgattgtaaccataggtatttattgattggaggaagggagggtcatattattttcggctttatttatgtaacatttgctagcttataaaaggcgaatgtgaaatattgcatctgcattttccaaggctgattcgtgtagctacccttgccacagttgtgacggatgtatggatgttcttgaacatttcagaaggagtggtagaaaaaaacacacattcagccaaccacttatatgaattgaatgtatcagaagtgtactgaagggactggagatggttttcctcagatgagggggccccaaaattgatagtgcacatctgcacgctttctgcgaggcctcagaacttttcccagggcccctccctcaaattgtctccatgggaaacttgacccagtggcaagttgcactttggtgatcttggtggtctacacacccgttctgtggagagtcgatttacataagctgtgtatacacacacacacacacacacacacacacacacacacacacccctaccccacactgactgtctaccgacaaagaccctatttcctggcaaacggcctcctgaaccctgactttttgtgtacatacttgtaaacacggatttttctgggttttggtttgctttttccttttttccccctgcccctgttctagcttgttcttcttggtttgctttcaacctgcttgatggatgtctgcagagtgctctctaagagtccacctcagtgcctcgtgtgctcagtggtcatgggaaggagcgaaggaaccatccttggttctcccagcttggttgtgtagcaatccctcagcattgtttttctcagcttcttggcaaaaattaaaacaacaacaacaacaacaacaacaacaacaaacagaaggataaactggcttgcctgtggaccctccccggctctggggccagtcgagagccactgagggacccagcactcagagacacaacacacatgtgtagctgcttctggctgagtgtgtttcctgtcaccaatggcctgtttggctggacgatgcctcggcttgaccttttttgaaaagtgctggttagttcccgcccctggtaaacctggggtaggtgggggttctgtcttaactcgaggggcacctgggatccaggacgcttctagggggctctggctgcccgtgttaatgaaggacagcgcttccgcgagcaccctgggaactgggtcttgggtagcaaagccctcccagagaaaagatgggcacaactaaggctttcctgagcaggaagggggtgaagaccaatcccttcctttggtcctttggtacgcaccccctcagagctgagatggtgaagaccaatcccttccttggtccttggtacgcaccccctcagagctgagatggaagacatggctagttcttttcagccttgtggagcctgtcagtcgccatcatacctcgagtgaggcccagctagataatgacttgtccaagatggcacacgtggaaagttgatctgcaccagaacccggatgactgtcaccttgaagcgtcctgttctccttctgtgctgtcccaggaagtgtctggcgggcgtgggcagcacagctctacactgtacgattcactagggcatcctgcgagcctcactagccttctggttcatgcctttgacaagcatttttgtgccccctctgcttactgtgacagtcgatgatgaatcttgcgttgccattttctgctgtgggtaactgcgtgcagtgtcttgccttgctttctcttcttactgtcccacagcttggtttcatgttacaaacagaaaagctcgaggctcccaccccgccacatcccaacttcatttccccctcactgtagcccatttccaccccaccacaaagttgccacaggttttctttgtatagaatatttattttgaagctctattttaatagtatttattttagaaagtctactattgtaagagttcttctgtttgtgaagaaaaaaacaagttaaaaactgaatgtactgatttagaaaatatatataaatatatattgttaaatatacacgggactgccgtt

SEQ ID NO: 24301 - DNA, 4178 bp, Homo sapiens
gcgagctgagctgacagcgcggagctggcgctgtggagcgcagggagccttgccggttcctccgaccggcgtctgcgagtacagcggcggctaacctgccccggcttcaggatttacacagacgtggggcgatgcttgtgaccctgcagctcctcaaaggcccctagaagcctgtttctccgtacagtccaggacctccagccccatggagcccccgatcccacagagcgcccccttgactcccaactcagtcatggtccagccccttcttgacagccggatgtcccacagccggctccagcacccactcaccatcctacccattgaccaggtgaagaccagccatgtggagaatgactacatagacaaccctagcctggccctgaccaccggcccaaagcggacccggggcggggccccagagctggccccgacgcccgcccgctgtgaccaggatgtcacccaccattggatctccttcagcgggcgcccctgctctgctacctgcctgccaccggctgcgtgaagctggcccagcgtggctacgaccgtctgcgccgccctggttgccgctgcaagcacacgaacagcgtcatctgcaaagcagccagcggggatgccaagaccagcaggcccgacaagcctttctgacagtttgtgtcgaagccccagtgctctgcctggaaacctggttctcttctgacatctaagaagactgcagcaaggtcagaggttttagcctcctgaggctgaccttgctagtctgcccactccctacccccagcttcggaaaatacagagaccaccaccacgtaccctgtattccccaaggtgatgaagaagcactttggggctttttttcagggtcctgaaactttgtgtcaaacagacaatgcaggggcagggtgtggtttggggggaaatttttctttttcagaagacagaacacagatgtggacacatatccggaaactgcagctgcttgaatgccttcccagcccctccttctccctccctccctccgccccccccttcctcttttccattgtctttggctctcacaggagctagctgcctgggaggaattgttaactgagtaccagggtacctttaaagaagacccttggagtcttctataccttcttctccttccccatctcactccaccccactttgtccctgatgtcttggggaaggtgtagaacaccctagcagttcctattgtatatacttgggagccactgagaacagaggacggccagtgagtccaagcctcgttcctccttctgcctccccggagccacaggatggatttaggagccactgctcagtgcacttctcccttccaactgcatcaactaactctcgggggtgttctgctcaccacaccgtccttcggttcttactgagtcacagactcgcctgcccactacgtgtcctgggttctctactcagatcccttccagaaactttatatgggtagaggaagccagggcggcaaatgcgagaccaaatatcattttgccaatgagtctgaggctgtggtctctggatccagtcattatgtttttatagaataattaaaccggatgctaacggtgttttaaaaaataataataaaacaacttgtttccttttggccacccccaggaagggctgatttcaaaatctgggggcgagcaacctcaaggaacacaatttccctccctatcaacaagaggattttaacagcaaagaagagaggcagcacctcccattggcagaatgaccgctgagccaggctgggtttgggtttcttctcttctgattctgctgctcactgtcatagccttttgtgtatagtgatgtgtctgtatctttaatgtaaatagagagatgatgaaaaaagagtctattttagtgttaggaagccccagcaggggagtcggaagagcttggaagagctggggagagggtaggggaaaggtttttccaggggccactgggtttgagccctgcttctgtgcacagccacaccaccctctcccgacagccctcaaagacgtagcaactctttctctcaaggtgctaaaggactcagaaggtgcagcacgtccagtgggtaggtacttgttgcatgcaaaagctgtagtgtatctggtccttcctccccagcttttgtgtggggttcttgctttgtgtggtattttgttttcccctctaatgagagggcatggcctgagtcagaagagctaccccaggtgaaactggaagtgcatgaggcagagcgtccgtagcatttccagtttgttctgtataggacagaggtgcctccgggaaggaggcagcgaggtaggtagctatgataggcacctaatgcttctcaaggacttattttttccttcttgaagactagtagtaacatcttatgatttagagtaagttgattgtaaccataggtatttattgattggaggaagggagggtcatattattttcggctttatttatgtaacatttgctagcttataaaaggcgaatgtgaaatattgcatctgcattttccaaggctgattcgtgtagctacccttgccacagttgtgacggatgtatggatgttcttgaacatttcagaaggagtggtagaaaaaaacacacattcagccaaccacttatatgaattgaatgtatcagaagtgtactgaagggactggagatggttttcctcagatgagggggccccaaaattgatagtgcacatctgcacgctttctgcgaggcctcagaacttttcccagggcccctccctcaaattgtctccatgggaaacttgacccagtggcaagttgcactttggtgatcttggtggtctacacacccgttctgtggagagtcgatttacataagctgtgtatacacacacacacacacacacacacacacacacacacacacccctaccccacactgactgtctaccgacaaagaccctatttcctggcaaacggcctcctgaaccctgactttttgtgtacatacttgtaaacacggatttttctgggttttggtttgctttttccttttttccccctgcccctgttctagcttgttcttcttggtttgctttcaacctgcttgatggatgtctgcagagtgctctctaagagtccacctcagtgcctcgtgtgctcagtggtcatgggaaggagcgaaggaaccatccttggttctcccagcttggttgtgtagcaatccctcagcattgtttttctcagcttcttggcaaaaattaaaacaacaacaacaacaacaacaacaacaacaaacagaaggataaactggcttgcctgtggaccctccccggctctggggccagtcgagagccactgagggacccagcactcagagacacaacacacatgtgtagctgcttctggctgagtgtgtttcctgtcaccaatggcctgtttggctggacgatgcctcggcttgaccttttttgaaaagtgctggttagttcccgcccctggtaaacctggggtaggtgggggttctgtcagtcgccatcatacctcgagtgaggcccagctagataatgacttgtccaagatggcacacgtggaaagttgatctgcaccagaacccggatgactgtcaccttgaagcgtcctgttctccttctgtgctgtcccaggaagtgtctggcgggcgtgggcagcacagctctacactgtacgattcactagggcatcctgcgagcctcactagccttctggttcatgcctttgacaagcatttttgtgccccctctgcttactgtgacagtcgatgatgaatcttgcgttgccattttctgctgtgggtaactgcgtgcagtgtcttgccttgctttctcttcttactgtcccacagcttggtttcatgttacaaacagaaaagctcgaggctcccaccccgccacatcccaacttcatttccccctcactgtagcccatttccaccccaccacaaagttgccacaggttttctttgtatagaatatttattttgaagctctattttaatagtatttattttagaaagtctactattgtaagagttcttctgtttgtgaagaaaaaaacaagttaaaaactgaatgtactgatttagaaaatatatataaatatatattgttaaatatacacgggactgccgtt

SEQ ID NO: 24302 - DNA, 246 bp, Homo sapiens
agcggtttgcagcctgatgctcagccccctccccacaggtacaaatgcagtgagtgtcagactggctggttctgggctcccagacccgccaagcagcaaatacagtgttgcgcgtgttctggggattttgatatcctgctgattcagtattctaggactctctgtgccctggctccctcccttcctcacagacctgggccagggaccccatcaatgaaggtaccctagggacccttaagttcaact

SEQ ID NO: 24303 - DNA, 4947 bp, Homo sapiens
gcgagctgagctgacagcgcggagctggcgctgtggagcgcagggagccttgccggttcctccgaccggcgtctgcgagtacagcggcggctaacctgccccggcttcaggatttacacagacgtggggcgatgcttgtgaccctgcagctcctcaaagccagcctgtattgagcggtttgcagcctgatgctcagccccctccccacagggcccctagaagcctgtttctccgtacagtccaggacctccagccccatggagcccccgatcccacagagcgcccccttgactcccaactcagtcatggtccagccccttcttgacagccggatgtcccacagccggctccagcacccactcaccatcctacccattgaccaggtgaagaccagccatgtggagaatgactacatagacaaccctagcctggccctgaccaccggcccaaagcggacccggggcggggccccagagctggccccgacgcccgcccgctgtgaccaggatgtcacccaccattggatctccttcagcgggcgccccagctctgtgagcagcagcagcagcacatcctctgaccaacggctcttagaccacatggcaccaccacccgtggctgaccaggcctcaccaagggctgtgcgcatccagcccaaggtggtccactgccagccgctggacctcaagggcccggcggtcccacccgagctggacaagcacttcttgctgtgcgaggcctgtgggaagtgtaaatgcaaggagtgtgcatccccccggacgttgccttcctgctgggtctgcaaccaggagtgcctgtgctcagcccagactctggtcaactatggcacgtgcatgtgtttggtgcagggcatcttctaccactgcacgaatgaggacgatgagggctcctgcgctgaccacccctgctcctgctcccgctccaactgctgcgcccgctggtccttcatgggtgctctctccgtggtgctgccctgcctgctctgctacctgcctgccaccggctgcgtgaagctggcccagcgtggctacgaccgtctgcgccgccctggttgccgctgcaagcacacgaacagcgtcatctgcaaagcagccagcggggatgccaagaccagcaggcccgacaagcctttctgacagtttgtgtcgaagccccagtgctctgcctggaaacctggttctcttctgacatctaagaagactgcagcaaggtcagaggttttagcctcctgaggctgaccttgctagtctgcccactccctacccccagcttcggaaaatacagagaccaccaccacgtaccctgtattccccaaggtgatgaagaagcactttggggctttttttcagggtcctgaaactttgtgtcaaacagacaatgcaggggcagggtgtggtttggggggaaatttttctttttcagaagacagaacacagatgtggacacatatccggaaactgcagctgcttgaatgccttcccagcccctccttctccctccctccctccgccccccccttcctcttttccattgtctttggctctcacaggagctagctgcctgggaggaattgttaactgagtaccagggtacctttaaagaagacccttggagtcttctataccttcttctccttccccatctcactccaccccactttgtccctgatgtcttggggaaggtgtagaacaccctagcagttcctattgtatatacttgggagccactgagaacagaggacggccagtgagtccaagcctcgttcctccttctgcctccccggagccacaggatggatttaggagccactgctcagtgcacttctcccttccaactgcatcaactaactctcgggggtgttctgctcaccacaccgtccttcggttcttactgagtcacagactcgcctgcccactacgtgtcctgggttctctactcagatcccttccagaaactttatatgggtagaggaagccagggcggcaaatgcgagaccaaatatcattttgccaatgagtctgaggctgtggtctctggatccagtcattatgtttttatagaataattaaaccggatgctaacggtgttttaaaaaataataataaaacaacttgtttccttttggccacccccaggaagggctgatttcaaaatctgggggcgagcaacctcaaggaacacaatttccctccctatcaacaagaggattttaacagcaaagaagagaggcagcacctcccattggcagaatgaccgctgagccaggctgggtttgggtttcttctcttctgattctgctgctcactgtcatagccttttgtgtatagtgatgtgtctgtatctttaatgtaaatagagagatgatgaaaaaagagtctattttagtgttaggaagccccagcaggggagtcggaagagcttggaagagctggggagagggtaggggaaaggtttttccaggggccactgggtttgagccctgcttctgtgcacagccacaccaccctctcccgacagccctcaaagacgtagcaactctttctctcaaggtgctaaaggactcagaaggtgcagcacgtccagtgggtaggtacttgttgcatgcaaaagctgtagtgtatctggtccttcctccccagcttttgtgtggggttcttgctttgtgtggtattttgttttcccctctaatgagagggcatggcctgagtcagaagagctaccccaggtgaaactggaagtgcatgaggcagagcgtccgtagcatttccagtttgttctgtataggacagaggtgcctccgggaaggaggcagcgaggtaggtagctatgataggcacctaatgcttctcaaggacttattttttccttcttgaagactagtagtaacatcttatgatttagagtaagttgattgtaaccataggtatttattgattggaggaagggagggtcatattattttcggctttatttatgtaacatttgctagcttataaaaggcgaatgtgaaatattgcatctgcattttccaaggctgattcgtgtagctacccttgccacagttgtgacggatgtatggatgttcttgaacatttcagaaggagtggtagaaaaaaacacacattcagccaaccacttatatgaattgaatgtatcagaagtgtactgaagggactggagatggttttcctcagatgagggggccccaaaattgatagtgcacatctgcacgctttctgcgaggcctcagaacttttcccagggcccctccctcaaattgtctccatgggaaacttgacccagtggcaagttgcactttggtgatcttggtggtctacacacccgttctgtggagagtcgatttacataagctgtgtatacacacacacacacacacacacacacacacacacacacacccctaccccacactgactgtctaccgacaaagaccctatttcctggcaaacggcctcctgaaccctgactttttgtgtacatacttgtaaacacggatttttctgggttttggtttgctttttccttttttccccctgcccctgttctagcttgttcttcttggtttgctttcaacctgcttgatggatgtctgcagagtgctctctaagagtccacctcagtgcctcgtgtgctcagtggtcatgggaaggagcgaaggaaccatccttggttctcccagcttggttgtgtagcaatccctcagcattgtttttctcagcttcttggcaaaaattaaaacaacaacaacaacaacaacaacaacaacaaacagaaggataaactggcttgcctgtggaccctccccggctctggggccagtcgagagccactgagggacccagcactcagagacacaacacacatgtgtagctgcttctggctgagtgtgtttcctgtcaccaatggcctgtttggctggacgatgcctcggcttgaccttttttgaaaagtgctggttagttcccgcccctggtaaacctggggtaggtgggggttctgtcttaactcgaggggcacctgggatccaggacgcttctagggggctctggctgcccgtgttaatgaaggacagcgcttccgcgagcaccctgggaactgggtcttgggtagcaaagccctcccagagaaaagatgggcacaactaaggctttcctgagcaggaagggggtgaagaccaatcccttcctttggtcctttggtacgcaccccctcagagctgagatggaagacatggctagttcttttcagccttgtggagcctgtcagtcgccatcatacctcgagtgaggcccagctagataatgacttgtccaagatggcacacgtggaaagttgatctgcaccagaacccggatgactgtcaccttgaagcgtcctgttctccttctgtgctgtcccaggaagtgtctggcgggcgtgggcagcacagctctacactgtacgattcactagggcatcctgcgagcctcactagccttctggttcatgcctttgacaagcatttttgtgccccctctgcttactgtgacagtcgatgatgaatcttgcgttgccattttctgctgtgggtaactgcgtgcagtgtcttgccttgctttctcttcttactgtcccacagcttggtttcatgttacaaacagaaaagctcgaggctcccaccccgccacatcccaacttcatttccccctcactgtagcccatttccaccccaccacaaagttgccacaggttttctttgtatagaatatttattttgaagctctattttaatagtatttattttagaaagtctactattgtaagagttcttctgtttgtgaagaaaaaaacaagttaaaaactgaatgtactgatttagaaaatatatataaatatatattgttaaatatacacgggactgccgtt

SEQ ID NO: 24304 - DNA, 444 bp, Homo sapiens
gtcgactgcacaaaacatttggggttccaggtctctaaagcccatccatggaaccccggtttcccttctctcacgtgatcctaacaacctgccgaggatacacctcatcatgatcctcctttcacagctgagaacacaccagcttagagaaattaagaagtgtatccaagctcacacaatcttaagtggccagatcaggaccaaaatccaggtcctctggctgggcgcagtggctcatgcatgtaatcccggctctttgggtggccaaggcgggtggatcacctgaggtcaggagttcaagaccagcttggccaacatggtgaaaccccgtctctgctaagaatacagaaattagctgggcatggtggtgggcgcctgtagtcccagctgctcgggaggctgaggcaggagaattgtttgaacctaggaggcggaggttgcagt

SEQ ID NO: 24305 - DNA, 432 bp, Homo sapiens
agctgagatcgcaccactgcattccagcctgatgacagagcgagacttcatctcaaaaaaaaacaaaattaacacaatgtgtggaaaatataaaattagttagaagatatgtcttagaaattaaacttttagaagagttaatggtaagtggagaatgttaaattttttattacatacttacagctcaacttaagttttcattcagaatcttttattttggtgtgaatgttaaatattcaaaaataatagaatgacacctgtggatttcacatgtgaagtaatctttttcatattaacattaaaatcttgaggaatttctcacacttgtataatgtacttttttattgggtgcagtttacaatttagaggtttcattctttgtcacctaactagtcaactccttggtcattttatctggaaaaattttaagga

SEQ ID NO: 24306 - DNA, 252 bp, Homo sapiens
tcaagagatgggggtctcactatgttgcctgggccagtctcaaactcctggactctagggatcctcccaccttggcctcccaaagtgctgggactacaggcatgagccactgtgcccagccaaggcttttcaactacactttgtatcctactcatcttatgcattctgatgcttttgcatctacctaatactgcctaatcttagtttatcttttataagatttctttcacaacacttacaaatatagcctgg

SEQ ID NO: 24307 - DNA, 408 bp, Homo sapiens
ggtcgacgaatatttcaaatgtcacagggagagaactacctgacttagcagattatagtgatctgatcactggggcatacagtatctcaaagtaggcaatatccctgtctacaaagagtcatatagtctggctttcattccactgctcagtcaggagatgaggaggtcgcatgttcacgctctcgtcaccagccctagctgagctcccaggcaacagccagtatcacttgccagtcatgtgaaagagccatcacggaggtccggggcagtcaaacctccggatgattcccaacctggctgccatctaactgcaatcacatgagagacgccaaacaggaatcctgtcgattcacaaaaccataagagacaatgataagttgtggtttgaaaccattaggttttggggtg

SEQ ID NO: 24308 - DNA, 403 bp, Homo sapiens
ttatacacattcctaagtctttttaaaagccacatgggcaaggcaacttcctttgtccctatcttctgaattaaatcactgcctaatcatctagttaccatataatacctcaaaaagtttccaactttaagaacctattctctttccattaataaatctcattcaatgaagtccagtttgtatccatcttcacaatatggcaagttgtatttctttgcagacattttgtataataaagtctttttttttcctgtaccatgaattgtttgttccttatttatgaaagaaaagtctcttataatttaaaaaattgtgagatgatactcctccactcaaaatattgaacctagatttttttttgagacagggtctgacaccaaggctggaatgcagtggcacttca

SEQ ID NO: 24309 - DNA, 475 bp, Homo sapiens
taaaagatactagtattcacagcaaatgtgcagacgtaactaagacatccccacacctctgttacaactagatatgttcattcgattttggtagttatacagttcccagtgaagtcaccaatgtttattggccccttccttcactgagatacgttcatgggttctgatgagaaatacttgtaattattctaagagcatgctttagcatgcaaccttggtaaaaatatggtaggatcatactcttaaaacatcttttcttttgtctgagtgcaggcattaggtaaattatgtcacacacagcactgcagtgatttatagaagttaaataaatgttcgtaagtaatcttaatacctttaaaatattttgggaggtaaggttttacattatgaaaatattctgagcattttataaaattattcaacatttatactttggttatagtttttgttaaataggaaatatctaattatataa

SEQ ID NO: 24310 - DNA, 138 bp, Homo sapiens
gattgtacattggatgggaactcagggaatcttgttgctagtaccgtcactacttttgttaccttggaaaattaacctctcagagtgtcagagtctctatctgtaaaataaacattttaaatcataaaactttatttc

SEQ ID NO: 24311 - DNA, 373 bp, Homo sapiens
ttcattctcctacaggtttgagctgaattgtgctgggttaaacattatggggagagatggtgcataatttagcttctgtagaaattttatatgataaacttacctgcatagtagagcgaggaatttagaagctacctgacattgtatagattattgaaactttttgagcctcaggttgtcttgaagtggtaagattagtaatttttacctcatctatagtttatgaggattaaataagatggtgtgtgtaatatactgagggtgttacttggcaaaaaggaaaagtcagttctcatatctacccaaacatttgagttttctgagagaaaactctgtgaaattcttcacagagcaacatccctgaatcatgacc

SEQ ID NO: 24312 - DNA, 426 bp, Homo sapiens
tgggcaatatggcaaaaccctgtctctataaaaaatacaaaaattagccaggcatgatggtgcgtgcctgcagtcccagctactcgggaggctgatgtgggaggatcgtttgagcccaggaggcagaggttgcagtgagccaagattgcgccactgccctccagtctgggtgacagagaccctgtctgcaaaaaaaataaaaaataaaggaataatgacatatttgtataaaaatatagaagcacaaaatatgaaaaaaaattttaaccctataaaaatgaatttacactagacaaattgtctttattctgtaatgcatactattttataaggtaataacattatttctaaaaagaaaattttgattttccttaaatgaaagagttatgtcattttcctccaaagatagtatagcttagatttgtg

SEQ ID NO: 24313 - DNA, 322 bp, Homo sapiens
tgtgacttctgaccactatcctgcatgttactttaaaataacagacacaaaagaaaagctatgaaaaattataagaataacagaaaacattaatattaaaattgtcgcttatttcaaagcagtcaagaattcagggcctgctgaaaatatctcatctggccttgttttacatggcactctgctaaaacatttttctctgagctaagactgtggtgtggtagttgaatgaatcaaaaaacaagtccatcagaaaacaaaattacagcgacgtcgtaggcctaagcttatgaataatttggggcctaaatttatggtatgctca

SEQ ID NO: 24314 - DNA, 363 bp, Homo sapiens
taaaatagatgtaaatgagataaaagtttataaatgaactctccacaagaaaagtttatgatatgtttacttaggtttttttcaatgctttttagtaaccacacccttagagttttgctaaactaaattaaatgatgggttagggcccagatgccatggagactttggaacaaactgtcccactttcactggagactagtccagcaagaaagctcccatagtccataatatcatattgaaggaaataaaaatgtattaccacaaacattggccagatctaggcaagattaactgagagtctgattcttctcttcacccctgcaatatcacgccaagcattttcttttctcatccaagaaaacc

SEQ ID NO: 24315 - DNA, 367 bp, Homo sapiens
tttatttgagacagcgtcttgccctctcacccaagctggagtgcagtggcgcaatcatggctcactacgtcgaactcctgagctcaagtgatcctcctgcctcagcctcgcaagtagctgagactacaggcacacaccaccatgcctagttaatttttttaattttttttggagaaatggggtcttaccacgtcgcccaagctggtctcaaactcctggccacaaactatcctcctacctcagcttcccaaagtgctgggattacaagcgtgagccaacatggccagccttaccttttacttttaaattatgttagccacatttcaagtgctcaatagccacatgtggtgtgagcagctatcacgtg

SEQ ID NO: 24316 - DNA, 723 bp, Homo sapiens
cttaccattagatctagcatgaagccctcacccatgccgtgtaactctacatttactccttccttccatcttcaggggaaaagaagcaggggctgataaaacaagcagagaaggcccagggtcggtttattgacttctaaggactattggtcttttgcagtgaaggaaaaaaaaaaaatgccttaggacctgctaggtgctaatttgacctggcaatgaggtaaagttaggctttggctgtcttcaacctcctaggatcggaatgccatctacttagcataggagtcagacaattccctgggcaatagatcgctttccacttgtggagctactgaataaatagcaaagtaattaacagtgtgctatggctagatgtatcaggtggaatttcattacagcagaaagaactgagagaatgaaggagtcattttgtgtccaccgtcaggtgaatcgtttgtgctttctttcactaggatggacaggttatctctgctttcttcaagaagagaaatttctgaattccctatcatatcttcactttgatcaaggggaaaggaagaaaagaaaactcttaagtgcctaaaattggtccaaaaataaagaattcttctcatttttccatttaatgattttgttcctgaaacctatgggtgattctcttttgttgtattttttgtttctttattttttctcaactattaaatatctaaattttgaaatgtg

SEQ ID NO: 24317 - DNA, 298 bp, Homo sapiens
gttctgctttcacataaatacagtcatacagtgcacactattttgcatctgtattccctcactgttatactcatgaaattcttcaaattattttgcaaagttgaagcatgtctgttttcatcattctgtagcattctattgcattgctctactacaatttatttatctgttctattgttgatgggcatttgtatcattttcagtctgaagctattatagataatgctgaaatgagcatttcaatacatgtcttttggtgaacaaatcgacacatttctatttggtaaattggtattcg

SEQ ID NO: 24318 - DNA, 476 bp, Homo sapiens
actcttcagcctgtcaaaaattgctgggattacaggagtaagccacccacacctggcctattttttaaattgtgaatcatttttactgattattgtacgtttacataaaaggacgtaaaatataaacagctaagctatcactaagcaaagacccctgtatcttatcactcaagactttctattaatggtttgccgtagagtttatatatctttgacttttaagaaagtctaacactggctgggcgtggtggctcacacctgtaatcccagcatcttggggggctgaggtgggtggatcgcttgaggtcaggagtttgagaccagcctggccaacatggtgaaaccctgtctctactaaaaatagaaaaattagctgagtgtggtggcacttgcctgtagtcccagctactctggaggctgaggtgggagaattgcttgaaccccagaggccgagattgccccactgcactccagcc

SEQ ID NO: 24319 - DNA, 465 bp, Homo sapiens
ctcctcggcatttatttatgagaaatgaatggaaatcatgtccacacaaaagcctttatgtgaatgtttatagtagccttattcacaattgctattctacaacccaaatgcttttacaaatgaatgggtatacaagctgtggtacatccattaatactcatcaactaaaaagaatggactcgatgtatgtacttacttggatgcctctcagaggcaatatgctgagcttacaaagggagacttagaaggctacagactgtatgattccatctatgtcacattcttgaaaagtaaaaatatgtagtgatagagaaaagggataagtactagagcctatgggtattgagaaggtgtggctataaagctgaaaagtgatagcacaagtgaattttttggtgtgatagaactgggctatattttgattgtggtggtggttatacaaatctatgtatctatttaacattc

SEQ ID NO: 24320 - DNA, 243 bp, Homo sapiens
gaaaggagtgaggaagtgtgtgatgagatgggagagcagctaggaggctactgcataaactcaggtaagaaataaaaatggcctagtgatagcattggcaatttgcaaggagaagagggctgataatggcatcattaaccaggagagatttagagcggagaataagccactatagaggaaagttatagagctgattttggaatatgtcgactatggtgaatgtggggtatccaggaagtgggc

SEQ ID NO: 24321 - DNA, 404 bp, Homo sapiens
ccacagtccttgttgacttttaaaaagttttactagggtaccacgtccagtgtcttgaccccaggctggtaaccatcgcttgcccattactctgcaccagcttctttacatgcattttcagtctcttcgttttccatgttaactatgctacaatcaactaaaagtccttaatgtgctaatttaggaaagaccttaaccattctccaaactactaatgacccccaccatttgatcccactctccctgtaaaactagcttttattattccacaacgtggagcctctgttggggttggccagtattctcatcatccctccaccatgccatgtttattaatgagtcaaggtttgtggccatgctccttttttccaattaaatactgtttgctttatcgtttaatcaaa

SEQ ID NO: 24322 - DNA, 422 bp, Homo sapiens
gacacatcttgtgcttccctatttaatattttctctactgtctgtactccccacagatcctgataaagcaagcttcataaagtaggtgccaggctgggcatagtgactcacacctgtaattccaacactttgggaggctgaggcgggagggtggcttgaggccaggagctcgagaccatcctgggcaacatagcaagaccccatctttactactactactactactactactactactactgctactactactactactactaataataataataataataaagtagatgccagttaatgcttttgactgacccaccttcatagtcctattcacgttctcaaagtttaacacaactattatcatcccataaaatcaagagacacttatgggtatacatacatgtatagtagcagtttgtttt

SEQ ID NO: 24323 - DNA, 776 bp, Homo sapiens
tttttttttgagacaaagtctcgctctgtagcccagtctggagtgcagtggcgcgattttggctcactgtaacctccatctcctgggttcaagcaattctcctgtctcagcctccctagtagctgggactgcaggtatgtgctaccacacctggctaatttttgtatttttagtagagatggagtttcaccatattggtcaggctggtcttgaactcctgacctcaggtgatccacccacctcggcctcccaaagtgctgggattgcaggcgtgataaacaaatattcttaatagggctactttgaattaatctgcctttatgtttgggagaagaaagctgagacattgcatgaaagatgatgagagataaatgttgatcttttggccccatttgttaattgtattcagtatttgaacgtcgtcctgtttattgttagttttcttcatcatttattgtatagacaatttttaaatctctgtaatatgatacattttcctatcttttaagttattgttacctaaagttaatccagattatatggtccttatatgtgtacaacattaaaatgaaaggctttgtcttgcattgtgaggtacaggcggaagttggaatcaggttttaggattctgtctctcattagctgaataatgtgaggattaacttctgccagctcagaccatttcctaatcagttgaaagggaaacaagtatttcagtctcaaaattgaataatgcacaagtcttaagtgattaaaataaaactgttcttatgtca

SEQ ID NO: 24324 - DNA, 971 bp, Homo sapiens
tttttttttgagacaaagtctcgctctgtagcccagtctggagtgcagtggcgcgattttggctcactgtaacctccatctcctgggttcaagcaattctcctgtctcagcctccctagtagctgggactgcaggtatgtgctaccacacctggctaatttttgtatttttagtagagatggagtttcaccatattggtcaggctggtcttgaactcctgacctcaggtgatccacccacctcggcctcccaaagtgctgggattgcaggcgtgataaacaaatattcttaatagggctactttgaattaatctgcctttatgtttgggagaagaaagctgagacattgcatgaaagatgatgagagataaatgttgatcttttggccccatttgttaattgtattcagtatttgaacgtcgtcctgtttattgttagttttcttcatcatttattgtatagacaatttttaaatctctgtaatatgatacattttcctatcttttaagttattgttacctaaagttaatccagattatatggtccttatatgtgtacaacattaaaatgaaaggctttgtcttgcattgtgaggtacaggcggaagttggaatcaggttttaggattctgtctctcattagctgaataatgtgaggattaacttctgccagctcagaccatttcctaatcagttgaaagggaaacaagtatttcagtctcaaaattgaataatgcacaagtcttaagtgattaaaataaaactgttcttatgtcaaaaaagcacaccaaacaccacaccaacaatcttccccgcctcgcccagaaggttcaaaccccacgctggccggggacccccgcaaggaccgggcaccccggccgggcacccggccgacaagggggctccccaaaaaacgcgggcacgacgcacaaccgggagggggaggctccagaccgggtatcaccacgcgcg

SEQ ID NO: 24325 - DNA, 1441 bp, Homo sapiens
tttttttttgagacaaagtctcgctctgtagcccagtctggagtgcagtggcgcgattttggctcactgtaacctccatctcctgggttcaagcaattctcctgtctcagcctccctagtagctgggactgcaggtatgtgctaccacacctggctaatttttgtatttttagtagagatggagtttcaccatattggtcaggctggtcttgaactcctgacctcaggtgatccacccacctcggcctcccaaagtgctgggattgcaggcgtgataaacaaatattcttaatagggctactttgaattaatctgcctttatgtttgggagaagaaagctgagacattgcatgaaagatgatgagagataaatgttgatcttttggccccatttgttaattgtattcagtatttgaacgtcgtcctgtttattgttagttttcttcatcatttattgtatagacaatttttaaatctctgtaatatgatacattttcctatcttttaagttattgttacctaaagttaatccagattatatggtccttatatgtgtacaacattaaaatgaaaggctttgtcttgcaaaaaaaaaaaaaaaaaaaaaaaaaaaaaaaaaaaaaaaaaaaaaaaaacaaaaaaaaatagaagaaaaaaaaaaaaatgaaaagagaggaggagagaggaagaagaagaaacaagaaggagacgaatcagagagagagggagagaaggaagggatgaagggaaagaacggagagaggaggggaggggcaaaggaataggagaaggaagagaggagggaaagaggagaaggggagatgatgagacaaggaggggagggaagtagagggaagaaagagcagcgggggaaggcgagggcttgcgagagaatgggaagagaggagaggagagggagaggggaggaggggtgcgacgtgggggacgagggagagcgaggcggagaggggggaggggaggagaagggaggggagggggaggggagggggagggggggtgagttggtggggaggtgggagagagggtagggacagagagacggagacgaaagaaaagacagaagaagtagtggtcgggcggagtatgtagggagaggggagacaggagggagagagagaggaagagaagcgcgggtagtgacaacagcggagaggggacaaggtggcgagagcgtgaaacattaagaagatagaagataaaaagagggagatgaagaaagaataggagaggggtatggggagcgcgaggagcagatgagtgtagaataaatgggtggaagggaggagctagtagagagacggtaaggataggcggagtataatgtatgggatatagttagatgtggagaggatatctactataaatgctagtgggagggttaggaatagttgaagtagaagtaggagatagaggagaagaa

SEQ ID NO: 24326 - DNA, 394 bp, Homo sapiens
cagtatttgaacgtcgtcctgtctatacaataaatgatgaagaaaactaacaataaacaggacgacgttcaaatactgaaacaatttttaaatctctgtaatatgatacattttcctatcttttaagttattgttacctaaagttaatccagattatatggtccttatatgtgtacaacattaaaatgaaaggctttgtcttgcattgtgaggtacaggcggaagttggaatcaggttttaggattctgtctctcattagctgaataatgtgaggattaacttctgccagctcagaccatttcctaatcagttgaaagggaaacaagtatttcagtctcaaaattgaataatgcacaagtcttaagtgattaaaataaaactgttcttatgtca

SEQ ID NO: 24327 - DNA, 388 bp, Homo sapiens
acttcagatgaactgtggacccctaaaactgtatacaaaaatgtgggctatctacatttgttaattttttgagagttattatatcatttcttagattctcaaaagagtttgtgaccaaaaaaagttaaaaataactgttctaagattccacaggaatcatctgtctcagggggactttgtagacttctgaaacactagagctaaggaacttcatgtggcccagccaccacaggagccaaccctagaaatgtaggtgcagccttcaaaacccccagaaagacatcctgcatccagctcagccatttctccctgtgattaaggctgtgaaccagatgctaagcaaggttttctgttctacaaaaaaggcaacaacaacaagaaaacacca

SEQ ID NO: 24328 - DNA, 239 bp, Homo sapiens
cacatcttggaaaatctgttgaatgtaaaaagagaatgcttccagttttatagagctcagaaataagcaaaagtacttgttatgtataataactgaactatcttttaaaaagcaagggaacagcctgggctcagtggcttatgcctgtaatcctagcactttgggaggccaagggggaacagatcacctcaggtcaggagttcgagaccagcctgaccaacatggtgaaacctcgtctc

SEQ ID NO: 24329 - DNA, 384 bp, Homo sapiens
caaatgatgaggtgctggggaaaatatttggcttccttttcaggtgtcgagaccacattgtctctcgacaattggtcgagagattatacctgtcctttggggagaagacagagaaacaagatagaataaaaaaaggggtgattacaactctcactgatatggtaatcacaaaggcccctctcttcaccacatcctccactgttttgcagggtctggaatcccaaaggacaatactgactagcctaacagggagttagggtgggaaaactgggatgaaggaagaatgtgggaaggcagtacttttctatattgacgaacacccaaaaataaagggttaatatcttgagatgggaacaactcttgtggatgaaagaatgaggtttc

SEQ ID NO: 24330 - DNA, 933 bp, Homo sapiens
cagaactgagcagacggtgaggttgcactgtgacttagtctcaatgggaactccagccaatcccatgggagttctggagctagtataacctttcagtgttgtcctaaggcaaggtgaggaagggaagggggtctttacagtcacaggtggatcaggtatagatgtgtaggctgccctgggaaggagtgtgaccttggacaagacagctgtctctggctgaggcaatcctcatattggtctggcagtggggtgggacttctttgtccctggaggaggatctcagctgcatatcagagtccaccacatggacttgcagcctctgagagtgaggcagcatagcacagtctcaggaatcagactgttgggttcaacgttcacctccaccagttactcaataacctctgtgatcctcagtttccttatttgcaaaatgagaataatgctgaatgtttaagtataactgaatattgtagaaggctgagtcaaggagtcctaccacacagtgtgcagtgtcttactcaaatatctcaatagatgtgtctctttctgcaagtctctcctctagaattctcaaggcagcggattatttgcaccttccccctccttccaccaactacatccagtcctttctacttctctcttcatgacaagcagagtagcttccttcttagcattaaatctggatacctcctgtggctttcatccactctctatctacccttcggggcccaaatagtaaatattttaggctatgtggtctttgttgcaactactcaactttgcccatgcaatgctaaaggttgacagtttctaaatgcatgggtatgagtgtttcaatgaaactttattgataaaaacaggaagtgggctgtattttgcctgcaggccatagtttgctgacctctcctccatttcattgtgttttgaacaaac

SEQ ID NO: 24331 - DNA, 605 bp, Homo sapiens
ctcccaaagtcctaggattacaggtgtgaggcactgtgcctacccacctcctgcttcctattcattgtcaagtcctgttgggtcggtcccctctgtgtccctgccatccactcgattccctctgcgtccactgcccctgcccaggccatcggcaccactcacctccatccctgtggtagcctccacctcagtccatcctctcacactgctggccagagacctttccagagcagctctgtcccatcttgggtgccatccttgaatggttgcccagggcctgcagagtaaagtacacacagcccctcagggtggcttctgggacccctaaaatctgcttcctttgtccctccctggactcatttctcacttccccaggaattcaattcgtttgggttccttagctgagccaggcacactccccactttgggttcgggttttgacctatttcttctgggagccttctgttgacaccctggggtgggagatgctgcttgcttttccctgcagcctgcacttggcctgttgtacctgctcatttaatcatgtcttcccacctgagcttcgagagggggactcaggcctgctgccttatacaacacctagc

SEQ ID NO: 24332 - DNA, 399 bp, Homo sapiens
aagaaggggaagaagatcaaaacccaccatgccccaggctcaacagcgtgctgatggaagtggaagagcctgaagtcttacaggactcactggatagatgttattcgactccatcaatgtactgtgaactacgtgactcattccagcactacagaagtgtgttttagtcatttgaggaacagcacatcagctttgcccttgacatggacaataggttctttactttgacggtgacaagtctctatctggtcttccagatgggagtcatattcccacaataagcagcccttactaagccgagaggtgtcattcctgcaggcaggacctataggcgcctgaagatttgaatgaaactatagttccatttggaagcccagacataggatgggtcagtgggca

SEQ ID NO: 24333 - DNA, 2170 bp, Homo sapiens
gctgcttttccggctttgttggagattgacgcggcagtgcacacctgctggtacgtgcaaaagtagccgacaggccagagtttccagtttcggtggcttcgtaggcttttagcttctgaaatccgctaaaagcggcggttcattcatcttcaagtacctagcctgactggtagggctgctcagcattccgaaacatttcgacctggggaggggggcggcggtgaaagaatactttctgtagagagtgcccctcgcgtcgcccctgctttgaaggctttatgtattaacggaatgccgaacatttgtgtcctacttgctgacagcgcacaggatccttctaacagtatttctcaagtacttaacaaaaagatgaaaacttgaagtccaagccgtgctgctgattccgtctcacagtttaaagactgtccagaaactttaagctttcaaaactgtacattttaaaatcctgtgcgtttatcttcattttgctgggcagaaagccaaagtactggactgcctggttcagggctgaacgcctagtacacctgctaacttggagcttcagagccatggcaaccaaggagtcaagagacgccaaagcacagttggccctctcctcatcggccaatcagagcaaggaagtgcctgaaaacccaaactatgctctcaaatgtactcttgtgggacacacggaagcagtgtcatcagttaagtttagtcctaatggagaatggctagcaagttcttctgctgataggctaatcataatttggggagcatatgatggaaaatatgagaaaacactctatggtcataatttggaaatatcggatgttgcctggtcatcagattccagtcgtcttgtttctgcctcagatgataaaactctaaaattatgggatgtgagatctggaaaatgtttgaaaacactgaaggggcacagtaattatgtcttttgttgtaacttcaatccgccatccaaccttataatctcgggatcttttgatgagactgtaaaaatatgggaggtgaaaacaggaaagtgtctcaagactttgtctgctcattctgacccagtttctgctgttcattttaattgtagtgggtccttgatagtgtcaggtagctatgatggcctctgtagaatctgggatgctgcatcaggtcagtgtttaaaaacgctcgttgatgacgataaccctcctgtctcttttgtaaaattttctccaaatggtaaatacattctcactgcaactttggacaacactcttaaactatgggattatagcagaggcaggtgcctgaaaacatacactggtcataagaatgagaaatattgcatatttgccaatttttcagttactggtggaaagtggattgtgtctggttccgaggataacctggtttacatttggaaccttcagactaaagagattgtgcagaaattacaaggccatacagatgttgtgatctcagcagcttgtcatcctacagaaaacctcatcgcatcagcagcattagaaaatgacaaaacaattaaactgtggatgagtaaccactaatccctttgaaaatcaagtagtagagccaagttggccaaaaaacttggatatttaaaaagacggtttcttttaattttggcagtttggtattttaaaaattgtctattgttaaattttgagattcatacactacatttacaaaatgagatagttgaaaaagcacatctagaattcagcttctgactaccaatcttttttgagcaactttttgtaatttttatggatttatgtcacttttattacagggatatattgcatagtggtgaaatctgggcttagtataccctcacccaaatagtatacattgtacctagtaaatactttcccatctctcaccccactcccacctttgaaggctctagtgtctatgattctgctctccacgtccaggtgtacacattgtttatctcccacttacgagaacatgtggtttttgactttctgtatcattacttcacttaatggcctccaggtccatccatgttgttgcaaaagataagatttcattatttttttttttttttttttttttttttttttttttttttttttttttttttttgggggggggggggggggacaacagacaaggggggggaagggggggg

SEQ ID NO: 24334 - DNA, 2116 bp, Homo sapiens
gctgcttttccggctttgttggagattgacgcggcagtgcacacctgctggtacgtgcaaaagtagccgacaggccagagtttccagtttcggtggcttcgtaggcttttagcttctgaaatccgctaaaagcggcggttcattcatcttcaagtacctagcctgactggtagggctgctcagcattccgaaacatttcgacctggggaggggggcggcggtgaaagaatactttctgtagagagtgcccctcgcgtcgcccctgctttgaaggctttatgtattaacggaatgccgaacatttgtgtcctacttgctgacagcgcacaggatccttctaacagtatttctcaagtacttaacaaaaagatgaaaacttgaagtccaagccgtgctgctgattccgtctcacagtttaaagactgtccagaaactttaagctttcaaaactgtacattttaaaatcctgtgcgtttatcttcattttgctgggcagaaagccaaagtactggactgcctggttcagggctgaacgcctagtacacctgctaacttggagcttcagagccatggcaaccaaggagtcaagagacgccaaagcacagttggccctctcctcatcggccaatcagagcaaggaagtgcctgaaaacccaaactatgctctcaaatgtactcttgtgggacacacggaagcagtgtcatcagttaagtttagtcctaatggagaatggctagcaagttcttctgctgataggctaatcataatttggggagcatatgatggaaaatatgagaaaacactctatggtcataatttggaaatatcggatgttgcctggtcatcagattccagtcgtcttgtttctgcctcagatgataaaactctaaaattatgggatgtgagatctggaaaatgtttgaaaacactgaaggggcacagtaattatgtcttttgttgtaacttcaatccgccatccaaccttataatctcgggatcttttgatgagactgtaaaaatatgggaggtgaaaacaggaaagtgtctcaagactttgtctgctcattctgacccagtttctgctgttcattttaattgtagtgggtccttgatagtgtcaggtagctatgatggcctctgtagaatctgggatgctgcatcaggtcagtgtttaaaaacgctcgttgatgacgataaccctcctgtctcttttgtaaaattttctccaaatggtaaatacattctcactgcaactttggacaacactcttaaactatgggattatagcagaggcaggtgcctgattactggtggaaagtggattgtgtctggttccgaggataacctggtttacatttggaaccttcagactaaagagattgtgcagaaattacaaggccatacagatgttgtgatctcagcagcttgtcatcctacagaaaacctcatcgcatcagcagcattagaaaatgacaaaacaattaaactgtggatgagtaaccactaatccctttgaaaatcaagtagtagagccaagttggccaaaaaacttggatatttaaaaagacggtttcttttaattttggcagtttggtattttaaaaattgtctattgttaaattttgagattcatacactacatttacaaaatgagatagttgaaaaagcacatctagaattcagcttctgactaccaatcttttttgagcaactttttgtaatttttatggatttatgtcacttttattacagggatatattgcatagtggtgaaatctgggcttagtataccctcacccaaatagtatacattgtacctagtaaatactttcccatctctcaccccactcccacctttgaaggctctagtgtctatgattctgctctccacgtccaggtgtacacattgtttatctcccacttacgagaacatgtggtttttgactttctgtatcattacttcacttaatggcctccaggtccatccatgttgttgcaaaagataagatttcattatttttttttttttttttttttttttttttttttttttttttttttttttttttgggggggggggggggggacaacagacaaggggggggaagggggggg

SEQ ID NO: 24335 - DNA, 2128 bp, Homo sapiens
  misc_feature (33)..(33): n is a, c, g, or t
gtggtgaagtagagagggttggctttggggtgnggaaaggtgatgtttcggtggcttcgtaggcttttagcttctgaaatccgctaaaagcggcggttcattcatcttcaagtacctagcctgactggtagggctgctcagcattccgaaacatttcgacctggggaggggggcggcggtgaaagaatactttctgtagagagtgcccctcgcgtcgcccctgctttgaaggctttatgtattaacggaatgccgaacatttgtgtcctacttgctgacagcgcacaggatccttctaacagtatttctcaagtacttaacaaaaagatgaaaacttgaagtccaagccgtgctgctgattccgtctcacagtttaaagactgtccagaaactttaagctttcaaaactgtacattttaaaatcctgtgcgtttatcttcattttgctgggcagaaagccaaagtactggactgcctggttcagggctgaacgcctagtacacctgctaacttggagcttcagagccatggcaaccaaggagtcaagagacgccaaagcacagttggccctctcctcatcggccaatcagagcaaggaagtgcctgaaaacccaaactatgctctcaaatgtactcttgtgggacacacggaagcagtgtcatcagttaagtttagtcctaatggagaatggctagcaagttcttctgctgataggctaatcataatttggggagcatatgatggaaaatatgagaaaacactctatggtcataatttggaaatatcggatgttgcctggtcatcagattccagtcgtcttgtttctgcctcagatgataaaactctaaaattatgggatgtgagatctggaaaatgtttgaaaacactgaaggggcacagtaattatgtcttttgttgtaacttcaatccgccatccaaccttataatctcgggatcttttgatgagactgtaaaaatatgggaggtgaaaacaggaaagtgtctcaagactttgtctgctcattctgacccagtttctgctgttcattttaattgtagtgggtccttgatagtgtcaggtagctatgatggcctctgtagaatctgggatgctgcatcaggtcagtgtttaaaaacgctcgttgatgacgataaccctcctgtctcttttgtaaaattttctccaaatggtaaatacattctcactgcaactttggacaacactcttaaactatgggattatagcagaggcaggtgcctgaaaacatacactggtcataagaatgagaaatattgcatatttgccaatttttcagttactggtggaaagtggattgtgtctggttccgaggataacctggtttacatttggaaccttcagactaaagagattgtgcagaaattacaaggccatacagatgttgtgatctcagcagcttgtcatcctacagaaaacctcatcgcatcagcagcattagaaaatgacaaaacaattaaactgtggatgagtaaccactaatccctttgaaaatcaagtagtagagccaagttggccaaaaaacttggatatttaaaaagacggtttcttttaattttggcagtttggtattttaaaaattgtctattgttaaattttgagattcatacactacatttacaaaatgagatagttgaaaaagcacatctagaattcagcttctgactaccaatcttttttgagcaactttttgtaatttttatggatttatgtcacttttattacagggatatattgcatagtggtgaaatctgggcttagtataccctcacccaaatagtatacattgtacctagtaaatactttcccatctctcaccccactcccacctttgaaggctctagtgtctatgattctgctctccacgtccaggtgtacacattgtttatctcccacttacgagaacatgtggtttttgactttctgtatcattacttcacttaatggcctccaggtccatccatgttgttgcaaaagataagatttcattatttttttttttttttttttttttttttttttttttttttttttttttttttttgggggggggggggggggacaacagacaaggggggggaagggggggg

SEQ ID NO: 24336 - DNA, 3985 bp, Homo sapiens
tgttcggtttggtggttggccggtgggccggagacgcaccgtagaaaccgaaccctcttacccaattggacgccgtccccaagagacacatctcaattcaaaggcagcttgctgatctagagaatttagcttttgtaactgatggaaattttgactctgccagctcattgaactcagataatcttgatgcaggcaacagacaggcttgtccattgtgccctaaggaaaaattcagagcttgtaatagccataagcttcgtcgtcacctccagaatttacactggaaagtctcagttgaatttgaaggttacaggatgtgcatctgtcacttaccttgtcgaccagtgaaaccaaacattattggagaacagataaccagtaaaatgggagcccattatcattgtatcatttgttcagcaacaatcaccagaagaactgatatgctaggacatgttaggcgccacatgaataaaggagagactaaatctagttatattgcagcttccactgctaaaccacctaaggaaattttgaaagaggcagacacggatgtacaagtttgtcccaactattctatacctcagaaaacagattcctattttaaccccaaaatgaaactaaatcggcagctaatattctgtacattggctgctttggctgaggaacgaaaacctttggaatgtctagatgcttttggagccactgggataatgggattacagtgggcaaaacatcttggaaatgcagtcaaagttacaatcaatgacttgaatgaaaattctgtgacactgattcaggaaaactgccatttaaacaaattgaaagtggtggtggacagtaaggaaaaggaaaagagtgatgatattcttgaagaaggagagaaaaatcttggtaatattaaggtgaccaaaatggatgccaatgtactgatgcatttgagatcttttgatttcatacatctagacccttttggaacatcagtgaattatctagattctgcattcagaaatataagaaaccttggcatagtgtcagtgacttctacagatatcagttctttatatgccaaggcacagcatgttgcccggcgtcactacggatgtaacattgtccgaactgaatattacaaggaactagcagccagaattgttgtagctgcagtggcaagagctgcagcccgatgcaacaaaggcatagaagtactgtttgcagtggctctggaacattttgtgttggtagttgtgagagttttgaggggacctacttcagcagatgaaacagccaagaagattcaatacctgatccattgtcagtggtgtgaagagagaatttttcagaaggatggtaatatggtagaagaaaacccatatagacagctgccttgtaactgtcatggaagcatgcctggaaagacagcaatagaacttggacctctgtggtcaagttcccttttcaatactggattcctcaaaagaatgctatttgaatctcttcaccatggtttggatgacattcagaccctaataaagacattaatctttgaatcagagtgtacgcctcaaagtcagttttcaattcatgcatcttcaaatgtcaacaagcaagaagaaaatggtgtatttattaaaactacagatgacaccacaacagataattacattgcacaaggaaagagaaaaagtaatgaaatgatcacaaatttaggcaagaagcaaaagactgatgtcagtactgaacatcctcccttttattacaacattcacagacacagcattaaaggaatgaatatgccaaagttaaaaaagtttttgtgctatttatctcaagcaggctttcgagtaagccgaactcattttgacccaatgggtgtacgcacagatgcacctctgatgcagtttaaatctatccttttaaagtacagcacccccacctacactggaggacagtcagaaagccatgtccagtcagcatctgaagatacagtaactgaaagagttgaaatgtcagtgaatgacaaagcagaagcaagtggctgcagaagatggtaaacgtagagaagaattggttctcaggtgtctgtatagatggcctaatagttctctataccaactgtagttctttttctgttctttcaattcagtagagtaaaaataaaaaacagtgtcattttcattcagaaactgagcagtttctaacttagctggtttgggagctttgctttccaagtttttttttgttttaaggcaaacttaaaattttaatggaaacatttcatatgaagccaagtctcactgagatcaccctactgcttaataattcagaaaattttcacatgcaaagtgtttggaattttatgtatgttatgaaagccatcttttacaattcttaatcacatctctgcctaaactgattcatgatgtttatgttttcctgtttgtagtgtacaaaatgaagctgaaggctcacatgttaaaatgaccctgaatagaataggaagaacagtgttcttacaggtcataatgtatttcacaattaaaaaactaaaatatgtacccatttttaagaaatcatacttctctccacattgatcttttcatttcttactagcttttaagaaattaaatacttgcctgagatagaaatactttatttttgtaactttaaggtctaaatgactaaacttcaaagtaagattttgtcagaataaattgagaccattaatctaatataatacttgttcatgagcactgaaatcctgaagaggagagatttggttataaattaaaaaggttgggtgatcttaagtgcctcagttaatgcacgtacagtattcatttggttggttgtactacctctcagaagtaaaatttgtcaccttatggaatgagagtttttgggtttgggggttgtttttttgttgttgcttggtttggtatttttggttttgtgtgtatttgtataaattttctgtataattagcccaggctgatgtaactataaaaattagttgaaaaaaaaaatattgtttccttaatggaattctcacttcatttgaatataagattttggatgaaaggatttggtataaagtttgggtttttgtctcaaggatttgatccatatttatccctaaatatttcttaagggatgtaactttttataaccattaagtggggggaagggggtggagggggtggtaataattataactgaaaggtttaaatatactacctaagaaaaaagtacttctgtgacatatacaaaaaaatctagtggataggcattagatgaatagagaatattaattttgcagaaatgaaggaaaatctcttcgtgctagtacagcgtattcccaagagagtttattttcctttctccaattaatgtggtcataaatttcggtaaaatcaagaaataggtgaagtgcaagctagtttctataatgaccattaaaaaaattctgctgtgtaattcttgccagttaaaattataacttgcaaatgagcagaataaatgaggtttttttcaattaaaaattactataaatccaggaggcaaactattttagcactcagattatctgatttaatacatattattgaatatcagtctcaaattttgctaaatgcttatcagcatgaaatatgttgatcagtgatgagttgggcttaatgcaaagatcctaatttaataaagaaacctgtaaattactgttacctaaaatatatgtgtatattaatttcacatataaaggtagatttttcaaagaaaaatttggtaggcggtagtttagaactctgatcaggtactacatcaaccaaaagaggaaatactttaaaaattccttttagcaacctgagcaatcttattctcgtaacaatagtagtaatttgggacattgcaaatgtttatcatgttgtaaagtagcatcagttgtatcctttcattaaaacttgataaacaaaagaacgagttaaggaaacca

SEQ ID NO: 24337 - DNA, 314 bp, Homo sapiens
atgtaacattgtccgaactgaatattacaaggaactagcagccagaattgttgtagctgcagtggcaaggtaccaaattgccaacagtgtacttagtgtgtttcagtatttgataaaaagagataatattacaagaagtacttaccttattcaaaatatgcacaaaatataaattctgtattccttatctgtaatactggtttttaatcttacgtggtatctgttgtaattttatttaaaagtttatacctgaaatattcagtttactctccaattaaaatgttactgaaataaagtataagaaagaaaaggta

SEQ ID NO: 24338 - DNA, 4491 bp, Homo sapiens
tgttcggtttggtggttggccggtgggccggagacgcaccgtagaaaccgaaccctcttacccaattggacgccgtccccagtacgcttctgcgcagtttgtggtggcgtcgtaacgcctcggggaaagggaagcggacgggcatctggaatcgctgcctctggctttctgttttctactaacaggatttggtcactggttcttcatcttttgtctgttgcacgcatcccgccctccccacttgcttccccactccttggatccagccctgtgggcattcacgtcagttctctgaccccgccgtgagccccgctccgggtccccgggcgggcttggcacggaggcggtaactatggagaatatggcggaggaggagctgctgcccctggagaaggaggaggtggaggtggcccaggtccaggtcccgaccccggcccgggactcggctggggtcccagctccggccccggattcggctctggactcggctccgactccggcctcggctccagccccagcccctgccctggcccaggctccggccctgtccccgtccctagcctctgcccctgaggaggctaaaagcaagagacacatctcaattcaaaggcagcttgctgatctagagaatttagcttttgtaactgatggaaattttgactctgccagctcattgaactcagataatcttgatgcaggcaacagacaggcttgtccattgtgccctaaggaaaaattcagagcttgtaatagccataagcttcgtcgtcacctccagaatttacactggaaagtctcagttgaatttgaaggttacaggatgtgcatctgtcacttaccttgtcgaccagtgaaaccaaacattattggagaacagataaccagtaaaatgggagcccattatcattgtatcatttgttcagcaacaatcaccagaagaactgatatgctaggacatgttaggcgccacatgaataaaggagagactaaatctagttatattgcagcttccactgctaaaccacctaaggaaattttgaaagaggcagacacggatgtacaagtttgtcccaactattctatacctcagaaaacagattcctattttaaccccaaaatgaaactaaatcggcagctaatattctgtacattggctgctttggctgaggaacgaaaacctttggaatgtctagatgcttttggagccactgggataatgggattacagtgggcaaaacatcttggaaatgcagtcaaagttacaatcaatgacttgaatgaaaattctgtgacactgattcaggaaaactgccatttaaacaaattgaaagtggtggtggacagtaaggaaaaggaaaagagtgatgatattcttgaagaaggagagaaaaatcttggtaatattaaggtgaccaaaatggatgccaatgtactgatgcatttgagatcttttgatttcatacatctagacccttttggaacatcagtgaattatctagattctgcattcagaaatataagaaaccttggcatagtgtcagtgacttctacagatatcagttctttatatgccaaggcacagcatgttgcccggcgtcactacggatgtaacattgtccgaactgaatattacaaggaactagcagccagaattgttgtagctgcagtggcaagagctgcagcccgatgcaacaaaggcatagaagtactgtttgcagtggctctggaacattttgtgttggtagttgtgagagttttgaggggacctacttcagcagatgaaacagccaagaagattcaatacctgatccattgtcagtggtgtgaagagagaatttttcagaaggatggtaatatggtagaagaaaacccatatagacagctgccttgtaactgtcatggaagcatgcctggaaagacagcaatagaacttggacctctgtggtcaagttcccttttcaatactggattcctcaaaagaatgctatttgaatctcttcaccatggtttggatgacattcagaccctaataaagacattaatctttgaatcagagtgtacgcctcaaagtcagttttcaattcatgcatcttcaaatgtcaacaagcaagaagaaaatggtgtatttattaaaactacagatgacaccacaacagataattacattgcacaaggaaagagaaaaagtaatgaaatgatcacaaatttaggcaagaagcaaaagactgatgtcagtactgaacatcctcccttttattacaacattcacagacacagcattaaaggaatgaatatgccaaagttaaaaaagtttttgtgctatttatctcaagcaggctttcgagtaagccgaactcattttgacccaatgggtgtacgcacagatgcacctctgatgcagtttaaatctatccttttaaagtacagcacccccacctacactggaggacagtcagaaagccatgtccagtcagcatctgaagatacagtaactgaaagagttgaaatgtcagtgaatgacaaagcagaagcaagtggctgcagaagatggtaaacgtagagaagaattggttctcaggtgtctgtatagatggcctaatagttctctataccaactgtagttctttttctgttctttcaattcagtagagtaaaaataaaaaacagtgtcattttcattcagaaactgagcagtttctaacttagctggtttgggagctttgctttccaagtttttttttgttttaaggcaaacttaaaattttaatggaaacatttcatatgaagccaagtctcactgagatcaccctactgcttaataattcagaaaattttcacatgcaaagtgtttggaattttatgtatgttatgaaagccatcttttacaattcttaatcacatctctgcctaaactgattcatgatgtttatgttttcctgtttgtagtgtacaaaatgaagctgaaggctcacatgttaaaatgaccctgaatagaataggaagaacagtgttcttacaggtcataatgtatttcacaattaaaaaactaaaatatgtacccatttttaagaaatcatacttctctccacattgatcttttcatttcttactagcttttaagaaattaaatacttgcctgagatagaaatactttatttttgtaactttaaggtctaaatgactaaacttcaaagtaagattttgtcagaataaattgagaccattaatctaatataatacttgttcatgagcactgaaatcctgaagaggagagatttggttataaattaaaaaggttgggtgatcttaagtgcctcagttaatgcacgtacagtattcatttggttggttgtactacctctcagaagtaaaatttgtcaccttatggaatgagagtttttgggtttgggggttgtttttttgttgttgcttggtttggtatttttggttttgtgtgtatttgtataaattttctgtataattagcccaggctgatgtaactataaaaattagttgaaaaaaaaaatattgtttccttaatggaattctcacttcatttgaatataagattttggatgaaaggatttggtataaagtttgggtttttgtctcaaggatttgatccatatttatccctaaatatttcttaagggatgtaactttttataaccattaagtggggggaagggggtggagggggtggtaataattataactgaaaggtttaaatatactacctaagaaaaaagtacttctgtgacatatacaaaaaaatctagtggataggcattagatgaatagagaatattaattttgcagaaatgaaggaaaatctcttcgtgctagtacagcgtattcccaagagagtttattttcctttctccaattaatgtggtcataaatttcggtaaaatcaagaaataggtgaagtgcaagctagtttctataatgaccattaaaaaaattctgctgtgtaattcttgccagttaaaattataacttgcaaatgagcagaataaatgaggtttttttcaattaaaaattactataaatccaggaggcaaactattttagcactcagattatctgatttaatacatattattgaatatcagtctcaaattttgctaaatgcttatcagcatgaaatatgttgatcagtgatgagttgggcttaatgcaaagatcctaatttaataaagaaacctgtaaattactgttacctaaaatatatgtgtatattaatttcacatataaaggtagatttttcaaagaaaaatttggtaggcggtagtttagaactctgatcaggtactacatcaaccaaaagaggaaatactttaaaaattccttttagcaacctgagcaatcttattctcgtaacaatagtagtaatttgggacattgcaaatgtttatcatgttgtaaagtagcatcagttgtatcctttcattaaaacttgataaacaaaagaacgagttaaggaaacca

SEQ ID NO: 24339 - DNA, 2213 bp, Homo sapiens
tgttcggtttggtggttggccggtgggccggagacgcaccgtagaaaccgaaccctcttacccaattggacgccgtccccagtacgcttctgcgcagtttgtggtggcgtcgtaacgcctcggggaaagggaagcggacgggcatctggaatcgctgcctctggctttctgttttctactaacaggatttggtcactggttcttcatcttttgtctgttgcacgcatcccgccctccccacttgcttccccactccttggatccagccctgtgggcattcacgtcagttctctgaccccgccgtgagccccgctccgggtccccgggcgggcttggcacggaggcggtaactatggagaatatggcggaggaggagctgctgcccctggagaaggaggaggtggaggtggcccaggtccaggtcccgaccccggcccgggactcggctggggtcccagctccggccccggattcggctctggactcggctccgactccggcctcggctccagccccagcccctgccctggcccaggctccggccctgtccccgtccctagcctctgcccctgaggaggctaaaagcaagagacacatctcaattcaaaggcagcttgctgatctagagaatttagcttttgtaactgatggaaattttgactctgccagctcattgaactcagataatcttgatgcaggcaacagacaggcttgtccattgtgccctaaggaaaaattcagagcttgtaatagccataagcttcgtcgtcacctccagaatttacactggaaagtctcagttgaatttgaaggttacaggatgtgcatctgtcacttaccttgtcgaccagtgaaaccaaacattattggagaacagataaccagtaaaatgggagcccattatcattgtatcatttgttcagcaacaatcaccagaagaactgatatgctaggacatgttaggcgccacatgaataaaggagagactaaatctagttatattgcagcttccactgctaaaccacctaaggaaattttgaaagaggcagacacggatgtacaagtttgtcccaactattctatacctcagaaaacagattcctattttaaccccaaaatgaaactaaatcggcagctaatattctgtacattggctgctttggctgaggaacgaaaacctttggaatgtctagatgcttttggagccactgggataatgggattacagtgggcaaaacatcttggaaatgcagtcaaagttacaatcaatgacttgaatgaaaattctgtgacactgattcaggaaaactgccatttaaacaaattgaaagtggtggtggacagtaaggaaaaggaaaagagtgatgatattcttgaagaaggagagaaaaatcttggtaatattaaggtgaccaaaatggatgccaatgtactgatgcatttgagatcttttgatttcatacatctagacccttttggaacatcagtgaattatctagattctgcattcagaaatataagaaaccttggcatagtgtcagtgacttctacagatatcagttctttatatgccaaggcacagcatgttgcccggcgtcactacggatgtaacattgtccgaactgaatattacaaggaactagcagccagaattgttgtagctgcagtggcaagagctgcagcccgatgcaacaaaggcatagaagtactgtttgcagtggctctggaacattttgtgttggtagttgtgagagttttgaggggacctacttcagcagatgaaacagccaagaagattcaatacctgatccattgtcagtggtgtgaagagagaatttttcagaaggatggtaatatggtagaagaaaacccatatagacagctgccttgtaactgtcatggaagcatgcctggaaagacagcaatagaacttggacctctgtggtcaagttcccttttcaatactggattcctcaaaagaatgctatttgaatctcttcaccatggtttggatgacattcagaccctaataaagacattaatctttgaatcagagtgtacgcctcaaagtcagttttcaattcatgcatcttcaaatgtcaacaagcaaggtgactaactgaacgctagcttactagctttaaactgcttaccaaaaatactgtatctttttcaattgtatttgatgttataataaaaccaatataattata

SEQ ID NO: 24340 - DNA, 274 bp, Homo sapiens
ttctgtgcaatggaatttaactacccaatgttccagtccctaagtccaagtaaaattgagaccattattttcataaaatttatcatgtatgaatacaagagtgattaggaaagtagtataggcttctctcaaggccctccttccatattcaaatgtaaaactatgtttgaacaatggctttctatttcagactgaagggaattcccctaaaattcacaggttgaagccataacccccaatgtgactggtcttggagacagggcctttaaataag

SEQ ID NO: 24341 - DNA, 343 bp, Homo sapiens
gtgagagagagacctcagagcttcatctctgacatctcaagggaaaaattaaaaagttcctgttggctatttttcttttgctgctgtgtttttctagggtagctgttcttacctggttttctgctgtcccacgtgactctcacatgcactcgttgggacagtggtttatgcccttgttctgtgcactgtccagtaccctcattctgggattcttaacctggactccagagggatttttgcactctctggaatgatatgcaagatgatgtgtccattgtacatgcagaaaggagccccagaatctaagaaagagggagaactgtgggaacttagatgtcaactc

SEQ ID NO: 24342 - DNA, 429 bp, Homo sapiens
agatggagtttcactcttgttgcccaggctggagtgcaatggcacgatcttggctcactgcaacctcctcctcccgggttcaagtgattctcctgtctcagcctcccaagtagctgggattacaggcgcccaccaccacgctcagctaattttttgtatttttagtagagacggggtttcagtatgtcggccaggctgatctcaaacccctgacctcaggcaatccacccaccctggcctcccaaagtgctgggattatgggcgtgagccaccgtgcccagcccccacttctatttatgttcacacacacaccaccacctaaagggctctgcagcactgtattaatagtgattatttccttttttgagatggagtctcgctctgtcgtccaggttggagtgcagtggtgcagtctcggctcactgcaac

SEQ ID NO: 24343 - DNA, 414 bp, Homo sapiens
ttttccacagctttcattcaagcttttgttaattttcacatgaacagtaaccacctttctctctgcctccagccttgccttctcctaaaatcgaaaaaagcctaaaactaatcttcatattttatcaaatgtagatccccaagcccaaaacatttaattcagtgcagggtgtggagagaatttgtctttaacaactgcactcctggggcagcaatacaggtcagaccaggagaactgacctaatctgttctctaccataagaggataactcttctgatacgcaaatctgattaaccatgccacttccctgcttttaactcttcagtgactgctatttccatttaggataaagtccaaagtccttgacatagacattcgccacctgtcctctgcctccctttagagacttgtctt

SEQ ID NO: 24344 - DNA, 1083 bp, Homo sapiens
ccactgagggacttagtacttcccatgcccacaactccaggttctacagcatcagaagtcctagttctcagagactgtataccttctctaggcaatattgcaagaatcccattgaactacagtctgctgctactatgtgggcactttggactctgtgttcagggaccagtaggcaagaagtcaccatctagtcaagggtaattgaccctgaactgcaggaggaggcaagcctgctgtcagaggatagtggcgagagcaatgtgtgtggaacttagcggacccactggaggcaccctctgtactccttgcccagttgtaactgaatggactagtgcagcaaccctggtctgagaagggtttggctcccaggagctcaggaccctcaggaatgagagcttggtttatactatcaaaaaagccaccaagaccagcaaagatgacagttgtgggtgaggggaatttagaatgaagcagggagtaatgaggaccagttgtggttccaaaaccatttgcaggaaggtgctatagttggtcctaccaaactcctctttcaacatttatcctcaggaagagaggtccattggcgccctgaaacagtcactctctgcgtgtttttgggaaaatggatccacataggcaaggggtggaccatggcaggcatagagcggtgccacttagatcccccttcaagacaagatatgccatccagctgcaaggagtgtgggtagctggcagccaccagctgctacttcaccaggatccaccttagctttcaagctgaggtcacgctattctcaagacaggaggggttggtggccaatgatttcactaaattatggaaattgagagcatgcttttctgagggggccctcttgccaaagaccaagcaaggccatggtacaaggacctaactgtttcagtccaacacaggactcctccaatgagtgacctttttcccagagttcccctgggatggcagctcgcctgctctccctgcctcgtcctgcttcctcttttcctttcaaaggtgcttactccaataataaatcctttggtattctaaatgtctacttcttgaagaat

SEQ ID NO: 24345 - DNA, 652 bp, Homo sapiens
ccactgagggacttagtacttcccatgcccacaactccaggttctacagcatcagaagtcctagttctcagagactgtataccttctctaggcaatattgcaagaatcccattgaactacagtctgctgctactatgtgggcactttggactctgtgttcagggaccagtaggcaagaagtcaccatctagtcaagggtaattgaccctgaactgcaggaggaggcaagcctgctgtcagaggatagtggcgagagcaatgtgtgtggaacttagcggacccactggaggcaccctctgtactccttgcccagttgtaactgaatggactagtgcagcaaccctggtctgagaagggtttggctcccaggagctcaggaccctcaggaatgatttcactaaattatggaaattgagagcatgcttttctgagggggccctcttgccaaagaccaagcaaggccatggtacaaggacctaactgtttcagtccaacacaggactcctccaatgagtgacctttttcccagagttcccctgggatggcagctcgcctgctctccctgcctcgtcctgcttcctcttttcctttcaaaggtgcttactccaataataaatcctttggtattctaaatgtctacttcttgaagaat

SEQ ID NO: 24346 - DNA, 382 bp, Homo sapiens
acgtagattcactgattaacattttgccatattctctcctcacccctgctgtatgtatgtgcgcgcgcgcgcacacacacacacacacacacacacacacacacacacacacaggaaaacaaatgtttttcagaactctttgaaaggaacctatagatatcatgactcctcacacataaatagttcagcacgtgttccctaaggctaagaatgctcttggccgggcgcggtggctcacgcctgtaatcccagcactttgggaggccgaggcgggtggatcacgaggtcaggagatcgcgaacatcctagctaacacggtgaaaccctgtctctactaaaaatgcaaaaaattagccgggcgtggtggcgggcgcctgtagtc

SEQ ID NO: 24347 - DNA, 536 bp, Homo sapiens
tcaccaataagcacgaatacttactgaatatgttttgtgtgccaggcactttttaaagcactttaataacaataactaatgtttattaagcatctactgtgtgccaggcactgcttttggtacaaaagatgtgaaataaaccacacaaagaccatccctcttggaacctatgttttattgagatccagccaggtggtagaacacatcagtaaacaaacatagacttcagcaggtggtgacatgtgctctgaaggagaaatggagtccgagtagagagtgactatgcatgatgaactggtcaaggaaagtctgtctgataagggggtatttgagaagagcacttctccaaggaagtggaggagcaagcccagtttgcttccaatttcttcctccttgtgtcttgccaactgggaccaagcatgcctggcgtggaacaaactctttctgttctctgctgatggagccattttctcccagagcccaggctctaggtctgaaccctgatccttctcttcacttttcttttctaatggcca

SEQ ID NO: 24348 - DNA, 665 bp, Homo sapiens
ctgtgtgcagtaaactggaatgctctccctcgctcactcctcagtgtaggagtgatctgaagcaggacaagctcagcctgcagctgccgtgggctttgtgtggactggacgcagagcttgggagacgggggagggctattactccaattcactgtcaatggaattacagctatagcggcagtgtatataggattgctttttctcgtcttcctggagatgctcagtcccagtatattttaaggaagagaaatataaaggaaatttagtatgcctccttttctttaaatgaagaatttagtttcctttacttcttaaaagagaatacctgttcttgtataacgtgactgcaccagacattctgaaaaatcagcaagaagcaaaagctggaaatagctatttcacagcaggtaatcatacctcaggatgtagctactgtacaaagtttatacttggataatcctggatgggaataaaggtagggggtaactgcctgaaaaacctattactatacaggccttagcatcatgaatgactttcttcatgaggatctgaagttactatctctgaccacattgcacagaagagccaataagaatttcaaagagggcaatttccactaagggaattaagctacacaaaaggaactttcacacagaaactctatc

SEQ ID NO: 24349 - DNA, 4977 bp, Homo sapiens
  misc_feature (4834)..(4834): n is a, c, g, or t
ctgtgtgcagtaaactggaatgctctccctcgctcactcctcagtgtaggagtgatctgaagcaggacaagctcagcctgcagctgccgtgggctttgtgtggactggacgcagagcttgggagacgggggagggctattactccaattcactgtcaatggaattacagctatagcggcagtgtatataggattgctttttctcgtcttcctggagatgctcagtcccagtatattttaaggaagagaaatataaaggaaatttagtatgcctccttttctttaaatgaagaatttagtttcctttacttcttaaaagagaatacctgttcttgtataacgtgactgcaccagacattctgaaaaatcagcaagaagcaaaagctggaaatagctatttcacagcagggttctgaagtaacggaagctaccttgtataaagacctcaacactgctgaccatgatcagcgcagcctggagcatcttcctcatcgggactaaaattgggctgttccttcaagtagcacctctatcagttatggctaaatcctgtccatctgtgtgtcgctgcgatgcgggtttcatttactgtaatgatcgctttctgacatccattccaacaggaataccagaggatgctacaactctctaccttcagaacaaccaaataaataatgctgggattccttcagatttgaaaaacttgctgaaagtagaaagaatatacctataccacaacagtttagatgaatttcctaccaacctcccaaagtatgtaaaagagttacatttgcaagaaaataacataaggactatcacttatgattcactttcaaaaattccctatctggaagaattacatttagatgacaactctgtctctgcagttagcatagaagagggagcattccgagacagcaactatctccgactgcttttcctgtcccgtaatcaccttagcacaattccctggggtttgcccaggactatagaagaactacgcttggatgataatcgcatatccactatttcatcaccatctcttcaaggtctcactagtctaaaacgcctggttctagatggaaacctgttgaacaatcatggtttaggtgacaaagttttcttcaacctagttaatttgacagagctgtccctggtgcggaattccctgactgctgcaccagtaaaccttccaggcacaaacctgaggaagctttatcttcaagataaccacatcaatcgggtgcccccaaatgctttttcttatctaaggcagctctatcgactggatatgtccaataataacctaagtaatttacctcagggtatctttgatgatttggacaatataacacaactgattcttcgcaacaatccctggtattgcgggtgcaagatgaaatgggtacgtgactggttacaatcactacctgtgaaggtcaacgtgcgtgggctcatgtgccaagccccagaaaaggttcgtgggatggctattaaggatctcaatgcagaactgtttgattgtaaggacagtgggattgtaagcaccattcagataaccactgcaatacccaacacagtgtatcctgcccaaggacagtggccagctccagtgaccaaacagccagatattaagaaccccaagctcactaaggatcaccaaaccacagggagtccctcaagaaaaacaattacaattactgtgaagtctgtcacctctgataccattcatatctcttggaaacttgctctacctatgactgctttgagactcagctggcttaaactgggccatagcccggcatttggatctataacagaaacaattgtaacaggggaacgcagtgagtacttggtcacagccctggagcctgattcaccctataaagtatgcatggttcccatggaaaccagcaacctctacctatttgatgaaactcctgtttgtattgagactgaaactgcaccccttcgaatgtacaaccctacaaccaccctcaatcgagagcaagagaaagaaccttacaaaaaccccaatttacctttggctgccatcattggtggggctgtggccctggttaccattgcccttcttgctttagtgtgttggtatgttcataggaatggatcgctcttctcaaggaactgtgcatatagcaaagggaggagaagaaaggatgactatgcagaagctggcactaagaaggacaactctatcctggaaatcagggaaacttcttttcagatgttaccaataagcaatgaacccatctcgaaggaggagtttgtaatacacaccatatttcctcctaatggaatgaatctgtacaaaaacaatcacagtgaaagcagtagtaaccgaagctacagagacagtggtattccagactcagatcactcacactcatgatgctgaaggactcacagcagacttgtgttttgggttttttaaacctaagggaggtgatggtaggaaccctgttctactgcaaaacactggaaaaagagactgaaaaaaagcaatgtactgtacatttgccatataatttatatttaagaactttttattaaaagtttcaaatttcaggttactgctgcgattgatgtagtggagatgcctgaacacaattctatattttagtattttttagtaatttgtactgtattttccttgcaaatattggagttataaaccatttactttgtgttctactgagtaagatgacttgttgactgtgaaagtgaattttcttgctgtgtcgaacaatcaggactgcattcatatgagatccttgtagtataagcacaggccatttttcactttggtattaataaaatgtaaaaaaaaaaaactggctgaatggctgaatgagataaaatttaattttaaaaaatggttatgaaataatgttccaattattaaatttgtattatcccagtggtattcaataaatcaaaatgtgtgaagtaatgggcaatatcaaacttcctgcatatctccatttttgctctaggcaaattaattatccttaaaaaagttaagcatatcttctgaactgaatacatcagctggcataaaaggagcatgaagtctgttaaagccattgtcagcaaagctttgaaaataaaggacttcacaaaaacggtaatgtaaatgtgcttccaagttggggggaaaatgtgtacttaggaaaacatggaaacttagacttgtatagtgtaatgaacacaaataccaaaactgcattttggttttgcctataccatcctgatttttgaaaagtgaattataaacacaaaattgttagtgtttatgatgtttttatcataaaggatgtcagagaaactttatgcatattaaaaatgtaatgtaattataagcgattcccctcaacaatccagagaaagtagttctttaaataagagataatttaaagaaaaataaatactagacatcaaatttagatctggtttatgtcaaaggttttaacactgtacataaatgttcaatttacttttacaaagatcaagaatactgcccattactgtcacaattttccagatattatataatgaactcgtaatgtaacatttccttctagcttcctactgaattgtgagctgttacttgttgaaaaaccatatcacttttctgttgccatgatttttttttttcaacaaaaaaccaaagtgcattgtacgccctttggccagtcttgtatgtgccttgatccaacgctacatgtattcagcttttaaaactccacaaatttttcatactccttaaatatgaaaaattatggtcttattgctgaataaaacttttaaaaagtacagaataattgtgcttgctttttcaggattgtgttactatcactaagtagcaaattgcccagcacattagtcctaaacgtcccatgtatttttctaggcataaaaataaaagttggctaaaaattttaaaaaatcaacatcttgaggttgtgtatcattttacttcaaagagttcagtgtttcatgtataaatgtatttcctcttacttatacactgtatagatggaaaatttaagaaatggtttcaaagcctttctctcttaggcgcactgctgccactgtcctgatactttttaaggtggtctttgaaaaactgtttttttaaaatagccttttagtagagtgagttggcatttgtgatactgtgaaatacacactttctctttgtccctgtttctggcatacaactcctaaaatccttgcaatcttcaaagtgatatattttcatatgctaatgagttcactgatagctggcaggccctaggtagcttcaagataaagtctgatcattgaaaagaccaagacatgattatagggttgggacttacaaccccaaaccctaacctccagagagggcgaagtggatgaagattaagttgatcaccagtgaccagtggtttaatcaagcatgcctatgtaatcaagcctccataaaaaaacaaaaggtcaagatttggagagcttccagattgctgaacatgtggtggttcctgcaggatggcatgcctggagagggcatggaagctctgtgcccacctagacctcaccttatgtttcctgccatctggatcctttgtaacatcctttataatacgtcagtaaatctgtttccttgcattttgtgagctgttgtagcaaattaatagaacacaaaaaggggatcctgggaaaccaaacttgaagctgactagtcttgcaactggtgtctgaagaggaggcagttttgtgggaataagccctcaacctgtgggatatgacacaatttccaggtagacagtgtngggattaaactgaattggaggacacccagctggtatctgctgaagaactgattgcttgcgtggtgtatggggcaaaacttgttaagacaagtcttctatgttgattattgttgaatgagagaattaaacacacatacacactt

SEQ ID NO: 24350 - DNA, 4729 bp, Homo sapiens
  misc_feature (4586)..(4586): n is a, c, g, or t
ctgtgtgcagtaaactggaatgctctccctcgctcactcctcagtgtaggagtgatctgaagcaggacaagctcagcctgcagctgccgtgggctttgtgtggactggacgcagagcttgggagacgggggagggctattactccaattcactgtcaatggaattacagctatagcggcagtgtatataggattgctttttctcgtcttcctgggttctgaagtaacggaagctaccttgtataaagacctcaacactgctgaccatgatcagcgcagcctggagcatcttcctcatcgggagtccatctgtgtgtcgctgcgatgcgggtttcatttactgtaatgatcgctttctgacatccattccaacaggaataccagaggatgctacaactctctaccttcagaacaaccaaataaataatgctgggattccttcagatttgaaaaacttgctgaaagtagaaagaatatacctataccacaacagtttagatgaatttcctaccaacctcccaaagtatgtaaaagagttacatttgcaagaaaataacataaggactatcacttatgattcactttcaaaaattccctatctggaagaattacatttagatgacaactctgtctctgcagttagcatagaagagggagcattccgagacagcaactatctccgactgcttttcctgtcccgtaatcaccttagcacaattccctggggtttgcccaggactatagaagaactacgcttggatgataatcgcatatccactatttcatcaccatctcttcaaggtctcactagtctaaaacgcctggttctagatggaaacctgttgaacaatcatggtttaggtgacaaagttttcttcaacctagttaatttgacagagctgtccctggtgcggaattccctgactgctgcaccagtaaaccttccaggcacaaacctgaggaagctttatcttcaagataaccacatcaatcgggtgcccccaaatgctttttcttatctaaggcagctctatcgactggatatgtccaataataacctaagtaatttacctcagggtatctttgatgatttggacaatataacacaactgattcttcgcaacaatccctggtattgcgggtgcaagatgaaatgggtacgtgactggttacaatcactacctgtgaaggtcaacgtgcgtgggctcatgtgccaagccccagaaaaggttcgtgggatggctattaaggatctcaatgcagaactgtttgattgtaaggacagtgggattgtaagcaccattcagataaccactgcaatacccaacacagtgtatcctgcccaaggacagtggccagctccagtgaccaaacagccagatattaagaaccccaagctcactaaggatcaccaaaccacagggagtccctcaagaaaaacaattacaattactgtgaagtctgtcacctctgataccattcatatctcttggaaacttgctctacctatgactgctttgagactcagctggcttaaactgggccatagcccggcatttggatctataacagaaacaattgtaacaggggaacgcagtgagtacttggtcacagccctggagcctgattcaccctataaagtatgcatggttcccatggaaaccagcaacctctacctatttgatgaaactcctgtttgtattgagactgaaactgcaccccttcgaatgtacaaccctacaaccaccctcaatcgagagcaagagaaagaaccttacaaaaaccccaatttacctttggctgccatcattggtggggctgtggccctggttaccattgcccttcttgctttagtgtgttggtatgttcataggaatggatcgctcttctcaaggaactgtgcatatagcaaagggaggagaagaaaggatgactatgcagaagctggcactaagaaggacaactctatcctggaaatcagggaaacttcttttcagatgttaccaataagcaatgaacccatctcgaaggaggagtttgtaatacacaccatatttcctcctaatggaatgaatctgtacaaaaacaatcacagtgaaagcagtagtaaccgaagctacagagacagtggtattccagactcagatcactcacactcatgatgctgaaggactcacagcagacttgtgttttgggttttttaaacctaagggaggtgatggtaggaaccctgttctactgcaaaacactggaaaaagagactgaaaaaaagcaatgtactgtacatttgccatataatttatatttaagaactttttattaaaagtttcaaatttcaggttactgctgcgattgatgtagtggagatgcctgaacacaattctatattttagtattttttagtaatttgtactgtattttccttgcaaatattggagttataaaccatttactttgtgttctactgagtaagatgacttgttgactgtgaaagtgaattttcttgctgtgtcgaacaatcaggactgcattcatatgagatccttgtagtataagcacaggccatttttcactttggtattaataaaatgtaaaaaaaaaaaactggctgaatggctgaatgagataaaatttaattttaaaaaatggttatgaaataatgttccaattattaaatttgtattatcccagtggtattcaataaatcaaaatgtgtgaagtaatgggcaatatcaaacttcctgcatatctccatttttgctctaggcaaattaattatccttaaaaaagttaagcatatcttctgaactgaatacatcagctggcataaaaggagcatgaagtctgttaaagccattgtcagcaaagctttgaaaataaaggacttcacaaaaacggtaatgtaaatgtgcttccaagttggggggaaaatgtgtacttaggaaaacatggaaacttagacttgtatagtgtaatgaacacaaataccaaaactgcattttggttttgcctataccatcctgatttttgaaaagtgaattataaacacaaaattgttagtgtttatgatgtttttatcataaaggatgtcagagaaactttatgcatattaaaaatgtaatgtaattataagcgattcccctcaacaatccagagaaagtagttctttaaataagagataatttaaagaaaaataaatactagacatcaaatttagatctggtttatgtcaaaggttttaacactgtacataaatgttcaatttacttttacaaagatcaagaatactgcccattactgtcacaattttccagatattatataatgaactcgtaatgtaacatttccttctagcttcctactgaattgtgagctgttacttgttgaaaaaccatatcacttttctgttgccatgatttttttttttcaacaaaaaaccaaagtgcattgtacgccctttggccagtcttgtatgtgccttgatccaacgctacatgtattcagcttttaaaactccacaaatttttcatactccttaaatatgaaaaattatggtcttattgctgaataaaacttttaaaaagtacagaataattgtgcttgctttttcaggattgtgttactatcactaagtagcaaattgcccagcacattagtcctaaacgtcccatgtatttttctaggcataaaaataaaagttggctaaaaattttaaaaaatcaacatcttgaggttgtgtatcattttacttcaaagagttcagtgtttcatgtataaatgtatttcctcttacttatacactgtatagatggaaaatttaagaaatggtttcaaagcctttctctcttaggcgcactgctgccactgtcctgatactttttaaggtggtctttgaaaaactgtttttttaaaatagccttttagtagagtgagttggcatttgtgatactgtgaaatacacactttctctttgtccctgtttctggcatacaactcctaaaatccttgcaatcttcaaagtgatatattttcatatgctaatgagttcactgatagctggcaggccctaggtagcttcaagataaagtctgatcattgaaaagaccaagacatgattatagggttgggacttacaaccccaaaccctaacctccagagagggcgaagtggatgaagattaagttgatcaccagtgaccagtggtttaatcaagcatgcctatgtaatcaagcctccataaaaaaacaaaaggtcaagatttggagagcttccagattgctgaacatgtggtggttcctgcaggatggcatgcctggagagggcatggaagctctgtgcccacctagacctcaccttatgtttcctgccatctggatcctttgtaacatcctttataatacgtcagtaaatctgtttccttgcattttgtgagctgttgtagcaaattaatagaacacaaaaaggggatcctgggaaaccaaacttgaagctgactagtcttgcaactggtgtctgaagaggaggcagttttgtgggaataagccctcaacctgtgggatatgacacaatttccaggtagacagtgtngggattaaactgaattggaggacacccagctggtatctgctgaagaactgattgcttgcgtggtgtatggggcaaaacttgttaagacaagtcttctatgttgattattgttgaatgagagaattaaacacacatacacactt

SEQ ID NO: 24351 - DNA, 842 bp, Homo sapiens
agacttggaggtgggctgtgtgcagtaaactggaatgctctccctcgctcactcctcagtgtaggagtgatctgaagcaggacaagctcagcctgcagctgccgtgggctttgtgtggactggacgcagagcttgggagacgggggagggctattactccaattcactgtcaatggaattacagctatagcggcagtgtatataggattgctttttctcgtcttcctggtaagtgttttccatgttttttcttatgattgtcccagaaagtttgcttggttttactctctagaaagaaacgacttgatactatgagaaatccaaataggaacgtttgctctgtcaccacaacaagcaatatatgtgcgtgcaagccagcaatgaaaaatttcactatcatggctgaatgtaagaagtttcttagaaccttctttcatttataaaagatagtaagtggctattttctgtcttgagtaattgctatgtgaaaagagccttatggaaaacagcaagttggaaagttcaatgttaaatattaaagaatacaaggagattcttcacagataggaaagcaacttggtgtgtactgtacgtgtgggatgatcaccaattgctgtttttacaactgtgaaagaaaatcaataatccctcagcccatgagtacgcagtacatgaaaagcatacatcttgctcacagctagccgagctactcctggagacttatgtgcctctgtaaaggattaacagctacacctagattttaaagcttgcactgctatcgtgcctgagctgcttcaagcatttcaggcttgcaaatctcaactagtaaattgaactcagag

SEQ ID NO: 24352 - DNA, 4783 bp, Homo sapiens
  misc_feature (4640)..(4640): n is a, c, g, or t
ctgtgtgcagtaaactggaatgctctccctcgctcactcctcagtgtaggagtgatctgaagcaggacaagctcagcctgcagctgccgtgggctttgtgtggactggacgcagagcttgggagacgggggagggctattactccaattcactgtcaatggaattacagctatagcggcagtgtatataggattgctttttctcgtcttcctgggttctgaagtaacggaagctaccttgtataaagacctcaacactgctgaccatgatcagcgcagcctggagcatcttcctcatcgggactaaaattgggctgttccttcaagtagcacctctatcagttatggctaaatcctgtccatctgtgtgtcgctgcgatgcgggtttcatttactgtaatgatcgctttctgacatccattccaacaggaataccagaggatgctacaactctctaccttcagaacaaccaaataaataatgctgggattccttcagatttgaaaaacttgctgaaagtagaaagaatatacctataccacaacagtttagatgaatttcctaccaacctcccaaagtatgtaaaagagttacatttgcaagaaaataacataaggactatcacttatgattcactttcaaaaattccctatctggaagaattacatttagatgacaactctgtctctgcagttagcatagaagagggagcattccgagacagcaactatctccgactgcttttcctgtcccgtaatcaccttagcacaattccctggggtttgcccaggactatagaagaactacgcttggatgataatcgcatatccactatttcatcaccatctcttcaaggtctcactagtctaaaacgcctggttctagatggaaacctgttgaacaatcatggtttaggtgacaaagttttcttcaacctagttaatttgacagagctgtccctggtgcggaattccctgactgctgcaccagtaaaccttccaggcacaaacctgaggaagctttatcttcaagataaccacatcaatcgggtgcccccaaatgctttttcttatctaaggcagctctatcgactggatatgtccaataataacctaagtaatttacctcagggtatctttgatgatttggacaatataacacaactgattcttcgcaacaatccctggtattgcgggtgcaagatgaaatgggtacgtgactggttacaatcactacctgtgaaggtcaacgtgcgtgggctcatgtgccaagccccagaaaaggttcgtgggatggctattaaggatctcaatgcagaactgtttgattgtaaggacagtgggattgtaagcaccattcagataaccactgcaatacccaacacagtgtatcctgcccaaggacagtggccagctccagtgaccaaacagccagatattaagaaccccaagctcactaaggatcaccaaaccacagggagtccctcaagaaaaacaattacaattactgtgaagtctgtcacctctgataccattcatatctcttggaaacttgctctacctatgactgctttgagactcagctggcttaaactgggccatagcccggcatttggatctataacagaaacaattgtaacaggggaacgcagtgagtacttggtcacagccctggagcctgattcaccctataaagtatgcatggttcccatggaaaccagcaacctctacctatttgatgaaactcctgtttgtattgagactgaaactgcaccccttcgaatgtacaaccctacaaccaccctcaatcgagagcaagagaaagaaccttacaaaaaccccaatttacctttggctgccatcattggtggggctgtggccctggttaccattgcccttcttgctttagtgtgttggtatgttcataggaatggatcgctcttctcaaggaactgtgcatatagcaaagggaggagaagaaaggatgactatgcagaagctggcactaagaaggacaactctatcctggaaatcagggaaacttcttttcagatgttaccaataagcaatgaacccatctcgaaggaggagtttgtaatacacaccatatttcctcctaatggaatgaatctgtacaaaaacaatcacagtgaaagcagtagtaaccgaagctacagagacagtggtattccagactcagatcactcacactcatgatgctgaaggactcacagcagacttgtgttttgggttttttaaacctaagggaggtgatggtaggaaccctgttctactgcaaaacactggaaaaagagactgaaaaaaagcaatgtactgtacatttgccatataatttatatttaagaactttttattaaaagtttcaaatttcaggttactgctgcgattgatgtagtggagatgcctgaacacaattctatattttagtattttttagtaatttgtactgtattttccttgcaaatattggagttataaaccatttactttgtgttctactgagtaagatgacttgttgactgtgaaagtgaattttcttgctgtgtcgaacaatcaggactgcattcatatgagatccttgtagtataagcacaggccatttttcactttggtattaataaaatgtaaaaaaaaaaaactggctgaatggctgaatgagataaaatttaattttaaaaaatggttatgaaataatgttccaattattaaatttgtattatcccagtggtattcaataaatcaaaatgtgtgaagtaatgggcaatatcaaacttcctgcatatctccatttttgctctaggcaaattaattatccttaaaaaagttaagcatatcttctgaactgaatacatcagctggcataaaaggagcatgaagtctgttaaagccattgtcagcaaagctttgaaaataaaggacttcacaaaaacggtaatgtaaatgtgcttccaagttggggggaaaatgtgtacttaggaaaacatggaaacttagacttgtatagtgtaatgaacacaaataccaaaactgcattttggttttgcctataccatcctgatttttgaaaagtgaattataaacacaaaattgttagtgtttatgatgtttttatcataaaggatgtcagagaaactttatgcatattaaaaatgtaatgtaattataagcgattcccctcaacaatccagagaaagtagttctttaaataagagataatttaaagaaaaataaatactagacatcaaatttagatctggtttatgtcaaaggttttaacactgtacataaatgttcaatttacttttacaaagatcaagaatactgcccattactgtcacaattttccagatattatataatgaactcgtaatgtaacatttccttctagcttcctactgaattgtgagctgttacttgttgaaaaaccatatcacttttctgttgccatgatttttttttttcaacaaaaaaccaaagtgcattgtacgccctttggccagtcttgtatgtgccttgatccaacgctacatgtattcagcttttaaaactccacaaatttttcatactccttaaatatgaaaaattatggtcttattgctgaataaaacttttaaaaagtacagaataattgtgcttgctttttcaggattgtgttactatcactaagtagcaaattgcccagcacattagtcctaaacgtcccatgtatttttctaggcataaaaataaaagttggctaaaaattttaaaaaatcaacatcttgaggttgtgtatcattttacttcaaagagttcagtgtttcatgtataaatgtatttcctcttacttatacactgtatagatggaaaatttaagaaatggtttcaaagcctttctctcttaggcgcactgctgccactgtcctgatactttttaaggtggtctttgaaaaactgtttttttaaaatagccttttagtagagtgagttggcatttgtgatactgtgaaatacacactttctctttgtccctgtttctggcatacaactcctaaaatccttgcaatcttcaaagtgatatattttcatatgctaatgagttcactgatagctggcaggccctaggtagcttcaagataaagtctgatcattgaaaagaccaagacatgattatagggttgggacttacaaccccaaaccctaacctccagagagggcgaagtggatgaagattaagttgatcaccagtgaccagtggtttaatcaagcatgcctatgtaatcaagcctccataaaaaaacaaaaggtcaagatttggagagcttccagattgctgaacatgtggtggttcctgcaggatggcatgcctggagagggcatggaagctctgtgcccacctagacctcaccttatgtttcctgccatctggatcctttgtaacatcctttataatacgtcagtaaatctgtttccttgcattttgtgagctgttgtagcaaattaatagaacacaaaaaggggatcctgggaaaccaaacttgaagctgactagtcttgcaactggtgtctgaagaggaggcagttttgtgggaataagccctcaacctgtgggatatgacacaatttccaggtagacagtgtngggattaaactgaattggaggacacccagctggtatctgctgaagaactgattgcttgcgtggtgtatggggcaaaacttgttaagacaagtcttctatgttgattattgttgaatgagagaattaaacacacatacacactt

SEQ ID NO: 24353 - DNA, 2948 bp, Homo sapiens
gtcgcaggaacctcttgtgagccacgagcagatgcaggtgttccagatgatcaccaagtcccagcggatcttctcccatgcccaggtggcagcagtctcctcccagctccctgcgcccgagggcaaaccagccgccctgaggccgctgcaggggccgtggccgcagcagcccccaccactggctcctgctgtggactctctccacgccggccctggaaaccccgaggcagagggctccccagcccgcaggagaaaaaccacacccggggttcccagagaggcctcccccggcagcacgagacgagacgcaaaggggggactgaaagtggccgcggttccaacgccccttgcagcaccgtctctggacccttccaggaatccagacatctcttctctggccaagcagctgcgatcctctaaagggaccttggacctggaggacatcttcccctccacaggccaacggcagacccagttaggtggggaggagccaccaggagcctcgctgccagggaagcaggccccagccgagaatggcgcggcttcaaggatcacaaaaggtgaaaagggcccagcctgctcccggggtggaggctaccggctcttgggcaaccccagggccccgcgattctccggcttccggaaagagaaggcgaagatggatatgtgctgtgcggcttctccgagccaggtagccatggcctccttctcatcggccgggcccccggcagatccctccaagtccaagctgacaatattcagcagaatccagggtggaaacatctacaggctcccccatccggtgaaggaagagaatgtggcaggcagaggtaaccagcaaaacggcagtcccacagactggacgaagcccaggagcacttttgtctgcaagaactgcagccagatgttttatacggagaaagggctgagcagccacatgtgttttcacagcgaccagtggccgtcacctcgagggaagcaggaaccgcaggtgtttggcacagagttttgcaagccgctaagacaggtgctgaggccagaaggggacaggcatagtcccccaggaaccaagaagcccttggaccccacagctgcagcccctttggtggtcccccaatcgatccccgtggttccagtgacccgacacatagggagcatggccatgggacaagagaaagacggggaggagcgagacagcaaggagagcagccagcagagaaagcggaagaagcggcccccaccctccacggctggggagcctggccctgcaggatgccaccagagccgcctgcggtcacccatgttcctggtggactgcctcctgaagggcttattccagtgctccccctacacaccacccccaatgctcagccccatccgggagggctctggggtgtacttcaacaccctctgttccacgtccactcaggccagccctgaccagctcatcagctccatgctcgatcaagtggatgggtcctttggcatctgtgtggtgaaggatgacaccaaaatcagcattgagccacatatcaatataggaagccggtttcaggcagagatcccggaactccaggagagatccctggctggaactgacgagcatgtagcttctctggtctggaagccatggggagatatgatgatcagctcagagacacaggatagagtgaccgagctctgcaatgtggcatgctccagcgtgatgccaggagggggcaccaacctggagctcgctctgcactgcctgcacgaggctcagggcaacgttcaggtcgccctggagactcttctgctccgagggccccacaagccacggacacacctgctcgctgactatcgctacacaggttcagacgtctggacccctatagagaagaggctttttaagaaggcgttctatgcccacaagaaggacttctacttgatacacaagatgatccagacaaagacggtagctcagtgcgttgagtattattacatctggaaaaaaatgatcaagtttgactgtggccgagccccagggctagaaaagagggtcaagagagagccggaggaagtggaaaggacagaggaaaaggtcccatgcagccctcgggagagacccagccaccatccaactcccaagttaaagaccaagagttataggagggagtccatcctcagctccagcccaaatgcaggctccaagcggacccccgagctgttgggaagtgcagagagccagggcatttttccatgcagagagtgtgaaagggtgtttgacaagatcaagagtcgaaatgcccatatgaagcggcaccgccttcaggaccacgtggagcccatcatcagggtgaagtggccagtgaagcccttccagctaaaggaagaggagctgggagctgacatcggccccctgcagtggtgactcccgtggcagcaagtccgaatggggcctccagtgctgcccctcctcccttcggcctctccagggcgtttggggcacccctctgcctccccccaccctccctgtcccctgttggccaacctgcctgcaaacatggagggcatttggccacagataggcaggaggagctcagttgtcggacagctatgcagtccctgtccggtggtgctggaggctccactctccttaggttcatagtctctccccttctttcccttccacttctagagcagggaggcttggggaggggaaaatttagctctgggtagctcttaaatcttagcctcagttgtggggtttggtttcatgtgttagataaggccaagacttagagaatcagtgggaaaaaaccttgagatctccaacacgctgggcccctccctggggcggggactctaccttccagattcagtccctagtcttgcgatgaattctgcattgttcggtgttttttgtacatgtcaactcgtaaatctgattaaattgggttcttgaactg

SEQ ID NO: 24354 - DNA, 452 bp, Homo sapiens
tctaacccccaatgtgactgtatttggagatggaaccaattagtcccaaggaactaattaaatttaaatgaggttgcaaaagtggagccttgatttgataagattattttctttatgagaagagacactggagaattcttgctctctttctccttgcacgcacatagagaaaaggccaggtgagaacataatgagaaagtagccctctgaaagccaggaagagacactagatactgaatcagccagcaccttcctctttgacttttagctttcagaaatgagaaaataaatttatgttgtttaaaccaaccactctatggtatttggttatggcagcctgagcaaatggtcatgacaagtttgcaacaagaaattactagccatagaaataagaaatatgaaataaaatggaaagtgtgatgcatatgcaggaagaaacccatccagcaatg

SEQ ID NO: 24355 - DNA, 785 bp, Homo sapiens
cttgtacccagcatttcagaagccatgtggggaagaaggctgggcctagcttctggtatatctaatatacttacctgaaggattcatatatcagaaagaacatcaatcagagaagagaaactttcattttttaccttccatccaaatgtagtaggtttgtactacagaaagtgccagttaatttccaaggaagatgttactcatgatacgaggcttttctgtttgatgctgccaccaagcactcatcttcaagtgcccattgggcaacatgtttacctcaagctacctattacaggtacagaaatagtaaagccatatacacctgtatctggttccttactctcagagttcaaggaaccagttcttcccaacaataaatacatctactttttgataaaaatctatcccactggactcttcacaccagagcttgatcgtcttcagattggagattttgtttctgtaagcagtcctgagggcaattttaaaatatccaagttccaagaattagaagatctctttttgttggcagctggaacaggcttcacaccaatggttaaaatactgaattatgctttgactgatatacccagtctcaggaaaagtgaagctgaatgttctttcataaaaccaggaagatggttatatttggagaacccattgcgggaattagctttagggataaagactggttgtgactttgtctcccagccctatttctgaatgggaaggacccgggacaaattacaagcctttctcgatttgcagccacttgccaccaatcc

SEQ ID NO: 24356 - DNA, 210 bp, Homo sapiens
cccaacctcttcttccatcaaagcttcataatatatagtaattaataaggaatgttcatctcattgtagcttttgatcttcattctctgtaactgagtgaaagtaaataatatatgtgatcaaaagccaagcagcaagacaaaaagggaagactagaacacaaataaggcaagactaatagttgaagcatggatcatgaaaaatcagtgg

SEQ ID NO: 24357 - DNA, 2225 bp, Homo sapiens
tgctgcgtcagaatgcgcctcacccctggcgaccccggaagtgggtcgggggcttggcctctgcccggccacagagccggagctggaggtgctgtcccgtctggcggcgatccccgggcagggcccggggccggggtttgaagatgctgaacgtcccttcccagtctttcccggcccccaggtcgcagcagcgtgtcgcctccggggggcgtagcaaggtacctttaaaacagggcagaagccttatggattggattcgactgaccaaaagtggaaaggatctaacgggattaaaaggcaggttaattgaagtaactgaagaagaacttaagaaacacaacaaaaaagatgattgttggatatgcataagaggtttcgtttataatgtcagcccttatatggagtatcatcctggtggagaagatgaactaatgagagcagcaggatcagatggtactgaactttttgatcaggttcatcgttgggtcaattatgaatccatgctgaaagaatgcctggttggcagaatggccattaaacctgctgttctgaaaggcatgcttcccaagagccaagtgacagatacacttgccaaagaaggtcctagttatccaagctatgattggttccaaacagactctttagtcaccattgccatatatactaaacagaaggatatcaatttagactcaataatagttgatcatcagaatgattcctttagagcagaaacaattattaaggattgtttatatcttatacatattgggctaagccatgaggttcaggaagatttttctgtgcgggttgttgagagtgtgggaaaaatagagattgttctacaaaaaaaagagaatacttcttgggactttcttggccatcccctgaagaatcataattcacttattccaaggaaagatacaggtttgtactacagaaagtgccagttaatttccaaggaagatgttactcatgatacgaggcttttctgtttgatgctgccaccaagcactcatcttcaagtgcccattgggcaacatgtttacctcaagctacctattacaggtacagaaatagtaaagccatatacacctgtatctggttccttactctcagagttcaaggaaccagttcttcccaacaataaatacatctactttttgataaaaatctatcccactggactcttcacaccagagcttgatcgtcttcagattggagattttgtttctgtaagcagtcctgagggcaattttaaaatatccaagttccaagaattagaagatctctttttgttggcagctggaacaggcttcacaccaatggttaaaatactgaattatgctttgactgatatacccagtctcaggaaagtgaagctgatgttcttcaataaaacagaagatgatataatttggagaagccaattggagaaattagcatttaaagataaaagactggatgttgaatttgttctctcagcacctatttctgaatggaatggcaaacagggacatatttcaccagctcttctttctgaatttttgaaaagaaatttggacaaatccaaagttctcgtctgcatttgtggaccagtgccatttacagaacaaggagtaaggttgctgcatgatctcaacttttccaaaaatgagatccatagttttacagcataatgaagagctgtcattgtcctttattcaactagtttatctaaatttgtgattgcttagggttttttaagagaacatttttgtacataacaaaaggttaactagaatccagccttcagtttcttaaatgaaatcaaatgttccttcagtacaggtaacttcttggctttcttttgtaccacaacttattttactactgatatttgacctggaaagttaatcatggcaacaaatacatacaggattctttgttatgaatcacaaatttccttgccatttaaattatatcactgttctacaataagcacttgtgttttatgacatgataaagtaaatgatcacttcgatcatgtttctatgctgtaaaatgtcttattagcaatacagattaaattttaccttgcactgttaactcaggaaatgatcatttatgtccttgttattaatgttaaaacatagaatgttataacttattaagtgatccaaacatttttttgtgtgtgtatggcattgatgcagaatagaataaaattatacttaagttctttttaa

SEQ ID NO: 24358 - DNA, 455 bp, Homo sapiens
ggctaagccatgaggttcaggaagatttttctggtaagctaccaaaaaccaaaaattatgtatgtacgtacatatacacatacctacagagagagagatacgaaaaaattgaaaaattagcatttgttttatttttcatgtctatattttcacattgcaaaacaaagatgtgatgttttctcttttttttttaaacttttaagttctgggatacatgtgcaagatgtgcacgtttgttacataggtaaatgtgtgtcatgggggtttgttgtacagatacaaacaaatacattaatttttaaatatacccctccctctggttttgggttttttcctattttttcttccccttattccttttttgtgtgtgagatggggtctcactctgtcacccaggttggactgcagcagtgtgatcttggttcactgcaacctctgcctctcaggctgaagtg

SEQ ID NO: 24359 - DNA, 798 bp, Homo sapiens
actttaaaaagctgtttttcttttccctagactggatgttgaatttgttctctcagcacctatttctgaatggaatggcaaacagggacatatttcaccagctcttctttctgaatttttgaaaagaaatttggacaaatccaaagttctcgtctgcatttgtggaccagtgccatttacagaacaaggagtaaggtgagtaacagtgtagtaggaaacagactgcccaacactgaagtgaagatctttcataacaagcatctctcagttcttcctgtttatatgaaactgcactttaataatcttacagttttagaaaataacaaagtctttaaatcttcgtatagtttgagttggaggccaggattatgcatattgttagataaaacataaaagtaagttacagccagcagtcagtgttctctgctcgtgatggctgccaatattgttacactcacaagattggtgccacaattcttatttgggacattaggcccaacctcttcttccatcaaagcttcataatatatagtaattaataaggaatgttcatctcattgtagcttttgatcttcattctctgtaactgagtgaaagtaaataatatatgtgatcaaaagccaagcagcaagacaaaaagggaagactagaacacaaataaggcaagactaatagttgaagcatggatcatgaaaaatcagtggtagtggcgatcctgtttgaaattcatcttgatgtgatttagctttaaaatggcactttaaaatatttggttaaatatagcccctattggatttc

SEQ ID NO: 24360 - DNA, 790 bp, Homo sapiens
tgctgcgtcagaatgcgcctcacccctggcgaccccggaagtgggtcgggggcttggcctctgcccggccacagagccggagctggaggtgctgtcccgtctggcggcgatccccgggcagggcccggggccggggtttgaagatgctgaacgtcccttcccagtctttcccggcccccaggtcgcagcagcgtgtcgcctccggggggcgtagcaaggtacctttaaaacagggcagaagccttatggattggattcgactgaccaaaagtggaaaggatctaacgggattaaaaggcaggttaattgaagtaactgaagaagaacttaagaaacacaacaaaaaagatgattgttggatatgcataagaggtttcgtttataatgtcagcccttatatggagtatcatcctggtggagaagatgaactaatgagagcagcaggatcagatggtactgaactttttgatcaggttcatcgttgggtcaattatgaatccatgctgaaagaatgcctggttggcagaatggccattaaacctgctgttctgaaaggcaaactctggcacctgtagagctgaggatggagatagacaccaggacctatagtgggctgagacattactttcaaagatttcttttactgtcacagcactgtgagcaaggacaagacatctattgaatgggctgcctgccagttggaagttcaacttttgtaaagtcagtcaaagttctttcttctagaagcctcagtttcctcattggtaaaatggagacaatttaggtagac

SEQ ID NO: 24361 - DNA, 2258 bp, Homo sapiens
tgctgcgtcagaatgcgcctcacccctggcgaccccggaagtgggtcgggggcttggcctctgcccggccacagagccggagctggaggtgctgtcccgtctggcggcgatccccgggcagggcccggggccggggtttgaagatgctgaacgtcccttcccagtctttcccggcccccaggtcgcagcagcgtgtcgcctccggggggcgtagcaaggtacctttaaaacagggcagaagccttatggattggattcgactgaccaaaagtggaaaggatctaacgggattaaaaggcaggttaattgaagtaactgaagaagaacttaagaaacacaacaaaaaagatgattgttggatatgcataagaggtttcgtttataatgtcagcccttatatggagtatcatcctggtggagaagatgaactaatgagagcagcaggatcagatggtactgaactttttgatcaggttcatcgttgggtcaattatgaatccatgctgaaagaatgcctggttggcagaatggccattaaacctgctgttctgaaagactatcgtgaggaggaaaagaaagtcttaaatggcatgcttcccaagagccaagtgacagatacacttgccaaagaaggtcctagttatccaagctatgattggttccaaacagactctttagtcaccattgccatatatactaaacagaaggatatcaatttagactcaataatagttgatcatcagaatgattcctttagagcagaaacaattattaaggattgtttatatcttatacatattgggctaagccatgaggttcaggaagatttttctgtgcgggttgttgagagtgtgggaaaaatagagattgttctacaaaaaaaagagaatacttcttgggactttcttggccatcccctgaagaatcataattcacttattccaaggaaagatacaggtttgtactacagaaagtgccagttaatttccaaggaagatgttactcatgatacgaggcttttctgtttgatgctgccaccaagcactcatcttcaagtgcccattgggcaacatgtttacctcaagctacctattacaggtacagaaatagtaaagccatatacacctgtatctggttccttactctcagagttcaaggaaccagttcttcccaacaataaatacatctactttttgataaaaatctatcccactggactcttcacaccagagcttgatcgtcttcagattggagattttgtttctgtaagcagtcctgagggcaattttaaaatatccaagttccaagaattagaagatctctttttgttggcagctggaacaggcttcacaccaatggttaaaatactgaattatgctttgactgatatacccagtctcaggaaagtgaagctgatgttcttcaataaaacagaagatgatataatttggagaagccaattggagaaattagcatttaaagataaaagactggatgttgaatttgttctctcagcacctatttctgaatggaatggcaaacagggacatatttcaccagctcttctttctgaatttttgaaaagaaatttggacaaatccaaagttctcgtctgcatttgtggaccagtgccatttacagaacaaggagtaaggttgctgcatgatctcaacttttccaaaaatgagatccatagttttacagcataatgaagagctgtcattgtcctttattcaactagtttatctaaatttgtgattgcttagggttttttaagagaacatttttgtacataacaaaaggttaactagaatccagccttcagtttcttaaatgaaatcaaatgttccttcagtacaggtaacttcttggctttcttttgtaccacaacttattttactactgatatttgacctggaaagttaatcatggcaacaaatacatacaggattctttgttatgaatcacaaatttccttgccatttaaattatatcactgttctacaataagcacttgtgttttatgacatgataaagtaaatgatcacttcgatcatgtttctatgctgtaaaatgtcttattagcaatacagattaaattttaccttgcactgttaactcaggaaatgatcatttatgtccttgttattaatgttaaaacatagaatgttataacttattaagtgatccaaacatttttttgtgtgtgtatggcattgatgcagaatagaataaaattatacttaagttctttttaa

SEQ ID NO: 24362 - DNA, 730 bp, Homo sapiens
tgctgcgtcagaatgcgcctcacccctggcgaccccggaagtgggtcgggggcttggcctctgcccggccacagagccggagctggaggtgctgtcccgtctggcggcgatccccgggcagggcccggggccggggtttgaagatgctgaacgtcccttcccagtctttcccggcccccaggtcgcagcagcgtgtcgcctccggggggcgtagcaaggtacctttaaaacagggcagaagccttatggattggattcgactgaccaaaagtggaaaggatctaacgggattaaaaggcaggttaattgaagtaactgaagaagaacttaagaaacacaacaaaaaagatgattgttggatatgcataagaggtttcgtttataatgtcagcccttatatggagtatcatcctggtggagaagatgaactaatgagagcagcaggatcagatggtactgaactttttgatcaggttcatcgttgggtcaattatgaatccatgctgaaagaatgcctggttggcagaatggccattaaacctgctgttctgaaagactatcgtgaggaggaaaagaaagtcttaaatggcatgcttcccaagagccaagtgacagatacacttgccaaagaaggtcctagttatccaagctatgattggttccaaacagactctttagtcaccattgccatatatactaaacagaaggtaaatatgtctttaaaatcaga

SEQ ID NO: 24363 - DNA, 6103 bp, Homo sapiens
ctatgatgtggtgcttgatgctatagacacaatgcagcgagtcgcctggcatatcaatgacatgaagcggaaacacgagcacgcggtccggttacaggagatacagagtttgctcactaactggaaggggccagacctgaccagctacggggaactggtgcttgagggaaccttccgcatccagcgagccaagaatgagcggacgctcttcctcttcgacaagctgctgctcatcacgaagaagagagatgacacgtttacatacaaagctcacatcctgtgtggcaacctcatgcttgtggaggtgattccaaaagagccgctcagcttcagcgtcttccactacaagaatcccaagctgcagcacacagtccaggccaaatcccagcaagacaaacgcctctgggttctgcacctaaagagactgattctggagaaccatgcagccaagattccagctaaggccaagcaagcaatccttgaaatggatgccattcatcatccaggcttctgttacagtcctgagggagggacgaaagcactgttcggctctaaagaaggttctgctccatatcggctgagaagaaaatctgaaccttcctcacggtcacataaagttttgaagaccagtgaaacagcacaagacatccaaaaggtttctagagaggaaggatctccccagctgtcttcagcaaggccgtctcctgcccagagaaatagtcagcctagcagttctaccatgatcagcgtgcttcgagcgggtggagctctcagaaacatctggaccgatcaccagatcaggcaagccttgtttcccagccgacggtccccgcaggagaatgaggatgatgaagatgattatcagatgttcgtgccgtcattttcctcctcagatctgaactctaccagactatgtgaagatagcacttctagtcgcccttgcagctggcatatgggacagatggagtccacagagacctccagctctggtcacaggattgtcaggcgggccagcagtgctggggagagcaacacatgccctcctgaaataggaactagtgacagaactagggaactgcagaacagccccaaaacagaagggcaggaggagatgactccctttgggtcatccatagagttgactattgatgacatagaccatgtctatgataacatcagttatgaggacttaaaactaatggttgctaagcgggaagaagctgaatccactccctctaaatcagccagggactccgttcgccccaagagcaccccagagttagccttcacaaagaggcaagctggccacagtaagggctctctttacgcacaaacagatggcaccctctcaggtggagaggcatccagccaaagcacgcatgaactccaagcggttgaggagaacatctatgacaccatagggctcccagatcctccgtcgctgggttttaagtgcagcagcctaaagcgtgcaaagcggagcacctttttgggtctggaggccgacttcgtgtgctgtgacagcctgaggccatttgtttcccaagacagcctccagctcagtgaggacgaagccccttaccatcaggccactcccgatcatggttatctgagtttgctgtatgactctcccagtggtaacttgtctatgcctcataagcctgtatctgataaactgtccgaagaagtagatgaaatctggaatgacctggaaaattacatcaagaaaaatgaagacaaggccagagaccgtctcctggcagcgtttcctgtgagcaaggatgatgtgccagacaggctgcacgcagagagcacccctgagctgagccgggacgtggggcgctctgtgtccacgctgtccctgcctgagagccaggctctcctcacgcccgtgaagagcagggctggcagagccagccgcgccaactgcccctttgaggaagacctgatttctaaagaaggctcctttatgagccttaaccggctttctctggctagtgaaatgcccctcatggacaatccctacgacctggccaacagtggcctgtctcaaacagacccagaaaaccctgacctggggatggaggccacagataagacaaaaagcagggtgtttatgatggctcggcagtacagtcagaagattaagaaggcgaatcaacttttaaaagtgaaaagtctggagctggagcagccgccggccagtcagcatcagaaatccatgcacaaagacctggctgccatcttggaagagaagaagcaaggagggcccgccattggtgccaggattgctgagtattcccagttgtatgaccagattgtattcagggagtctcccttgaaaattcagaaggatggctgggccagccctcaagaatcctccctcctgaggtctgtgtcaccttcccaggtccaccatggtagtggagactggcttctgcattcaacctatagtaatggagagttagcagatttctgtctcccaccagagcaagacttgaggtcaagatatcccacgtttgagatcaatacaaaaagtactcccaggcaattgtccgcagcttgctctgtgccttctcttcaaacctctgaccctctgccaggctctgtgcagagatgcagcgtggtagtaagtcagcccaacaaagagaactggtgtcaggaccatctttacaactccttgggtcggaaagggatcagcgctaaatctcagccttatcacaggtcccagtcatcttcctccgtcttgatcaacaaatcaatggattccatcaactaccctagtgatgtgggaaagcagcagctgctgtctttacacagaagttcaaggtgtgagagtcaccaggacttgctgccagatattgctgactcgcatcaacagggcactgaaaaactctcagatctcacactccaagactcacagaaagttgtggtggtcaatagaaatttacccttaaatgcccaaattgcaacacagaattatttttccaatttcaaagagactgatggagatgaagatgactatgtggaaatcaagtcagaagaagatgagtcggagttggagctatctcacaatcgtagaaggaaatctgactcaaagtttgtggatgctgacttttctgataatgtctgcagcggcaacacattgcattctttgaatagtccgcgcactccaaaaaagccggttaacagcaaacttggcctttcaccatatctgacaccatataatgattctgacaaactgaatgactatctttggagggggccatctcccaatcaacaaaatattgtccagtctctaagggaaaaatttcagtgtctcagttcaagcagctttgcttaaggttcttcataataactgcttgaatcaacttcttattttgctcataaaacgttacagatactgatgaggtgttttatgtataccagattaaaacaattttgtaagaaccagaggtgtaaaatatactttcttttacagcacaacttttggaaatggctgacgatgcagcccggattgtactgtagcacatgttggcatcaacagtatattttctcatgctgagtgtcttcatgtttcatgtaagtcaatcttacttgaaagtttttagacttttaacacgatggccataacctgacaatagtgcccacaccttaagaaatgcaataatcctttcctgttatccagaaggcccaggtagttttatcctgtgactcaaaggcagcaaggagactttttcacattttaaaaggcaacgaaagctgttgaaagaattatgcttatatctcacattttggttatatttgtggtaacaccttaggataacgtaagccagagatctgtaaattggactgcagtctgaggtgcccattttagggtttttgtgctagtattcttttatgtcattttgatgcagaaattgtgtgactgttgaaaattaaaatgtagcgggacccattttctgtacgcagaaccctttacctgtattcctggacaaggcctagagaacgagctgctcatcatgtttctaatataatttctggggtgaaatgaatgatttccttactggcttagagaaaaccaaggtcaataaaatgcagattgacttaactattagaaaagatgggatgacttctgggaaccacttaactcttcaaatgactgttgaaagagaaaaagcaaaactgaaatcccaccagaccattttgtgtgcctgtttctaatcgatacaaagttaagcatgagctaaaatcagacaaagcactttaaatttatcctttccagagcgctttgcacatgcaccctcctgagtttgggattctgccaaatgaccaacttgatcctggccctgaggagtcattggctgcaggaatagggcaagaatctatttcctaaactacacataacatgggagcctttttttcgttgttttcaggtatattaaagaatgaaatctttggttactaggtgctgactaataaataacaccttttatattctgaccatttgtcacatttcattgtgatactgtatactgatctaactccttatgaaaggcaacaaacaaaaataagacattgaataaaaagcaaaatcaaagaagctaaagagaaaaatgaaggcagatatattgcaactttataacatattctattttattgaagactgcaattaatgcagcaagaatgctttctcaagcggtggcctttgtattctcattttaatcaggtgtacattctatggcctctcccccatgctgttagtttctattttaaaagatacaataatatatgtagggaaaggggcctgggctcttcatttaaaggtaagcagtaatattgagtaagtgacataattctttttctctttgttaagtcctatgcctctttttcttaactgtaaaacatagaatatgagcgtttttatcttacaaataggtacctaaggcatgtgattttatttttaaataacaaaaaataacccaagtttcttgcttctccaaagtattcttctcatagcttataaaagaaagtccacattgaatagcatggtctgggaacattccttctttattgtgtttatttgaacatgatatgagtttccaagatgaaatgatcaaaaaagataagtaccacaagaaagtttttttgtttggttggtttttttgtttgtttgtttttttcttgagactgagtctctccctgttgcccaagttggagtgcaatcttggctcactgcagcctccacctccccggttccagcgattctcctgcctcagcctcttgaatagctgggattacaggcgcccgccaccacacctggctaatttttgtgttgttagtagaggcggggtttcatcatgttggccaggctggtctcgaactcctgatctcatgatccgtctgcctcggcctcccagagtgctgggattacaggcatgagccactgcgcccggccaagaaagtatgtttttagaggtgtgtgtaagtgcatttgtattacctatgaacaaaattacctgactcttgtcccaggaaagctgtttcgcattttcgctttttgattggtattatccagttctatgtagttcatattattgttctgtctgactctcagaaattacttcttcacgccagtgtcttgttgcatgactttgatgtcacctataggaatacacctcactgcacgtaagtgggtatcttactgtataaaaggtctacatggctttaggttttaggacaaatgtgtagatttatagaccatttctgttggccaggacacagattttgagagctgtgtgtatatatatataatcatgtttgtatttttttcctgaaagttatcaattgcttttgtttaaaacagtttgttttagaggtggggtggggatgtatataacgaggaaaagttatatgtactttaaagtatgtcaagttcttactagtttcctgtactgaaggttcaattttttttatataagtttacttttcacctgctctattctttgtggggaaaaaatgcatctagaaaaacatagtttaaatactgtatataagataatgaaagttagtaacgtccattatttaataaagtttgtaaagt

SEQ ID NO: 24364 - DNA, 5400 bp, Homo sapiens
ctatgatgtggtgcttgatgctatagacacaatgcagcgagtcgcctggcatatcaatgacatgaagcggaaacacgagcacgcggtccggttacaggagatacagagtttgctcactaactggaaggggccagacctgaccagctacggggaactggtgcttgagggaaccttccgcatccagcgagccaagaatgagcggacgctcttcctcttcgacaagctgctgctcatcacgaagaagagagatgacacgtttacatacaaagctcacatcctgtgtggcaacctcatgcttgtggaggtgattccaaaagagccgctcagcttcagcgtcttccactacaagaatcccaagctgcagcacacagtccaggccaaatcccagcaagacaaacgcctctgggttctgcacctaaagagactgattctggagaaccatgcagccaagattccagctaaggccaagcaagcaatccttgaaatggatgccattcatcatccaggcttctgttacagtcctgagggagggacgaaagcactgttcggctctaaagaaggttctgctccatatcggctgagaagaaaatctgaaccttcctcacggtcacataaagttttgaagaccagtgaaacagcacaagacatccaaaaggtttctagagaggaaggatctccccagctgtcttcagcaaggccgtctcctgcccagagaaatagtcagcctagcagttctaccatgatcagcgtgcttcgagcgggtggagctctcagaaacatctggaccgatcaccagatcaggcaagccttgtttcccagccgacggtccccgcaggagaatgaggatgatgaagatgattatcagatgttcgtgccgtcattttcctcctcagatctgaactctaccagactatgtgaagatagcacttctagtcgcccttgcagctggcatatgggacagatggagtccacagagacctccagctctggtcacaggattgtcaggcgggccagcagtgctggggagagcaacacatgccctcctgaaataggaactagtgacagaactagggaactgcagaacagccccaaaacagaagggcaggaggagatgactccctttgggtcatccatagagttgactattgatgacatagaccatgtctatgataacatcagttatgaggacttaaaactaatggttgctaagcgggaagaagctgaatccactccctctaaatcagccagggactccgttcgccccaagagcaccccagagttagccttcacaaagaggcaagctggccacagtaagggctctctttacgcacaaacagatggcaccctctcaggtggagaggcatccagccaaagcacgcatgaactccaagcggttgaggagaacatctatgacaccatagggctcccagatcctccgtcgctgggttttaagtgcagcagcctaaagcgtgcaaagcggagcacctttttgggtctggaggccgacttcgtgtgctgtgacagcctgaggccatttgtttcccaagacagcctccagctcagtgaggacgaagccccttaccatcaggccactcccgatcatggttatctgagtttgctgtatgactctcccagtggtaacttgtctatgcctcataagcctgtatctgataaactgtccgaagaagtagatgaaatctggaatgacctggaaaattacatcaagaaaaatgaagacaaggccagagaccgtctcctggcagcgtttcctgtgagcaaggatgatgtgccagacaggctgcacgcagagagcacccctgagctgagccgggacgtggggcgctctgtgtccacgctgtccctgcctgagagccaggctctcctcacgcccgtgaagagcagggctggcagagccagccgcgccaactgcccctttgaggaagacctgatttctaaagaaggctcctttatgagccttaaccggctttctctggctagtgaaatgcccctcatggacaatccctacgacctggccaacagtggcctgtctcaaacagacccagaaaaccctgacctggggatggaggccacagataagacaaaaagcagggtgtttatgatggctcggcagtacagtcagaagattaagaaggcgaatcaacttttaaaagtgaaaagtctggagctggagcagccgccggccagtcagcatcagaaatccatgcacaaagacctggctgccatcttggaagagaagaagcaaggagggcccgccattggtgccaggattgctgagtattcccagttgtatgaccagattgtattcagggagtctcccttgaaaattcagaaggatggctgggccagccctcaagaatcctccctcctgaggtctgtgtcaccttcccaggtccaccatggtagtggagactggcttctgcattcaacctatagtaatggagagttagcagatttctgtctcccaccagagcaagacttgaggtcaagatatcccacgtttgagatcaatacaaaaagtactcccaggcaattgtccgcagcttgctctgtgccttctcttcaaacctctgaccctctgccaggctctgtgcagagatgcagcgtggtagtaagtcagcccaacaaagagaactggtgtcaggaccatctttacaactccttgggtcggaaagggatcagcgctaaatctcagccttatcacaggtcccagtcatcttcctccgtcttgatcaacaaatcaatggattccatcaactaccctagtgatgtgggaaagcagcagctgctgtctttacacagaagttcaaggtgtgagagtcaccaggacttgctgccagatattgctgactcgcatcaacagggcactgaaaaactctcagatctcacactccaagactcacagaaagttgtggtggtcaatagaaatttacccttaaatgcccaaattgcaacacagaattatttttccaatttcaaagagactgatggagatgaagatgactatgtggaaatcaagtcagaagaagatgagtcggagttggagctatctcacaatcgtagaaggaaatctgactcaaagtttgtggatgctgacttttctgataatgtctgcagcggcaacacattgcattctttgaatagtccgcgcactccaaaaaagccggttaacagcaaacttggcctttcaccatatctgacaccatataatgattctgacaaactgaatgactatctttggagggggccatctcccaatcaacaaaatattgtccagtctctaagggaaaaatttcagtgtctcagttcaagcagctttgcttaaggttcttcataataactgcttgaatcaacttcttattttgctcataaaacgttacagatactgatgaggtgttttatgtataccagattaaaacaattttgtaagaaccagaggtgtaaaatatactttcttttacagcacaacttttggaaatggctgacgatgcagcccggattgtactgtagcacatgttggcatcaacagtatattttctcatgctgagtgtcttcatgtttcatagcgctttgcacatgcaccctcctgagtttgggattctgccaaatgaccaacttgatcctggccctgaggagtcattggctgcaggaatagggcaagaatctatttcctaaactacacataacatgggagcctttttttcgttgttttcaggtatattaaagaatgaaatctttggttactaggtgctgactaataaataacaccttttatattctgaccatttgtcacatttcattgtgatactgtatactgatctaactccttatgaaaggcaacaaacaaaaataagacattgaataaaaagcaaaatcaaagaagctaaagagaaaaatgaaggcagatatattgcaactttataacatattctattttattgaagactgcaattaatgcagcaagaatgctttctcaagcggtggcctttgtattctcattttaatcaggtgtacattctatggcctctcccccatgctgttagtttctattttaaaagatacaataatatatgtagggaaaggggcctgggctcttcatttaaaggtaagcagtaatattgagtaagtgacataattctttttctctttgttaagtcctatgcctctttttcttaactgtaaaacatagaatatgagcgtttttatcttacaaataggtacctaaggcatgtgattttatttttaaataacaaaaaataacccaagtttcttgcttctccaaagtattcttctcatagcttataaaagaaagtccacattgaatagcatggtctgggaacattccttctttattgtgtttatttgaacatgatatgagtttccaagatgaaatgatcaaaaaagataagtaccacaagaaagtttttttgtttggttggtttttttgtttgtttgtttttttcttgagactgagtctctccctgttgcccaagttggagtgcaatcttggctcactgcagcctccacctccccggttccagcgattctcctgcctcagcctcttgaatagctgggattacaggcgcccgccaccacacctggctaatttttgtgttgttagtagaggcggggtttcatcatgttggccaggctggtctcgaactcctgatctcatgatccgtctgcctcggcctcccagagtgctgggattacaggcatgagccactgcgcccggccaagaaagtatgtttttagaggtgtgtgtaagtgcatttgtattacctatgaacaaaattacctgactcttgtcccaggaaagctgtttcgcattttcgctttttgattggtattatccagttctatgtagttcatattattgttctgtctgactctcagaaattacttcttcacgccagtgtcttgttgcatgactttgatgtcacctataggaatacacctcactgcacgtaagtgggtatcttactgtataaaaggtctacatggctttaggttttaggacaaatgtgtagatttatagaccatttctgttggccaggacacagattttgagagctgtgtgtatatatatataatcatgtttgtatttttttcctgaaagttatcaattgcttttgtttaaaacagtttgttttagaggtggggtggggatgtatataacgaggaaaagttatatgtactttaaagtatgtcaagttcttactagtttcctgtactgaaggttcaattttttttatataagtttacttttcacctgctctattctttgtggggaaaaaatgcatctagaaaaacatagtttaaatactgtatataagataatgaaagttagtaacgtccattatttaataaagtttgtaaagt

SEQ ID NO: 24365 - DNA, 6273 bp, Homo sapiens
ctatgatgtggtgcttgatgctatagacacaatgcagcgagtcgcctggcatatcaatgacatgaagcggaaacacgagcacgcggtccggttacaggagatacagagtttgctcactaactggaaggggccagacctgaccagctacggggaactggtgcttgagggaaccttccgcatccagcgagccaagaatgagcggacgctcttcctcttcgacaagctgctgctcatcacgaagaagagagatgacacgtttacatacaaagctcacatcctgtgtggcaacctcatgcttgtggaggtgattccaaaagagccgctcagcttcagcgtcttccactacaagaatcccaagctgcagcacacagtccaggccaaatcccagcaagacaaacgcctctgggttctgcacctaaagagactgattctggagaaccatgcagccaagattccagctaaggccaagcaagcaatccttgaaatggatgccattcatcatccaggcttctgttacagtcctgagggagggacgaaagcactgttcggctctaaagaaggttctgctccatatcggctgagaagaaaatctgaaccttcctcacggtcacataaagttttgaagaccagtgaaacagcacaagacatccaaaaggtttctagagaggaaggatctccccagctgtcttcagcaaggccgtctcctgcccagagaaatagtcagcctagcagttctaccatgatcagcgtgcttcgagcgggtggagctctcagaaacatctggaccgatcaccagatcaggcaagccttgtttcccagccgacggtccccgcaggagaatgaggatgatgaagatgattatcagatgttcgtgccgtcattttcctcctcagatctgaactctaccagactatgtgaagatagcacttctagtcgcccttgcagctggcatatgggacagatggagtccacagagacctccagctctggtcacaggattgtcaggcgggccagcagtgctggggagagcaacacatgccctcctgaaataggaactagtgacagaactagggaactgcagaacagccccaaaacagaagggcaggaggagatgactccctttgggtcatccatagagttgactattgatgacatagaccatgtctatgataacatcagttatgaggacttaaaactaatggttgctaagcgggaagaagctgaatccactccctctaaatcagccagggactccgttcgccccaagagcaccccagagttagccttcacaaagaggcaagctggccacagtaagggctctctttacgcacaaacagatggcaccctctcaggtggagaggcatccagccaaagcacgcatgaactccaagcggttgaggagaacatctatgacaccatagggctcccagatcctccgtcgctgggttttaagtgcagcagcctaaagcgtgcaaagcggagcacctttttgggtctggaggccgacttcgtgtgctgtgacagcctgaggccatttgtttcccaagacagcctccagctcagtgaggacgaagccccttaccatcaggccactcccgatcatggttatctgagtttgctgtatgactctcccagtggtaacttgtctatgcctcataagcctgtatctgataaactgtccgaagaagtagatgaaatctggaatgacctggaaaattacatcaagaaaaatgaagacaaggccagagaccgtctcctggcagcgtttcctgtgagcaaggatgatgtgccagacaggctgcacgcagagagcacccctgagctgagccgggacgtggggcgctctgtgtccacgctgtccctgcctgagagccaggctctcctcacgcccgtgaagagcagggctggcagagccagccgcgccaactgcccctttgaggaagacctgatttctaaagaaggctcctttatgagccttaaccggctttctctggctagtgaaatgcccctcatggacaatccctacgacctggccaacagtggcctgtctcaaacagacccagaaaaccctgacctggggatggaggccacagataagacaaaaagcagggtgtttatgatggctcggcagtacagtcagaagattaagaaggcgaatcaacttttaaaagtgaaaagtctggagctggagcagccgccggccagtcagcatcagaaatccatgcacaaagacctggctgccatcttggaagagaagaagcaaggagggcccgccattggtgccaggattgctgagtattcccagttgtatgaccagattgtattcagggagtctcccttgaaaattcagaaggatggctgggccagccctcaagaatcctccctcctgaggtctgtgtcaccttcccaggtccaccatggtagtggagactggcttctgcattcaacctatagtaatggagagttagcagatttctgtctcccaccagagcaagacttgaggtcaagatatcccacgtttgagatcaatacaaaaagtactcccaggcaattgtccgcagcttgctctgtgccttctcttcaaacctctgaccctctgccaggctctgtgcagagatgcagcgtggtagtaagtcagcccaacaaagagaactggtgtcaggaccatctttacaactccttgggtcggaaagggatcagcgctaaatctcagccttatcacaggtcccagtcatcttcctccgtcttgatcaacaaatcaatggattccatcaactaccctagtgatgtgggaaagcagcagctgctgtctttacacagaagttcaaggtgtgagagtcaccaggacttgctgccagatattgctgactcgcatcaacagggcactgaaaaactctcagatctcacactccaagactcacagaaagttgtggtggtcaatagaaatttacccttaaatgcccaaattgcaacacagaattatttttccaatttcaaagagactgatggagatgaagatgactatgtggaaatcaagtcagaagaagatgagtcggagttggagctatctcacaatcgtagaaggaaatctgactcaaagtttgtggatgctgacttttctgataatgtctgcagcggcaacacattgcattctttgaatagtccgcgcactccaaaaaagccggttaacagcaaacttggcctttcaccatatctgacaccatataatgattctgacaaactgaatgactatctttggagggggccatctcccaatcaacaaaatattgtccagtctctaagggaaaaatttcagtgtctcagttcaagcagctttgcttaaggttcttcataataactgcttgaatcaacttcttattttgctcataaaacgttacagatactgatgaggtgttttatgtataccagattaaaacaattttgtaagaaccagaggtgtaaaatatactttcttttacagcacaacttttggaaatggctgacgatgcagcccggattgtactgtagcacatgttggcatcaacagtatattttctcatgctgagtgtcttcatgtttcatgtaagtcaatcttacttgaaagtttttagacttttaacacgatggccataacctgacaatagtgcccacaccttaagaaatgcaataatcctttcctgttatccagaaggcccaggtagttttatcctgtgactcaaaggcagcaaggagactttttcacattttaaaaggcaacgaaagctgttgaaagaattatgcttatatctcacattttggttatatttgtggtaacaccttaggataacgtaagccagagatctgtaaattggactgcagtctgaggtgcccattttagggtttttgtgctagtattcttttatgtcattttgatgcagaaattgtgtgactgttgaaaattaaaatgtagcgggacccattttctgtacgcagaaccctttacctgtattcctggacaaggcctagagaacgagctgctcatcatgtttctaatataatttctggggtgaaatgaatgatttccttactggcttagagaaaaccaaggtcaataaaatgcagattgacttaactattagaaaagatgggatgacttctgggaaccacttaactcttcaaatgactgttgaaagagaaaaagcaaaactgaaatcccaccagaccattttgtgtgcctgtttctaatcgatacaaagttaagcatgagctaaaatcagacaaagcactttaaatttatcctttccagagcgctttgcacatgcaccctcctgagtttgggattctgccaaatgaccaacttgatcctggccctgaggagtcattggctgcaggaatagggcaagaatctatttcctaaactacacataacatgggagcctttttttcgttgttttcaggtatattaaagaatgaaatctttggttactaggtgctgactaataaataacaccttttatattctgaccatttgtcacatttcattgtgatactgtatactgatctaactccttatgaaaggcaacaaacaaaaataagacattgaataaaaagcaaaatcaaagaagctaaagagaaaaatgaaggcagatatattgcaactttataacatattctattttattgaagactgcaattaatgcagcaagaatgctttctcaagcggtggcctttgtattctcattttaatcaggtgtacattctatggcctctcccccatgctgttagtttctattttaaaagatacaataatatatgtagggaaaggggcctgggctcttcatttaaaggtaagcagtaatattgagtaagtgacataattctttttctctttgttaagtcctatgcctctttttcttaactgtaaaacatagaatatgagcgtttttatcttacaaataggtacctaaggcatgtgattttatttttaaataacaaaaaataacccaagtttcttgcttctccaaagtattcttctcatagcttataaaagaaagtccacattgaatagcatggtctgggaacattccttctttattgtgtttatttgaacatgatatgagtttccaagatgaaatgatcaaaaaagataagtaccacaagaaagtttttttgtttggttggtttttttgtttgtttgtttttttcttgagactgagtctctccctgttgcccaagttggagtgcaatcttggctcactgcagcctccacctccccggttccagcgattctcctgcctcagcctcttgaatagctgggattacaggcgcccgccaccacacctggctaatttttgtgttgttagtagaggcggggtttcatcatgttggccaggctggtctcgaactcctgatctcatgatccgtctgcctcggcctcccagagtgctgggattacaggcatgagccactgcgcccggccaagaaagtatgtttttagaggtgtgtgtaagtgcatttgtattacctatgaacaaaattacctgactcttgtcccaggaaagctgtttcgcattttcgctttttgattggtattatccagttctatgtagttcatattattgttctgtctgactctcagaaattacttcttcacgccagtgtcttgttgcatgactttgatgtcacctataggaatacacctcactgcacgtaagtgggtatcttactgtataaaaggtctacatggctttaggttttaggacaaatgtgtagatttatagaccatttctgttggccaggacacagattttgagagctgtgtgtatatatatataatcatgtttgtatttttttcctgaaagttatcaattgcttttgtttaaaacagtttgttttagaggtggggtggggatgtatataacgaggaaaagttatatgtactttaaagtatgtcaagttcttactagtttcctgtactgaaggttcaattttttttatataagtttacttttcacctgctctattctttgtggggaaaaaatgcatctagaaaaacatagtttaaatactgtatataagataatgaaagttagtaacgtccattatttaataaagtttgtaaagtccaccacacacaggcacatggacacaaatctgtgggccccgcccgagaaactcttaaacccgcgtggcgcggcgccacggtagaccgcacaggtgcagaacacgcgacaacggcgatccataaaccgggccgcgtgaacacggccgccaggtaaggcagagaatcccgca

SEQ ID NO: 24366 - DNA, 5280 bp, Homo sapiens
ctatgatgtggtgcttgatgctatagacacaatgcagcgagtcgcctggcatatcaatgacatgaagcggaaacacgagcacgcggtccggttacaggagatacagagtttgctcactaactggaaggggccagacctgaccagctacggggaactggtgcttgagggaaccttccgcatccagcgagccaagaatgagcggacgctcttcctcttcgacaagctgctgctcatcacgaagaagagagatgacacgtttacatacaaagctcacatcctgtgtggcaacctcatgcttgtggaggtgattccaaaagagccgctcagcttcagcgtcttccactacaagaatcccaagctgcagcacacagtccaggccaaatcccagcaagacaaacgcctctgggttctgcacctaaagagactgattctggagaaccatgcagccaagattccagctaaggccaagcaagcaatccttgaaatggatgccattcatcatccaggcttctgttacagtcctgagggagggacgaaagcactgttcggctctaaagaaggttctgctccatatcggctgagaagaaaatctgaaccttcctcacggtcacataaagttttgaagaccagtgaaacagcacaagacatccaaaaggtttctagagaggaaggatctccccagctgtcttcagcaaggccgtctcctgcccagagaaatagtcagcctagcagttctaccatgatcagcgtgcttcgagcgggtggagctctcagaaacatctggaccgatcaccagatcaggcaagccttgtttcccagccgacggtccccgcaggagaatgaggatgatgaagatgattatcagatgttcgtgccgtcattttcctcctcagatctgaactctaccagactatgtgaagatagcacttctagtcgcccttgcagctggcatatgggacagatggagtccacagagacctccagctctggtcacaggattgtcaggcgggccagcagtgctggggagagcaacacatgccctcctgaaataggaactagtgacagaactagggaactgcagaacagccccaaaacagaagggcaggaggagatgactccctttgggtcatccatagagttgactattgatgacatagaccatgtctatgataacatcagttatgaggacttaaaactaatggttgctaagcgggaagaagctgaatccactccctctaaatcagccagggactccgttcgccccaagagcaccccagagttagccttcacaaagaggcaagctggccacagtaagggctctctttacgcacaaacagatggcaccctctcaggtggagaggcatccagccaaagcacgcatgaactccaagcggttgaggagaacatctatgacaccatagggctcccagatcctccgtcgctgggttttaagtgcagcagcctaaagcgtgcaaagcggagcacctttttgggtctggaggccgacttcgtgtgctgtgacagcctgaggccatttgtttcccaagacagcctccagctcagtgaggacgaagccccttaccatcaggccactcccgatcatggttatctgagtttgctgtatgactctcccagtggtaacttgtctatgcctcataagcctgtatctgataaactgtccgaagaagtagatgaaatctggaatgacctggaaaattacatcaagaaaaatgaagacaaggccagagaccgtctcctggcagcgtttcctgtgagcaaggatgatgtgccagacaggctgcacgcagagagcacccctgagctgagccgggacgtggggcgctctgtgtccacgctgtccctgcctgagagccaggctctcctcacgcccgtgaagagcagggctggcagagccagccgcgccaactgcccctttgaggaagacctgatttctaaagaaggctcctttatgagccttaaccggctttctctggctagtgaaatgcccctcatggacaatccctacgacctggccaacagtggcctgtctcaaacagacccagaaaaccctgacctggggatggaggccacagataagacaaaaagcagggtgtttatgatggctcggcagtacagtcagaagattaagaaggcgaatcaacttttaaaagtgaaaagtctggagctggagcagccgccggccagtcagcatcagaaatccatgcacaaagacctggctgccatcttggaagagaagaagcaaggagggcccgccattggtgccaggattgctgagtattcccagttgtatgaccagattgtattcagggagtctcccttgaaaattcagaaggatggctgggccagccctcaagaatcctccctcctgaggtctgtgtcaccttcccaggtccaccatggtagtggagactggcttctgcattcaacctatagtaatggagagttagcagatttctgtctcccaccagagcaagacttgaggtcaagatatcccacgtttgagatcaatacaaaaagtactcccaggcaattgtccgcagcttgctctgtgccttctcttcaaacctctgaccctctgccaggctctgtgcagagatgcagcgtggtagtaagtcagcccaacaaagagaactggtgtcaggaccatctttacaactccttgggtcggaaagggatcagcgctaaatctcagccttatcacaggtcccagtcatcttcctccgtcttgatcaacaaatcaatggattccatcaactaccctagtgatgtgggaaagcagcagctgctgtctttacacagaagttcaaggtgtgagagtcaccaggacttgctgccagatattgctgactcgcatcaacagggcactgaaaaactctcagatctcacactccaagactcacagaaagttgtggtggtcaatagaaatttacccttaaatgcccaaattgcaacacagaattatttttccaatttcaaagagactgatggagatgaagatgactatgtggaaatcaagtcagaagaagatgagtcggagttggagctatctcacaatcgtagaaggaaatctgactcaaagtttgtggatgctgacttttctgataatgtctgcagcggcaacacattgcattctttgaatagtccgcgcactccaaaaaagccggttaacagcaaacttggcctttcaccatatctgacaccatataatgattctgacaaactgaatgactatctttggagggggccatctcccaatcaacaaaatattgtccagtctctaagggaaaaatttcagtgtctcagttcaagcagctttgcttaaggttcttcataataactgcttgaatcaacttcttattttgctcataaaacgttacagatactgatgaggtgttttatgtataccagattaaaacaattttgtaagaaccagaggtgtaaaatatactttcttttacagcacaacttttggaaatggctgacgatgcagcccggattgtactgtagcacatgttggcatcaacagtatattttctcatgctgagtgtcttcatgtttcatgtaagtcaatcttacttgaaagtttttagacttttaacacgatggccataacctgacaatagtgcccacaccttaagaaatgcaataatcctttcctgttatccagaaggcccaggtagttttatcctgtgactcaaaggcagcaaggagactttttcacattttaaaaggcaacgaaagctgttgaaagaattatgcttatatctcacattttggttatatttgtggtaacaccttaggataacgtaagccagagatctgtaaattggactgcagtctgaggtgcccattttagggtttttgtgctagtattcttttatgtcattttgatgcagaaattgtgtgactgttgaaaattaaaatgtagcgggacccattttctgtacgcagaaccctttacctgtattcctggacaaggcctagagaacgagctgctcatcatgtttctaatataatttctggggtgaaatgaatgatttccttactggcttagagaaaaccaaggtcaataaaatgcagattgacttaactattagaaaagatgggatgacttctgggaaccacttaactcttcaaatgactgttgaaagagaaaaagcaaaactgaaatcccaccagaccattttgtgtgcctgtttctaatcgatacaaagttaagcatgagctaaaatcagacaaagcactttaaatttatcctttccagagcgctttgcacatgcaccctcctgagtttgggattctgccaaatgaccaacttgatcctggccctgaggagtcattggctgcaggaatagggcaagaatctatttcctaaactacacataacatgggagcctttttttcgttgttttcaggtatattaaagaatgaaatctttggttactaggtgctgactaataaataacaccttttatattctgaccatttgtcacatttcattgtgatactgtatactgatctaactccttatgaaaggcaacaaacaaaaataagacattgaataaaaagcaaaatcaaagaagctaaagagaaaaatgaaggcagatatattgcaactttataacatattctattttattgaagactgcaattaatgcagcaagaatgctttctcaagcggtggcctttgtattctcattttaatcaggtgtacattctatggcctctcccccatgctgttagtttctattttaaaagatacaataatatatgtagggaaaggggcctgggctcttcatttaaaggtaagcagtaatattgagtaagtgacataattctttttctctttgttaagtcctatgcctctttttcttaactgtaaaacatagaatatgagcgtttttatcttacaaataggtacctaaggcatgtgattttatttttaaataacaaaaaataacccaagtttcttgcttctccaaagtattcttctcatagcttataaaagaaagtccacattgaatagcatggtctgggaacattccttctttattgtgtttatttgaacatgatatgagtttccaagatgaaatgatcaaaaaagataagtaccacaagaaagtttttttgtttggttggtttttttgtttgtttgtttttttcttgagactgagtctctccctgttgcccaagattgcgcccctgtactccagcctgggcaacagagcaagactccatctcaaataaaaaataaaaata

SEQ ID NO: 24367 - DNA, 415 bp, Homo sapiens
gtagcagccgggccctggcctctccgcaaggcccctttgtgtaatgatgagtgctgtgtaccatgtggctttttgagagcgttctggccacatggtcatttcccatctcatcagagggtcctgtgggtggtggaatcaagttgtctgactgtctacatctcgtcttggcaggccaaatcccagcaagacaaacgcctctgggttctgcacctaaagagactgattctggagaaccatgcagccaagattccagctaaggtaggacactgaataatgcacagtgaaatgggagagagatacaagaatcatttgaacctgggaggtggaggttactgtgagccgagatcacatcattgaactccagactgggcgacagagtgagactgtctcaaaataaaaacaaagagactgggtc

SEQ ID NO: 24368 - DNA, 400 bp, Homo sapiens
catcatcctatgtgatttacttttatggtgtttagtaagaaatattgctttattttcttgtaaaaaatttccagtggtaaaaataaatcaacatagtagaataaacgtcaatagtttgaaaatgaaatctaaacccataaacaaattattgacaaatgccttttatctcaattatacacctattggaaaatttctttataagacacagccatttccaatatatttgtgaaaagagttgtttaaaacctatttatcactttgaataagttccacgttttttgacacataccaataacataggaataatatattttttcttgtttatgttatagcttttcactgagtaccttgtaaaggcatgagacacagtgtgattggcatatgtggtggtgttagtggt

SEQ ID NO: 24369 - DNA, 393 bp, Homo sapiens
ctttaataattaaataacttaaggaaataattatgtatggaataaattcaggaatctacaagttttgcattcaaaactttctgggaatagttttggcttctggctgtgccaagggggagatttccagcagtctgcaccatgcctccttctttggctcagagcccatgagccttgatccctaccagtgtccctcacccaaaggcctggacaagaactgaacaaggacccactgggctgtgggcataggcactcttcacagggattacatgaaactgcatttcctcccatctcctcttctaggggaggaatatccactctagctcatgccctggagcctcctcaccctcctcccttggaggatcacctgggcatggaccttcctgttttctgatc

SEQ ID NO: 24370 - DNA, 545 bp, Homo sapiens
tctgtctgaggaagtttggactatgtggtgtgagatccgtagacattggactaatgtcattaacatattttaatatttaaatttcttattaaaaaatagataatgcagtagttactttttgaaggacgaccgaagcaggatatttccctgaccccttcatgggacccacgtcagaggtgtttactcagcctgctgcccacaactcctcacaggagggagcgcacaagtgaacgagggtgaggactggagagcaccagcactggaacaacccggccacttcggcgctactgggatcaaactccatcacttggacacactgtgttccacccctcgtgggagggagcatgcaggtgagaggatgcaggagtcagggtgagcacttttgggctccagcaggagcaaactctgtgcagggccctgcagcagtgactgaggggcggcctgtgactcccaaagccccagaggacatgctacagtgctcttttagctctaccatccgtaggtggcttaagtgtaaacagctcagtgggccctttgcctttttg

SEQ ID NO: 24371 - DNA, 312 bp, Homo sapiens
gaacgcatgcctcgaataacccaaatatgaaagacagaaaacatgttctaggatttaaggctcctaaaggtaacataactgtgatatttggcaccagtgccaaatggagatttgaagctgaagccaataatgtcactcaccaaactttgagccttttaaaagatattgttaacgtcagcctttgaggttcatgtcaggtatagcaaaaatgtatggatggctgcccacatttgcatttatatttttacttagttcttctctgttaaagaggatgaatgccccaaaacattaaaaaaaaaaaaaaacttaact

SEQ ID NO: 24372 - DNA, 203 bp, Homo sapiens
tctctgtgctccctgtgcctccatagcagattctgggatagcagattctgggggcaacaatctcaatttcgttggtgctggaggagtggcctcagggcatctgctgtcacctctgctggggccccagtccagcccgtgccctcactgtccccgcggtggccgcctgccttcccagcctcttcccctctgcagtgcgcgctctt

SEQ ID NO: 24373 - DNA, 194 bp, Homo sapiens
ttagagacagggtcttactctgtcacacaagctggagtgcagtggcacaatgacagcacactgaagcctcaaactcctgagcttgagcaatccgcctgccttagcctcctgagtgaccaggactatggttgcttaccatcatgcccagctaaatatatatatatatatatatatatatatatatatatatatat

SEQ ID NO: 24374 - DNA, 741 bp, Homo sapiens
cacacgggggctgaaaggcccggctccagcactcctgtggtcatcatcctgctgaatcgctttgaactacccttggcctaaccgcgactcccatcccgcttccctcctgcctcgccactgcaggcctgtccctttgctttcttaaaactgcgcaccgtctgaggccacttcgagcctactggatccctggttccaacccagtaggatcacagaagcagggccagctgccaggcttctgcaaaagacttgagacagctcacaatgaagtactctgtattaggcagggtaatattgattgcaagtgacagaaacccaatcagaaactcactggagtcatgaggaacacttattggctcagagtaaaggcaaaatagaccttcagagaaataaagtctgggaaattgactagatcctcactgaaagaactactaaaggatgtacttatggaagaagaaaattacaaagtgaaagaactgggatgcaagaagtaatggtgagcatggaatttggcaaagattcaagtaaaacaaagcaaggactgagtatataaaatcataatcataacaaattttgactattatatgtaacagccaatctcttaactgggtcataataagaaagtgaaaggcagaaaaaatgacaaaaagaataattagaatgttaataagaagagtaacaagattttgaaaaatttgtgctggttgatatcaacttttggcacttttctctttttctatactg

SEQ ID NO: 24375 - DNA, 392 bp, Homo sapiens
atccaggctggtgttcagtggcgcaatctgggctaactgcaaactccgcctcctgggttctagcaattctcctgcctcagcctctcaagtagctgggattctaggcatgcaccaccacactcaactaatttttgtaatttttagtagagacaagatttccctatattggccaggctggtcttgaactcctggcctcaagtaatctgcctgccttggcctcccaaagtgccgaaattacaggtgtgagccaccacacttggctaagactactaatttctaatgctgcttctgtcatataccacatgtgtatgtattaaagttgttaagtttctagacttgtctttggtgttctgaagtttcactatatgtctagctatgatcttttttttttt

SEQ ID NO: 24376 - DNA, 547 bp, Homo sapiens
tgagttaatgctgaaatgagttaagaccttgggggggaactgttgggaaggcataattgcttttgaaatgtgaggacatgagatttgggatgggccaggggtagagtaatatggtttgtctgtgtccccactcaaatgtcatcttgaattctcacatgttgtgagaggggtccagtgggaggtaaccgaatatgagggtaggtctttcccatgctgtcctagtgatagtgaataagtctcacaagatctgatggttttataaggcagaatttccctgcacaagctctctttttgcctgacatcatccatgtaagatatgacttgctcctctttgctcctgccatgattgtgatgcttccccagccacatggaactgtgagttctccattagacctttttcctttgtaaattgcccagtctctagtctgtctttatcagcagtgtgaaaatggactaatacatcctcctaaacagatttccaaagagtattttattccacttccttattttgcaatggacacagtaaaaataaagcattatcataatg

SEQ ID NO: 24377 - DNA, 443 bp, Homo sapiens
atgccaagtacttttccaggatctagagcatggagcagttaactgggtatcagcttctaggaattggcattctagtgcaggaggtcgacaataaacagaccaataaacataaataatctaagttagtataggtctagtgtgttcagcaaaggaaagtgtttgctaatgactggaccagcatagtcaaggaggaggtgacgttgagtttgaaaaataaggaaacagccgtgcaaagaagatatgggggcaggttgagggaggggcacattgtatggaggaggaacaggtgccaggtctccagaagggaacaaagtggcatttcctcaggcagagagatgccaagcatgagcagggtacctgtagtcccagctacctgggaggctgaggcaggagaatcacttgaacttgggttgtagtgagccaaaattgcaccactgcactcc

SEQ ID NO: 24378 - DNA, 220 bp, Homo sapiens
cttgacatagggaaaaaacacaagttgtgcatctaaaaattctgccccagaaacattatatctgccatttatgtgaccttttgatttataataagcagatgctgaaattctaaaatttcaaaatatttttaaagaattgcttaaagattttttttgaatttaaaatgtttattttttaagcttttcaaatacaagaagaatataaagaaaaaaattaccc

SEQ ID NO: 24379 - DNA, 721 bp, Homo sapiens
gagacggagtctccaatctgtcgccaggctggagtgaagtggtgggatctcagctcactgcaacctccgcctcccgggttcaagtgattgccctgcctcagcctcccgagtagctgagactacaggtgcgtgccaccaacgcctggctaattttttgtatttagtagagacagggttttaccatgttggccaggatggtctcgatctcctgaccttgtgatctgcctcggcctcccaaagggttgggattacaggtgtgagccaccacacctggcctattcattcttaagaaatacttctgttaaagagatcaaccaggcctccttagtctacaggggtcatgaagtcctacgcagtagctggctccaggaggttactgccagcagaacccttgtcaataacaatactaaaaatgtcaataagacgatacaggcttatagagcatttaccagtctcaagcactattctaagtgctttttatatattgccacactgcaacctccaatgatcctatgagatcagcattcctataattcccatttgacagatgaggcaaccgaggctcagtgaggttaaataacttggtcaatgaccacgcaactgctaaatggcagagctgggatttcattaggaaaaggcccagagaccttcttgtgtaggtgctcaaaagtggtacctgcctggcaagacagagggctcagatggagcacgacattttctt

SEQ ID NO: 24380 - DNA, 494 bp, Homo sapiens
aggggggttccccacgcattaagcaaataagcaattttgcagcagacaccagctgggtgtcctctaattcaattcacttcttacactacctggagatagcatcagataccataggttgaaggctcagtgccacaagatggctcccacttcagatgacaatcagaagccccagatggtgaccaagggtcctaaccaactagctataagttagggttcccataaccccttcttgagctccattagtttgctagagagcctcacagaactcggaaacactatacagtcatgctgtacataatgacatttcaatgtcagcctgcatagacaatggtgatcccataagattataatactgtatttttactgtaccttttctatgtttaggtatgtttagatagacaaatagtcaatccttgaacaacttgggtttgaactgtgtgggtccacttatacatggattttttttcaataaatgtattggaaaattaaaaaaa

SEQ ID NO: 24381 - DNA, 696 bp, Homo sapiens
caaatatatgctttctacccgtaactcactgtaaataaaaagaaagggataatatattgtgcaaactctagtcaaaaaaaagttggaatgacaatattaatataaacaaaagtggacttcaaaagaagcaatattatcagagagaaagagggcactgcttggtgaattgccccctgataaagacataacaataccggaagtaaaaattgacataactgcaaggggaaattgacaaatccacaattatatttgggatttaaatgctttactcttaataattaataaaagttagctaaaaaattaattttagctaaataaattagctaaaaagttaacaaggatagatctgaacaacactaggataaacttgtcctaatggacatttatagaccactataaccaaaagtggtagaattcacaatttttgcaagtacacatggaatattcaccaaaataaaccatatcctgatttataaaataaactaacaaactggcttctctcacttagcaatatgaatttaaatttcccccatatctcttcatggctttatacctcatttccttttattgctgaataatgtttcattttatggatgggccataaaatgtttatctatgcacctatagagggacatcttggttgcttccaagttttggccaatattaataaagctgttataaacattcatttgcagg

SEQ ID NO: 24382 - DNA, 434 bp, Homo sapiens
gttcaaaaatagtggatttgtaatcattgtttaatgtgctttaaatattttttgtagctgatcacagactgtggccacaaaaaagatagaaattttattatgacgggtaatgataaaatatttgtatgaaaactatttatcttattggccaggcacggtggctcatgcctgtaatcccagcactttgggaggctgtggtgtgtggatcgcttgagcacaggagttcaagaccagacggggcaacatggtgaaaccccatctctacaaaaaatacaaaaactagctgggcatggtggtgtgcacctgtagccccagctactggggaggctgaggtgcgagattacttgagcccaggaggtcgaggctgcagtgagctaagatcgtaccactgcaatccagcttgagtgatggagtgagaccttgtctcaaaaaaa

SEQ ID NO: 24383 - DNA, 489 bp, Homo sapiens
aagtgagcagaagtcactatacttatttcagataaaatgtactttaaatcaaaagctgtgagaaaagtcaaggaagatcacatataatgacaaagggattgatttagtaaaaggatatgacaattgtaaagatacattcacccaacaccagaaaaccaaactatagaaatcaaatattattagagctaaagggagaggcagactccaatacaataattgttggggacttcaacagttcactctcagtattgatagatcgcttagacacaaaatcaacaaagaaacactggatttaatctgtgctccagaacaaatggacctaacagacacttgaagaacatttcatctgacagttacagaatactcattcttttcatcagcacatagaacattctccaggatagaccatatattaggccacaaagcaagtctcaatgaattttaaaacatcacaatcatttcaattaccttttatgaacacaatggaat

SEQ ID NO: 24384 - DNA, 445 bp, Homo sapiens
cagaatctgtttcttccccatctcttccgttgagttttctcacttcagccttgttgtttactctcactgcatctaagctttcaccctttcctgtccttgtactctacctttccttaggctcctctgctcctctctcaacctggaccccataatgtaacccctctgttaccggtggaagagataggagttaccctgagttaccggcgtcgaacccctacaggtccacagcaacttcagtccttgccgcctcagaagaaagaattcgactgaggggcatgaagcagaaaaacagactaaggcaagtttcagaacaggaatggaagttcattttaaaaggctttagaacaggaacgaaaggaacattcacttgaaagagacccaagtgggtacctgagggtccaagagagaaaagagagcaaaagaagacaggaatgaaaaaaaagaa

SEQ ID NO: 24385 - DNA, 1480 bp, Homo sapiens
ggaacagcaagtggcacatagtaggcacaccttttattcctctctcatcctgttctctactcattaagctgtccactctcttttttgaccttagcacattcctaatgctctaaccttctcagcctctttttttaaagtgtcagagccctataaaatattgttaataaataattttaacataaaaagaggtacagatttacagatgtacatgcagtataaaatgataacctcaagcatacctttctccaaagaaaaatgttacaaaactaaacacagttggctgagcttgagttgcattactgcatacttaggacgtgccagcacataacaaacgtttaaggaaagtgattacaagaagaaaagttaatattttagacaagttgattcagtttttcttgggttgtatgatgttagaagttgactactgtctcaaattggagcctgtaggccactggtgttttataggcacttgattggagaactaatgctttaaccacaccagaataattgcattctgcaaattaaatgcaatgccatatgctgccaatcccccctgcgtgtcccccggcattatcttctttctcgaccaccactgatgagcatctaattgcccttcaaggccttattcagatggcccttattgtagctgtttctgatctttttagactcatttggcccctcacttaagattccatggcatctgatacatacctctaatataacacactgttatggttacccttgttcgtctgtcttccccaccactctgcaagtgtctccatgcttgacgttttgtgcatgtctgtgttgctcacattgtacacattgcattgtattcaggagacatttaaaagcagccttttgaatttaagttaaggtacttcaattggaagtacctctatgtcctgtggagttaattcaaagtatttctatatcttgtggagttaactcacccaaggacacttaatggtgatgttataaagaggaataaactctaagacctaattcctttaacactgaagcttcaaggcagagtgcaacttttaattctgcttcttggaacaagaggagagagcagtgggtttgtttgctttttccaactcagaaataacactaggtaaggaagggatttatagaggcatgatgtggacctcgaatgaatggcttagtgaactgacccaggaagttgatgtagacttacattttgttcattaaaatcaagcagttgccagcactttgggaggccaaggtgggtgggtcacgaggtcaggagtttgagaccaacctggccaagatggtgaaaccctttctctactaaaaatacaaaaattagccaggtgcggtggcgggcacctgtaatcccagctacttgggaggctgaggcaggagaatcacttgaacccgggaggcggaagttgcagtgagctaagatcatgaccctgcactccagcctgggcgacaaagcaagactccgtcaaag

SEQ ID NO: 24386 - DNA, 96 bp, Homo sapiens
ctgtgggaaaccacaggtgcctggaactttgaagagactgtaccacttctctgagccttggctttcccatctgcccaatgaagggtgccatgcagt

SEQ ID NO: 24387 - DNA, 349 bp, Homo sapiens
cagtctacactagcaaaccttacacagcccctaactgttgaggtcagagaagggaactgattctaggtatagcatattgcaaatactagaatccaccttgacctgcccactcaggtgccctggagtatttgaagaagatgacttcaggtttgtttgaacttaaagtgctatagcaccaaatgctattacaatttaggacataagcaatttttgtatgaaacatatcattctcactcttagttctccggagtcagaaggaactaagaaaggtttacctggaggtcagcaagagcagatggatgaacgggagccagggaaagagggagttgggctaccaagccttggtaca

SEQ ID NO: 24388 - DNA, 356 bp, Homo sapiens
taggtgcttctacagcacatggcaccaacctctaataatcacaccacttgctattacatttgatttttgaaagagtagcctgcgcagtaatgggaggaaactagattgtatatgttgatgagcaactagaaacaaagaagtgcagggccctagttgtagactaatgttttgaaacatttggctgtgggctgggcatggtggctcatgcctatagtcccagcacttggggaggccaaagtagaggatcacttgaggccaagagttcaagacccctgggcaacatagcaagcccctgtgtctatttaaataaataaataaaataaaatcagaaaaccacaggctcatatccctttaca

SEQ ID NO: 24389 - DNA, 381 bp, Homo sapiens
catatgaataagattccctatattcatatattttatagtatgatgcaaaaatataaacaatattttcaattaaatttcagtgatggcttcaaaaatattgattaaaaggccaggcttcatttctcatgcctgtaataccagcactttgggaggccaaggcaggagaattacttgaacccaggagtttgagaccaacctgggcaacataatgagactttgaatctacaaaaaatattaaaaattagccaggcatggtggcgtgtgcctgtagtcccagttacttgggaagctgagataggaggatcacctgagcccagggaggttgaggctgcactgagctgtgattgtgccactgcactccagcctgagtgagagtaagac

SEQ ID NO: 24390 - DNA, 367 bp, Homo sapiens
cttttcaaaaattaagacaattcattgatctcttgtcaaatgattctaaattttatcacaaaattacccatttttatagtctcttaaatatttgacttacaagcagcatttatgtattagatttattgtattgagctttataattttcttaaaaagttattatgtagacctatacttgaagacacgttcaagtcatatgcaaattaaaaaatgataaaacttgcataccaaaaatttttttggctgcttagttagagagtctttctgcacctgagtaaaccaggattcttggatgccagtattaaaaataaactatgttaattataaaacacacaagcaacaacaaaaaaccctgacttttaaaaac

SEQ ID NO: 24391 - DNA, 407 bp, Homo sapiens
tgaagatagcagtcacttggtattatgttccaggcattctactaaattcatttgatcctcatagcaatttcatgagattagcactattatctccgttttactgaagaggaaaaagcactattatccccaggttactgatgaaaccggtgctcagagaagtgaaacaatttgcccaaagtaggaagtggcaaaccaggagttaaacctgggtctgtccaattccaaagcttgtgttcaaaatctctacactatagataaaacagatgaacaaaatatttgctctatctgaatgaacagaatcatattttcaaagaaagtattgggacccatagtctgataaaaagctctatttttaaaatttatttacatgaaatatttcataaaggtataaacatcagctagacatt

SEQ ID NO: 24392 - DNA, 360 bp, Homo sapiens
ttttttgccattgaaggtaatgcatctgcaaaaacaaaaacaaaaacaaacaaacaaacaaaaaccctattccaaataaggcaacattctgaaattctgggtagacatgaattttggtggatgtatcaccactcagcacagtatacagagcatgtgtgaaggtacacagtaagtgacaggctcatgtgaacatcctcctttctttctacaaaggtagaagagtagcagaggcccctttcccaggaggataacctgggcttatggagggctttgtacttagacacttaccaaccaagtaggagcaactggaaggaaaatgagagacagaagtggatgataactgttttccttctcagccat

SEQ ID NO: 24393 - DNA, 933 bp, Homo sapiens
cccattgatcctcttgatgataattacatacttgttcagtacatatgagcaaatattttctcctagtcttccacttccttttaaataaactttttattttggactaattttaggtttagagataagttgcaaagtggtagagagtttccagatattactcactcagtaagccctattttaacgtcttacattacaatgtacacttgtgaaaactttttataccacattggcacatagtattaactaggacttcattcagatttcaccagcttttccagtaatgttttttttgtgttccaggattcagtgtaggatactatattgcatttagctgtcatatctccttagtgtcttctggtctgtgacagtttctcagtctttctttctttcccatgaccttaacagtttttaggagtgataggtattttgtagaatgtccctcactttgtgttgaagtttttctcttgattagattgggcctatggattttttgaaagaatacaccaaaggcaaagtgacttccttatcatatatcagtgtatacatgacattcacatgacatcactggtgatgttaaccttcatcactagttaaggcagcatttgccaggtttctccactataaaattactacttttccctttccagattctatttattagaagcaaatcactaactgcagcctatactgaaggggcagggaagggcaggagggttaagctttacctcccacaaagactctctcaataaattatttggaattcttctgtaagaaagaattgtctcttcaatactgtttgtttatttgaccaataatttaagtcacttatttatattagtatgaacttatatggatttttggcacttattttgggctttctttttgtatttattgagacgtaactcacaacataaaactcaccatttcaaagca

SEQ ID NO: 24394 - DNA, 305 bp, Homo sapiens
ggtcatgagatgataccctgccatttatacttatcccaatattagtttaaaacctattcctgagaagccgaggcgggcggatcacctgaggtgaggagttcgtagaccatcctggccaacatggtgaaactccgtctctactaaaaatacaaaaattagccaggcgtggtggcaggtgcctgtaatcccagcactcgggaggctgagacaggagaatcacttgaacctgggaggtggaggttgcagtgagccgagatcgcgccattgcactgcagctggggaacaagacaagactaaatctcaaa

SEQ ID NO: 24395 - DNA, 970 bp, Homo sapiens
cctccgcacatgacgtatattttctgcgcttgcagcactccggaagtgagaagtttagcgccagtggtgatgccttggtggttacttgcttccgtcacgctggcatcctgaaggcgttaagcattaaaacaatgtgcaaaagcgccttcttggtggagtaacgggcttttgtttttgtttgagacagggtctcacgctgtcgcccatactggagtccagtggcgcattcttagctcactgcagcctggaactcctgctgcccgagctcaagcaactttcccatctcagcctctcaagtagctgggaccgcaggtgcgcaccactatgcttggcgaattatttttgtagaaatgaggtctccctgtgttgcccaggctgggaactattttctacacgcttttttagtatcggtttctacctttgcgccgccgtgtgtgaagatacttaacacaaagtgttgttttacacgtgaagagacaaccaaaaggtggatgccttcttggttttgtactatttatttatatgctagcacgtagtaactaaagaataataaaatttaaagcctgtgaaaatgttagggtcccaaaattactaagcaaaagggaaaagtcaagctgggaactgctcagggcaaaacctgcctcccattctagtcagtcatccttctgctcactgagatagatgcatattctgattgtctcctttggaaaggcttatcagaaactcgtatgtagccttttgtctctcatctacctgtgacctagaagcccttcctgcttccgagttgtccccacctttctggaaggaaccagtgtacttacatatgttgattgatgtctcctgtctccctaaaatgtataaaaccaatctgtgccccaaccaccttgggcacatgtcatctggacttcctggggctgtgtcacacgctgcgcgtccttaacgttggcaaaataaactttctaaaaaaaaa

SEQ ID NO: 24396 - DNA, 470 bp, Homo sapiens
atggacaaggcccttctgcatctgtcccctgcatcccactccatgcccctctctcactgctcattgcactctgccactcagacaagagcggacctacacagagggattcaggatagcaagataatgtctttgatcttagttacattgccatcactggactggaggtggtacctgagaccatcagatgcactttcagagctgaacaggtgacatcacaccatagctgggacttgttttagtgattaatgaaaagatcattgggcaagagccaggaaggaatacaaaaagagctggaagagataagaagtaattacaaagaaattaactttgtgaaataaaaaacttaaaaagttctttcagaaatcaggaaaaatctatggaaagataaatatatatgttttgtgtatataggaataatagttgctattaatgaggaaaatcccagaacaaacagaacagaagaaataaca

SEQ ID NO: 24397 - DNA, 358 bp, Homo sapiens
atggacaaggcccttctgcatctgtcccctgcatcccactccatgcccctctctcactgctcattgcactctgccactcagacaagagcggacctacacagagggattcaggatagcaagataatgtctttgatcttagttacattgccatcactggactggaggtggtacctgagaccatcagatgcactttcagagctgaacaggtgacatcacaccatagctgggacttgttttagtgattaatgaaaagatcattgggcaagagccaggaaggaatacaaaaagagctggaagagataagaagtaattacaaagaaattaactttgtgcgaaagtatgtagtcggggatcctct

SEQ ID NO: 24398 - DNA, 353 bp, Homo sapiens
gcaagaatctgtggtttgagacatcgaatgggcacctctgctccgtgcaaaccacttccttgctggcctcaaagcctcagttagtcctaaatgcctagggcactctatcacaggtggaggctgagttttggctgcttcttcgaattctggatttctccaccctttctttctgccagacaggaagctaacttcatgctttctctcatctttgtgtctaacaccttcacaatacagcacattgggctctttcagtggaaaataaaaatcactgtgcgagaggggctgattgctgatgattgaagcttatcgaaataaaaccagaacacatgcatgttcttattcagagaaggtag

SEQ ID NO: 24399 - DNA, 476 bp, Homo sapiens
agaatcaagaatggatccatcttgtggatgatgacatcattcagcaacaaggtacaattgctacaatagaggatcatatttccaagccaggtccaaagaggcatcagggctgtcaagcttaggtataaatgttgacagaatcttcctttggattacctaaggctctgaatttctgggaagatcttgatgccctctaaccccagcaaattgatgctagctatacattgaatctgacagtggcagctcaaacagattttaaacacatcttgtatgtatccattcatacacatttacatattaaaaacatgtcttcaagtttgagctttcttggtgtatctcaggtaccttttgacatggttctctttttattgtatgtactaatagagtgagaacctacttattacttgggggctgcaccaagccattcatgatagctcgacccccatgacccaaacacctccctttaggtcccactt

SEQ ID NO: 24400 - DNA, 454 bp, Homo sapiens
gattgaagttatagcttttagacaatatagagctaaattatgaaggggaaacatgttttcaaagaagactgggtggataagaaggaactaaagaaagtaatagtcggaataattccaatgcatggcgattaggattttagtgttcactaccatagtctcccaggggacacccacatccaacagaacttgtatgtttttatttacagttattaaataactgtatttaatatcatccatgcccccaattatttaatatcatcctagcccccaattattcagttttttaaaaaaattcaaccaagctttttaagggaaagcattaattttataaacctagatctgagcaatttataacagagccatgtgagctatttcaggaaatcaacaaatatttattgagcacctatgatgtgctaggcagagtacataagtcgaagtagttacagttctggaa

SEQ ID NO: 24401 - DNA, 326 bp, Homo sapiens
atatacctaatgctaaatgacgagttaatgggtgcagcacaccagcatggcacatgtatacatatgtaactaacctgcacattgtgcacatgtaccttaaaacttaaagtataataataataaaaagaaaaaatagttataaaacaaagcaaatatgttagttttaatgaatttatagactagtttgtctttttcctatttccttttttactgatttcttcttttgttttttattttacttttgttttttagagacagggtctcataccgtcacccaggcttgagttcagtgatgctatcaatcatggctcactgtagctttgtcc

SEQ ID NO: 24402 - DNA, 147 bp, Homo sapiens
atttaaacttagtctaaaatattaaaaaaacaatttcccagtaatacctaaaactactggtacttgtgaaaaatgtgctaccagaaccctagctaagaaagtgagctcaaaaagtcatggactaaaaattttttttagggttaaaac

SEQ ID NO: 24403 - DNA, 355 bp, Homo sapiens
tgtgatcagggagattttttgaaagcaaggggattagatctgagcaccaaagatgggagaggaatttgaaaagctgggatggagggaagcacacattctcgttgcaaagtttgtaagacaagatgctgaggaaggtaagcacacgcaggctctgaagagagcccactccaccgcccatgaggaggcagattcggcaggctgggctgtggcagagaggagtggaaagaaggtaggggccgggtgcggtggctcatgcctataatcacagcactttgggagcccaagccaggaggattgtttgaggctaggagtttgagaccagcctgtgcaacatagtgagaccctgtctctacca

SEQ ID NO: 24404 - DNA, 381 bp, Homo sapiens
tccctttcatatatacataaaacttattatttctgtccctgtggagaagtgtgactaatacatctgggttaataggctttgttttttattttattttttccttattttctttttgggttgatagttttttttttcttttggtacttaaaacatattctattgtcttctgtttttcattgtttctagtgataaatcagctatcattcttattattcttctccagtatatactttatctcttttccctggttgcttttttgttttttgtttctttttttcctggttgctttttttttggatattgagttttgctcttgttgcagtgagccaagatcacgccattgcactccagcctgggtgacagggcaagacactgtctcaa

SEQ ID NO: 24405 - DNA, 479 bp, Homo sapiens
gcagaagaacaccaccttcttgcacttcttcacctcctctggcattgaagacttatgcatcttcatgtccttgaacaccttgatgacaccatcagagacggccacccctgaggccatgtttccggaagtgaaaagaagaaggcatggagagcctcagaagacaccgctgctaggacccacctgaaccaagtcttaacatctttaagaagatttgaatcaaatcaagtatattttgtggacaaaatggcatgaaactagaaatcaacaaacaggagtaaatttggaaaattcacaactgtgtaaattaaacaatgtgctcctgaacaaccaatgcatcaaagaagaaatcaaaatggaaatacaaacatatcttgaaatgagctaaatagaaacaaaatatccccaaaattgtgggattcaacaaaagcagttctaagagggaagattatagcaataaacacgtacattaaaatggaaga

SEQ ID NO: 24406 - DNA, 483 bp, Homo sapiens
aggactctactatgtcatcttaagtgaaacagtgcatatgtatactagtaaaattctctgctttcctagcattggacaaaaacaaaaatcaacaaaagaattgcctcagtgtcttaaactgggatccctactagttgactaggcacttagttactgaaggatatgtgtggaattcaagttcttttcaacctataagaaatatcggccaggtgcagtggctcacgcctgtaatcccagcactttgggaggccgaggcaggaggatcacaaggtcaggatttcaagaccagcctggccaacatagtgaaatcctgtctctactaaaaatacaaaaaaattagctgggcgtggtggtggggacctgtaatcccagctactcgggaggctgaggcaggagaatcacttcaacccgggaggtggaggttgcagtgaaccaagatcgcaccattgcactccagcctgggcgacagtgtaagagtcagtc

SEQ ID NO: 24407 - DNA, 443 bp, Homo sapiens
gaaatattagagccccaggaggacttggtgctgtctgtttgaaagtctcccatgttttacgtttggttcaaaagatcccctgcgctccctctcacccagcaaaccagccaaaccagtttcttcaccctgcctgcttctgtgttaagcaaacagtgcactgcaaacagtgactaagcctagtgccttgttaggaagaaactggcgtttttttgcttgccactgtgcagggtgctcagggtggaccggaacggttttgttgtggcttaggaaaggggacctgctcgtggaggttgtgtagaactggagtgggaggagtggggcaaggcgcactaaggggccggggggagttcgggatgatcttgaaacttgttcagcttctgcttgggctttttaaaagttattccagggccagattagatgctgtggctcacacctgtaatccc

SEQ ID NO: 24408 - DNA, 325 bp, Homo sapiens
attcactgtgtcagcatatagtagcaaaataagaaaaaaaggtgtatttagttctgagccaaatcttaatccagttaaaatgtactgaatgttaacttacaatttttaaattagcaatataagaataattcataaaacttatctttgcattaaattttctttaaatttatgttcaaaggaatatcaaaggcaactttttaaaaatagacttcatgggattgtcaatgtcttaaacagcctttttacttgaccactaaagcacagtaattgatctttggttttaacaactgaaaccctttaaagcaaatgccaacagctttttgat

SEQ ID NO: 24409 - DNA, 916 bp, Homo sapiens
gctttttaggtctccacttaataaccattgtgttccttgtataattcctcttacgacacttaggattgttgacacttttttcttttactagactcttctgtgagagctgggattcatttttggcttactttctataatctctccaatgccttgaacagtatgtggcacaaaacaagttcttagagaaatattttggtgaattcccaagtaattgatagatttgaactcagatctgatgcttggaaacaaccataatgtcctcctaaattctcaacaccttacacacaaatttggggacccacctacttgattgagtctgtttttgatgattacaggggtaacttaccattgccagtgtaatgatactttgttcctccctctaagaccaacctttttttttaaggtggtggttgtgttgatgggcttttcccatactttcttttttagttctgttatttatactttaggctataaagagcagtttggattccttttttcagactttcaaccttgatgattattgctacttagatattagttccttagcatgctttcacattggtgccattcttatttagcaagtggaaaaagtataagaatactgaacaatgcgaattcacatacataattgcttatgaatctacttgtatggtttattggaaaaagtaaaacaactgggctgggcgcactgcctcacgcctgtaatcccagtactttgggaggtctgggtgaacagatcacctgaggttgggaatttgagaccagcctggccaacgttgtgaaaccctgtctcattagccaggtgtggtggcacatccctgtaacctagctacttgggaggctgaggcacaagaatcacctgaacccaggaggtggaggttgcagtgaactgagattatgttactgcactccatcc

SEQ ID NO: 24410 - DNA, 489 bp, Homo sapiens
cttttggcccccattctttcacccattgccctttccagagagttttctaaaatgtgtgtatggaaataagagagacacataagtgttgtaaattgccaacccttgcatgtaaaaattatttcttaaattttggaatgtctgcttaattatagtagggatatggggagaaaaaaataataaatgcacaaataggaagaagaaactttgctcaatttacagttttgtcacaagctatgtgctatacataggaaaccttaaaatgtcagtgaaagggaattgtaagatgtgcatattttctttctttttttctttttttttttggcaaagtctcactccgtcctccaggctgaagtgcggtggcacaatctcggctcactgcagcctccacctcccaggagaatccttgaacccggttcaagcggttgcagtgagccaagacggtgccattacattccagccttggtgatgagagggaaaatccatctcaag

SEQ ID NO: 24411 - DNA, 604 bp, Homo sapiens
tagtagagatggggtttcaccatgttagccaggatggtctcgatctcctgacctcgtgatccgcctgtctcggcctcccaaagtgctgggattacaggcgtgagccgccgctcccagcctaatttttgtatttttaatagggacagggtttcaccatcttggctaggctggtcttgaactcctgaccttgtgatctgcccgcctcagcctcccaaagtgctgggattacaggcgtgagccaccgcgcccagccggtttgttcctcttttactttgtctagtgtattcttagccttcaaggcccatgccaactgttgctccattaattcattttaacatatttatgagcgcttcactgtcccttctcctaggtgctggaaatacagcaaggaattagaccagttccctgctctctggtatggggcgaccatactgccaccacacctagctaatttttgtatttttagtagagatgggtttcactgcatttgtcaggctggtctcgaacttctgacctcagatgatccacctgccttggcctcccaaagtgctgggattacaggcataagccaccgtgcccaggccactattcatttttaacacga

SEQ ID NO: 24412 - DNA, 426 bp, Homo sapiens
atgcccatcgccgtgtcactgggtctgcttccagccagcccggggagggaaaggagggcaacagcatgaccccccttcagggtgcatgttggaaaccgcacagatcatttgcagccagatcctgttgactagaacttggttccatgaccaacacttagtgcaaagtatgctgggaaatccagcctttcttctgggcagccgtgtgcccaggtaaaatgcagaggttatatgacttaagaaagaaggggacaaagaaaggaaattgggggataacgaagtcttatgtccttaccttacactttcaggagaattatggaaaggggaagaaagctggaaagctgggtccagtctcgcccatctgcaccagaggtctccagcgtgactgcagtgggcgccctggctaaaaccaagctctgtttgtgtctg

SEQ ID NO: 24413 - DNA, 783 bp, Homo sapiens
gagggaacaaaccttcaaagcatagcagcactgtttcttggaagcctcttggaaaacatcttatctctttcctaagtagcacaaagcaagattcaaacagggtattttccttactccatggtatacaggccttttcagaaatgttgtatataggcactgtttctgtagatcatatatgctaattaactaatttcagtttgtaaaagttaagtaactatattttttagttaatttctagtatctgtttgagccaagccatccaggcactccactaagttaggggtggccaagtagtgcttgttgaatggagaagccgccttccatatccaagcaaaaggttaatgaacccccagccgcaagagtcagagaatcgggacacctcccatttccaaagtctgcctggcaacacaaagagccagcaagaataagatatagctggtttataatcttaaatgaaatgaatggctcttcaaacagatgactcaatgtggtcagatttattatgaagtattgtgaattttccaactgtcctccccgaccaagcacacaggaagaggcaggctcaatgacaacctctcagggctcatttagaatgtcattaagcgtgcttgcacctgtcacctttatatcagcatcatctcaatcaaaggtaaaatgatacttctatggcccatgaaggaatgagcttttcctatgatgcaggatgactttttgcttcattcaatggaagagttttgtggggcaattgtaggaagcagaatggagaccctgccttgaagatgt

SEQ ID NO: 24414 - DNA, 274 bp, Homo sapiens
caccatatttgtggtcatttgttatggcagccataggaaactaacacaaagatccagagagcaggaccagaaccaaaacagaaaaagtgaaagataaactttcctattattgaatctgctcaagagtgtgagagactgagttatgaaatagttggcttcagtaattggagttgggtttcagtggttcaatggtcaaaagggagagaggctggtgacagggcgagatcttatctcttaaaaaaagggaggaagagagtttattgggtagaactgg

SEQ ID NO: 24415 - DNA, 257 bp, Homo sapiens
gataaaattaaaacacatacacactgtgaaagttcagataataaaaaaattcagataatacattaataataaagaaaatgaaatcacctgtaattcaatttgatctatattcttacagtttttttatatgtagaagtggttttttaatggaatcatgaaatcattttcttactacagcaattcatacgcatacacaactttttgttaacacgtacctaataatccattgttggatgtaccaaattcatttaactatt

SEQ ID NO: 24416 - DNA, 542 bp, Homo sapiens
actatatcagtacgtgttaggagggaacaaaattagatgtgttgtacccaatctgccttcttttcttctttactgtatgctttgaaggctgcaaaatttcctctaaatattccctttacctaaatcttttctaaaaagtttctagtcttttaaaaaatgtttagcttaattacattgtcaaagaatatggtcttgtgtgataccaattgcttgaaatgtgttgaggctactttacagactagtatgagatcatttcttaagtaaatatatgcttttccatgtgttttcttcagttttggggtggagtagtctacatgtctattcattaacataaaactaattttgcttttcaaatatttcatatctatagtgacctttttgtcagcttttctattagttactgagaaggtaggttaaaaactctgaggccagggtggtgggacgcctataatcccagcattttgggaggccaaggcaggagcgttgcttgagcccagaagtttgagaccagcttgggcaacagagtaagatcccatctgtac

SEQ ID NO: 24417 - DNA, 142 bp, Homo sapiens
tcatcttcctcctgaaatctacttctcctgactgttctgtcttgggattggctccagcctctcaagcccaaaacattggagttacccacactctcactcaatcaccagccagccttagtgagcccaccctactcatttcctc

SEQ ID NO: 24418 - DNA, 499 bp, Homo sapiens
agaaagattaaatatacaaaggaatctacattatctaaaccaagcttacccaacccacagcccataggccatttgcaatccaacacagctttgatgcagcccaacacaaacttgtaaactcttttaagacgttatgagatttttttgtgattttttttttcatcagcttttgttagtgttagtatattttaagtgtggcccaagacaattcttccaatgtagcccagggaaaacaaaagattggacatccctgcaaaccttttattttatttttttaactttctgaattcttcttgcacaaacattttgatgtcagctctactagactttctacctgcatttcataacctgaattctaatctaaatctaaaattctaacgatataaaattttataaataggtgttcataagagtccccagttcttcatccttgcatttcattaaaacacttattttgcaaatcagggtgggggtgatggggatagaatggaaagaagaa

SEQ ID NO: 24419 - DNA, 512 bp, Homo sapiens
tatggcaaactgttcaacttggtaaagctttgaactattccataacagtcattttctggaataagatactattgtaaatatacaactaagatgtgaatgtttgaataataattttatttcaatttcacatgaaaatttagatgtctcatatactcacccattttaggggcaggaagtcaatgaagctgcttgcgacatcgcccgacaagtggctgatgaaggagatgctttggtagcaggaggagtgagtcagacaccttcataccttagctgcaagagtgaaactgaagtcaaaaaagtatttctgcaacagttagaggtctttatgaagaagaacgtggacttcttgattgcagaggtaaagaaagatgtggtgaaagataagacaaatacacctagtacattttctctaccttttgctttcaagagtactgtgtggggttaggtgacaatcataactagcaatagtaatatttagtttttgaaatcgttttccaattcagggctactac

SEQ ID NO: 24420 - DNA, 2510 bp, Homo sapiens
gtataaagaggcaggctgcggactcggggagctcggggctgcgcagcgggaaggctcgcctagtcggtccgcatccgtgtcgaccacctgtctggacaccacgaagatgccacccgttgggggcaaaaaggccaagaagggcatcctagaacgtttaaatgctggagagattgtgattggagatggagggtttgtctttgcactggagaagaggggctacgtaaaggcaggaccctggactcctgaagctgctgtggagcacccagaagcagttcgccagcttcatcgagagttcctcagagctggctcaaacgtcatgcagaccttcaccttctatgcgagtgaagacaagctggagaacaggggcaactatgtcttagagaagatatctgggcaggaagtcaatgaagctgcttgcgacatcgcccgacaagtggctgatgaaggagatgctttggtagcaggaggagtgagtcagacaccttcataccttagctgcaagagtgaaactgaagtcaaaaaagtatttctgcaacagttagaggtctttatgaagaagaacgtggacttcttgattgcagagtattttgaacacgttgaagaagctgtgtgggcagttgaaaccttgatagcatccggtaaacctgtggcagcaaccatgtgcattgggcccagaaggagatttgcatggcgtgccccccggcgagtgtgcagtgcgcctggtgaaagcaggagcatccatcattggtgtgaactgccactttgaccccaccattagtttaaaaacagtgaagctcatgaaggagggcttggaggctgcccgactgaaagctcacctgatgagccagcccttggcttaccacactcctgactgcaacaagcagggattcatcgatctcccagaattcccatttggactggaacccagagttgccaccagatgggatattcaaaaatacgccagagaggcctacaacctgggggtcaggtacattggcgggtgctgtggatttgagccctaccacatcagggcaattgcagaggagctggccccagaaaggggctttttgccaccagcttcagaaaaacatggcagctggggaagtggtttggacatgcacaccaaaccctgggttagagcaagggccaggaaggaatactgggagaatcttcggatagcctcaggccggccatacaacccttcaatgtcaaagccagatggctggggagtgaccaaaggaacagccgagctgatgcagcagaaagaagccacaactgagcagcagctgaaagagctctttgaaaaacaaaaattcaaatcacagtagcctcgatagaagctatttttgatgaatttctaggtgtttgggtcacagttcctacaaatacggaaaagggggttaaaaagcagtgctttcatgaatgccatcctacacatattattgctattacctgaacaaaatagaattacaaatagcacttgataattttaaagtatgttttagaaattttcttaggagcaaaataagtacaaagtaaatcttgaacaggttcactaagcacccaccctgtgaaaagtattatggaaatcactgcagcacaggaaaagtaattcagatgttaatgccacttgaagaagttggtaggctagcaaagaggatgagacatgaactgtcataaaggactcagcaaccagccagggacagataaagcgctatggaaaggggcttccaagttcttttgaacatgacccttagtaacaaacacaatttatataatgacccagcaaaacacatcacatcttactgtcgaaattaaatgtgtgatccatcctagtattttctgttccattccttttcattctatttcatttataaaacatgctagttgagacttttcaaatggatttttatgacccactactgggtttggatccacagtttgaaaaatattgctacaagacacttaaggagaccatcctgtttaagtttattcttataagtaggtcagtcatatgagacctgatcaataaatatccaatacccagagtcctgctctcagagttcttctgtttcgtgacccacttttctaccagtaaaagacatagaccaatggggaggaggggaggagagatggatatttcagccctctccatcctagtcaacactggatccacctagtgcctctgggccataaggctgagcagagtgagcttgtattagttggtagcttttaaaaaatataataagaaaaaagtagagattctccaaactctagcctggtttcctagattgagaactatgatatttttctctgataatttaatatctactctcctacaaaagctcaagcctgaagatacaagactattagaagaaacatgactaccctcagtgtattagaaaagaggtcatgcagctttctaaacattattgaattgtttgagctgttttgaaattgtaattcttttcagctattaaaaagaagagcaatgagactataaaattgta

SEQ ID NO: 24421 - DNA, 1565 bp, Homo sapiens
cccctctgcgagaaacacccaagaatgatcaataaaaaaaaaataaataaattaaaaaaaaaaaaaaaaaaaaaaaggaatcatggtgaagccaaacaaccacagactgcccacacaggtggctgagattgacacctttgctttttaatgtctgataggcaactttgtgtgctgcatgaaattatttaaaatattatataatttttaaatggttccatgatataaagaccaaagctaggggaggagtctgttgtctggtgtcatgtgttttgttcacacagggccaggaaggaatactgggagaatcttcggatagcctcaggccggccatacaacccttcaatgtcaaagccagatggctggggagtgaccaaaggaacagccgagctgatgcagcagaaagaagccacaactgagcagcagctgaaagagctctttgaaaaacagtttgggtcacagttcctacaaatacggaaaagggggttaaaaagcagtgctttcatgaatgccatcctacacatattattgctattacctgaacaaaatagaattacaaatagcacttgataattttaaagtatgttttagaaattttcttaggagcaaaataagtacaaagtaaatcttgaacaggttcactaagcacccaccctgtgaaaagtattatggaaatcactgcagcacaggaaaagtaattcagatgttaatgccacttgaagaagttggtaggctagcaaagaggatgagacatgaactgtcataaaggactcagcaaccagccagggacagataaagcgctatggaaaggggcttccaagttcttttgaacatgacccttagtaacaaacacaatttatataatgacccagcaaaacacatcacatcttactgtcgaaattaaatgtgtgatccatcctagtattttctgttccattccttttcattctatttcatttataaaacatgctagttgagacttttcaaatggatttttatgacccactactgggtttggatccacagtttgaaaaatattgctacaagacacttaaggagaccatcctgtttaagtttattcttataagtaggtcagtcatatgagacctgatcaataaatatccaatacccagagtcctgctctcagagttcttctgtttcgtgacccacttttctaccagtaaaagacatagaccaatggggaggaggggaggagagatggatatttcagccctctccatcctagtcaacactggatccacctagtgcctctgggccataaggctgagcagagtgagcttgtattagttggtagcttttaaaaaatataataagaaaaaagtagagattctccaaactctagcctggtttcctagattgagaactatgatatttttctctgataatttaatatctactctcctacaaaagctcaagcctgaagatacaagactattagaagaaacatgactaccctcagtgtattagaaaagaggtcatgcagctttctaaacattattgaattgtttgagctgttttgaaattgtaattcttttcagctattaaaa

SEQ ID NO: 24422 - DNA, 557 bp, Homo sapiens
tatggcaaactgttcaacttggtaaagctttgaactattccataacagtcattttctggaataagatactattgtaaatatacaactaagatgtgaatgtttgaataataattttatttcaatttcacatgaaaatttagatgtctcatatactcacccattttaggggcaggaagtcaatgaagctgcttgcgacatcgcccgacaagtggctgatgaaggagatgctttggtagcaggaggagtgagtcagacaccttcataccttagtattttgaacacgttgaagaagctgtgtgggcagttgaaaccttgatagcatccggtaaacctgtggcagcaaccatgtgcattgggcccagaaggagatttgcatggcgtgccccccggcgagtgtgcagtgcgcctggtgaaagcagctggaattcgaaacgtctcagttcctccgccttagttcctcttttcccgggttcggaggccacctgtgcagcagggcacacctgccactctcatcgccctcggagccggcaaccagccgacagccggctccagccccg

SEQ ID NO: 24423 - DNA, 401 bp, Homo sapiens
gtataaagaggcaggctgcggactcggggagctcggggctgcgcagcgggaaggctcgcctagtcggtccgcatccgtgtcgaccacctgtctggacaccacgaagatgccacccgttgggggcaaaaaggccaagaaggagatggagggtttgtctttgcactggagaagaggggctacgtaaaggcaggaccctggactcctgaagctgctgtggagcacccagaagcagttcgccagcttcatcgagagttcctcagagctggctcaaacgtcatgcagaccttcaccttctatgcgagtgaagacaagctggagaacaggggcaactatgtcttagagaagatatctgggcaggaagtcaatggctgcttgtgacattggcccccgccacccccccc

SEQ ID NO: 24424 - DNA, 2660 bp, Homo sapiens
gaagtggtttggacatgcacaccaaaccctgggttagagcaagggccaggaaggaatactgggagaatcttcggatagcctcaggccggccatacaacccttcaatgtcaaagccagatggctggggagtgaccaaaggaacagccgagctgatgcagcagaaagaagctcatgaaggagggcttggaggctgcccaactgaaagctcacctgatgagccagcccttggcttaccacactcctgactgcaacaagcagggattcatcgatctcccagaattcccatttggactggaacccagagttgccaccagatgggatattcaaaaatacgccagagaggcctacaacctgggggtcaggtacattggcggggtgctgtggatttgagccctaccacatcagggcaattgcagaagcagttcgccagcttcatcgagagttcctcagagctggctcaaacgtcatgcagaccttcaccttctatgcgagtgaagacaagctggagaacaggggcaactatgtcttagagaagatatctgggcaggaagtcaatgaagctgcttgcgacatcgcccgacaagtggctgatgaaggagatgctttggtagcaggaggagtgagtcagacaccttcataccttagctgcaagagtgaaactgaagtcaaaaaagtatttctgcaacagttagaggtctttatgaagaagaacgtggacttcttgattgcagagtattttgaacacgttgaagaagctgtgtgggcagttgaaaccttgatagcatccggtaaacctgtggcagcaaccatgtgcattgggcccagaaggagatttgcatggcgtgccccccggcgagtgtgcagtgcgcctggtgaaagcaggagcatccatcattggtgtgaactgccactttgaccccaccattagtttaaaaacagtgaagctcatgaaggagggcttggaggctgcccgactgaaagctcacctgatgagccagcccttggcttaccacactcctgactgcaacaagcagggattcatcgatctcccagaattcccatttggactggaacccagagttgccaccagatgggatattcaaaaatacgccagagaggcctacaacctgggggtcaggtacattggcgggtgctgtggatttgagccctaccacatcagggcaattgcagaggagctggccccagaaaggggctttttgccaccagcttcagaaaaacatggcagctggggaagtggtttggacatgcacaccaaaccctgggttagagcaagggccaggaaggaatactgggagaatcttcggatagcctcaggccggccatacaacccttcaatgtcaaagccagatggctggggagtgaccaaaggaacagccgagctgatgcagcagaaagaagccacaactgagcagcagctgaaagagctctttgaaaaacaaaaattcaaatcacagtagcctcgatagaagctatttttgatgaatttctaggtgtttgggtcacagttcctacaaatacggaaaagggggttaaaaagcagtgctttcatgaatgccatcctacacatattattgctattacctgaacaaaatagaattacaaatagcacttgataattttaaagtatgttttagaaattttcttaggagcaaaataagtacaaagtaaatcttgaacaggttcactaagcacccaccctgtgaaaagtattatggaaatcactgcagcacaggaaaagtaattcagatgttaatgccacttgaagaagttggtaggctagcaaagaggatgagacatgaactgtcataaaggactcagcaaccagccagggacagataaagcgctatggaaaggggcttccaagttcttttgaacatgacccttagtaacaaacacaatttatataatgacccagcaaaacacatcacatcttactgtcgaaattaaatgtgtgatccatcctagtattttctgttccattccttttcattctatttcatttataaaacatgctagttgagacttttcaaatggatttttatgacccactactgggtttggatccacagtttgaaaaatattgctacaagacacttaaggagaccatcctgtttaagtttattcttataagtaggtcagtcatatgagacctgatcaataaatatccaatacccagagtcctgctctcagagttcttctgtttcgtgacccacttttctaccagtaaaagacatagaccaatggggaggaggggaggagagatggatatttcagccctctccatcctagtcaacactggatccacctagtgcctctgggccataaggctgagcagagtgagcttgtattagttggtagcttttaaaaaatataataagaaaaaagtagagattctccaaactctagcctggtttcctagattgagaactatgatatttttctctgataatttaatatctactctcctacaaaagctcaagcctgaagatacaagactattagaagaaacatgactaccctcagtgtattagaaaagaggtcatgcagctttctaaacattattgaattgtttgagctgttttgaaattgtaattcttttcagctattaaaaagaagagcaatgagactataaaattgta

SEQ ID NO: 24425 - DNA, 2446 bp, Homo sapiens
gtataaagaggcaggctgcggactcggggagctcggggctgcgcagcgggaaggctcgcctagtcggtccgcatccgtgtcgaccacctgtctggacaccacgaagatgccacccgttgggggcaaaaaggccaagaagggcatcctagaacgtttaaatgctggagagattgtgattggagatggagggtttgtctttgcactggagaagaggggctacgtaaaggcaggaccctggactcctgaagctgctgtggagcacccagaagcagttcgccagcttcatcgagagttcctcagagctggctcaaacgtcatgcagaccttcaccttctatgcgagtgaagacaagctggagaacaggggcaactatgtcttagagaagatatctgggcaggaagtcaatgaagctgcttgcgacatcgcccgacaagtggctgatgaaggagatgctttggtagcaggaggagtgagtcagacaccttcataccttagctgcaagagtgaaactgaagtcaatattttgaacacgttgaagaagctgtgtgggcagttgaaaccttgatagcatccggtaaacctgtggcagcaaccatgtgcattgggcccagaaggagatttgcatggcgtgccccccggcgagtgtgcagtgcgcctggtgaaagcaggagcatccatcattggtgtgaactgccactttgaccccaccattagtttaaaaacagtgaagctcatgaaggagggcttggaggctgcccgactgaaagctcacctgatgagccagcccttggcttaccacactcctgactgcaacaagcagggattcatcgatctcccagaattcccatttggactggaacccagagttgccaccagatgggatattcaaaaatacgccagagaggcctacaacctgggggtcaggtacattggcgggtgctgtggatttgagccctaccacatcagggcaattgcagaggagctggccccagaaaggggctttttgccaccagcttcagaaaaacatggcagctggggaagtggtttggacatgcacaccaaaccctgggttagagcaagggccaggaaggaatactgggagaatcttcggatagcctcaggccggccatacaacccttcaatgtcaaagccagatggctggggagtgaccaaaggaacagccgagctgatgcagcagaaagaagccacaactgagcagcagctgaaagagctctttgaaaaacaaaaattcaaatcacagtagcctcgatagaagctatttttgatgaatttctaggtgtttgggtcacagttcctacaaatacggaaaagggggttaaaaagcagtgctttcatgaatgccatcctacacatattattgctattacctgaacaaaatagaattacaaatagcacttgataattttaaagtatgttttagaaattttcttaggagcaaaataagtacaaagtaaatcttgaacaggttcactaagcacccaccctgtgaaaagtattatggaaatcactgcagcacaggaaaagtaattcagatgttaatgccacttgaagaagttggtaggctagcaaagaggatgagacatgaactgtcataaaggactcagcaaccagccagggacagataaagcgctatggaaaggggcttccaagttcttttgaacatgacccttagtaacaaacacaatttatataatgacccagcaaaacacatcacatcttactgtcgaaattaaatgtgtgatccatcctagtattttctgttccattccttttcattctatttcatttataaaacatgctagttgagacttttcaaatggatttttatgacccactactgggtttggatccacagtttgaaaaatattgctacaagacacttaaggagaccatcctgtttaagtttattcttataagtaggtcagtcatatgagacctgatcaataaatatccaatacccagagtcctgctctcagagttcttctgtttcgtgacccacttttctaccagtaaaagacatagaccaatggggaggaggggaggagagatggatatttcagccctctccatcctagtcaacactggatccacctagtgcctctgggccataaggctgagcagagtgagcttgtattagttggtagcttttaaaaaatataataagaaaaaagtagagattctccaaactctagcctggtttcctagattgagaactatgatatttttctctgataatttaatatctactctcctacaaaagctcaagcctgaagatacaagactattagaagaaacatgactaccctcagtgtattagaaaagaggtcatgcagctttctaaacattattgaattgtttgagctgttttgaaattgtaattcttttcagctattaaaaagaagagcaatgagactataaaattgta

SEQ ID NO: 24426 - DNA, 2142 bp, Homo sapiens
gtataaagaggcaggctgcggactcggggagctcggggctgcgcagcgggaaggctcgcctagtcggtccgcatccgtgtcgaccacctgtctggacaccacgaagatgccacccgttgggggcaaaaaggccaagaagggcatcctagaacgtttaaatgctggagagattgtgattggagatggagggtttgtctttgcactggagaagaggggctacgtaaaggcaggaccctggactcctgaagctgctgtggagcacccagaagcagttcgccagcttcatcgagagttcctcagagctggctcaaacgtcatgcagaccttcaccttctatgcgagtgaagacaagctggagaacagggagcatccatcattggtgtgaactgccactttgaccccaccattagtttaaaaacagtgaagctcatgaaggagggcttggaggctgcccgactgaaagctcacctgatgagccagcccttggcttaccacactcctgactgcaacaagcagggattcatcgatctcccagaattcccatttggactggaacccagagttgccaccagatgggatattcaaaaatacgccagagaggcctacaacctgggggtcaggtacattggcgggtgctgtggatttgagccctaccacatcagggcaattgcagaggagctggccccagaaaggggctttttgccaccagcttcagaaaaacatggcagctggggaagtggtttggacatgcacaccaaaccctgggttagagcaagggccaggaaggaatactgggagaatcttcggatagcctcaggccggccatacaacccttcaatgtcaaagccagatggctggggagtgaccaaaggaacagccgagctgatgcagcagaaagaagccacaactgagcagcagctgaaagagctctttgaaaaacaaaaattcaaatcacagtagcctcgatagaagctatttttgatgaatttctaggtgtttgggtcacagttcctacaaatacggaaaagggggttaaaaagcagtgctttcatgaatgccatcctacacatattattgctattacctgaacaaaatagaattacaaatagcacttgataattttaaagtatgttttagaaattttcttaggagcaaaataagtacaaagtaaatcttgaacaggttcactaagcacccaccctgtgaaaagtattatggaaatcactgcagcacaggaaaagtaattcagatgttaatgccacttgaagaagttggtaggctagcaaagaggatgagacatgaactgtcataaaggactcagcaaccagccagggacagataaagcgctatggaaaggggcttccaagttcttttgaacatgacccttagtaacaaacacaatttatataatgacccagcaaaacacatcacatcttactgtcgaaattaaatgtgtgatccatcctagtattttctgttccattccttttcattctatttcatttataaaacatgctagttgagacttttcaaatggatttttatgacccactactgggtttggatccacagtttgaaaaatattgctacaagacacttaaggagaccatcctgtttaagtttattcttataagtaggtcagtcatatgagacctgatcaataaatatccaatacccagagtcctgctctcagagttcttctgtttcgtgacccacttttctaccagtaaaagacatagaccaatggggaggaggggaggagagatggatatttcagccctctccatcctagtcaacactggatccacctagtgcctctgggccataaggctgagcagagtgagcttgtattagttggtagcttttaaaaaatataataagaaaaaagtagagattctccaaactctagcctggtttcctagattgagaactatgatatttttctctgataatttaatatctactctcctacaaaagctcaagcctgaagatacaagactattagaagaaacatgactaccctcagtgtattagaaaagaggtcatgcagctttctaaacattattgaattgtttgagctgttttgaaattgtaattcttttcagctattaaaaagaagagcaatgagactataaaattgta

SEQ ID NO: 24427 - DNA, 1092 bp, Homo sapiens
gtataaagaggcaggctgcggactcggggagctcggggctgcgcagcgggaaggctcgcctagtcggtccgcatccgtgtcgaccacctgtctggacaccacgaagatgccacccgttgggggcaaaaaggccaagaagggcatcctagaacgtttaaatgctggagagattgtgattggagatggagggtttgtctttgcactggagaagaggggctacgtaaaggcaggaccctggactcctgaagctgctgtggagcacccagaagcagttcgccagcttcatcgagagttcctcagagctggctcaaacgtcatgcagaccttcaccttctatgcgagtgaagacaagctggagaacaggggcaactatgtcttagagaagatatctgggcaggaagtcaatgaagctgcttgcgacatcgcccgacaagtggctgatgaaggagatgctttggtagcaggaggagtgagtcagacaccttcataccttagctgcaagagtgaaactgaagtcaaaaaagtatttctgcaacagttagaggtctttatgaagaagaacgtggacttcttgattgcagagtattttgaacacgttgaagaagctgtgtgggcagttgaaaccttgatagcatccggtaaacctgtggcagcaaccatgtgcattgggcccagaaggagatttgcatggcgtgccccccggcgagtgtgcagtgcgcctggtgaaagcaggagcatccatcattggtgtgaactgccactttgaccccaccattagtttaaaaacaagtgagcttgtattagttggtagcttttaaaaaatataataagaaaaaagtagagattctccaaactctagcctggtttcctagattgagaactatgatatttttctctgataatttaatatctactctcctacaaaagctcaagcctgaagatacaagactattagaagaaacatgactaccctcagtgtattagaaaagaggtcatgcagctttctaaacattattgaattgtttgagctgttttgaaattgtaattcttttcagctattaaaaagaagagcaatgagactataaaattgta

SEQ ID NO: 24428 - DNA, 1511 bp, Homo sapiens
cccctctgcgagaaacacccaagaatgatcaataaaaaaaaaataaataaattaaaaaaaaaaaaaaaaaaaaaaaggaatcatggtgaagccaaacaaccacagactgcccacacaggtggctgagattgacacctttgctttttaatgtctgataggcaactttgtgtgctgcatgaaattatttaagagtctgttgtctggtgtcatgtgttttgttcacacagggccaggaaggaatactgggagaatcttcggatagcctcaggccggccatacaacccttcaatgtcaaagccagatggctggggagtgaccaaaggaacagccgagctgatgcagcagaaagaagccacaactgagcagcagctgaaagagctctttgaaaaacagtttgggtcacagttcctacaaatacggaaaagggggttaaaaagcagtgctttcatgaatgccatcctacacatattattgctattacctgaacaaaatagaattacaaatagcacttgataattttaaagtatgttttagaaattttcttaggagcaaaataagtacaaagtaaatcttgaacaggttcactaagcacccaccctgtgaaaagtattatggaaatcactgcagcacaggaaaagtaattcagatgttaatgccacttgaagaagttggtaggctagcaaagaggatgagacatgaactgtcataaaggactcagcaaccagccagggacagataaagcgctatggaaaggggcttccaagttcttttgaacatgacccttagtaacaaacacaatttatataatgacccagcaaaacacatcacatcttactgtcgaaattaaatgtgtgatccatcctagtattttctgttccattccttttcattctatttcatttataaaacatgctagttgagacttttcaaatggatttttatgacccactactgggtttggatccacagtttgaaaaatattgctacaagacacttaaggagaccatcctgtttaagtttattcttataagtaggtcagtcatatgagacctgatcaataaatatccaatacccagagtcctgctctcagagttcttctgtttcgtgacccacttttctaccagtaaaagacatagaccaatggggaggaggggaggagagatggatatttcagccctctccatcctagtcaacactggatccacctagtgcctctgggccataaggctgagcagagtgagcttgtattagttggtagcttttaaaaaatataataagaaaaaagtagagattctccaaactctagcctggtttcctagattgagaactatgatatttttctctgataatttaatatctactctcctacaaaagctcaagcctgaagatacaagactattagaagaaacatgactaccctcagtgtattagaaaagaggtcatgcagctttctaaacattattgaattgtttgagctgttttgaaattgtaattcttttcagctattaaaa

SEQ ID NO: 24429 - DNA, 715 bp, Homo sapiens
ggaaggaatactgggagaatcttcggatagcctcaggccggccatacaacccttcaatgtcaaagccagatggctggggagtgaccaaaggaacagccgagctgatgcagcagaaagaagccacaactgagcagcagctgaaagagctctttgaaaaacaaaaattcaaatcacagtagcctcgatagaagctatttttgatgaatttctaggtgtttgggtcacagttcctacaaatacggaaaagggggttaaaaagcagtgctttcatgaatgccatcctacacatattattgctattacctgaacaaaatagaattacaaatagcacttgataattttaaagtatgttttagaaattttcttaggagcaaaataagtacaaagtaaatcttgaacaggttcactaagcacccaccctgtgaaaagtattatggaaatcactgcagcacaggaaaagtaattcagatgttaatgccacttgaagaagttggtaggctagcaaagaggatgagacatgaactgtcataaaggactcagcaaccagccagggacagataaagcgctatggaaaggggcttccaagttcttttgaacatgacccttagtaacaaacacaatttatataatgacccagcaaaacacatcacatcttactgtcgaaattaaatgtgtgatccatcctagtattttctgttccattccttttcattct

SEQ ID NO: 24430 - DNA, 494 bp, Homo sapiens
agaatgtataatgcctaatggcataatgccacttattacaggactggaacccagagttgccaccagatgggatattcaaaaatacgccagagaggcctacaacctgggggtcaggtacattggcgggtgctgtggatttgagccctaccacatcagggcaattgcagaggagctggccccagaaaggggctttttgccaccagcttcagaaaaacatggcagctggggaagtggtttggacatgcacaccaaaccctgggttagagcaaggtaagcatctttttactaacccaaactaatttagattatgaatatgttcaagtgaggccatttagaagactgcagcaaatttgttgtgtgatgatgaagaatcagtcatccccaaattctctcccagagatgtttacaaagcatccttattaggtgatttctggagattgttttaagaatatagaacgtatttgacctgattttggattttgaaaaaaaaaaaa

SEQ ID NO: 24431 - DNA, 2470 bp, Homo sapiens
gtataaagaggcaggctgcggactcggggagctcggggctgcgcagcgggaaggctcgcctagtcggtccgcatccgtgtcgaccacctgtctggacaccacgaagatgccacccgttgggggcaaaaaggccaagaaggagatggagggtttgtctttgcactggagaagaggggctacgtaaaggcaggaccctggactcctgaagctgctgtggagcacccagaagcagttcgccagcttcatcgagagttcctcagagctggctcaaacgtcatgcagaccttcaccttctatgcgagtgaagacaagctggagaacaggggcaactatgtcttagagaagatatctgggcaggaagtcaatgaagctgcttgcgacatcgcccgacaagtggctgatgaaggagatgctttggtagcaggaggagtgagtcagacaccttcataccttagctgcaagagtgaaactgaagtcaaaaaagtatttctgcaacagttagaggtctttatgaagaagaacgtggacttcttgattgcagagtattttgaacacgttgaagaagctgtgtgggcagttgaaaccttgatagcatccggtaaacctgtggcagcaaccatgtgcattgggcccagaaggagatttgcatggcgtgccccccggcgagtgtgcagtgcgcctggtgaaagcaggagcatccatcattggtgtgaactgccactttgaccccaccattagtttaaaaacagtgaagctcatgaaggagggcttggaggctgcccgactgaaagctcacctgatgagccagcccttggcttaccacactcctgactgcaacaagcagggattcatcgatctcccagaattcccatttggactggaacccagagttgccaccagatgggatattcaaaaatacgccagagaggcctacaacctgggggtcaggtacattggcgggtgctgtggatttgagccctaccacatcagggcaattgcagaggagctggccccagaaaggggctttttgccaccagcttcagaaaaacatggcagctggggaagtggtttggacatgcacaccaaaccctgggttagagcaagggccaggaaggaatactgggagaatcttcggatagcctcaggccggccatacaacccttcaatgtcaaagccagatggctggggagtgaccaaaggaacagccgagctgatgcagcagaaagaagccacaactgagcagcagctgaaagagctctttgaaaaacaaaaattcaaatcacagtagcctcgatagaagctatttttgatgaatttctaggtgtttgggtcacagttcctacaaatacggaaaagggggttaaaaagcagtgctttcatgaatgccatcctacacatattattgctattacctgaacaaaatagaattacaaatagcacttgataattttaaagtatgttttagaaattttcttaggagcaaaataagtacaaagtaaatcttgaacaggttcactaagcacccaccctgtgaaaagtattatggaaatcactgcagcacaggaaaagtaattcagatgttaatgccacttgaagaagttggtaggctagcaaagaggatgagacatgaactgtcataaaggactcagcaaccagccagggacagataaagcgctatggaaaggggcttccaagttcttttgaacatgacccttagtaacaaacacaatttatataatgacccagcaaaacacatcacatcttactgtcgaaattaaatgtgtgatccatcctagtattttctgttccattccttttcattctatttcatttataaaacatgctagttgagacttttcaaatggatttttatgacccactactgggtttggatccacagtttgaaaaatattgctacaagacacttaaggagaccatcctgtttaagtttattcttataagtaggtcagtcatatgagacctgatcaataaatatccaatacccagagtcctgctctcagagttcttctgtttcgtgacccacttttctaccagtaaaagacatagaccaatggggaggaggggaggagagatggatatttcagccctctccatcctagtcaacactggatccacctagtgcctctgggccataaggctgagcagagtgagcttgtattagttggtagcttttaaaaaatataataagaaaaaagtagagattctccaaactctagcctggtttcctagattgagaactatgatatttttctctgataatttaatatctactctcctacaaaagctcaagcctgaagatacaagactattagaagaaacatgactaccctcagtgtattagaaaagaggtcatgcagctttctaaacattattgaattgtttgagctgttttgaaattgtaattcttttcagctattaaaaagaagagcaatgagactataaaattgta

SEQ ID NO: 24432 - DNA, 2285 bp, Homo sapiens
tatggcaaactgttcaacttggtaaagctttgaactattccataacagtcattttctggaataagatactattgtaaatatacaactaagatgtgaatgtttgaataataattttatttcaatttcacatgaaaatttagatgtctcatatactcacccattttaggggcaggaagtcaatgaagctgcttgcgacatcgcccgacaagtggctgatgaaggagatgctttggtagcaggaggagtgagtcagacaccttcataccttagctgcaagagtgaaactgaagtcaaaaaagtatttctgcaacagttagaggtctttatgaagaagaacgtggacttcttgattgcagagtattttgaacacgttgaagaagctgtgtgggcagttgaaaccttgatagcatccggtaaacctgtggcagcaaccatgtgcattgggcccagaaggagatttgcatggcgtgccccccggcgagtgtgcagtgcgcctggtgaaagcaggagcatccatcattggtgtgaactgccactttgaccccaccattagtttaaaaacagtgaagctcatgaaggagggcttggaggctgcccgactgaaagctcacctgatgagccagcccttggcttaccacactcctgactgcaacaagcagggattcatcgatctcccagaattcccatttggactggaacccagagttgccaccagatgggatattcaaaaatacgccagagaggcctacaacctgggggtcaggtacattggcgggtgctgtggatttgagccctaccacatcagggcaattgcagaggagctggccccagaaaggggctttttgccaccagcttcagaaaaacatggcagctggggaagtggtttggacatgcacaccaaaccctgggttagagcaagggccaggaaggaatactgggagaatcttcggatagcctcaggccggccatacaacccttcaatgtcaaagccagatggctggggagtgaccaaaggaacagccgagctgatgcagcagaaagaagccacaactgagcagcagctgaaagagctctttgaaaaacaaaaattcaaatcacagtagcctcgatagaagctatttttgatgaatttctaggtgtttgggtcacagttcctacaaatacggaaaagggggttaaaaagcagtgctttcatgaatgccatcctacacatattattgctattacctgaacaaaatagaattacaaatagcacttgataattttaaagtatgttttagaaattttcttaggagcaaaataagtacaaagtaaatcttgaacaggttcactaagcacccaccctgtgaaaagtattatggaaatcactgcagcacaggaaaagtaattcagatgttaatgccacttgaagaagttggtaggctagcaaagaggatgagacatgaactgtcataaaggactcagcaaccagccagggacagataaagcgctatggaaaggggcttccaagttcttttgaacatgacccttagtaacaaacacaatttatataatgacccagcaaaacacatcacatcttactgtcgaaattaaatgtgtgatccatcctagtattttctgttccattccttttcattctatttcatttataaaacatgctagttgagacttttcaaatggatttttatgacccactactgggtttggatccacagtttgaaaaatattgctacaagacacttaaggagaccatcctgtttaagtttattcttataagtaggtcagtcatatgagacctgatcaataaatatccaatacccagagtcctgctctcagagttcttctgtttcgtgacccacttttctaccagtaaaagacatagaccaatggggaggaggggaggagagatggatatttcagccctctccatcctagtcaacactggatccacctagtgcctctgggccataaggctgagcagagtgagcttgtattagttggtagcttttaaaaaatataataagaaaaaagtagagattctccaaactctagcctggtttcctagattgagaactatgatatttttctctgataatttaatatctactctcctacaaaagctcaagcctgaagatacaagactattagaagaaacatgactaccctcagtgtattagaaaagaggtcatgcagctttctaaacattattgaattgtttgagctgttttgaaattgtaattcttttcagctattaaaaagaagagcaatgagactataaaattgta

SEQ ID NO: 24433 - DNA, 1368 bp, Homo sapiens
gtataaagaggcaggctgcggactcggggagctcggggctgcgcagcgggaaggctcgcctagtcggtccgcatccgtgtcgaccacctgtctggacaccacgaagatgccacccgttgggggcaaaaaggccaagaagggcatcctagaacgtttaaatgctggagagattgtgattggagatggagggtttgtctttgcactggagaagaggggctacgtaaaggcaggaccctggactcctgaagctgctgtggagcacccagaagcagttcgccagcttcatcgagagttcctcagagctggctcaaacgtcatgcagaccttcaccttctatgcgagtgaagacaagctggagaacaggggcaactatgtcttagagaagatatctgggcaggaagtcaatgaagctgcttgcgacatcgcccgacaagtggctgatgaaggagatgctttggtagcaggaggagtgagtcagacaccttcataccttagctgcaagagtgaaactgaagtcaaaaaagtatttctgcaacagttagaggtctttatgaagaagaacgtggacttcttgattgcagagtattttgaacacgttgaagaagctgtgtgggcagttgaaaccttgatagcatccggtaaacctgtggcagcaaccatgtgcattgggcccagaaggagatttgcatggcgtgccccccggcgagtgtgcagtgcgcctggtgaaagcaggagcatccatcattggtgtgaactgccactttgaccccaccattagtttaaaaacagtgaagctcatgaaggagggcttggaggctgcccgactgaaagctcacctgatgagccagcccttggcttaccacactcctgactgcaacaagcagggattcatcgatctcccagaattcccatttggactggaacccagagttgccaccagatgggatattcaaaaatacgccagagaggcctacaacctgggggtcaggtacattggcgggtgctgtggatttgagccctaccacatcagggcaattgcagaggagctggccccagaaaggggctttttgccaccagcttcagaaaaacatggcagctggggaagtggtttggacatgcacaccaaaccctgggttagagcaaggtaagcatctttttactaacccaaactaatttagattatgaatatgttcaagtgaggccatttagaagactgcagcaaatttgttgtgtgatgatgaagaatcagtcatccccaaattctctcccagagatgtttacaaagcatccttattaggtgatttctggagattgttttaagaatatagaacgtatttgacctgattttggattttgaaaaaaaaaaaa

SEQ ID NO: 24434 - DNA, 770 bp, Homo sapiens
  misc_feature (45)..(45): n is a, c, g, or t
  misc_feature (51)..(51): n is a, c, g, or t
  misc_feature (58)..(58): n is a, c, g, or t
  misc_feature (76)..(76): n is a, c, g, or t
gagtgaccacacaatagatacacccacacaaatcgaaaccccttncaaacnccccacncatcatggaaccccttgnggaagccaaggactgccagaatacggcacgagaaggctggttgccttaagctcttccctgcctcgtgttcctgagaaacggattaatagccctttatccccctgcaccctcctgcaggggatggcactttgagccctctggagccctccccttgctgagccttactctcttcagactttctgaatgtacaatgccgttggttgggatttggggactggaagggaccaaggacactgaccccaagctgtcctgcctagcgtccagcgtcttctaggagggtggggtctgcctgtcctggtgtggttggtttggccctgtttgctgtgactacccccccccctccccgaaccgagggacggctgcctttgtctctgcctcagatgccacctgccccgcccatgctccccatcagcagcatccagactttcaggaagggcagggccagccagtccagaaccgcatccctcagcagggactgataagccatctctcggagggccccctaatacccagtggagtctggttcacaccctggggggtgtgtcactgtgatgggacacgtaggagtccacccttaaaaccagcaccctgtccctcgaggctgccgagtgggtgtgtggactcgggggccactcccaatgaaactggcaacggcctggggcttaatgaaatcccttctggaatacttcccccg

SEQ ID NO: 24435 - DNA, 2467 bp, Homo sapiens
atcgcgcctgcgccagaaccgctgcctcgctcccggaagtggagggtctacacgaagcgccgctgggtctgggtgcccggaggcagcagcgttcgcggagttcgcccgctggcccccgatcaccatgtcggctttcgacaccaaccccttcgcggacccagtggatgtaaaccccttccaggatccctctgtgacccagctgaccaacgccccgcagggcggcctggcggaattcaaccccttctcagagacaaatgcagcgacaacagttcctgtcacccaactccctgggtcctcacagccagcggttctccagccatcagtggaaccaacccagccgaccccccaggccgtggtgtctgcagcccaggcaggcctgctccggcagcaggaagaactggacaggaaagctgccgagctggaacgcaaggagcgggagctgcagaacactgtagccaacttgcatgtgagacagaacaactggccccctctgccctcgtggtgccctgtgaagccctgcttctatcaggatttctccacagagatccctgccgactaccagcggatatgcaagatgctctactatctgtggatgttgcattcagtgactctgtttctgaacctgcttgcctgcctggcctggttctcgggcaacagctccaagggagtggactttggcctctccatcctgtggtttctgatcttcactccctgtgccttcctttgttggtaccgacccatctataaggcctttaggtccgacaactctttcagcttctttgtgttcttctttgtatttttttgtcaaatagggatctacatcatccagttggttggcatccctggcctgggggacagcggttggattgcagccctgtctacactggataatcattccctggccatatcagtcatcatgatggtggtggctggcttcttcaccctctgtgccgtgctctcagtcttcctcctgcagcgggtgcactccctctaccgacggacaggggccagcttccagcaggcccaggaggagttttcccagggcatcttcagcagcagaaccttccacagagctgcttcatctgctgcccaaggagccttccaggggaattagtcctcctctcttctctccccctcagcctttctctcgcctgccttctgagctgcactttccgtgggtgccttatgtggtggtggttgtgcccagcacagacctggcagggttcttgccgtggctcttcctcctccctcagcgaccagctctccctggaacgggagggacagggaattttttccccctctatgtacaaaaaaaaacaaagctctctttccttctctggtgatggtttggtaggattcttttgtctctggaagcagtgggactgaagttctcttcgtcctgtgcacacacagacacccccacacagttgggatcacaggctgacctgggcccatcccagctggagctttctgccagggtcctgggccttgactcccccaccctgcaggcctggcctgaatctggcttcttagacacagcccagtccttcctgcctgggctgggaataagcctctcacaggttctggtggacagatctgttccccaggtcactccagtggtctccaggcttccagagaaggctggttgcctcaagctcttctctgcctcataaacggatccagagaaggctggttgccttaagctcttccctgcctcgtgttcctgagaaacggattaatagccctttatccccctgcaccctcctgcaggggatggcactttgagccctctggagccctccccttgctgagccttactctcttcagactttctgaatgtacaatgccgttggttgggatttggggactggaagggaccaaggacactgaccccaagctgtcctgcctagcgtccagcgtcttctaggagggtggggtctgcctgtcctggtgtggttggtttggccctgtttgctgtgactacccccccccctccccgaaccgagggacggctgcctttgtctctgcctcagatgccacctgccccgcccatgctccccatcagcagcatccagactttcaggaagggcagggccagccagtccagaaccgcatccctcagcagggactgataagccatctctcggagggccccctaatacccagtggagtctggttcacaccctggggggtgtgtcactgtgatgggacacgtaggagtccacccttaaaaccagcaccctgtccctcgaggctgccgagtgggtgtgtggactcgggggccttcccacaaaactagcctccggctctgggcccgagacagccgcaggccccagccactgaatgatactggcagcggctggggttttatgaactcctttctggtattttttcccctctatgtacaaatgtatatgttacgtctcaatttttgtgcttaagtaaaaataaaaacattttcagacaa

SEQ ID NO: 24436 - DNA, 2499 bp, Homo sapiens
  misc_feature (16)..(16): n is a, c, g, or t
  misc_feature (23)..(23): n is a, c, g, or t
caggctggtacgcccncgagtantggatatcgtcgaccacgccgtcgcggacgcgtgggcgctcccggaagtggagggtctacacgaagcgccgctgggtctgggtgcccggaggcagcagcgttcgcggagttcgcccgctggcccccgatcaccatgtcggctttcgacaccaaccccttcgcggacccagtggatgtaaaccccttccaggatccctctgtgacccagctgaccaacgccccgcagggcggcctggcggaattcaaccccttctcagagacaaatgcagcgacaacagttcctgtcacccaactccctgggtcctcacagccagcggttctccagccatcagtggaaccaacccagccgaccccccaggccgtggtgtctgcagcccaggcaggcctgctccggcagcaggaagaactggacaggaaagctgccgagctggaacgcaaggagcgggagctgcagaacactgtagccaacttgcatgtgagacagaacaactggccccctctgccctcgtggtgccctgtgaagccctgcttctatcaggatttctccacagagatccctgccgactaccagcggatatgcaagatgctctactatctgtggatgttgcattcagtgactctgtttctgaacctgcttgcctgcctggcctggttctcgggcaacagctccaagggagtggactttggcctctccatcctgtggtttctgatcttcactccctgtgccttcctttgttggtaccgacccatctataaggcctttaggtccgacaactctttcagcttctttgtgttcttctttgtatttttttgtcaaatagggatctacatcatccagttggttggcatccctggcctgggggacagcggttggattgcagccctgtctacactggataatcattccctggccatatcagtcatcatgatggtggtggctggcttcttcaccctctgtgccgtgctctcagtcttcctcctgcagcgggtgcactccctctaccgacggacaggggccagcttccagcaggcccaggaggagttttcccagggcatcttcagcagcagaaccttccacagagctgcttcatctgctgcccaaggagccttccaggggaattagtcctcctctcttctctccccctcagcctttctctcgcctgccttctgagctgcactttccgtgggtgccttatgtggtggtggttgtgcccagcacagacctggcagggttcttgccgtggctcttcctcctccctcagcgaccagctctccctggaacgggagggacagggaattttttccccctctatgtacaaaaaaaaacaaagctctctttccttctctggtgatggtttggtaggattcttttgtctctggaagcagtgggactgaagttctcttcgtcctgtgcacacacagacacccccacacagttgggatcacaggctgacctgggcccatcccagctggagctttctgccagggtcctgggccttgactcccccaccctgcaggcctggcctgaatctggcttcttagacacagcccagtccttcctgcctgggctgggaataagcctctcacaggttctggtggacagatctgttccccaggtcactccagtggtctccaggcttccagagaaggctggttgcctcaagctcttctctgcctcataaacggatccagagaaggctggttgccttaagctcttccctgcctcgtgttcctgagaaacggattaatagccctttatccccctgcaccctcctgcaggggatggcactttgagccctctggagccctccccttgctgagccttactctcttcagactttctgaatgtacaatgccgttggttgggatttggggactggaagggaccaaggacactgaccccaagctgtcctgcctagcgtccagcgtcttctaggagggtggggtctgcctgtcctggtgtggttggtttggccctgtttgctgtgactacccccccccctccccgaaccgagggacggctgcctttgtctctgcctcagatgccacctgccccgcccatgctccccatcagcagcatccagactttcaggaagggcagggccagccagtccagaaccgcatccctcagcagggactgataagccatctctcggagggccccctaatacccagtggagtctggttcacaccctggggggtgtgtcactgtgatgggacacgtaggagtccacccttaaaaccagcaccctgtccctcgaggctgccgagtgggtgtgtggactcgggggccttcccacaaaactagcctccggctctgggcccgagacagccgcaggccccagccactgaatgatactggcagcggctggggttttatgaactcctttctggtattttttcccctctatgtacaaatgtatatgttacgtctcaatttttgtgcttaagtaaaaataaaaacattttcagacaa

SEQ ID NO: 24437 - DNA, 2607 bp, Homo sapiens
atcgcgcctgcgccagaaccgctgcctcgctcccggaagtggagggtctacacgaagcgccgctgggtctgggtgcccggaggcagcagcgttcgcggagttcgcccgctggcccccgatcaccatgtcggctttcgacaccaaccccttcgcggacccagtggatgtaaaccccttccaggatccctctgtgacccagctgaccaacgccccgcagggcggcctggcggaattcaaccccttctcagagacaaatgcagcgacaacagttcctgtcacccaactccctgggtcctcacagccagcggttctccagccatcagtggaaccaacccagccgaccccccaggccgtggtgtctgcagcccaggcaggcctgctccggcagcaggaagaactggacaggaaagctgccgagctggaacgcaaggagcgggagctgcagaacactgtagccaacttgcatgtgagacagaacaactggccccctctgccctcgtggtgccctgtgaagccctgcttctatcaggatttctccacagagatccctgccgactaccagcggatatgcaagatgctctactatctgtggatgttgcattcagtgactctgtttctgaacctgcttgcctgcctggcctggttctcgggcaacagctccaagggagtggactttggcctctccatcctgtggtttctgatcttcactccctgtgccttcctttgttggtaccgacccatctataaggcctttaggtccgacaactctttcagcttctttgtgttcttctttgtatttttttgtcaaatagggatctacatcatccagttggttggcatccctggcctgggggacagcggttggattgcagccctgtctacactggataatcattccctggccatatcagtcatcatgatggtggtggctggcttcttcaccctctgtgccgtgctctcagtcttcctcctgcagcgggtgcactccctctaccgacggacaggggccagcttccagcaggcccaggaggagttttcccagggcatcttcagcagcagaaccttccacagagctgcttcatctgctgcccaaggagccttccaggggaattagtcctcctctcttctctccccctcagcctttctctcgcctgccttctgagctgcactttccgtgggtgccttatgtggtggtggttgtgcccagcacagacctggcagggttcttgccgtggctcttcctcctccctcagcgaccagctctccctggaacgggagggacagggaattttttccccctctatgtacaaaaaaaaacaaagctctctttccttctctggtgatggtttggtaggattcttttgtctctggaagcagtgggactgaagttctcttcgtcctgtgcacacacagacacccccacacagttgggatcacaggctgacctgggcccatcccagctggagctttctgccagggtcctgggccttgactcccccaccctgcaggcctggcctgaatctggcttcttagacacagcccagtccttcctgcctgggctgggaataagcctctcacaggttctggtggacagatctgttccccaggtcactccagtggtctccaggcttccagagaaggctggttgcctcaagctcttctctgcctcataaacggatccagagaaggctggttgccttaagctcttccctgcctcgtgttcctgagaaacggattaatagccctttatccccctgcaccctcctgcaggggatggcactttgagccctctggagccctccccttgctgagccttactctcttcagactttctgaatgtacaatgccgttggttgggatttggggactggaagggaccaaggacactgaccccaagctgtcctgcctagcgtccagcgtcttctaggagggtggggtctgcctgtcctggtgtggttggtttggccctgtttgctgtgactacccccccccctccccgaaccgagggacggctgcctttgtctctgcctcagatgccacctgccccgcccatgctccccatcagcagcatccagactttcaggaagggcagggccagccagtccagaaccgcatccctcagcagggactgataagccatctctcggagggccccctaatacccagtggagtctggttcacaccctggggggtgtgtcactgtgatgggacacgtaggagtccacccttaaaaccagcaccctgtccctcgaggctgccgagtgggtgtgtggactcgggggccttcccacaaaactagcctccggctctgggcccgagacagccgcaggccccagccactgaatgatactggcagcggctggggttttatgaactcctttctggtattttttcccctctatgtacaaatgtatatgttacgtctcaatttttgtgcttaagtaaaaataaaaacattttcagacaaaatataattaataaatataataaatacactacaaagacaaaatatccacggtcatgtaagtttacaacacaaacacatgatagaaaacaataaccatattttggtgtgggtcggcggcgcctcactgtgttcgtcttttc

SEQ ID NO: 24438 - DNA, 2228 bp, Homo sapiens
atcgcgcctgcgccagaaccgctgcctcgctcccggaagtggagggtctacacgaagcgccgctgggtctgggtgcccggaggcagcagcgttcgcggagttcgcccgctggcccccgatcaccatgtcggctttcgacaccaaccccttcgcggacccagtggatgtaaaccccttccaggatccctctgtgacccagctgaccaacgccccgcagggcggcctggcggaattcaaccccttctcagagacaaatgcagcgacaacagttcctgtcacccaactccctgggtcctcacagccagcggttctccagccatcagtggaaccaacccagccgaccccccaggccgtggtgtctgcagcccaggcaggcctgctccggcagcaggaagaactggacaggaaagctgccgagctggaacgcaaggagcgggagctgcagaacactgtagccaacttgcatgtgagacagaacaactggccccctctgccctcgtggtgccctgtgaagccctgcttctatcaggatttctccacagagatccctgccgactaccagcggatatgcaagatgctctactatctgtggatgttgcattcagtgactctgtttctgaacctgcttgcctgcctggcctggttctcgggcaacagctccaagggagtggactttggcctctccatcctgtggtttctgatcttcactccctgtgccttcctttgttggtaccgacccatctataaggcctttaggtccgacaactctttcagcttctttgtgttcttctttgtatttttttgtcaaatagggatctacatcatccagttggttggcatccctggcctgggggacagcggttggattgcagccctgtctacactggataatcattccctggccatatcagtcatcatgatggtggtggctggcttcttcaccctctgtgccgtgctctcagtcttcctcctgcagcgggtgcactccctctaccgacggacaggggccagcttccagcaggcccaggaggagttttcccagggcatcttcagcagcagaaccttccacagagctgcttcatctgctgcccaaggagccttccaggggaattagtcctcctctcttctctccccctcagcctttctctcgcctgccttctgagctgcactttccgtgggtgccttatgtggtggtggttgtgcccagcacagacctggcagggttcttgccgtggctcttcctcctccctcagcgaccagctctccctggaacgggagggacagggaattttttccccctctatgtacaaaaaaaaacaaagctctctttccttctctggtgatggtttggtaggattcttttgtctctggaagcagtgggactgaagttctcttcgtcctgtgcacacacagacacccccacacagttgggatcacaggctgacctgggcccatcccagctggagctttctgccagggtcctgggccttgactcccccaccctgcaggcctggcctgaatctggcttcttagacacagcccagtccttcctgcctgggctgggaataagcctctcacaggttctggtggacagatctgttccccaggtcactccagtggtctccaggcttccagagaaggctggttgcctcaagctcttctctgcctcataaacggatccagagaaggctggttgccttaagctcttccctgcctcgtgttcctgagaaacggattaatagccctttatccccctgcaccctcctgcaggggatggcactttgagccctctggagccctccccttgctgagccttactctcttcagactttctgaatgtacaatgccgttggttgggatttggggactggaagggaccaaggacactgaccccaagctgtcctgcctagcgtccagcgtcttctaggagggtggggtctgcctgtcctggtgtggttggtttggccctgtttgctgtgactccacccttaaaaccagcaccctgtccctcgaggctgccgagtgggtgtgtggactcgggggccttcccacaaaactagcctccggctctgggcccgagacagccgcaggccccagccactgaatgatactggcagcggctggggttttatgaactcctttctggtattttttcccctctatgtacaaatgtatatgttacgtctcaatttttgtgcttaagtaaaaataaaaacattttcagacaa

SEQ ID NO: 24439 - DNA, 1835 bp, Homo sapiens
atcgcgcctgcgccagaaccgctgcctcgctcccggaagtggagggtctacacgaagcgccgctgggtctgggtgcccggaggcagcagcgttcgcggagttcgcccgctggcccccgatcaccatgtcggctttcgacaccaaccccttcgcggacccagtggatgtaaaccccttccaggatccctctgtgacccagctgaccaacgccccgcagggcggcctggcggaattcaaccccttctcagagacaaatgcagcgacaacagttcctgtcacccaactccctgggtcctcacagccagcggttctccagccatcagtggaaccaacccagccgaccccccaggccgtggtgtctgcagcccaggcaggcctgctccggcagcaggaagaactggacaggaaagctgccgagctggaacgcaaggagcgggagctgcagaacactgtagccaacttgcatgtgagacagaacaactggccccctctgccctcgtggtgccctgtgaagccctgcttctatcaggatttctccacagagatccctgccgactaccagcggatatgcaagatgctctactatctgtggatgttgcattcagtgactctgtttctgaacctgcttgcctgcctggcctggttctcgggcaacagctccaagggagtggactttggcctctccatcctgtggtttctgatcttcactccctgtgccttcctttgttggtaccgacccatctataaggcctttaggtccgacaactctttcagcttctttgtgttcttctttgtatttttttgtcaaatagggatctacatcatccagttggttggcatccctggcctgggggacagcggttggattgcagccctgtctacactggataatcattccctggccatatcagtcatcatgatggtggtggctggcttcttcaccctctgtgccgtgctctcagtcttcctcctgcagcgggtgcactccctctaccgacggacaggggccagcttccagcaggcccaggaggagttttcccagggcatcttcagcagcagaaccttccacagagctgcttcatctgctgcccaaggagccttccaggggaattagtcctcctctcttctctccccctcagcctttctctcgcctgccttctgagctgcactttccgtgggtgccttatgtggtggtggttgtgcccagcacagacctggcagggttcttgccgtggctcttcctcctccctcagcgaccagctctccctggaacgggagggacagggaattttttccccctctatgtacaaaaaaaaacaaagctctctttccttctctggtgatggtttggtaggattcttttgtctctggaagcagtgggactgaagttctcttcgtcctgtgcacacacagacacccccacacagttgggatcacaggctgacctgggcccatcccagctggagctttctgccagggtcctgggccttgactcccccaccctgcaggcctggcctgaatctggcttcttagacacagcccagtccttcctgcctgggctgggaataagcctctcacaggttctggtggacagatctgttccccaggtcactccagtggtctccaggcttccagagaaggctggttgcctcaagctcttctctgcctcataaacggatccagagaaggctggttgccttaagctcttccctgcctcctggcagcggctggggttttatgaactcctttctggtattttttcccctctatgtacaaatgtatatgttacgtctcaatttttgtgcttaagtaaaaataaaaacattttcagacaa

SEQ ID NO: 24440 - DNA, 1771 bp, Homo sapiens
atcgcgcctgcgccagaaccgctgcctcgctcccggaagtggagggtctacacgaagcgccgctgggtctgggtgcccggaggcagcagcgttcgcggagttcgcccgctggcccccgatcaccatgtcggctttcgacaccaaccccttcgcggacccagtggatgtaaaccccttccaggatccctctgtgacccagctgaccaacgccccgcagggcggcctggcggaattcaaccccttctcagagacaaatgcagcgacaacagttcctgtcacccaactccctgggtcctcacagccagcggttctccagccatcagtggaaccaacccagccgaccccccaggccgtggtgtctgcagcccaggcaggcctgctccggcagcaggaagaactggacaggaaagctgccgagctggaacgcaaggagcgggagctgcagaacactgtagccaacttgcatgtgagacagaacaactggccccctctgccctcgtggtgccctgtgaagccctgcttctatcaggatttctccacagagatccctgccgactaccagcggatatgcaagatgctctactatctgtggatgttgcattcagtgactctgtttctgaacctgcttgcctgcctggcctggttctcgggcaacagctccaagggagtggactttggcctctccatcctgtggtttctgatcttcactccctgtgccttcctttgttggtaccgacccatctataaggcctttaggtccgacaactctttcagcttctttgtgttcttctttgtatttttttgtcaaatagggatctacatcatccagttggttggcatccctggcctgggggacagcggttggattgcagccctgtctacactggataatcattccctggccatatcagtcatcatgatggtggtggctggcttcttcaccctctgtgccgtgctctcagtcttcctcctgcagcgggtgcactccctctaccgacggacaggggccagcttccagcaggcccaggaggagttttcccagggcatcttcagcagcagaaccttccacagagctgcttcatctgctgcccaaggagccttccaggggaattagtcctcctctcttctctccccctcagcctttctctcgcctgccttctgagctgcactttccgtgggtgccttatgtggtggtggttgtgcccagcacagacctggcagggttcttgccgtggctcttcctcctccctcagcgaccagctctccctggaacgggagggacagggaattttttccccctctatgtacaaaaaaaaacaaagctctctttccttctctggtgatggtttggtaggattcttttgtctctggaagcagtgggactgaagttctcttcgtcctgtgcacacacagacacccccacacagttgggatcacaggctgacctgggcccatcccagctggagctttctgccagggtcctgggccttgaggggtgtgtcactgtgatgggacacgtaggagtccacccttaaaaccagcaccctgtccctcgaggctgccgagtgggtgtgtggactcgggggccttcccacaaaactagcctccggctctgggcccgagacagccgcaggccccagccactgaatgatactggcagcggctggggttttatgaactcctttctggtattttttcccctctatgtacaaatgtatatgttacgtctcaatttttgtgcttaagtaaaaataaaaacattttcagacaa

SEQ ID NO: 24441 - DNA, 1815 bp, Homo sapiens
  misc_feature (1366)..(1366): n is a, c, g, or t
atcgcgcctgcgccagaaccgctgcctcgctcccggaagtggagggtctacacgaagcgccgctgggtctgggtgcccggaggcagcagcgttcgcggagttcgcccgctggcccccgatcaccatgtcggctttcgacaccaaccccttcgcggacccagtggatgtaaaccccttccaggatccctctgtgacccagctgaccaacgccccgcagggcggcctggcggaattcaaccccttctcagagacaaatgcagcgacaacagttcctgtcacccaactccctgggtcctcacagccagcggttctccagccatcagtggaaccaacccagccgaccccccaggccgtggtgtctgcagcccaggcaggcctgctccggcagcaggaagaactggacaggaaagctgccgagctggaacgcaaggagcgggagctgcagaacactgtagccaacttgcatgtgagacagaacaactggccccctctgccctcgtggtgccctgtgaagccctgcttctatcaggatttctccacagagatccctgccgactaccagcggatatgcaagatgctctactatctgtggatgttgcattcagtgactctgtttctgaacctgcttgcctgcctggcctggttctcgggcaacagctccaagggagtggactttggcctctccatcctgtggtttctgatcttcactccctgtgccttcctttgttggtaccgacccatctataaggcctttaggtccgacaactctttcagcttctttgtgttcttctttgtatttttttgtcaaatagggatctacatcatccagttggttggcatccctggcctgggggacagcggttggattgcagccctgtctacactggataatcattccctggccatatcagtcatcatgatggtggtggctggcttcttcaccctctgtgccgtgctctcagtcttcctcctgcagcgggtgcactccctctaccgacggacaggggccagcttccagcaggcccaggaggagttttcccagggcatcttcagcagcagaaccttccacagagctgcttcatctgctgcccaaggagccttccaggggaattagtcctcctctcttctctccccctcagcctttctctcgcctgccttctgagctgcactttccgtgggtgccttatgtggtggtggttgtgcccagcacagacctggcagggttcttgccgtggctcttcctcctccctcagcgaccagctctccctggaacgggagggacagggaattttttccccctctatgtacaaaaaaaaacaaagctctctttccttctctggtgatggtttggtaaaaaaaaaaaaanaaaaaaaaaaaaaaaacaacacaaaaaaaaaaaaaaaaaaaacaaaaaaaagttgtgtgggcgggcgcgccccgcgcgccccccgaaaaaattttcacacacacccctcggggggggcgggcggcggcccccaatgaggtggtagatgcgcaacacatgcgttccacacagtgggtgtgggtcccgacaagaaacgccggcggcgtccccaacgacaacagcgtgcgggggggttcattccccccacacaatatagaaaaacgccgcccgcgggggcgacaccgcacggaggttgtgttctgaaaaacaacccaccggagggagggacctaccgcggagggcagccacaacaggggggcggtcccaccacaccagcgaggggggacccgccaacgcgggacgagccctcactcatacaaaaatgtacggccaccggcgacgcggagggt

SEQ ID NO: 24442 - DNA, 2398 bp, Homo sapiens
atcgcgcctgcgccagaaccgctgcctcgctcccggaagtggagggtctacacgaagcgccgctgggtctgggtgcccggaggcagcagcgttcgcggagttcgcccgctggcccccgatcaccatgtcggctttcgacaccaaccccttcgcggacccagtggatgtaaaccccttccagacaaatgcagcgacaacagttcctgtcacccaactccctgggtcctcacagccagcggttctccagccatcagtggaaccaacccagccgaccccccaggccgtggtgtctgcagcccaggcaggcctgctccggcagcaggaagaactggacaggaaagctgccgagctggaacgcaaggagcgggagctgcagaacactgtagccaacttgcatgtgagacagaacaactggccccctctgccctcgtggtgccctgtgaagccctgcttctatcaggatttctccacagagatccctgccgactaccagcggatatgcaagatgctctactatctgtggatgttgcattcagtgactctgtttctgaacctgcttgcctgcctggcctggttctcgggcaacagctccaagggagtggactttggcctctccatcctgtggtttctgatcttcactccctgtgccttcctttgttggtaccgacccatctataaggcctttaggtccgacaactctttcagcttctttgtgttcttctttgtatttttttgtcaaatagggatctacatcatccagttggttggcatccctggcctgggggacagcggttggattgcagccctgtctacactggataatcattccctggccatatcagtcatcatgatggtggtggctggcttcttcaccctctgtgccgtgctctcagtcttcctcctgcagcgggtgcactccctctaccgacggacaggggccagcttccagcaggcccaggaggagttttcccagggcatcttcagcagcagaaccttccacagagctgcttcatctgctgcccaaggagccttccaggggaattagtcctcctctcttctctccccctcagcctttctctcgcctgccttctgagctgcactttccgtgggtgccttatgtggtggtggttgtgcccagcacagacctggcagggttcttgccgtggctcttcctcctccctcagcgaccagctctccctggaacgggagggacagggaattttttccccctctatgtacaaaaaaaaacaaagctctctttccttctctggtgatggtttggtaggattcttttgtctctggaagcagtgggactgaagttctcttcgtcctgtgcacacacagacacccccacacagttgggatcacaggctgacctgggcccatcccagctggagctttctgccagggtcctgggccttgactcccccaccctgcaggcctggcctgaatctggcttcttagacacagcccagtccttcctgcctgggctgggaataagcctctcacaggttctggtggacagatctgttccccaggtcactccagtggtctccaggcttccagagaaggctggttgcctcaagctcttctctgcctcataaacggatccagagaaggctggttgccttaagctcttccctgcctcgtgttcctgagaaacggattaatagccctttatccccctgcaccctcctgcaggggatggcactttgagccctctggagccctccccttgctgagccttactctcttcagactttctgaatgtacaatgccgttggttgggatttggggactggaagggaccaaggacactgaccccaagctgtcctgcctagcgtccagcgtcttctaggagggtggggtctgcctgtcctggtgtggttggtttggccctgtttgctgtgactacccccccccctccccgaaccgagggacggctgcctttgtctctgcctcagatgccacctgccccgcccatgctccccatcagcagcatccagactttcaggaagggcagggccagccagtccagaaccgcatccctcagcagggactgataagccatctctcggagggccccctaatacccagtggagtctggttcacaccctggggggtgtgtcactgtgatgggacacgtaggagtccacccttaaaaccagcaccctgtccctcgaggctgccgagtgggtgtgtggactcgggggccttcccacaaaactagcctccggctctgggcccgagacagccgcaggccccagccactgaatgatactggcagcggctggggttttatgaactcctttctggtattttttcccctctatgtacaaatgtatatgttacgtctcaatttttgtgcttaagtaaaaataaaaacattttcagacaa

SEQ ID NO: 24443 - DNA, 2742 bp, Homo sapiens
atcgcgcctgcgccagaaccgctgcctcgctcccggaagtggagggtctacacgaagcgccgctgggtctgggtgcccggaggcagcagcgttcgcggagttcgcccgctggcccccgatcaccatgtcggctttcgacaccaaccccttcgcggacccagtggatgtaaaccccttccaggtagagcccctctcccgccatccagctctcagatttccctagggcccacggccgccgcccgggcctctcgctagagccgggagacgtggcgtaggagggacgggtcatctgcccaatgggagagcgggctttgaggtctggcctatcgtaacgcgtgaggggcgcgactagcagcaggtggaactgcagaggaggcggggcgctgaagtgttggagacagtggggtcttctagcacccggaggctgggctgtgctagggaaggggactggagcaggatccctctgtgacccagctgaccaacgccccgcagggcggcctggcggaattcaaccccttctcagagacaaatgcagcgacaacagttcctgtcacccaactccctgggtcctcacagccagcggttctccagccatcagtggaaccaacccagccgaccccccaggccgtggtgtctgcagcccaggcaggcctgctccggcagcaggaagaactggacaggaaagctgccgagctggaacgcaaggagcgggagctgcagaacactgtagccaacttgcatgtgagacagaacaactggccccctctgccctcgtggtgccctgtgaagccctgcttctatcaggatttctccacagagatccctgccgactaccagcggatatgcaagatgctctactatctgtggatgttgcattcagtgactctgtttctgaacctgcttgcctgcctggcctggttctcgggcaacagctccaagggagtggactttggcctctccatcctgtggtttctgatcttcactccctgtgccttcctttgttggtaccgacccatctataaggcctttaggtccgacaactctttcagcttctttgtgttcttctttgtatttttttgtcaaatagggatctacatcatccagttggttggcatccctggcctgggggacagcggttggattgcagccctgtctacactggataatcattccctggccatatcagtcatcatgatggtggtggctggcttcttcaccctctgtgccgtgctctcagtcttcctcctgcagcgggtgcactccctctaccgacggacaggggccagcttccagcaggcccaggaggagttttcccagggcatcttcagcagcagaaccttccacagagctgcttcatctgctgcccaaggagccttccaggggaattagtcctcctctcttctctccccctcagcctttctctcgcctgccttctgagctgcactttccgtgggtgccttatgtggtggtggttgtgcccagcacagacctggcagggttcttgccgtggctcttcctcctccctcagcgaccagctctccctggaacgggagggacagggaattttttccccctctatgtacaaaaaaaaacaaagctctctttccttctctggtgatggtttggtaggattcttttgtctctggaagcagtgggactgaagttctcttcgtcctgtgcacacacagacacccccacacagttgggatcacaggctgacctgggcccatcccagctggagctttctgccagggtcctgggccttgactcccccaccctgcaggcctggcctgaatctggcttcttagacacagcccagtccttcctgcctgggctgggaataagcctctcacaggttctggtggacagatctgttccccaggtcactccagtggtctccaggcttccagagaaggctggttgcctcaagctcttctctgcctcataaacggatccagagaaggctggttgccttaagctcttccctgcctcgtgttcctgagaaacggattaatagccctttatccccctgcaccctcctgcaggggatggcactttgagccctctggagccctccccttgctgagccttactctcttcagactttctgaatgtacaatgccgttggttgggatttggggactggaagggaccaaggacactgaccccaagctgtcctgcctagcgtccagcgtcttctaggagggtggggtctgcctgtcctggtgtggttggtttggccctgtttgctgtgactacccccccccctccccgaaccgagggacggctgcctttgtctctgcctcagatgccacctgccccgcccatgctccccatcagcagcatccagactttcaggaagggcagggccagccagtccagaaccgcatccctcagcagggactgataagccatctctcggagggccccctaatacccagtggagtctggttcacaccctggggggtgtgtcactgtgatgggacacgtaggagtccacccttaaaaccagcaccctgtccctcgaggctgccgagtgggtgtgtggactcgggggccttcccacaaaactagcctccggctctgggcccgagacagccgcaggccccagccactgaatgatactggcagcggctggggttttatgaactcctttctggtattttttcccctctatgtacaaatgtatatgttacgtctcaatttttgtgcttaagtaaaaataaaaacattttcagacaa

SEQ ID NO: 24444 - DNA, 2378 bp, Homo sapiens
gcggccgctcccaacatcagagggagaggacagcttagtcatggccaaggggtcaggaaggtgtgggggcagtggaagacaggttggcctctctaaggtggtctctggtacctaagacactctgtggggcggggactgcttctgggactccttgatggctgtccctgcctggggcaaggcctctctgcctgcctacccaggctgacactgtttctgtttgttgtgtctggctgtccctgtacctcccctgttctctccaggccgtggtgtctgcagcccaggcaggcctgctccggcagcaggaagaactggacaggaaagctgccgagctggaacgcaaggagcgggagctgcagaacactgtagccaacttgcatgtgagacagaacaactggccccctctgccctcgtggtgccctgtgaagccctgcttctatcaggatttctccacagagatccctgccgactaccagcggatatgcaagatgctctactatctgtggatgttgcattcagtgactctgtttctgaacctgcttgcctgcctggcctggttctcgggcaacagctccaagggagtggactttggcctctccatcctgtggtttctgatcttcactccctgtgccttcctttgttggtaccgacccatctataaggcctttaggtccgacaactctttcagcttctttgtgttcttctttgtatttttttgtcaaatagggatctacatcatccagttggttggcatccctggcctgggggacagcggttggattgcagccctgtctacactggataatcattccctggccatatcagtcatcatgatggtggtggctggcttcttcaccctctgtgccgtgctctcagtcttcctcctgcagcgggtgcactccctctaccgacggacaggggccagcttccagcaggcccaggaggagttttcccagggcatcttcagcagcagaaccttccacagagctgcttcatctgctgcccaaggagccttccaggggaattagtcctcctctcttctctccccctcagcctttctctcgcctgccttctgagctgcactttccgtgggtgccttatgtggtggtggttgtgcccagcacagacctggcagggttcttgccgtggctcttcctcctccctcagcgaccagctctccctggaacgggagggacagggaattttttccccctctatgtacaaaaaaaaacaaagctctctttccttctctggtgatggtttggtaggattcttttgtctctggaagcagtgggactgaagttctcttcgtcctgtgcacacacagacacccccacacagttgggatcacaggctgacctgggcccatcccagctggagctttctgccagggtcctgggccttgactcccccaccctgcaggcctggcctgaatctggcttcttagacacagcccagtccttcctgcctgggctgggaataagcctctcacaggttctggtggacagatctgttccccaggtcactccagtggtctccaggcttccagagaaggctggttgcctcaagctcttctctgcctcataaacggatccagagaaggctggttgccttaagctcttccctgcctcgtgttcctgagaaacggattaatagccctttatccccctgcaccctcctgcaggggatggcactttgagccctctggagccctccccttgctgagccttactctcttcagactttctgaatgtacaatgccgttggttgggatttggggactggaagggaccaaggacactgaccccaagctgtcctgcctagcgtccagcgtcttctaggagggtggggtctgcctgtcctggtgtggttggtttggccctgtttgctgtgactacccccccccctccccgaaccgagggacggctgcctttgtctctgcctcagatgccacctgccccgcccatgctccccatcagcagcatccagactttcaggaagggcagggccagccagtccagaaccgcatccctcagcagggactgataagccatctctcggagggccccctaatacccagtggagtctggttcacaccctggggggtgtgtcactgtgatgggacacgtaggagtccacccttaaaaccagcaccctgtccctcgaggctgccgagtgggtgtgtggactcgggggccttcccacaaaactagcctccggctctgggcccgagacagccgcaggccccagccactgaatgatactggcagcggctggggttttatgaactcctttctggtattttttcccctctatgtacaaatgtatatgttacgtctcaatttttgtgcttaagtaaaaataaaaacattttcagacaa

SEQ ID NO: 24445 - DNA, 1676 bp, Homo sapiens
gagctcagtacccgctgatccgcttaagatcatccagttggtttggcatccctggcctgggggacagcggttggattgcagccctgtctacactggataatcattccctggccatatcagtcatcatgatggtggtggctggcttcttcaccctctgtgccgtgctctcagtcttcctcctgcagcgggtgcactccctctaccgacggacaggggccagcttccagcaggcccaggaggagttttcccagggcatcttcagcagcagaaccttccacagagctgcttcatctgctgcccaaggagccttccaggggaattagtcctcctctcttctctccccctcagcctttctctcgcctgccttctgagctgcactttccgtgggtgccttatgtggtggtggttgtgcccagcacagacctggcagggttcttgccgtggctcttcctcctccctcagcgaccagctctccctggaacgggagggacagggaattttttccccctctatgtacaaaaaaaaacaaagctctctttccttctctggtgatggtttggtaggattcttttgtctctggaagcagtgggactgaagttctcttcgtcctgtgcacacacagacacccccacacagttgggatcacaggctgacctgggcccatcccagctggagctttctgccagggtcctgggccttgactcccccaccctgcaggcctggcctgaatctggcttcttagacacagcccagtccttcctgcctgggctgggaataagcctctcacaggttctggtggacagatctgttccccaggtcactccagtggtctccaggcttccagagaaggctggttgcctcaagctcttctctgcctcataaacggatccagagaaggctggttgccttaagctcttccctgcctcgtgttcctgagaaacggattaatagccctttatccccctgcaccctcctgcaggggatggcactttgagccctctggagccctccccttgctgagccttactctcttcagactttctgaatgtacaatgccgttggttgggatttggggactggaagggaccaaggacactgaccccaagctgtcctgcctagcgtccagcgtcttctaggagggtggggtctgcctgtcctggtgtggttggtttggccctgtttgctgtgactacccccccccctccccgaaccgagggacggctgcctttgtctctgcctcagatgccacctgccccgcccatgctccccatcagcagcatccagactttcaggaagggcagggccagccagtccagaaccgcatccctcagcagggactgataagccatctctcggagggccccctaatacccagtggagtctggttcacaccctggggggtgtgtcactgtgatgggacacgtaggagtccacccttaaaaccagcaccctgtccctcgaggctgccgagtgggtgtgtggactcgggggccttcccacaaaactagcctccggctctgggcccgagacagccgcaggccccagccactgaatgatactggcagcggctggggttttatgaactcctttctggtattttttcccctctatgtacaaatgtatatgttacgtctcaatttttgtgcttaagtaaaaataaaaacattttcagacaa

SEQ ID NO: 24446 - DNA, 1611 bp, Homo sapiens
tagtcttagtcgggcctgggttaaatcgcgcgagatcattccctggccatatcagtcatcatgatggtggtggctggcttcttcaccctctgtgccgtgctctcagtcttcctcctgcagcgggtgcactccctctaccgacggacaggggccagcttccagcaggcccaggaggagttttcccagggcatcttcagcagcagaaccttccacagagctgcttcatctgctgcccaaggagccttccaggggaattagtcctcctctcttctctccccctcagcctttctctcgcctgccttctgagctgcactttccgtgggtgccttatgtggtggtggttgtgcccagcacagacctggcagggttcttgccgtggctcttcctcctccctcagcgaccagctctccctggaacgggagggacagggaattttttccccctctatgtacaaaaaaaaacaaagctctctttccttctctggtgatggtttggtaggattcttttgtctctggaagcagtgggactgaagttctcttcgtcctgtgcacacacagacacccccacacagttgggatcacaggctgacctgggcccatcccagctggagctttctgccagggtcctgggccttgactcccccaccctgcaggcctggcctgaatctggcttcttagacacagcccagtccttcctgcctgggctgggaataagcctctcacaggttctggtggacagatctgttccccaggtcactccagtggtctccaggcttccagagaaggctggttgcctcaagctcttctctgcctcataaacggatccagagaaggctggttgccttaagctcttccctgcctcgtgttcctgagaaacggattaatagccctttatccccctgcaccctcctgcaggggatggcactttgagccctctggagccctccccttgctgagccttactctcttcagactttctgaatgtacaatgccgttggttgggatttggggactggaagggaccaaggacactgaccccaagctgtcctgcctagcgtccagcgtcttctaggagggtggggtctgcctgtcctggtgtggttggtttggccctgtttgctgtgactacccccccccctccccgaaccgagggacggctgcctttgtctctgcctcagatgccacctgccccgcccatgctccccatcagcagcatccagactttcaggaagggcagggccagccagtccagaaccgcatccctcagcagggactgataagccatctctcggagggccccctaatacccagtggagtctggttcacaccctggggggtgtgtcactgtgatgggacacgtaggagtccacccttaaaaccagcaccctgtccctcgaggctgccgagtgggtgtgtggactcgggggccttcccacaaaactagcctccggctctgggcccgagacagccgcaggccccagccactgaatgatactggcagcggctggggttttatgaactcctttctggtattttttcccctctatgtacaaatgtatatgttacgtctcaatttttgtgcttaagtaaaaataaaaacattttcagacaa

SEQ ID NO: 24447 - DNA, 1565 bp, Homo sapiens
tgggagtataacctggatggctggcttcctggtgggcccaaaggacaggcttctctcaccccacccctcttcgccaggtgcactccctctaccgacggacaggggccagcttccagcaggcccaggaggagttttcccagggcatcttcagcagcagaaccttccacagagctgcttcatctgctgcccaaggagccttccaggggaattagtcctcctctcttctctccccctcagcctttctctcgcctgccttctgagctgcactttccgtgggtgccttatgtggtggtggttgtgcccagcacagacctggcagggttcttgccgtggctcttcctcctccctcagcgaccagctctccctggaacgggagggacagggaattttttccccctctatgtacaaaaaaaaacaaagctctctttccttctctggtgatggtttggtaggattcttttgtctctggaagcagtgggactgaagttctcttcgtcctgtgcacacacagacacccccacacagttgggatcacaggctgacctgggcccatcccagctggagctttctgccagggtcctgggccttgactcccccaccctgcaggcctggcctgaatctggcttcttagacacagcccagtccttcctgcctgggctgggaataagcctctcacaggttctggtggacagatctgttccccaggtcactccagtggtctccaggcttccagagaaggctggttgcctcaagctcttctctgcctcataaacggatccagagaaggctggttgccttaagctcttccctgcctcgtgttcctgagaaacggattaatagccctttatccccctgcaccctcctgcaggggatggcactttgagccctctggagccctccccttgctgagccttactctcttcagactttctgaatgtacaatgccgttggttgggatttggggactggaagggaccaaggacactgaccccaagctgtcctgcctagcgtccagcgtcttctaggagggtggggtctgcctgtcctggtgtggttggtttggccctgtttgctgtgactacccccccccctccccgaaccgagggacggctgcctttgtctctgcctcagatgccacctgccccgcccatgctccccatcagcagcatccagactttcaggaagggcagggccagccagtccagaaccgcatccctcagcagggactgataagccatctctcggagggccccctaatacccagtggagtctggttcacaccctggggggtgtgtcactgtgatgggacacgtaggagtccacccttaaaaccagcaccctgtccctcgaggctgccgagtgggtgtgtggactcgggggccttcccacaaaactagcctccggctctgggcccgagacagccgcaggccccagccactgaatgatactggcagcggctggggttttatgaactcctttctggtattttttcccctctatgtacaaatgtatatgttacgtctcaatttttgtgcttaagtaaaaataaaaacattttcagacaa

SEQ ID NO: 24448 - DNA, 1248 bp, Homo sapiens
  misc_feature (13)..(13): n is a, c, g, or t
  misc_feature (15)..(15): n is a, c, g, or t
  misc_feature (17)..(17): n is a, c, g, or t
  misc_feature (20)..(21): n is a, c, g, or t
  misc_feature (56)..(56): n is a, c, g, or t
aggactcgagcgntngntcnnaaaaaacccacgggcgtgttttaaaacggaagcgncatactatacgtcttaggtacgaggctgggtggtgaaaaaaacaaagctctctttccttctctggtgatggtttggtaggattcttttgtctctggaagcagtgggactgaagttctcttcgtcctgtgcacacacagacacccccacacagttgggatcacaggctgacctgggcccatcccagctggagctttctgccagggtcctgggccttgactcccccaccctgcaggcctggcctgaatctggcttcttagacacagcccagtccttcctgcctgggctgggaataagcctctcacaggttctggtggacagatctgttccccaggtcactccagtggtctccaggcttccagagaaggctggttgcctcaagctcttctctgcctcataaacggatccagagaaggctggttgccttaagctcttccctgcctcgtgttcctgagaaacggattaatagccctttatccccctgcaccctcctgcaggggatggcactttgagccctctggagccctccccttgctgagccttactctcttcagactttctgaatgtacaatgccgttggttgggatttggggactggaagggaccaaggacactgaccccaagctgtcctgcctagcgtccagcgtcttctaggagggtggggtctgcctgtcctggtgtggttggtttggccctgtttgctgtgactacccccccccctccccgaaccgagggacggctgcctttgtctctgcctcagatgccacctgccccgcccatgctccccatcagcagcatccagactttcaggaagggcagggccagccagtccagaaccgcatccctcagcagggactgataagccatctctcggagggccccctaatacccagtggagtctggttcacaccctggggggtgtgtcactgtgatgggacacgtaggagtccacccttaaaaccagcaccctgtccctcgaggctgccgagtgggtgtgtggactcgggggccttcccacaaaactagcctccggctctgggcccgagacagccgcaggccccagccactgaatgatactggcagcggctggggttttatgaactcctttctggtattttttcccctctatgtacaaatgtatatgttacgtctcaatttttgtgcttaagtaaaaataaaaacattttcagacaa

SEQ ID NO: 24449 - DNA, 1036 bp, Homo sapiens
atcgcgcctgcgccagaaccgctgcctcgctcccggaagtggagggtctacacgaagcgccgctgggtctgggtgcccggaggcagcagcgttcgcggagttcgcccgctggcccccgatcaccatgtcggctttcgacaccaaccccttcgcggacccagtggatgtaaaccccttccaggatccctctgtgacccagctgaccaacgccccgcagggcggcctggcggaattcaaccccttctcagagacaaatgcagcgacaacagttcctgtcacccaactccctgggtcctcacagccagcggttctccagccatcagtggaaccaacccagccgaccccccaggccgtggtgtctgcagcccaggcaggcctgctccggcagcaggaagaactggacaggaaagctgccgagctggaacgcaaggagcgggagctgcagaacactgtagccaacttgcatgtgagacagaacaactggccccctctgccctcgtggtgccctgtgaagccctgcttctatcaggatttctccacagagatccctgccgactaccagcggatatgcaagatgctctactatctgtggatgttgcattcagtgactctgtttctgaacctgcttgcctgcctggcctggttctcgggcaacagctccaagggagtggactttggcctctccatcctgtggtttctgatcttcactccctgtgccttcctttgttggtaccgacccatctataaggcctttaggtccgacaactctttcagcttctttgtgttcttctttgtatttttttgtcaaatagggatctacatcatccagttggttggcatccctggcctgggggacaggtgagacctgggcatcacagagggaattaggctttggatatgggactcagcctctcttgccctgttttctagctcccacagagccccgccagtgccctgcttttcccatggcggggagtgggtgagtgggccagctcggatctgctttgggccttctctccagttcttcatcagtagc

SEQ ID NO: 24450 - DNA, 844 bp, Homo sapiens
  misc_feature (55)..(55): n is a, c, g, or t
ggacgtcatttttcatcctcgagcccgtgccgagtgagagaagcggcggaggtcnccaagagaaggctggttgccttaagctcttccctgcctcgtgttcctgagaaacggattaatagccctttatccccctgcaccctcctgcaggggatggcactttgagccctctggagccctccccttgctgagccttactctcttcagactttctgaatgtacaatgccgttggttgggatttggggactggaagggaccaaggacactgaccccaagctgtcctgcctagcgtccagcgtcttctaggagggtggggtctgcctgtcctggtgtggttggtttggccctgtttgctgtgactacccccccccctccccgaaccgagggacggctgcctttgtctctgcctcagatgccacctgccccgcccatgctccccatcagcagcatccagactttcaggaagggcagggccagccagtccagaaccgcatccctcagcagggactgataagccatctctcggagggccccctaatacccagtggagtctggttcacaccctggggggtgtgtcactgtgatgggacacgtaggagtccacccttaaaaccagcaccctgtccctcgaggctgccgagtgggtgtgtggactcgggggccttcccacaaaactagcctccggctctgggcccgagacagccgcaggccccagccactgaatgatactggcagcggctggggttttatgaactcctttctggtattttttcccctctatgtacaaatgtatatgttacgtctcaatttttgtgcttaagtaaaaataaaaacattttcagacaa

SEQ ID NO: 24451 - DNA, 664 bp, Homo sapiens
tactactaaattcgcggccgctcgactttctgaatgtacaatgccgttggttgggatttggggactggaagggaccaaggacactgaccccaagctgtcctgcctagcgtccagcgtcttctaggagggtggggtctgcctgtcctggtgtggttggtttggccctgtttgctgtgactacccccccccctccccgaaccgagggacggctgcctttgtctctgcctcagatgccacctgccccgcccatgctccccatcagcagcatccagactttcaggaagggcagggccagccagtccagaaccgcatccctcagcagggactgataagccatctctcggagggccccctaatacccagtggagtctggttcacaccctggggggtgtgtcactgtgatgggacacgtaggagtccacccttaaaaccagcaccctgtccctcgaggctgccgagtgggtgtgtggactcgggggccttcccacaaaactagcctccggctctgggcccgagacagccgcaggccccagccactgaatgatactggcagcggctggggttttatgaactcctttctggtattttttcccctctatgtacaaatgtatatgttacgtctcaatttttgtgcttaagtaaaaataaaaacattttcagacaa

SEQ ID NO: 24452 - DNA, 556 bp, Homo sapiens
aatttgtggtgacaactaaagaagagcttttccacaaatctttgaaaagcaatctgggaaaggaattcattacccccccccctccccgaaccgagggacggctgcctttgtctctgcctcagatgccacctgccccgcccatgctccccatcagcagcatccagactttcaggaagggcagggccagccagtccagaaccgcatccctcagcagggactgataagccatctctcggagggccccctaatacccagtggagtctggttcacaccctggggggtgtgtcactgtgatgggacacgtaggagtccacccttaaaaccagcaccctgtccctcgaggctgccgagtgggtgtgtggactcgggggccttcccacaaaactagcctccggctctgggcccgagacagccgcaggccccagccactgaatgatactggcagcggctggggttttatgaactcctttctggtattttttcccctctatgtacaaatgtatatgttacgtctcaatttttgtgcttaagtaaaaataaaaacattttcagacaa

SEQ ID NO: 24453 - DNA, 568 bp, Homo sapiens
atcgcgcctgcgccagaaccgctgcctcgctcccggaagtggagggtctacacgaagcgccgctgggtctgggtgcccggaggcagcagcgttcgcggagttcgcccgctggcccccgatcaccatgtcggctttcgacaccaaccccttcgcggacccagtggatgtaaaccccttccaggatccctctgtgacccagctgaccaacgccccgcagggcggcctggcggaattcaaccccttctcagagacaaatgcagcgacaacagttcctgtcacccaactccctgggtcctcacagccagcggttctccagccatcagtggaaccaacccagccgaccccccaggtagtgctgacaaagaactctggccttttctctccagtgagggaatcatccagaccagtagctgagccctgaggctgggggcaagcagagagctttcagcctttggcccctaagggccctcttgctaatttgttcggagctggtcacctacaagtagaggggctgctctgccaattaatatccttactccctccatcccactcaccacccccattgtta

SEQ ID NO: 24454 - DNA, 2596 bp, Homo sapiens
atcgcgcctgcgccagaaccgctgcctcgctcccggaagtggagggtctacacgaagcgccgctgggtctgggtgcccggaggcagcagcgttcgcggagttcgcccgctggcccccgatcaccatgtcggctttcgacaccaaccccttcgcggacccagtggatgtaaaccccttccaggatccctctgtgacccagctgaccaacgccccgcagggcggcctggcggaattcaaccccttctcagagacaaatgcagcgacaacagttcctgtcacccaactccctgggtcctcacagccagcggttctccagccatcagtggaaccaacccagccgaccccccagctcctgcttagacaggccagcaagttcccgcctgcccaattcctggcagtgagcgagctctcagagaggcagatgctcctaggaggagaaagtattctcagagacagctacatgcgaaagcttccgaaggccgtggtgtctgcagcccaggcaggcctgctccggcagcaggaagaactggacaggaaagctgccgagctggaacgcaaggagcgggagctgcagaacactgtagccaacttgcatgtgagacagaacaactggccccctctgccctcgtggtgccctgtgaagccctgcttctatcaggatttctccacagagatccctgccgactaccagcggatatgcaagatgctctactatctgtggatgttgcattcagtgactctgtttctgaacctgcttgcctgcctggcctggttctcgggcaacagctccaagggagtggactttggcctctccatcctgtggtttctgatcttcactccctgtgccttcctttgttggtaccgacccatctataaggcctttaggtccgacaactctttcagcttctttgtgttcttctttgtatttttttgtcaaatagggatctacatcatccagttggttggcatccctggcctgggggacagcggttggattgcagccctgtctacactggataatcattccctggccatatcagtcatcatgatggtggtggctggcttcttcaccctctgtgccgtgctctcagtcttcctcctgcagcgggtgcactccctctaccgacggacaggggccagcttccagcaggcccaggaggagttttcccagggcatcttcagcagcagaaccttccacagagctgcttcatctgctgcccaaggagccttccaggggaattagtcctcctctcttctctccccctcagcctttctctcgcctgccttctgagctgcactttccgtgggtgccttatgtggtggtggttgtgcccagcacagacctggcagggttcttgccgtggctcttcctcctccctcagcgaccagctctccctggaacgggagggacagggaattttttccccctctatgtacaaaaaaaaacaaagctctctttccttctctggtgatggtttggtaggattcttttgtctctggaagcagtgggactgaagttctcttcgtcctgtgcacacacagacacccccacacagttgggatcacaggctgacctgggcccatcccagctggagctttctgccagggtcctgggccttgactcccccaccctgcaggcctggcctgaatctggcttcttagacacagcccagtccttcctgcctgggctgggaataagcctctcacaggttctggtggacagatctgttccccaggtcactccagtggtctccaggcttccagagaaggctggttgcctcaagctcttctctgcctcataaacggatccagagaaggctggttgccttaagctcttccctgcctcgtgttcctgagaaacggattaatagccctttatccccctgcaccctcctgcaggggatggcactttgagccctctggagccctccccttgctgagccttactctcttcagactttctgaatgtacaatgccgttggttgggatttggggactggaagggaccaaggacactgaccccaagctgtcctgcctagcgtccagcgtcttctaggagggtggggtctgcctgtcctggtgtggttggtttggccctgtttgctgtgactacccccccccctccccgaaccgagggacggctgcctttgtctctgcctcagatgccacctgccccgcccatgctccccatcagcagcatccagactttcaggaagggcagggccagccagtccagaaccgcatccctcagcagggactgataagccatctctcggagggccccctaatacccagtggagtctggttcacaccctggggggtgtgtcactgtgatgggacacgtaggagtccacccttaaaaccagcaccctgtccctcgaggctgccgagtgggtgtgtggactcgggggccttcccacaaaactagcctccggctctgggcccgagacagccgcaggccccagccactgaatgatactggcagcggctggggttttatgaactcctttctggtattttttcccctctatgtacaaatgtatatgttacgtctcaatttttgtgcttaagtaaaaataaaaacattttcagacaa

SEQ ID NO: 24455 - DNA, 2411 bp, Homo sapiens
atcgcgcctgcgccagaaccgctgcctcgctcccggaagtggagggtctacacgaagcgccgctgggtctgggtgcccggaggcagcagcgttcgcggagttcgcccgctggcccccgatcaccatgtcggctttcgacaccaaccccttcgcggacccagtggatgtaaaccccttccaggatccctctgtgacccagctgaccaacgccccgcagggcggcctggcggaattcaaccccttctcagagacaaatgcagcgacaacagttcctgtcacccaactccctgggtcctcacagccagcggttctccagccatcagtggaaccaacccagccgaccccccaggccgtggtgtctgcagcccaggcaggcctgctccggcagcaggaagaactggacaggaaagctgccgagctggaacgcaaggagcgggagctgcagaacactgtagccaacttgcatgtgagacagaacaactggccccctctgccctcgtggtgccctgtgaagccctgcttctatcaggatttctccacagagatccctgccgactaccagcggatatgcaagatgctctactatctgtggatgttgcattcagtgactctgtttctgaacctgcttgcctgcctggcctggttctcgggcaacagctccaagggagtggactttggcctctccatcctgtggtttctgatcttcactccctgtgccttcctttgttggtaccgacccatctataaggcctttagggatctacatcatccagttggttggcatccctggcctgggggacagcggttggattgcagccctgtctacactggataatcattccctggccatatcagtcatcatgatggtggtggctggcttcttcaccctctgtgccgtgctctcagtcttcctcctgcagcgggtgcactccctctaccgacggacaggggccagcttccagcaggcccaggaggagttttcccagggcatcttcagcagcagaaccttccacagagctgcttcatctgctgcccaaggagccttccaggggaattagtcctcctctcttctctccccctcagcctttctctcgcctgccttctgagctgcactttccgtgggtgccttatgtggtggtggttgtgcccagcacagacctggcagggttcttgccgtggctcttcctcctccctcagcgaccagctctccctggaacgggagggacagggaattttttccccctctatgtacaaaaaaaaacaaagctctctttccttctctggtgatggtttggtaggattcttttgtctctggaagcagtgggactgaagttctcttcgtcctgtgcacacacagacacccccacacagttgggatcacaggctgacctgggcccatcccagctggagctttctgccagggtcctgggccttgactcccccaccctgcaggcctggcctgaatctggcttcttagacacagcccagtccttcctgcctgggctgggaataagcctctcacaggttctggtggacagatctgttccccaggtcactccagtggtctccaggcttccagagaaggctggttgcctcaagctcttctctgcctcataaacggatccagagaaggctggttgccttaagctcttccctgcctcgtgttcctgagaaacggattaatagccctttatccccctgcaccctcctgcaggggatggcactttgagccctctggagccctccccttgctgagccttactctcttcagactttctgaatgtacaatgccgttggttgggatttggggactggaagggaccaaggacactgaccccaagctgtcctgcctagcgtccagcgtcttctaggagggtggggtctgcctgtcctggtgtggttggtttggccctgtttgctgtgactacccccccccctccccgaaccgagggacggctgcctttgtctctgcctcagatgccacctgccccgcccatgctccccatcagcagcatccagactttcaggaagggcagggccagccagtccagaaccgcatccctcagcagggactgataagccatctctcggagggccccctaatacccagtggagtctggttcacaccctggggggtgtgtcactgtgatgggacacgtaggagtccacccttaaaaccagcaccctgtccctcgaggctgccgagtgggtgtgtggactcgggggccttcccacaaaactagcctccggctctgggcccgagacagccgcaggccccagccactgaatgatactggcagcggctggggttttatgaactcctttctggtattttttcccctctatgtacaaatgtatatgttacgtctcaatttttgtgcttaagtaaaaataaaaacattttcagacaa

SEQ ID NO: 24456 - DNA, 1824 bp, Homo sapiens
ggcatgaggcgggggtgggaagtcaggaggtttggcctctccatcctgtggtttctgatcttcactccctgtgccttcctttgttggtaccgacccatctataaggcctttaggtccgacaactctttcagcttctttgtgttcttctttgtatttttttgtcaaatagggatctacatcatccagttggttggcatccctggcctgggggacagcggttggattgcagccctgtctacactggataatcattccctggccatatcagtcatcatgatggtggtggctggcttcttcaccctctgtgccgtgctctcagtcttcctcctgcagcgggtgcactccctctaccgacggacaggggccagcttccagcaggcccaggaggagttttcccagggcatcttcagcagcagaaccttccacagagctgcttcatctgctgcccaaggagccttccaggggaattagtcctcctctcttctctccccctcagcctttctctcgcctgccttctgagctgcactttccgtgggtgccttatgtggtggtggttgtgcccagcacagacctggcagggttcttgccgtggctcttcctcctccctcagcgaccagctctccctggaacgggagggacagggaattttttccccctctatgtacaaaaaaaaacaaagctctctttccttctctggtgatggtttggtaggattcttttgtctctggaagcagtgggactgaagttctcttcgtcctgtgcacacacagacacccccacacagttgggatcacaggctgacctgggcccatcccagctggagctttctgccagggtcctgggccttgactcccccaccctgcaggcctggcctgaatctggcttcttagacacagcccagtccttcctgcctgggctgggaataagcctctcacaggttctggtggacagatctgttccccaggtcactccagtggtctccaggcttccagagaaggctggttgcctcaagctcttctctgcctcataaacggatccagagaaggctggttgccttaagctcttccctgcctcgtgttcctgagaaacggattaatagccctttatccccctgcaccctcctgcaggggatggcactttgagccctctggagccctccccttgctgagccttactctcttcagactttctgaatgtacaatgccgttggttgggatttggggactggaagggaccaaggacactgaccccaagctgtcctgcctagcgtccagcgtcttctaggagggtggggtctgcctgtcctggtgtggttggtttggccctgtttgctgtgactacccccccccctccccgaaccgagggacggctgcctttgtctctgcctcagatgccacctgccccgcccatgctccccatcagcagcatccagactttcaggaagggcagggccagccagtccagaaccgcatccctcagcagggactgataagccatctctcggagggccccctaatacccagtggagtctggttcacaccctggggggtgtgtcactgtgatgggacacgtaggagtccacccttaaaaccagcaccctgtccctcgaggctgccgagtgggtgtgtggactcgggggccttcccacaaaactagcctccggctctgggcccgagacagccgcaggccccagccactgaatgatactggcagcggctggggttttatgaactcctttctggtattttttcccctctatgtacaaatgtatatgttacgtctcaatttttgtgcttaagtaaaaataaaaacattttcagacaa

SEQ ID NO: 24457 - DNA, 2173 bp, Homo sapiens
gggctttccggtgatccagctgttccagccttctccccgagctgggagtaaagctccttcactggcctctccggctctggcctgtaggctccaggccttctgcaacgcctccagctaagatggggccaccctggggttcaggtgaatgaggaccgcagcgcgtgccgggtgcacgttctccttccttggagaggcggtgaggaagaagccatcgaagaggctgctgcagaagtcctcaagggcaaattcgtcggccagcagcgcaaggttgcccgtgagcaggtggaggaagatgtcgccaaaggccaagtcgccaaaggtctccaccagcccgggcagcaggcggaggagcgcgttcttgttcctctgcttggtgatgtgcaggacgtagtacagccccacctcgcaggccatgcgctgctcctgcagaaacttagtgaagctttcgggaagtgtgtttggatatgagactggggctttctcctcagccggaagtttctgatccacattgaaagtgtagtcatccaccaggaaggacatgagcatcgggaggaacctggtgatgagctctacctccatcttgggctccttgaagaatcattccctggccatatcagtcatcatgatggtggtggctggcttcttcaccctctgtgccgtgctctcagtcttcctcctgcagcgggtgcactccctctaccgacggacaggggccagcttccagcaggcccaggaggagttttcccagggcatcttcagcagcagaaccttccacagagctgcttcatctgctgcccaaggagccttccaggggaattagtcctcctctcttctctccccctcagcctttctctcgcctgccttctgagctgcactttccgtgggtgccttatgtggtggtggttgtgcccagcacagacctggcagggttcttgccgtggctcttcctcctccctcagcgaccagctctccctggaacgggagggacagggaattttttccccctctatgtacaaaaaaaaacaaagctctctttccttctctggtgatggtttggtaggattcttttgtctctggaagcagtgggactgaagttctcttcgtcctgtgcacacacagacacccccacacagttgggatcacaggctgacctgggcccatcccagctggagctttctgccagggtcctgggccttgactcccccaccctgcaggcctggcctgaatctggcttcttagacacagcccagtccttcctgcctgggctgggaataagcctctcacaggttctggtggacagatctgttccccaggtcactccagtggtctccaggcttccagagaaggctggttgcctcaagctcttctctgcctcataaacggatccagagaaggctggttgccttaagctcttccctgcctcgtgttcctgagaaacggattaatagccctttatccccctgcaccctcctgcaggggatggcactttgagccctctggagccctccccttgctgagccttactctcttcagactttctgaatgtacaatgccgttggttgggatttggggactggaagggaccaaggacactgaccccaagctgtcctgcctagcgtccagcgtcttctaggagggtggggtctgcctgtcctggtgtggttggtttggccctgtttgctgtgactacccccccccctccccgaaccgagggacggctgcctttgtctctgcctcagatgccacctgccccgcccatgctccccatcagcagcatccagactttcaggaagggcagggccagccagtccagaaccgcatccctcagcagggactgataagccatctctcggagggccccctaatacccagtggagtctggttcacaccctggggggtgtgtcactgtgatgggacacgtaggagtccacccttaaaaccagcaccctgtccctcgaggctgccgagtgggtgtgtggactcgggggccttcccacaaaactagcctccggctctgggcccgagacagccgcaggccccagccactgaatgatactggcagcggctggggttttatgaactcctttctggtattttttcccctctatgtacaaatgtatatgttacgtctcaatttttgtgcttaagtaaaaataaaaacattttcagacaa

SEQ ID NO: 24458 - DNA, 1021 bp, Homo sapiens
atcgcgcctgcgccagaaccgctgcctcgctcccggaagtggagggtctacacgaagcgccgctgggtctgggtgcccggaggcagcagcgttcgcggagttcgcccgctggcccccgatcaccatgtcggctttcgacaccaaccccttcgcggacccagtggatgtaaaccccttccaggatccctctgtgacccagctgaccaacgccccgcagggcggcctggcggaattcaaccccttctcagagacaaatgcagcgacaacagttcctgtcacccaactccctgggtcctcacagccagcggttctccagccatcagtggaaccaacccagccgaccccccaggccgtggtgtctgcagcccaggcaggcctgctccggcagcaggaagaactggacaggaaagctgccgagctggaacgcaaggagcgggagctgcagaacactgtagccaacttgcatgtgagacagaacaactggccccctctgccctcgtggtgccctgtgaagccctgcttctatcaggatttctccacagagatccctgccgactaccagcggatatgcaagatgctctactatctgtggatgttgcattcagtgactctgtttctgaacctgcttgcctgcctggcctggttctcgggcaacagctccaagggagtggactttggcctctccatcctgtggtttctgatcttcactccctgtgccttcctttgttggtaccgacccatctataaggcctttaggtccgacaactctttcagcttctttgtgttcttctttgtatttttttgtcaaatagggatctacatcatccagttggttggcatccctggcctgggggacagcggttggattgcagccctgtctacactggataatcattccctggccatatcagtcatcatgatggtggtggctggcttcttcaccctctgtgccgtgctctcagtcttcctcctgcagcgggtgcactccctctaccgacgtcgggtatccatggtaccgacc

SEQ ID NO: 24459 - DNA, 1392 bp, Homo sapiens
tgaggatcccccgcggccccctccagcccagggaattagtcctcctctcttctctccccctcagcctttctctcgcctgccttctgagctgcactttccgtgggtgccttatgtggtggtggttgtgcccagcacagacctggcagggttcttgccgtggctcttcctcctccctcagcgaccagctctccctggaacgggagggacagggaattttttccccctctatgtacaaaaaaaaacaaagctctctttccttctctggtgatggtttggtaggattcttttgtctctggaagcagtgggactgaagttctcttcgtcctgtgcacacacagacacccccacacagttgggatcacaggctgacctgggcccatcccagctggagctttctgccagggtcctgggccttgactcccccaccctgcaggcctggcctgaatctggcttcttagacacagcccagtccttcctgcctgggctgggaataagcctctcacaggttctggtggacagatctgttccccaggtcactccagtggtctccaggcttccagagaaggctggttgcctcaagctcttctctgcctcataaacggatccagagaaggctggttgccttaagctcttccctgcctcgtgttcctgagaaacggattaatagccctttatccccctgcaccctcctgcaggggatggcactttgagccctctggagccctccccttgctgagccttactctcttcagactttctgaatgtacaatgccgttggttgggatttggggactggaagggaccaaggacactgaccccaagctgtcctgcctagcgtccagcgtcttctaggagggtggggtctgcctgtcctggtgtggttggtttggccctgtttgctgtgactacccccccccctccccgaaccgagggacggctgcctttgtctctgcctcagatgccacctgccccgcccatgctccccatcagcagcatccagactttcaggaagggcagggccagccagtccagaaccgcatccctcagcagggactgataagccatctctcggagggccccctaatacccagtggagtctggttcacaccctggggggtgtgtcactgtgatgggacacgtaggagtccacccttaaaaccagcaccctgtccctcgaggctgccgagtgggtgtgtggactcgggggccttcccacaaaactagcctccggctctgggcccgagacagccgcaggccccagccactgaatgatactggcagcggctggggttttatgaactcctttctggtattttttcccctctatgtacaaatgtatatgttacgtctcaatttttgtgcttaagtaaaaataaaaacattttcagacaa

SEQ ID NO: 24460 - DNA, 1164 bp, Homo sapiens
aaggcttgagctacctgcgatcccggcgcagatttttctcggcggcagtaggattcttttgtctctggaagcagtgggactgaagttctcttcgtcctgtgcacacacagacacccccacacagttgggatcacaggctgacctgggcccatcccagctggagctttctgccagggtcctgggccttgactcccccaccctgcaggcctggcctgaatctggcttcttagacacagcccagtccttcctgcctgggctgggaataagcctctcacaggttctggtggacagatctgttccccaggtcactccagtggtctccaggcttccagagaaggctggttgcctcaagctcttctctgcctcataaacggatccagagaaggctggttgccttaagctcttccctgcctcgtgttcctgagaaacggattaatagccctttatccccctgcaccctcctgcaggggatggcactttgagccctctggagccctccccttgctgagccttactctcttcagactttctgaatgtacaatgccgttggttgggatttggggactggaagggaccaaggacactgaccccaagctgtcctgcctagcgtccagcgtcttctaggagggtggggtctgcctgtcctggtgtggttggtttggccctgtttgctgtgactacccccccccctccccgaaccgagggacggctgcctttgtctctgcctcagatgccacctgccccgcccatgctccccatcagcagcatccagactttcaggaagggcagggccagccagtccagaaccgcatccctcagcagggactgataagccatctctcggagggccccctaatacccagtggagtctggttcacaccctggggggtgtgtcactgtgatgggacacgtaggagtccacccttaaaaccagcaccctgtccctcgaggctgccgagtgggtgtgtggactcgggggccttcccacaaaactagcctccggctctgggcccgagacagccgcaggccccagccactgaatgatactggcagcggctggggttttatgaactcctttctggtattttttcccctctatgtacaaatgtatatgttacgtctcaatttttgtgcttaagtaaaaataaaaacattttcagacaa

SEQ ID NO: 24461 - DNA, 1195 bp, Homo sapiens
ggttggtaggattcttcagtcccactgcttccagagacaaaagaatcctaccaaaccatcaccagagaaggaaagagagcaggattcttttgtctctggaagcagtgggactgaagttctcttcgtcctgtgcacacacagacacccccacacagttgggatcacaggctgacctgggcccatcccagctggagctttctgccagggtcctgggccttgactcccccaccctgcaggcctggcctgaatctggcttcttagacacagcccagtccttcctgcctgggctgggaataagcctctcacaggttctggtggacagatctgttccccaggtcactccagtggtctccaggcttccagagaaggctggttgcctcaagctcttctctgcctcataaacggatccagagaaggctggttgccttaagctcttccctgcctcgtgttcctgagaaacggattaatagccctttatccccctgcaccctcctgcaggggatggcactttgagccctctggagccctccccttgctgagccttactctcttcagactttctgaatgtacaatgccgttggttgggatttggggactggaagggaccaaggacactgaccccaagctgtcctgcctagcgtccagcgtcttctaggagggtggggtctgcctgtcctggtgtggttggtttggccctgtttgctgtgactacccccccccctccccgaaccgagggacggctgcctttgtctctgcctcagatgccacctgccccgcccatgctccccatcagcagcatccagactttcaggaagggcagggccagccagtccagaaccgcatccctcagcagggactgataagccatctctcggagggccccctaatacccagtggagtctggttcacaccctggggggtgtgtcactgtgatgggacacgtaggagtccacccttaaaaccagcaccctgtccctcgaggctgccgagtgggtgtgtggactcgggggccttcccacaaaactagcctccggctctgggcccgagacagccgcaggccccagccactgaatgatactggcagcggctggggttttatgaactcctttctggtattttttcccctctatgtacaaatgtatatgttacgtctcaatttttgtgcttaagtaaaaataaaaacattttcagacaa

SEQ ID NO: 24462 - DNA, 3639 bp, Homo sapiens
cagagagcaaatcccatttattggaatttcactgacaacaaattgagaggaaggcttccccctcccctgaaacatgccatcctctctgccctcagggctcagcacagggataagacccccactccgcatgtccccagagggcagcactccaggggggtgggggggaggggaggggtgctctacgccaggctggggagctgggacaggagggaagacgtgcaccctcacctcttggctcaatccctctccccgggacctggtgctgcccccagtccctggggtgggctggcagacagggctcatgcaacaatgagtagacaggaggtggcacggaaacgtggccttggtgccccttggcgggggcgggaggactaaaggggccatgctgtggccacagcgggtccaaatggaagtatctgcagtgtacatacaggagggttggagagaggcatccttttccctaggctgtgcctggggacaagagagaggggaagtacagctggcactgccgtgccaggggcagggtccaggccagccgtgccacctgagcgggcacagcgagctggagctcggctactccttggcgcggccaatgatggtgaggatgtacaggaagatgttgatgatgtctgtgtacaggttcagcgcagcaaacacatactcttctgggctcagggacagctgcttgttccccagcagcagctgggtgtccactgcgaggaagcaggtgaagagcagagcgcccagtgaggcgtacacgatctccaggatgcggttccggatgaagatgcagagaatggcgaagatgaagagcaccaccatgctcaccaggagcacgcccatgcatgaggtgaagtcgtagcgggtctgcatggagaagatgacgacggtgaagcagacggctgtggtgatgcccacggccatgatgactgcctcggtgttgtagaagctggcgatcatccccaccatgtacgacaggctggcggtcaggaccgacagtgcaacaaggttccaggggtgctttcgccggaagtccccacaacagctgaggacgatgagagagatgaagaagacagcataggagacatagtaggtccagacattctcccggacaaagcccttcacctccgcaacaaaagtgaacacagacaccgtggacagggtcaccgacagctgcaaggtcagcactaggaacaccttgcggatgaaggcctgtcggatgctcttgtcatcccagttggtggcagggaagtcctggttgtcatagtaggatgggggaccctcctcctggtagtttccatgctggggtgagtcagggtcttgtcctgggaagacctgtggctgtccataggggttgggggggaaggggctctggggatatggcccctgggggtagcccccttgggggtaggggccctgtgggtagccctcttgtgggtaggggccctgtgggtagcccccttgggggtagggaccctgtgggtagcccccttgggggtaggggctggggccatgggggtaccctggctgaccgtagggggagggctggaaagggggctgtgggtaaggggccccagggtagggaggctgagcataggggggcatgggtggctggggcccccccggatatccagggttggggggaggatagttgtccccagacaccaaaaaactcttttcatgggacatggcctcgggttccgcggtccgccccggtggccgggcgccgcaggccggtacgcacggtgtccgctgcgcggccgcgcggtgatggccgatgcgcccgcacccgcacccgctcggagcgactcttcagggaggtggcaggaaaggcttggaacagctgccggaggtgacggagcggcggccccgcccggtgcgctggaggtcgaagcttccaggtagcggcccgcagagcctgacccaggctctggacatcctgagcccaagtcccccacactcagtgcagtgatgagtgcggaagtgaaggtgacagggcagaaccaggagcaatttctgctcctagccaagtcggccaagggggcagcgctggccacactcatccatcaggtgctggaggcccctggtgtctacgtgtttggagaactgctggacatgcccaatgttagagagctggctgagagtgactttgcctctaccttccggctgctcacagtgtttgcttatgggacatacgctgactacttagctgaagcccggaatcttcctccactaacagaggctcagaagaataagcttcgacacctctcagttgtcaccctggctgctaaagtaaagtgtatcccatatgcagtgttgctggaggctcttgccctgcgtaatgtgcggcagctggaagaccttgtgattgaggctgtgtatgctgacgtgcttcgtggctccctggaccagcgcaaccagcggctcgaggttgactacagcatcgggcgggacatccagcgccaggacctcagtgccattgcccgaaccctgcaggaatggtgtgtgggctgtgaggtcgtgctgtcaggcattgaggagcaggtgagccgtgccaaccaacacaaggagcagcagctgggcctgaagcagcagattgagagtgaggttgccaaccttaaaaaaaccattaaagttacgacggcagcagcagccgcagccacatctcaggaccctgagcaacacctgactgagctgagggaaccagctcctggcaccaaccagcgccagcccagcaagaaagcctcaaagggcaaggggctccgagggagcgccaagatttggtccaagtcgaattgaaagaactgtcgtttcctccctggggatgtggggtcccagctgcctgcctgcctcttaggagtcctcagagagccttctgtgcccctggccagctgataatcctaggttcatgacccttcacctcccctaaccccaaacatagatcacaccttctctagggaggagtcaaatgtaggtcatgtttttgttggtactttctgttttttgtgacttcatgtgttccattgctccccgctgccatgctctctcccttgtttccttaagagctcagcatctgtccctgttcattacatgtcattgagtaggtgggtagccctgatgggggtcgctctgtctggagcataacccacaggcgttttttctgccaccccatccctgcatgcctgatccccagttcctataccctacccctgacctattgagcagcctctgaagagccatagggcccccacctttactcacaccctgagaattctgggagccagtctgccatgccaggagtcactggacatgttcatcctagaatcctgtcacactacagtcatttcttttcctctctctggcccttgggtcctgggaatgctgctgcttcaaccccagagcctaagaatggcagccgtttcttaacatgttgagagatgattctttcttggccctggccatctcgggaagcttgatggcaatcctggaagggtttaatctccttttgtgagtttggtggggaagggaagggtatatagattgtattaaaaaaaaaaaggtatatatgcatatatctatatataatatgacgcagaaataaatctatgagaaatctatctacaaactaccctgaactgg

SEQ ID NO: 24463 - DNA, 1837 bp, Homo sapiens
cgccatagagtttagtggccagaagcgactcttcagggaggtggcaggaaaggcttggaacagctgccggaggtgacggagcggcggccccgcccggtgcgctggaggtcgaagcttccaggtagcggcccgcagagcctgacccaggctctggacatcctgagcccaagtcccccacactcagtgcagtgatgagtgcggaagtgaaggtgacagggcagaaccaggagcaatttctgctcctagccaagtcggccaagggggcagcgctggccacactcatccatcaggtgctggaggcccctggtgtctacgtgtttggagaactgctggacatgcccaatgttagagagctggctgagagtgactttgcctctaccttccggctgctcacagtgtttgcttatgggacatacgctgactacttagctgaagcccggaatcttcctccactaacagaggctcagaagaataagcttcgacacctctcagttgtcaccctggctgctaaagtaaagtgtatcccatatgcagtgttgctggaggctcttgccctgcgtaatgtgcggcagctggaagaccttgtgattgaggctgtgtatgctgacgtgcttcgtggctccctggaccagcgcaaccagcggctcgaggttgactacagcatcgggcgggacatccagcgccaggacctcagtgccattgcccgaaccctgcaggaatggtgtgtgggctgtgaggtcgtgctgtcaggcattgaggagcaggtgagccgtgccaaccaacacaaggagcagcagctgggcctgaagcagcagattgagagtgaggttgccaaccttaaaaaaaccattaaagttacgacggcagcagcagccgcagccacatctcaggaccctgagcaacacctgactgagctgagggaaccagctcctggcaccaaccagcgccagcccagcaagaaagcctcaaagggcaaggggctccgagggagcgccaagatttggtccaagtcgaattgaaagaactgtcgtttcctccctggggatgtggggtcccagctgcctgcctgcctcttaggagtcctcagagagccttctgtgcccctggccagctgataatcctaggttcatgacccttcacctcccctaaccccaaacatagatcacaccttctctagggaggagtcaaatgtaggtcatgtttttgttggtactttctgttttttgtgacttcatgtgttccattgctccccgctgccatgctctctcccttgtttccttaagagctcagcatctgtccctgttcattacatgtcattgagtaggtgggtagccctgatgggggtcgctctgtctggagcataacccacaggcgttttttctgccaccccatccctgcatgcctgatccccagttcctataccctacccctgacctattgagcagcctctgaagagccatagggcccccacctttactcacaccctgagaattctgggagccagtctgccatgccaggagtcactggacatgttcatcctagaatcctgtcacactacagtcatttcttttcctctctctggcccttgggtcctgggaatgctgctgcttcaaccccagagcctaagaatggcagccgtttcttaacatgttgagagatgattctttcttggccctggccatctcgggaagcttgatggcaatcctggaagggtttaatctccttttgtgagtttggtggggaagggaagggtatatagattgtattaaaaaaaaaaaggtatatatgcatatatctatatataatatgacgcagaaataaatctatgagaaatcta

SEQ ID NO: 24464 - DNA, 2757 bp, Homo sapiens
cgccatagagtttagtggccagaagcgactcttcagggaggtggcaggaaaggcttggaacagctgccggaggtgacggagcggcggccccgcccggtgcgctggaggtcgaagcttccaggtagcggcccgcagagcctgacccaggctctggacatcctgagcccaagtcccccacactcagtgcagtgatgagtgcggaagtgaaggtgacagggcagaaccaggagcaatttctgctcctagccaagtcggccaagggggcagcgctggccacactcatccatcaggtgctggaggcccctggtgtctacgtgtttggagaactgctggacatgcccaatgttagagagctggctgagagtgactttgcctctaccttccggctgctcacagtgtttgcttatgggacatacgctgactacttagctgaagcccggaatcttcctccactaacagaggctcagaagaataagcttcgacacctctcagttgtcaccctggctgctaaagtaaagtgtatcccatatgcagtgttgctggaggctcttgccctgcgtaatgtgcggcagctggaagaccttgtgattgaggctgtgtatgctgacgtgcttcgtggctccctggaccagcgcaaccagcggctcgaggttgactacagcatcgggcgggacatccagcgccaggacctcagtgccattgcccgaaccctgcaggaatggtgtgtgggctgtgaggtcgtgctgtcaggcattgaggagcaggtgagccgtgccaaccaacacaaggagcagcagctgggcctgaagcagcagattgagagtgaggttgccaaccttaaaaaaaccattaaagttacgacggcagcagcagccgcagccacatctcaggaccctgagcaacacctgactgagctgagggaaccagctcctggcaccaaccagcgccagcccagcaagaaagcctcaaagggcaaggggctccgagggagcgccaagatttggtccaagtcgaattgaaagaactgtcgtttcctccctggggatgtggggtcccagctgcctgcctgcctcttaggagtcctcagagagccttctgtgcccctggccagctgataatcctaggttcatgacccttcacctcccctaaccccaaacatagatcacaccttctctagggaggagtcaaatgtaggtcatgtttttgttggtactttctgttttttgtgacttcatgtgttccattgctccccgctgccatgctctctcccttgtttccttaagagctcagcatctgtccctgttcattacatgtcattgagtaggtgggtagccctgatgggggtcgctctgtctggagcataacccacaggcgttttttctgccaccccatccctgcatgcctgatccccagttcctataccctacccctgacctattgagcagcctctgaagagccatagggcccccacctttactcacaccctgagaattctgggagccagtctgccatgccaggagtcactggacatgttcatcctagaatcctgtcacactacagtcatttcttttcctctctctggcccttgggtcctgggaatgctgctgcttcaaccccagagcctaagaatggcagccgtttcttaacatgttgagagatgattctttcttggccctggccatctcgggaagcttgatggcaatcctggaagggtttaatctccttttgtgagtttggtggggaagggaagggtatatagattgtattaaaaaaaaaaaggtatatatgcatatatctatatataatatgacgcagaaataaatctatgagaaatctaaaaaaaaaaaaaaaaaaaaaaaaaacaaaaaaaaaaacaccaaaaagcaaaaaaacaaaaaagcgggggcgccggccaataagaacatcgacacaggggcgacacacagcgaacagcacacacccagagacacaggtaggcgcataagaaggggcgcccaacaacgagagcagcgcctgaacaaacaaacagcagagcaaggcgcgcgcgcacaagcgtacacagaccacacaaacggcaccaccaccgggccacgacagggcggagacaccagcgcgcagccggggacggaccacagacacagaacagagcggggaggggacgaacaaacagacgagggcgcaacacaacgacccgcgcgccggacacgatacgaagaccgacgacgtacatctgagaggaagggaacagcacacgacgcgcactactccgcggggggcggtacaagccgaggcagcgggcggaagagcgcaacaaggagagcccagagacacagccgatcaacgcaggagcccggcagaccgcagagaacacgacccacacgaccaacagcacagagcagaagaagataacacccgacagcccaccacaggacagagacacgacaactccctgcccacgctgcgcggaggggagcagtacgcagagagaaacacgcgaagccaagaaccccggccgaagacacacacgacgatcgagagaaccgacggcaacgcagacaccgaaggcacgcaggccacgcagcaaggactaccacaacgctgccacagaccagacagatgggcgacgcgagccgcaccgacggacaggcacgcaaggaacaacacaaccacggcagagctacagacccaaggaagcgacgcaccagtcacacgccacgcacagcgtctacaaccacagcgacccaagaggacgccgcc

SEQ ID NO: 24465 - DNA, 3688 bp, Homo sapiens
cagagagcaaatcccatttattggaatttcactgacaacaaattgagaggaaggcttccccctcccctgaaacatgccatcctctctgccctcagggctcagcacagggataagacccccactccgcatgtccccagagggcagcactccaggggggtgggggggaggggaggggtgctctacgccaggctggggagctgggacaggagggaagacgtgcaccctcacctcttggctcaatccctctccccgggacctggtgctgcccccagtccctggggtgggctggcagacagggctcatgcaacaatgagtagacaggaggtggcacggaaacgtggccttggtgccccttggcgggggcgggaggactaaaggggccatgctgtggccacagcgggtccaaatggaagtatctgcagtgtacatacaggagggttggagagaggcatccttttccctaggctgtgcctggggacaagagagaggggaagtacagctggcactgccgtgccaggggcagggtccaggccagccgtgccacctgagcgggcacagcgagctggagctcggctactccttggcgcggccaatgatggtgaggatgtacaggaagatgttgatgatgtctgtgtacaggttcagcgcagcaaacacatactcttctgggctcagggacagctgcttgttccccagcagcagctgggtgtccactgcgaggaagcaggtgaagagcagagcgcccagtgaggcgtacacgatctccaggatgcggttccggatgaagatgcagagaatggcgaagatgaagagcaccaccatgctcaccaggagcacgcccatgcatgaggtgaagtcgtagcgggtctgcatggagaagatgacgacggtgaagcagacggctgtggtgatgcccacggccatgatgactgcctcggtgttgtagaagctggcgatcatccccaccatgtacgacaggctggcggtcaggaccgacagtgcaacaaggttccaggggtgctttcgccggaagtccccacaacagctgaggacgatgagagagatgaagaagacagcataggagacatagtaggtccagacattctcccggacaaagcccttcacctccgcaacaaaagtgaacacagacaccgtggacagggtcaccgacagctgcaaggtcagcactaggaacaccttgcggatgaaggcctgtcggatgctcttgtcatcccagttggtggcagggaagtcctggttgtcatagtaggatgggggaccctcctcctggtagtttccatgctggggtgagtcagggtcttgtcctgggaagacctgtggctgtccataggggttgggggggaaggggctctggggatatggcccctgggggtagcccccttgggggtaggggccctgtgggtagccctcttgtgggtaggggccctgtgggtagcccccttgggggtagggaccctgtgggtagcccccttgggggtaggggctggggccatgggggtaccctggctgaccgtagggggagggctggaaagggggctgtgggtaaggggccccagggtagggaggctgagcataggggggcatgggtggctggggcccccccggatatccagggttggggggaggatagttgtccccagacaccaaaaaactcttttcatgggacatggcctcgggttccgcggtccgccccggtggccgggcgccgcaggccggtacgcacggtgtccgctgcgcggccgcgcggtgatggccgatgcgcccgcacccgcacccgctcggagcgactcttcagggaggtggcaggaaaggcttggaacagctgccggaggtgacggagcggcggccccgcccggtgcgctggaggtcgaagcttccaggtagcggcccgcagagcctgacccagggtacgacgaagcagtcggcgggagcccacggtcgctgggcggtgtctttaagggagggggcggagccacgtctctggacatcctgagcccaagtcccccacactcagtgcagtgatgagtgcggaagtgaaggtgacagggcagaaccaggagcaatttctgctcctagccaagtcggccaagggggcagcgctggccacactcatccatcaggtgctggaggcccctggtgtctacgtgtttggagaactgctggacatgcccaatgttagagagctggctgagagtgactttgcctctaccttccggctgctcacagtgtttgcttatgggacatacgctgactacttagctgaagcccggaatcttcctccactaacagaggctcagaagaataagcttcgacacctctcagttgtcaccctggctgctaaagtaaagtgtatcccatatgcagtgttgctggaggctcttgccctgcgtaatgtgcggcagctggaagaccttgtgattgaggctgtgtatgctgacgtgcttcgtggctccctggaccagcgcaaccagcggctcgaggttgactacagcatcgggcgggacatccagcgccaggacctcagtgccattgcccgaaccctgcaggaatggtgtgtgggctgtgaggtcgtgctgtcaggcattgaggagcaggtgagccgtgccaaccaacacaaggagcagcagctgggcctgaagcagcagattgagagtgaggttgccaaccttaaaaaaaccattaaagttacgacggcagcagcagccgcagccacatctcaggaccctgagcaacacctgactgagctgagggaaccagctcctggcaccaaccagcgccagcccagcaagaaagcctcaaagggcaaggggctccgagggagcgccaagatttggtccaagtcgaattgaaagaactgtcgtttcctccctggggatgtggggtcccagctgcctgcctgcctcttaggagtcctcagagagccttctgtgcccctggccagctgataatcctaggttcatgacccttcacctcccctaaccccaaacatagatcacaccttctctagggaggagtcaaatgtaggtcatgtttttgttggtactttctgttttttgtgacttcatgtgttccattgctccccgctgccatgctctctcccttgtttccttaagagctcagcatctgtccctgttcattacatgtcattgagtaggtgggtagccctgatgggggtcgctctgtctggagcataacccacaggcgttttttctgccaccccatccctgcatgcctgatccccagttcctataccctacccctgacctattgagcagcctctgaagagccatagggcccccacctttactcacaccctgagaattctgggagccagtctgccatgccaggagtcactggacatgttcatcctagaatcctgtcacactacagtcatttcttttcctctctctggcccttgggtcctgggaatgctgctgcttcaaccccagagcctaagaatggcagccgtttcttaacatgttgagagatgattctttcttggccctggccatctcgggaagcttgatggcaatcctggaagggtttaatctccttttgtgagtttggtggggaagggaagggtatatagattgtattaaaaaaaaaaaggtatatatgcatatatctatatataatatgacgcagaaataaatctatgagaaatcta

SEQ ID NO: 24466 - DNA, 1729 bp, Homo sapiens
gtgcggggcagcaatggagagctgagggagcgtcgtcaggctctggacatcctgagcccaagtcccccacactcagtgcagtgatgagtgcggaagtgaaggtgacagggcagaaccaggagcaatttctgctcctagccaagtcggccaagggggcagcgctggccacactcatccatcaggtgctggaggcccctggtgtctacgtgtttggagaactgctggacatgcccaatgttagagagctggctgagagtgactttgcctctaccttccggctgctcacagtgtttgcttatgggacatacgctgactacttagctgaagcccggaatcttcctccactaacagaggctcagaagaataagcttcgacacctctcagttgtcaccctggctgctaaagtaaagtgtatcccatatgcagtgttgctggaggctcttgccctgcgtaatgtgcggcagctggaagaccttgtgattgaggctgtgtatgctgacgtgcttcgtggctccctggaccagcgcaaccagcggctcgaggttgactacagcatcgggcgggacatccagcgccaggacctcagtgccattgcccgaaccctgcaggaatggtgtgtgggctgtgaggtcgtgctgtcaggcattgaggagcaggtgagccgtgccaaccaacacaaggagcagcagctgggcctgaagcagcagattgagagtgaggttgccaaccttaaaaaaaccattaaagttacgacggcagcagcagccgcagccacatctcaggaccctgagcaacacctgactgagctgagggaaccagctcctggcaccaaccagcgccagcccagcaagaaagcctcaaagggcaaggggctccgagggagcgccaagatttggtccaagtcgaattgaaagaactgtcgtttcctccctggggatgtggggtcccagctgcctgcctgcctcttaggagtcctcagagagccttctgtgcccctggccagctgataatcctaggttcatgacccttcacctcccctaaccccaaacatagatcacaccttctctagggaggagtcaaatgtaggtcatgtttttgttggtactttctgttttttgtgacttcatgtgttccattgctccccgctgccatgctctctcccttgtttccttaagagctcagcatctgtccctgttcattacatgtcattgagtaggtgggtagccctgatgggggtcgctctgtctggagcataacccacaggcgttttttctgccaccccatccctgcatgcctgatccccagttcctataccctacccctgacctattgagcagcctctgaagagccatagggcccccacctttactcacaccctgagaattctgggagccagtctgccatgccaggagtcactggacatgttcatcctagaatcctgtcacactacagtcatttcttttcctctctctggcccttgggtcctgggaatgctgctgcttcaaccccagagcctaagaatggcagccgtttcttaacatgttgagagatgattctttcttggccctggccatctcgggaagcttgatggcaatcctggaagggtttaatctccttttgtgagtttggtggggaagggaagggtatatagattgtattaaaaaaaaaaaggtatatatgcatatatctatatataatatgacgcagaaataaatctatgagaaatcta

SEQ ID NO: 24467 - DNA, 3541 bp, Homo sapiens
cagagagcaaatcccatttattggaatttcactgacaacaaattgagaggaaggcttccccctcccctgaaacatgccatcctctctgccctcagggctcagcacagggataagacccccactccgcatgtccccagagggcagcactccaggggggtgggggggaggggaggggtgctctacgccaggctggggagctgggacaggagggaagacgtgcaccctcacctcttggctcaatccctctccccgggacctggtgctgcccccagtccctggggtgggctggcagacagggctcatgcaacaatgagtagacaggaggtggcacggaaacgtggccttggtgccccttggcgggggcgggaggactaaaggggccatgctgtggccacagcgggtccaaatggaagtatctgcagtgtacatacaggagggttggagagaggcatccttttccctaggctgtgcctggggacaagagagaggggaagtacagctggcactgccgtgccaggggcagggtccaggccagccgtgccacctgagcgggcacagcgagctggagctcggctactccttggcgcggccaatgatggtgaggatgtacaggaagatgttgatgatgtctgtgtacaggttcagcgcagcaaacacatactcttctgggctcagggacagctgcttgttccccagcagcagctgggtgtccactgcgaggaagcaggtgaagagcagagcgcccagtgaggcgtacacgatctccaggatgcggttccggatgaagatgcagagaatggcgaagatgaagagcaccaccatgctcaccaggagcacgcccatgcatgaggtgaagtcgtagcgggtctgcatggagaagatgacgacggtgaagcagacggctgtggtgatgcccacggccatgatgactgcctcggtgttgtagaagctggcgatcatccccaccatgtacgacaggctggcggtcaggaccgacagtgcaacaaggttccaggggtgctttcgccggaagtccccacaacagctgaggacgatgagagagatgaagaagacagcataggagacatagtaggtccagacattctcccggacaaagcccttcacctccgcaacaaaagtgaacacagacaccgtggacagggtcaccgacagctgcaaggtcagcactaggaacaccttgcggatgaaggcctgtcggatgctcttgtcatcccagttggtggcagggaagtcctggttgtcatagtaggatgggggaccctcctcctggtagtttccatgctggggtgagtcagggtcttgtcctgggaagacctgtggctgtccataggggttgggggggaaggggctctggggatatggcccctgggggtagcccccttgggggtaggggccctgtgggtagccctcttgtgggtaggggccctgtgggtagcccccttgggggtagggaccctgtgggtagcccccttgggggtaggggctggggccatgggggtaccctggctgaccgtagggggagggctggaaagggggctgtgggtaaggggccccagggtagggaggctgagcataggggggcatgggtggctggggcccccccggatatccagggttggggggaggatagttgtccccagacaccaaaaaactcttttcatgggacatggcctcgggttccgcggtccgccccggtggccgggcgccgcaggccggtacgcacggtgtccgctgcgcggccgcgcggtgatggccgatgcgcccgcacccgcacccgctcggagcgactcttcagggaggtggcaggaaaggcttggaacagctgccggaggtgacggagcggcggccccgcccggtgcgctggaggtcgaagcttccaggtagcggcccgcagagcctgacccaggctctggacatcctgagcccaagtcccccacactcagtgcagtgatgagtgcggaagtgaaggtgacagggcagaaccaggagcaatttctgctcctagccaagtcggccaagggggcagcgctggccacactcatccatcaggtgctggaggcccctggtgtctacgtgtttggagaactgctggacatgcccaatgttagagagctgaagcccggaatcttcctccactaacagaggctcagaagaataagcttcgacacctctcagttgtcaccctggctgctaaagtaaagtgtatcccatatgcagtgttgctggaggctcttgccctgcgtaatgtgcggcagctggaagaccttgtgattgaggctgtgtatgctgacgtgcttcgtggctccctggaccagcgcaaccagcggctcgaggttgactacagcatcgggcgggacatccagcgccaggacctcagtgccattgcccgaaccctgcaggaatggtgtgtgggctgtgaggtcgtgctgtcaggcattgaggagcaggtgagccgtgccaaccaacacaaggagcagcagctgggcctgaagcagcagattgagagtgaggttgccaaccttaaaaaaaccattaaagttacgacggcagcagcagccgcagccacatctcaggaccctgagcaacacctgactgagctgagggaaccagctcctggcaccaaccagcgccagcccagcaagaaagcctcaaagggcaaggggctccgagggagcgccaagatttggtccaagtcgaattgaaagaactgtcgtttcctccctggggatgtggggtcccagctgcctgcctgcctcttaggagtcctcagagagccttctgtgcccctggccagctgataatcctaggttcatgacccttcacctcccctaaccccaaacatagatcacaccttctctagggaggagtcaaatgtaggtcatgtttttgttggtactttctgttttttgtgacttcatgtgttccattgctccccgctgccatgctctctcccttgtttccttaagagctcagcatctgtccctgttcattacatgtcattgagtaggtgggtagccctgatgggggtcgctctgtctggagcataacccacaggcgttttttctgccaccccatccctgcatgcctgatccccagttcctataccctacccctgacctattgagcagcctctgaagagccatagggcccccacctttactcacaccctgagaattctgggagccagtctgccatgccaggagtcactggacatgttcatcctagaatcctgtcacactacagtcatttcttttcctctctctggcccttgggtcctgggaatgctgctgcttcaaccccagagcctaagaatggcagccgtttcttaacatgttgagagatgattctttcttggccctggccatctcgggaagcttgatggcaatcctggaagggtttaatctccttttgtgagtttggtggggaagggaagggtatatagattgtattaaaaaaaaaaaggtatatatgcatatatctatatataatatgacgcagaaataaatctatgagaaatcta

SEQ ID NO: 24468 - DNA, 3612 bp, Homo sapiens
cagagagcaaatcccatttattggaatttcactgacaacaaattgagaggaaggcttccccctcccctgaaacatgccatcctctctgccctcagggctcagcacagggataagacccccactccgcatgtccccagagggcagcactccaggggggtgggggggaggggaggggtgctctacgccaggctggggagctgggacaggagggaagacgtgcaccctcacctcttggctcaatccctctccccgggacctggtgctgcccccagtccctggggtgggctggcagacagggctcatgcaacaatgagtagacaggaggtggcacggaaacgtggccttggtgccccttggcgggggcgggaggactaaaggggccatgctgtggccacagcgggtccaaatggaagtatctgcagtgtacatacaggagggttggagagaggcatccttttccctaggctgtgcctggggacaagagagaggggaagtacagctggcactgccgtgccaggggcagggtccaggccagccgtgccacctgagcgggcacagcgagctggagctcggctactccttggcgcggccaatgatggtgaggatgtacaggaagatgttgatgatgtctgtgtacaggttcagcgcagcaaacacatactcttctgggctcagggacagctgcttgttccccagcagcagctgggtgtccactgcgaggaagcaggtgaagagcagagcgcccagtgaggcgtacacgatctccaggatgcggttccggatgaagatgcagagaatggcgaagatgaagagcaccaccatgctcaccaggagcacgcccatgcatgaggtgaagtcgtagcgggtctgcatggagaagatgacgacggtgaagcagacggctgtggtgatgcccacggccatgatgactgcctcggtgttgtagaagctggcgatcatccccaccatgtacgacaggctggcggtcaggaccgacagtgcaacaaggttccaggggtgctttcgccggaagtccccacaacagctgaggacgatgagagagatgaagaagacagcataggagacatagtaggtccagacattctcccggacaaagcccttcacctccgcaacaaaagtgaacacagacaccgtggacagggtcaccgacagctgcaaggtcagcactaggaacaccttgcggatgaaggcctgtcggatgctcttgtcatcccagttggtggcagggaagtcctggttgtcatagtaggatgggggaccctcctcctggtagtttccatgctggggtgagtcagggtcttgtcctgggaagacctgtggctgtccataggggttgggggggaaggggctctggggatatggcccctgggggtagcccccttgggggtaggggccctgtgggtagccctcttgtgggtaggggccctgtgggtagcccccttgggggtagggaccctgtgggtagcccccttgggggtaggggctggggccatgggggtaccctggctgaccgtagggggagggctggaaagggggctgtgggtaaggggccccagggtagggaggctgagcataggggggcatgggtggctggggcccccccggatatccagggttggggggaggatagttgtccccagacaccaaaaaactcttttcatgggacatggcctcgggttccgcggtccgccccggtggccgggcgccgcaggccggtacgcacggtgtccgctgcgcggccgcgcggtgatggccgatgcgcccgcacccgcacccgctcggagcgactcttcagggaggtggcaggaaaggcttggaacagctgccggaggtgacggagcggcggccccgcccggtgcgctggaggtcgaagcttccaggtagcggcccgcagagcctgacccagggtacgacgaagcagtcggcgggagcccacggtcgctgggcggtgtctttaagggagggggcggagccacgtctctggacatcctgagcccaagtcccccacactcagtgcagtgatgagtgcggaagtgaaggtgacagggcagaaccaggagcaatttctgctcctagccaagtcggccaagggggcagcgctggccacactcatccatcaggtgctggaggcccctggtgtctacgtgtttggagaactgctggacatgcccaatgttagagagctgaagcccggaatcttcctccactaacagaggctcagaagaataagcttcgacacctctcagttgtcaccctggctgctaaagtaaagtgtatcccatatgcagtgttgctggaggctcttgccctgcgtaatgtgcggcagctggaagaccttgtgattgaggctgtgtatgctgacgtgcttcgtggctccctggaccagcgcaaccagcggctcgaggttgactacagcatcgggcgggacatccagcgccaggacctcagtgccattgcccgaaccctgcaggaatggtgtgtgggctgtgaggtcgtgctgtcaggcattgaggagcaggtgagccgtgccaaccaacacaaggagcagcagctgggcctgaagcagcagattgagagtgaggttgccaaccttaaaaaaaccattaaagttacgacggcagcagcagccgcagccacatctcaggaccctgagcaacacctgactgagctgagggaaccagctcctggcaccaaccagcgccagcccagcaagaaagcctcaaagggcaaggggctccgagggagcgccaagatttggtccaagtcgaattgaaagaactgtcgtttcctccctggggatgtggggtcccagctgcctgcctgcctcttaggagtcctcagagagccttctgtgcccctggccagctgataatcctaggttcatgacccttcacctcccctaaccccaaacatagatcacaccttctctagggaggagtcaaatgtaggtcatgtttttgttggtactttctgttttttgtgacttcatgtgttccattgctccccgctgccatgctctctcccttgtttccttaagagctcagcatctgtccctgttcattacatgtcattgagtaggtgggtagccctgatgggggtcgctctgtctggagcataacccacaggcgttttttctgccaccccatccctgcatgcctgatccccagttcctataccctacccctgacctattgagcagcctctgaagagccatagggcccccacctttactcacaccctgagaattctgggagccagtctgccatgccaggagtcactggacatgttcatcctagaatcctgtcacactacagtcatttcttttcctctctctggcccttgggtcctgggaatgctgctgcttcaaccccagagcctaagaatggcagccgtttcttaacatgttgagagatgattctttcttggccctggccatctcgggaagcttgatggcaatcctggaagggtttaatctccttttgtgagtttggtggggaagggaagggtatatagattgtattaaaaaaaaaaaggtatatatgcatatatctatatataatatgacgcagaaataaatctatgagaaatcta

SEQ ID NO: 24469 - DNA, 1696 bp, Homo sapiens
gtgcggggcagcaatggagagctgagggagcgtcgtcagggtggacaccatgcgacacccatttctcctttgcatcctgtgtcctctggacatcctgagcccaagtcccccacactcagtgcagtgatgagtgcggaagtgaaggtgacagggcagaaccaggagcaatttctgctcctagccaagtcggccaagggggcagcgctggccacactcatccatcaggtgctggaggcccctggtgtctacgtgtttggagaactgctggacatgcccaatgttagagagctgaagcccggaatcttcctccactaacagaggctcagaagaataagcttcgacacctctcagttgtcaccctggctgctaaagtaaagtgtatcccatatgcagtgttgctggaggctcttgccctgcgtaatgtgcggcagctggaagaccttgtgattgaggctgtgtatgctgacgtgcttcgtggctccctggaccagcgcaaccagcggctcgaggttgactacagcatcgggcgggacatccagcgccaggacctcagtgccattgcccgaaccctgcaggaatggtgtgtgggctgtgaggtcgtgctgtcaggcattgaggagcaggtgagccgtgccaaccaacacaaggagcagcagctgggcctgaagcagcagattgagagtgaggttgccaaccttaaaaaaaccattaaagttacgacggcagcagcagccgcagccacatctcaggaccctgagcaacacctgactgagctgagggaaccagctcctggcaccaaccagcgccagcccagcaagaaagcctcaaagggcaaggggctccgagggagcgccaagatttggtccaagtcgaattgaaagaactgtcgtttcctccctggggatgtggggtcccagctgcctgcctgcctcttaggagtcctcagagagccttctgtgcccctggccagctgataatcctaggttcatgacccttcacctcccctaaccccaaacatagatcacaccttctctagggaggagtcaaatgtaggtcatgtttttgttggtactttctgttttttgtgacttcatgtgttccattgctccccgctgccatgctctctcccttgtttccttaagagctcagcatctgtccctgttcattacatgtcattgagtaggtgggtagccctgatgggggtcgctctgtctggagcataacccacaggcgttttttctgccaccccatccctgcatgcctgatccccagttcctataccctacccctgacctattgagcagcctctgaagagccatagggcccccacctttactcacaccctgagaattctgggagccagtctgccatgccaggagtcactggacatgttcatcctagaatcctgtcacactacagtcatttcttttcctctctctggcccttgggtcctgggaatgctgctgcttcaaccccagagcctaagaatggcagccgtttcttaacatgttgagagatgattctttcttggccctggccatctcgggaagcttgatggcaatcctggaagggtttaatctccttttgtgagtttggtggggaagggaagggtatatagattgtattaaaaaaaaaaaggtatatatgcatatatctatatataatatgacgcagaaataaatctatgagaaatcta

SEQ ID NO: 24470 - DNA, 2016 bp, Homo sapiens
cgccatagagtttagtggccagaagcgactcttcagggaggtggcaggaaaggcttggaacagctgccggaggtgacggagcggcggccccgcccggtgcgctggaggtcgaagcttccaggtagcggcccgcagagcctgacccaggctctggacatcctgagcccaagtcccccacactcagtgcagtgatgagtgcggaagtgaaggtgacagggcagaaccaggagcaatttctgctcctagccaagtcggccaagggggcagcgctggccacactcatccatcaggtgctggaggcccctggtgtctacgtgtttggagaactgctggacatgcccaatgttagagagctggctgagagtgactttgcctctaccttccggctgctcacagtgtttgcttatgggacatacgctgactacttagctgaagcccggaatcttcctccactaacagaggctcagaagaataagcttcgacacctctcagttgtcaccctggctgctaaagtaaagtgtatcccatatgcagtgttgctggaggctcttgccctgcgtaatgtgcggcagctggaagaccttgtgattgaggctgtgtatgctgacgtgcttcgtggctccctggaccagcgcaaccagcggctcgaggttgactacagcatcgggcgggacatccagcgccaggacctcagtgccattgcccgaaccctgcaggaatggtgtgtgggctgtgaggtcgtgctgtcaggcattgaggagcaggtgagccgtgccaaccaacacaaggagcagcagctgggcctgaagcagcagattgagagtgaggttgccaaccttaaaaaaaccattaaagttacgacggcagcagcagccgcagccacatctcaggaccctgagcaacacctgactgagctgagggaaccagctcctggcaccaaccagcgccagcccagcaagaaagcctcaaagggcaaggggtgagccagggtagcaggaactgctcacttgcagggtgccctgcttttaccccagggacctcactgtcctcatttccttcagttatttgcatgggagtagggagtgggggagcctccaggggttaggggattccctgcattctctctctctctctctttctctctcttctccttgccaggctccgagggagcgccaagatttggtccaagtcgaattgaaagaactgtcgtttcctccctggggatgtggggtcccagctgcctgcctgcctcttaggagtcctcagagagccttctgtgcccctggccagctgataatcctaggttcatgacccttcacctcccctaaccccaaacatagatcacaccttctctagggaggagtcaaatgtaggtcatgtttttgttggtactttctgttttttgtgacttcatgtgttccattgctccccgctgccatgctctctcccttgtttccttaagagctcagcatctgtccctgttcattacatgtcattgagtaggtgggtagccctgatgggggtcgctctgtctggagcataacccacaggcgttttttctgccaccccatccctgcatgcctgatccccagttcctataccctacccctgacctattgagcagcctctgaagagccatagggcccccacctttactcacaccctgagaattctgggagccagtctgccatgccaggagtcactggacatgttcatcctagaatcctgtcacactacagtcatttcttttcctctctctggcccttgggtcctgggaatgctgctgcttcaaccccagagcctaagaatggcagccgtttcttaacatgttgagagatgattctttcttggccctggccatctcgggaagcttgatggcaatcctggaagggtttaatctccttttgtgagtttggtggggaagggaagggtatatagattgtattaaaaaaaaaaaggtatatatgcatatatctatatataatatgacgcagaaataaatctatgagaaatcta

SEQ ID NO: 24471 - DNA, 3309 bp, Homo sapiens
cagagagcaaatcccatttattggaatttcactgacaacaaattgagaggaaggcttccccctcccctgaaacatgccatcctctctgccctcagggctcagcacagggataagacccccactccgcatgtccccagagggcagcactccaggggggtgggggggaggggaggggtgctctacgccaggctggggagctgggacaggagggaagacgtgcaccctcacctcttggctcaatccctctccccgggacctggtgctgcccccagtccctggggtgggctggcagacagggctcatgcaacaatgagtagacaggaggtggcacggaaacgtggccttggtgccccttggcgggggcgggaggactaaaggggccatgctgtggccacagcgggtccaaatggaagtatctgcagtgtacatacaggagggttggagagaggcatccttttccctaggctgtgcctggggacaagagagaggggaagtacagctggcactgccgtgccaggggcagggtccaggccagccgtgccacctgagcgggcacagcgagctggagctcggctactccttggcgcggccaatgatggtgaggatgtacaggaagatgttgatgatgtctgtgtacaggttcagcgcagcaaacacatactcttctgggctcagggacagctgcttgttccccagcagcagctgggtgtccactgcgaggaagcaggtgaagagcagagcgcccagtgaggcgtacacgatctccaggatgcggttccggatgaagatgcagagaatggcgaagatgaagagcaccaccatgctcaccaggagcacgcccatgcatgaggtgaagtcgtagcgggtctgcatggagaagatgacgacggtgaagcagacggctgtggtgatgcccacggccatgatgactgcctcggtgttgtagaagctggcgatcatccccaccatgtacgacaggctggcggtcaggaccgacagtgcaacaaggttccaggggtgctttcgccggaagtccccacaacagctgaggacgatgagagagatgaagaagacagcataggagacatagtaggtccagacattctcccggacaaagcccttcacctccgcaacaaaagtgaacacagacaccgtggacagggtcaccgacagctgcaaggtcagcactaggaacaccttgcggatgaaggcctgtcggatgctcttgtcatcccagttggtggcagggaagtcctggttgtcatagtaggatgggggaccctcctcctggtagtttccatgctggggtgagtcagggtcttgtcctgggaagacctgtggctgtccataggggttgggggggaaggggctctggggatatggcccctgggggtagcccccttgggggtaggggccctgtgggtagccctcttgtgggtaggggccctgtgggtagcccccttgggggtagggaccctgtgggtagcccccttgggggtaggggctggggccatgggggtaccctggctgaccgtagggggagggctggaaagggggctgtgggtaaggggccccagggtagggaggctgagcataggggggcatgggtggctggggcccccccggatatccagggttggggggaggatagttgtccccagacaccaaaaaactcttttcatgggacatggcctcgggttccgcggtccgccccggtggccgggcgccgcaggccggtacgcacggtgtccgctgcgcggccgcgcggtgatggccgatgcgcccgcacccgcacccgctcggagcgactcttcagggaggtggcaggaaaggcttggaacagctgccggaggtgacggagcggcggccccgcccggtgcgctggaggtcgaagcttccagctgaagcccggaatcttcctccactaacagaggctcagaagaataagcttcgacacctctcagttgtcaccctggctgctaaagtaaagtgtatcccatatgcagtgttgctggaggctcttgccctgcgtaatgtgcggcagctggaagaccttgtgattgaggctgtgtatgctgacgtgcttcgtggctccctggaccagcgcaaccagcggctcgaggttgactacagcatcgggcgggacatccagcgccaggacctcagtgccattgcccgaaccctgcaggaatggtgtgtgggctgtgaggtcgtgctgtcaggcattgaggagcaggtgagccgtgccaaccaacacaaggagcagcagctgggcctgaagcagcagattgagagtgaggttgccaaccttaaaaaaaccattaaagttacgacggcagcagcagccgcagccacatctcaggaccctgagcaacacctgactgagctgagggaaccagctcctggcaccaaccagcgccagcccagcaagaaagcctcaaagggcaaggggctccgagggagcgccaagatttggtccaagtcgaattgaaagaactgtcgtttcctccctggggatgtggggtcccagctgcctgcctgcctcttaggagtcctcagagagccttctgtgcccctggccagctgataatcctaggttcatgacccttcacctcccctaaccccaaacatagatcacaccttctctagggaggagtcaaatgtaggtcatgtttttgttggtactttctgttttttgtgacttcatgtgttccattgctccccgctgccatgctctctcccttgtttccttaagagctcagcatctgtccctgttcattacatgtcattgagtaggtgggtagccctgatgggggtcgctctgtctggagcataacccacaggcgttttttctgccaccccatccctgcatgcctgatccccagttcctataccctacccctgacctattgagcagcctctgaagagccatagggcccccacctttactcacaccctgagaattctgggagccagtctgccatgccaggagtcactggacatgttcatcctagaatcctgtcacactacagtcatttcttttcctctctctggcccttgggtcctgggaatgctgctgcttcaaccccagagcctaagaatggcagccgtttcttaacatgttgagagatgattctttcttggccctggccatctcgggaagcttgatggcaatcctggaagggtttaatctccttttgtgagtttggtggggaagggaagggtatatagattgtattaaaaaaaaaaaggtatatatgcatatatctatatataatatgacgcagaaataaatctatgagaaatcta

SEQ ID NO: 24472 - DNA, 1789 bp, Homo sapiens
cgccatagagtttagtggccagaagcgactcttcagggaggtggcaggaaaggcttggaacagctgccggaggtgacggagcggcggccccgcccggtgcgctggaggtcgaagcttccaggtagcggcccgcagagcctgacccaggctctggacatcctgagcccaagtcccccacactcagtgcagtgatgagtgcggaagtgaaggtgacagggcagaaccaggagcaatttctgctcctagccaagtcggccaagggggcagcgctggccacactcatccatcaggtgctggaggcccctggtgtctacgtgtttggagaactgctggacatgcccaatgttagagagctggctgagagtgactttgcctctaccttccggctgctcacagtgtttgcttatgggacatacgctgactacttagctgaagcccggaatcttcctccactaacagaggctcagaagaataagcttcgacacctctcagttgtcaccctggctgctaaagtaaagtgtatcccatatgcagtgttgctggaggctcttgccctgcgtaatgtgcggcagctggaagaccttgtgattgaggctgtgtatgctgacgtgcttcgtggctccctggaccagcgcaaccagcggctcgaggttgactacagcatcgggcgggacatccagcgccaggacctcagtgccattgcccgaaccctgcaggaatggtgtgtgggctgtgaggtcgtgctgtcaggcattgaggagcaggtgagccgtgccaaccaacacaaggagcagcagctgggcctgaagcagcagattgagagtgaggttgccaaccttaaaaaaaccattaaagttacgacggcagcagcagccgcagccacatctcaggaccctgagcaacacctgactgagctgagggaaccagctcctggcaccaaccagcgccagcccagcaagaaagcctcaaagggcaaggggctccgagggagcgccaagatttggtccaagtcgaattgaaagaactgtcgtttcctcagagagccttctgtgcccctggccagctgataatcctaggttcatgacccttcacctcccctaaccccaaacatagatcacaccttctctagggaggagtcaaatgtaggtcatgtttttgttggtactttctgttttttgtgacttcatgtgttccattgctccccgctgccatgctctctcccttgtttccttaagagctcagcatctgtccctgttcattacatgtcattgagtaggtgggtagccctgatgggggtcgctctgtctggagcataacccacaggcgttttttctgccaccccatccctgcatgcctgatccccagttcctataccctacccctgacctattgagcagcctctgaagagccatagggcccccacctttactcacaccctgagaattctgggagccagtctgccatgccaggagtcactggacatgttcatcctagaatcctgtcacactacagtcatttcttttcctctctctggcccttgggtcctgggaatgctgctgcttcaaccccagagcctaagaatggcagccgtttcttaacatgttgagagatgattctttcttggccctggccatctcgggaagcttgatggcaatcctggaagggtttaatctccttttgtgagtttggtggggaagggaagggtatatagattgtattaaaaaaaaaaaggtatatatgcatatatctatatataatatgacgcagaaataaatctatgagaaatcta

SEQ ID NO: 24473 - DNA, 3536 bp, Homo sapiens
cagagagcaaatcccatttattggaatttcactgacaacaaattgagaggaaggcttccccctcccctgaaacatgccatcctctctgccctcagggctcagcacagggataagacccccactccgcatgtccccagagggcagcactccaggggggtgggggggaggggaggggtgctctacgccaggctggggagctgggacaggagggaagacgtgcaccctcacctcttggctcaatccctctccccgggacctggtgctgcccccagtccctggggtgggctggcagacagggctcatgcaacaatgagtagacaggaggtggcacggaaacgtggccttggtgccccttggcgggggcgggaggactaaaggggccatgctgtggccacagcgggtccaaatggaagtatctgcagtgtacatacaggagggttggagagaggcatccttttccctaggctgtgcctggggacaagagagaggggaagtacagctggcactgccgtgccaggggcagggtccaggccagccgtgccacctgagcgggcacagcgagctggagctcggctactccttggcgcggccaatgatggtgaggatgtacaggaagatgttgatgatgtctgtgtacaggttcagcgcagcaaacacatactcttctgggctcagggacagctgcttgttccccagcagcagctgggtgtccactgcgaggaagcaggtgaagagcagagcgcccagtgaggcgtacacgatctccaggatgcggttccggatgaagatgcagagaatggcgaagatgaagagcaccaccatgctcaccaggagcacgcccatgcatgaggtgaagtcgtagcgggtctgcatggagaagatgacgacggtgaagcagacggctgtggtgatgcccacggccatgatgactgcctcggtgttgtagaagctggcgatcatccccaccatgtacgacaggctggcggtcaggaccgacagtgcaacaaggttccaggggtgctttcgccggaagtccccacaacagctgaggacgatgagagagatgaagaagacagcataggagacatagtaggtccagacattctcccggacaaagcccttcacctccgcaacaaaagtgaacacagacaccgtggacagggtcaccgacagctgcaaggtcagcactaggaacaccttgcggatgaaggcctgtcggatgctcttgtcatcccagttggtggcagggaagtcctggttgtcatagtaggatgggggaccctcctcctggtagtttccatgctggggtgagtcagggtcttgtcctgggaagacctgtggctgtccataggggttgggggggaaggggctctggggatatggcccctgggggtagcccccttgggggtaggggccctgtgggtagccctcttgtgggtaggggccctgtgggtagcccccttgggggtagggaccctgtgggtagcccccttgggggtaggggctggggccatgggggtaccctggctgaccgtagggggagggctggaaagggggctgtgggtaaggggccccagggtagggaggctgagcataggggggcatgggtggctggggcccccccggatatccagggttggggggaggatagttgtccccagacaccaaaaaactcttttcatgggacatggcctcgggttccgcggtccgccccggtggccgggcgccgcaggccggtacgcacggtgtccgctgcgcggccgcgcggtgatggccgatgcgcccgcacccgcacccgctcggagcgactcttcagggaggtggcaggaaaggcttggaacagctgccggaggtgacggagcggcggccccgcccggtgcgctggaggtcgaagcttccagctctggacatcctgagcccaagtcccccacactcagtgcagtgatgagtgcggaagtgaaggtgacagggcagaaccaggagcaatttctgctcctagccaagtcggccaagggggcagcgctggccacactcatccatcaggtgctggaggcccctggtgtctacgtgtttggagaactgctggacatgcccaatgttagagagctggctgagagtgactttgcctctaccttccggctgctcacagtgtttgcttatgggacatacgctgactacttagctgaagcccggaatcttcctccactaacagaggctcagaagaataagcttcgacacctctcagttgtcaccctggctgctaaagtaaagctggaagaccttgtgattgaggctgtgtatgctgacgtgcttcgtggctccctggaccagcgcaaccagcggctcgaggttgactacagcatcgggcgggacatccagcgccaggacctcagtgccattgcccgaaccctgcaggaatggtgtgtgggctgtgaggtcgtgctgtcaggcattgaggagcaggtgagccgtgccaaccaacacaaggagcagcagctgggcctgaagcagcagattgagagtgaggttgccaaccttaaaaaaaccattaaagttacgacggcagcagcagccgcagccacatctcaggaccctgagcaacacctgactgagctgagggaaccagctcctggcaccaaccagcgccagcccagcaagaaagcctcaaagggcaaggggctccgagggagcgccaagatttggtccaagtcgaattgaaagaactgtcgtttcctccctggggatgtggggtcccagctgcctgcctgcctcttaggagtcctcagagagccttctgtgcccctggccagctgataatcctaggttcatgacccttcacctcccctaaccccaaacatagatcacaccttctctagggaggagtcaaatgtaggtcatgtttttgttggtactttctgttttttgtgacttcatgtgttccattgctccccgctgccatgctctctcccttgtttccttaagagctcagcatctgtccctgttcattacatgtcattgagtaggtgggtagccctgatgggggtcgctctgtctggagcataacccacaggcgttttttctgccaccccatccctgcatgcctgatccccagttcctataccctacccctgacctattgagcagcctctgaagagccatagggcccccacctttactcacaccctgagaattctgggagccagtctgccatgccaggagtcactggacatgttcatcctagaatcctgtcacactacagtcatttcttttcctctctctggcccttgggtcctgggaatgctgctgcttcaaccccagagcctaagaatggcagccgtttcttaacatgttgagagatgattctttcttggccctggccatctcgggaagcttgatggcaatcctggaagggtttaatctccttttgtgagtttggtggggaagggaagggtatatagattgtattaaaaaaaaaaaggtatatatgcatatatctatatataatatgacgcagaaataaatctatgagaaatcta

SEQ ID NO: 24474 - DNA, 3597 bp, Homo sapiens
cagagagcaaatcccatttattggaatttcactgacaacaaattgagaggaaggcttccccctcccctgaaacatgccatcctctctgccctcagggctcagcacagggataagacccccactccgcatgtccccagagggcagcactccaggggggtgggggggaggggaggggtgctctacgccaggctggggagctgggacaggagggaagacgtgcaccctcacctcttggctcaatccctctccccgggacctggtgctgcccccagtccctggggtgggctggcagacagggctcatgcaacaatgagtagacaggaggtggcacggaaacgtggccttggtgccccttggcgggggcgggaggactaaaggggccatgctgtggccacagcgggtccaaatggaagtatctgcagtgtacatacaggagggttggagagaggcatccttttccctaggctgtgcctggggacaagagagaggggaagtacagctggcactgccgtgccaggggcagggtccaggccagccgtgccacctgagcgggcacagcgagctggagctcggctactccttggcgcggccaatgatggtgaggatgtacaggaagatgttgatgatgtctgtgtacaggttcagcgcagcaaacacatactcttctgggctcagggacagctgcttgttccccagcagcagctgggtgtccactgcgaggaagcaggtgaagagcagagcgcccagtgaggcgtacacgatctccaggatgcggttccggatgaagatgcagagaatggcgaagatgaagagcaccaccatgctcaccaggagcacgcccatgcatgaggtgaagtcgtagcgggtctgcatggagaagatgacgacggtgaagcagacggctgtggtgatgcccacggccatgatgactgcctcggtgttgtagaagctggcgatcatccccaccatgtacgacaggctggcggtcaggaccgacagtgcaacaaggttccaggggtgctttcgccggaagtccccacaacagctgaggacgatgagagagatgaagaagacagcataggagacatagtaggtccagacattctcccggacaaagcccttcacctccgcaacaaaagtgaacacagacaccgtggacagggtcaccgacagctgcaaggtcagcactaggaacaccttgcggatgaaggcctgtcggatgctcttgtcatcccagttggtggcagggaagtcctggttgtcatagtaggatgggggaccctcctcctggtagtttccatgctggggtgagtcagggtcttgtcctgggaagacctgtggctgtccataggggttgggggggaaggggctctggggatatggcccctgggggtagcccccttgggggtaggggccctgtgggtagccctcttgtgggtaggggccctgtgggtagcccccttgggggtagggaccctgtgggtagcccccttgggggtaggggctggggccatgggggtaccctggctgaccgtagggggagggctggaaagggggctgtgggtaaggggccccagggtagggaggctgagcataggggggcatgggtggctggggcccccccggatatccagggttggggggaggatagttgtccccagacaccaaaaaactcttttcatgggacatggcctcgggttccgcggtccgccccggtggccgggcgccgcaggccggtacgcacggtgtccgctgcgcggccgcgcggtgatggccgatgcgcccgcacccgcacccgctcggagcgactcttcagggaggtggcaggaaaggcttggaacagctgccggaggtgacggagcggcggccccgcccggtgcgctggaggtcgaagcttccaggtagcggcccgcagagcctgacccaggctctggacatcctgagcccaagtcccccacactcagtgcagtgatgagtgcggaagtgaaggtgacagggcagaaccaggagcaatttctgctcctagccaagtcggccaagggggcagcgctggccacactcatccatcaggtgctggaggcccctggtgtctacgtgtttggagaactgctggacatgcccaatgttagagagctggctgagagtgactttgcctctaccttccggctgctcacagtgtttgcttatgggacatacgctgactacttagctgaagcccggaatcttcctccactaacagaggctcagaagaataagcttcgacacctctcagttgtcaccctggctgctaaagtaaagtgtatcccatatgcagtgttgctggaggctcttgccctgcgtaatgtgcggcagctggaagaccttgtgattgaggctgtgtatgctgacgtgcttcgtggctccctggaccagcgcaaccagcggctcgaggttgactacagcatcgggcgggacatccagcgccaggacctcagtgccattgtgtgtgggctgtgaggtcgtgctgtcaggcattgaggagcaggtgagccgtgccaaccaacacaaggagcagcagctgggcctgaagcagcagattgagagtgaggttgccaaccttaaaaaaaccattaaagttacgacggcagcagcagccgcagccacatctcaggaccctgagcaacacctgactgagctgagggaaccagctcctggcaccaaccagcgccagcccagcaagaaagcctcaaagggcaaggggctccgagggagcgccaagatttggtccaagtcgaattgaaagaactgtcgtttcctccctggggatgtggggtcccagctgcctgcctgcctcttaggagtcctcagagagccttctgtgcccctggccagctgataatcctaggttcatgacccttcacctcccctaaccccaaacatagatcacaccttctctagggaggagtcaaatgtaggtcatgtttttgttggtactttctgttttttgtgacttcatgtgttccattgctccccgctgccatgctctctcccttgtttccttaagagctcagcatctgtccctgttcattacatgtcattgagtaggtgggtagccctgatgggggtcgctctgtctggagcataacccacaggcgttttttctgccaccccatccctgcatgcctgatccccagttcctataccctacccctgacctattgagcagcctctgaagagccatagggcccccacctttactcacaccctgagaattctgggagccagtctgccatgccaggagtcactggacatgttcatcctagaatcctgtcacactacagtcatttcttttcctctctctggcccttgggtcctgggaatgctgctgcttcaaccccagagcctaagaatggcagccgtttcttaacatgttgagagatgattctttcttggccctggccatctcgggaagcttgatggcaatcctggaagggtttaatctccttttgtgagtttggtggggaagggaagggtatatagattgtattaaaaaaaaaaaggtatatatgcatatatctatatataatatgacgcagaaataaatctatgagaaatcta

SEQ ID NO: 24475 - DNA, 3086 bp, Homo sapiens
cagagagcaaatcccatttattggaatttcactgacaacaaattgagaggaaggcttccccctcccctgaaacatgccatcctctctgccctcagggctcagcacagggataagacccccactccgcatgtccccagagggcagcactccaggggggtgggggggaggggaggggtgctctacgccaggctggggagctgggacaggagggaagacgtgcaccctcacctcttggctcaatccctctccccgggacctggtgctgcccccagtccctggggtgggctggcagacagggctcatgcaacaatgagtagacaggaggtggcacggaaacgtggccttggtgccccttggcgggggcgggaggactaaaggggccatgctgtggccacagcgggtccaaatggaagtatctgcagtgtacatacaggagggttggagagaggcatccttttccctaggctgtgcctggggacaagagagaggggaagtacagctggcactgccgtgccaggggcagggtccaggccagccgtgccacctgagcgggcacagcgagctggagctcggctactccttggcgcggccaatgatggtgaggatgtacaggaagatgttgatgatgtctgtgtacaggttcagcgcagcaaacacatactcttctgggctcagggacagctgcttgttccccagcagcagctgggtgtccactgcgaggaagcaggtgaagagcagagcgcccagtgaggcgtacacgatctccaggatgcggttccggatgaagatgcagagaatggcgaagatgaagagcaccaccatgctcaccaggagcacgcccatgcatgaggtgaagtcgtagcgggtctgcatggagaagatgacgacggtgaagcagacggctgtggtgatgcccacggccatgatgactgcctcggtgttgtagaagctggcgatcatccccaccatgtacgacaggctggcggtcaggaccgacagtgcaacaaggttccaggggtgctttcgccggaagtccccacaacagctgaggacgatgagagagatgaagaagacagcataggagacatagtaggtccagacattctcccggacaaagcccttcacctccgcaacaaaagtgaacacagacaccgtggacagggtcaccgacagctgcaaggtcagcactaggaacaccttgcggatgaaggcctgtcggatgctcttgtcatcccagttggtggcagggaagtcctggttgtcatagtaggatgggggaccctcctcctggtagtttccatgctggggtgagtcagggtcttgtcctgggaagacctgtggctgtccataggggttgggggggaaggggctctggggatatggcccctgggggtagcccccttgggggtaggggccctgtgggtagccctcttgtgggtaggggccctgtgggtagcccccttgggggtagggaccctgtgggtagcccccttgggggtaggggctggggccatgggggtaccctggctgaccgtagggggagggctggaaagggggctgtgggtaaggggccccagggtagggaggctgagcataggggggcatgggtggctggggcccccccggatatccagggttggggggaggatagttgtccccagacaccaaaaaactcttttcatgggacatggcctcgggttccgcggtccgccccggtggccgggcgccgcaggccggtacgcacggtgtccgctgcgcggccgcgcggtgatggccgatgcgcccgcacccgcacccgctcggagcgactcttcagggaggtggcaggaaaggcttggaacagctgccggaggtgacggagcggcggccccgcccggtgcgctggaggtcgaagcttccaggtagcggcccgcagagcctgacccagggtacgacgaagcagtcggcgggagcccacggtcgctgggcggtgtctttaagggagggggcggagccacgtctctggacatcctgagcccaagtcccccacactcagtgcagtgatgagtgcggaagtgaaggtgacagggcagaaccaggagcaatttctgctcctagccaagtcggccaagggggcagcgctggccacactcatccatcaggtgctggaggcccctggtgtctacgtgtttggagaatcctggcaccaaccagcgccagcccagcaagaaagcctcaaagggcaaggggctccgagggagcgccaagatttggtccaagtcgaattgaaagaactgtcgtttcctccctggggatgtggggtcccagctgcctgcctgcctcttaggagtcctcagagagccttctgtgcccctggccagctgataatcctaggttcatgacccttcacctcccctaaccccaaacatagatcacaccttctctagggaggagtcaaatgtaggtcatgtttttgttggtactttctgttttttgtgacttcatgtgttccattgctccccgctgccatgctctctcccttgtttccttaagagctcagcatctgtccctgttcattacatgtcattgagtaggtgggtagccctgatgggggtcgctctgtctggagcataacccacaggcgttttttctgccaccccatccctgcatgcctgatccccagttcctataccctacccctgacctattgagcagcctctgaagagccatagggcccccacctttactcacaccctgagaattctgggagccagtctgccatgccaggagtcactggacatgttcatcctagaatcctgtcacactacagtcatttcttttcctctctctggcccttgggtcctgggaatgctgctgcttcaaccccagagcctaagaatggcagccgtttcttaacatgttgagagatgattctttcttggccctggccatctcgggaagcttgatggcaatcctggaagggtttaatctccttttgtgagtttggtggggaagggaagggtatatagattgtattaaaaaaaaaaaggtatatatgcatatatctatatataatatgacgcagaaataaatctatgagaaatcta

SEQ ID NO: 24476 - DNA, 1373 bp, Homo sapiens
cgccatagagtttagtggccagaagcgactcttcagggaggtggcaggaaaggcttggaacagctgccggaggtgacggagcggcggccccgcccggtgcgctggaggtcgaagcttccaggtagcggcccgcagagcctgacccaggctctggacatcctgagcccaagtcccccacactcagtgcagtgatgagtgcggaagtgaaggtgacagggcagaaccaggagcaatttctgctcctagccaagtcggccaagggggcagcgctggccacactcatccatcaggtgctggaggcccctggtgtctacgtgtttggagaactgctggacatgcccaatgttagagagctggctgagagtgactttgcctctaccttccggctgctcacagtgtttgcttatgggacatacgctgactacttagctgaagcccggaatcttcctccactaacagaggctcagaagaataagcttcgacacctctcagttgtcaccctggctgctaaagtaaagtgtatcccatatgcagtgttgctggaggctcttgccctgcgtaatgtgcggcagctggaagaccttgtgattgaggctgtgtatgctgacgtgcttcgtggctccctggaccagcgcaaccagcggctcgaggttgactacagcatcgggcgggacatccagcgccaggacctcagtgccattgcccgaaccctgcaggaatggtgtgtgggctgtgaggtcgtgctgtcaggcattgaggagcaggtgagccgtgccaaccaacacaaggagcagcagctgggcctgaagcagcagattgagagtgaggttgccaaccttaaaaaaaccattaaagttacgacggcagcagcagccgcagccacatctcaggaccctgagcaacacctgactgagctgagggaaccagctcctggcaccaaccagcgccagcccagcaagaaagcctcaaagggcaaggggctccgagggagcgccaagatttggtccaagtcgaattgaaagaactgtcgtttcctccctggggatgtggggtcccagctgcctgcctgcctcttaggagtcctcagagagccttctgtgcccctggccagctgataatcctaggttcatgacccttcacctcccctaaccccagagcctaagaatggcagccgtttcttaacatgttgagagatgattctttcttggccctggccatctcgggaagcttgatggcaatcctggaagggtttaatctccttttgtgagtttggtggggaagggaagggtatatagattgtattaaaaaaaaaaaggtatatatgcatatatctatatataatatgacgcagaaataaatctatgagaaatcta

SEQ ID NO: 24477 - DNA, 1357 bp, Homo sapiens
cgccatagagtttagtggccagaagcgactcttcagggaggtggcaggaaaggcttggaacagctgccggaggtgacggagcggcggccccgcccggtgcgctggaggtcgaagcttccaggtagcggcccgcagagcctgacccaggctctggacatcctgagcccaagtcccccacactcagtgcagtgatgagtgcggaagtgaaggtgacagggcagaaccaggagcaatttctgctcctagccaagtcggccaagggggcagcgctggccacactcatccatcaggtgctggaggcccctggtgtctacgtgtttggagaactgctggacatgcccaatgttagagagctggctgagagtgactttgcctctaccttccggctgctcacagtgtttgcttatgggacatacgctgactacttagctgaagcccggaatcttcctccactaacagaggctcagaagaataagcttcgacacctctcagttgtcaccctggctgctaaagtaaagtgtatcccatatgcagtgttgctggaggctcttgccctgcgtaatgtgcggcagctggaagaccttgtgattgaggctgtgtatgctgacgtgcttcgtggctccctggaccagcgcaaccagcggctcgaggttgactacagcatcgggcgggacatccagcgccaggacctcagtgccattgcccgaaccctgcaggaatggtgtgtgggctgtgaggtcgtgctgtcaggcattgaggagcaggtgagccgtgccaaccaacacaaggagcagcagctgggcctgaagcagcagattgagagtgaggttgccaaccttaaaaaaaccattaaagttacgacggcagcagcagccgcagccacatctcaggaccctgagcaacacctgactgagctgagggaaccagctcctggcaccaaccagcgccagcccagcaagaaagcctcaaagggcaaggggctccgagggagcgccaagatttggtccaagtcgaattgaaagaactgtcgtttcctccctggggatgtggggtcccagctgcctgcctgcctcttaggagtcctcagagagccttctgtgcccccttgggtcctgggaatgctgctgcttcaaccccagagcctaagaatggcagccgtttcttaacatgttgagagatgattctttcttggccctggccatctcgggaagcttgatggcaatcctggaagggtttaatctccttttgtgagtttggtggggaagggaagggtatatagattgtattaaaaaaaaaaaggtatatatgcatatatctatatataatatgacgcagaaataaatctatgagaaatcta

SEQ ID NO: 24478 - DNA, 347 bp, Homo sapiens
atttggacagtggctgtagcagacaaccagatgagcaggggctggaaggttctggaaccttccttgctatccccattcctttcatcctggtaggttgccaaccttaaaaaaaccattaaagttacgacggcagcagcagccgcagccacatctcaggaccctgagcaacacctgactgagctgagggaaccagctcctggcaccaaccagcgccagcccagcaagaaagcctcaaagggcaaggggtgagccagggtagcaggaactgctcacttgcagggtgccctgcttttaccccagggacctcactgtcctcatttccttcagttatttgcatgggagtaggg

SEQ ID NO: 24479 - DNA, 411 bp, Homo sapiens
ccctacccctgacctattgagcagcctctgaagagccatagggcccccacctttactcacaccctgagaattctgggagccagtctgccatgccaggagtcactggacatgttcatcctagaatcctgtcacactacagtcatttcttttcctctctctggcccttgggtcctgggaatgctgctgcttcaaccccagagcctaagaatggcagccgtttcttaacatgttgagagatgattctttcttggccctggccatctcgggaagcttgatggcaatcctggaagggtttaatctccttttgtgagtttggtggggaagggaagggtatatagattgtattaaaaaaaaaaaggtatatatgcatatatctatatataatatgacgcagaaataaatctatgagaa

SEQ ID NO: 24480 - DNA, 1880 bp, Homo sapiens
gcacacattacaggagagagctgaacgttctctcagcccagagcagcaaacaaatgatatattagagacttctgactttccggacgcgtggggagcgactcttcagggaggtggcaggaaaggcttggaacagctgccggaggtgacggagcggcggccccgcccggtgcgctggaggtcgaagcttccagctctggacatcctgagcccaagtcccccacactcagtgcagtgatgagtgcggaagtgaaggtgacagggcagaaccaggagcaatttctgctcctagccaagtcggccaagggggcagcgctggccacactcatccatcaggtgctggaggcccctggtgtctacgtgtttggagaactgctggacatgcccaatgttagagagctggctgagagtgactttgcctctaccttccggctgctcacagtgtttgcttatgggacatacgctgactacttagctgaagcccggaatcttcctccactaacagaggctcagaagaataagcttcgacacctctcagttgtcaccctggctgctaaagtaaagtgtatcccatatgcagtgttgctggaggctcttgccctgcgtaatgtgcggcagctggaagaccttgtgattgaggctgtgtatgctgacgtgcttcgtggctccctggaccagcgcaaccagcggctcgaggttgactacagcatcgggcgggacatccagcgccaggacctcagtgccattgcccgaaccctgcaggaatggtgtgtgggctgtgaggtcgtgctgtcaggcattgaggagcaggtgagccgtgccaaccaacacaaggagcagcagctgggcctgaagcagcagattgagagtgaggttgccaaccttaaaaaaaccattaaagttacgacggcagcagcagccgcagccacatctcaggaccctgagcaacacctgactgagctgagggaaccagctcctggcaccaaccagcgccagcccagcaagaaagcctcaaagggcaaggggctccgagggagcgccaagatttggtccaagtcgaattgaaagaactgtcgtttcctccctggggatgtggggtcccagctgcctgcctgcctcttaggagtcctcagagagccttctgtgcccctggccagctgataatcctaggttcatgacccttcacctcccctaaccccaaacatagatcacaccttctctagggaggagtcaaatgtaggtcatgtttttgttggtactttctgttttttgtgacttcatgtgttccattgctccccgctgccatgctctctcccttgtttccttaagagctcagcatctgtccctgttcattacatgtcattgagtaggtgggtagccctgatgggggtcgctctgtctggagcataacccacaggcgttttttctgccaccccatccctgcatgcctgatccccagttcctataccctacccctgacctattgagcagcctctgaagagccatagggcccccacctttactcacaccctgagaattctgggagccagtctgccatgccaggagtcactggacatgttcatcctagaatcctgtcacactacagtcatttcttttcctctctctggcccttgggtcctgggaatgctgctgcttcaaccccagagcctaagaatggcagccgtttcttaacatgttgagagatgattctttcttggccctggccatctcgggaagcttgatggcaatcctggaagggtttaatctccttttgtgagtttggtggggaagggaagggtatatagattgtattaaaaaaaaaaaggtatatatgcatatatctatatataatatgacgcagaaataaatctatgagaaatcta

SEQ ID NO: 24481 - DNA, 2012 bp, Homo sapiens
gtgcggggcagcaatggagagctgagggagcgtcgtcagggtggacaccatgcgacacccatttctcctttgcatcctgtgtcttggggttcaatggggtgcacgtgatggggcttggggttaggcccaggggagggggtgggtgtggcagccttgcgaagtggctgactttaggattcctagatcagaattttagaccgctccatgtctgattcctcaccgcagaaccgacttagtgcctttacaatccagtccctcagccttgtgcttcccatccgaccagccatcggggacctctagcttcacatcctctttccttgcagctctggacatcctgagcccaagtcccccacactcagtgcagtgatgagtgcggaagtgaaggtgacagggcagaaccaggagcaatttctgctcctagccaagtcggccaagggggcagcgctggccacactcatccatcaggtgctggaggcccctggtgtctacgtgtttggagaactgctggacatgcccaatgttagagagctggctgagagtgactttgcctctaccttccggctgctcacagtgtttgcttatgggacatacgctgactacttagctgaagcccggaatcttcctccactaacagaggctcagaagaataagcttcgacacctctcagttgtcaccctggctgctaaagtaaagtgtatcccatatgcagtgttgctggaggctcttgccctgcgtaatgtgcggcagctggaagaccttgtgattgaggctgtgtatgctgacgtgcttcgtggctccctggaccagcgcaaccagcggctcgaggttgactacagcatcgggcgggacatccagcgccaggacctcagtgccattgcccgaaccctgcaggaatggtgtgtgggctgtgaggtcgtgctgtcaggcattgaggagcaggtgagccgtgccaaccaacacaaggagcagcagctgggcctgaagcagcagattgagagtgaggttgccaaccttaaaaaaaccattaaagttacgacggcagcagcagccgcagccacatctcaggaccctgagcaacacctgactgagctgagggaaccagctcctggcaccaaccagcgccagcccagcaagaaagcctcaaagggcaaggggctccgagggagcgccaagatttggtccaagtcgaattgaaagaactgtcgtttcctccctggggatgtggggtcccagctgcctgcctgcctcttaggagtcctcagagagccttctgtgcccctggccagctgataatcctaggttcatgacccttcacctcccctaaccccaaacatagatcacaccttctctagggaggagtcaaatgtaggtcatgtttttgttggtactttctgttttttgtgacttcatgtgttccattgctccccgctgccatgctctctcccttgtttccttaagagctcagcatctgtccctgttcattacatgtcattgagtaggtgggtagccctgatgggggtcgctctgtctggagcataacccacaggcgttttttctgccaccccatccctgcatgcctgatccccagttcctataccctacccctgacctattgagcagcctctgaagagccatagggcccccacctttactcacaccctgagaattctgggagccagtctgccatgccaggagtcactggacatgttcatcctagaatcctgtcacactacagtcatttcttttcctctctctggcccttgggtcctgggaatgctgctgcttcaaccccagagcctaagaatggcagccgtttcttaacatgttgagagatgattctttcttggccctggccatctcgggaagcttgatggcaatcctggaagggtttaatctccttttgtgagtttggtggggaagggaagggtatatagattgtattaaaaaaaaaaaggtatatatgcatatatctatatataatatgacgcagaaataaatctatgagaaatcta

SEQ ID NO: 24482 - DNA, 1772 bp, Homo sapiens
gtgcggggcagcaatggagagctgagggagcgtcgtcagggtggacaccatgcgacacccatttctcctttgcatcctgtgtcctctggacatcctgagcccaagtcccccacactcagtgcagtgatgagtgcggaagtgaaggtgacagggcagaaccaggagcaatttctgctcctagccaagtcggccaagggggcagcgctggccacactcatccatcaggtgctggaggcccctggtgtctacgtgtttggagaactgctggacatgcccaatgttagagagctggctgagagtgactttgcctctaccttccggctgctcacagtgtttgcttatgggacatacgctgactacttagctgaagcccggaatcttcctccactaacagaggctcagaagaataagcttcgacacctctcagttgtcaccctggctgctaaagtaaagtgtatcccatatgcagtgttgctggaggctcttgccctgcgtaatgtgcggcagctggaagaccttgtgattgaggctgtgtatgctgacgtgcttcgtggctccctggaccagcgcaaccagcggctcgaggttgactacagcatcgggcgggacatccagcgccaggacctcagtgccattgcccgaaccctgcaggaatggtgtgtgggctgtgaggtcgtgctgtcaggcattgaggagcaggtgagccgtgccaaccaacacaaggagcagcagctgggcctgaagcagcagattgagagtgaggttgccaaccttaaaaaaaccattaaagttacgacggcagcagcagccgcagccacatctcaggaccctgagcaacacctgactgagctgagggaaccagctcctggcaccaaccagcgccagcccagcaagaaagcctcaaagggcaaggggctccgagggagcgccaagatttggtccaagtcgaattgaaagaactgtcgtttcctccctggggatgtggggtcccagctgcctgcctgcctcttaggagtcctcagagagccttctgtgcccctggccagctgataatcctaggttcatgacccttcacctcccctaaccccaaacatagatcacaccttctctagggaggagtcaaatgtaggtcatgtttttgttggtactttctgttttttgtgacttcatgtgttccattgctccccgctgccatgctctctcccttgtttccttaagagctcagcatctgtccctgttcattacatgtcattgagtaggtgggtagccctgatgggggtcgctctgtctggagcataacccacaggcgttttttctgccaccccatccctgcatgcctgatccccagttcctataccctacccctgacctattgagcagcctctgaagagccatagggcccccacctttactcacaccctgagaattctgggagccagtctgccatgccaggagtcactggacatgttcatcctagaatcctgtcacactacagtcatttcttttcctctctctggcccttgggtcctgggaatgctgctgcttcaaccccagagcctaagaatggcagccgtttcttaacatgttgagagatgattctttcttggccctggccatctcgggaagcttgatggcaatcctggaagggtttaatctccttttgtgagtttggtggggaagggaagggtatatagattgtattaaaaaaaaaaaggtatatatgcatatatctatatataatatgacgcagaaataaatctatgagaaatcta

SEQ ID NO: 24483 - DNA, 1788 bp, Homo sapiens
gaaggtcacttgatcagtgcggcgcgtgccgcgcaccaatgaagagctgaaggatcgtcgtcagtctctgctaaatacagactcgccaaatcccccactagctcaggtgtcacttcgaattaagttgcagagaagccaagggtgacagcggcagcagaccatggagccaattctctggatccatatcctagaagtctcgaccaacggggagtcatcgcatgcgccaaaattcatccatcaggtgctggaggcccctggtgtctacgtgtttggagaactgctggacatgcccaatgttagagagctggctgagagtgactttgcctctaccttccggctgctcacagtgtttgcttatgggacatacgctgactacttagctgaagcccggaatcttcctccactaacagaggctcagaagaataagcttcgacacctctcagttgtcaccctggctgctaaagtaaagtgtatcccatatgcagtgttgctggaggctcttgccctgcgtaatgtgcggcagctggaagaccttgtgattgaggctgtgtatgctgacgtgcttcgtggctccctggaccagcgcaaccagcggctcgaggttgactacagcatcgggcgggacatccagcgccaggacctcagtgccattgcccgaaccctgcaggaatggtgtgtgggctgtgaggtcgtgctgtcaggcattgaggagcaggtgagccgtgccaaccaacacaaggagcagcagctgggcctgaagcagcagattgagagtgaggttgccaaccttaaaaaaaccattaaagttacgacggcagcagcagccgcagccacatctcaggaccctgagcaacacctgactgagctgagggaaccagctcctggcaccaaccagcgccagcccagcaagaaagcctcaaagggcaaggggctccgagggagcgccaagatttggtccaagtcgaattgaaagaactgtcgtttcctccctggggatgtggggtcccagctgcctgcctgcctcttaggagtcctcagagagccttctgtgcccctggccagctgataatcctaggttcatgacccttcacctcccctaaccccaaacatagatcacaccttctctagggaggagtcaaatgtaggtcatgtttttgttggtactttctgttttttgtgacttcatgtgttccattgctccccgctgccatgctctctcccttgtttccttaagagctcagcatctgtccctgttcattacatgtcattgagtaggtgggtagccctgatgggggtcgctctgtctggagcataacccacaggcgttttttctgccaccccatccctgcatgcctgatccccagttcctataccctacccctgacctattgagcagcctctgaagagccatagggcccccacctttactcacaccctgagaattctgggagccagtctgccatgccaggagtcactggacatgttcatcctagaatcctgtcacactacagtcatttcttttcctctctctggcccttgggtcctgggaatgctgctgcttcaaccccagagcctaagaatggcagccgtttcttaacatgttgagagatgattctttcttggccctggccatctcgggaagcttgatggcaatcctggaagggtttaatctccttttgtgagtttggtggggaagggaagggtatatagattgtattaaaaaaaaaaaggtatatatgcatatatctatatataatatgacgcagaaataaatctatgagaaatcta

SEQ ID NO: 24484 - DNA, 1859 bp, Homo sapiens
gtgcggggcagcaatggagagctgagggagcgtcgtcaggctctggacatcctgagcccaagtcccccacactcagtgcagtgatgagtgcggaagtgaaggtgacagggcagaaccaggagcaatttctgctcctagccaagtcggccaagggggcagcgctggccacactcatccatcaggtgctggaggcccctggtgtctacgtgtttggagaactgctggacatgcccaatgttagagagggtaggaattggatgacgtatggagcaagagggcattgtggtttgggagaatagtgtaaacaaaagcctgaaggtggaaatgagcccttcctatgtgaagagtgatcagagaggcagagaactccttttgctggctgagagtgactttgcctctaccttccggctgctcacagtgtttgcttatgggacatacgctgactacttagctgaagcccggaatcttcctccactaacagaggctcagaagaataagcttcgacacctctcagttgtcaccctggctgctaaagtaaagtgtatcccatatgcagtgttgctggaggctcttgccctgcgtaatgtgcggcagctggaagaccttgtgattgaggctgtgtatgctgacgtgcttcgtggctccctggaccagcgcaaccagcggctcgaggttgactacagcatcgggcgggacatccagcgccaggacctcagtgccattgcccgaaccctgcaggaatggtgtgtgggctgtgaggtcgtgctgtcaggcattgaggagcaggtgagccgtgccaaccaacacaaggagcagcagctgggcctgaagcagcagattgagagtgaggttgccaaccttaaaaaaaccattaaagttacgacggcagcagcagccgcagccacatctcaggaccctgagcaacacctgactgagctgagggaaccagctcctggcaccaaccagcgccagcccagcaagaaagcctcaaagggcaaggggctccgagggagcgccaagatttggtccaagtcgaattgaaagaactgtcgtttcctccctggggatgtggggtcccagctgcctgcctgcctcttaggagtcctcagagagccttctgtgcccctggccagctgataatcctaggttcatgacccttcacctcccctaaccccaaacatagatcacaccttctctagggaggagtcaaatgtaggtcatgtttttgttggtactttctgttttttgtgacttcatgtgttccattgctccccgctgccatgctctctcccttgtttccttaagagctcagcatctgtccctgttcattacatgtcattgagtaggtgggtagccctgatgggggtcgctctgtctggagcataacccacaggcgttttttctgccaccccatccctgcatgcctgatccccagttcctataccctacccctgacctattgagcagcctctgaagagccatagggcccccacctttactcacaccctgagaattctgggagccagtctgccatgccaggagtcactggacatgttcatcctagaatcctgtcacactacagtcatttcttttcctctctctggcccttgggtcctgggaatgctgctgcttcaaccccagagcctaagaatggcagccgtttcttaacatgttgagagatgattctttcttggccctggccatctcgggaagcttgatggcaatcctggaagggtttaatctccttttgtgagtttggtggggaagggaagggtatatagattgtattaaaaaaaaaaaggtatatatgcatatatctatatataatatgacgcagaaataaatctatgagaaatcta

SEQ ID NO: 24485 - DNA, 3563 bp, Homo sapiens
cagagagcaaatcccatttattggaatttcactgacaacaaattgagaggaaggcttccccctcccctgaaacatgccatcctctctgccctcagggctcagcacagggataagacccccactccgcatgtccccagagggcagcactccaggggggtgggggggaggggaggggtgctctacgccaggctggggagctgggacaggagggaagacgtgcaccctcacctcttggctcaatccctctccccgggacctggtgctgcccccagtccctggggtgggctggcagacagggctcatgcaacaatgagtagacaggaggtggcacggaaacgtggccttggtgccccttggcgggggcgggaggactaaaggggccatgctgtggccacagcgggtccaaatggaagtatctgcagtgtacatacaggagggttggagagaggcatccttttccctaggctgtgcctggggacaagagagaggggaagtacagctggcactgccgtgccaggggcagggtccaggccagccgtgccacctgagcgggcacagcgagctggagctcggctactccttggcgcggccaatgatggtgaggatgtacaggaagatgttgatgatgtctgtgtacaggttcagcgcagcaaacacatactcttctgggctcagggacagctgcttgttccccagcagcagctgggtgtccactgcgaggaagcaggtgaagagcagagcgcccagtgaggcgtacacgatctccaggatgcggttccggatgaagatgcagagaatggcgaagatgaagagcaccaccatgctcaccaggagcacgcccatgcatgaggtgaagtcgtagcgggtctgcatggagaagatgacgacggtgaagcagacggctgtggtgatgcccacggccatgatgactgcctcggtgttgtagaagctggcgatcatccccaccatgtacgacaggctggcggtcaggaccgacagtgcaacaaggttccaggggtgctttcgccggaagtccccacaacagctgaggacgatgagagagatgaagaagacagcataggagacatagtaggtccagacattctcccggacaaagcccttcacctccgcaacaaaagtgaacacagacaccgtggacagggtcaccgacagctgcaaggtcagcactaggaacaccttgcggatgaaggcctgtcggatgctcttgtcatcccagttggtggcagggaagtcctggttgtcatagtaggatgggggaccctcctcctggtagtttccatgctggggtgagtcagggtcttgtcctgggaagacctgtggctgtccataggggttgggggggaaggggctctggggatatggcccctgggggtagcccccttgggggtaggggccctgtgggtagccctcttgtgggtaggggccctgtgggtagcccccttgggggtagggaccctgtgggtagcccccttgggggtaggggctggggccatgggggtaccctggctgaccgtagggggagggctggaaagggggctgtgggtaaggggccccagggtagggaggctgagcataggggggcatgggtggctggggcccccccggatatccagggttggggggaggatagttgtccccagacaccaaaaaactcttttcatgggacatggcctcgggttccgcggtccgccccggtggccgggcgccgcaggccggtacgcacggtgtccgctgcgcggccgcgcggtgatggccgatgcgcccgcacccgcacccgctcggagcgactcttcagggaggtggcaggaaaggcttggaacagctgccggaggtgacggagcggcggccccgcccggtgcgctggaggtcgaagcttccaggtagcggcccgcagagcctgacccaggctctggacatcctgagcccaagtcccccacactcagtgcagtgatgagtgcggaagtgaaggtgacagggcagaaccaggagcaatttctgctcctagccaagtcggccaagggggcagcgctggccacactcatccatcaggtgctggaggcccctggtgtctacgtgtttggagaactgctggacatgcccaatgttagagagctggctgagagtgactttgcctctaccttccggctgctcacagtgtttgcttatgggacatacgctgactacttagctgaagcccggaatcttcctccactaacagaggctcagaagaataagcttcgacacctctcagttgtcaccctggctgctaaagtaaagctggaagaccttgtgattgaggctgtgtatgctgacgtgcttcgtggctccctggaccagcgcaaccagcggctcgaggttgactacagcatcgggcgggacatccagcgccaggacctcagtgccattgcccgaaccctgcaggaatggtgtgtgggctgtgaggtcgtgctgtcaggcattgaggagcaggtgagccgtgccaaccaacacaaggagcagcagctgggcctgaagcagcagattgagagtgaggttgccaaccttaaaaaaaccattaaagttacgacggcagcagcagccgcagccacatctcaggaccctgagcaacacctgactgagctgagggaaccagctcctggcaccaaccagcgccagcccagcaagaaagcctcaaagggcaaggggctccgagggagcgccaagatttggtccaagtcgaattgaaagaactgtcgtttcctccctggggatgtggggtcccagctgcctgcctgcctcttaggagtcctcagagagccttctgtgcccctggccagctgataatcctaggttcatgacccttcacctcccctaaccccaaacatagatcacaccttctctagggaggagtcaaatgtaggtcatgtttttgttggtactttctgttttttgtgacttcatgtgttccattgctccccgctgccatgctctctcccttgtttccttaagagctcagcatctgtccctgttcattacatgtcattgagtaggtgggtagccctgatgggggtcgctctgtctggagcataacccacaggcgttttttctgccaccccatccctgcatgcctgatccccagttcctataccctacccctgacctattgagcagcctctgaagagccatagggcccccacctttactcacaccctgagaattctgggagccagtctgccatgccaggagtcactggacatgttcatcctagaatcctgtcacactacagtcatttcttttcctctctctggcccttgggtcctgggaatgctgctgcttcaaccccagagcctaagaatggcagccgtttcttaacatgttgagagatgattctttcttggccctggccatctcgggaagcttgatggcaatcctggaagggtttaatctccttttgtgagtttggtggggaagggaagggtatatagattgtattaaaaaaaaaaaggtatatatgcatatatctatatataatatgacgcagaaataaatctatgagaaatcta

SEQ ID NO: 24486 - DNA, 1539 bp, Homo sapiens
tccacctgtttgttctggtggaggagacgttagtactagaaagaggaacaaaagtacaagagaaaaaggcgtagaacaaaagaagaggtgaaatgaggacacagcggacctggctgagagtgactttgcctctaccttccggctgctcacagtgtttgcttatgggacatacgctgactacttagctgaagcccggaatcttcctccactaacagaggctcagaagaataagcttcgacacctctcagttgtcaccctggctgctaaagtaaagctggaagaccttgtgattgaggctgtgtatgctgacgtgcttcgtggctccctggaccagcgcaaccagcggctcgaggttgactacagcatcgggcgggacatccagcgccaggacctcagtgccattgcccgaaccctgcaggaatggtgtgtgggctgtgaggtcgtgctgtcaggcattgaggagcaggtgagccgtgccaaccaacacaaggagcagcagctgggcctgaagcagcagattgagagtgaggttgccaaccttaaaaaaaccattaaagttacgacggcagcagcagccgcagccacatctcaggaccctgagcaacacctgactgagctgagggaaccagctcctggcaccaaccagcgccagcccagcaagaaagcctcaaagggcaaggggctccgagggagcgccaagatttggtccaagtcgaattgaaagaactgtcgtttcctccctggggatgtggggtcccagctgcctgcctgcctcttaggagtcctcagagagccttctgtgcccctggccagctgataatcctaggttcatgacccttcacctcccctaaccccaaacatagatcacaccttctctagggaggagtcaaatgtaggtcatgtttttgttggtactttctgttttttgtgacttcatgtgttccattgctccccgctgccatgctctctcccttgtttccttaagagctcagcatctgtccctgttcattacatgtcattgagtaggtgggtagccctgatgggggtcgctctgtctggagcataacccacaggcgttttttctgccaccccatccctgcatgcctgatccccagttcctataccctacccctgacctattgagcagcctctgaagagccatagggcccccacctttactcacaccctgagaattctgggagccagtctgccatgccaggagtcactggacatgttcatcctagaatcctgtcacactacagtcatttcttttcctctctctggcccttgggtcctgggaatgctgctgcttcaaccccagagcctaagaatggcagccgtttcttaacatgttgagagatgattctttcttggccctggccatctcgggaagcttgatggcaatcctggaagggtttaatctccttttgtgagtttggtggggaagggaagggtatatagattgtattaaaaaaaaaaaggtatatatgcatatatctatatataatatgacgcagaaataaatctatgagaaatcta

SEQ ID NO: 24487 - DNA, 1531 bp, Homo sapiens
cgatctagaggatccctttaggttggcactcactctcaaactgctggacatgcccaatgttagagagctggctgagagtgactttgcctctaccttccggctgctcacagtgtttgcttatgggacatacgctgactacttagctgaagcccggaatcttcctccactaacagaggctcagaagaataagcttcgacacctctcagttgtcaccctggctgctaaagtaaagtgtatcccatatgcagtgttgctggaggctcttgccctgcgtaatgtgcggcagctggaagaccttgtgattgaggctgtgtatgctgacgtgcttcgtggctccctggaccagcgcaaccagcggctcgaggttgactacagcatcgggcgggacatccagcgccaggacctcagtgccattgtgtgtgggctgtgaggtcgtgctgtcaggcattgaggagcaggtgagccgtgccaaccaacacaaggagcagcagctgggcctgaagcagcagattgagagtgaggttgccaaccttaaaaaaaccattaaagttacgacggcagcagcagccgcagccacatctcaggaccctgagcaacacctgactgagctgagggaaccagctcctggcaccaaccagcgccagcccagcaagaaagcctcaaagggcaaggggctccgagggagcgccaagatttggtccaagtcgaattgaaagaactgtcgtttcctccctggggatgtggggtcccagctgcctgcctgcctcttaggagtcctcagagagccttctgtgcccctggccagctgataatcctaggttcatgacccttcacctcccctaaccccaaacatagatcacaccttctctagggaggagtcaaatgtaggtcatgtttttgttggtactttctgttttttgtgacttcatgtgttccattgctccccgctgccatgctctctcccttgtttccttaagagctcagcatctgtccctgttcattacatgtcattgagtaggtgggtagccctgatgggggtcgctctgtctggagcataacccacaggcgttttttctgccaccccatccctgcatgcctgatccccagttcctataccctacccctgacctattgagcagcctctgaagagccatagggcccccacctttactcacaccctgagaattctgggagccagtctgccatgccaggagtcactggacatgttcatcctagaatcctgtcacactacagtcatttcttttcctctctctggcccttgggtcctgggaatgctgctgcttcaaccccagagcctaagaatggcagccgtttcttaacatgttgagagatgattctttcttggccctggccatctcgggaagcttgatggcaatcctggaagggtttaatctccttttgtgagtttggtggggaagggaagggtatatagattgtattaaaaaaaaaaaggtatatatgcatatatctatatataatatgacgcagaaataaatctatgagaaatcta

SEQ ID NO: 24488 - DNA, 875 bp, Homo sapiens
  misc_feature (828)..(828): n is a, c, g, or t
  misc_feature (834)..(834): n is a, c, g, or t
cgccatagagtttagtggccagaagcgactcttcagggaggtggcaggaaaggcttggaacagctgccggaggtgacggagcggcggccccgcccggtgcgctggaggtcgaagcttccaggtagcggcccgcagagcctgacccaggctctggacatcctgagcccaagtcccccacactcagtgcagtgatgagtgcggaagtgaaggtgacagggcagaaccaggagcaatttctgctcctagccaagtcggccaagggggcagcgctggccacactcatccatcaggtgctggaggcccctggtgtctacgtgtttggagaactgctggacatgcccaatgttagagagctggctgagagtgactttgcctctaccttccggctgctcacagtgtttgcttatgggacatacgctgactacttagctgaagcccggaatcttcctccactaacagaggctcagaagaataagcttcgacacctctcagttgtcaccctggctgctaaagtaaagtgtatcccatatgcagtgttgctggaggctcttgccctgcgtaatgtgcggcagctggaagaccttgtgattgaggctgtgtatgctgacgtgcttcgtggctccctggaccagcgcaaccagcggctcgaggttgactacagcatcgggcgggacatccagcgccaggacctcagtgccattgcccgaaccctgcaggaatggtgtgtgggctgtgaggtcgtgctgtcaggcattgaggagcaggtgagccgtgccaaccaacacaaggagcagcagctgggcctgaagcagcagattgagagtgagnttccancctaaaaacccaaaggacacaggcgcagcagcgcgacccat

SEQ ID NO: 24489 - DNA, 2751 bp, Homo sapiens
cagagagcaaatcccatttattggaatttcactgacaacaaattgagaggaaggcttccccctcccctgaaacatgccatcctctctgccctcagggctcagcacagggataagacccccactccgcatgtccccagagggcagcactccaggggggtgggggggaggggaggggtgctctacgccaggctggggagctgggacaggagggaagacgtgcaccctcacctcttggctcaatccctctccccgggacctggtgctgcccccagtccctggggtgggctggcagacagggctcatgcaacaatgagtagacaggaggtggcacggaaacgtggccttggtgccccttggcgggggcgggaggactaaaggggccatgctgtggccacagcgggtccaaatggaagtatctgcagtgtacatacaggagggttggagagaggcatccttttccctaggctgtgcctggggacaagagagaggggaagtacagctggcactgccgtgccaggggcagggtccaggccagccgtgccacctgagcgggcacagcgagctggagctcggctactccttggcgcggccaatgatggtgaggatgtacaggaagatgttgatgatgtctgtgtacaggttcagcgcagcaaacacatactcttctgggctcagggacagctgcttgttccccagcagcagctgggtgtccactgcgaggaagcaggtgaagagcagagcgcccagtgaggcgtacacgatctccaggatgcggttccggatgaagatgcagagaatggcgaagatgaagagcaccaccatgctcaccaggagcacgcccatgcatgaggtgaagtcgtagcgggtctgcatggagaagatgacgacggtgaagcagacggctgtggtgatgcccacggccatgatgactgcctcggtgttgtagaagctggcgatcatccccaccatgtacgacaggctggcggtcaggaccgacagtgcaacaaggttccaggggtgctttcgccggaagtccccacaacagctgaggacgatgagagagatgaagaagacagcataggagacatagtaggtccagacattctcccggacaaagcccttcacctccgcaacaaaagtgaacacagacaccgtggacagggtcaccgacagctgcaaggtcagcactaggaacaccttgcggatgaaggcctgtcggatgctcttgtcatcccagttggtggcagggaagtcctggttgtcatagtaggatgggggaccctcctcctggtagtttccatgctggggtgagtcagggtcttgtcctgggaagacctgtggctgtccataggggttgggggggaaggggctctggggatatggcccctgggggtagcccccttgggggtaggggccctgtgggtagccctcttgtgggtaggggccctgtgggtagcccccttgggggtagggaccctgtgggtagcccccttgggggtaggggctggggccatgggggtaccctggctgaccgtagggggagggctggaaagggggctgtgggtaaggggccccagggtagggaggctgagcataggggggcatgggtggctggggcccccccggatatccagggttggggggaggatagttgtccccagacaccaaaaaactcttttcatgggacatggcctcgggttccgcggtccgccccggtggccgggcgccgcaggccggtacgcacggtgtccgctgcgcggccgcgcggtgatggccgatgcgcccgcacccgcacccgctcggagcgactcttcagggaggtggcaggaaaggcttggaacagctgccggaggtgacggagcggcggccccgcccggtgcgctggaggtcgaagcttccaggtagcggcccgcagagcctgacccagggtacgacgaagcagtcggcgggagcccacggtcgctgggcggtgtctttaagggagggggcggagccacgtctctggacatcctgagcccaagtcccccacactcagtgcagtgatgagtgcggaagtgaaggtgacagggcagaaccaggagcaatttctgctcctagccaagtcggccaagggggcagcgctggccacactcatccatcaggtgctggaggcccctggtgtctacgtgtttggagaactgctggacatgcccaatgttagagagctggctgagagtgactttgcctctaccttccggctgctcacagtgtttgcttatgggacatacgctgactacttagctgaagcccggaatcttcctccactaacagaggctcagaagaataagcttcgacacctctcagttgtcaccctggctgctaaagtaaagtgtatcccatatgcagtgttgctggaggctcttgccctgcgtaatgtgcggcagctggaagaccttgtgattgaggctgtgtatgctgacgtgcttcgtggctccctggaccagcgcaaccagcggctcgaggttgactacagcatcgggcgggacatccagcgccaggacctcagtgccattgcccgaaccctgcaggaatggtgtgtgggctgtgaggtcgtgctgtcaggcattgaggagcaggtgagccgtgccaaccaacacaaggagcagcagctgggcctgaagcagcagattgagagtgagggtgccaaccttaaaaaaccttaaagtcgacgggagagcgggcaatttaggaccggaaacgttggtgggaccg

SEQ ID NO: 24490 - DNA, 1833 bp, Homo sapiens
  misc_feature (40)..(40): n is a, c, g, or t
  misc_feature (50)..(51): n is a, c, g, or t
  misc_feature (55)..(56): n is a, c, g, or t
  misc_feature (88)..(89): n is a, c, g, or t
  misc_feature (91)..(91): n is a, c, g, or t
  misc_feature (98)..(98): n is a, c, g, or t
  misc_feature (107)..(107): n is a, c, g, or t
  misc_feature (111)..(111): n is a, c, g, or t
  misc_feature (115)..(115): n is a, c, g, or t
  misc_feature (120)..(121): n is a, c, g, or t
  misc_feature (127)..(127): n is a, c, g, or t
  misc_feature (143)..(143): n is a, c, g, or t
  misc_feature (210)..(210): n is a, c, g, or t
  misc_feature (224)..(224): n is a, c, g, or t
  misc_feature (235)..(235): n is a, c, g, or t
  misc_feature (240)..(240): n is a, c, g, or t
  misc_feature (250)..(250): n is a, c, g, or t
  misc_feature (260)..(260): n is a, c, g, or t
  misc_feature (264)..(264): n is a, c, g, or t
gaatggagtctccagactgtcacccaggctggagtgcagnggcacggtcnnggcnnactgcaacctccgcctcccgggttcaagcganncncctgccncagcctccngagnagcngggannacaggngcatgccaccacgccnggctaattttttttgtagggatagggttgtgccaggttgatctcaaactgctgtcctcaagtgatcngcccacctcggccncccaaagtgcnggganttacaggcgngagccacggngccnggccagattttcttgaatgaatatttctccatttgctgtatgcccttaagagaattggcaaatactttaaattacggtattttataatttttactagttaaaatgttgttttgctggaaagagggcatgccagcctccttactccaccatcttagaaatcctgctttggcttgaacactttataagaaaactcaataatctttttgagctaaacttctgatttttttttaacattggtgtttaaaagcaaaggaagaaatataggaaagaccgtacatacatacacacccttaggtaatacactcacttgctttaaagtatcccaagaataagtgaaacaaaaccttaactcctcagtccctctctttccaaaggtgaccactgttaatagtttaatgtgtgtccttaggtattcttcagaacctgcagaaagagagcctcagattaagaaaaagtaagtgatgtatgaactgcttctctgaaaatcactgctgtttctattgtgtttctagtcattcatacctagagaaattccttaccgagcagatgatggaaaggagggaggatgtatggcttccactcatctcctatagaaattcattagtcactgggggtgaagatgatagaatgtctgtgaacagtggaagtagcagcagcaaaacctcatcagtaaggaataagaaaggacgacctccacttcataaaaaacgagtagaaggtaagtctgcctttacactataagaaacaatttgcctggttttaaagagataaagtagtaaataatcttttgaagcaagataatagtatcaggcacatgattttcttgtatattttattcacaatgagatgttaaggcaaaaaggttgaaacagatgaagtaagacagaaaagcatcaaggaaaaagaagttgaggaagcatggagcacaaaggaagacagaccaaaagaggaaaaaattagctaggtctataaaatcaatccccatactatatgcctctaatacattaaaatataaagtaagatagtcacaatgctattctattaaaattcttcctaatataggtgagatacaggtaatttgagggtagatttctgcagcaaattgaatataccagaatagttgttttccagttctaccacttggttggaacagtaagacagtgatggcctccaggtgcggtggctcacatccgtaatcccagttactcaggagaccaaggaaggaggatcaggaaattaaggccagaaattcgagaccagcccgggaaacatagcaagactcccatctctaagaaaaaaaaaattttaaatgggtggcatgcacctgtagtcccagccacctgggaagccgaggcgggagaatcacctgagcccagaagtctgaggttgcagtgagccacgatcatgccaccgcactccagcctgggcgacagaggaagactcccatcatttaattttttaaaaaggcagtaatggctaaatctggttttataaccctcttggactatggggaatgggaagttaaattgtcatgaaaatctgatcaacagtaggtattcctatatgtta

SEQ ID NO: 24491 - DNA, 235 bp, Homo sapiens
tgagtgcctccctaggagtgacagttacctccggagtatgtggctaggactctgcatgacagtcaaggggaagtcaggctgaagtgtttgaaagctctgcagagtctatataccaatagagaattattccccaaattggaactattcactaaccgattcaagcagtccccaacctttttggcaccagggaccagtttcatggaagacagtttttctgtggaccaaggtgggggtt

SEQ ID NO: 24492 - DNA, 6183 bp, Homo sapiens
ggctgtgacactaatacttaacatggtggttgtgtctctttatgcctgactcaatcagttgaaatccaaaagtaagttcttccttgatttacctgccaagacctgagttcaggccctcagggtgctgaggttttcctttaatgccaccagatggcgggttaggattgcagctccgttgaaggcgcggcccccgctcccgaacccccggcgaccaccccgtaacaacccccccacatcgggaataacacaccggagacttttggggggaaactaggtcgatggtcggcggcgcccggatgggcagctgaggattgcctttgaggttattttaaaagttttgagttgtacagcacttgattattttgctgcattgtgaaaggacctctccagcaatgattacttcagaattaccagtgttacaggattcaactaatgaaactactgcccattccgatgctggcagcgagcttgaagaaacagaggtcaaaggaaaaagaaaaaggggtcgtcctggccggcctccatctacaaataagaaacctcgaaaatctccaggtgagaagagcagaattgaagctggaattagaggagcaggccgtggaagagctaatggacaccctcaacagaatggggaaggggagcctgtcacattatttgaggtggtgaaactggggaaaagtgcaatgcagtccgtggtggatgactggattgaatcatataaacaagacagggacatcgcacttctggatttaatcaacttttttatccagtgttcaggatgtcgaggtactgtgagaatagagatgtttcgaaatatgcagaatgcagaaatcatcagaaaaatgactgaagaatttgatgaggacagtggtgattatcctcttaccatgcctggacctcagtggaaaaaatttcgttcaaacttttgtgaatttattggagtcctgattcgacagtgtcagtatagcataatttatgatgagtatatgatggacacagtaatctcccttttgacgggtttgtcagactcccaggtcagagcttttaggcatacaagtaccctggctgccatgaagctcatgactgctctggtgaatgttgccttaaacctcagtattcatcaggataatacccagagacaatatgaagccgagagaaataaaatgattgggaagagagccaatgaaaggttggagttactacttcagaaacgcaaagagctgcaagaaaatcaggatgaaatcgaaaatatgatgaactctatttttaagggtatatttgttcatagataccgtgatgctattgctgagattagagccatttgtattgaagaaattggagtatggatgaaaatgtatagtgatgccttcctaaatgacagttacctaaaatatgttggctggactcttcatgacaggcaaggggaagtcaggctgaagtgtttgaaagctctgcagagtctatataccaatagagaattattccccaaattggaactattcactaaccgattcaaggatcgcattgtatcaatgacacttgataaagaatatgatgttgctgtggaagctattcgattggttactctgatacttcatggaagtgaagaagctctttccaatgaagactgtgaaaatgtttaccacttggtgtactcggcacatcgccctgttgctgtggcagctggagagttccttcacaaaaagctatttagcagacatgacccacaagcagaagaagcattagcaaagaggaggggaagaaacagcccgaatggaaacctcattaggatgctggttcttttctttcttgaaagtgagttacatgaacatgcagcctacttggtggacagtttatgggagagctctcaagaactgttgaaagactgggaatgtatgacagagttgctattagaagaacctgttcaaggagaggaagcaatgtctgatcgtcaagagagtgctcttatagagctaatggtttgtacaattcgtcaagctgctgaggcacatcctccagtgggaaggggtaccggcaagagagtgctaactgccaaagaaaggaaaactcaaattgatgatagaaacaaattgactgaacattttattattacacttcctatgttactgtcaaagtattctgcagatgcagagaaggtagcaaacttgctacaaatcccacagtattttgatttagaaatctacagcacaggtagaatggaaaagcatctggatgctttattaaaacagattaagtttgttgtggagaaacacgtagaatcagatgttctagaagcctgcagtaaaacctatagtatcttatgcagtgaagaatataccatccagaacagagttgacatagctcgaagccagctgattgatgagtttgtagatcgattcaatcattctgtggaagacctattgcaagagggagaagaagctgatgatgatgacatttacaatgttctttctacattaaagcggttaacttcttttcacaatgcacatgatctcacaaaatgggatctctttggtaattgctacagattattgaagactggaattgaacatggagccatgccagaacagatagtcgtgcaagcactgcagtgttcccattattcgattctttggcagttggtgaaaattactgatggctctccttccaaagaggatttgttggtattgaggaaaacggtgaaatcctttttggctgtttgccagcagtgcctgtctaatgttaatactccagtgaaagaacaggctttcatgttactctgtgatcttctgatgattttcagccaccaattaatgacaggtggcagagagggccttcagcctttggtgttcaatccagatactggactccaatctgaactcctcagttttgtgatggatcacgtttttattgaccaagacgaggagaaccagagcatggagggtgatgaagaagatgaagctaataaaattgaggccttacataaaagaaggaatctacttgctgctttcagcaaacttatcatttatgacattgttgacatgcatgcagctgcagacatcttcaaacactacatgaagtattacaatgactatggtgatattattaaggaaacactgagtaaaaccaggcagattgataaaattcagtgtgccaagactctcattctcagtttgcaacagttatttaatgaacttgttcaagagcaaggtcccaacctagataggacatctgcccatgtcagtggcattaaagaactggcacgtcgctttgcccttacatttggattggaccagattaagacacgagaagcagttgccacacttcacaaggatggcatagagtttgcatttaaataccaaaatcagaaaggacaagagtatccacctcctaatctggcttttcttgaagtactaagtgaattttcttctaaacttcttcgacaggacaaaaagacagttcattcatacctagagaaattccttaccgagcagatgatggaaaggagggaggatgtatggcttccactcatctcctatagaaattcattagtcactgggggtgaagatgatagaatgtctgtgaacagtggaagtagcagcagcaaaacctcatcagtaaggaataagaaaggacgacctccacttcataaaaaacgagtagaagatgagagtctggataacacatggctaaacaggactgacaccatgattcagactcctggccccctgccagcaccacaactcacatccactgtactgcgggagaacagtcggcccatgggagaccagattcaagaacctgagtctgaacatggttctgaaccagactttttacacaatcctcagatgcagatctcttggttaggccagccgaagttagaagacttaaatcggaaggacagaacaggaatgaactacatgaaagtgagaactggagtgaggcatgctgttcggggtctaatggaggaagatgctgagcccatctttgaagatgtgatgatgtcatcccgaagccagttagaagatatgaatgaagaatttgaggacaccatggttattgatctgcctccatcaagaaatcggcgagagagagctgagctaaggccagacttctttgactctgcagctatcatagaagatgattcaggatttggaatgcctatgttctgaagtctgaagaaaatttacaaatctggaactctattatttagagctagaggcctatatactgtgatagcttgtatggggaaaaacacttttgatgtgatctgatttgttttttaatcaaatgattaaggtcaatccctttttgcagtgacagaagaggagcatgtaaattacccaagggaatgttggtgaatgtcaactcagaaagactgacctgaaaatcatttgtgtcctactgttggacttatcccaatacagatgtgtgtgtttttctggagggaggaagaaattttaaatttttaaaacagctgtcaagataaacactgttatacacctgttttatgaaaactcaacattgagtaaaaaaaaacatatttttaactttattttcctgttgtacaatttaaaaaccgttttaacattttgcctttttatgttttaaaagctaaccatttttattaaacctatgagtaagcagctcatcctaattgcgaagagtgttttggagttcactggatttggttgacctttgtggaacacaaataatgaaggagcagaacattgacaagctaagatgaaattctgacatagtacatctctgccaaaaaccacacaccctctgtggatatggatatgaattcccagattttatatactcttgaataaaaggtttatttttatttataagtgggcataaaataagaaatgtccatgcagccatttttccaacagatgctgtacaccgttcattttatatagactagggagattcaaatacagtgcattttctattggtatttgttctgtgcatttttagcaacttctaccagcaaataaagtattctcagtaaaacgaaaatgattctcaagttatcagtttgctgtttttaccacttatttcatgccctgccaaattcaagttacacagacttccattttcttaagataatcaatcatgaagaaatcctttatcaatcattcaaaagtaattttaagtgtaacataactgtgtttacttcccatgcacttaatacccttatgcgctaattttgtgaattaagtttactgattatagaagtatgtgctgcatagaagtctgtgcttagagggtgaagttcctaagcttaccttgaattacagctacatttcagtgttaaatgtgcatattaagaataattcttttggggaaagaaattatgaatcttcaggacagtctacaatggtttagagttacattctgcctagacttttatgacttgctgctattgttttaaaaaccccacttagtctcttcctttctgatttctaaagtaagcctcagaatttccaaaccaattcatccacagctgtttctgggctggtttttaaagtagctgcaacagaatcatgaggctttccctttttatcaaatacgaaaaacattttttaaaattctgcacacccagtgatcatcttttgtgcgggaaagcaagatgatgatggatgattttattcatccttttagtaaagacacaaaacatttttctcaacatttgtacagttctgaaaaaaacctggtcaccaaaaatatcttctctgctaattcagcaattcttgggctccagttaggggagctggggcctcactttctcccagaattgtgggcttcactggaagtgaaggtgcaggaatgactggactgtccaccccagccctgcctgcctgtggttttggccagggagcaagccatgaggtgccctggcacatgcacaaattgatcctttgcgtgacagtcttgtatggaaaacagatgctgacagaattgtagactaccatgccacacaaaaaggctaaatatctactccaatgggtttccagttcagtttgaagtcaatcaaatttttgtattttcggtgtctccttgattggttttgctagtaattctgtaaattgtacatttgcaatatgaggttttttttccttttgtacaatttgaaactgatgcttcacctttcctttaataaactattcaaaatca

SEQ ID NO: 24493 - DNA, 6552 bp, Homo sapiens
  misc_feature (6383)..(6383): n is a, c, g, or t
  misc_feature (6398)..(6398): n is a, c, g, or t
ggctgtgacactaatacttaacatggtggttgtgtctctttatgcctgactcaatcagttgaaatccaaaagtaagttcttccttgatttacctgccaagacctgagttcaggccctcagggtgctgaggttttcctttaatgccaccagatggcgggttaggattgcagctccgttgaaggcgcggcccccgctcccgaacccccggcgaccaccccgtaacaacccccccacatcgggaataacacaccggagacttttggggggaaactaggtcgatggtcggcggcgcccggatgggcagctgaggattgcctttgaggttattttaaaagttttgagttgtacagcacttgattattttgctgcattgtgaaaggacctctccagcaatgattacttcagaattaccagtgttacaggattcaactaatgaaactactgcccattccgatgctggcagcgagcttgaagaaacagaggtcaaaggaaaaagaaaaaggggtcgtcctggccggcctccatctacaaataagaaacctcgaaaatctccaggtgagaagagcagaattgaagctggaattagaggagcaggccgtggaagagctaatggacaccctcaacagaatggggaaggggagcctgtcacattatttgaggtggtgaaactggggaaaagtgcaatgcagtccgtggtggatgactggattgaatcatataaacaagacagggacatcgcacttctggatttaatcaacttttttatccagtgttcaggatgtcgaggtactgtgagaatagagatgtttcgaaatatgcagaatgcagaaatcatcagaaaaatgactgaagaatttgatgaggacagtggtgattatcctcttaccatgcctggacctcagtggaaaaaatttcgttcaaacttttgtgaatttattggagtcctgattcgacagtgtcagtatagcataatttatgatgagtatatgatggacacagtaatctcccttttgacgggtttgtcagactcccaggtcagagcttttaggcatacaagtaccctggctgccatgaagctcatgactgctctggtgaatgttgccttaaacctcagtattcatcaggataatacccagagacaatatgaagccgagagaaataaaatgattgggaagagagccaatgaaaggttggagttactacttcagaaacgcaaagagctgcaagaaaatcaggatgaaatcgaaaatatgatgaactctatttttaagggtatatttgttcatagataccgtgatgctattgctgagattagagccatttgtattgaagaaattggagtatggatgaaaatgtatagtgatgccttcctaaatgacagttacctaaaatatgttggctggactcttcatgacaggcaaggggaagtcaggctgaagtgtttgaaagctctgcagagtctatataccaatagagaattattccccaaattggaactattcactaaccgattcaaggatcgcattgtatcaatgacacttgataaagaatatgatgttgctgtggaagctattcgattggttactctgatacttcatggaagtgaagaagctctttccaatgaagactgtgaaaatgtttaccacttggtgtactcggcacatcgccctgttgctgtggcagctggagagttccttcacaaaaagctatttagcagacatgacccacaagcagaagaagcattagcaaagaggaggggaagaaacagcccgaatggaaacctcattaggatgctggttcttttctttcttgaaagtgagttacatgaacatgcagcctacttggtggacagtttatgggagagctctcaagaactgttgaaagactgggaatgtatgacagagttgctattagaagaacctgttcaaggagaggaagcaatgtctgatcgtcaagagagtgctcttatagagctaatggtttgtacaattcgtcaagctgctgaggcacatcctccagtgggaaggggtaccggcaagagagtgctaactgccaaagaaaggaaaactcaaattgatgatagaaacaaattgactgaacattttattattacacttcctatgttactgtcaaagtattctgcagatgcagagaaggtagcaaacttgctacaaatcccacagtattttgatttagaaatctacagcacaggtagaatggaaaagcatctggatgctttattaaaacagattaagtttgttgtggagaaacacgtagaatcagatgttctagaagcctgcagtaaaacctatagtatcttatgcagtgaagaatataccatccagaacagagttgacatagctcgaagccagctgattgatgagtttgtagatcgattcaatcattctgtggaagacctattgcaagagggagaagaagctgatgatgatgacatttacaatgttctttctacattaaagcggttaacttcttttcacaatgcacatgatctcacaaaatgggatctctttggtaattgctacagattattgaagactggaattgaacatggagccatgccagaacagatagtcgtgcaagcactgcagtgttcccattattcgattctttggcagttggtgaaaattactgatggctctccttccaaagaggatttgttggtattgaggaaaacggtgaaatcctttttggctgtttgccagcagtgcctgtctaatgttaatactccagtgaaagaacaggctttcatgttactctgtgatcttctgatgattttcagccaccaattaatgacaggtggcagagagggccttcagcctttggtgttcaatccagatactggactccaatctgaactcctcagttttgtgatggatcacgtttttattgaccaagacgaggagaaccagagcatggagggtgatgaagaagatgaagctaataaaattgaggccttacataaaagaaggaatctacttgctgctttcagcaaacttatcatttatgacattgttgacatgcatgcagctgcagacatcttcaaacactacatgaagtattacaatgactatggtgatattattaaggaaacactgagtaaaaccaggcagattgataaaattcagtgtgccaagactctcattctcagtttgcaacagttatttaatgaacttgttcaagagcaaggtcccaacctagataggacatctgcccatgtcagtggcattaaagaactggcacgtcgctttgcccttacatttggattggaccagattaagacacgagaagcagttgccacacttcacaaggatggcatagagtttgcatttaaataccaaaatcagaaaggacaagagtatccacctcctaatctggcttttcttgaagtactaagtgaattttcttctaaacttcttcgacaggacaaaaagacagttcattcatacctagagaaattccttaccgagcagatgatggaaaggagggaggatgtatggcttccactcatctcctatagaaattcattagtcactgggggtgaagatgatagaatgtctgtgaacagtggaagtagcagcagcaaaacctcatcagtaaggaataagaaaggacgacctccacttcataaaaaacgagtagaagatgagagtctggataacacatggctaaacaggactgacaccatgattcagactcctggccccctgccagcaccacaactcacatccactgtactgcgggagaacagtcggcccatgggagaccagattcaagaacctgagtctgaacatggttctgaaccagactttttacacaatcctcagatgcagatctcttggttaggccagccgaagttagaagacttaaatcggaaggacagaacaggaatgaactacatgaaagtgagaactggagtgaggcatgctgttcggggtctaatggaggaagatgctgagcccatctttgaagatgtgatgatgtcatcccgaagccagttagaagatatgaatgaagaatttgaggacaccatggttattgatctgcctccatcaagaaatcggcgagagagagctgagctaaggccagacttctttgactctgcagctatcatagaagatgattcaggatttggaatgcctatgttctgaagtctgaagaaaatttacaaatctggaactctattatttagagctagaggcctatatactgtgatagcttgtatggggaaaaacacttttgatgtgatctgatttgttttttaatcaaatgattaaggtcaatccctttttgcagtgacagaagaggagcatgtaaattacccaagggaatgttggtgaatgtcaactcagaaagactgacctgaaaatcatttgtgtcctactgttggacttatcccaatacagatgtgtgtgtttttctggagggaggaagaaattttaaatttttaaaacagctgtcaagataaacactgttatacacctgttttatgaaaactcaacattgagtaaaaaaaaacatatttttaactttattttcctgttgtacaatttaaaaaccgttttaacattttgcctttttatgttttaaaagctaaccatttttattaaacctatgagtaagcagctcatcctaattgcgaagagtgttttggagttcactggatttggttgacctttgtggaacacaaataatgaaggagcagaacattgacaagctaagatgaaattctgacatagtacatctctgccaaaaaccacacaccctctgtggatatggatatgaattcccagattttatatactcttgaataaaaggtttatttttatttataagtgggcataaaataagaaatgtccatgcagccatttttccaacagatgctgtacaccgttcattttatatagactagggagattcaaatacagtgcattttctattggtatttgttctgtgcatttttagcaacttctaccagcaaataaagtattctcagtaaaacgaaaatgattctcaagttatcagtttgctgtttttaccacttatttcatgccctgccaaattcaagttacacagacttccattttcttaagataatcaatcatgaagaaatcctttatcaatcattcaaaagtaattttaagtgtaacataactgtgtttacttcccatgcacttaatacccttatgcgctaattttgtgaattaagtttactgattatagaagtatgtgctgcatagaagtctgtgcttagagggtgaagttcctaagcttaccttgaattacagctacatttcagtgttaaatgtgcatattaagaataattcttttggggaaagaaattatgaatcttcaggacagtctacaatggtttagagttacattctgcctagacttttatgacttgctgctattgttttaaaaaccccacttagtctcttcctttctgatttctaaagtaagcctcagaatttccaaaccaattcatccacagctgtttctgggctggtttttaaagtagctgcaacagaatcatgaggctttccctttttatcaaatacgaaaaacattttttaaaattctgcacacccagtgatcatcttttgtgcgggaaagcaagatgatgatggatgattttattcatccttttagtaaagacacaaaacatttttctcaacatttgtacagttctgaaaaaaacctggtcaccaaaaatatcttctctgctaattcagcaattcttgggctccagttaggggagctggggcctcactttctcccagaattgtgggcttcactggaagtgaaggtgcaggaatgactggactgtccaccccagccctgcctgcctgtggttttggccagggagcaagccatgaggtgccctggcacatgcacaaattgatcctttgcgtgacagtcttgtatggaaaacagatgctgacagaattgtagactaccatgccacacaaaaaggctaaatatctactccaatgggtttccagttcagtttgaagtcaatcaaatttttgtattttcggtgtctccttgattggttttgctagtaattctgtaaattgtacatttgcaatatgaggttttttttccttttgtacaatttgaaactgatgcttcacctttcctttaataaactattcaaaatcaaaaaaaaaaaaaaaaaaaactcgagactcttttagcaaccccagtattccttcactatttcgcttcctgcattagcaaattttacttacagtcaaaagtgcagatttatactcctgacgtgtctcattcacagctaaataataggccataggacttttggtaggtttaaacttttaattctgtatttcatgattataagncttgctagaattttntctaatctttagtagatttgattaaataatgattcacagaatttagtaacagaatcaaactaagccatgtatgagggtaatcgagatgaggatattaactcaaaagaaatagggtgattttaaaggattaataaaatcctgaaatgttaagtag

SEQ ID NO: 24494 - DNA, 6956 bp, Homo sapiens
aggaggtggtcacagatattttataatggaggcaaggtcaaaccggaattggagtcccatagctctgagcccaggaaactggatgaatttatctattagtatggactgggactggcatctttaacaacatggaaagcttgaaacagtctttgtggaaaataggagatcagccagagattagaagaaaacgcaagaaaattataagtaggagtccagtcacgaattcatatccaatctggtcagttatgacttcctccagcgaaaagccacacatcttgcaaaccctggtgaaagcgcttgtcagccgtaaatcgcgaatacaatgctaagctctgaggcccttgctaaatccaagtaggagcagggatctgcgcggcctcaccctcgggtttccgcagggcgtctcgagagctgcggatgggggcagcaggagccgggcgggaacagaggaaagcgccggccctgagacctagggaggagcctcggtgaaggaacccggggcgggttcctgcctagatctccaagaagctccaaaaatggcgggcggcaactcggcgagccggacgcgcaggcgccaccgtggccgtccttccgccagccgcgggcggcccaagaaccgtccacagcgcccttatccagaagcctacgcctctcgcgattggctgaactgcgcgagcgctccgtgtgggggcggggccgccacgcagcggccacgtttcccgccccgctggtgcgcgtgcgcgcaatccccactggaaagcgtttgcgcgcgcccctgccgcggcccctagctcgcgcctcagctccctcccctttccgggcaggcccgtcccgtcagcaaggcagtgagcaccgcggccagcagagggcggtccggacccaagtctgcagcggcgccattggcgtgtggaaaatgccaccagatggcgggttaggattgcagctccgttgaaggcgcggcccccgctcccgaacccccggcgaccaccccgtaacaacccccccacatcgggaataacacaccggagacttttggggggaaactaggtcgatggtcggcggcgcccggatgggcagctgaggattgcctttgaggttattttaaaagttttgagttgtacagcacttgattattttgctgcattgtgaaaggacctctccagcaatgattacttcagaattaccagtgttacaggattcaactaatgaaactactgcccattccgatgctggcagcgagcttgaagaaacagaggtcaaaggaaaaagaaaaaggggtcgtcctggccggcctccatctacaaataagaaacctcgaaaatctccaggtgagaagagcagaattgaagctggaattagaggagcaggccgtggaagagctaatggacaccctcaacagaatggggaaggggagcctgtcacattatttgaggtggtgaaactggggaaaagtgcaatgcagtccgtggtggatgactggattgaatcatataaacaagacagggacatcgcacttctggatttaatcaacttttttatccagtgttcaggatgtcgaggtactgtgagaatagagatgtttcgaaatatgcagaatgcagaaatcatcagaaaaatgactgaagaatttgatgaggacagtggtgattatcctcttaccatgcctggacctcagtggaaaaaatttcgttcaaacttttgtgaatttattggagtcctgattcgacagtgtcagtatagcataatttatgatgagtatatgatggacacagtaatctcccttttgacgggtttgtcagactcccaggtcagagcttttaggcatacaagtaccctggctgccatgaagctcatgactgctctggtgaatgttgccttaaacctcagtattcatcaggataatacccagagacaatatgaagccgagagaaataaaatgattgggaagagagccaatgaaaggttggagttactacttcagaaacgcaaagagctgcaagaaaatcaggatgaaatcgaaaatatgatgaactctatttttaagggtatatttgttcatagataccgtgatgctattgctgagattagagccatttgtattgaagaaattggagtatggatgaaaatgtatagtgatgccttcctaaatgacagttacctaaaatatgttggctggactcttcatgacaggcaaggggaagtcaggctgaagtgtttgaaagctctgcagagtctatataccaatagagaattattccccaaattggaactattcactaaccgattcaaggatcgcattgtatcaatgacacttgataaagaatatgatgttgctgtggaagctattcgattggttactctgatacttcatggaagtgaagaagctctttccaatgaagactgtgaaaatgtttaccacttggtgtactcggcacatcgccctgttgctgtggcagctggagagttccttcacaaaaagctatttagcagacatgacccacaagcagaagaagcattagcaaagaggaggggaagaaacagcccgaatggaaacctcattaggatgctggttcttttctttcttgaaagtgagttacatgaacatgcagcctacttggtggacagtttatgggagagctctcaagaactgttgaaagactgggaatgtatgacagagttgctattagaagaacctgttcaaggagaggaagcaatgtctgatcgtcaagagagtgctcttatagagctaatggtttgtacaattcgtcaagctgctgaggcacatcctccagtgggaaggggtaccggcaagagagtgctaactgccaaagaaaggaaaactcaaattgatgatagaaacaaattgactgaacattttattattacacttcctatgttactgtcaaagtattctgcagatgcagagaaggtagcaaacttgctacaaatcccacagtattttgatttagaaatctacagcacaggtagaatggaaaagcatctggatgctttattaaaacagattaagtttgttgtggagaaacacgtagaatcagatgttctagaagcctgcagtaaaacctatagtatcttatgcagtgaagaatataccatccagaacagagttgacatagctcgaagccagctgattgatgagtttgtagatcgattcaatcattctgtggaagacctattgcaagagggagaagaagctgatgatgatgacatttacaatgttctttctacattaaagcggttaacttcttttcacaatgcacatgatctcacaaaatgggatctctttggtaattgctacagattattgaagactggaattgaacatggagccatgccagaacagatagtcgtgcaagcactgcagtgttcccattattcgattctttggcagttggtgaaaattactgatggctctccttccaaagaggatttgttggtattgaggaaaacggtgaaatcctttttggctgtttgccagcagtgcctgtctaatgttaatactccagtgaaagaacaggctttcatgttactctgtgatcttctgatgattttcagccaccaattaatgacaggtggcagagagggccttcagcctttggtgttcaatccagatactggactccaatctgaactcctcagttttgtgatggatcacgtttttattgaccaagacgaggagaaccagagcatggagggtgatgaagaagatgaagctaataaaattgaggccttacataaaagaaggaatctacttgctgctttcagcaaacttatcatttatgacattgttgacatgcatgcagctgcagacatcttcaaacactacatgaagtattacaatgactatggtgatattattaaggaaacactgagtaaaaccaggcagattgataaaattcagtgtgccaagactctcattctcagtttgcaacagttatttaatgaacttgttcaagagcaaggtcccaacctagataggacatctgcccatgtcagtggcattaaagaactggcacgtcgctttgcccttacatttggattggaccagattaagacacgagaagcagttgccacacttcacaaggatggcatagagtttgcatttaaataccaaaatcagaaaggacaagagtatccacctcctaatctggcttttcttgaagtactaagtgaattttcttctaaacttcttcgacaggacaaaaagacagttcattcatacctagagaaattccttaccgagcagatgatggaaaggagggaggatgtatggcttccactcatctcctatagaaattcattagtcactgggggtgaagatgatagaatgtctgtgaacagtggaagtagcagcagcaaaacctcatcagtaaggaataagaaaggacgacctccacttcataaaaaacgagtagaagatgagagtctggataacacatggctaaacaggactgacaccatgattcagactcctggccccctgccagcaccacaactcacatccactgtactgcgggagaacagtcggcccatgggagaccagattcaagaacctgagtctgaacatggttctgaaccagactttttacacaatcctcagatgcagatctcttggttaggccagccgaagttagaagacttaaatcggaaggacagaacaggaatgaactacatgaaagtgagaactggagtgaggcatgctgttcggggtctaatggaggaagatgctgagcccatctttgaagatgtgatgatgtcatcccgaagccagttagaagatatgaatgaagaatttgaggacaccatggttattgatctgcctccatcaagaaatcggcgagagagagctgagctaaggccagacttctttgactctgcagctatcatagaagatgattcaggatttggaatgcctatgttctgaagtctgaagaaaatttacaaatctggaactctattatttagagctagaggcctatatactgtgatagcttgtatggggaaaaacacttttgatgtgatctgatttgttttttaatcaaatgattaaggtcaatccctttttgcagtgacagaagaggagcatgtaaattacccaagggaatgttggtgaatgtcaactcagaaagactgacctgaaaatcatttgtgtcctactgttggacttatcccaatacagatgtgtgtgtttttctggagggaggaagaaattttaaatttttaaaacagctgtcaagataaacactgttatacacctgttttatgaaaactcaacattgagtaaaaaaaaacatatttttaactttattttcctgttgtacaatttaaaaaccgttttaacattttgcctttttatgttttaaaagctaaccatttttattaaacctatgagtaagcagctcatcctaattgcgaagagtgttttggagttcactggatttggttgacctttgtggaacacaaataatgaaggagcagaacattgacaagctaagatgaaattctgacatagtacatctctgccaaaaaccacacaccctctgtggatatggatatgaattcccagattttatatactcttgaataaaaggtttatttttatttataagtgggcataaaataagaaatgtccatgcagccatttttccaacagatgctgtacaccgttcattttatatagactagggagattcaaatacagtgcattttctattggtatttgttctgtgcatttttagcaacttctaccagcaaataaagtattctcagtaaaacgaaaatgattctcaagttatcagtttgctgtttttaccacttatttcatgccctgccaaattcaagttacacagacttccattttcttaagataatcaatcatgaagaaatcctttatcaatcattcaaaagtaattttaagtgtaacataactgtgtttacttcccatgcacttaatacccttatgcgctaattttgtgaattaagtttactgattatagaagtatgtgctgcatagaagtctgtgcttagagggtgaagttcctaagcttaccttgaattacagctacatttcagtgttaaatgtgcatattaagaataattcttttggggaaagaaattatgaatcttcaggacagtctacaatggtttagagttacattctgcctagacttttatgacttgctgctattgttttaaaaaccccacttagtctcttcctttctgatttctaaagtaagcctcagaatttccaaaccaattcatccacagctgtttctgggctggtttttaaagtagctgcaacagaatcatgaggctttccctttttatcaaatacgaaaaacattttttaaaattctgcacacccagtgatcatcttttgtgcgggaaagcaagatgatgatggatgattttattcatccttttagtaaagacacaaaacatttttctcaacatttgtacagttctgaaaaaaacctggtcaccaaaaatatcttctctgctaattcagcaattcttgggctccagttaggggagctggggcctcactttctcccagaattgtgggcttcactggaagtgaaggtgcaggaatgactggactgtccaccccagccctgcctgcctgtggttttggccagggagcaagccatgaggtgccctggcacatgcacaaattgatcctttgcgtgacagtcttgtatggaaaacagatgctgacagaattgtagactaccatgccacacaaaaaggctaaatatctactccaatgggtttccagttcagtttgaagtcaatcaaatttttgtattttcggtgtctccttgattggttttgctagtaattctgtaaattgtacatttgcaatatgaggttttttttccttttgtacaatttgaaactgatgcttcacctttcctttaataaactattcaaaatca

SEQ ID NO: 24495 - DNA, 3421 bp, Homo sapiens
aggaggtggtcacagatattttataatggaggcaaggtcaaaccggaattggagtcccatagctctgagcccaggaaactggatgaatttatctattagtatggactgggactggcatctttaacaacatggaaagcttgaaacagtctttgtggaaaataggagatcagccagagattagaagaaaacgcaagaaaattataagtaggagtccagtcacgaattcatatccaatctggtcagttatgacttcctccagcgaaaagccacacatcttgcaaacccttgagagagaaaacacaaataggggtaacctactggagacaggcccttaagactataaagtagttgagcgattccatactgaaatagagttggctatagcgatagagaagttagtcatatatgggcctaatgatccaggagagtaaggattcacttttgtggtgaaaagttgtaagcaggtgaaaggtagggatccatggccacggacgggcaggtggagatcagggaagaggcgacgttaaacataaatagtttgttaatgatttcaccttactgattatttctcttttggcatctagaaggctaagattctcatgtgtatttcagagctactgaaagtagtcctaggttgtggagggagaaatccactttcacagctgagtctatcttctcagtctagttatattctcctctcacaaactagccaatgctgccgccttatgcaaagccgacaccacggaaagatgtgctttacagaggcaggatgacgccaatcggcctagggccggcggtgtttcgtctagattaatggcgagggaagtccccaatagtccttttgaaaccttttcactcttgcctggtgaaagcgcttgtcagccgtaaatcgcgaatacaatgctaagctctgaggcccttgctaaatccaagtaggagcagggatctgcgcggcctcaccctcgggtttccgcagggcgtctcgagagctgcggatgggggcagcaggagccgggcgggaacagaggaaagcgccggccctgagacctagggaggagcctcggtgaaggaacccggggcgggttcctgcctagatctccaagaagctccaaaaatggcgggcggcaactcggcgagccggacgcgcaggcgccaccgtggccgtccttccgccagccgcgggcggcccaagaaccgtccacagcgcccttatccagaagcctacgcctctcgcgattggctgaactgcgcgagcgctccgtgtgggggcggggccgccacgcagcggccacgtttcccgccccgctggtgcgcgtgcgcgcaatccccactggaaagcgtttgcgcgcgcccctgccgcggcccctagctcgcgcctcagctccctcccctttccgggcaggcccgtcccgtcagcaaggcagtgagcaccgcggccagcagagggcggtccggacccaagtctgcagcggcgccattggcgtgtggaaaatgccaccagatggcgggttaggattgcagctccgttgaaggcgcggcccccgctcccgaacccccggcgaccaccccgtaacaacccccccacatcgggaataacacaccggagacttttggggggaaactaggtcgatggtcggcggcgcccggatgggcagctgaggattgcctttgaggttattttaaaagttttgagttgtacagcacttgattattttgctgcattgtgaaaggacctctccagcaatgattacttcagaattaccagtgttacaggattcaactaatgaaactactgcccattccgatgctggcagcgagcttgaagaaacagaggtcaaaggaaaaagaaaaaggggtcgtcctggccggcctccatctacaaataagaaacctcgaaaatctccaggtgagaagagcagaattgaagctggaattagaggagcaggccgtggaagagctaatggacaccctcaacagaatggggaaggggagcctgtcacattatttgaggtggtgaaactggggaaaagtgcaatgcagtccgtggtggatgactggattgaatcatataaacaagacagggacatcgcacttctggatttaatcaacttttttatccagtgttcaggatgtcgaggtactgtgagaatagagatgtttcgaaatatgcagaatgcagaaatcatcagaaaaatgactgaagaatttgatgaggacagtggtgattatcctcttaccatgcctggacctcagtggaaaaaatttcgttcaaacttttgtgaatttattggagtcctgattcgacagtgtcagtatagcataatttatgatgagtatatgatggacacagtaatctcccttttgacgggtttgtcagactcccaggtcagagcttttaggcatacaagtaccctggctgccatgaagctcatgactgctctggtgaatgttgccttaaacctcagtattcatcaggataatacccagagacaatatgaagccgagagaaataaaatgattgggaagagagccaatgaaaggttggagttactacttcagaaacgcaaagagctgcaagaaaatcaggatgaaatcgaaaatatgatgaactctatttttaagggtatatttgttcatagataccgtgatgctattgctgagattagagccatttgtattgaagaaattggagtatggatgaaaatgtatagtgatgccttcctaaatgacagttacctaaaatatgttggctggactcttcatgacaggcaaggggaagtcaggctgaagtgtttgaaagctctgcagagtctatataccaatagagaattattccccaaattggaactattcactaaccgattcaaggatcgcattgtatcaatgacacttgataaagaatatgatgttgctgtggaagctattcgattggttactctgatacttcatggaagtgaagaagctctttccaatgaagactgtgaaaatgtttaccacttggtgtactcggcacatcgccctgttgctgtggcagctggagagttccttcacaaaaagctatttagcagacatgacccacaagcagaagaagcattagcaaagaggaggggaagaaacagcccgaatggaaacctcattaggatgctggttcttttctttcttgaaagtgaggtaaaaaatgttttaagataattccttatttcttttattatattacattttaaatgtcaattcattttaatttttttcaatcaaataaaaacaagtctgtttcttataaagttaccttcatgaattgcatgatatagaatcagtcctttaccttttgtggaaaggtgttctgaatatatatgtaggtgtggatcaacactgaatacagactggcaattgttaaacttttacagtattgcaatactgcata

SEQ ID NO: 24496 - DNA, 2797 bp, Homo sapiens
aggaggtggtcacagatattttataatggaggcaaggtcaaaccggaattggagtcccatagctctgagcccaggaaactggatgaatttatctattagtatggactgggactggcatctttaacaacatggaaagcttgaaacagtctttgtggaaaataggagatcagccagagattagaagaaaacgcaagaaaattataagtaggagtccagtcacgaattcatatccaatctggtcagttatgacttcctccagcgaaaagccacacatcttgcaaacccttgagagagaaaacacaaataggggtaacctactggagacaggcccttaagactataaagtagttgagcgattccatactgaaatagagttggctatagcgatagagaagttagtcatatatgggcctaatgatccaggagagtaaggattcacttttgtggtgaaaagttgtaagcaggtgaaaggtagggatccatggccacggacgggcaggtggagatcagggaagaggcgacgttaaacataaatagtttgttaatgatttcaccttactgattatttctcttttggcatctagaaggctaagattctcatgtgtatttcagagctactgaaagtagtcctaggttgtggagggagaaatccactttcacagctgagtctatcttctcagtctagttatattctcctctcacaaactagccaatgctgccgccttatgcaaagccgacaccacggaaagatgtgctttacagaggcaggatgacgccaatcggcctagggccggcggtgtttcgtctagattaatggcgagggaagtccccaatagtccttttgaaaccttttcactcttgcctggtgaaagcgcttgtcagccgtaaatcgcgaatacaatgctaagctctgaggcccttgctaaatccaagtaggagcagggatctgcgcggcctcaccctcgggtttccgcagggcgtctcgagagctgcggatgggggcagcaggagccgggcgggaacagaggaaagcgccggccctgagacctagggaggagcctcggtgaaggaacccggggcgggttcctgcctagatctccaagaagctccaaaaatggcgggcggcaactcggcgagccggacgcgcaggcgccaccgtggccgtccttccgccagccgcgggcggcccaagaaccgtccacagcgcccttatccagaagcctacgcctctcgcgattggctgaactgcgcgagcgctccgtgtgggggcggggccgccacgcagcggccacgtttcccgccccgctggtgcgcgtgcgcgcaatccccactggaaagcgtttgcgcgcgcccctgccgcggcccctagctcgcgcctcagctccctcccctttccgggcaggcccgtcccgtcagcaaggcagtgagcaccgcggccagcagagggcggtccggacccaagtctgcagcggcgccattggcgtgtggaaaatgccaccagatggcgggttaggattgcagctccgttgaaggcgcggcccccgctcccgaacccccggcgaccaccccgtaacaacccccccacatcgggaataacacaccggagacttttggggggaaactaggtcgatggtcggcggcgcccggatgggcagctgaggattgcctttgaggttattttaaaagttttgagttgtacagcacttgattattttgctgcattgtgaaaggacctctccagcaatgattacttcagaattaccagtgttacaggattcaactaatgaaactactgcccattccgatgctggcagcgagcttgaagaaacagaggtcaaaggaaaaagaaaaaggggtcgtcctggccggcctccatctacaaataagaaacctcgaaaatctccaggtgagaagagcagaattgaagctggaattagaggagcaggccgtggaagagctaatggacaccctcaacagaatggggaaggggagcctgtcacattatttgaggtggtgaaactggggaaaagtgcaatgcagtccgtggtggatgactggattgaatcatataaacaagacagggacatcgcacttctggatttaatcaacttttttatccagtgttcaggatgtcgaggtactgtgagaatagagatgtttcgaaatatgcagaatgcagaaatcatcagaaaaatgactgaagaatttgatgaggacagtggtgattatcctcttaccatgcctggacctcagtggaaaaaatttcgttcaaacttttgtgaatttattggagtcctgattcgacagtgtcagtatagcataatttatgatgagtatatgatggacacagtaatctcccttttgacgggtttgtcagactcccaggtcagagcttttaggcatacaagtaccctggctggacaagtcttggggactagataaaatgggcaggaacatttaatcctctgcttcaaagactatgtgcatggacagttacaaggcagttatggccagatatgattatcggctttggaataaaatgctccttgacattgcttaaatcttagctgagaagagagacaatcaggttagttattttgtagggtacagatgtgatgagttccagagcttcataagtcatcagagtggtcttatcagtagtatttttaatctgttttccaaatatcccattttcctgttatgaattcaatatgtgtccctgttgtcagtgtttatgcattgcatttaattgtatacttttacatttttattaaaagttttttttatcattaaatag

SEQ ID NO: 24497 - DNA, 2172 bp, Homo sapiens
  misc_feature (2144)..(2144): n is a, c, g, or t
aggaggtggtcacagatattttataatggaggcaaggtcaaaccggaattggagtcccatagctctgagcccaggaaactggatgaatttatctattagtatggactgggactggcatctttaacaacatggaaagcttgaaacagtctttgtggaaaataggagatcagccagagattagaagaaaacgcaagaaaattataagtaggagtccagtcacgaattcatatccaatctggtcagttatgacttcctccagcgaaaagccacacatcttgcaaacccttgagagagaaaacacaaataggggtaacctactggagacaggcccttaagactataaagtagttgagcgattccatactgaaatagagttggctatagcgatagagaagttagtcatatatgggcctaatgatccaggagagtaaggattcacttttgtggtgaaaagttgtaagcaggtgaaaggtagggatccatggccacggacgggcaggtggagatcagggaagaggcgacgttaaacataaatagtttgttaatgatttcaccttactgattatttctcttttggcatctagaaggctaagattctcatgtgtatttcagagctactgaaagtagtcctaggttgtggagggagaaatccactttcacagctgagtctatcttctcagtctagttatattctcctctcacaaactagccaatgctgccgccttatgcaaagccgacaccacggaaagatgtgctttacagaggcaggatgacgccaatcggcctagggccggcggtgtttcgtctagattaatggcgagggaagtccccaatagtccttttgaaaccttttcactcttgcctggtgaaagcgcttgtcagccgtaaatcgcgaatacaatgctaagctctgaggcccttgctaaatccaagtaggagcagggatctgcgcggcctcaccctcgggtttccgcagggcgtctcgagagctgcggatgggggcagcaggagccgggcgggaacagaggaaagcgccggccctgagacctagggaggagcctcggtgaaggaacccggggcgggttcctgcctagatctccaagaagctccaaaaatggcgggcggcaactcggcgagccggacgcgcaggcgccaccgtggccgtccttccgccagccgcgggcggcccaagaaccgtccacagcgcccttatccagaagcctacgcctctcgcgattggctgaactgcgcgagcgctccgtgtgggggcggggccgccacgcagcggccacgtttcccgccccgctggtgcgcgtgcgcgcaatccccactggaaagcgtttgcgcgcgcccctgccgcggcccctagctcgcgcctcagctccctcccctttccgggcaggcccgtcccgtcagcaaggcagtgagcaccgcggccagcagagggcggtccggacccaagtctgcagcggcgccattggcgtgtggaaaatgccaccagatggcgggttaggattgcagctccgttgaaggcgcggcccccgctcccgaacccccggcgaccaccccgtaacaacccccccacatcgggaataacacaccggagacttttggggggaaactaggtcgatggtcggcggcgcccggatgggcagctgaggattgcctttgaggttattttaaaagttttgagttgtacagcacttgattattttgctgcattgtgaaaggacctctccagcaatgattacttcagaattaccagtgttacaggattcaactaatgaaactactgcccattccgatgctggcagcgagcttgaagaaacagaggtcaaaggaaaaagaaaaaggggtcgtcctggccggcctccatctacaaataagaaacctcgaaaatctccaggtgagaagagcagaattgaagctggaattagaggagcaggccgtggaagagctaatggacaccctcaacagaatggggaaggggagcctgtcacattatttgaggtggtgaaactggggaaaagtgcaatgcagagatgttgacctttcaaataggtcagtgttgtccaggctgacctcgaacttctgggcccaagtgatcctccccggcctgagcctctcgagtagctgggactacngagccttcatgttgttgcattcacttgg

SEQ ID NO: 24498 - DNA, 331 bp, Homo sapiens
ctccccctttttgttgttgttgttgttaaacactgaaatgatttgtgtgttgagggaagactaaagttcatattcatgtaactttgcaatgccctgtttttcatttccaggctatttagcagacatgacccacaagcagaagaagcattagcaaagaggaggggaagaaacagcccgaatggaaacctcattaggatgctggttcttttctttcttgaaagtgaggtaaaaaatgttttaagataattccttatttcttttattatattacattttaaatgtcaattcattttaatttttttcaatcaaataaaaacaagtctgtttctta

SEQ ID NO: 24499 - DNA, 725 bp, Homo sapiens
ctctcagaaagctccaaatgtcattgtctagcccagtgaaaatagagtaattgggtcaaaatagtttaatagaagctttttttttccagtttggtattattagtgtttattttatagaaaacatgaaaaacagaagatacttaagttggaggccattcagaatgcaaatatatacaaacagcattagaaatatttattgcttatggaaagcgagtatgaatgcattctagctttgtatattaatttgagattgtcttttttttctctctctagtgatgctattgctgagattagagccatttgtattgaagaaattggagtatggatgaaaatgtatagtgatgccttcctaaatgacagttacctaaaatatgttggctggactcttcatgacagggtaagttactctgttctaagctttgatggaagttatgtttgtctcagtactaaaatgctgggaatcaaaatgacagtagttgatttttcaggagttgtaatcatgtggaaattttaagatgatgcagctgaataactatttacttgatgattgtgatgaaactggaagcatttgcccaggggtgaagaccctatcttgtttagttacaatattgtcttgaaccaagtttgacaacctggtatatataaagttttcagagaaagaaaatcattatattctttttctaattcagaatcaaaggagatttcttttttcttaatatataaaa

SEQ ID NO: 24500 - DNA, 7534 bp, Homo sapiens
aggaggtggtcacagatattttataatggaggcaaggtcaaaccggaattggagtcccatagctctgagcccaggaaactggatgaatttatctattagtatggactgggactggcatctttaacaacatggaaagcttgaaacagtctttgtggaaaataggagatcagccagagattagaagaaaacgcaagaaaattataagtaggagtccagtcacgaattcatatccaatctggtcagttatgacttcctccagcgaaaagccacacatcttgcaaacccttgagagagaaaacacaaataggggtaacctactggagacaggcccttaagactataaagtagttgagcgattccatactgaaatagagttggctatagcgatagagaagttagtcatatatgggcctaatgatccaggagagtaaggattcacttttgtggtgaaaagttgtaagcaggtgaaaggtagggatccatggccacggacgggcaggtggagatcagggaagaggcgacgttaaacataaatagtttgttaatgatttcaccttactgattatttctcttttggcatctagaaggctaagattctcatgtgtatttcagagctactgaaagtagtcctaggttgtggagggagaaatccactttcacagctgagtctatcttctcagtctagttatattctcctctcacaaactagccaatgctgccgccttatgcaaagccgacaccacggaaagatgtgctttacagaggcaggatgacgccaatcggcctagggccggcggtgtttcgtctagattaatggcgagggaagtccccaatagtccttttgaaaccttttcactcttgcctggtgaaagcgcttgtcagccgtaaatcgcgaatacaatgctaagctctgaggcccttgctaaatccaagtaggagcagggatctgcgcggcctcaccctcgggtttccgcagggcgtctcgagagctgcggatgggggcagcaggagccgggcgggaacagaggaaagcgccggccctgagacctagggaggagcctcggtgaaggaacccggggcgggttcctgcctagatctccaagaagctccaaaaatggcgggcggcaactcggcgagccggacgcgcaggcgccaccgtggccgtccttccgccagccgcgggcggcccaagaaccgtccacagcgcccttatccagaagcctacgcctctcgcgattggctgaactgcgcgagcgctccgtgtgggggcggggccgccacgcagcggccacgtttcccgccccgctggtgcgcgtgcgcgcaatccccactggaaagcgtttgcgcgcgcccctgccgcggcccctagctcgcgcctcagctccctcccctttccgggcaggcccgtcccgtcagcaaggcagtgagcaccgcggccagcagagggcggtccggacccaagtctgcagcggcgccattggcgtgtggaaaatgccaccagatggcgggttaggattgcagctccgttgaaggcgcggcccccgctcccgaacccccggcgaccaccccgtaacaacccccccacatcgggaataacacaccggagacttttggggggaaactaggtcgatggtcggcggcgcccggatgggcagctgaggattgcctttgaggttattttaaaagttttgagttgtacagcacttgattattttgctgcattgtgaaaggacctctccagcaatgattacttcagaattaccagtgttacaggattcaactaatgaaactactgcccattccgatgctggcagcgagcttgaagaaacagaggtcaaaggaaaaagaaaaaggggtcgtcctggccggcctccatctacaaataagaaacctcgaaaatctccaggtgagaagagcagaattgaagctggaattagaggagcaggccgtggaagagctaatggacaccctcaacagaatggggaaggggagcctgtcacattatttgaggtggtgaaactggggaaaagtgcaatgcagtccgtggtggatgactggattgaatcatataaacaagacagggacatcgcacttctggatttaatcaacttttttatccagtgttcaggatgtcgaggtactgtgagaatagagatgtttcgaaatatgcagaatgcagaaatcatcagaaaaatgactgaagaatttgatgaggacagtggtgattatcctcttaccatgcctggacctcagtggaaaaaatttcgttcaaacttttgtgaatttattggagtcctgattcgacagtgtcagtatagcataatttatgatgagtatatgatggacacagtaatctcccttttgacgggtttgtcagactcccaggtcagagcttttaggcatacaagtaccctggctgccatgaagctcatgactgctctggtgaatgttgccttaaacctcagtattcatcaggataatacccagagacaatatgaagccgagagaaataaaatgattgggaagagagccaatgaaaggttggagttactacttcagaaacgcaaagagctgcaagaaaatcaggatgaaatcgaaaatatgatgaactctatttttaagggtatatttgttcatagataccgtgatgctattgctgagattagagccatttgtattgaagaaattggagtatggatgaaaatgtatagtgatgccttcctaaatgacagttacctaaaatatgttggctggactcttcatgacaggcaaggggaagtcaggctgaagtgtttgaaagctctgcagagtctatataccaatagagaattattccccaaattggaactattcactaaccgattcaaggatcgcattgtatcaatgacacttgataaagaatatgatgttgctgtggaagctattcgattggttactctgatacttcatggaagtgaagaagctctttccaatgaagactgtgaaaatgtttaccacttggtgtactcggcacatcgccctgttgctgtggcagctggagagttccttcacaaaaagctatttagcagacatgacccacaagcagaagaagcattagcaaagaggaggggaagaaacagcccgaatggaaacctcattaggatgctggttcttttctttcttgaaagtgagttacatgaacatgcagcctacttggtggacagtttatgggagagctctcaagaactgttgaaagactgggaatgtatgacagagttgctattagaagaacctgttcaaggagaggaagcaatgtctgatcgtcaagagagtgctcttatagagctaatggtttgtacaattcgtcaagctgctgaggcacatcctccagtgggaaggggtaccggcaagagagtgctaactgccaaagaaaggaaaactcaaattgatgatagaaacaaattgactgaacattttattattacacttcctatgttactgtcaaagtattctgcagatgcagagaaggtagcaaacttgctacaaatcccacagtattttgatttagaaatctacagcacaggtagaatggaaaagcatctggatgctttattaaaacagattaagtttgttgtggagaaacacgtagaatcagatgttctagaagcctgcagtaaaacctatagtatcttatgcagtgaagaatataccatccagaacagagttgacatagctcgaagccagctgattgatgagtttgtagatcgattcaatcattctgtggaagacctattgcaagagggagaagaagctgatgatgatgacatttacaatgttctttctacattaaagcggttaacttcttttcacaatgcacatgatctcacaaaatgggatctctttggtaattgctacagattattgaagactggaattgaacatggagccatgccagaacagatagtcgtgcaagcactgcagtgttcccattattcgattctttggcagttggtgaaaattactgatggctctccttccaaagaggatttgttggtattgaggaaaacggtgaaatcctttttggctgtttgccagcagtgcctgtctaatgttaatactccagtgaaagaacaggctttcatgttactctgtgatcttctgatgattttcagccaccaattaatgacaggtggcagagagggccttcagcctttggtgttcaatccagatactggactccaatctgaactcctcagttttgtgatggatcacgtttttattgaccaagacgaggagaaccagagcatggagggtgatgaagaagatgaagctaataaaattgaggccttacataaaagaaggaatctacttgctgctttcagcaaacttatcatttatgacattgttgacatgcatgcagctgcagacatcttcaaacactacatgaagtattacaatgactatggtgatattattaaggaaacactgagtaaaaccaggcagattgataaaattcagtgtgccaagactctcattctcagtttgcaacagttatttaatgaacttgttcaagagcaaggtcccaacctagataggacatctgcccatgtcagtggcattaaagaactggcacgtcgctttgcccttacatttggattggaccagattaagacacgagaagcagttgccacacttcacaaggatggcatagagtttgcatttaaataccaaaatcagaaaggacaagagtatccacctcctaatctggcttttcttgaagtactaagtgaattttcttctaaacttcttcgacaggacaaaaagacagttcattcatacctagagaaattccttaccgagcagatgatggaaaggagggaggatgtatggcttccactcatctcctatagaaattcattagtcactgggggtgaagatgatagaatgtctgtgaacagtggaagtagcagcagcaaaacctcatcagtaaggaataagaaaggacgacctccacttcataaaaaacgagtagaagatgagagtctggataacacatggctaaacaggactgacaccatgattcagactcctggccccctgccagcaccacaactcacatccactgtactgcgggagaacagtcggcccatgggagaccagattcaagaacctgagtctgaacatggttctgaaccagactttttacacaatcctcagatgcagatctcttggttaggccagccgaagttagaagacttaaatcggaaggacagaacaggaatgaactacatgaaagtgagaactggagtgaggcatgctgttcggggtctaatggaggaagatgctgagcccatctttgaagatgtgatgatgtcatcccgaagccagttagaagatatgaatgaagaatttgaggacaccatggttattgatctgcctccatcaagaaatcggcgagagagagctgagctaaggccagacttctttgactctgcagctatcatagaagatgattcaggatttggaatgcctatgttctgaagtctgaagaaaatttacaaatctggaactctattatttagagctagaggcctatatactgtgatagcttgtatggggaaaaacacttttgatgtgatctgatttgttttttaatcaaatgattaaggtcaatccctttttgcagtgacagaagaggagcatgtaaattacccaagggaatgttggtgaatgtcaactcagaaagactgacctgaaaatcatttgtgtcctactgttggacttatcccaatacagatgtgtgtgtttttctggagggaggaagaaattttaaatttttaaaacagctgtcaagataaacactgttatacacctgttttatgaaaactcaacattgagtaaaaaaaaacatatttttaactttattttcctgttgtacaatttaaaaaccgttttaacattttgcctttttatgttttaaaagctaaccatttttattaaacctatgagtaagcagctcatcctaattgcgaagagtgttttggagttcactggatttggttgacctttgtggaacacaaataatgaaggagcagaacattgacaagctaagatgaaattctgacatagtacatctctgccaaaaaccacacaccctctgtggatatggatatgaattcccagattttatatactcttgaataaaaggtttatttttatttataagtgggcataaaataagaaatgtccatgcagccatttttccaacagatgctgtacaccgttcattttatatagactagggagattcaaatacagtgcattttctattggtatttgttctgtgcatttttagcaacttctaccagcaaataaagtattctcagtaaaacgaaaatgattctcaagttatcagtttgctgtttttaccacttatttcatgccctgccaaattcaagttacacagacttccattttcttaagataatcaatcatgaagaaatcctttatcaatcattcaaaagtaattttaagtgtaacataactgtgtttacttcccatgcacttaatacccttatgcgctaattttgtgaattaagtttactgattatagaagtatgtgctgcatagaagtctgtgcttagagggtgaagttcctaagcttaccttgaattacagctacatttcagtgttaaatgtgcatattaagaataattcttttggggaaagaaattatgaatcttcaggacagtctacaatggtttagagttacattctgcctagacttttatgacttgctgctattgttttaaaaaccccacttagtctcttcctttctgatttctaaagtaagcctcagaatttccaaaccaattcatccacagctgtttctgggctggtttttaaagtagctgcaacagaatcatgaggctttccctttttatcaaatacgaaaaacattttttaaaattctgcacacccagtgatcatcttttgtgcgggaaagcaagatgatgatggatgattttattcatccttttagtaaagacacaaaacatttttctcaacatttgtacagttctgaaaaaaacctggtcaccaaaaatatcttctctgctaattcagcaattcttgggctccagttaggggagctggggcctcactttctcccagaattgtgggcttcactggaagtgaaggtgcaggaatgactggactgtccaccccagccctgcctgcctgtggttttggccagggagcaagccatgaggtgccctggcacatgcacaaattgatcctttgcgtgacagtcttgtatggaaaacagatgctgacagaattgtagactaccatgccacacaaaaaggctaaatatctactccaatgggtttccagttcagtttgaagtcaatcaaatttttgtattttcggtgtctccttgattggttttgctagtaattctgtaaattgtacatttgcaatatgaggttttttttccttttgtacaatttgaaactgatgcttcacctttcctttaataaactattcaaaatca

SEQ ID NO: 24501 - DNA, 6087 bp, Homo sapiens
  misc_feature (14)..(14): n is a, c, g, or t
acatttgtgcaatngaggtggtacggtcggattccgggttgtaaatgccaccagatggcgggttaggattgcagctccgttgaaggcgcggcccccgctcccgaacccccggcgaccaccccgtaacaacccccccacatcgggaataacacaccggagacttttggggggaaactaggtcgatggtcggcggcgcccggatgggcagctgaggattgcctttgaggttattttaaaagttttgagttgtacagcacttgattattttgctgcattgtgaaaggacctctccagcaatgattacttcagaattaccagtgttacaggattcaactaatgaaactactgcccattccgatgctggcagcgagcttgaagaaacagaggtcaaaggaaaaagaaaaaggggtcgtcctggccggcctccatctacaaataagaaacctcgaaaatctccaggtgagaagagcagaattgaagctggaattagaggagcaggccgtggaagagctaatggacaccctcaacagaatggggaaggggagcctgtcacattatttgaggtggtgaaactggggaaaagtgcaatgcagtccgtggtggatgactggattgaatcatataaacaagacagggacatcgcacttctggatttaatcaacttttttatccagtgttcaggatgtcgaggtactgtgagaatagagatgtttcgaaatatgcagaatgcagaaatcatcagaaaaatgactgaagaatttgatgaggacagtggtgattatcctcttaccatgcctggacctcagtggaaaaaatttcgttcaaacttttgtgaatttattggagtcctgattcgacagtgtcagtatagcataatttatgatgagtatatgatggacacagtaatctcccttttgacgggtttgtcagactcccaggtcagagcttttaggcatacaagtaccctggctgccatgaagctcatgactgctctggtgaatgttgccttaaacctcagtattcatcaggataatacccagagacaatatgaagccgagagaaataaaatgattgggaagagagccaatgaaaggttggagttactacttcagaaacgcaaagagctgcaagaaaatcaggatgaaatcgaaaatatgatgaactctatttttaagggtatatttgttcatagataccgtgatgctattgctgagattagagccatttgtattgaagaaattggagtatggatgaaaatgtatagtgatgccttcctaaatgacagttacctaaaatatgttggctggactcttcatgacaggcaaggggaagtcaggctgaagtgtttgaaagctctgcagagtctatataccaatagagaattattccccaaattggaactattcactaaccgattcaaggatcgcattgtatcaatgacacttgataaagaatatgatgttgctgtggaagctattcgattggttactctgatacttcatggaagtgaagaagctctttccaatgaagactgtgaaaatgtttaccacttggtgtactcggcacatcgccctgttgctgtggcagctggagagttccttcacaaaaagctatttagcagacatgacccacaagcagaagaagcattagcaaagaggaggggaagaaacagcccgaatggaaacctcattaggatgctggttcttttctttcttgaaagtgagttacatgaacatgcagcctacttggtggacagtttatgggagagctctcaagaactgttgaaagactgggaatgtatgacagagttgctattagaagaacctgttcaaggagaggaagcaatgtctgatcgtcaagagagtgctcttatagagctaatggtttgtacaattcgtcaagctgctgaggcacatcctccagtgggaaggggtaccggcaagagagtgctaactgccaaagaaaggaaaactcaaattgatgatagaaacaaattgactgaacattttattattacacttcctatgttactgtcaaagtattctgcagatgcagagaaggtagcaaacttgctacaaatcccacagtattttgatttagaaatctacagcacaggtagaatggaaaagcatctggatgctttattaaaacagattaagtttgttgtggagaaacacgtagaatcagatgttctagaagcctgcagtaaaacctatagtatcttatgcagtgaagaatataccatccagaacagagttgacatagctcgaagccagctgattgatgagtttgtagatcgattcaatcattctgtggaagacctattgcaagagggagaagaagctgatgatgatgacatttacaatgttctttctacattaaagcggttaacttcttttcacaatgcacatgatctcacaaaatgggatctctttggtaattgctacagattattgaagactggaattgaacatggagccatgccagaacagatagtcgtgcaagcactgcagtgttcccattattcgattctttggcagttggtgaaaattactgatggctctccttccaaagaggatttgttggtattgaggaaaacggtgaaatcctttttggctgtttgccagcagtgcctgtctaatgttaatactccagtgaaagaacaggctttcatgttactctgtgatcttctgatgattttcagccaccaattaatgacaggtggcagagagggccttcagcctttggtgttcaatccagatactggactccaatctgaactcctcagttttgtgatggatcacgtttttattgaccaagacgaggagaaccagagcatggagggtgatgaagaagatgaagctaataaaattgaggccttacataaaagaaggaatctacttgctgctttcagcaaacttatcatttatgacattgttgacatgcatgcagctgcagacatcttcaaacactacatgaagtattacaatgactatggtgatattattaaggaaacactgagtaaaaccaggcagattgataaaattcagtgtgccaagactctcattctcagtttgcaacagttatttaatgaacttgttcaagagcaaggtcccaacctagataggacatctgcccatgtcagtggcattaaagaactggcacgtcgctttgcccttacatttggattggaccagattaagacacgagaagcagttgccacacttcacaaggatggcatagagtttgcatttaaataccaaaatcagaaaggacaagagtatccacctcctaatctggcttttcttgaagtactaagtgaattttcttctaaacttcttcgacaggacaaaaagacagttcattcatacctagagaaattccttaccgagcagatgatggaaaggagggaggatgtatggcttccactcatctcctatagaaattcattagtcactgggggtgaagatgatagaatgtctgtgaacagtggaagtagcagcagcaaaacctcatcagtaaggaataagaaaggacgacctccacttcataaaaaacgagtagaagatgagagtctggataacacatggctaaacaggactgacaccatgattcagactcctggccccctgccagcaccacaactcacatccactgtactgcgggagaacagtcggcccatgggagaccagattcaagaacctgagtctgaacatggttctgaaccagactttttacacaatcctcagatgcagatctcttggttaggccagccgaagttagaagacttaaatcggaaggacagaacaggaatgaactacatgaaagtgagaactggagtgaggcatgctgttcggggtctaatggaggaagatgctgagcccatctttgaagatgtgatgatgtcatcccgaagccagttagaagatatgaatgaagaatttgaggacaccatggttattgatctgcctccatcaagaaatcggcgagagagagctgagctaaggccagacttctttgactctgcagctatcatagaagatgattcaggatttggaatgcctatgttctgaagtctgaagaaaatttacaaatctggaactctattatttagagctagaggcctatatactgtgatagcttgtatggggaaaaacacttttgatgtgatctgatttgttttttaatcaaatgattaaggtcaatccctttttgcagtgacagaagaggagcatgtaaattacccaagggaatgttggtgaatgtcaactcagaaagactgacctgaaaatcatttgtgtcctactgttggacttatcccaatacagatgtgtgtgtttttctggagggaggaagaaattttaaatttttaaaacagctgtcaagataaacactgttatacacctgttttatgaaaactcaacattgagtaaaaaaaaacatatttttaactttattttcctgttgtacaatttaaaaaccgttttaacattttgcctttttatgttttaaaagctaaccatttttattaaacctatgagtaagcagctcatcctaattgcgaagagtgttttggagttcactggatttggttgacctttgtggaacacaaataatgaaggagcagaacattgacaagctaagatgaaattctgacatagtacatctctgccaaaaaccacacaccctctgtggatatggatatgaattcccagattttatatactcttgaataaaaggtttatttttatttataagtgggcataaaataagaaatgtccatgcagccatttttccaacagatgctgtacaccgttcattttatatagactagggagattcaaatacagtgcattttctattggtatttgttctgtgcatttttagcaacttctaccagcaaataaagtattctcagtaaaacgaaaatgattctcaagttatcagtttgctgtttttaccacttatttcatgccctgccaaattcaagttacacagacttccattttcttaagataatcaatcatgaagaaatcctttatcaatcattcaaaagtaattttaagtgtaacataactgtgtttacttcccatgcacttaatacccttatgcgctaattttgtgaattaagtttactgattatagaagtatgtgctgcatagaagtctgtgcttagagggtgaagttcctaagcttaccttgaattacagctacatttcagtgttaaatgtgcatattaagaataattcttttggggaaagaaattatgaatcttcaggacagtctacaatggtttagagttacattctgcctagacttttatgacttgctgctattgttttaaaaaccccacttagtctcttcctttctgatttctaaagtaagcctcagaatttccaaaccaattcatccacagctgtttctgggctggtttttaaagtagctgcaacagaatcatgaggctttccctttttatcaaatacgaaaaacattttttaaaattctgcacacccagtgatcatcttttgtgcgggaaagcaagatgatgatggatgattttattcatccttttagtaaagacacaaaacatttttctcaacatttgtacagttctgaaaaaaacctggtcaccaaaaatatcttctctgctaattcagcaattcttgggctccagttaggggagctggggcctcactttctcccagaattgtgggcttcactggaagtgaaggtgcaggaatgactggactgtccaccccagccctgcctgcctgtggttttggccagggagcaagccatgaggtgccctggcacatgcacaaattgatcctttgcgtgacagtcttgtatggaaaacagatgctgacagaattgtagactaccatgccacacaaaaaggctaaatatctactccaatgggtttccagttcagtttgaagtcaatcaaatttttgtattttcggtgtctccttgattggttttgctagtaattctgtaaattgtacatttgcaatatgaggttttttttccttttgtacaatttgaaactgatgcttcacctttcctttaataaactattcaaaatca

SEQ ID NO: 24502 - DNA, 4863 bp, Homo sapiens
tgtggtgatctagaggatccctatggatgaaaatgtatagtgatgccttcctaaatgacagttacctaaaatatgttggctggactcttcatgacaggcaaggggaagtcaggctgaagtgtttgaaagctctgcagagtctatataccaatagagaattattccccaaattggaactattcactaaccgattcaaggatcgcattgtatcaatgacacttgataaagaatatgatgttgctgtggaagctattcgattggttactctgatacttcatggaagtgaagaagctctttccaatgaagactgtgaaaatgtttaccacttggtgtactcggcacatcgccctgttgctgtggcagctggagagttccttcacaaaaagctatttagcagacatgacccacaagcagaagaagcattagcaaagaggaggggaagaaacagcccgaatggaaacctcattaggatgctggttcttttctttcttgaaagtgagttacatgaacatgcagcctacttggtggacagtttatgggagagctctcaagaactgttgaaagactgggaatgtatgacagagttgctattagaagaacctgttcaaggagaggaagcaatgtctgatcgtcaagagagtgctcttatagagctaatggtttgtacaattcgtcaagctgctgaggcacatcctccagtgggaaggggtaccggcaagagagtgctaactgccaaagaaaggaaaactcaaattgatgatagaaacaaattgactgaacattttattattacacttcctatgttactgtcaaagtattctgcagatgcagagaaggtagcaaacttgctacaaatcccacagtattttgatttagaaatctacagcacaggtagaatggaaaagcatctggatgctttattaaaacagattaagtttgttgtggagaaacacgtagaatcagatgttctagaagcctgcagtaaaacctatagtatcttatgcagtgaagaatataccatccagaacagagttgacatagctcgaagccagctgattgatgagtttgtagatcgattcaatcattctgtggaagacctattgcaagagggagaagaagctgatgatgatgacatttacaatgttctttctacattaaagcggttaacttcttttcacaatgcacatgatctcacaaaatgggatctctttggtaattgctacagattattgaagactggaattgaacatggagccatgccagaacagatagtcgtgcaagcactgcagtgttcccattattcgattctttggcagttggtgaaaattactgatggctctccttccaaagaggatttgttggtattgaggaaaacggtgaaatcctttttggctgtttgccagcagtgcctgtctaatgttaatactccagtgaaagaacaggctttcatgttactctgtgatcttctgatgattttcagccaccaattaatgacaggtggcagagagggccttcagcctttggtgttcaatccagatactggactccaatctgaactcctcagttttgtgatggatcacgtttttattgaccaagacgaggagaaccagagcatggagggtgatgaagaagatgaagctaataaaattgaggccttacataaaagaaggaatctacttgctgctttcagcaaacttatcatttatgacattgttgacatgcatgcagctgcagacatcttcaaacactacatgaagtattacaatgactatggtgatattattaaggaaacactgagtaaaaccaggcagattgataaaattcagtgtgccaagactctcattctcagtttgcaacagttatttaatgaacttgttcaagagcaaggtcccaacctagataggacatctgcccatgtcagtggcattaaagaactggcacgtcgctttgcccttacatttggattggaccagattaagacacgagaagcagttgccacacttcacaaggatggcatagagtttgcatttaaataccaaaatcagaaaggacaagagtatccacctcctaatctggcttttcttgaagtactaagtgaattttcttctaaacttcttcgacaggacaaaaagacagttcattcatacctagagaaattccttaccgagcagatgatggaaaggagggaggatgtatggcttccactcatctcctatagaaattcattagtcactgggggtgaagatgatagaatgtctgtgaacagtggaagtagcagcagcaaaacctcatcagtaaggaataagaaaggacgacctccacttcataaaaaacgagtagaagatgagagtctggataacacatggctaaacaggactgacaccatgattcagactcctggccccctgccagcaccacaactcacatccactgtactgcgggagaacagtcggcccatgggagaccagattcaagaacctgagtctgaacatggttctgaaccagactttttacacaatcctcagatgcagatctcttggttaggccagccgaagttagaagacttaaatcggaaggacagaacaggaatgaactacatgaaagtgagaactggagtgaggcatgctgttcggggtctaatggaggaagatgctgagcccatctttgaagatgtgatgatgtcatcccgaagccagttagaagatatgaatgaagaatttgaggacaccatggttattgatctgcctccatcaagaaatcggcgagagagagctgagctaaggccagacttctttgactctgcagctatcatagaagatgattcaggatttggaatgcctatgttctgaagtctgaagaaaatttacaaatctggaactctattatttagagctagaggcctatatactgtgatagcttgtatggggaaaaacacttttgatgtgatctgatttgttttttaatcaaatgattaaggtcaatccctttttgcagtgacagaagaggagcatgtaaattacccaagggaatgttggtgaatgtcaactcagaaagactgacctgaaaatcatttgtgtcctactgttggacttatcccaatacagatgtgtgtgtttttctggagggaggaagaaattttaaatttttaaaacagctgtcaagataaacactgttatacacctgttttatgaaaactcaacattgagtaaaaaaaaacatatttttaactttattttcctgttgtacaatttaaaaaccgttttaacattttgcctttttatgttttaaaagctaaccatttttattaaacctatgagtaagcagctcatcctaattgcgaagagtgttttggagttcactggatttggttgacctttgtggaacacaaataatgaaggagcagaacattgacaagctaagatgaaattctgacatagtacatctctgccaaaaaccacacaccctctgtggatatggatatgaattcccagattttatatactcttgaataaaaggtttatttttatttataagtgggcataaaataagaaatgtccatgcagccatttttccaacagatgctgtacaccgttcattttatatagactagggagattcaaatacagtgcattttctattggtatttgttctgtgcatttttagcaacttctaccagcaaataaagtattctcagtaaaacgaaaatgattctcaagttatcagtttgctgtttttaccacttatttcatgccctgccaaattcaagttacacagacttccattttcttaagataatcaatcatgaagaaatcctttatcaatcattcaaaagtaattttaagtgtaacataactgtgtttacttcccatgcacttaatacccttatgcgctaattttgtgaattaagtttactgattatagaagtatgtgctgcatagaagtctgtgcttagagggtgaagttcctaagcttaccttgaattacagctacatttcagtgttaaatgtgcatattaagaataattcttttggggaaagaaattatgaatcttcaggacagtctacaatggtttagagttacattctgcctagacttttatgacttgctgctattgttttaaaaaccccacttagtctcttcctttctgatttctaaagtaagcctcagaatttccaaaccaattcatccacagctgtttctgggctggtttttaaagtagctgcaacagaatcatgaggctttccctttttatcaaatacgaaaaacattttttaaaattctgcacacccagtgatcatcttttgtgcgggaaagcaagatgatgatggatgattttattcatccttttagtaaagacacaaaacatttttctcaacatttgtacagttctgaaaaaaacctggtcaccaaaaatatcttctctgctaattcagcaattcttgggctccagttaggggagctggggcctcactttctcccagaattgtgggcttcactggaagtgaaggtgcaggaatgactggactgtccaccccagccctgcctgcctgtggttttggccagggagcaagccatgaggtgccctggcacatgcacaaattgatcctttgcgtgacagtcttgtatggaaaacagatgctgacagaattgtagactaccatgccacacaaaaaggctaaatatctactccaatgggtttccagttcagtttgaagtcaatcaaatttttgtattttcggtgtctccttgattggttttgctagtaattctgtaaattgtacatttgcaatatgaggttttttttccttttgtacaatttgaaactgatgcttcacctttcctttaataaactattcaaaatca

SEQ ID NO: 24503 - DNA, 4527 bp, Homo sapiens
tgatggtacacgcattgagctttgcgctggagagtttcttcaccgcgaagctatttagcagacatgacccacaagcagaagaagcattagcaaagaggaggggaagaaacagcccgaatggaaacctcattaggatgctggttcttttctttcttgaaagtgagttacatgaacatgcagcctacttggtggacagtttatgggagagctctcaagaactgttgaaagactgggaatgtatgacagagttgctattagaagaacctgttcaaggagaggaagcaatgtctgatcgtcaagagagtgctcttatagagctaatggtttgtacaattcgtcaagctgctgaggcacatcctccagtgggaaggggtaccggcaagagagtgctaactgccaaagaaaggaaaactcaaattgatgatagaaacaaattgactgaacattttattattacacttcctatgttactgtcaaagtattctgcagatgcagagaaggtagcaaacttgctacaaatcccacagtattttgatttagaaatctacagcacaggtagaatggaaaagcatctggatgctttattaaaacagattaagtttgttgtggagaaacacgtagaatcagatgttctagaagcctgcagtaaaacctatagtatcttatgcagtgaagaatataccatccagaacagagttgacatagctcgaagccagctgattgatgagtttgtagatcgattcaatcattctgtggaagacctattgcaagagggagaagaagctgatgatgatgacatttacaatgttctttctacattaaagcggttaacttcttttcacaatgcacatgatctcacaaaatgggatctctttggtaattgctacagattattgaagactggaattgaacatggagccatgccagaacagatagtcgtgcaagcactgcagtgttcccattattcgattctttggcagttggtgaaaattactgatggctctccttccaaagaggatttgttggtattgaggaaaacggtgaaatcctttttggctgtttgccagcagtgcctgtctaatgttaatactccagtgaaagaacaggctttcatgttactctgtgatcttctgatgattttcagccaccaattaatgacaggtggcagagagggccttcagcctttggtgttcaatccagatactggactccaatctgaactcctcagttttgtgatggatcacgtttttattgaccaagacgaggagaaccagagcatggagggtgatgaagaagatgaagctaataaaattgaggccttacataaaagaaggaatctacttgctgctttcagcaaacttatcatttatgacattgttgacatgcatgcagctgcagacatcttcaaacactacatgaagtattacaatgactatggtgatattattaaggaaacactgagtaaaaccaggcagattgataaaattcagtgtgccaagactctcattctcagtttgcaacagttatttaatgaacttgttcaagagcaaggtcccaacctagataggacatctgcccatgtcagtggcattaaagaactggcacgtcgctttgcccttacatttggattggaccagattaagacacgagaagcagttgccacacttcacaaggatggcatagagtttgcatttaaataccaaaatcagaaaggacaagagtatccacctcctaatctggcttttcttgaagtactaagtgaattttcttctaaacttcttcgacaggacaaaaagacagttcattcatacctagagaaattccttaccgagcagatgatggaaaggagggaggatgtatggcttccactcatctcctatagaaattcattagtcactgggggtgaagatgatagaatgtctgtgaacagtggaagtagcagcagcaaaacctcatcagtaaggaataagaaaggacgacctccacttcataaaaaacgagtagaagatgagagtctggataacacatggctaaacaggactgacaccatgattcagactcctggccccctgccagcaccacaactcacatccactgtactgcgggagaacagtcggcccatgggagaccagattcaagaacctgagtctgaacatggttctgaaccagactttttacacaatcctcagatgcagatctcttggttaggccagccgaagttagaagacttaaatcggaaggacagaacaggaatgaactacatgaaagtgagaactggagtgaggcatgctgttcggggtctaatggaggaagatgctgagcccatctttgaagatgtgatgatgtcatcccgaagccagttagaagatatgaatgaagaatttgaggacaccatggttattgatctgcctccatcaagaaatcggcgagagagagctgagctaaggccagacttctttgactctgcagctatcatagaagatgattcaggatttggaatgcctatgttctgaagtctgaagaaaatttacaaatctggaactctattatttagagctagaggcctatatactgtgatagcttgtatggggaaaaacacttttgatgtgatctgatttgttttttaatcaaatgattaaggtcaatccctttttgcagtgacagaagaggagcatgtaaattacccaagggaatgttggtgaatgtcaactcagaaagactgacctgaaaatcatttgtgtcctactgttggacttatcccaatacagatgtgtgtgtttttctggagggaggaagaaattttaaatttttaaaacagctgtcaagataaacactgttatacacctgttttatgaaaactcaacattgagtaaaaaaaaacatatttttaactttattttcctgttgtacaatttaaaaaccgttttaacattttgcctttttatgttttaaaagctaaccatttttattaaacctatgagtaagcagctcatcctaattgcgaagagtgttttggagttcactggatttggttgacctttgtggaacacaaataatgaaggagcagaacattgacaagctaagatgaaattctgacatagtacatctctgccaaaaaccacacaccctctgtggatatggatatgaattcccagattttatatactcttgaataaaaggtttatttttatttataagtgggcataaaataagaaatgtccatgcagccatttttccaacagatgctgtacaccgttcattttatatagactagggagattcaaatacagtgcattttctattggtatttgttctgtgcatttttagcaacttctaccagcaaataaagtattctcagtaaaacgaaaatgattctcaagttatcagtttgctgtttttaccacttatttcatgccctgccaaattcaagttacacagacttccattttcttaagataatcaatcatgaagaaatcctttatcaatcattcaaaagtaattttaagtgtaacataactgtgtttacttcccatgcacttaatacccttatgcgctaattttgtgaattaagtttactgattatagaagtatgtgctgcatagaagtctgtgcttagagggtgaagttcctaagcttaccttgaattacagctacatttcagtgttaaatgtgcatattaagaataattcttttggggaaagaaattatgaatcttcaggacagtctacaatggtttagagttacattctgcctagacttttatgacttgctgctattgttttaaaaaccccacttagtctcttcctttctgatttctaaagtaagcctcagaatttccaaaccaattcatccacagctgtttctgggctggtttttaaagtagctgcaacagaatcatgaggctttccctttttatcaaatacgaaaaacattttttaaaattctgcacacccagtgatcatcttttgtgcgggaaagcaagatgatgatggatgattttattcatccttttagtaaagacacaaaacatttttctcaacatttgtacagttctgaaaaaaacctggtcaccaaaaatatcttctctgctaattcagcaattcttgggctccagttaggggagctggggcctcactttctcccagaattgtgggcttcactggaagtgaaggtgcaggaatgactggactgtccaccccagccctgcctgcctgtggttttggccagggagcaagccatgaggtgccctggcacatgcacaaattgatcctttgcgtgacagtcttgtatggaaaacagatgctgacagaattgtagactaccatgccacacaaaaaggctaaatatctactccaatgggtttccagttcagtttgaagtcaatcaaatttttgtattttcggtgtctccttgattggttttgctagtaattctgtaaattgtacatttgcaatatgaggttttttttccttttgtacaatttgaaactgatgcttcacctttcctttaataaactattcaaaatca

SEQ ID NO: 24504 - DNA, 5118 bp, Homo sapiens
  misc_feature (5112)..(5112): n is a, c, g, or t
aggaggtggtcacagatattttataatggaggcaaggtcaaaccggaattggagtcccatagctctgagcccaggaaactggatgaatttatctattagtatggactgggactggcatctttaacaacatggaaagcttgaaacagtctttgtggaaaataggagatcagccagagattagaagaaaacgcaagaaaattataagtaggagtccagtcacgaattcatatccaatctggtcagttatgacttcctccagcgaaaagccacacatcttgcaaacccttgagagagaaaacacaaataggggtaacctactggagacaggcccttaagactataaagtagttgagcgattccatactgaaatagagttggctatagcgatagagaagttagtcatatatgggcctaatgatccaggagagtaaggattcacttttgtggtgaaaagttgtaagcaggtgaaaggtagggatccatggccacggacgggcaggtggagatcagggaagaggcgacgttaaacataaatagtttgttaatgatttcaccttactgattatttctcttttggcatctagaaggctaagattctcatgtgtatttcagagctactgaaagtagtcctaggttgtggagggagaaatccactttcacagctgagtctatcttctcagtctagttatattctcctctcacaaactagccaatgctgccgccttatgcaaagccgacaccacggaaagatgtgctttacagaggcaggatgacgccaatcggcctagggccggcggtgtttcgtctagattaatggcgagggaagtccccaatagtccttttgaaaccttttcactcttgcctggtgaaagcgcttgtcagccgtaaatcgcgaatacaatgctaagctctgaggcccttgctaaatccaagtaggagcagggatctgcgcggcctcaccctcgggtttccgcagggcgtctcgagagctgcggatgggggcagcaggagccgggcgggaacagaggaaagcgccggccctgagacctagggaggagcctcggtgaaggaacccggggcgggttcctgcctagatctccaagaagctccaaaaatggcgggcggcaactcggcgagccggacgcgcaggcgccaccgtggccgtccttccgccagccgcgggcggcccaagaaccgtccacagcgcccttatccagaagcctacgcctctcgcgattggctgaactgcgcgagcgctccgtgtgggggcggggccgccacgcagcggccacgtttcccgccccgctggtgcgcgtgcgcgcaatccccactggaaagcgtttgcgcgcgcccctgccgcggcccctagctcgcgcctcagctccctcccctttccgggcaggcccgtcccgtcagcaaggcagtgagcaccgcggccagcagagggcggtccggacccaagtctgcagcggcgccattggcgtgtggaaaatgccaccagatggcgggttaggattgcagctccgttgaaggcgcggcccccgctcccgaacccccggcgaccaccccgtaacaacccccccacatcgggaataacacaccggagacttttggggggaaactaggtcgatggtcggcggcgcccggatgggcagctgaggattgcctttgaggttattttaaaagttttgagttgtacagcacttgattattttgctgcattgtgaaaggacctctccagcaatgattacttcagaattaccagtgttacaggattcaactaatgaaactactgcccattccgatgctggcagcgagcttgaagaaacagaggtcaaaggaaaaagaaaaaggggtcgtcctggccggcctccatctacaaataagaaacctcgaaaatctccaggtgagaagagcagaattgaagctggaattagaggagcaggccgtggaagagctaatggacaccctcaacagaatggggaaggggagcctgtcacattatttgaggtggtgaaactggggaaaagtgcaatgcagtccgtggtggatgactggattgaatcatataaacaagacagggacatcgcacttctggatttaatcaacttttttatccagtgttcaggatgtcgaggtactgtgagaatagagatgtttcgaaatatgcagaatgcagaaatcatcagaaaaatgactgaagaatttgatgaggacagtggtgattatcctcttaccatgcctggacctcagtggaaaaaatttcgttcaaacttttgtgaatttattggagtcctgattcgacagtgtcagtatagcataatttatgatgagtatatgatggacacagtaatctcccttttgacgggtttgtcagactcccaggtcagagcttttaggcatacaagtaccctggctgccatgaagctcatgactgctctggtgaatgttgccttaaacctcagtattcatcaggataatacccagagacaatatgaagccgagagaaataaaatgattgggaagagagccaatgaaaggttggagttactacttcagaaacgcaaagagctgcaagaaaatcaggatgaaatcgaaaatatgatgaactctatttttaagggtatatttgttcatagataccgtgatgctattgctgagattagagccatttgtattgaagaaattggagtatggatgaaaatgtatagtgatgccttcctaaatgacagttacctaaaatatgttggctggactcttcatgacaggcaaggggaagtcaggctgaagtgtttgaaagctctgcagagtctatataccaatagagaattattccccaaattggaactattcactaaccgattcaaggatcgcattgtatcaatgacacttgataaagaatatgatgttgctgtggaagctattcgattggttactctgatacttcatggaagtgaagaagctctttccaatgaagactgtgaaaatgtttaccacttggtgtactcggcacatcgccctgttgctgtggcagctggagagttccttcacaaaaagctatttagcagacatgacccacaagcagaagaagcattagcaaagaggaggggaagaaacagcccgaatggaaacctcattaggatgctggttcttttctttcttgaaagtgagttacatgaacatgcagcctacttggtggacagtttatgggagagctctcaagaactgttgaaagactgggaatgtatgacagagttgctattagaagaacctgttcaaggagaggaagcaatgtctgatcgtcaagagagtgctcttatagagctaatggtttgtacaattcgtcaagctgctgaggcacatcctccagtgggaaggggtaccggcaagagagtgctaactgccaaagaaaggaaaactcaaattgatgatagaaacaaattgactgaacattttattattacacttcctatgttactgtcaaagtattctgcagatgcagagaaggtagcaaacttgctacaaatcccacagtattttgatttagaaatctacagcacaggtagaatggaaaagcatctggatgctttattaaaacagattaagtttgttgtggagaaacacgtagaatcagatgttctagaagcctgcagtaaaacctatagtatcttatgcagtgaagaatataccatccagaacagagttgacatagctcgaagccagctgattgatgagtttgtagatcgattcaatcattctgtggaagacctattgcaagagggagaagaagctgatgatgatgacatttacaatgttctttctacattaaagcggttaacttcttttcacaatgcacatgatctcacaaaatgggatctctttggtaattgctacagattattgaagactggaattgaacatggagccatgccagaacagatagtcgtgcaagcactgcagtgttcccattattcgattctttggcagttggtgaaaattactgatggctctccttccaaagaggatttgttggtattgaggaaaacggtgaaatcctttttggctgtttgccagcagtgcctgtctaatgttaatactccagtgaaagaacaggctttcatgttactctgtgatcttctgatgattttcagccaccaattaatgacaggtggcagagagggccttcagcctttggtgttcaatccagatactggactccaatctgaactcctcagttttgtgatggatcacgtttttattgaccaagacgaggagaaccagagcatggagggtgatgaagaagatgaagctaataaaattgaggccttacataaaagaaggaatctacttgctgctttcagcaaacttatcatttatgacattgttgacatgcatgcagctgcagacatcttcaaacactacatgaagtattacaatgactatggtgatattattaaggaaacactgagtaaaaccaggcagattgataaaattcagtgtgccaagactctcattctcagtttgcaacagttatttaatgaacttgttcaagagcaaggtcccaacctagataggacatctgcccatgtcagtggcattaaagaactggcacgtcgctttgcccttacatttggattggaccagattaagacacgagaagcagttgccacacttcacaaggatggcatagagtttgcatttaaataccaaaatcagaaaggacaagagtatccacctcctaatctggcttttcttgaagtactaagtgaattttcttctacaagtttttgtgtgaactcatgttttcagttctcttgggtatatatctaggagtggaaatactgggtcacagggcaattctatgctttttgaggagctgccacactgtttttcacggaggctgcaccattttggattcccaccagcaacatatgagaactccgatttctccagaccctcaacaaaatttatctttcattttttgattatagtcatcttcatgggtatgaagtggtgtcttattgtggttttcacttacatttcactaatgattaataatgttgagcatcttttcatatacttatttgccatttgtgtttcttcttccttttncttttc

SEQ ID NO: 24505 - DNA, 3905 bp, Homo sapiens
aggaggtggtcacagatattttataatggaggcaaggtcaaaccggaattggagtcccatagctctgagcccaggaaactggatgaatttatctattagtatggactgggactggcatctttaacaacatggaaagcttgaaacagtctttgtggaaaataggagatcagccagagattagaagaaaacgcaagaaaattataagtaggagtccagtcacgaattcatatccaatctggtcagttatgacttcctccagcgaaaagccacacatcttgcaaacccttgagagagaaaacacaaataggggtaacctactggagacaggcccttaagactataaagtagttgagcgattccatactgaaatagagttggctatagcgatagagaagttagtcatatatgggcctaatgatccaggagagtaaggattcacttttgtggtgaaaagttgtaagcaggtgaaaggtagggatccatggccacggacgggcaggtggagatcagggaagaggcgacgttaaacataaatagtttgttaatgatttcaccttactgattatttctcttttggcatctagaaggctaagattctcatgtgtatttcagagctactgaaagtagtcctaggttgtggagggagaaatccactttcacagctgagtctatcttctcagtctagttatattctcctctcacaaactagccaatgctgccgccttatgcaaagccgacaccacggaaagatgtgctttacagaggcaggatgacgccaatcggcctagggccggcggtgtttcgtctagattaatggcgagggaagtccccaatagtccttttgaaaccttttcactcttgcctggtgaaagcgcttgtcagccgtaaatcgcgaatacaatgctaagctctgaggcccttgctaaatccaagtaggagcagggatctgcgcggcctcaccctcgggtttccgcagggcgtctcgagagctgcggatgggggcagcaggagccgggcgggaacagaggaaagcgccggccctgagacctagggaggagcctcggtgaaggaacccggggcgggttcctgcctagatctccaagaagctccaaaaatggcgggcggcaactcggcgagccggacgcgcaggcgccaccgtggccgtccttccgccagccgcgggcggcccaagaaccgtccacagcgcccttatccagaagcctacgcctctcgcgattggctgaactgcgcgagcgctccgtgtgggggcggggccgccacgcagcggccacgtttcccgccccgctggtgcgcgtgcgcgcaatccccactggaaagcgtttgcgcgcgcccctgccgcggcccctagctcgcgcctcagctccctcccctttccgggcaggcccgtcccgtcagcaaggcagtgagcaccgcggccagcagagggcggtccggacccaagtctgcagcggcgccattggcgtgtggaaaatgccaccagatggcgggttaggattgcagctccgttgaaggcgcggcccccgctcccgaacccccggcgaccaccccgtaacaacccccccacatcgggaataacacaccggagacttttggggggaaactaggtcgatggtcggcggcgcccggatgggcagctgaggattgcctttgaggttattttaaaagttttgagttgtacagcacttgattattttgctgcattgtgaaaggacctctccagcaatgattacttcagaattaccagtgttacaggattcaactaatgaaactactgcccattccgatgctggcagcgagcttgaagaaacagaggtcaaaggaaaaagaaaaaggggtcgtcctggccggcctccatctacaaataagaaacctcgaaaatctccaggtgagaagagcagaattgaagctggaattagaggagcaggccgtggaagagctaatggacaccctcaacagaatggggaaggggagcctgtcacattatttgaggtggtgaaactggggaaaagtgcaatgcagtccgtggtggatgactggattgaatcatataaacaagacagggacatcgcacttctggatttaatcaacttttttatccagtgttcaggatgtcgaggtactgtgagaatagagatgtttcgaaatatgcagaatgcagaaatcatcagaaaaatgactgaagaatttgatgaggacagtggtgattatcctcttaccatgcctggacctcagtggaaaaaatttcgttcaaacttttgtgaatttattggagtcctgattcgacagtgtcagtatagcataatttatgatgagtatatgatggacacagtaatctcccttttgacgggtttgtcagactcccaggtcagagcttttaggcatacaagtaccctggctgccatgaagctcatgactgctctggtgaatgttgccttaaacctcagtattcatcaggataatacccagagacaatatgaagccgagagaaataaaatgattgggaagagagccaatgaaaggttggagttactacttcagaaacgcaaagagctgcaagaaaatcaggatgaaatcgaaaatatgatgaactctatttttaagggtatatttgttcatagataccgtgatgctattgctgagattagagccatttgtattgaagaaattggagtatggatgaaaatgtatagtgatgccttcctaaatgacagttacctaaaatatgttggctggactcttcatgacaggcaaggggaagtcaggctgaagtgtttgaaagctctgcagagtctatataccaatagagaattattccccaaattggaactattcactaaccgattcaaggatcgcattgtatcaatgacacttgataaagaatatgatgttgctgtggaagctattcgattggttactctgatacttcatggaagtgaagaagctctttccaatgaagactgtgaaaatgtttaccacttggtgtactcggcacatcgccctgttgctgtggcagctggagagttccttcacaaaaagctatttagcagacatgacccacaagcagaagaagcattagcaaagaggaggggaagaaacagcccgaatggaaacctcattaggatgctggttcttttctttcttgaaagtgagttacatgaacatgcagcctacttggtggacagtttatgggagagctctcaagaactgttgaaagactgggaatgtatgacagagttgctattagaagaacctgttcaaggagaggaagcaatgtctgatcgtcaagagagtgctcttatagagctaatggtttgtacaattcgtcaagctgctgaggcacatcctccagtgggaaggggtaccggcaagagagtgctaactgccaaagaaaggaaaactcaaattgatgatagaaacaaattgactgaacattttattattacacttcctatgttactgtcaaagtattctgcagatgcagagaaggtagcaaacttgctacaaatcccacagtattttgatttagaaatctacagcacaggtagaatggaaaagcatctggatgctttattaaaacagattaagtttgttgtggagaaacacgtagaatcagatgttctagaagcctgcagtaaaacctatagtatcttatgcagtgaagaatataccatccagaacagagttgacatagctcgaagccagctgattgatgagtttgtagatcgattcaatcattctgtggaagacctattgcaagagggagaagaagctgatgatgatgacatttacaatgttctttctacattaaagcggttaacttcttttcacaagtacgttattttatttaaagtaaaggcaacgaggtggctcatgcctgtaacccc

SEQ ID NO: 24506 - DNA, 3030 bp, Homo sapiens
aggaggtggtcacagatattttataatggaggcaaggtcaaaccggaattggagtcccatagctctgagcccaggaaactggatgaatttatctattagtatggactgggactggcatctttaacaacatggaaagcttgaaacagtctttgtggaaaataggagatcagccagagattagaagaaaacgcaagaaaattataagtaggagtccagtcacgaattcatatccaatctggtcagttatgacttcctccagcgaaaagccacacatcttgcaaacccttgagagagaaaacacaaataggggtaacctactggagacaggcccttaagactataaagtagttgagcgattccatactgaaatagagttggctatagcgatagagaagttagtcatatatgggcctaatgatccaggagagtaaggattcacttttgtggtgaaaagttgtaagcaggtgaaaggtagggatccatggccacggacgggcaggtggagatcagggaagaggcgacgttaaacataaatagtttgttaatgatttcaccttactgattatttctcttttggcatctagaaggctaagattctcatgtgtatttcagagctactgaaagtagtcctaggttgtggagggagaaatccactttcacagctgagtctatcttctcagtctagttatattctcctctcacaaactagccaatgctgccgccttatgcaaagccgacaccacggaaagatgtgctttacagaggcaggatgacgccaatcggcctagggccggcggtgtttcgtctagattaatggcgagggaagtccccaatagtccttttgaaaccttttcactcttgcctggtgaaagcgcttgtcagccgtaaatcgcgaatacaatgctaagctctgaggcccttgctaaatccaagtaggagcagggatctgcgcggcctcaccctcgggtttccgcagggcgtctcgagagctgcggatgggggcagcaggagccgggcgggaacagaggaaagcgccggccctgagacctagggaggagcctcggtgaaggaacccggggcgggttcctgcctagatctccaagaagctccaaaaatggcgggcggcaactcggcgagccggacgcgcaggcgccaccgtggccgtccttccgccagccgcgggcggcccaagaaccgtccacagcgcccttatccagaagcctacgcctctcgcgattggctgaactgcgcgagcgctccgtgtgggggcggggccgccacgcagcggccacgtttcccgccccgctggtgcgcgtgcgcgcaatccccactggaaagcgtttgcgcgcgcccctgccgcggcccctagctcgcgcctcagctccctcccctttccgggcaggcccgtcccgtcagcaaggcagtgagcaccgcggccagcagagggcggtccggacccaagtctgcagcggcgccattggcgtgtggaaaatgccaccagatggcgggttaggattgcagctccgttgaaggcgcggcccccgctcccgaacccccggcgaccaccccgtaacaacccccccacatcgggaataacacaccggagacttttggggggaaactaggtcgatggtcggcggcgcccggatgggcagctgaggattgcctttgaggttattttaaaagttttgagttgtacagcacttgattattttgctgcattgtgaaaggacctctccagcaatgattacttcagaattaccagtgttacaggattcaactaatgaaactactgcccattccgatgctggcagcgagcttgaagaaacagaggtcaaaggaaaaagaaaaaggggtcgtcctggccggcctccatctacaaataagaaacctcgaaaatctccaggtgagaagagcagaattgaagctggaattagaggagcaggccgtggaagagctaatggacaccctcaacagaatggggaaggggagcctgtcacattatttgaggtggtgaaactggggaaaagtgcaatgcagtccgtggtggatgactggattgaatcatataaacaagacagggacatcgcacttctggatttaatcaacttttttatccagtgttcaggatgtcgaggtactgtgagaatagagatgtttcgaaatatgcagaatgcagaaatcatcagaaaaatgactgaagaatttgatgaggacagtggtgattatcctcttaccatgcctggacctcagtggaaaaaatttcgttcaaacttttgtgaatttattggagtcctgattcgacagtgtcagtatagcataatttatgatgagtatatgatggacacagtaatctcccttttgacgggtttgtcagactcccaggtcagagcttttaggcatacaagtaccctggctgccatgaagctcatgactgctctggtgaatgttgccttaaacctcagtattcatcaggataatacccagagacaatatgaagccgagagaaataaaatgattgggaagagagccaatgaaaggttggagttactacttcagaaacgcaaagagctgcaagaaaatcaggatgaaatcgaaaatatgatgaactctatttttaagggtatatttgttcatagataccggtaagagattttaaaaataattttgaaggcttttcacttaaacaattattgattttttttgtggcccaggctaactgtaaaactcactaattatgatttatgttttgttttctggaaaacaactttggctgtcaatgtcacactacaactatagaagaaattgtatgactgctgccactaccactgttatactcttccaaattcagaacatatgctgttggaagtagcttatgtacttggatttatactgatggaatattaattaataggatcataaactaatgtagctttaataagatattcttgttttcacatttaaaaaattaagtgccctacttcttgctctgtggtactcattttgttccatgggcaaattaataattta

SEQ ID NO: 24507 - DNA, 2068 bp, Homo sapiens
aggaggtggtcacagatattttataatggaggcaaggtcaaaccggaattggagtcccatagctctgagcccaggaaactggatgaatttatctattagtatggactgggactggcatctttaacaacatggaaagcttgaaacagtctttgtggaaaataggagatcagccagagattagaagaaaacgcaagaaaattataagtaggagtccagtcacgaattcatatccaatctggtcagttatgacttcctccagcgaaaagccacacatcttgcaaacccttgagagagaaaacacaaataggggtaacctactggagacaggcccttaagactataaagtagttgagcgattccatactgaaatagagttggctatagcgatagagaagttagtcatatatgggcctaatgatccaggagagtaaggattcacttttgtggtgaaaagttgtaagcaggtgaaaggtagggatccatggccacggacgggcaggtggagatcagggaagaggcgacgttaaacataaatagtttgttaatgatttcaccttactgattatttctcttttggcatctagaaggctaagattctcatgtgtatttcagagctactgaaagtagtcctaggttgtggagggagaaatccactttcacagctgagtctatcttctcagtctagttatattctcctctcacaaactagccaatgctgccgccttatgcaaagccgacaccacggaaagatgtgctttacagaggcaggatgacgccaatcggcctagggccggcggtgtttcgtctagattaatggcgagggaagtccccaatagtccttttgaaaccttttcactcttgcctggtgaaagcgcttgtcagccgtaaatcgcgaatacaatgctaagctctgaggcccttgctaaatccaagtaggagcagggatctgcgcggcctcaccctcgggtttccgcagggcgtctcgagagctgcggatgggggcagcaggagccgggcgggaacagaggaaagcgccggccctgagacctagggaggagcctcggtgaaggaacccggggcgggttcctgcctagatctccaagaagctccaaaaatggcgggcggcaactcggcgagccggacgcgcaggcgccaccgtggccgtccttccgccagccgcgggcggcccaagaaccgtccacagcgcccttatccagaagcctacgcctctcgcgattggctgaactgcgcgagcgctccgtgtgggggcggggccgccacgcagcggccacgtttcccgccccgctggtgcgcgtgcgcgcaatccccactggaaagcgtttgcgcgcgcccctgccgcggcccctagctcgcgcctcagctccctcccctttccgggcaggcccgtcccgtcagcaaggcagtgagcaccgcggccagcagagggcggtccggacccaagtctgcagcggcgccattggcgtgtggaaaatgccaccagatggcgggttaggattgcagctccgttgaaggcgcggcccccgctcccgaacccccggcgaccaccccgtaacaacccccccacatcgggaataacacaccggagacttttggggggaaactaggtcgatggtcggcggcgcccggatgggcagctgaggattgcctttgaggttattttaaaagttttgagttgtacagcacttgattattttgctgcattgtgaaaggacctctccagcaatgattacttcagaattaccagtgttacaggattcaactaatgaaactactgcccattccgatgctggcagcgagcttgaagaaacagaggtcaaaggaaaaagaaaaaggggtcgtcctggccggcctccatctacaaataagaaacctcgaaaatctccaggtgagaagagcagaattgaagctggaattagaggagcaggccgtggaagagctaatggacaccctcaacagaatggggaaggggagcctgtcacattatttgaggtggtgaaactggggaaaagtgcaatgcaggtaaattttaagtttttatttcacgtat

SEQ ID NO: 24508 - DNA, 406 bp, Homo sapiens
cgttgccattaccctcgtctgattatcatgtctcacctgcatcgttgtgatggatttctaattagatcctctgctgtatgtttacctccaacagtctagctcaacacagtagccagaataatcctttagaaatatgtcagatcaggccgggtgcagtggcctgtaatcccagcactttgggaggctgaggtgggtgaatgacctgaggttgggagtttgagaccagcctggccaacatggtgaaaccttgtctctactaaaaatacaaaaattagccaggtgtggggtgcatacctgtaatcccagctacttgggaggctgaggctcaagaacagcttgaacctgggaggcggaggttgcagtgagccaagattgcaccactgcactccagcctgagcgacagagt

SEQ ID NO: 24509 - DNA, 437 bp, Homo sapiens
gagttctcctttctcaaccatctattgaattggcaaaaacttaaaaagatggataaacttactgctggcagggatgtgggaaagggcactgtcatgcactgtttctggacatgtgtgttgtgtgttgttacagcctttttggaaaataatctggcaatatccacaataagcaaattaaacacacgatttgacccagaaatcctactccaagaactctattgtagagaaatcaagcttcagtgtgtaaggacgtgtatgtacataccacccccaagaatgtttattgtggtatttttctggaaataagttaatgcatattaatatattttgccaattcgtaggatggaatggtatgtaaccaataaaaataatgtattagttctatacagatttatactagttttgctttgagagagttccataatgcatttttttct

SEQ ID NO: 24510 - DNA, 467 bp, Homo sapiens
gtgtaacaggagtgtctagggaggtccaactattgtgggaggaatcaagggcaaactgggtatctcagagcaagagaatttgttgggattgtgagtagtcaggtggaggagaagtagttgaggaagaaagttctaaggagtgtgaagctaggagatgatagtggttagaaaggaaagggtgtggacatcaactaggaagtgtagaggtgacaaatatggtgggggggggagggggagacaaataaatatagtcagactggtttttgcaaacaaaaggtaagactaatttaaaaacaattccatttcacaatgcctgccaatgcttcaacaatttaaaatacttgtatgttgtattaaaagacagttcgggaagtgtattccatctcatgacaaattggtaagtcaacattgatagagcataaagcttattttggcctaaatttcagctccaaagtcttactattcta

SEQ ID NO: 24511 - DNA, 370 bp, Homo sapiens
gcaaacccaatccatgggtagaccagatagcaggtaggaatgatggtagcttggactaggctcatggcagtgaagatggagagaagaataaatttcagaggcatttaggaggtagagtagatagatcatagcaggagcttgaatatggaacctgagcaagacagaagagtagaggacagaaagaggcacattcactggtctagagaacacttcaagagaaccagtttggaaggcaagaggctgaactcattgtcttaaacctattgagtttgggagcgctttgagatgtccagatgaaatgtcagaagaatctgacagtaggatatgtgggtctggagtgtgcacaaggcaggcgattaataatcgtgtc

SEQ ID NO: 24512 - DNA, 717 bp, Homo sapiens
ctgcctgggcttggtcggccgcgcttcagcacccgccgagccggacagcgcctgctgcatggagctgcccgccgcggccggggacgcagtccggagtcccgccgccgccgccgccctcatcttccccgggggctccggggagctagaactggcgttagaggaggagctggcgctgctggcggccggggagcggccgtccgaccccggggaacaccctcaggccgagcctgggtctctggccgagggggccggaccgcagccgccgccctcccaggaccccgagctgctgtcggtgatccgacagaaggagaaggatctggtgttggcggcccggctgggtaaggcgctgctcgagaggaaccaggacatgagccggcagtacgagcagatgcataaggagctgacagacaagctcgagacaagatctcactctatcccccaggctgcagtggagtggctgatcatggcttactgcaccctcaagtgaccctcccactcagcctcctgagtagctgggactacaggcgcctactacacacctggctaattttgtaaaaatgtttcgtagagatggggtctcactatgttgccaaggctggtctcaaactacggggctcaagcagtcctcctgccctggccttccaaagtggtgggattacaggagtgaaccattgagcctggcctgtattttcaattaaatcaaacacttgggagtat

SEQ ID NO: 24513 - DNA, 2548 bp, Homo sapiens
tgagtgcaaagggaagatctggcctacggctgcaggtccagagctaaattccccccagctcccttgctgccgagctcaagcctagcatgtgatgtggtaccctttcttcaagagagacaggccctctcttgaagcaggatggcagtggaatgctaccagcttgcacccccacacatgtaccctggtcctgcctggggtctctttgttcctttttccctcttggagggaaaaccacccaggacagcagcagtgataccatattcattctcctgttaggtgacactgctgagtgtggagatgactgccctaaaagaggagagagaccgactcagagtcacttctgaggacaaggagccaaaggagcagcttcagaaggccatcagggaccgcgacgaggccattgcaaagaagaatgctgtggagctggaacttgccaagtgcaggatggatatgatgtctctgaacagccagttgctggatgccattcagcagaaactgaacctctcgcagcagctggaagcttggcagtttgcttcctcagggctttttactatctggctcctttggtttctgatctagtggcctttctcagttcccgtatcaacagctttagttgtacacccctcctgcctttgaggatgacatgcacagggtcattgaccggcagctgatggacacgcacctgaaagaacggagccagccggctgctgccctctgcaggggccacagcgctgggcggggggatgagcccagcatcgctgaaggcaaacgactcttctcattcttcaggaaaatttaagttgggaggagtcaggccaccaaagatgggtggactggaggcagctggaaaggcggtgcaggcaaggcctcccctgcagcttgcacctcagcagctgccctgcccctcatgctagggccccatgggtccgggagggcctgctccctttcgtcggtggggatggagacctagaggtgggggcctgccttggccactgaaggcttcccttggcccaccgcctggccaagcccacgcctgggcttctccaggaccacgtgcttgagcagggttaggccacctcccagaggggccccttggtgttgggctttgcagctcacacccaacagatcgcagcccacccccaggcactgctgcctccttgattttagcaaatggggaacagaaggaatggaggcccttctctgcatgcctcaggaggcctgagccccaggggcctagacctgtgggggcagcgggccaggcctgagcctccattccttccccagcccctggcccagggtcaaaggagagatggcagcccctcccccgcatgcatgcacctcagctggcaggaggccaagcctctggccgcagggtctaagagccggggcttacccaagctcagctgaggccacccgagccccagggaggaagaaggccctgtccccctgtcgccactgctctccctcccagccttcagtctctgccccttagcagggcctggccaggcagagtgttatcaccagtcatctgcaggctttagccatccagccctttcccctgctcagggctggggttggacggggtctcctcctcccacagctccctcctccacccctcacatacatacataatttcttggcctagccaaacaagtccaggccactgaatggcaccagaggggtctgtggtcagccaccccaccttgagggcagcacaggcaccacggggtggaggggagggggaggctgccggaagcctccagatgctgcctgcctgcctgcagaagcctgcagtggctgctgctcctgcctctgcagccgcccctcctcctccacccaggccccaactcagaggctccgcggcccggccagccctcagctgctcacaaccgattcagtctccctccctccctcacgtggggaaagcacagcagggatgcgcggcaagaatgtacctgtagatgtgtacataccacagtgctgtaattttgtatgtagcaatcatgtaaatacatgtatggattttataatatacatatataaaaatctataaaggcatatttttagaaaaacagcacaccactgcttcttttgaaaatagtctgaataagaataaaatgaatttctacagagaaaaaaaaaaagaaccgcaagacacacacacgaacaaaaacaaaaaacaaaaataaaaaaaaacaaacaaaaaaaaaaaaaacaaaaaaagaacacacaaaacagaaaaaacaacgaagagagcggcggagcggggcaggagacgaaagaaaaagaacaagcggcagggcggccacaaactaaaaaaagcgaacaacgaacgaaagaagaagcgagaaaagaaacaagagacgcagaaaaaaaagaaaagcagaggagataaaacaacagaaacacgacgcaccggagaagctaaacacaccagaacaacaacagagaaaagaaaaacagaaaaagaaagaaaaaaaacagagaggagagaaagaaaaaaaaaggaagagggagcgaacacacaaaacaaaaacaacaaaaacaa

SEQ ID NO: 24514 - DNA, 2418 bp, Homo sapiens
gagtcttcagaaacctcgtccgccaaggatgtgccagccggcagcttgcgcactgccctcaatgagctcaagagactgatacagagcattgtggatggcatggagcccacgggctcccggagacttgatgatgactccttagaagaacagataaggcagaccagtgaggactcgagagccctaagggagctcatggagggagagaggggtaaactgaggcaaagcctagaagagctgcagcgactccacagtcaggtgacactgctgagtgtggagatgactgccctaaaagaggagagagaccgactcagagtcacttctgaggacaaggagccaaaggagcagcttcagaaggccatcagggaccgcgacgaggccattgcaaagaagaatgctgtggagctggaacttgccaagtgcaggatggatatgatgtctctgaacagccagttgctggatgccattcagcagaaactgaacctctcgcagcagctggaagcttggcaggatgacatgcacagggtcattgaccggcagctgatggacacgcacctgaaagaacggagccagccggctgctgccctctgcaggggccacagcgctgggcggggggatgagcccagcatcgctgaaggcaaacgactcttctcattcttcaggaaaatttaagttgggaggagtcaggccaccaaagatgggtggactggaggcagctggaaaggcggtgcaggcaaggcctcccctgcagcttgcacctcagcagctgccctgcccctcatgctagggccccatgggtccgggagggcctgctccctttcgtcggtggggatggagacctagaggtgggggcctgccttggccactgaaggcttcccttggcccaccgcctggccaagcccacgcctgggcttctccaggaccacgtgcttgagcagggttaggccacctcccagaggggccccttggtgttgggctttgcagctcacacccaacagatcgcagcccacccccaggcactgctgcctccttgattttagcaaatggggaacagaaggaatggaggcccttctctgcatgcctcaggaggcctgagccccaggggcctagacctgtgggggcagcgggccaggcctgagcctccattccttccccagcccctggcccagggtcaaaggagagatggcagcccctcccccgcatgcatgcacctcagctggcaggaggccaagcctctggccgcagggtctaagagccggggcttacccaagctcagctgaggccacccgagccccagggaggaagaaggccctgtccccctgtcgccactgctctccctcccagccttcagtctctgccccttagcagggcctggccaggcagagtgttatcaccagtcatctgcaggctttagccatccagccctttcccctgctcagggctggggttggacggggtctcctcctcccacagctccctcctccacccctcacatacatacataatttcttggcctagccaaacaagtccaggccactgaatggcaccagaggggtctgtggtcagccaccccaccttgagggcagcacaggcaccacggggtggaggggagggggaggctgccggaagcctccagatgctgcctgcctgcctgcagaagcctgcagtggctgctgctcctgcctctgcagccgcccctcctcctccacccaggccccaactcagaggctccgcggcccggccagccctcagctgctcacaaccgattcagtctccctccctccctcacgtggggaaagcacagcagggatgcgcggcaagaatgtacctgtagatgtgtacataccacagtgctgtaattttgtatgtagcaatcatgtaaatacatgtatggattttataatatacatatataaaaatctataaaggcatatttttagaaaaacagcacaccactgcttcttttgaaaatagtctgaataagaataaaatgaatttctacagagaaaaaaaaaaagaaccgcaagacacacacacgaacaaaaacaaaaaacaaaaataaaaaaaaacaaacaaaaaaaaaaaaaacaaaaaaagaacacacaaaacagaaaaaacaacgaagagagcggcggagcggggcaggagacgaaagaaaaagaacaagcggcagggcggccacaaactaaaaaaagcgaacaacgaacgaaagaagaagcgagaaaagaaacaagagacgcagaaaaaaaagaaaagcagaggagataaaacaacagaaacacgacgcaccggagaagctaaacacaccagaacaacaacagagaaaagaaaaacagaaaaagaaagaaaaaaaacagagaggagagaaagaaaaaaaaaggaagagggagcgaacacacaaaacaaaaacaacaaaaacaa

SEQ ID NO: 24515 - DNA, 3565 bp, Homo sapiens
aaagacctgttttatgtaaactaatgatcttaattttgggtggtggggggagtcttaccactgcactccagcctgggcgacagagcaagactccatctcaaaaaaatcaaaaaggattttagttgtgggactcatttttagttgtttaaatgtatagttcaccaattgattagatgattggcaaatttcaagtgaactccctagtctagaacctcatgcctaaggataagaataaacataataactttaagtattttcagtaagaatggcgttctctttgtgaaaccaacttcttccctgctctggaagaaggaatatttttgtagctgtgaattcggcaacttgtcctatgtggtagggtgttttattgtgtctactgactaggaaaaagaaaagttgggacagcgcggagagaaaaaataaaaggctgtggaatttttatcagtgtttaaatcccttcacttttcacccagcacttagagcaagagaaacatgaattgagaagacgatttgagaaccgagaaggggagtgggaaggccgagtgtcagagctggagagtgatgtgaagcagctacaggatgagttggagaggcagcagattcatctgcgggaagcagatcgagaaaaatcacgggctgtccaggaactgtcggaacagaaccaaaggctattggatcagctcagcaggaaaattaagacttggatttactattctacctcagcccttcttgtatattgaaaataaaactaccaactcttcagttaccggaggaaaaagaacttctctgatatcatccctcagcactgatgttctcatgggagcagtgccgtgtctgcatgtgtttcaggcatcagaagttgagagacaactctccatgcaggtccacgccctcagagaagactttcgggagaaaaactcatcaaccaaccagcacattatccggctggagagccttcaggccgagatcaagatgctgtcagatcggaaacgggagctggagcatcgtctcagcgctactttagaggaaaatgacctgctccaagggaccgtggaggagctacaggaccgggtgctaatcctggagaggcagggccatgacaaggacctacagctgcaccaaagccagctggagcttcaggaggtgcgtctctcctgccgacagctgcaggtgaaggtggaagaactcactgaggagaggagtctgcagagctctgccgccaccagcacatccctcctgtcagagatcgagcagagcatggaggctgaggagctggagcaggagcgagagcaggtgacactgctgagtgtggagatgactgccctaaaagaggagagagaccgactcagagtcacttctgaggacaaggagccaaaggagcagcttcagaaggccatcagggaccgcgacgaggccattgcaaagaagaatgctgtggagctggaacttgccaagtgcaggatggatatgatgtctctgaacagccagttgctggatgccattcagcagaaactgaacctctcgcagcagctggaagcttggcagtttgcttcctcagggctttttactatctggctcctttggtttctgatctagtggcctttctcagttcccgtatcaacagctttagttgtacacccctcctgcctttgaggatgacatgcacagggtcattgaccggcagctgatggacacgcacctgaaagaacggagccagccggctgctgccctctgcaggggccacagcgctgggcggggggatgagcccagcatcgctgaaggcaaacgactcttctcattcttcaggaaaatttaagttgggaggagtcaggccaccaaagatgggtggactggaggcagctggaaaggcggtgcaggcaaggcctcccctgcagcttgcacctcagcagctgccctgcccctcatgctagggccccatgggtccgggagggcctgctccctttcgtcggtggggatggagacctagaggtgggggcctgccttggccactgaaggcttcccttggcccaccgcctggccaagcccacgcctgggcttctccaggaccacgtgcttgagcagggttaggccacctcccagaggggccccttggtgttgggctttgcagctcacacccaacagatcgcagcccacccccaggcactgctgcctccttgattttagcaaatggggaacagaaggaatggaggcccttctctgcatgcctcaggaggcctgagccccaggggcctagacctgtgggggcagcgggccaggcctgagcctccattccttccccagcccctggcccagggtcaaaggagagatggcagcccctcccccgcatgcatgcacctcagctggcaggaggccaagcctctggccgcagggtctaagagccggggcttacccaagctcagctgaggccacccgagccccagggaggaagaaggccctgtccccctgtcgccactgctctccctcccagccttcagtctctgccccttagcagggcctggccaggcagagtgttatcaccagtcatctgcaggctttagccatccagccctttcccctgctcagggctggggttggacggggtctcctcctcccacagctccctcctccacccctcacatacatacataatttcttggcctagccaaacaagtccaggccactgaatggcaccagaggggtctgtggtcagccaccccaccttgagggcagcacaggcaccacggggtggaggggagggggaggctgccggaagcctccagatgctgcctgcctgcctgcagaagcctgcagtggctgctgctcctgcctctgcagccgcccctcctcctccacccaggccccaactcagaggctccgcggcccggccagccctcagctgctcacaaccgattcagtctccctccctccctcacgtggggaaagcacagcagggatgcgcggcaagaatgtacctgtagatgtgtacataccacagtgctgtaattttgtatgtagcaatcatgtaaatacatgtatggattttataatatacatatataaaaatctataaaggcatatttttagaaaaacagcacaccactgcttcttttgaaaatagtctgaataagaataaaatgaatttctacagagaaaaaaaaaaagaaccgcaagacacacacacgaacaaaaacaaaaaacaaaaataaaaaaaaacaaacaaaaaaaaaaaaaacaaaaaaagaacacacaaaacagaaaaaacaacgaagagagcggcggagcggggcaggagacgaaagaaaaagaacaagcggcagggcggccacaaactaaaaaaagcgaacaacgaacgaaagaagaagcgagaaaagaaacaagagacgcagaaaaaaaagaaaagcagaggagataaaacaacagaaacacgacgcaccggagaagctaaacacaccagaacaacaacagagaaaagaaaaacagaaaaagaaagaaaaaaaacagagaggagagaaagaaaaaaaaaggaagagggagcgaacacacaaaacaaaaacaacaaaaacaa

SEQ ID NO: 24516 - DNA, 1301 bp, Homo sapiens
aaagacctgttttatgtaaactaatgatcttaattttgggtggtggggggagtcttaccactgcactccagcctgggcgacagagcaagactccatctcaaaaaaatcaaaaaggattttagttgtgggactcatttttagttgtttaaatgtatagttcaccaattgattagatgattggcaaatttcaagtgaactccctagtctagaacctcatgcctaaggataagaataaacataataactttaagtattttcagtaagaatggcgttctctttgtgaaaccaacttcttccctgctctggaagaaggaatatttttgtagctgtgaattcggcaacttgtcctatgtggtagggtgttttattgtgtctactgactaggaaaaagaaaagttgggacagcgcggagagaaaaaataaaaggctgtggaatttttatcagtgtttaaatcccttcacttttcacccagcacttagagcaagagaaacatgaattgagaagacgatttgagaaccgagaaggggagtgggaaggccgagtgtcagagctggagagtgatgtgaagcaccgcccctcctcctccacccaggccccaactcagaggctccgcggcccggccagccctcagctgctcacaaccgattcagtctccctccctccctcacgtggggaaagcacagcagggatgcgcggcaagaatgtacctgtagatgtgtacataccacagtgctgtaattttgtatgtagcaatcatgtaaatacatgtatggattttataatatacatatataaaaatctataaaggcatatttttagaaaaacagcacaccactgcttcttttgaaaatagtctgaataagaataaaatgaatttctacagagaaaaaaaaaaagaaccgcaagacacacacacgaacaaaaacaaaaaacaaaaataaaaaaaaacaaacaaaaaaaaaaaaaacaaaaaaagaacacacaaaacagaaaaaacaacgaagagagcggcggagcggggcaggagacgaaagaaaaagaacaagcggcagggcggccacaaactaaaaaaagcgaacaacgaacgaaagaagaagcgagaaaagaaacaagagacgcagaaaaaaaagaaaagcagaggagataaaacaacagaaacacgacgcaccggagaagctaaacacaccagaacaacaacagagaaaagaaaaacagaaaaagaaagaaaaaaaacagagaggagagaaagaaaaaaaaaggaagagggagcgaacacacaaaacaaaaacaacaaaaacaa

SEQ ID NO: 24517 - DNA, 1769 bp, Homo sapiens
aaagacctgttttatgtaaactaatgatcttaattttgggtggtggggggagtcttaccactgcactccagcctgggcgacagagcaagactccatctcaaaaaaatcaaaaaggattttagttgtgggactcatttttagttgtttaaatgtatagttcaccaattgattagatgattggcaaatttcaagtgaactccctagtctagaacctcatgcctaaggataagaataaacataataactttaagtattttcagtaagaatggcgttctctttgtgaaaccaacttcttccctgctctggaagaaggaatatttttgtagctgtgaattcggcaacttgtcctatgtggtagggtgttttattgtgtctactgactaggaaaaagaaaagttgggacagcgcggagagaaaaaataaaaggctgtggaatttttatcagtgtttaaatcccttcacttttcacccagcacttagagcaagagaaacatgaattgagaagacgatttgagaaccgagaaggggagtgggaaggccgagtgtcagagctggagagtgatgtgaagcagctacaggatgagttggagaggcagcagattcatctgcgggaagcagatcgagaaaaatcacgggctgtccaggaactgtcggaacagaaccaaaggctattggatcagctcagcaggaaaattaagacttggatttactattctacctcagcccttcttgtatattgaaaataaaactaccaactcttcagttaccggaggaaaaagaacttctctgatatcatccctcagcactgatgttctcatgggagcagtgccgtgtctgcatggtttcccatctggagaatccagtcaccatttgattgtctgggaagtaggaattggacagttcaggaagtcacttcacagagccagctcagtaacaggatttctgattcagttctaaaagcttttttcagcaactgggaatggaatctctatccttgtaaaaatttttatgtttttgactattttcattcattattcatgaaagattcaaccagagaggcctggctagattgatttatttgttcaaaaacatttaatacatactttgagtaagtgtttcttacggagacttatagaatgaatgcaacaaaccagaaaaattaaaggggaaattaagatttcttgggggctaagttcatgttacaaaataacatgagctaaagcagactctgccccgtgaaagataggtgaccaagagagacgaagggaaaaagcagatttcaacatgacatagcaaaagctcatggagcttggaatctgactctgttactcattaactgggggaccttgtttgtgcctcagtttccttttctttaaaatgggtgtaaaaattatgcctcatacaagtattattgaaatgaaaaatgagataatgtgtttatgttaaacagcgtgtgaaggtaaggatttgtttcagtgttgatggttgttttactaaagcagtgtctttataatttgttcactttgcctaatttcttatagaaaatcctgataagctgctcctaaaagaacgtaggaagataacatttctactagatctagatttttgttatcctttctggccttgaatataggcccttggtgagttttatagctttttcccttttttcaagcaggaccagcccctggggtttccatcagcagcaagtttagatagcgttttattaactgagtatccagcctgggcaacagagcaagaccccatcttta

SEQ ID NO: 24518 - DNA, 757 bp, Homo sapiens
aagccccgcaaagtaccactatggaacaggcgcaagatgtctcccatttctcaaaaacaattcccttatggaccacatcttcccctttgggattaaaaacgattcagtctccctccctccctcacgtggggaaagcacagcagggatgcgcggcaagaatgtacctgtagatgtgtacataccacagtgctgtaattttgtatgtagcaatcatgtaaatacatgtatggattttataatatacatatataaaaatctataaaggcatatttttagaaaaacagcacaccactgcttcttttgaaaatagtctgaataagaataaaatgaatttctacagagaaaaaaaaaaagaaccgcaagacacacacacgaacaaaaacaaaaaacaaaaataaaaaaaaacaaacaaaaaaaaaaaaaacaaaaaaagaacacacaaaacagaaaaaacaacgaagagagcggcggagcggggcaggagacgaaagaaaaagaacaagcggcagggcggccacaaactaaaaaaagcgaacaacgaacgaaagaagaagcgagaaaagaaacaagagacgcagaaaaaaaagaaaagcagaggagataaaacaacagaaacacgacgcaccggagaagctaaacacaccagaacaacaacagagaaaagaaaaacagaaaaagaaagaaaaaaaacagagaggagagaaagaaaaaaaaaggaagagggagcgaacacacaaaacaaaaacaacaaaaacaa

SEQ ID NO: 24519 - DNA, 3401 bp, Homo sapiens
ctgcctgggcttggtcggccgcgcttcagcacccgccgagccggacagcgcctgctgcatggagctgcccgccgcggccggggacgcagtccggagtcccgccgccgccgccgccctcatcttccccgggggctccggggagctagaactggcgttagaggaggagctggcgctgctggcggccggggagcggccgtccgaccccggggaacaccctcaggccgagcctgggtctctggccgagggggccggaccgcagccgccgccctcccaggaccccgagctgctgtcggtgatccgacagaaggagaaggatctggtgttggcggcccggctgggtaaggcgctgctcgagaggaaccaggacatgagccggcagtacgagcagatgcataaggagctgacagacaagctcgagcacttagagcaagagaaacatgaattgagaagacgatttgagaaccgagaaggggagtgggaaggccgagtgtcagagctggagagtgatgtgaagcagctacaggatgagttggagaggcagcagattcatctgcgggaagcagatcgagaaaaatcacgggctgtccaggaactgtcggaacagaaccaaaggctattggatcagctcagcaggaaaattaagacttggatttactattctacctcagcccttcttgtatattgaaaataaaactaccaactcttcagttaccggaggaaaaagaacttctctgatatcatccctcagcactgatgttctcatgggagcagtgccgtgtctgcatgtgtttcaggcatcagaagttgagagacaactctccatgcaggtccacgccctcagagaagactttcgggagaaaaactcatcaaccaaccagcacattatccggctggagagccttcaggccgagatcaagatgctgtcagatcggaaacgggagctggagcatcgtctcagcgctactttagaggaaaatgacctgctccaagggaccgtggaggagctacaggaccgggtgctaatcctggagaggcagggccatgacaaggacctacagctgcaccaaagccagctggagcttcaggaggtgcgtctctcctgccgacagctgcaggtgaaggtggaagaactcactgaggagaggagtctgcagagctctgccgccaccagcacatccctcctgtcagagatcgagcagagcatggaggctgaggagctggagcaggagcgagagcaggtgacactgctgagtgtggagatgactgccctaaaagaggagagagaccgactcagagtcacttctgaggacaaggagccaaaggagcagcttcagaaggccatcagggaccgcgacgaggccattgcaaagaagaatgctgtggagctggaacttgccaagtgcaggatggatatgatgtctctgaacagccagttgctggatgccattcagcagaaactgaacctctcgcagcagctggaagcttggcaggatgacatgcacagggtcattgaccggcagctgatggacacgcacctgaaagaacggagccagccggctgctgccctctgcaggggccacagcgctgggcggggggatgagcccagcatcgctgaaggcaaacgactcttctcattcttcaggaaaatttaagttgggaggagtcaggccaccaaagatgggtggactggaggcagctggaaaggcggtgcaggcaaggcctcccctgcagcttgcacctcagcagctgccctgcccctcatgctagggccccatgggtccgggagggcctgctccctttcgtcggtggggatggagacctagaggtgggggcctgccttggccactgaaggcttcccttggcccaccgcctggccaagcccacgcctgggcttctccaggaccacgtgcttgagcagggttaggccacctcccagaggggccccttggtgttgggctttgcagctcacacccaacagatcgcagcccacccccaggcactgctgcctccttgattttagcaaatggggaacagaaggaatggaggcccttctctgcatgcctcaggaggcctgagccccaggggcctagacctgtgggggcagcgggccaggcctgagcctccattccttccccagcccctggcccagggtcaaaggagagatggcagcccctcccccgcatgcatgcacctcagctggcaggaggccaagcctctggccgcagggtctaagagccggggcttacccaagctcagctgaggccacccgagccccagggaggaagaaggccctgtccccctgtcgccactgctctccctcccagccttcagtctctgccccttagcagggcctggccaggcagagtgttatcaccagtcatctgcaggctttagccatccagccctttcccctgctcagggctggggttggacggggtctcctcctcccacagctccctcctccacccctcacatacatacataatttcttggcctagccaaacaagtccaggccactgaatggcaccagaggggtctgtggtcagccaccccaccttgagggcagcacaggcaccacggggtggaggggagggggaggctgccggaagcctccagatgctgcctgcctgcctgcagaagcctgcagtggctgctgctcctgcctctgcagccgcccctcctcctccacccaggccccaactcagaggctccgcggcccggccagccctcagctgctcacaaccgattcagtctccctccctccctcacgtggggaaagcacagcagggatgcgcggcaagaatgtacctgtagatgtgtacataccacagtgctgtaattttgtatgtagcaatcatgtaaatacatgtatggattttataatatacatatataaaaatctataaaggcatatttttagaaaaacagcacaccactgcttcttttgaaaatagtctgaataagaataaaatgaatttctacagagaaaaaaaaaaagaaccgcaagacacacacacgaacaaaaacaaaaaacaaaaataaaaaaaaacaaacaaaaaaaaaaaaaacaaaaaaagaacacacaaaacagaaaaaacaacgaagagagcggcggagcggggcaggagacgaaagaaaaagaacaagcggcagggcggccacaaactaaaaaaagcgaacaacgaacgaaagaagaagcgagaaaagaaacaagagacgcagaaaaaaaagaaaagcagaggagataaaacaacagaaacacgacgcaccggagaagctaaacacaccagaacaacaacagagaaaagaaaaacagaaaaagaaagaaaaaaaacagagaggagagaaagaaaaaaaaaggaagagggagcgaacacacaaaacaaaaacaacaaaaacaa

SEQ ID NO: 24520 - DNA, 3358 bp, Homo sapiens
ctgcctgggcttggtcggccgcgcttcagcacccgccgagccggacagcgcctgctgcatggagctgcccgccgcggccggggacgcagtccggagtcccgccgccgccgccgccctcatcttccccgggggctccggggagctagaactggcgttagaggaggagctggcgctgctggcggccggggagcggccgtccgaccccggggaacaccctcaggccgagcctgggtctctggccgagggggccggaccgcagccgccgccctcccaggaccccgagctgctgtcggtgatccgacagaaggagaaggatctggtgttggcggcccggctgggtaaggcgctgctcgagaggaaccaggacatgagccggcagtacgagcagatgcataaggagctgacagacaagctcgagcacttagagcaagagaaacatgaattgagaagacgatttgagaaccgagaaggggagtgggaaggccgagtgtcagagctggagagtgatgtgaagcagctacaggatgagttggagaggcagcagattcatctgcgggaagcagatcgagaaaaatcacgggctgtccaggaactgtcggaacagaaccaaaggctattggatcagctcagcaggtgtttcaggcatcagaagttgagagacaactctccatgcaggtccacgccctcagagaagactttcgggagaaaaactcatcaaccaaccagcacattatccggctggagagccttcaggccgagatcaagatgctgtcagatcggaaacgggagctggagcatcgtctcagcgctactttagaggaaaatgacctgctccaagggaccgtggaggagctacaggaccgggtgctaatcctggagaggcagggccatgacaaggacctacagctgcaccaaagccagctggagcttcaggaggtgcgtctctcctgccgacagctgcaggtgaaggtggaagaactcactgaggagaggagtctgcagagctctgccgccaccagcacatccctcctgtcagagatcgagcagagcatggaggctgaggagctggagcaggagcgagagcaggtgacactgctgagtgtggagatgactgccctaaaagaggagagagaccgactcagagtcacttctgaggacaaggagccaaaggagcagcttcagaaggccatcagggaccgcgacgaggccattgcaaagaagaatgctgtggagctggaacttgccaagtgcaggatggatatgatgtctctgaacagccagttgctggatgccattcagcagaaactgaacctctcgcagcagctggaagcttggcagtttgcttcctcagggctttttactatctggctcctttggtttctgatctagtggcctttctcagttcccgtatcaacagctttagttgtacacccctcctgcctttgaggatgacatgcacagggtcattgaccggcagctgatggacacgcacctgaaagaacggagccagccggctgctgccctctgcaggggccacagcgctgggcggggggatgagcccagcatcgctgaaggcaaacgactcttctcattcttcaggaaaatttaagttgggaggagtcaggccaccaaagatgggtggactggaggcagctggaaaggcggtgcaggcaaggcctcccctgcagcttgcacctcagcagctgccctgcccctcatgctagggccccatgggtccgggagggcctgctccctttcgtcggtggggatggagacctagaggtgggggcctgccttggccactgaaggcttcccttggcccaccgcctggccaagcccacgcctgggcttctccaggaccacgtgcttgagcagggttaggccacctcccagaggggccccttggtgttgggctttgcagctcacacccaacagatcgcagcccacccccaggcactgctgcctccttgattttagcaaatggggaacagaaggaatggaggcccttctctgcatgcctcaggaggcctgagccccaggggcctagacctgtgggggcagcgggccaggcctgagcctccattccttccccagcccctggcccagggtcaaaggagagatggcagcccctcccccgcatgcatgcacctcagctggcaggaggccaagcctctggccgcagggtctaagagccggggcttacccaagctcagctgaggccacccgagccccagggaggaagaaggccctgtccccctgtcgccactgctctccctcccagccttcagtctctgccccttagcagggcctggccaggcagagtgttatcaccagtcatctgcaggctttagccatccagccctttcccctgctcagggctggggttggacggggtctcctcctcccacagctccctcctccacccctcacatacatacataatttcttggcctagccaaacaagtccaggccactgaatggcaccagaggggtctgtggtcagccaccccaccttgagggcagcacaggcaccacggggtggaggggagggggaggctgccggaagcctccagatgctgcctgcctgcctgcagaagcctgcagtggctgctgctcctgcctctgcagccgcccctcctcctccacccaggccccaactcagaggctccgcggcccggccagccctcagctgctcacaaccgattcagtctccctccctccctcacgtggggaaagcacagcagggatgcgcggcaagaatgtacctgtagatgtgtacataccacagtgctgtaattttgtatgtagcaatcatgtaaatacatgtatggattttataatatacatatataaaaatctataaaggcatatttttagaaaaacagcacaccactgcttcttttgaaaatagtctgaataagaataaaatgaatttctacagagaaaaaaaaaaagaaccgcaagacacacacacgaacaaaaacaaaaaacaaaaataaaaaaaaacaaacaaaaaaaaaaaaaacaaaaaaagaacacacaaaacagaaaaaacaacgaagagagcggcggagcggggcaggagacgaaagaaaaagaacaagcggcagggcggccacaaactaaaaaaagcgaacaacgaacgaaagaagaagcgagaaaagaaacaagagacgcagaaaaaaaagaaaagcagaggagataaaacaacagaaacacgacgcaccggagaagctaaacacaccagaacaacaacagagaaaagaaaaacagaaaaagaaagaaaaaaaacagagaggagagaaagaaaaaaaaaggaagagggagcgaacacacaaaacaaaaacaacaaaaacaa

SEQ ID NO: 24521 - DNA, 571 bp, Homo sapiens
gagtcttcagaaacctcgtccgccaaggatgtgccagccggcagcttgcgcactgccctcaatgagctcaagagactgatacagagcattgtggatggcatggagcccacgggctcccggagacttgatgatgactccttagaagaacagataaggcagaccagtgaggactcgagagccctaagggagctcatggagggagagaggggtaaactgaggcaaagcctagaagagctgcagcgactccacagtcaggtgagcaccccaaccttcagttcagtgcagggcatgtgcacctgcccctggctctcttgggacccttttgagtttctctctcccatttctgtgtgagaagtggctctccttcatcagatcatcaaggaatggtgacctgaagttgaggtaaactgaatgtcttcaagagaagaacccagtcctttagcccaaagtaaaattggcagggatgagaatggctggtcctccatttcctccagtgacactctgccttatacagagccaaagttaatctgactggtagatgctgacagccctcgggctacttatgggtgct

SEQ ID NO: 24522 - DNA, 511 bp, Homo sapiens
agtagagacggagtttcaccatgttggtcatgctggttgagaactcctgacctcaagtgattcacctacctgggcctcccaaagtgctgggattacaggcgtgagccaccacgcccggctctaatttttgtatttttagtagagacagagtttcgccatgttggccaggctggtcttgaactcctggcctcaagggattcacccacctgggtctcccaaagtgctgggattacaggtgtgagccacccaccacgccagccttaaatcacactttcaacttcacttcctttagatacttgcacttcaactgagttcaccggctgcaggcctgcggagttacctttgatatttatctgtccactccagtagcaaaggggctatgtctgagtgaatcgtccttttctttccattctcccccctcatgtaccctcaacccttcattctttcctcacgtgaacacagcacagttgaggcccagttgtgggtcagtgctaacgtgcaagacttaaaa

SEQ ID NO: 24523 - DNA, 389 bp, Homo sapiens
gccccatgtacttttggctgtggacattaatggtgagtacccatgcaaacattgtttttatactttcagtagagtattcaataaattacatgagatattcaacactttattataaaataggctttgtgttgaatgattttgcacatctgcaggctaatgtaagtgttctgggcacatttaaggtaggctaggctaagttacgtttggtaggttaggtgtattgaatgcatttttaacttaacagtatttccaacttatgatgggtttatcaggatgtgaccccagtgtaagttgagtagtatctgtatttctgggcaaagtattattctttcccattgtaaacttatgtttgattatgacctttggtaccccaaaattaaattgttttg

SEQ ID NO: 24524 - DNA, 101 bp, Homo sapiens
gggaaagttgggaagggccctccctctctctggacttgataggacccaaccaattcagtaacttcaggggttaggtggagcaagaagccaagaagtagagg

SEQ ID NO: 24525 - DNA, 244 bp, Homo sapiens
ctctacctcccaggcacaagtgatcctcccacctcagcacccctgagtagctggaaccacatgtgcccaccaccacacccagctaatttttgtgtgtacatatataaatagtggtttttatttttatttttttttaagagacgaggtttcaccatgctgcccaggctggtctggaactcctgggctcaggcgatgcgcccactttggcctcccaaagttgggattttagctgagattgcaggtg

SEQ ID NO: 24526 - DNA, 1062 bp, Homo sapiens
gagagagagagagcatggccgttaatgaggtgaagtagaaatcatgcagatctggctctgctctcttaaattccattctgacatgaaaccttgagtaagttactcttctgggaatcttagtgtcctgtagaaaatgagaatgataacatctacctggtagaaattaagatgaatgatatctacctggtagaaatgaaggatgcagagaaaacactctgtgctgggtttgttaacttgatgggtagttcaaatgttaattctctgtcttgttcatgtcaggtttccttctttgcactccccccaaagctggctctagggacccacacagaacagaagctcagtcaacattttgttgaattaaacacagttgcgtcagcaaacgtttgctgcatcctcagaactgcagcaggcactttgagaagcttcagagaagtactggttctttttctgccttcataaagcttaccatgtcatcagaagggtgttttcaactagaaatagtagccaaagacccaagagtgagagtgtaagatctagagggagtttccccgaggaagaaaccacactgctatcagcttactcagccagtagtgatgagagccagtgtgtaagatagaaaagtcctttgcccactttcagaagatcctggacaaattataaaaatagcatttatcaacttcttccaggctttccaccaaatttcacgaatcctactaaagctactacaaaaataggaatcactgttttcattttacagattaggacacaaaggctcagagagcagagtaacttgcttcagggctcatctctataaggggcagaaccaagatgcaggccactgtgttcataatagaaatacagctacaggaccaggcagctcaagcctgctccaatgaataccacctatatacgtttagctcgtttgaactcatggactttcgtgtcacaagcagtttttctcacttagttcttcttgtgtcttctgaaatgtcattttgctggattcttttaagaaaatatagggctatattacattacttaaaggttttctggcaccataga

SEQ ID NO: 24527 - DNA, 483 bp, Homo sapiens
agtcactggatgcagtaacacaacttcctccaagtacagacaacccccagtgtctccagatattgcctaatgtccccagggagcaaaatagcccatctgagaactgctgctttcataaagtacaatgtctggtgaaataggtagaggctgtttttagtcaggcgttagtagagatggaagagaccccaggaacatcctggaaggggctgtaatgttctgtttcttgaattgggtgtcggtaatatggagacgttcaatttttttttttttttttttggcaggatcttgctctgtcacccaggctggagcacagtggcaccgtcttggctcactgtagcctttgcctcctgggctcaagcagtcttcccacctcagccttcctgagtagctggaactacaggcaggtgccatcactgttgcctaatttttgtatttatttattttttgtagagaggggggtctcactatgttgcccaggctggt

SEQ ID NO: 24528 - DNA, 394 bp, Homo sapiens
cctagcagtcctcaagtttgatctcttctaccctagttgcctcacctctctgtcattacctggattccaatgccagcattccttgcttagaaagacctaacggcctcctttgaactctagagcctttcatcagccaaagtgcatctattgcactatcttagaattgcctggtcatttttctgtaactcacatctcactgtaagcacagtgaggacgtgacgatgttagtctctctgttcccctcccccagcatctggtggctcttcaccatcatcatggtcatgatcaccactgacatttaccgagcacttattaagtgttgagcagtgtctgtgctaaggcttttatagatgaactcattgaactcggtataatcttttgaagaaggtactgt

SEQ ID NO: 24529 - DNA, 408 bp, Homo sapiens
gagattgaagtatacaaagcttatattatttgctcaaggccacaaagtttgtgagtggaactagaattagatgcctggcagcctggcccctgagcctgccctcttaaccatgactgtagcttgcatctctcaatatttgctattaagagttttaagttcttgacaaaaaggtaagtgtacaatggtcttaggctgttgctttcatttgtatctacctgatttctggtatatataaatgaggttgagtcttttttttgtgtctttgtcatctaaccatgtttcctcttttgtgaattatttgttcatatttttttcaccatgttatttattgagttattgttttctttttgattttgaatagtgtgtcagttatgcattgctatacaataaattatcccaaactaggta

SEQ ID NO: 24530 - DNA, 254 bp, Homo sapiens
atcagttttatatctagccatcttactgaattctcttattatgtaagagtttttcaactgattttcttgggttctctagataaatggtcccatcatctgcaaatggtagtaattttacctcctccctcccagtgtttttaacctcatgtttctctctgacttaatgggaatgcttttaatatcccccttaaccattatgaccccaattattttttacttcgtaaaaatccttttcaattcctaccaaaaatgat

SEQ ID NO: 24531 - DNA, 398 bp, Homo sapiens
acaaggttacgtctcaatcagttgacagaaatgttgtgaccagaggctttcaggaacctaactctgtatcttccttaggagcaatcgttcagtatttgctaattcagtgtttgcagagactttatagggtgtagctgctgcaaatgacaagaatcaactgtaatcatttactaagtatcagctgtaatggtgaagataaatattctagacttaatatgccaggagggatgtgcgtgcctcatatgctctatggacatgttacagtaagggaaataggaggtgtccccctcaacctggaactcctctaacaagccagatagaaatgcatcattttttaggccatttcacttggatcgaagcttgttttctttcacactcctagtgctttcaaaaaaaaa

SEQ ID NO: 24532 - DNA, 651 bp, Homo sapiens
ctccagcctgggagacagagcgagactccgtctcaaaaaaaaaaaaaaaacaacttgaggaggtgggagaaacatgaaggcaatcccttttccttccctttcttttgttggtttttttttttttcatttattcagtacgttcctagtacttttctaggagccaaagatatagcagtgaacaaaacagataaacaagtaagtacataaattaaacgatttctgacatggattcaaagtcagaggaccatgcatctttagcaagctctccctgagtaggatggcagcagatgatctgtggtccatgcatagtgtaaagaaaccgctccgaagagccagaagtcctcctttcttctgtcagggaagtttgcagaagtgaatcagtggatagcaacaccaaagtgataccttcagggtagacaggaaggtaccagcactttgcgacaccaaggcgggaggatcatttgaggccaggagtttgagaccaacctggccaacatgatgaaaccacgtctatacaaaccttagctgggcgtggtggcacaggcctgtagtcccagctacttgggaggctgaggtggaaggatagcttgagcctagtgagctgagatcacgctactgtactccagcctaggtgacaaaagaagactctgt

SEQ ID NO: 24533 - DNA, 347 bp, Homo sapiens
atatttattgagtatctaccatgttcctagtacttttctaggagccaaagatatagcagtgaacaaaacagataaacaagtaagtacataaattaaacgatttctgacatggattcaaagtcagaggttttgggtgggggccaggaccatgcatctttagcaagctctccctgagtaggatggcagcagatgatctgtggtccatgcatagtgtaaagaaaccgctccgaagagccagggagcagtgtccagctgcaagtcctcctttcttctgtcagggaagtttgcagaagtgaatcagtggatagcaacaccaaagtgataccttcagggtagacaggaaggta

SEQ ID NO: 24534 - DNA, 466 bp, Homo sapiens
attttaaagctatcttctctagttaatagagcctttttgtttttaagtatttatattccagaaacaagaatcaagcaaaagcacattttaatctttcctgtaaatgttatatatttggacactttataagacttcatagtagggtaataaaaaaattaccatgtttcgccaggcatggtggctcatacctgtaatcccagcactttgcgacaccaaggcgggaggatcatttgaggccaggagtttgagaccaacctggccaacatgatgaaaccacgtctgtaaaaaaaaaaaaaatacaaaccttagctgggcgtggtggcacaggcctgtagtcccagctacttgggaggctgaggtggaaggatagcttgagcctgggagaaggaggttgcagtgagctgagatcacgctactgtactccagcctaggtgacaaaagaagactctgtcttaaaaaaaaaaaa

SEQ ID NO: 24535 - DNA, 1827 bp, Homo sapiens
acctcccactacacccccttaagctcttgcgccacctgttggtcaccattctgggatggctaaacctctttctctccttagccttataaactcaggctgttaactctacctagattagtgtggtggtctttgtagttcctagctgggcagtagtcaaagtacatgttctagtttaaaactagagtaggtgcagccataaaacagaacaaaatcatgtcctttgcagcaacatggatgcagctggaggccattatcctgagtgaattaacgcaggaacagaaaaccaaataccacacgttctcacaagtgggagctaaacgttgggtacacgcggacataaagatggcaacagtagaaactggggactactagaagggggagggagggaggggagcaagggttgaaaaactgttgggtactgtgctcactacctggttgacaggatcacttgtactccaaacctcagcatcatgcaatatatatctagttaataaacctgcacatgtaccatctaaaagtaaaaagaagcaaatttaaaaaaaaaaaaacaaaaaaacagacccctccccaccagtctcctggttctttttgaaggtggctgtggtcagactattccagcaggttcctcagtgcttcatgctgttcatcaaacctggatccatctggacctaccatttatgtcatttattgttataaaaaataatacatattctcttgacaccttataattagagttcatttaagtcctttttatcaactccattagagtacttgtctggtgtcgagagttttggtagttccagtatatgtgcttgttttgtttcttccactggatctcaagaaggaacaaattattttggtgtcttatagaacaaattcagattgtactagattagaaggaatttattttgatgttattttggagaaaagacttacttgggacttgggtggaagtggagttcatatggatggttttgttttgaataatttctaaggtcttttagctctatcatttcttgtcagtctcccaccgctaaaatataactctatttacttcgttttttcacacagaaagattatagtgacatagtcttcctcttacttaaatacatgtctttttaggattctgccatagtattgattctgccatggcatttattatgcccagtgaccaaggcattagaatatttgtggtacctttacctttttaggccaataaatatcattcatttgctaaagaacatttcattaaacgaggtacagttggctctccatatccatgggtttggcatctggattcaaccaaccgtgaattgaaaatattcaggaagaaatttcacagagttccaaaaaaacctggaatttgtggcatgctgagtactacattgaatctacacagatgaagtgatgtgtaggcattctgttaggtattataagtaatctagggatgatttaaagtatacaggacaatgcgagtgggttatatgcaaatactacattattttatataagagacttgagcatgttgggttttgttatcttttgggggatcctagaactaatcccccatggatactgtgggatgactgtacttattttttagaaataatttctacactatagccccttttttactcccagtttctttcatttttttttttttaggcttcctaaaatattggcagaagctccatcctttctctgtggctttgttccaatgtttttaggcatgttttcagcttgttctacatcccgggggatatattaataagacctagcctaaatgtaagcttgatagttcagggactatcttaagtgttatgttaa

SEQ ID NO: 24536 - DNA, 439 bp, Homo sapiens
ccctctcattatgtgacagactttttctttactcaatcatatttcatttaaaatgtcactattgggagactctctgaatctgctgtgattctgggggctgctggataagaaaaataaaaaagtatcactattaaaattttcaattttaaattaaaattgttattattttcctatatttcaaaatatttgtggtgtatttgatttgaaaggacaagaggaagtgtttaaaataaatgtaaatttattttacaatgccatgaaatgcaactgaggcaaaaacatcgctattttacattttctaatgttattttcctttcaccttatcttgctatgaatatgattagcagagtctatacagggtatgtattttagcatactttgtggaataatattagaaaatagtatgatagtagtaaacctagcatattttagatgtaca

SEQ ID NO: 24537 - DNA, 321 bp, Homo sapiens
caattttatagaaaaagaagacaatgaaaatatgacaaagtgtttttcaaaaaccaacagaaaagatggaaggaacaagatcaaacatatatatgatagcagtaaatgtaattgggataaattcacttattgaaaggcagtactcttactgagttaaaaactaaagccacctgtacattgtttaaaagagacatatctaggctgggcacgatggctcatgcctgtaatcccagcagtttaggaggccaaggcgggtggatcacttgaggtcaggagttcaagaccagcctggccaacatggcaaaactccatgtctactaa

SEQ ID NO: 24538 - DNA, 414 bp, Homo sapiens
ttagatatgagtggtgaactttggttatccatctgtatttaagagcaaggggctgagttttatttttcttcacagatggtgtgggtttcccctgctcttatatatgtagatccggtttcctgttattgctgcctatgaataggaaatctgcatggaaccttgatgttgggtggggggcttgtctcctggaagtttcactttcagatcaagactgagaatgggctggattttagtcaggagtttatgtgtgtgtggtaaggggattcaaaggatttaaatacctggggatttgacgggggcggggtgtgctttactctagagtgtttgcatataatctggccctcctagttctttctagacagttttttttaactttttattttgaactaattttagacgtagagacaagttact

SEQ ID NO: 24539 - DNA, 248 bp, Homo sapiens
aatacaacactttagttttagagccaaacatgtactctgcagctagagaattagaattactggtagcttacattcaatttaggaagaagcagcaactgcataatacatccaaatagtagcaaaggtaagaatgattgatataaataatcatatagctatcaacaggtctggagatacacaatacataacattttaaaggagaataactttaaccattctcacctaaaattctcagcagccagatcaga

SEQ ID NO: 24540 - DNA, 476 bp, Homo sapiens
ggtctttacaacaaccctacgaggtcgacactcttatctccattttcttactagtgaggaagttgatgcacagataggttaagtaataccaaaagtcacatggctggtaaatgacaagaccgggatgccaacccaagcagtttggttgcagaacccatgcactgacagctgtactgtagtgctgactgctaaagttccccagcacacacctttattgttagtcttccttttcatggaaaaactaaaatgacatgtcctcaatatccatttactaaattgattggctctgtaacagaatcactgatgtggctgatagctctagatccagactggaatttgccctctgttttccagaattgtgaaattgtggttgggacatacctgttgccctcccttctctgaaatgccatattggacacaggatgggtgttactcacaataataaatgaacaagtaatgtgacccaaagagactga

SEQ ID NO: 24541 - DNA, 227 bp, Homo sapiens
ttagaactgatctttgccccaagtctccctgggagagcaggctcagggtaggcacatgctcataagaacctctagccttacttgctacaccaagggagcaggaaaatatataaaggataggcaataaataggcaaagccagggaatgggaaggggagacgtaagctaccctgcagcatcttggtatgtgacccattcggatatattcttttttttttttttttctat

SEQ ID NO: 24542 - DNA, 334 bp, Homo sapiens
aaagcttgccacctgctgtcagaccggcgcttgtgtggagccaggggctgtaggtaccccggctgagtagcctctcagatgtccatggtcctggctgcacgccagcgtgggggcaggcaggcggacgctcaagaaaaacggaggcaccgatatgagtagtaattgagaacgagggttcatgatcctcatctgatttcaatccctgctcctccacccaaaatgtgtggccttgaaggagttaaccaatttaaattttagtttcctcagtggaagataataaatccgcctacctcataaaggtttggtgagaattaactcaggtgatgcatgtgaa

SEQ ID NO: 24543 - DNA, 352 bp, Homo sapiens
ttggccctgtggaacctgtggatatgaccattcgcatcccaagaatactgtattttccacctattcttggtttcaagttgtggaacccactgatatggagggccaactgtatatattgaaaacaatttgcatataagtagacccacactggttcagacccctgttgttcagggtcagctctatatctttccaactttgtgcattgattgaaaaaccaacaacagtatgatattagggctataacagatctgttagccaagcccacatgcccctgaacagaacattctgcacattgggccaacttccaactgccggcacctgaagttatttgcattatcagctatctttgtcc

SEQ ID NO: 24544 - DNA, 289 bp, Homo sapiens
gtgggtccaacaaccgacctcagggtgggctcaggctggaaaaaaccacaccgagttcctcccccaagaaatactgaagacagcagcaataagttccatgtgctccccattcgcccctcacagaaaaggccaaaaggcatgaccatggaatcatcaaactattcccaacacagttccttatgggaaagaacatggaatgaagtcacagccaacaacagaactccaaggtcccctagtaaagcgcagaccccagacaacaaagatacgagtgggtctgagtcaagacaga

SEQ ID NO: 24545 - DNA, 342 bp, Homo sapiens
ctagagaaaagaggggtcactggttccagtttaggtagacatccccagaggtgtctgttgctcttgtttcttttctgaaaggtaagtggtgacacctccaggagcccagtggcatttggatttgttatctcccactgggaggacggcatccttcatttgctggccatttcttaggttggtgatttgcaaacatcccttctccccatggagggactgtgtagagttggaagaggggagggatgggaagaggctacactaaccctaggctccttttcagcaaccaagtctcagaagtggtgccatcattcacttttgatttaatgtaaattgcattaaaacaac

SEQ ID NO: 24546 - DNA, 384 bp, Homo sapiens
aaagagaaagtgagagagagagagagatggagggagacggtctccctgtgttgtccaggctagagtgcagtggtacgatcataactcactgcggccttgaactcctaggatcaagtgatcctcccacctcagcctcctgagtagctggaactacaagcatgcaccaccatgcctggaaaagtttttttttctcttttttgtacagatgaggttcttgctatgttgcctaggctggtcttgaacttctggcctcaagaaatcctcctcctgatcctcctacctcagccttccaaagtgttgggattacaggtatgagccaccacacctggcatcatctgtatcatttgtaatatactttacaataaataggtaaacgtgtaagct

SEQ ID NO: 24547 - DNA, 172 bp, Homo sapiens
gggtttcgccatgttgggcaggctggtctcgaactcctgacctcaggtgatccgcccacctcggcctcccaaagtgctgggattataggcgtgggtcaccacaactggacttactgcccatcttttaagagatgaggacagaaagattgagtgacacagttatgtctcctgc

SEQ ID NO: 24548 - DNA, 1244 bp, Homo sapiens
cggcgactacaactcccagtaggccgtgcggcgaaccacagccctcggccaatgggagtctccgctggtctggccttcgaccaatggaagcattatggccgatggccaatgggagcccccacccgctggcctctggccaatgggagcactcagctaaggctggtgggggcggtgttgctcggggctgcgatgccccttaggttgcgggcaaccagaggcctcactcgtgggcaggaagcaagggcggaccccgagagatgactgattgtgggggtggggaccgtctgctcctcctaatggctggggaccgtgcacgtctgcgcgggccggacctgctcttctcgggaacttgcgcgggaggaggcccggagctgcgccgctttaccctctgctccccggtgcctaaaacgcacacgcatcaaagtcacaggacgagttagaggagaaaggcagagggagatttgaaacacagaggaggtgatgagaagacacagcagaagatatctgaagactggaaagaatgctgcaaccaacaggagaaggaaaagacagaaatgtgttttccatttggagcatccagagggagcacaaccatatcaacaccttgattttgatccagtgacattgattttggacttgtggcctccagaacttttagagaataaatttgcattgttttaagccaacaggttggtggaaacttttttacagcagccacaggaagcaaacacagactcctaactggtgcttagtcctagaatatcagtttctgttccacttctggatctcataattgcatctcagacatcaacactgacttcatattcttaatgcaccaattctaccatttcttcaggctgcaaacagagaaaaacttatttaagcattccagaattgacccaatagaagactctccagaaaagactgcatggtctctgaagcagcatgatcagcatgactggctgcatctgggctccaccgtttgccacttcagacaggtccttagcctcttagaggttcattttccttgctgtagcccggagtaagaatgtttagcctacaagatttattttgaggcatcaatgaatcactatgtgagcctcacacagtgtctggcactgatattacaagatatggttgatcttgccatccttgttattgtcctggttggggattcctctctgttgaagatacggagcctctaaaaatgagtggcagaggctcccagctcaggatccttgtcc

SEQ ID NO: 24549 - DNA, 595 bp, Homo sapiens
cggcgactacaactcccagtaggccgtgcggcgaaccacagccctcggccaatgggagtctccgctggtctggccttcgaccaatggaagcattatggccgatggccaatgggagcccccacccgctggcctctggccaatgggagcactcagctaaggctggtgggggcggtgttgctcggggctgcgatgccccttaggttgcgggcaaccagaggcctcactcgtgggcaggaagcaagggcggaccccgagagatgactgattgtgggggtggggaccgtctgctcctcctaatggctggggaccgtgcacgtctgcgcgggccggacctgctcttctcgggaacttgcgcgggaggaggcccggagctgcgccgctttaccctctgctccccggtgcctaaaacgcacacgcatcaaagtcacaggacgagttagaggaatatacaatagagttttccagaggctgctggatgagtcatattgtaacagatgcaatgggaacatggagctgtgggaactcaactgccttaagtgaagccagacattaaggagatttgaaaaaatataatacagtgccactcttctcccta

SEQ ID NO: 24550 - DNA, 344 bp, Homo sapiens
tttgtttatttttgagacagagcctggctctgttgcccaggctgaagtgaagtggcattatcttggctaactgcaactccacctcccaggttcaagtgatcgagaaaggcagagggagatttgaaacacagaggaggtgatgagaagacacagcagaagatatctgaagactggaaagaatgctgcaaccaacaggagaaggaaaagacagaaatgtgttttccatttggagcatccagagggagcacaaccatatcaacaccttgattttgatccagtgacattgattttggacttgtggcctccagaacttttagagaataaatttgcattgttttaagcca

SEQ ID NO: 24551 - DNA, 347 bp, Homo sapiens
attttttttctgtactatccaggggggctctaaatgtaatcacaagtgttcctagagaaaggcagagggagatttgaaacacagaggaggtgatgagaagacacagcagaagatatctgaagactggaaagaatgctgcaaccaacaggagaaggaaaagacagaaatgtgttttccatttggagcatccagagggagcacaaccatatcaacaccttgattttgatccagtgacattgattttggacttgtggcctccagaacttttagagaataaatttgcattgttttaagccaacaggttggtggaaacttttttacagcagccacaggaagcaaacacagac

SEQ ID NO: 24552 - DNA, 685 bp, Homo sapiens
cggcgactacaactcccagtaggccgtgcggcgaaccacagccctcggccaatgggagtctccgctggtctggccttcgaccaatggaagcattatggccgatggccaatgggagcccccacccgctggcctctggccaatgggagcactcagctaaggctggtgggggcggtgttgctcggggctgcgatgccccttaggttgcgggcaaccagaggcctcactcgtgggcaggaagcaagggcggaccccgagagatgactgattgtgggggtggggaccgtctgctcctcctaatggctggggaccgtgcacgtctgcgcgggccggacctgctcttctcgggaacttgcgcgggaggaggcccggagctgcgccgctttaccctctgctccccggtgcctaaaacgcacacgcatcaaagtcacaggacgagttagaggagaaaggcagagggagatttgaaacacagaggaggtgatgagaagacacagcagaagatatctgaagactggaaagaatgctgcaaccaacaggagaaggaaaagacagaaatgtgttttccatttggagcatccagagggagcacaaccatatcaacaccttgattttgatccagtgacattgattttggacttgtggcctccagaacttttagagaataaatttgcattgttttaagcca

SEQ ID NO: 24553 - DNA, 430 bp, Homo sapiens
tagggatagggaggcagtattgtgtaatggccttgcattcagatagctcttggttcaaatcctgcatctgtcatgtattatctgtgggattaaacatcaaagtgttgttaccacattattattatgattgttattactattgtctttatgattatagtcatttaagcagaatgatacagaaatccaggagggaaagggaaaagaatattttgtgtcataatgtctgccattgttaagagagattatgtaccttgattgtgctaaacacaatatattcattatctcagtgtttttcaaaggtgtattttgcagggtattaacagttacttgtggtcaagtgagtttaaagaacaccagctaaccatagttaaacaggcttctttattgcagaactctttagtctttttaatatactactgtaccttgcaga

SEQ ID NO: 24554 - DNA, 123 bp, Homo sapiens
gaaaaaggaatgatttttgttcttgtaaagttaatgctgggaacaagccagttggttttctagctgtttcttgggacagactgatgagtttgtgagctcttaggagtcagcatgatttcccat

SEQ ID NO: 24555 - DNA, 348 bp, Homo sapiens
aaaagggtaaggtatcctggctacaaagagactgaaaaatgacccaagagctagtcagatctgaggggtcctgttaagaagctctacattttatccttgaagcaacagatatctcaaaaaacgggtagaggcaactcagttttttattactaagaaccctgacaacagttatagactagaataagagcaaaacaggcagcaactggagacccatcaaccaactatctgagagtaattcagcagataaataattgagatctgacaaagggagaggcagtagagatgaacagaaaagttaaaagcaggaaattctcaagtttctagcaatagtgaaaccaccaaccaaat

SEQ ID NO: 24556 - DNA, 812 bp, Homo sapiens
gcgtgaatttccttgagcagaatctgggaggcaaacaggaattgcttcagatacaaacgtaggagccactggtgacagacagggaggggcaaggtgggaaagccatgcttgctttctcagcaggaaagctcacagcctggggcaagttctgagtggggcactgcaggagccaggccagcctcaccaactatgagggagttgggtaaggcctcttgctacagctatcacccatttccctgagaaactatatagaacaacagaggcaaccaaaagcccctctggaacataaccccattggcctgagaaccaccccctcaatcccctacagtggccacagcaagcctcacccaaggaaagtctaagcttggacccacctaaaccagccccaacctgatggtatttctctattttcccatggttgccaaacacaaaagatagaaacttctttgggggctttatggccccatccatcacctgacaaactaaaatccttatcctggccaatgcagggcaagcacagatccccctactactactatagctgatgctcttttgaaaatgccacccacaggctggaggccaatctacttgggccataacagcaacttatgacagaataatcttgctgccaggaagaagaagacaatagctaattccactgcccacaacatcctggctaaccaatggtccttagtctctccatttgacaactttactgctagcataaccagcattcgagaaagccagcacactaaacgtatctacaaccaaggactgggtctacctcactcccctgccacctccatccaagc

SEQ ID NO: 24557 - DNA, 435 bp, Homo sapiens
gaccaaagaatgatatagggcccagaaggtaggcaaagagaaagttgttgggtttatggttacaagtaaactagcagttgtggtgcagatagttttatttcccccacattaatctgaacagcccatccagacttaaacactgctttttgcatttacttctaggcaggaagacagggttctgatggtgtgagtctccttcaactcagcaaaccaccttggtctgcctcgagtttccaacacccctcctgcctgctagtgataggtgtgaggcaggttgatgaacatggaacttttttcttttggtcccaaagcatgctactcctggagtttcattcagtgaatgagaactatagtttggttctgtgagatctctatgaatcaaggcggccactgaagcggatcagcgggatcactctaggctacccagcagacacg

SEQ ID NO: 24558 - DNA, 2786 bp, Homo sapiens
  misc_feature (828)..(828): n is a, c, g, or t
ggcaggccggctcggaggcagcgagaaagcgcagccaggcggctgctcggcgttctctcaggtgactgctcggagttctcccagtgtttggtgttgcaagcaggatccaaaggagacctatagtgactcccaggagctcttagtgaccaagtgaaggtacctgtggggctcattgtgcccattgctctttcactgctttcaactggtagttgtgggttgaagcactggacaatgccacatactttgtggatggtgtgggtcttgggggtcatcatcagcctctccaaggaagaatcctccaatcaggcttctctgtcttgtgaccgcaatggtatctgcaagggcagctcaggatctttaaactccattccctcagggctcacagaagctgtaaaaagccttgacctgtccaacaacaggatcacctacattagcaacagtgacctacagaggtgtgtgaacctccaggctctggtgctgacatccaatggaattaacacaatagaggaagattctttttcttccctgggcagtcttgaacatttagacttatcctataattacttatctaatttatcgtcttcctggttcaagcccctttcttctttaacattcttaaacttactgggaaatccttacaaaaccctaggggaaacatctcttttttctcatctcacaaaattgcaaatcctgagagtgggaaatatggacaccttcactaagattcaaagaaaagattttgctggacttaccttccttgaggaacttgagattgatgcttcagatctacagagctatgagccaaaaagtttgaagtcaattcagaangtaagtcatctgatccttcatatgaagcagcatattttactgctggagatttttgtagatgttacaagttccgtggaatgtttggaactgcgagatactgatttggacactttccatttttcagaactatccactggtgaaacaaattcattgattaaaaagtttacatttagaaatgtgaaaatcaccgatgaaagtttgtttcaggttatgaaacttttgaatcagatttctggattgttagaattagagtttgatgactgtacccttaatggagttggtaattttagagcatctgataatgacagagttatagatccaggtaaagtggaaacgttaacaatccggaggctgcatattccaaggttttacttattttatgatctgagcactttatattcacttacagaaagagttaaaagaatcacagtagaaaacagtaaagtttttctggttccttgtttactttcacaacatttaaaatcattagaatacttggatctcagtgaaaatttgatggttgaagaatacttgaaaaattcagcctgtgaggatgcctggccctctctacaaactttaattttaaggcaaaatcatttggcatcattggaaaaaaccggagagactttgctcactctgaaaaacttgactaacattgatatcagtaagaatagttttcattctatgcctgaaacttgtcagtggccagaaaagatgaaatatttgaacttatccagcacacgaatacacagtgtaacaggctgcattcccaagacactggaaattttagatgttagcaacaacaatctcaatttattttctttgaatttgccgcaactcaaagaactttatatttccagaaataagttgatgactctaccagatgcctccctcttacccatgttactagtattgaaaatcagtaggaatgcaataactacgttttctaaggagcaacttgactcatttcacacactgaagactttggaagctggtggcaataacttcatttgctcctgtgaattcctctccttcactcaggagcagcaagcactggccaaagtcttgattgattggccagcaaattacctgtgtgactctccatcccatgtgcgtggccagcaggttcaggatgtccgcctctcggtgtcggaatgtcacaggacagcactggtgtctggcatgtgctgtgctctgttcctgctgatcctgctcacgggggtcctgtgccaccgtttccatggcctgtggtatatgaaaatgatgtgggcctggctccaggccaaaaggaagcccaggaaagctcccagcaggaacatctgctatgatgcatttgtttcttacagtgagcgggatgcctactgggtggagaaccttatggtccaggagctggagaacttcaatccccccttcaagttgtgtcttcataagcgggacttcattcctggcaagtggatcattgacaatatcattgactccattgaaaagagccacaaaactgtctttgtgctttctgaaaactttgtgaagagtgagtggtgcaagtatgaactggacttctcccatttccgtctttttgatgagaacaatgatgctgccattctcattcttctggagcccattgagaaaaaagccattccccagcgcttctgcaagctgcggaagataatgaacaccaagacctacctggagtggcccatggacgaggctcagcgggaaggattttgggtaaatctgagagctgcgataaagtcctaggttcccatatttaagaccagtctttgtctagttgggatctttatgtcactagttatagttaagttcattcagacataattatataaaaactacgtggatgtaccgtcatttgaggacttgcttactaaaactacaaaacttcaaattttgtctggggtgctgttttataaacatatgcccagaaggcacgtccgagctga

SEQ ID NO: 24559 - DNA, 3354 bp, Homo sapiens
  misc_feature (769)..(769): n is a, c, g, or t
ggcaggccggctcggaggcagcgagaaagcgcagccaggcggctgctcggcgttctctcaggtgactgctcggagttctcccagtgtttggtgttgcaagcaggatccaaaggagacctatagtgactcccaggagctcttagtgaccaagtgaaggttgaagcactggacaatgccacatactttgtggatggtgtgggtcttgggggtcatcatcagcctctccaaggaagaatcctccaatcaggcttctctgtcttgtgaccgcaatggtatctgcaagggcagctcaggatctttaaactccattccctcagggctcacagaagctgtaaaaagccttgacctgtccaacaacaggatcacctacattagcaacagtgacctacagaggtgtgtgaacctccaggctctggtgctgacatccaatggaattaacacaatagaggaagattctttttcttccctgggcagtcttgaacatttagacttatcctataattacttatctaatttatcgtcttcctggttcaagcccctttcttctttaacattcttaaacttactgggaaatccttacaaaaccctaggggaaacatctcttttttctcatctcacaaaattgcaaatcctgagagtgggaaatatggacaccttcactaagattcaaagaaaagattttgctggacttaccttccttgaggaacttgagattgatgcttcagatctacagagctatgagccaaaaagtttgaagtcaattcagaangtaagtcatctgatccttcatatgaagcagcatattttactgctggagatttttgtagatgttacaagttccgtggaatgtttggaactgcgagatactgatttggacactttccatttttcagaactatccactggtgaaacaaattcattgattaaaaagtttacatttagaaatgtgaaaatcaccgatgaaagtttgtttcaggttatgaaacttttgaatcagatttctggattgttagaattagagtttgatgactgtacccttaatggagttggtaattttagagcatctgataatgacagagttatagatccaggtaaagtggaaacgttaacaatccggaggctgcatattccaaggttttacttattttatgatctgagcactttatattcacttacagaaagagttaaaagaatcacagtagaaaacagtaaagtttttctggttccttgtttactttcacaacatttaaaatcattagaatacttggatctcagtgaaaatttgatggttgaagaatacttgaaaaattcagcctgtgaggatgcctggccctctctacaaactttaattttaaggcaaaatcatttggcatcattggaaaaaaccggagagactttgctcactctgaaaaacttgactaacattgatatcagtaagaatagttttcattctatgcctgaaacttgtcagtggccagaaaagatgaaatatttgaacttatccagcacacgaatacacagtgtaacaggctgcattcccaagacactggaaattttagatgttagcaacaacaatctcaatttattttctttgaatttgccgcaactcaaagaactttatatttccagaaataagttgatgactctaccagatgcctccctcttacccatgttactagtattgaaaatcagtaggaatgcaataactacgttttctaaggagcaacttgactcatttcacacactgaagactttggaagctggtggcaataacttcatttgctcctgtgaattcctctccttcactcaggagcagcaagcactggccaaagtcttgattgattggccagcaaattacctgtgtgactctccatcccatgtgcgtggccagcaggttcaggatgtccgcctctcggtgtcggaatgtcacaggacagcactggtgtctggcatgtgctgtgctctgttcctgctgatcctgctcacgggggtcctgtgccaccgtttccatggcctgtggtatatgaaaatgatgtgggcctggctccaggccaaaaggaagcccaggaaagctcccagcaggaacatctgctatgatgcatttgtttcttacagtgagcgggatgcctactgggtggagaaccttatggtccaggagctggagaacttcaatccccccttcaagttgtgtcttcataagcgggacttcattcctggcaagtggatcattgacaatatcattgactccattgaaaagagccacaaaactgtctttgtgctttctgaaaactttgtgaagagtgagtggtgcaagtatgaactggacttctcccatttccgtctttttgatgagaacaatgatgctgccattctcattcttctggagcccattgagaaaaaagccattccccagcgcttctgcaagctgcggaagataatgaacaccaagacctacctggagtggcccatggacgaggctcagcgggaaggattttgggtaaatctgagagctgcgataaagtcctaggttcccatatttaagaccagtctttgtctagttgggatctttatgtcactagttatagttaagttcattcagacataattatataaaaactacgtggatgtaccgtcatttgaggacttgcttactaaaactacaaaacttcaaattttgtctggggtgctgttttataaacatatgccagatttaaaaattggtttttggtttttcttttttctatgagataaccatgatcataagtctattactgatatctgaatatagtcccttggtatccaagggaattggttgcaggatcctcgtggatatcaaaattcatagatgatcaagtcccttataagagtggcatagtatttgcatataacctgtgtacattctcctgtatactttaaatcatctctagattacttatgatacccaatacaatgtaaatactatgtaaatagttgtactgtctttttatttatattattattgttattttttattttcaaaatttttaaaacatacttttgatccacagttggttgacttcatggatgcagaacccatggatatagagggccaactgtaatctgtagcaactggcttagttcattaggaaacagcacaaatgaacttaagattctcaatgactgtgtcattctttcttcctgctaagagactcctctgtggccacaaaaggcattctctgtcctacctagctgtcacttctctgtgcagctgatctcaagagcaacaaggcaaagtatttggggcactccccaaaacttgttgctattcctagaaaaaagtgctgtgtatttcctattaaactttacaggatgaga

SEQ ID NO: 24560 - DNA, 3413 bp, Homo sapiens
  misc_feature (828)..(828): n is a, c, g, or t
ggcaggccggctcggaggcagcgagaaagcgcagccaggcggctgctcggcgttctctcaggtgactgctcggagttctcccagtgtttggtgttgcaagcaggatccaaaggagacctatagtgactcccaggagctcttagtgaccaagtgaaggtacctgtggggctcattgtgcccattgctctttcactgctttcaactggtagttgtgggttgaagcactggacaatgccacatactttgtggatggtgtgggtcttgggggtcatcatcagcctctccaaggaagaatcctccaatcaggcttctctgtcttgtgaccgcaatggtatctgcaagggcagctcaggatctttaaactccattccctcagggctcacagaagctgtaaaaagccttgacctgtccaacaacaggatcacctacattagcaacagtgacctacagaggtgtgtgaacctccaggctctggtgctgacatccaatggaattaacacaatagaggaagattctttttcttccctgggcagtcttgaacatttagacttatcctataattacttatctaatttatcgtcttcctggttcaagcccctttcttctttaacattcttaaacttactgggaaatccttacaaaaccctaggggaaacatctcttttttctcatctcacaaaattgcaaatcctgagagtgggaaatatggacaccttcactaagattcaaagaaaagattttgctggacttaccttccttgaggaacttgagattgatgcttcagatctacagagctatgagccaaaaagtttgaagtcaattcagaangtaagtcatctgatccttcatatgaagcagcatattttactgctggagatttttgtagatgttacaagttccgtggaatgtttggaactgcgagatactgatttggacactttccatttttcagaactatccactggtgaaacaaattcattgattaaaaagtttacatttagaaatgtgaaaatcaccgatgaaagtttgtttcaggttatgaaacttttgaatcagatttctggattgttagaattagagtttgatgactgtacccttaatggagttggtaattttagagcatctgataatgacagagttatagatccaggtaaagtggaaacgttaacaatccggaggctgcatattccaaggttttacttattttatgatctgagcactttatattcacttacagaaagagttaaaagaatcacagtagaaaacagtaaagtttttctggttccttgtttactttcacaacatttaaaatcattagaatacttggatctcagtgaaaatttgatggttgaagaatacttgaaaaattcagcctgtgaggatgcctggccctctctacaaactttaattttaaggcaaaatcatttggcatcattggaaaaaaccggagagactttgctcactctgaaaaacttgactaacattgatatcagtaagaatagttttcattctatgcctgaaacttgtcagtggccagaaaagatgaaatatttgaacttatccagcacacgaatacacagtgtaacaggctgcattcccaagacactggaaattttagatgttagcaacaacaatctcaatttattttctttgaatttgccgcaactcaaagaactttatatttccagaaataagttgatgactctaccagatgcctccctcttacccatgttactagtattgaaaatcagtaggaatgcaataactacgttttctaaggagcaacttgactcatttcacacactgaagactttggaagctggtggcaataacttcatttgctcctgtgaattcctctccttcactcaggagcagcaagcactggccaaagtcttgattgattggccagcaaattacctgtgtgactctccatcccatgtgcgtggccagcaggttcaggatgtccgcctctcggtgtcggaatgtcacaggacagcactggtgtctggcatgtgctgtgctctgttcctgctgatcctgctcacgggggtcctgtgccaccgtttccatggcctgtggtatatgaaaatgatgtgggcctggctccaggccaaaaggaagcccaggaaagctcccagcaggaacatctgctatgatgcatttgtttcttacagtgagcgggatgcctactgggtggagaaccttatggtccaggagctggagaacttcaatccccccttcaagttgtgtcttcataagcgggacttcattcctggcaagtggatcattgacaatatcattgactccattgaaaagagccacaaaactgtctttgtgctttctgaaaactttgtgaagagtgagtggtgcaagtatgaactggacttctcccatttccgtctttttgatgagaacaatgatgctgccattctcattcttctggagcccattgagaaaaaagccattccccagcgcttctgcaagctgcggaagataatgaacaccaagacctacctggagtggcccatggacgaggctcagcgggaaggattttgggtaaatctgagagctgcgataaagtcctaggttcccatatttaagaccagtctttgtctagttgggatctttatgtcactagttatagttaagttcattcagacataattatataaaaactacgtggatgtaccgtcatttgaggacttgcttactaaaactacaaaacttcaaattttgtctggggtgctgttttataaacatatgccagatttaaaaattggtttttggtttttcttttttctatgagataaccatgatcataagtctattactgatatctgaatatagtcccttggtatccaagggaattggttgcaggatcctcgtggatatcaaaattcatagatgatcaagtcccttataagagtggcatagtatttgcatataacctgtgtacattctcctgtatactttaaatcatctctagattacttatgatacccaatacaatgtaaatactatgtaaatagttgtactgtctttttatttatattattattgttattttttattttcaaaatttttaaaacatacttttgatccacagttggttgacttcatggatgcagaacccatggatatagagggccaactgtaatctgtagcaactggcttagttcattaggaaacagcacaaatgaacttaagattctcaatgactgtgtcattctttcttcctgctaagagactcctctgtggccacaaaaggcattctctgtcctacctagctgtcacttctctgtgcagctgatctcaagagcaacaaggcaaagtatttggggcactccccaaaacttgttgctattcctagaaaaaagtgctgtgtatttcctattaaactttacaggatgaga

SEQ ID NO: 24561 - DNA, 4025 bp, Homo sapiens
  misc_feature (1440)..(1440): n is a, c, g, or t
gaccaaagaatgatatagggcccagaaggtaggcaaagagaaagttgttgggtttatggttacaagtaaactagcagttgtggtgcagatagttttatttcccccacattaatctgaacagcccatccagacttaaacactgctttttgcatttacttctaggcaggaagacagggttctgatggtgtgagtctccttcaactcagcaaaccaccttggtctgcctcgagtttccaacacccctcctgcctgctagtgataggtgtgaggcaggttgatgaacatggaacttttttcttttggtcccaaagcatgctactcctggagtttcattcagtgaatgagaactatagtttggttctgtgagatctctatgaatcaaggcggccactgaagcggagaaaagaaatgcttaaatgttaagaaagtttgaagtgcagaaaaaggtgattgtaaatccatatggttaagcttagcccatttcttaaaaggcttgattgctcattcctccattcattgatttactcactcttccaatccatgttattgagtcttgctctgtaattccggatggttgtgcttttaagtactgcatagtggttgtatgtctgtgttagcattgctgaatgtatcagggaattcatttttttatccccattcattcgttccattcatctgtttctctctctctctctctttgtgtgtgtgtgtgtgtgtgtgtgtgtgtgtgtgtgtgtgtgtgttatgcctagaaaacatttctcaagaattagaattacgatatgctgtcaaacacaatgacttatttgaacctcttttatttgtaggttgaagcactggacaatgccacatactttgtggatggtgtgggtcttgggggtcatcatcagcctctccaaggaagaatcctccaatcaggcttctctgtcttgtgaccgcaatggtatctgcaagggcagctcaggatctttaaactccattccctcagggctcacagaagctgtaaaaagccttgacctgtccaacaacaggatcacctacattagcaacagtgacctacagaggtgtgtgaacctccaggctctggtgctgacatccaatggaattaacacaatagaggaagattctttttcttccctgggcagtcttgaacatttagacttatcctataattacttatctaatttatcgtcttcctggttcaagcccctttcttctttaacattcttaaacttactgggaaatccttacaaaaccctaggggaaacatctcttttttctcatctcacaaaattgcaaatcctgagagtgggaaatatggacaccttcactaagattcaaagaaaagattttgctggacttaccttccttgaggaacttgagattgatgcttcagatctacagagctatgagccaaaaagtttgaagtcaattcagaangtaagtcatctgatccttcatatgaagcagcatattttactgctggagatttttgtagatgttacaagttccgtggaatgtttggaactgcgagatactgatttggacactttccatttttcagaactatccactggtgaaacaaattcattgattaaaaagtttacatttagaaatgtgaaaatcaccgatgaaagtttgtttcaggttatgaaacttttgaatcagatttctggattgttagaattagagtttgatgactgtacccttaatggagttggtaattttagagcatctgataatgacagagttatagatccaggtaaagtggaaacgttaacaatccggaggctgcatattccaaggttttacttattttatgatctgagcactttatattcacttacagaaagagttaaaagaatcacagtagaaaacagtaaagtttttctggttccttgtttactttcacaacatttaaaatcattagaatacttggatctcagtgaaaatttgatggttgaagaatacttgaaaaattcagcctgtgaggatgcctggccctctctacaaactttaattttaaggcaaaatcatttggcatcattggaaaaaaccggagagactttgctcactctgaaaaacttgactaacattgatatcagtaagaatagttttcattctatgcctgaaacttgtcagtggccagaaaagatgaaatatttgaacttatccagcacacgaatacacagtgtaacaggctgcattcccaagacactggaaattttagatgttagcaacaacaatctcaatttattttctttgaatttgccgcaactcaaagaactttatatttccagaaataagttgatgactctaccagatgcctccctcttacccatgttactagtattgaaaatcagtaggaatgcaataactacgttttctaaggagcaacttgactcatttcacacactgaagactttggaagctggtggcaataacttcatttgctcctgtgaattcctctccttcactcaggagcagcaagcactggccaaagtcttgattgattggccagcaaattacctgtgtgactctccatcccatgtgcgtggccagcaggttcaggatgtccgcctctcggtgtcggaatgtcacaggacagcactggtgtctggcatgtgctgtgctctgttcctgctgatcctgctcacgggggtcctgtgccaccgtttccatggcctgtggtatatgaaaatgatgtgggcctggctccaggccaaaaggaagcccaggaaagctcccagcaggaacatctgctatgatgcatttgtttcttacagtgagcgggatgcctactgggtggagaaccttatggtccaggagctggagaacttcaatccccccttcaagttgtgtcttcataagcgggacttcattcctggcaagtggatcattgacaatatcattgactccattgaaaagagccacaaaactgtctttgtgctttctgaaaactttgtgaagagtgagtggtgcaagtatgaactggacttctcccatttccgtctttttgatgagaacaatgatgctgccattctcattcttctggagcccattgagaaaaaagccattccccagcgcttctgcaagctgcggaagataatgaacaccaagacctacctggagtggcccatggacgaggctcagcgggaaggattttgggtaaatctgagagctgcgataaagtcctaggttcccatatttaagaccagtctttgtctagttgggatctttatgtcactagttatagttaagttcattcagacataattatataaaaactacgtggatgtaccgtcatttgaggacttgcttactaaaactacaaaacttcaaattttgtctggggtgctgttttataaacatatgccagatttaaaaattggtttttggtttttcttttttctatgagataaccatgatcataagtctattactgatatctgaatatagtcccttggtatccaagggaattggttgcaggatcctcgtggatatcaaaattcatagatgatcaagtcccttataagagtggcatagtatttgcatataacctgtgtacattctcctgtatactttaaatcatctctagattacttatgatacccaatacaatgtaaatactatgtaaatagttgtactgtctttttatttatattattattgttattttttattttcaaaatttttaaaacatacttttgatccacagttggttgacttcatggatgcagaacccatggatatagagggccaactgtaatctgtagcaactggcttagttcattaggaaacagcacaaatgaacttaagattctcaatgactgtgtcattctttcttcctgctaagagactcctctgtggccacaaaaggcattctctgtcctacctagctgtcacttctctgtgcagctgatctcaagagcaacaaggcaaagtatttggggcactccccaaaacttgttgctattcctagaaaaaagtgctgtgtatttcctattaaactttacaggatgaga

SEQ ID NO: 24562 - DNA, 385 bp, Homo sapiens
cttccaaaaaaatgaaaagggaggaacacttacctcattccatgatatcaaaccaaacaaataacatcacaagaaaactgcagaccagtattccttatgaatatgcttataaaaatcctccataaaatactggcaaactcaatccagcaacatatgacaaaaattatacattgtgaccaagtgagatttattccaagaatgcaaggttggttcaatgtgaaagtcaaccagtaggatacatcaaactaacagaataaaagaaaccacatgatcatttcaacagacgggaaaaaaaacacttgacaaatccaatatcctttaattaaaaaaaaaaaactagaaatagaaggaaatgtcctcaacttgatgagcatttatgaaaata

SEQ ID NO: 24563 - DNA, 518 bp, Homo sapiens
aaatctacataactgatttaagacatttcctctttactaacataagcacttaacattatcagcttcattgtatgcactgctttaactgcatcccgtaaattttcatatgttctgtttccattgtcattctgctcaaaatgttttctgatttcctttgctgtttttcgttaattcttaggttaattcccaaatattaggggattttccagataactttttgctagaatttggttttgttatttaatgtcatctgtgtggtctaagaatatgctctgcataaattcaagtttttaaaacttactgacatttattttttggcccagcatatagtttaattttgggggatgttatgtgtgcatttgaaaaaaatgtgttttctctcttgttgagtgttctgtaaatgacaataaggtcgaattagattgatggtgttgttcaagtcttttatgtcttaaccaattttctatatacttgttataccaattactgagagagaagtagtaaaatctccaaccata

SEQ ID NO: 24564 - DNA, 2190 bp, Homo sapiens
  misc_feature (2187)..(2190): n is a, c, g, or t
ccttcctccctcctgcatctgagctttgtctccaccagcaacatgagccgccaattcacctgcaagtcgggagctgccgccaaggggggcttcagtggctgtcagtgggggctttggcagccggagcctctacagcctggggggtgtccggagcctcaatgtggccagtggcagcgggaagagtggaggctatggatttggccggggccgggccagtggctttgctggaagcatgtttggcagtgtggccctggggcctgtgtgcccaactgtatgcccacctggaggcatccaccaggttaccgtcaatgagagcctcctggcccccctcaacgtggagctggaccccgagatccagaaagtgcgtgcccaggagcgagagcagatcaaggctctgaacaacaagttcgcctccttcatcgacaaggtgcggttcctggagcagcagaaccaggtactggagaccaagtgggagctgctgcagcagctggacctgaacaactgcaagaacaacctggagcccatcctcgagggctacatcagcaacctgcggaagcagctggagacgctgtctggggacagggtgaggctggactcggagctgaggaatgtgcgggacgtagtggaggactacaagaagaggtatgaggaggaaatcaacaagcggacagcagcagagaacgagtttgtgctgctcaagaaggatgtggatgctgcttacgccaataaggtggaactgcaggccaaggtggaatccatggaccaggagatcaagttcttcaggtgtctctttgaagccgagatcactcagatccagtcccacatcagtgacatgtctgtcatcctgtccatggacaacaaccggaacctagacctggacagcatcattgacgaagtccgcacccagtatgaggagattgccttgaagagtaaggccgaggctgaggccctgtaccagaccaagttccaagagcttcagctggcagctggcaggcatggggacgacctcaaaaacaccaagaatgaaatctcggagctcactcggctcatccagagaatccgctcagagatcgagaacgtgaagaagcaggcttccaacctggagacagccatcgctgatgctgagcagcggggagacaacgccctgaaggatgcccgggccaagctggacgagctggagggcgccctgcaccaggccaaggaggagctggcgcggatgctgcgcgagtaccaggagctcatgagcctgaagctggccctggacatggagatcgccacctatcgcaagctactggagagcgaggagtgcaggatgtcaggagaatttccctcccctgtcagcatctccatcatcagcagcaccagtggcggcagtgtctatggcttccggcccagcatggtcagcggtggctatgtggccaacagcagcaactgcatctctggagtgtgcagcgtgagaggcggggagggcaggagccggggcagtgccaacgattacaaagacaccctagggaagggttccagcctgagtgcaccctccaagaaaaccagtcggtagagaagactgccccgggccccgcctcattccatgacccggctctggatcccacactgtacttcccacagcccactctcagctccatctccaccctgctggtcctgctcccatacacctggcactggccttggccacccacttctcccagcctgtgtcttcctgatcctgggaaggcctggatgaccaagcttggtgaaattcctccctgtacacaccctattaactccttggctgtggtcccccagctacaccaccagcccaggtcctggctgccagctttcctcctctgcccggcctctagcgcagtcgctaactactctgctgggctccctgggtctctgcccaaggccccgcacacactggggcctagcatagttcctgcctatgccaggagctggctctgtgtttaagaaaaggaggactgaaggacaaacaaccaagagtggcccagtccccacccccacatctagctcagtctcaaatctgagtgggaccaagtgcaattcagggcctttttctccactcacctgcacccagaagcagagaaaagcaggcactgttcacttttcctttattcttaatggccttcctctgttgcaacctcaataaacagcacaatctcaaaaaannnn

SEQ ID NO: 24565 - DNA, 1521 bp, Homo sapiens
  misc_feature (1518)..(1521): n is a, c, g, or t
ccttcctccctcctgcatctgagctttgtctccaccagcaacatgagccgccaattcacctgcaagtcgggagctgccgccaaggggggcttcagtggctgctcagctgtgctctcagggggcagctcatcctccttccgggcagggagcaaagggctcagtgggggctttggcagccggagcctctacagcctggggggtgtccggagcctcaatgtggccagtggcagcgggaagagtggaggctatggatttggccggggccgggccagtggctttgctggaagcatgtttggcagtgtggccctggggcctgtgtgcccaactgtatgcccacctggaggcatccaccaggttaccgtcaatgagagcctcctggcccccctcaacgtggagctggaccccgagatccagaaagtgcgtgcccaggagcgagagcagatcaaggctctgaacaacaagttcgcctccttcatcgacaaggtgcggttcctggagcagcagaaccaggtactggagaccaagtgggagctgctgcagcagctggacctgaacaactgcaagaacaacctggagcccatcctcgagggctacatcagcaacctgcggaagcagctggagacgctgtctggggacagggtgaggctggactcggagctgaggaatgtgcgggacgtagtggaggactacaagaagaggtatgaggaggaaatcaacaagcggacagcagcagagaacgagtttgtgctgctcaagaaggatgtggatgctgcttacgccaataaggtggaactgcaggccaaggtggaatccatggaccaggagatcaagttcttcaggtgtctctttgaagccgagatcactcagatccagtcccacatcagtgacatgtctgtcatcctgtccatggacaacaaccggaacctagacctggacagcatcattgacgaagtccgcacccagtatgaggagattgccttgaagagtaaggccgaggctgaggccctgtaccagaccaagttccaagagcttcagctggcagctggcaggcatggggacgacctcaaaaacaccaagcttggtgaaattcctccctgtacacaccctattaactccttggctgtggtcccccagctacaccaccagcccaggtcctggctgccagctttcctcctctgcccggcctctagcgcagtcgctaactactctgctgggctccctgggtctctgcccaaggccccgcacacactggggcctagcatagttcctgcctatgccaggagctggctctgtgtttaagaaaaggaggactgaaggacaaacaaccaagagtggcccagtccccacccccacatctagctcagtctcaaatctgagtgggaccaagtgcaattcagggcctttttctccactcacctgcacccagaagcagagaaaagcaggcactgttcacttttcctttattcttaatggccttcctctgttgcaacctcaataaacagcacaatctcaaaaaannnn

SEQ ID NO: 24566 - DNA, 2246 bp, Homo sapiens
  misc_feature (2243)..(2246): n is a, c, g, or t
ccttcctccctcctgcatctgagctttgtctccaccagcaacatgagccgccaattcacctgcaagtcgggagctgccgccaaggggggcttcagtggctgctcagctgtgctctcagggggcagctcatcctccttccgggcagggagcaaagggctcagtgggggctttggcagccggagcctctacagcctggggggtgtccggagcctcaatgtggccagtggcagcgggaagagtggaggctatggatttggccggggccgggccagtggctttgctggaagcatgtttggcagtgtggccctggggcctgtgtgcccaactgtatgcccacctggaggcatccaccaggttaccgtcaatgagagcctcctggcccccctcaacgtggagctggaccccgagatccagaaagtgcgtgcccaggagcgagagcagatcaaggctctgaacaacaagttcgcctccttcatcgacaaggtgcggttcctggagcagcagaaccaggtactggagaccaagtgggagctgctgcagcagctggacctgaacaactgcaagaacaacctggagcccatcctcgagggctacatcagcaacctgcggaagcagctggagacgctgtctggggacagggtgaggctggactcggagctgaggaatgtgcgggacgtagtggaggactacaagaagaggtatgaggaggaaatcaacaagcggacagcagcagagaacgagtttgtgctgctcaagaaggatgtggatgctgcttacgccaataaggtggaactgcaggccaaggtggaatccatggaccaggagatcaagttcttcaggtgtctctttgaagccgagatcactcagatccagtcccacatcagtgacatgtctgtcatcctgtccatggacaacaaccggaacctagacctggacagcatcattgacgaagtccgcacccagtatgaggagattgccttgaagagtaaggccgaggctgaggccctgtaccagaccaagttccaagagcttcagctggcagctggcaggcatggggacgacctcaaaaacaccaagaatgaaatctcggagctcactcggctcatccagagaatccgctcagagatcgagaacgtgaagaagcaggcttccaacctggagacagccatcgctgatgctgagcagcggggagacaacgccctgaaggatgcccgggccaagctggacgagctggagggcgccctgcaccaggccaaggaggagctggcgcggatgctgcgcgagtaccaggagctcatgagcctgaagctggccctggacatggagatcgccacctatcgcaagctactggagagcgaggagtgcaggatgtcaggagaatttccctcccctgtcagcatctccatcatcagcagcaccagtggcggcagtgtctatggcttccggcccagcatggtcagcggtggctatgtggccaacagcagcaactgcatctctggagtgtgcagcgtgagaggcggggagggcaggagccggggcagtgccaacgattacaaagacaccctagggaagggttccagcctgagtgcaccctccaagaaaaccagtcggtagagaagactgccccgggccccgcctcattccatgacccggctctggatcccacactgtacttcccacagcccactctcagctccatctccaccctgctggtcctgctcccatacacctggcactggccttggccacccacttctcccagcctgtgtcttcctgatcctgggaaggcctggatgaccaagcttggtgaaattcctccctgtacacaccctattaactccttggctgtggtcccccagctacaccaccagcccaggtcctggctgccagctttcctcctctgcccggcctctagcgcagtcgctaactactctgctgggctccctgggtctctgcccaaggccccgcacacactggggcctagcatagttcctgcctatgccaggagctggctctgtgtttaagaaaaggaggactgaaggacaaacaaccaagagtggcccagtccccacccccacatctagctcagtctcaaatctgagtgggaccaagtgcaattcagggcctttttctccactcacctgcacccagaagcagagaaaagcaggcactgttcacttttcctttattcttaatggccttcctctgttgcaacctcaataaacagcacaatctcaaaaaannnn

SEQ ID NO: 24567 - DNA, 286 bp, Homo sapiens
cccaaaccacactcccctcctgcccgcactgattgtctcttgtctttatcattctgagacactgaatggccaagacttgatgctgcaggcctgggccctaagaaaggagcaggagggagatggccgggctaaatgggaaacagtgtctatgcctagatgagagagtggaaaaattggtttagaagtttgtacagaaagcaattgacaggagtcgacaaattaaagaccacaggccaaatctggcctgccacctatttttgtaaataaagccttatacacacacaca

SEQ ID NO: 24568 - DNA, 479 bp, Homo sapiens
atcttggtttcattctttgtttccttttcctaccaacaactaaatcagagagaacctgtcttttacagaggacaattcatcagtggttaaactgagagctcacgtcttctaaagggaagaaatttaaaaaggcagttgatacttggaggagcaaactgtcactctaaggaaatcataccacatgtctagctgtcctgatacagcttaaaaataaaagtggagatgacagatttggtgaataaagtccttgacagagaaaacacatagaaaagcataatttccgtttgagaaggagtttcgcttttatctcccaggctggagtgcaacgaacggcatgatctcggctcactgcaacctccgcctcctgggttcaagcaattctcctacctcagcctcctgagtagccgggactacaagccatgtgccattacagccggctaatttttttgtatttttagtagagatggggtttcatcatt

SEQ ID NO: 24569 - DNA, 1013 bp, Homo sapiens
gcaaccttgagcctcctttggtgaataagggtggtgcctgggaaagcatggagggatcaggctggtgatcagcaagcttgcacttcatttgcctaaggacatgcagttgcacttctttagagtcagcttttcacaaggttgggtgaaaattgttaggaggcagcacaaggggagcaaagatgttactaaccccagtcgccaaagcctgaggtatctggcctgtaaacataagcagtcttctctgcttcagagagcctggtgagaagggatgggaagctgggtttcagttaagctagagggaaagtgctggaagaggaggtacgtgaacaagtagcagataattgagcaagagttacagagaacacagtggaaggatttggaagaaaggggaagatttggaagaaaagaaagggatgcaccattgttacatcaaatagtgagatgagtgcggagcagtctggggatggggtcataatagatggtcctgggaggtttcaaatgccggtaaaaattgagataaggaaagatatgagacctgttgaacttagtttttatattccgttattaggcgagaactgggacctgaaggctttccacaatagcttggcaggggagagggttttggcagttaggcatgactgcttctgaaggttgtaggcactaaaatggtacaggtcatgccttgtttttgtttttctgttttgttttgctttgttttcccaatatagacatccagttgttgctgcaccagcttttgaaaatcctttctccgtgaaattgctttggcattttcatctaaaattagtgactatatcttatgagtctggctctggattgcctcttctgttcattgatctctttgtctggccttatgataatatactgtcttgagtattgcagagttatgttaaaatcagaaagtgtgagtcctccatctttgtgcttcaagattgttttggttattctaaaatagccacatatattttaaaatcaactaggcagtttctacgaaa

SEQ ID NO: 24570 - DNA, 425 bp, Homo sapiens
attgaatgaaatgggttttttactataaagatgtttttaccaagcaaactcttgccatttcttctacttaaagtttatagataatgaaggaaaagtattttctcccgtggttaaaattcttttacataaaacttaaaagcttttatcctgtttttaaatttaaatttaaatttcattttaaatgtaaatatcctcattttaaaaccaaaataatacatggaatgtaaactcaaaagatcattttggagaattttcatactgtaacttgagaaacttctttaaataaatgaatatttcttttttatttttagtagacttaacatttcactaaaagactggaggaaggaaaacagatttaaattaattttttagaatctttttgtaattgaagatcatgtgaatgaaaacaaagtagctgtgaacct

SEQ ID NO: 24571 - DNA, 2333 bp, Homo sapiens
  misc_feature (4)..(6): n is a, c, g, or t
  misc_feature (8)..(9): n is a, c, g, or t
  misc_feature (1794)..(1794): n is a, c, g, or t
cagnnngnnggcttttagccctgcggagggtggggctagagcaggcaggaagacgagctaggagcctattgctataatgtgggtgggaggtgagggtagcttggaatgagattgaaatagtggagatagtgaaaatagatttggggtacattttggaggcagagctggtagatactgatggattaaatatgaggggtgggaaggagtgaagagaacgtacacatgagggcttaagggtcttgctggagcagccggagtgggagatgctgtttgctgagctgctttgtgcgtctgtcagaaagcagcggctctctttcgggcctgctaagctggggatacatactaaacactgaagtggagctcatgagtggcacatggatgtttggatctggaccttgttcagttgaggggtcaaggatagatacatgaatttgagagcctccacttacagttggcatttgcagtcgtgggacagggtacacttgctgagggagagaatatggatagagaagagatttgaggacagagcccaggggtgtcccaacaaggtgagttctgggagagaagtcagctggggaattgcttcagtgtcctgaaggcagatcaatgagaaggagcagttctataaatagaaatccctgcagagatgttagaaaaccagcattacagcatgccaagagatagaatagtgattaataactgcttaaaagtgtatgttctgccactggaatgctaggaaagctacccaaaaaggctgttcctaattgaggaatatggttcttaaatgtttacattgccttatatttgtgatagggattattggctttgtgagcaaagctctttgacatttgtggatggagtgtactcattattgagaggaattttctgaaatgaatgtcagttccttttttcccctaagctttgctttgaattactatacagtttacttaagaaacctgtgatcagcgagaggaaagagaagtgatttctgaagcttctatggccacttcctgctgagtcttagcattctatcctgtcaagtatgctaatgggagaaggagcaacatctctggatacaaaggatcgccaggatgctgatgtgaatagtaggggtgagctagctctgtcctcatgcccagaccttgtcctgatctgtagcacacatttgagagacaggagctgtgttgattgcctattgctgctgtaacaaattattacacttagtggcttaaaagaacatgtttattttatggttctggaggtaagaaatctgaaacggctctgtagtaggctaacaccctccaggtgttaggctgtaactcctgaaacgtggatgtagccttatgtggaataagggtctttgcagatgtgattaagcaccttgagatagggcaattatcgtggattgtcaagatgggccctaaatgccacctcaaatgttctcctcacagagatgcagaggaggattactcagaagagaaggcagtgtgaccacagaagtagggaattaggcatgctgtggccacaagccaaaaaatacatgcagccaccagaagctggaagaggcaaggaaccgactgtccctagagcctctggagggagcacggccctgtcctgcctaccccttcgcttctacccagtgataccaatttcagacatctggagtctggaactgtgagagaagagttttctgttgttttaagccactaagtataggtaattattaatgacaatttgttatagcagcaatagggaaccaatacagagtctcactgggctaatccagtgtcagcnggactgtgttcctttcaggaggctcttagaatctgttttcttgactcttccagcttctagagtctgtccacattccttcactcatggcttcttatgtcttcaagccagtctttgacactttttagatagtgattcttctgcttccctcttccgcatttaaggacgctgtgattgcattagaccccaccttgataattatcttaaggtcagctgattagctaccttaactccatctgcatccttaattgccctttgcccatgtaaggtgtaacatactcagattctggggctatgacagagacatctttaggagctgttattttgccttaaaaaggaggcaattatttaagtatataaggtgaatagttaggtctttctctccaggaaacctaacttgtcattcagcggttaccatgcatgggtatcttcttccaattgcctgagccagccagactttcatgtttgagcattcagattgggctttatttctcaaggcatgtggcaaacctcacaatgacactgaaaggttaaaaaaaaaa

SEQ ID NO: 24572 - DNA, 877 bp, Homo sapiens
aggctgaggcaagaggttgcttgagcccaagagttggaggctgcagtgaaccatgatcatgccacctgcactccagcctgagcaacaagcaagaccctctccctaaaagaaataaataaattagaaatcaataataattaagatatctagaaaatgtcccaatatttggaaattaaagactacatttctaaataacctacacttcaaagaaaaaatcattaggtaaattagaaaatattttagtaaatgataaaaagcacaacataacaacgtttgtgagatgcaatgaaagacatattaggggaaaatttgcagttttaatgttagaaaaggataaaaatcagttatctaagcttctatcttaacaagctagcaaagaagggtaaatgaagcccaaagtaaacaaagaccaaatgatagtaacaataaaaatataaaccaatgaaaaagaaaaacaaaagagaaaagttaacaaaaattaacaaaatcaccatttgtgtaaaattattaataaatttaataactccctagcaagactggttacaaacaaaaaagagaaaatagaaattacaaacatcaggaatgaaaaataagacatcacactatagacattaaaaggataataaggggatattatgaacaatttcatgacaataaacctgacaaattacatatgatacttacagaaagatatagtgacaactacagaaagatttagaagagggaggctctaaagagctatatatccattgaataaatagagctcaatattttaaatcttcaggaatagatggtgaattctaccaaacatttaatgaaaacaataatcctaatcataatcataaactgatatggtttggctgtgtccccacccaaa

SEQ ID NO: 24573 - DNA, 931 bp, Homo sapiens
aggctgaggcaagaggttgcttgagcccaagagttggaggctgcagtgaaccatgatcatgccacctgcactccagcctgagcaacaagcaagaccctctccctaaaagaaataaataaattagaaatcaataataattaagatatctagaaaatgtcccaatatttggaaattaaagactacatttctaaataacctacacttcaaagaaaaaatcattaggtaaattagaaaatattttagtaaatgataaaaagcacaacataacaacgtttgtgagatgcaatgaaagacatattaggggaaaatttgcagttttaatgttagaaaaggataaaaatcagttatctaagcttctatcttaacaagctagcaaagaagggtaaatgaagcccaaagtaaacaaagaccaaatgatagtaacaataaaaatataaaccaatgaaaaagaaaaacaaaagagaaaagttaacaaaaattaacaaaatcaccatttgtgtaaaattattaataaatttaataactccctagcaagactggttacaaacaaaaaagagaaaatagaaattacaaacatcaggaatgaaaaataagacatcacactatagacattaaaaggataataaggggatattatgaacaatttcatgacaataaacctgacaaattacataaaataaactttgacaagacacagttccacttatagaaagtatatttcttctttatgatacttacagaaagatatagtgacaactacagaaagatttagaagagggaggctctaaagagctatatatccattgaataaatagagctcaatattttaaatcttcaggaatagatggtgaattctaccaaacatttaatgaaaacaataatcctaatcataatcataaactgatatggtttggctgtgtccccacccaaa

SEQ ID NO: 24574 - DNA, 421 bp, Homo sapiens
tttttgagacagggtcttctctgttgcccaggctggagtgcattggcatgatcacggctcactgcagcctagaactcctgggctcatgcgattctctcacctcagcctccccagtagctgagaccacagacacacactaccacacctggctaattgttttatttttttattttctgtaaagacagggtattcttatggtgcgcaggccggtctcaaactcctgggcgatcctccagcatcagcctcccaaagtgctgggattacaggtgtgagcaaccatgcctggcccaaaggaacacttatagctttaaggtaatttattagaatacaaaaagactgaaaataaataaattaagaaatcaactgaagaaggtaaatagcaatgtacattatagcaaggaatttacagttcctccatatc

SEQ ID NO: 24575 - DNA, 222 bp, Homo sapiens
gagacagagcctcattctattgcccaggctggagtgcagtggcacaattgtagctgccaccttgaactcctgggatcaagtgattctcccctcagcttcctgagtagctaagactacaggggcataccatcatgcccagctaattattaaattttgtgtgtgtgtgtgtgtgggtggggtgaaaccccataatgaattatgttccccaggctgttcttgaac

SEQ ID NO: 24576 - DNA, 460 bp, Homo sapiens
gaacaatatcttaaacacttaaatatgatttagggagccaggcatagtggtatgttcgtgtagtcccagctactgaggaggctgaggtgggaggatcccttgagcctaggagttcgaggcaagcctgggcaacatggcaagaactcatcttaaaataaccttaaaaaaaagtttggcctatagagttacctactcagttcactttaaagaaccagcatgttgagtcttatgttaaacacatcttataaaacagtgggcctattttgtatctagttgtcacattttacttaactttttttctctgtctcataaagacatgcttttattctatttatttctgtttattaagttttctcaacagtcattgaatgccagctatgggcactttattgcaaagggatgactaaagttgtggcaaaggtcaaagacaatttctttttcagttagtatcactagggct

SEQ ID NO: 24577 - DNA, 399 bp, Homo sapiens
acattagaatggacatttcaggtgaggccaggcctgtaaaagaggctaaccggacaggcatgttagagaggatgggattaatagggcttgcttggcaagaggagactgtatccactagggcacagtagtagcctaaagtaatgaaaatatagggatcgcctggtgcgatggctcatgcctttactcccagtactttgggaggctgagacaggcggatcacaagatcaggagttcaagaccagcctgaccaacatggtgaaaccccgtctctactaaaaatacaaaaattaggcgtggtggggcgcgtctgtaatcccggctactcaggaggctgaggcaggagaatcgcttgaacctgggaggcagaggtagcagtgagccaagatcacgccactgcac

SEQ ID NO: 24578 - DNA, 119 bp, Homo sapiens
tgaataaccttcctggtattacttgctagattttttgtttgggttgtatttattagggtatcctcatgtacgtacagtgcttttccccactcacgggtcagccaactctacagcaagtc

SEQ ID NO: 24579 - DNA, 544 bp, Homo sapiens
tcccaccagtgccagccgaagcccagtccttcaggacaccaaagtctggcccttcctctctggcgataccaggagctcaggatagagaagaggaaacaggaggaggaggccagaatggcacagaagtaggggaagatgggataggacaggctgggaacaggtaatcaggcccctcccagggcttctttcccctctggaagcgtccggcctccccatccacctctgcctaagtaaatctgctctcaacctatatatatacaaggtcattcattctagcattgtttgcaagagtgaaagagtggaaacacccgaagtgtccatcagtaagggacaggctagattgattacggatgtaattgctgtccatccatacagagcatactctacagtgtattctaaaataagactaaggaagctgtttatattctgatatgaaactaccatcaagatgtataaagtaaaaataactaaggagtggaacagtgtatatggcatattattatttgtcgaagtaaaattttcacgaagataaacatgactaaga

SEQ ID NO: 24580 - DNA, 373 bp, Homo sapiens
ttttcttgtttagagttccttatcgattctgaatattagtcgttttgtcagatgcataattgcaaattttttctcccacttcataggttgttaattctgattactatttcttttactgtgcggaagctttttagtttaattaggttccatttatttatttttgtttttgttccatttgtttttgtggtcttagtcataaattatttgcctaggccaacatccagaagtgcttttcctaggtttttctttctagaatttttatgttctagaagttttcaggtctttaagtctttcatccatcttgagttaactttttcaatacagtgagagacaaggatccagtttcattattcttcgtgtagctatccaattt

SEQ ID NO: 24581 - DNA, 1245 bp, Homo sapiens
aagaaaattatttatttgaccatagaatccttttccgaggctgtttattatcttacagagtatcttagggtaatttggaaccaaacctttttttttcttcttttttgtattgagacttttttgagttaggggactacttaccaactaacattagcagtttttgttgaggacaagtttcattaaggggaatatataggggaaagtttgctagtacaatggaatgtacacttggctttctatctgcaggtttcacatctgcagattgaactactgtggattgaaaatattcaggcagaaaaataaataacagtacaacaataaaaagtaatacgaaatttaaaaagacggtataactgaggtaggagttgggctaatccccagttttggggctcacttgtcctgtatcctaacaactatttacatagtatttacattatattagccattgtaagtaatctagagatgatttaaagtatatggaaggatgtgtgtaaattgtatgtgaatacaaacattttatataagggacttgagtatctgtggatcttgatggggtagggggtgtcctgaaaccaatcccccttggatactgagggatgactatacacttaagccaccagacatcttgcatatcatagacaattgtttggggtccatgagctttaattacaaaatgtaatgctgggagaacatagagaagagtgattttgttttttaaatgtagacttgattctgtagaaatatactacatttgataaatatactaagtatatagattatttcatccaatatattagtaatttagatagtggatagccactttcctatctttctcttatccatatgaatgtaatggatatgttgttacaacttatgattttctaaactagctgtgatttataatgacatcctgagaaaagtcagtgaaactcatttctaacgaataccagatttcttaaaatagtcaagtatttttcttttgtgtatgatgagatattaacttggtgttatttcatttttttttttaaggagtcattctaccctgttctatctttacttatgtgaaaatgtttaaactatgagtttttttcatgtgccttcttttggagtaatgtcaacttttaaatacacatgtttaaataacttagagtgtaataaattgtgtttaatatatactgtagataatgatggttaaatgctttgttaacacatgttcttttaaatacaagatactactttgtaaga

SEQ ID NO: 24582 - DNA, 103 bp, Homo sapiens
gtctgtgtcatcacacaccctccatacgttttgttaaagctggactgtgtcactcctttatgtgatctccctggctcttcaggcatttgggtttgtgctcttg

SEQ ID NO: 24583 - DNA, 482 bp, Homo sapiens
caaaaccaaaaacatgtaacaaaatatttatcaagaggaaaaaatggctttcagtgaaggaaaattagtttgtacgctgcttttaattttttaaaagactttaggacatcaattttctgtataaatatgttagtaaacttttttctgtatgcaaatatctatttttgtaatgtatctgttttactgaaagcaaatcgtattcactgcctttgttatgtttattcaaaaatataagataatattttaaattatccagctattttgaccagttgcttccttatccaaggtccatttctgtttctccctgcttataaggatcgtctgttacttcacctcatgaattatgtgttagcaggataatttaagtgaagggatcttgaggagccgcaacagacagtggaacatctgtcttcatacattttccatttagtgcctaaaaagggttgctgccctttccatttttctggagaccattgtgggga

SEQ ID NO: 24584 - DNA, 760 bp, Homo sapiens
gagggaaaggggaagtttgggaggaaggcttctgagaagactggtgggagagaaggagagcctgcagacagaggcctccagcttggtctgtctccccacctctaccagcatctgctgagctatgagccaaaccagggatttacagggaggaaaagctttcggactgctgaaggcccagcaggaagagaggctggatgagatcaacaagcaattcctagacgatcccaaatatagcagtgatgaggatctgccctccaaactggaaggcttcaaagagaaatacatggagtttgaccttaatggaaatggcgatattgatatcatgtccctgaaacgaatgctggagaaacttggagtccccaagactcacctagagctaaagaaattaattggagaggtgtccagtggctccggggagacgttcagctaccctgactttctcaggatgatgctgggcaagagatctgccatcctaaaaatgatcctgatgtatgaggaaaaagcgagagaaaaggaaaagccaacaggccccccagccaagaaagctatctctgagttgccctgatttgaagggaaaagggatgatgggattgaaggggcttctaatgacccagatatggaaacagaagacaaaattgtaagccagagtcaacaaattaaataaattaccccctcctccagaaaaaaaaaacaccttcctccacaaatgttatatagtcatttatttttaacaacaaataattgctcctggataaaataa

SEQ ID NO: 24585 - DNA, 734 bp, Homo sapiens
gagggaaaggggaagtttgggaggaaggcttctgagaagactggtgggagagaaggagagcctgcagacagaggcctccagcttggtctgtctccccacctctaccagcatctgctgagctatgagccaaaccagggatttacagggaggaaaagctttcggactgctgaaggcccagcaggaagagaggctggatgagatcaacaagcaattcctagacgatcccaaatatagcagtgatgaggatctgccctccaaactggaaggcttcaaagagaaatacatggagtttgaccttaatggaaatggcgatattgatatcatgtccctgaaacgaatgctggagaaacttggagtccccaagactcacctagagctaaagaaattaattggagaggtgtccagtggctccggggagacgttcagctaccctgactttctcaggatgatgctgggcaagagatctgccatcctaaaaatgatcctgatgtatgaggaaaaagcgagagaaaaggaaaagccaacaggccccccagccaagaaagctatctctgagttgccctgatttgaagggaaaagggatgatgggattgaaggggcttctaatgacccagatatggaaacagaagacaaaattgtaagccagagtcaacaaattaaataaattaccccctcctccagattcaaaaaaagacttttctgtattgttggtgctggtttgcttctttatatag

SEQ ID NO: 24586 - DNA, 628 bp, Homo sapiens
gagggaaaggggaagtttgggaggaaggcttctgagaagactggtgggagagaaggagagcctgcagacagaggcctccagcttggtctgtctccccacctctaccagcatctgctgagctatgagccaaaccagggatttacagggaggaaaagctttcggactgctgaaggcccagcaggaagagaggctggatgagatcaacaagcaattcctagacgatcccaaatatagcagtgatgaggatctgccctccaaactggaaggcttcaaagagaaatacatggagtttgaccttaatggaaatggcgatattgatatcatgtccctgaaacgaatgctggagaaacttggagtccccaagactcacctagagctaaagaaattaattggagaggtgtccagtggctccggggagacgttcagctaccctgactttctcaggatgatgctgggcaagagatctgccatcctaaaaatgatcctgatgtatgaggaaaaagcgagagaaaaggaaaagccaacaggccccccagccaagaaagctatctctgagttgccctgatttgaagggaacaaaattgtaagccagagtcaacaaattaaataaattaccccctcctccaga

SEQ ID NO: 24587 - DNA, 513 bp, Homo sapiens
gagggaaaggggaagtttgggaggaaggcttctgagaagactggtgggagagaaggagagcctgcagacagaggcctccagcttggtctgtctccccacctctaccagcatctgctgagctatgagccaaaccagggatttacagggaggaaaagctttcggactgctgaaggcccagcaggaagagaggctggatgagatcaacaagcaattcctagacgatcccaaatatagcagtgatgaggatctgccctccaaactggaaggcttcaaagagaaatacatggagtttgaccttaatggaaatggcgatattgatatcatgtccctgaaacgaatgctggagaaacttggagtccccaagactcacctagagctaaagaaattaattggagaggtgtccagtggctccggggagacgttcagctaccctgactttctcaggatgatgctgggcaagagatctgccatcctaaaaataacctctatttatgagaaaaaccagaaggaaat

SEQ ID NO: 24588 - DNA, 732 bp, Homo sapiens
  misc_feature (624)..(625): n is a, c, g, or t
  misc_feature (628)..(628): n is a, c, g, or t
  misc_feature (633)..(633): n is a, c, g, or t
gagggaaaggggaagtttgggaggaaggcttctgagaagactggtgggagagaaggagagcctgcagacagaggcctccagcttggaggaaaagctttcggactgctgaaggcccagcaggaagagaggctggatgagatcaacaagcaattcctagacgatcccaaatatagcagtgatgaggatctgccctccaaactggaaggcttcaaagagaaatacatggagtttgaccttaatggaaatggcgatattgatatcatgtccctgaaacgaatgctggagaaacttggagtccccaagactcacctagagctaaagaaattaattggagaggtgtccagtggctccggggagacgttcagctaccctgactttctcaggatgatgctgggcaagagatctgccatcctaaaaatgatcctgatgtatgaggaaaaagcgagagaaaaggaaaagccaacaggccccccagccaagaaagctatctctgagttgccctgatttgaagggaaaagggatgatgggattgaaggggcttctaatgacccagatatggaaacagaagacaaaattgtaagccagagtcaacaaattaaataaattaccccctcctccagaaannaanaaaanaaagcttgcgcgcccgatttagagctcacttggccaaattggattaaggagagtatacttggggccccctgcgcgccaaattactattaaatatagaag

SEQ ID NO: 24589 - DNA, 1511 bp, Homo sapiens
gagggaaaggggaagtttgggaggaaggcttctgagaagactggtgggagagaaggagagcctgcagacagaggcctccagcttggaggaaaagctttcggactgctgaaggcccagcaggaagagaggctggatgagatcaacaagcaattcctagacgatcccaaatatagcagtgatgaggatctgccctccaaactggaaggcttcaaaggtgagggggaaactgtaggcggtggagacagggctgggggtaggagggttaggatttccacaagaacaaggcaggaacagcagagataaaaagtttacttttgtggtagcaaaaggggaacctgcctttattgccctcctgccacactgcggtccctttcccgggcctgcctctctcagcatcccctctagctccttacaacctagcggggccctcaactcccaaccccacttcctctgcctgcccctcctcctccttccacgttgtctcctccacctagcagttggttggcaaccccttcctcaagaaatacatggagtttgaccttaatggaaatggcgatattggtgagaaacgggtgatttgcgggggcagggtggtgtgcaggcctaagaagacagaggtctctcctacatgctccattcctcatgatttgggagggggcccacctaccacagtgggaggaaggagaatggggatgcggaagtgggagaggagagagagggtctccccaccttctccccatccccatcctctgcccccagatatcatgtccctgaaacgaatgctggagaaacttggagtccccaagactcacctagagctaaagaaattaattggagaggtgtccagtggctccggggagacgttcagctaccctgactttctcaggatgatgctgggcaagagatctgccatcctaaaaatgtgagtgtcaatttccaacctcccctgtacttacctgttttctcctcccccatccctacccttgtccacaggctcaacatttctacacgttgcccatcatcccttcttccatccttagagggacccttccaaggtcccgaccccatccctatccatagtcctggtccccagaaactccaacccctgcccttcctcttcccccttccaccctcacatccccatccccttctagcctttcctagcaccctatgatttattcccttgagaggagtgttccctgatccctgtgcctcttcccatctcaaccaggatcctgatgtatgaggaaaaagcgagagaaaaggaaaagccaacaggccccccagccaagaaagctatctctgagttgccctgatttgaagggaaaagggatgatgggattgaaggggcttctaatgacccagatatggaaacagaagacaaaattgtaagccagagtcaacaaattaaataaattaccccctcctccagaaaaaaaaaacaccttcctccacaaatgttatatagtcatttatttttaacaacaaataattgctcctggataaaataa

SEQ ID NO: 24590 - DNA, 682 bp, Homo sapiens
gagggaaaggggaagtttgggaggaaggcttctgagaagactggtgggagagaaggagagcctgcagacagaggcctccagcttggtctgtctccccacctctaccagcatctgctgagctatgagccaaaccagggatttacagggaggaaaagctttcggactgctgaaggcccagcaggaagagaggctggatgagatcaacaagcaattcctagacgatcccaaatatagcagtgatgaggatctgccctccaaactggaaggcttcaaagagaaatacatggagtttgaccttaatggaaatggcgatattgatatcatgtccctgaaacgaatgctggagaaacttggagtccccaagactcacctagagctaaagaaattaattggagaggtgtccagtggctccggggagacgttcagctaccctgactttctcaggatgatgctgggcaagagatctgccatcctaaaaatgatcctgatgtatgaggaaaaagcgagagaaaaggaaaagccaacaggccccccagccaagaaagctatctctgagttgccctgatttgaagggaaaagggatgatgggattgaaggggcttctaatgacccagatatggaaacagaagacaaaattgtaagccagagtcaacaaattaaataaattaccccctcctccaga

SEQ ID NO: 24591 - DNA, 751 bp, Homo sapiens
gagggaaaggggaagtttgggaggaaggcttctgagaagactggtgggagagaaggagagcctgcagacagaggcctccagcttggtctgtctccccacctctaccagcatctgctgagctatgagccaaaccagggatttacagggaggaaaagctttcggactgctgaaggcccagcaggaagagaggctggatgagatcaacaagcaattcctagacgatcccaaatatagcagtgatgaggatctgccctccaaactggaaggcttcaaagagaaatacatggagtttgaccttaatggaaatggcgatattgatatcatgtccctgaaacgaatgctggagaaacttggagtccccaagactcacctagagctaaagaaattaattggagaggtgtccagtggctccggggagacgttcagctaccctgactttctcaggatgatgctgggcaagagatctgccatcctaaaaatgatcctgatgtatgaggaaaaagcgagagaaaaggaaaagccaacaggccccccagccaagaaagctatctctgagttgccctgatttgaagggaaaagggatgatgggattgaaggggcttctaatgacccagatatggaaacagaagacaaaattgtaagccagagtcaacaaattaaataaattaccccctcctccagaaaaataaaagaactcacaaacaatgcggcccgtattttgagcttactttgccaattcgccttatgtgag

SEQ ID NO: 24592 - DNA, 760 bp, Homo sapiens
  misc_feature (698)..(699): n is a, c, g, or t
gagggaaaggggaagtttgggaggaaggcttctgagaagactggtgggagagaaggagagcctgcagacagaggcctccagcttggtctgtctccccacctctaccagcatctgctgagctatgagccaaaccagggatttacagggaggaaaagctttcggactgctgaaggcccagcaggaagagaggctggatgagatcaacaagcaattcctagacgatcccaaatatagcagtgatgaggatctgccctccaaactggaaggcttcaaagagaaatacatggagtttgaccttaatggaaatggcgatattgatatcatgtccctgaaacgaatgctggagaaacttggagtccccaagactcacctagagctaaagaaattaattggagaggtgtccagtggctccggggagacgttcagctaccctgactttctcaggatgatgctgggcaagagatctgccatcctaaaaatgatcctgatgtatgaggaaaaagcgagagaaaaggaaaagccaacaggccccccagccaagaaagctatctctgagttgccctgatttgaagggaaaagggatgatgggattgaaggggcttctaatgacccagatatggaaacagaagacaaaattgtaagccagagtcaacaaattaaataaattaccccctcctccagacagaaaaaaaaaaaannctttttcacacccgctcataataaattctcctttcattttaaccaaaaaataatcttaggg

SEQ ID NO: 24593 - DNA, 621 bp, Homo sapiens
gagggaaaggggaagtttgggaggaaggcttctgagaagactggtgggagagaaggagagcctgcagacagaggcctccagcttggaggaaaagctttcggactgctgaaggcccagcaggaagagaggctggatgagatcaacaagcaattcctagacgatcccaaatatagcagtgatgaggatctgccctccaaactggaaggcttcaaagagaaatacatggagtttgaccttaatggaaatggcgatattgatatcatgtccctgaaacgaatgctggagaaacttggagtccccaagactcacctagagctaaagaaattaattggagaggtgtccagtggctccggggagacgttcagctaccctgactttctcaggatgatgctgggcaagagatctgccatcctaaaaatgatcctgatgtatgaggaaaaagcgagagaaaaggaaaagccaacaggccccccagccaagaaagctatctctgagttgccctgatttgaagggaaaagggatgatgggattgaaggggcttctaatgacccagatatggaaacagaagacaaaattgtaagccagagtcaacaaattaaataaattaccccctcctccaga

SEQ ID NO: 24594 - DNA, 514 bp, Homo sapiens
  misc_feature (16)..(16): n is a, c, g, or t
  misc_feature (43)..(43): n is a, c, g, or t
aattcgcggccgcgtncgacacggctgcgagaagacgacacanggggaggtccccggctgaaaaccctccagtcagcgcttatcccttctgctctctcccctcacccagaaatacatggagtttgaccttaatggaaatggcgatattgatatcatgtccctgaaacgaatgctggagaaacttggagtccccaagactcacctagagctaaagaaattaattggagaggtgtccagtggctccggggagacgttcagctaccctgactttctcaggatgatgctgggcaagagatctgccatcctaaaaatgatcctgatgtatgaggaaaaagcgagagaaaaggaaaagccaacaggccccccagccaagaaagctatctctgagttgccctgatttgaagggaaaagggatgatgggattgaaggggcttctaatgacccagatatggaaacagaagacaaaattgtaagccagagtcaacaaattaaataaattaccccctcctccaga

SEQ ID NO: 24595 - DNA, 984 bp, Homo sapiens
gagggaaaggggaagtttgggaggaaggcttctgagaagactggtgggagagaaggagagcctgcagacagaggcctccagcttggaggaaaagctttcggactgctgaaggcccagcaggaagagaggctggatgagatcaacaagcaattcctagacgatcccaaatatagcagtgatgaggatctgccctccaaactggaaggcttcaaaggtgagggggaaactgtaggcggtggagacagggctgggggtaggagggttaggatttccacaagaacaaggcaggaacagcagagataaaaagtttacttttgtggtagcaaaaggggaacctgcctttattgccctcctgccacactgcggtccctttcccgggcctgcctctctcagcatcccctctagctccttacaacctagcggggccctcaactcccaaccccacttcctctgcctgcccctcctcctccttccacgttgtctcctccacctagcagttggttggcaaccccttcctcagtccccggctgaaaaccctccagtcagcgcttatcccttctgctctctcccctcacccagaaatacatggagtttgaccttaatggaaatggcgatattgatatcatgtccctgaaacgaatgctggagaaacttggagtccccaagactcacctagagctaaagaaattaattggagaggtgtccagtggctccggggagacgttcagctaccctgactttctcaggatgatgctgggcaagagatctgccatcctaaaaatgatcctgatgtatgaggaaaaagcgagagaaaaggaaaagccaacaggccccccagccaagaaagctatctctgagttgccctgatttgaagggaaaagggatgatgggattgaaggggcttctaatgacccagatatggaaacagaagacaaaattgtaagccagagtcaacaaattaaataaattaccccctcctccaga

SEQ ID NO: 24596 - DNA, 891 bp, Homo sapiens
gatatatgtgtgaaggatcaatgaaatcaatgaatgatagcatctaaacatacttcctcctgggttatcttaacaggtatatgggaaaccaggtggagatagggggaagaaaaacaatcaaagaacctcagatagcttcaaacatttctatgtaatgtaggcccaaccaataatacacattaatatacaattaatgtgcatcccagtcacctataggaaaacttgttaaaatgcagattctgactccgtagttctgatggggggcacctaagattccccatttctaacaagctcccaagaagaggctttacagtccaacagagcaggatttgcacctgattcaataataattatgtgacaagttatctttgaaactgtttccatatgagtaaaatggtgataataatacatgtgttacataatcagtatgataattatataatacagcatatgtaaagcaattagcatattgtaggcactcagtataagttctgctttcccacccagaagaaaactactagagttttaaaaaagatttatcaaaataacaaaattccatttcatgttgggtggaaaagttactcatgagattggaaaaatgcctacttttgcctaacatttttattatcattaccttactctttgaattaataatggtcagatgcacttttgaaaagcaacaatattgagggacagaatatattttaaaaagaaaaatgatcacttttaatttggtctaaaatagttacctcaaaatgaaataggtaaagaatgactgattattaaattgtcaatttttttaaaaaaagcagcccttcatttgatatgttaatatatagtgttatcggctcacgacaataaatttacttggccaaatggttttcatttgag

SEQ ID NO: 24597 - DNA, 307 bp, Homo sapiens
gttgagagtatacaccttgtgaggtctgtcagggcaagatgtcagcaggtggaggggctgtgaatgcctttgtgttaaggtttgagcactgtgcaggtggaactgtgagggcgtggagatgagtgtgagtgtgcagatatgtcaatgtctataaggctggtctgtatattcactcactcaccaatgcaacaaacatctatggaacagaatttaccagacacacagtccctgccctcctgggctcacattcacaggtgacaacaagcaaacaggaggatccagaattctcgagtagtagtagtagccc

SEQ ID NO: 24598 - DNA, 472 bp, Homo sapiens
tatactaggtaaaatatcattttacaccttactagcatattgatgattgataatgcagcttatactgctcagaacaaaattaccctttcccccctctcctaccctaactcaagttcatgtcatattgatctttatgttggaatcacatcacatgacattatgtacattttatgtcttcatggaattagggagaaaaggctttgggaccatgaggaaactcagtgaatttgaaatatactgataggctcactctcataaaccacatattgatgccacatatggatatattgtcactcaggtcagtgtgagaatatgatcctttcagtgatgttatagctcacaatcctttttaaaggactataccaaaacattaacagctgtcactactagtattgtacagtttcctacaggatcctgaaatccatcttcagtatttttatcagcttcacacacagcatatatgtataaatgt

SEQ ID NO: 24599 - DNA, 418 bp, Homo sapiens
ctttcttaaagagataaaggtatggaacaagaatcacagatgggctatgaacctcctgaaattgtagttcgaattatgtgtttgtgtgaatgatgcttactgtttctgattttatttgattgttgtataatgaaaatgatgttggctaatgatatagaaattaggagaagaaatattgaaaacacacacacagtattttattcatttgtccagaggacatgaaaatttaaaatggatgcatgaaagatattgattatttaattatatgttgtgtcacattatatgattgttaaaggcaatctaataaaaaaggtagagagggttaaatattaatttaaaaggctgtcacattttgaattatcttaatagaaaggtcttttgtgcaaaatgagaggcagacattattgcagaaaatgcc

SEQ ID NO: 24600 - DNA, 1311 bp, Homo sapiens
  misc_feature (700)..(700): n is a, c, g, or t
cctggctcctcccaggtcaagctgggaacacgaaagaaggaagccagcagagggcaagtacagacaggttcattgcagagcgtagccttggggttcagcccctcaacctgaggctgaggatctcttggagcttggggagcgtccttggggaccacattcagtagatggaaccacagggccgtaagggtgcgtccatgtgcattgcctggaaggtgaagcttgtagaaagcaaaggtttgtagaaggcgaaggtttgtagaaggcgaaggtttatagaaggtgaaggtttatagtagcctacagcgacttcatttccactctctctcttctagccatgtgttgaaatcagttattcgttgggaatgactaggctgtggatggctttcagtgtgcatatctggactccctctccctgagttccaaacctggctctgctcctttggagcttctgctatgtggcagatcgcctccctgtgcctcagtttccccatgtgtcaaacggggatgacggggtttcaagaatcagagtccacatcagatgcttgcctggcacacgggaatgtgtgagctgggcctgccctggcagcgacagagagctggtgaccaccagaaaccctggccctgggacggcttttgtctcttttttgttgggcaaatgggctcccagccgggcttgggcctccaccgccgggaaggcggnactgcgctcgggtactgggctccggcctcccgaagtccttggtaagccttgcctgtagcggctccgctgccgagtgctttgacaccaggcgctcccagagctctgcccccactgccaagcggcagctgctccggagggcacggggggctggatttggctgtggcttctccagctctgcacaagagccccccttccctggccctgctgcagcatgactgcctcctggctcgtgtcacccactctgtctctgtctctcttcatacgtttccagctgagctgggatccatagtctgtttccctctccacgaccaatctatttatcttctctggaacttcttgtaatgccgggagtgcagagcttacaagttggggcaggaagctttagaagcccaggcagccctgagaggctctttccttgtaagtgggtctctccccaggagcctcttggaatatttagcagggacttttacccatgctgggtctagagaccctcccgcccctctgtttcctgccctcctacttagactgggatctggtttccctcagctggttcccttgctagcgtgtgactctgtgtgtctgtctgtgactggtttagatttgtatgaaat

SEQ ID NO: 24601 - DNA, 775 bp, Homo sapiens
gtaactccggaaggtacatatttaagattcatgagggtctttcacagtactttttttctccatctgagaacttgtctgctttcgttttgaaaaacttttaatacagccagccccctatattcatgggttccacttctatacatccaatcaaccacagattgaaaatgttctggggaaagaaattccatcaagttccaaaacttgagtttgccaggtgccaagtacttcgttgaatccacaggaatgaagtgatgtgtattagatattataagtaatctagagatgatttaaagcatattggaaaatgtgcataggttatatgcaaatactacaccattttatgttaagagacttgggcatccccaggttttgttatctgatggaggtcctggaaccagtcccccacagataccgagggactactgtaatataagaggccacttagttctttttctgagtttcacttccttggtggtactgcatgtgattttctttaaaaagcaccctagacacttccttttctgttctgcctcttctgctttttgatttttctgctaatgaacttagtattaccctgaggtctttctccaacattctgacatacatatttaaactctagtacttatttttatttcttgtaggctcatttccttcatctgcaaaatgattaagttaaactagcaagtctgcaaaattcttttcagttcctagatcctatccaaaaggtttagctgttagcctgggcaacagagcgagactctgtcaaaaaaaaaaa

SEQ ID NO: 24602 - DNA, 382 bp, Homo sapiens
aagtagatgggccagcaagggtggagtgaactggtaccagttactggggcccagtgtactggattgagggatggccagtgagttgtgttcatatatgtaccagtccaatgccaatgtaaagaatttctgccattctaccattgcagagtgggcctgaaaaatgttttcagcaatgttcaaatttcttcccactacctgcaaacatgaatttggggatttcagctaacttcttactacctgtagcatatgggatttggagtagggtataattaaaattgatgggtaactctaatctccttttagccttattagccatataaaccctctgacagctacttaaacaaagaaactaggagtcttcttatctctctcttttcttctt

SEQ ID NO: 24603 - DNA, 478 bp, Homo sapiens
ctgtttttttatggtgtctcaacaccccatgcacttgccacctacttgagaaaactactagaccttaaaagtgagagttttaaacaaatgaatgtttgttttgttttacatttaccgtgggaaattttaaatatatacagaaatagagtatcatagcaagcctgcattcatctgtcacccagctccaaaaattataaactcatagctaatcttgtttcacttttactcccacttctttccctccccactccactggatcattttgaagcaaattccaaatgtcacgtcgtttcattagcttctatttctaaataaggtgtctcttaaacataaccagaatacccccttttgaaaaggaaggctgggtgaggtgactcattcctctaatcccagcactttaggaagccaaggcaggatgatcgcttgaggccaggagttcaaggccagactgagcagcatagtgagatccagtcttaaa

SEQ ID NO: 24604 - DNA, 601 bp, Homo sapiens
cccctctctggacctaagtgtcttaatctctcttaaacaggaggttgcaacactggcctccctgattccaccttcaacaggatgggactctatggcttcgaatgtaacccacatcagtcttgctcctaaagaatctgcccttccacaaatcaccaacccctatcccgccccatgtcaccccctgtgctccttcccaggtgctgacctgacagcagtggaccctgttcggggcaagacggccctggaatgggcagtgctgaccgacagcttcgacaccgtgtggaggattcggcagctgctgaggcggccccaagtggagcagcttagccagcactacaagcccgagtggccggccttgtccgggctcgtggcccaggcccaggcccaggcccaggttgccccttcactcctagaacggctgcaggctaccttgagcctcccctttgccccgtctcctcaggaggggggtgttctggaccaccttgtgactgccacaaccagcctggccagtcccttcgtcaccactgcctgccacactctgtgccctgaccatccaccttcgctgggcacccgaagcaagtccgtgccagagctgttaggt

SEQ ID NO: 24605 - DNA, 385 bp, Homo sapiens
ttttttttggttttgtttttttaagttcgcggctgggaagaggtgggagggaagtgctgaggcatggggaatagaataagggcagatgacagaaagatagaagcacaggaagtgtttggaaggaaaaacaagaaaggctgctgacgaaaaatactccagaaaaaaaaaacgaaaaaggtgatctttgccaagaaaaatgtgctaatcttatgcagctgaaagatagttaaagaaacattgtaagatttctgtcttcaactccttaattcttaatcctgaagcattcccaaaggaataaggagtattccatgacctatagctataagcaccacttctcataattgtgaacctctgttatgggcaaaaataaaatgccaggatagca

SEQ ID NO: 24606 - DNA, 353 bp, Homo sapiens
ttctacataaacacatatacatttttttacttggagactgtcacggtataaagaacactttttactaaaagtcacgaggccagagattcagccctagttttgctactaaatatctgactgttggcaagtggcttatgaaagtggaactattaatggggtgattgagcaaggaaagttttcaggtccctttcagctctgattttttctgtcttagtcaaagagttttagggttttatggcaatagatagagattttctacaaaatggcttcagtggtgaattgtagcaaacatttaaagaactaataccagtccttctcaaacttttccaaaaaaactgaagagaagtgagcac

SEQ ID NO: 24607 - DNA, 390 bp, Homo sapiens
ctttgtcgtgtgagccttgctctcctggggaggctcaggctgacggctgatgtgggcattgccgaaggtaacctgtggcccagtgtatatggccgggtctcctcaagctgcattcattcaagtaggacccagggtgcatgcccatctccagcccagggcagctcccctgtaagctgggtgagctactgaagccaaggcgggaggcagctgacaacacccacagcccatgcggaggtggtggaaaggctggactcagcagcaacaccaaatcctggaccaggcagaaaccacccaagactgaggggctcgtgccagagcggtggccacaggtaagaacccgggcccaggctgtgtggcaggaatcctccatgtcccagggcttagcatagc

SEQ ID NO: 24608 - DNA, 392 bp, Homo sapiens
aaccctatcagttgtagatgtctgatggaaatacaaaataagatattcagttctaacagtagcttaatctaataatttcatctttcatgatcattcacccatgatgcacaagccaaaacctaggaaacattactaattcttttccctttcatcatggacatctaattcagtaaaaagtcctatttgttttaacatgaaattatatcccaattcccaccattaaatagcgtgtgaatttcaaccatcctcatccaagcctcatcctctctcatttgaactaatgaccagatgatgaaacttaaaaacttaagtcagccaggcatggtggctcatgcctgtaatcttggcagtacaagaggtcaaggcaggaggatcccttaaagccttaaagc

SEQ ID NO: 24609 - DNA, 209 bp, Homo sapiens
ggcagccagagccaagggccctaagccggagaaggagaaaccagtactggacaatagcaggtgacagcagaggagaaaaagggggtagggaggggacaaggaaagacctgagggggtggcagtggacaaagagattgagcaaccacaggacaaggtaaccagaggaaacagagacaaggaaaaaagatgcaggaaatgaggaggcccca

SEQ ID NO: 24610 - DNA, 687 bp, Homo sapiens
gaccctcaatctagaacataagctcctctctcggtgtccacctgtagtgacctcaaattagaacgtcagctcctcccagagtcttcagctgcatgaccctcaatctttaacatcagctcctctccgggtctgcagctgcatgaccctaaaaatacacgaacagctcctccctgaatcttcagctgtacgaccctcaaactacaacatcagctcctgtctgcatctctagctgcagggccctcaaactagaatatcagctcctccccgagtcttcacctgcatgaccctcaaactagaacatcagctcctgtacagatttccaactgtagggccctcaaactagaacatcagctcctccccaagtcagcagctgcaagaccctcaaattagcaactcagctcctcccggagtcttcagctgcatgaccctcaatctcgaagatcagatactctccgggtcttcagctgtagggccctcaaactataacatcagctcctctccaagtattcagctgcacgaccctcaatctcgaacatcagctcctcttcaggtctgcagctgtagggccctcaatctagaacatcagctcctccctgagtcttctgctgcacgaccctcaaactagaatctcagctcctcccgagtcttcagctgcacgaccctcaaactagaacctcagctcctccc

SEQ ID NO: 24611 - DNA, 784 bp, Homo sapiens
gcaggaccagctgggacaggtccttctgtgacacctgctgcatcaccaggctgggtgaacggacacaattgccagaactcacagaatagaagtatcagcaccgaaacctcacaggaaaaatgctcctctccaggtttgcagctgcaagaccatcaaactacaacatcagctcctctccagagtctgcagctgcaagaccctcaaactagaacatcagttcctccccgagtcttcatctgcatgaccctcaaactagaacatcagctcctctccgagtcttcagctgcacgaccctcaaactagaacatcagctcctctccaggtctgcagctgcaagaccctcaaactagaacatcagctcctctccaggtctgcagctgcaagaccctcaatctagaacatcagctcctctccaagtctgcagctgcacgaccctcaatctagaacatcagctcctctccaggtctgcagctgcaagaacctcaaactagaacattagctcctctccaggtctccagctgcacgaccctcaaactagaacatcagctcctctccaggtctgcagctccacgaccctcaatctagaacatcagctcctccccgggtcttcagctgcatgaccctcaatctagaacatcagctcctctcctgactctgcagctggaagatccactaactagaacatcagctcctgtctgggtctccagctccatgacccttaatcaagattatcagctcctccctgagtccccagctgaggaccatcgttggggatcctctaagt

SEQ ID NO: 24612 - DNA, 1459 bp, Homo sapiens
gcaggaccagctgggacaggtccttctgtgacacctgctgcatcaccaggctgggtgaacggacacaattgccagaactcacagaatagaagtatcagcaccgaaacctcacaggaaaaatgctcctctccaggtttgcagctgcaagaccatcaaactacaacatcagctcctctccagagtctgcagctgcaagaccctcaaactagaacatcagttcctccccgagtcttcatctgcatgaccctcaaactagaacatcagctcctctccgagtcttcagctgcacgaccctcaaactagaacatcagctcctctccaggtctgcagctgcaagaccctcaaactagaacatcagctcctctccaggtctgcagctgcaagaccctcaatctagaacatcagctcctctccaagtctgcagctgcacgaccctcaatctagaacatcagctcctctccaggtctgcagctgcaagaacctcaaactagaacattagctcctctccaggtctccagctgcacgaccctcaaactagaacatcagctcctctccaggtctgcagctccacgaccctcaatctagaacatcagctcctccccgggtcttcagctgcatgaccctcaatctagaacatcagctcctctcctgactctgcagctggaagatccactaactagaacatcagctcctgtctgggtctccagctccatgacccttaatcaagattatcagctcctccctgagtccccagctgaaagaccctcaacagcgaacaacatcagctcctcccaaagtcctcaactgcatgaccctcgaactacaacatcagctcctccccgagtcttcagctgcatgaccctctatctagaacatcagctcctctccaggtctgcagctgcacgaacctaaaattagaacatcagctcctctcttggtctgcagctggtaagatccactagctcgaacatcatctcctgcctgagtctccagctccatgaacctcagtcaagattgtcagctcctccctgagtctccagctgaaagaccctcaacacgaacaacatcagctcctcccgaagtcctcaactgcatgaccctcaaactacaacatcagctccaccccgagtcttcagctgcaggactctcaatctagaacatcagctcctctccaggtctgcagctgcacgaccctcagtctagaacatcagctcctccccaggtctgcagctgcacgaccctcaatctagaacatcagctcctctacaggtctgcagttgcaagaccctcaaactagaacatcagctcctctccggatctgcagctgctagacactcaaactagaacatcaacttctgtccaggtctccagttccgtgaccctaaatctagaacatcagctcctccgagtctccaactgaaagaccctcaacgcgaacaactaaagctcctccccaagt

SEQ ID NO: 24613 - DNA, 256 bp, Homo sapiens
ccccaaagttgggtgcatctacatttaggatagttaagtcttcttgttgaattgaaccctctatcgttatgcaatgcctttctttgttttattttactattaatgatttaaagtccttttttcttaaaagagaaacaattccaggtatggtggctcatgccagcactttcagactgaggcagtaggattgcctgagaccaggagtttgagaccagctgaggcaacataacaacactctgtttgtacagattctttt

SEQ ID NO: 24614 - DNA, 440 bp, Homo sapiens
ttttttttgggggtagcagcagtaacagtggtggccagaaaagcacctaaaactctgacaaagcggaatcctttcatctgtccaaagcatctgcaatctgaaaagtagaagaggggaatctccgttgccttttttctctcttcatcctgtcacctggcccaagagtacacccgccatggagggtgcgtaacaagcagggagactaaaggacccaatttctagctaaagggtcaggaaaatgaggggtcttgaaagctggagaatgtggacaggagagagcttgtgaaatagatcccataaagttgcacatgaatttgtaggttcacatgcatggacctgaccctaagcagtattccagtgaatgagaactgaactattaggcagaacacccaggtttcagactgctcactggggggcataagcttaggactgttctgatt

SEQ ID NO: 24615 - DNA, 559 bp, Homo sapiens
ctcctgagctcaaacagtctgcccaccttgaactctcaaagatgctgggattacaggtgtgagccatcacagctagctgccacttatccactttagctaggtctcagtatctctgagcctcaggttacctggacttagaatgaaggccttcctcagccacagaagtacatggacctggcccatgattgtcctttagaaactgagcagagtactgcatcaacgttaggagtaaaggcactgaaccagattgctggtgtaggcatcccagttaggtcaccagctcactacatggccttgagcaattcacaaatcatctgtgggccacatatccatcagctatatgggttaatggtagtacccactgacagagtgtagagacaactaatgaactaatctacaaaaaaaccaagaagagtaccttacagagtatgtgctcaggaagtgtgcgctgttgctgaagtcactaaggaagtcaggttttctgtgggtagagatagcagggtctaagatggcaagattggacatcagaatgagtgtgaatgaagtactatcttggata

SEQ ID NO: 24616 - DNA, 989 bp, Homo sapiens
ctaatattctatttttaaatatgggcattaatttcatttcagttcgttcactcattccattcatttatcatttcacaaacatttgaaatcctaatataagcaaggtgctctgtttaaggcagaaatttgaaaatgtacaagatatatggtcttgtctttaaggagctgttcatctagaatggaggaatttacactgataattattcctacacttgaaacaaagaaattaactctcaaattgcgtggcaagcatatatagactttgctataaatatttatgaaatgagttactgttttccttaaaaaagctaagactaagggctggcaatcaaataagagcaaatttagtggtgaacgtagaactgcccactaccagctagagtctccaacctaaaagtcccatgttgctagtgatccccaggggttttatagaaggaatccctgcattggcagtaattttggattagatgatccctaagagcaccatcaagtcttaggattctatgaattaggaaataaaccaaattatatattttctaatactgatcagctcatattttatcatcatgtcatgtctggctttcatacttagtcataatttactttctgggtcatttagaggctagcgttctctaaggtcacttctgcttgcacattgtaggatattatttagtatggctttaagaattcaatctttccccctctcctttatggaatgtgtgtttcctctatttgtacacttaaccttttgtcctaagtttttatttttatggatactaatgagtaactttgaggttgacactagacccaaacagatgcaaacagccactttctgtcctcttgtgacacagttgaaacactttatctcttgtctgctgtttggagtgtcctgaaagaaacactgaagtggcagtcaacagagcaagggtaacaggatctttaaataatttaaagttgtctgatcttgacataaaagtgaaccctttctt

SEQ ID NO: 24617 - DNA, 363 bp, Homo sapiens
cttggaaacataacagaaaatggggatataacctatatctctatcaataggtgaacacaattaatcaaagtgatcagccttagccaggtgcggtggctgaagcctgtaatcccagcactttgggaggctgaagcaggtggatcatttgaggtcaggagttcaagaccagcctggccaacatggtgaaaccctgtctctactaaaaatacaaaaattagccgggcgtggtggcgcacacttgtaatcccagctactggggaggctgaggcaggagaattgcttgagcctgggaggcagaggttgcggtcagccgagatcacgccactgcactccagtctgggtgacagagtgagaccctgtctc

SEQ ID NO: 24618 - DNA, 427 bp, Homo sapiens
tatttatcttgatctttacctgaatgagagacaggggtgaagaaatatggtggaaggatacagggtaagacagaactactggtagggcccataacccatctgtatctatgtttgagttatactaaaggaatgaagatgccatagttatttatgagatatttctaaatgcaatggtgacatactacatgatgtctagagcatgaggattcattctctgtctccctgagtgggtctaaccttcatggctgagatcatcttagtcagcctgcctgttttgcacacatgctcctctgtgctgtgtcgggcatttcctccttagtgtgaaggtgcctccctgggcaatgtgccagggacacagtaatgttggttgtttgagttagcacaaactgtttgtgcttgtgtttgacaaacacacagaagataagag

SEQ ID NO: 24619 - DNA, 245 bp, Homo sapiens
ccacccatccatctattcatctaccacctgcctacctatccatccatctacccactcactcatccatctatccatccattacccacccatccttccacccacctattcacccatctacccattcacccatccacccatctatccacccgcccattcattcacccatccactcatccagacatccatctgtccacccattcatccatccatccattcatccatccactcacctacccatccactca

SEQ ID NO: 24620 - DNA, 908 bp, Homo sapiens
tgctggcctctcctgttctctgtctcctcacttccctctgtggctctgctcagaactggcggtttttcccagctccttgcccagaccaatacttccatgctgtcttcaagccctgcttcctgcacatctcccagcccagatggggagaacccatgtaagaaggtccactgggcttctgggaggagaaggacatcatccacagactcagagtccaagtcccacccggactcctccaagatacccaggtcccggagacccagccgcctgacagtgaagtatgaccggggccagctccagcgctggctggagatggagcaatgggtggatgctcaagttcaggagctcttccagagtcttgctctgtcacccaggctggagtgcagtggtgtgatccattctctgcaacttctgcctcccgggttcaatcgattctcctgcctcagctcctggagtagctgggattacgggatcaagcaaccccttctgagcctgagattgacctggaagctctcatggatctatccacagaggagcagaagactcagctggaggccattcttgggaactgcccccgccccacagaggcttttatctctgagctgctcagtcaactcaagaaactccggagactcagccggcctcagaaataagcctgagagaccatctttagcagcctcagcactgccaggcctgccctgaaactccagatcctggctaagagggaaatagctccttgggacacaaacaagaaatgtggacaaggagggacatttgcatactcctactgtctgtgtggtcacagctagtttctgtcagctgggctctctgggagaaagctggctgttgtccaatgccttccttggcagccaagtggataaaacctttaggagccccagctcaatggagtg

SEQ ID NO: 24621 - DNA, 478 bp, Homo sapiens
tagtatatgtttagtaaattactgttgaatggaaaactgaatgggtgttctgagtgaggagaaagtctaaccatgggaaattggagagaggtgggttgagtccctgacagtaaccttcattccagcaccagctggtcaggcccctctgagacccatgtgatttccaaataggatcaagcaaccccttctgagcctgagattgacctggaagctctcatggatctatccacagaggagcagaagactcagctggaggtaggatgggggctagaagctggccttgggtcagtgggaacccagaaacccaggttctgcctcctttggtggagtgcagagaaccaatccagaggggagaattcttgggagattggtggggacttgcgggaaagtgctgtgacttggggccctgtctgtgttctctcctatctaggccattcttgggaactgcccccgccccacagaggtaagggatgttctt

SEQ ID NO: 24622 - DNA, 792 bp, Homo sapiens
tgctggcctctcctgttctctgtctcctcacttccctctgtggctctgctcagaactggcggtttttcccagctccttgcccagaccaatacttccatgctgtcttcaagccctgcttcctgcacatctcccagcccagatggggagaacccatgtaagaaggtccactgggcttctgggaggagaaggacatcatccacagactcagagtccaagtcccacccggactcctccaagatacccaggtcccggagacccagccgcctgacagtgaagtatgaccggggccagctccagcgctggctggagatggagcaatgggtggatgctcaagttcaggagctcttccaggatcaagcaaccccttctgagcctgagattgacctggaagctctcatggatctatccacagaggagcagaagactcagctggaggccattcttgggaactgcccccgccccacagaggcttttatctctgagctgctcagtcaactcaagaaactccggagactcagccggcctcagaaataagcctgagagaccatctttagcagcctcagcactgccaggcctgccctgaaactccagatcctggctaagagggaaatagctccttgggacacaaacaagaaatgtggacaaggagggacatttgcatactcctactgtctgtgtggtcacagctagtttctgtcagctgggctctctgggagaaagctggctgttgtccaatgccttccttggcagccaagtggataaaacctttaggagccccagctcaatggagtg

SEQ ID NO: 24623 - DNA, 454 bp, Homo sapiens
ctggtgcgcagagcagacagtggagggttcagtgggcagtgctcttcaccccgggtctgaataatgcccggggcttgggaggcccctttggctgggcactttctcagggtggccatgctgagctgctgacccccaagccctcctctccagctccctttcatcatcaccgtgagtgttcatttaaactcagcaagacccatgccaacaaaaacaaagaaaatgatctcttagtggttatttatatggtaaacctcctctggggtgattttttttccagtccagcttgcaataatttcttaagaaagataaagtgatttttaagtgtaattttaaggagcaggcccatacgttagcttgcttgctgttattcttctgttcatgttgttcacaacatgaactttgatttgtcttctccaggtagtttgggaccacagagaaaaatcccccttctgtt

SEQ ID NO: 24624 - DNA, 653 bp, Homo sapiens
agaattgagatagacattgtatcagaagaaagcagttttgaacaaagagagcgaattactagccagttaacaagtgtcagctgttttataagcatggcataacacttcctaaattgtgcactgcattgttcagttaaaggaattggcgttctgtgactttttgacagttaaataatttgagaacttctgcattttgggcctgtgctcttggaaatccagaatgtacattaacttatttatgcctagtgttccattaatggaacgctaagcatctgggagttctttatatcctactgctcaaggtcatcgccaaggtctgatttttcaccctcaaaaaattgcaaccttagacataaatacaggagtcctatgagtcattaatatactaaacaaactttcttgtttaactctgctttttctaaacttacatgcttagtgatcattctttgcagggcgtgttttgagaaacatagtaatagcaagtagttaagtttctatctacctggtgttcacagtgggagtagtatagaggaagacccaagtttagcctttggaaaacctgagtttgtggtttttaatgcttttagtgaatcactatattggaaaagttaatttaagttcctcatgattgtttccttttgtaaaatatagta

SEQ ID NO: 24625 - DNA, 3493 bp, Homo sapiens
cagggcaaggcaatacagaagtgatccacacagggacattgcacagacaagcaagtcatcacattggagaattttgtttccatgaaattgagaaagacattcatggcttcgagtttcagtggaaagaagatgaaacaaatggccatgcagcacccatgacagaaatcaaagagttggctggtagtacaggccaacatgatcaaaggcatgctggaaacaagcgtattaaagatcagcttggatcaagctttcatttgcatctgcctgaaccgcacatatttcagtctgaagggaaaattggtaatcaagttgagaagtctatcaacaatgcttcctcagtttcaacatcccaaagaatttgttgtaggcccaaaacccatatttctaataagtatggaaataattccctccattcttcattactcacacaaaaatgggaagtacacatgagagaaaaatcttttgaatgtatacagagcttcaaatcctttaattgcagctcactcttaaaaaaacatcagataattcacttagaagagaaacaatgtaaatgtgatgtatgtggcaaggtctttaatcagaagcgataccttgcctgccatcgtagatgtcacactggtgagaaaccttacaagtgtaatgagtgtggcaagacctttggtcataattcatccctcttcattcacaaagcgcttcatactggagagaaaccttatgaatgtgaagaatgtgacaaagttttcagtcgcaaatcacaccttgaaagacataagaggattcatactggagagaaaccatacaaatgtaaggttcgtgatgaggctttcgcatataattcatatctggcaaaacatactatacttcacactggagagaaaccttacacatgtaatgaatgtggcaaagtttttaatcgactatcaacccttgcacgccatcatagacttcatactggagagaaaccttacaaatgtgaagagtgtgacaaagttttcagtcgcaaatcacaccttgaaagacataggaggattcatagtggagagaaaccttacaaatgtgaagaatgttgcaaagttttcagtcgcaaatcaaacctggaaagacacaggaggattcatactggagagaaaccatacaaatgtaaggtttgtgacaaggctttccagagggattcacacctggcacaacatcagagagttcatactggagagaaaccttacaagtgtaatgagtgtggcaagaccttcggtcagacatcatcgcttataatccatcgtaggcttcatactggagagaaaccttacaagtgtaatgagtgtggcaagaccttcagtcagatgtcatcccttgtataccatcataggcttcatagtggagagaagccttaatagtgtaatgagtgtggcaagaccttccatcacaattcaaccctgtaagtcataaggcaattcatactggagagaaaccttacaagcataatgaatgtggcaaggtttttaatcaaaaagcaacctttgcacatcaccatagacttcatactggagagaaaccttacaaatgggaggaatgtgacaaaagttttcagttgtaaatcaaaccttaaaacacataagaaaattcacattgaagagaaaccatacagaggtaaggtttgtgacaaggtttttgcatataatgcatatctggcaaaacatactagaattcacactggagagaaactcattataagtgtaatgagtgtggcaagaccgttggtcaaaattcacaccttgtaattaaaaggtcaaaattcacaccttgtaattcatagtggagagaaaccttacaagcacaatgaatgtgacatggtttttaatcaacaatcacaccttgcaagtcatcatagacttcatactgcatagaaatcttacaaacgtgaacaatgtgacaaagttttcattcacaaatccagcttcaaatacataggagaattcacactggagaaaagccatagaaatgtaaggtttgtgacaaggctttcgggaatgattcacacgtggcaccccatactagaattcacactggagagaaaccttacaagtgcaatgagtgtggcaaaccctttagtgggcagtcaccacttattcaccatcaagcaatccatggtatagggaaacttgactaatgtaatgattgtcacaaagttttcagtaatgctacaaccattgcacatcattggagaatccacagtgaagagatcttacaagtgtaataaatgtggcaaatttttcagacatcgttcatgccttgcatttcactggtgaactcatgctggagagaaaccttataaatgtcatgattgaggcaaggtcttcagtcaagcttcatcctatgcaaaacataggaggattcatacaggagagaaacctcacaagtgtgatgattgtggcaaagcgtttacttcacattcacacctcattagacatcagagaatccatgctggacagaaatcttacaaatgtcatcagtgtggaagggtcttcagtccaaggtcactccttgcagaccatcagacaattccttttggagacagttgtttcaaatgcagtgagtatagcaaaccatcaagcattaattgacattagagtcaaatcagccttgacctgagtttgttgatttaacattgatttcaagcattaattgccattaaactgtttatgttaagaggattgcactgggggccatggctcatgcctgtaattccagcactttgagaggcaaagacaggtaggtcactggagctcacgagtttgagaacagcctagccaacagatgggagctacttttcccagcctttattttctttttcttgttttttttttgagatggagtcttgctctgtcgcccaggttggagtgcagtggcacgatctcagctcactgcaacctcctcctcccaggttcaagcaattctcctgcctcagtctcccaagtagctgacactacagttgtgtgccaccacacctgggtaattttttgtgtttttagtagagactgggtttcaccgtgttagccagaatggtctctatcttctgactttatgatccacccgactccacctcccaaagtgctgagattacaggagtgagccactgtgcctggcctgttttttgtttctttaacaaaaagttatagagacttctatgagtattgtaccgaatctaaatcacaattgagtatataatcattgagcgatattcatttttccaatcagtatgggatttatatctatttatacatgtttttaatcattttgatcaatgtttatagatttcaaggtacaaacctcactttttatgtttattcctaaatatttcttactttaagttctttagcaaatggaattggtttttaattttcttttaaaattatttattgttaatgtatggaaattcaactaatttttggtgctgttattctattctgcaaataaactgaatgtgtttgttagttcc

SEQ ID NO: 24626 - DNA, 3528 bp, Homo sapiens
cagggcaaggcaatacagaagtgatccacacagggacattgcacagacaagcaagtcatcacattggagaattttgtttccatgaaattgagaaagacattcatggcttcgagtttcagtggaaagaagatgaaacaaatggccatgcagcacccatgacagaaatcaaagagttggctggtagtacaggccaacatgatcaaaggcatgctggaaacaagcgtattaaagatcagcttggatcaagctttcatttgcatctgcctgaaccgcacatatttcagtctgaagggaaaattggtaatcaagttgagaagtctatcaacaatgcttcctcagtttcaacatcccaaagaatttgttgtaggcccaaaacccatatttctaataagtatggaaataattccctccattcttcattactcacacaaaaatgggaagtacacatgagagaaaaatcttttgaatgtatacagagcttcaaatcctttaattgcagctcactcttaaaaaaacatcagataattcacttagaagagaaacaatgtaaatgtgatgtatgtggcaaggtctttaatcagaagcgataccttgcctgccatcgtagatgtcacactggtgagaaaccttacaagtgtaatgagtgtggcaagacctttggtcataattcatccctcttcattcacaaagcgcttcatactggagagaaaccttatgaatgtgaagaatgtgacaaagttttcagtcgcaaatcacaccttgaaagacataagaggattcatactggagagaaaccatacaaatgtaaggttcgtgatgaggctttcgcatataattcatatctggcaaaacatactatacttcacactggagagaaaccttacacatgtaatgaatgtggcaaagtttttaatcgactatcaacccttgcacgccatcatagacttcatactggagagaaaccttacaaatgtgaagagtgtgacaaagttttcagtcgcaaatcacaccttgaaagacataggaggattcatagtggagagaaaccttacaaatgtgaagaatgttgcaaagttttcagtcgcaaatcaaacctggaaagacacaggaggattcatactggagagaaaccatacaaatgtaaggtttgtgacaaggctttccagagggattcacacctggcacaacatcagagagttcatactggagagaaaccttacaagtgtaatgagtgtggcaagaccttcggtcagacatcatcgcttataatccatcgtaggcttcatactggagagaaaccttacaagtgtaatgagtgtggcaagaccttcagtcagatgtcatcccttgtataccatcataggcttcatagtggagagaagccttaatagtgtaatgagtgtggcaagaccttccatcacaattcaaccctgtaagtcataaggcaattcatactggagagaaaccttacaagcataatgaatgtggcaaggtttttaatcaaaaagcaacctttgcacatcaccatagacttcatactggagagaaaccttacaaatgggaggaatgtgacaaaagttttcagttgtaaatcaaaccttaaaacacataagaaaattcacattgaagagaaaccatacagaggtaaggtttgtgacaaggtttttgcatataatgcatatctggcaaaacatactagaattcacactggagagaaactcattataagtgtaatgagtgtggcaagaccgttggtcaaaattcacaccttgtaattaaaaggtcaaaattcacaccttgtaattcatagtggagagaaaccttacaagcacaatgaatgtgacatggtttttaatcaacaatcacaccttgcaagtcatcatagacttcatactgcatagaaatcttacaaacgtgaacaatgtgacaaagttttcattcacaaatccagcttcaaatacataggagaattcacactggagaaaagccatagaaatgtaaggtttgtgacaaggctttcgggaatgattcacacgtggcaccccatactagaattcacactggagagaaaccttacaagtgcaatgagtgtggcaaaccctttagtgggcagtcaccacttattcaccatcaagcaatccatggtatagggaaacttgactaatgtaatgattgtcacaaagttttcagtaatgctacaaccattgcacatcattggagaatccacagtgaagagatcttacaagtgtaataaatgtggcaaatttttcagacatcgttcatgccttgcatttcactggtgaactcatgctggagagaaaccttataaatgtcatgattgaggcaaggtcttcagtcaagcttcatcctatgcaaaacataggaggattcatacaggagagaaacctcacaagtgtgatgattgtggcaaagcgtttacttcacattcacacctcattagacatcagagaatccatgctggacagaaatcttacaaatgtcatcagtgtggaagggtcttcagtccaaggtcactccttgcagaccatcagacaattccttttggagacagttgtttcaaatgcagtgagtatagcaaaccatcaagcattaattgacattagagtcaaatcagccttgacctgagtttgttgatttaacattgatttcaagcattaattgccattaaactgtttatgttaagaggattgcactgggggccatggctcatgcctgtaattccagcactttgagaggcaaagacaggtaggtcactggagctcacgagtttgagaacagcctagccaacagatgggagctacttttcccagcctttattttctttttcttgttttttttttgagatggagtcttgctctgtcgcccaggttggagtgcagtggcacgatctcagctcactgcaacctcctcctcccaggttcaagcaattctcctgcctcagtctcccaagtagctgacactacagttgtgtgccaccacacctgggtaattttttgtgtttttagtagagactgggtttcaccgtgttagccagaatggtctctatcttctgactttatgatccacccgactccacctcccaaagtgctgagattacaggagtgagccactgtgcctggcctgttttttgtttctttaacatatataatcattgagcgatattcatttttccaatcagtatgggatttatatctatttatacatgtttttaatcattttgatcaatgtttatagatttcaaggtacaaacctcactttttatgtttattcctaaatatttcttactttaagttctttagcaaatggaattggtttttaattttcttttaaaattatttattgttaatgtatggaaattcaactaatttttggtgctgttattctattctgcaaataaactgaatgtgtttgttagttccagttgcattttggctgactctttgtgattttctttacagaaggtcatgtcatctacaaacaaataaaatttgacttctttctttctga

SEQ ID NO: 24627 - DNA, 3581 bp, Homo sapiens
cagggcaaggcaatacagaagtgatccacacagggacattgcacagacaagcaagtcatcacattggagaattttgtttccatgaaattgagaaagacattcatggcttcgagtttcagtggaaagaagatgaaacaaatggccatgcagcacccatgacagaaatcaaagagttggctggtagtacaggccaacatgatcaaaggcatgctggaaacaagcgtattaaagatcagcttggatcaagctttcatttgcatctgcctgaaccgcacatatttcagtctgaagggaaaattggtaatcaagttgagaagtctatcaacaatgcttcctcagtttcaacatcccaaagaatttgttgtaggcccaaaacccatatttctaataagtatggaaataattccctccattcttcattactcacacaaaaatgggaagtacacatgagagaaaaatcttttgaatgtatacagagcttcaaatcctttaattgcagctcactcttaaaaaaacatcagataattcacttagaagagaaacaatgtaaatgtgatgtatgtggcaaggtctttaatcagaagcgataccttgcctgccatcgtagatgtcacactggtgagaaaccttacaagtgtaatgagtgtggcaagacctttggtcataattcatccctcttcattcacaaagcgcttcatactggagagaaaccttatgaatgtgaagaatgtgacaaagttttcagtcgcaaatcacaccttgaaagacataagaggattcatactggagagaaaccatacaaatgtaaggttcgtgatgaggctttcgcatataattcatatctggcaaaacatactatacttcacactggagagaaaccttacacatgtaatgaatgtggcaaagtttttaatcgactatcaacccttgcacgccatcatagacttcatactggagagaaaccttacaaatgtgaagagtgtgacaaagttttcagtcgcaaatcacaccttgaaagacataggaggattcatagtggagagaaaccttacaaatgtgaagaatgttgcaaagttttcagtcgcaaatcaaacctggaaagacacaggaggattcatactggagagaaaccatacaaatgtaaggtttgtgacaaggctttccagagggattcacacctggcacaacatcagagagttcatactggagagaaaccttacaagtgtaatgagtgtggcaagaccttcggtcagacatcatcgcttataatccatcgtaggcttcatactggagagaaaccttacaagtgtaatgagtgtggcaagaccttcagtcagatgtcatcccttgtataccatcataggcttcatagtggagagaagccttaatagtgtaatgagtgtggcaagaccttccatcacaattcaaccctgtaagtcataaggcaattcatactggagagaaaccttacaagcataatgaatgtggcaaggtttttaatcaaaaagcaacctttgcacatcaccatagacttcatactggagagaaaccttacaaatgggaggaatgtgacaaaagttttcagttgtaaatcaaaccttaaaacacataagaaaattcacattgaagagaaaccatacagaggtaaggtttgtgacaaggtttttgcatataatgcatatctggcaaaacatactagaattcacactggagagaaactcattataagtgtaatgagtgtggcaagaccgttggtcaaaattcacaccttgtaattaaaaggtcaaaattcacaccttgtaattcatagtggagagaaaccttacaagcacaatgaatgtgacatggtttttaatcaacaatcacaccttgcaagtcatcatagacttcatactgcatagaaatcttacaaacgtgaacaatgtgacaaagttttcattcacaaatccagcttcaaatacataggagaattcacactggagaaaagccatagaaatgtaaggtttgtgacaaggctttcgggaatgattcacacgtggcaccccatactagaattcacactggagagaaaccttacaagtgcaatgagtgtggcaaaccctttagtgggcagtcaccacttattcaccatcaagcaatccatggtatagggaaacttgactaatgtaatgattgtcacaaagttttcagtaatgctacaaccattgcacatcattggagaatccacagtgaagagatcttacaagtgtaataaatgtggcaaatttttcagacatcgttcatgccttgcatttcactggtgaactcatgctggagagaaaccttataaatgtcatgattgaggcaaggtcttcagtcaagcttcatcctatgcaaaacataggaggattcatacaggagagaaacctcacaagtgtgatgattgtggcaaagcgtttacttcacattcacacctcattagacatcagagaatccatgctggacagaaatcttacaaatgtcatcagtgtggaagggtcttcagtccaaggtcactccttgcagaccatcagacaattccttttggagacagttgtttcaaatgcagtgagtatagcaaaccatcaagcattaattgacattagagtcaaatcagccttgacctgagtttgttgatttaacattgatttcaagcattaattgccattaaactgtttatgttaagaggattgcactgggggccatggctcatgcctgtaattccagcactttgagaggcaaagacaggtaggtcactggagctcacgagtttgagaacagcctagccaacagatgggagctacttttcccagcctttattttctttttcttgttttttttttgagatggagtcttgctctgtcgcccaggttggagtgcagtggcacgatctcagctcactgcaacctcctcctcccaggttcaagcaattctcctgcctcagtctcccaagtagctgacactacagttgtgtgccaccacacctgggtaattttttgtgtttttagtagagactgggtttcaccgtgttagccagaatggtctctatcttctgactttatgatccacccgactccacctcccaaagtgctgagattacaggagtgagccactgtgcctggcctgttttttgtttctttaacaaaaagttatagagacttctatgagtattgtaccgaatctaaatcacaattgagtatataatcattgagcgatattcatttttccaatcagtatgggatttatatctatttatacatgtttttaatcattttgatcaatgtttatagatttcaaggtacaaacctcactttttatgtttattcctaaatatttcttactttaagttctttagcaaatggaattggtttttaattttcttttaaaattatttattgttaatgtatggaaattcaactaatttttggtgctgttattctattctgcaaataaactgaatgtgtttgttagttccagttgcattttggctgactctttgtgattttctttacagaaggtcatgtcatctacaaacaaataaaatttgacttctttctttctga

SEQ ID NO: 24628 - DNA, 3940 bp, Homo sapiens
cagggcaaggcaatacagaagtgatccacacagggacattgcacagacaagcaagtcatcacattggagaattttgtttccatgaaattgagaaagacattcatggcttcgagtttcagtggaaagaagatgaaacaaatggccatgcagcacccatgacagaaatcaaagagttggctggtagtacaggccaacatgatcaaaggcatgctggaaacaagcgtattaaagatcagcttggatcaagctttcatttgcatctgcctgaaccgcacatatttcagtctgaagggaaaattggtaatcaagttgagaagtctatcaacaatgcttcctcagtttcaacatcccaaagaatttgttgtaggcccaaaacccatatttctaataagtatggaaataattccctccattcttcattactcacacaaaaatgggaagtacacatgagagaaaaatcttttgaatgtatacagagcttcaaatcctttaattgcagctcactcttaaaaaaacatcagataattcacttagaagagaaacaatgtaaatgtgatgtatgtggcaaggtctttaatcagaagcgataccttgcctgccatcgtagatgtcacactggtgagaaaccttacaagtgtaatgagtgtggcaagacctttggtcataattcatccctcttcattcacaaagcgcttcatactggagagaaaccttatgaatgtgaagaatgtgacaaagttttcagtcgcaaatcacaccttgaaagacataagaggattcatactggagagaaaccatacaaatgtaaggttcgtgatgaggctttcgcatataattcatatctggcaaaacatactatacttcacactggagagaaaccttacacatgtaatgaatgtggcaaagtttttaatcgactatcaacccttgcacgccatcatagacttcatactggagagaaaccttacaaatgtgaagagtgtgacaaagttttcagtcgcaaatcacaccttgaaagacataggaggattcatagtggagagaaaccttacaaatgtgaagaatgttgcaaagttttcagtcgcaaatcaaacctggaaagacacaggaggattcatactggagagaaaccatacaaatgtaaggtttgtgacaaggctttccagagggattcacacctggcacaacatcagagagttcatactggagagaaaccttacaagtgtaatgagtgtggcaagaccttcggtcagacatcatcgcttataatccatcgtaggcttcatactggagagaaaccttacaagtgtaatgagtgtggcaagaccttcagtcagatgtcatcccttgtataccatcataggcttcatagtggagagaagccttaatagtgtaatgagtgtggcaagaccttccatcacaattcaaccctgtaagtcataaggcaattcatactggagagaaaccttacaagcataatgaatgtggcaaggtttttaatcaaaaagcaacctttgcacatcaccatagacttcatactggagagaaaccttacaaatgggaggaatgtgacaaaagttttcagttgtaaatcaaaccttaaaacacataagaaaattcacattgaagagaaaccatacagaggtaaggtttgtgacaaggtttttgcatataatgcatatctggcaaaacatactagaattcacactggagagaaactcattataagtgtaatgagtgtggcaagaccgttggtcaaaattcacaccttgtaattaaaaggtcaaaattcacaccttgtaattcatagtggagagaaaccttacaagcacaatgaatgtgacatggtttttaatcaacaatcacaccttgcaagtcatcatagacttcatactgcatagaaatcttacaaacgtgaacaatgtgacaaagttttcattcacaaatccagcttcaaatacataggagaattcacactggagaaaagccatagaaatgtaaggtttgtgacaaggctttcgggaatgattcacacgtggcaccccatactagaattcacactggagagaaaccttacaagtgcaatgagtgtggcaaaccctttagtgggcagtcaccacttattcaccatcaagcaatccatggtatagggaaacttgactaatgtaatgattgtcacaaagttttcagtaatgctacaaccattgcacatcattggagaatccacagtgaagagatcttacaagtgtaataaatgtggcaaatttttcagacatcgttcatgccttgcatttcactggtgaactcatgctggagagaaaccttataaatgtcatgattgaggcaaggtcttcagtcaagcttcatcctatgcaaaacataggaggattcatacaggagagaaacctcacaagtgtgatgattgtggcaaagcgtttacttcacattcacacctcattagacatcagagaatccatgctggacagaaatcttacaaatgtcatcagtgtggaagggtcttcagtccaaggtcactccttgcagaccatcagacaattccttttggagacagttgtttcaaatgcagtgagtatagcaaaccatcaagcattaattgacattagagtcaaatcagccttgacctgagtttgttgatttaacattgatttcaagcattaattgccattaaactgtttatgttaagaggattgcactgggggccatggctcatgcctgtaattccagcactttgagaggcaaagacaggtaggtcactggagctcacgagtttgagaacagcctagccaacagatgggagctacttttcccagcctttattttctttttcttgttttttttttgagatggagtcttgctctgtcgcccaggttggagtgcagtggcacgatctcagctcactgcaacctcctcctcccaggttcaagcaattctcctgcctcagtctcccaagtagctgacactacagttgtgtgccaccacacctgggtaattttttgtgtttttagtagagactgggtttcaccgtgttagccagaatggtctctatcttctgactttatgatccacccgactccacctcccaaagtgctgagattacaggagtgagccactgtgcctggcctgttttttgtttctttaacaaaaagttatagagacttctatgagtattgtaccgaatctaaatcacaattgagtatataatcattgagcgatattcatttttccaatcagtatgggatttatatctatttatacatgtttttaatcattttgatcaatgtttatagatttcaaggtacaaacctcactttttatgtttattcctaaatatttcttactttaagttctttagcaaatggaattggtttttaattttcttttaaaattatttattgttaatgtatggaaattcaactaatttttggtgctgttattctattctgcaaataaactgaatgtgtttgttagttccagttgcattttggctgactctttgtgattttctttacagaaggtcatgtcatctacaaacaaataaaatttgacttctttctttctgaaaaaaaaaaaaaaaaaaaaaaaaaaaaaaaaaaaaaaaaaaaaagagggggggaaaagctcaccacaggaggggacacacacatagacaacacgcagacacataacgagcaacacaaagagcgcacccaaatagaggccagccacgcatgtatgaccagccacgcgcagccgccggcagaaaagattaaagacacccaaccgcggcgaccaaccaatccaataaggccaacatcaacggagagacaatacaacctcaccgaggtaggtgacacacgaagcgagccacacacaagcagatgaatatagaagacccgaggacacaaaacacacgaagaagagaaggaaaacgacaagaacg

SEQ ID NO: 24629 - DNA, 2015 bp, Homo sapiens
ccatcgagtttctcggccatcgcgcgcctgcgccattgggctgtcagtcagaggcggcgtggagatcgctgggagcggttgcggcgtgccgggagctgagttatagctgtgacttctgccctgccaggccgcacacaagctggctgacccggtttgtaaaaatggaatttcaagcagtagtgatggcagtaggtggaggatctcggatgacagacctaacttccagcattcccaaacctctgcttccagttgggaacaaacctttaatttggtacccattgaacctgcttgagcgtgttggatttgaagaagtcattgtggttacaaccagggatgttcaaaaggctctatgtgcagaattcaagatgaaaatgaagccagatattgtgtgtattcctgatgacgctgacatgggaactgcagattctttgcgctacatatatccaaaacttaagacagatgtgctggtgctgagctgtgatctgataacagacgttgccttacatgaggttgtggacctgtttagagcttatgatgcatcacttgctatgttgatgagaaaaggccaagatagcatagaacctgttcccggtcaaaaggggaaaaaaaaagcagtggagcagcgtgacttcattggagtggacagcacaggaaagaggctgctcttcatggctaatgaagcagacttggatgaagagctggtcattaagggatccatcctacagaagcatcctagaatacgtttccacacgggtcttgtggatgcccacctctactgtttgaaaaaatacatcgtggatttcctaatggaaaatgggtcaataacttctatccggagtgaactgattccatatttagtgagaaaacagttttcctcagcttcctcacaacagggacaagaagaaaaagaggaggatctaaagaaaaaggagctgaagtccttagatatctacagttttataaaagaagccaatacactgaacctggctccctatgatgcctgctggaatgcctgtcgaggagacaggtgggaagacttgtccagatcacaggtgcgctgctatgtccacatcatgaaagaggggctctgctctcgagtgagcacactgggactctacatggaagcaaacagacaggtgcccaaattgctgtctgctctctgtccagaagaaccaccagtccattcgtcagcccagattgtcagcaaacacctggttggagttgacagcctcattgggccagagacacagattggagagaagtcatccattaagcgctcagtcattggctcatcctgtctcataaaagatagagtgactattaccaattgccttctcatgaactcagtcactgtggaggaaggaagcaatatccaaggcagtgtcatctgcaacaatgctgtgatcgagaagggtgcagacatcaaggactgcttgattggaagtggccagaggattgaagccaaagctaaacgagtgaatgaggtgatcgtggggaatgaccagctcatggagatctgagttctgagcaagtcagactccttccttttggcctccaaagccacagatgttggccggcccacctgtttaactctgtatttatttcccaataaagaagggcttccaaaggcatgctggagacttgtggagcagtccaaagctccatgtcaggtgggctccaggtgtacacagtgtatgttcatgtgtcatgtggtaaagatcatctggagcaagtgtgtgggacaggacagatacagtggcctaactcttgtgtgccaagatgtatcggtggggcagcagctgtccaatgtaaagctcctaggaaggctactttctgactggctgacccaacccagtcctgaaagtatccctcacctaaaaggacctgggagtacttcagtcccttatcctaatcagcctttctagacccataggcctagctgctggcagtgccacgcctgagcatcagcccaggactctgctcccatacctaccatacagattcccagccccttc

SEQ ID NO: 24630 - DNA, 755 bp, Homo sapiens
ccatcgagtttctcggccatcgcgcgcctgcgccattgggctgtcagtcagaggcggcgtggagatcgctgggagcggttgcggcgtgccgggagctgagttatagctgtgacttctgccctgccaggccgcacacaagctggctgacccggtttgtaaaaatggaatttcaagcagtagtgatggcagtaggtggaggatctcggatgacagacctaacttccagcattcccaaacctctgcttccagttgggaacaaacctttaatttggtacccattgaacctgcttgagcgtgttggatttgaagaagtcattgtggttacaaccagggatgttcaaaaggctctatgtgcagaattcaagatgaaaatgaagccagatattgtgtgtattcctgatgacgctgacatgggaactgcagattctttgcgctacatatatccaaaacttaagacagatgtgctggtgctgagctgtgatctgataacagacgttgccttacatgaggttgtggacctgtttagagcttatgatgcatcacttgctatgttgatgagaaaaggccaagatagcatagaacctgttcccggtcaaaaggggaaaaaaaaagcagatggagactcgctctgttgccaggctggagtgcagtggcaccatctcggttcactccaatctccacctcccgggttcaagcacttcacctgcctcagcctcccgagtagctgggactacatgcacatgccaccacaccca

SEQ ID NO: 24631 - DNA, 335 bp, Homo sapiens
gactaccactaaattcgcggccgcgtcgacctgtggaggaaggaagcaatatccaaggcagtgtcatctgcaacaatgctgtgatcgagaagggtgcagacatcaaggactgcttgattggaagtggccagaggattgaagccaaagctaaacgagtgaatgaggtgatcgtggggaatgaccagctcatggagatctgagttctgagcaagtcagactccttccttttggcctccaaagccacagatgttggccggcccacctgtttaactctgtatttatttcccaataaagaagggcttccaaaggaaaaaaaagtcgacgcggccgcgaat

SEQ ID NO: 24632 - DNA, 1639 bp, Homo sapiens
  misc_feature (1587)..(1587): n is a, c, g, or t
  misc_feature (1602)..(1602): n is a, c, g, or t
  misc_feature (1626)..(1626): n is a, c, g, or t
  misc_feature (1636)..(1636): n is a, c, g, or t
ccatcgagtttctcggccatcgcgcgcctgcgccattgggctgtcagtcagaggcggcgtggagatcgctgggagcggttgcggcgtgccgggagctgagttatagctgtgacttctgccctgccaggccgcacacaagctggctgacccggtttgtaaaaatggaatttcaagcagtagtgatggcagtaggtggaggatctcggatgacagacctaacttccagcattcccaaacctctgcttccagttgggaacaaacctttaatttggtacccattgaacctgcttgagcgtgttggatttgaagaagtcattgtggttacaaccagggatgttcaaaaggctctatgtgcagaattcaagatgaaaatgaagccagatattgtgtgtattcctgatgacgctgacatgggaactgcagattctttgcgctacatatatccaaaacttaagacagatgtgctggtgctgagctgtgatctgataacagacgttgccttacatgaggttgtggacctgtttagagcttatgatgcatcacttgctatgttgatgagaaaaggccaagatagcatagaacctgttcccggtcaaaaggggaaaaaaaaagcagtggagcagcgtgacttcattggagtggacagcacaggaaagaggctgctcttcatggctaatgaagcagacttggatgaagagctggtcattaagggatccatcctacagaagcatcctagaatacgtttccacacgggtcttgtggatgcccacctctactgtttgaaaaaatacatcgtggatttcctaatggaaaatgggtcaataacttctatccggagtgaactgattccatatttagtgagaaaacagttttcctcagcttcctcacaacagggacaagaagaaaaagaggaggatctaaagaaaaaggagctgaagtccttagatatctacagttttataaaagaagccaatacactgaacctggctccctatgatgcctgctggaatgcctgtcgaggagacaggtgggaagacttgtccagatcacaggtgcgctgctatgtccacatcatgaaagaggggctctgctctcgagtgagcacactgggactctacatggaagcaaacagacaggtgcccaaattgctgtctgctctctgtccagaagaaccaccagtccattcgtcagcccagattgtcagcaaacacctggttggagttgacagcctcattgggccagagacacagattggagagaagtcatccattaagcgctcagtcattggctcatcctgtctcataaaagatagagtgactattaccaattgccttctcatgaactcagtcactgtggaggaaggaagcaatatccaaggcagtgtcatctgcaacaatgctgtgatcgagaagggtgcagacatcaaggactgcttgattggaagtggccagaggattgaagccaaagctaaacgagtgaatgaggtgatcgtggggaatgaccagctcatggagatctgagttctgagcaagtcagactccttcctttggaagcccttctttattgggaataaataccgggttaaanaggtgggccgccaanatttgtggcctcggtgccgaattnctgaagcccnggg

SEQ ID NO: 24633 - DNA, 1511 bp, Homo sapiens
ccatcgagtttctcggccatcgcgcgcctgcgccattgggctgtcagtcagaggcggcgtggagatcgctgggagcggttgcggcgtgccgggagctgagttatagctgtgacttctgccctgccaggccgcacacaagctggctgacccggtttgtaaaaatggaatttcaagcagtagtgatggcagtaggtggaggatctcggatgacagacctaacttccagcattcccaaacctctgcttccagttgggaacaaacctttaatttggtacccattgaacctgcttgagcgtgttggatttgaagaagtcattgtggttacaaccagggatgttcaaaaggctctatgtgcagaattcaagatgaaaatgaagccagatattgtgtgtattcctgatgacgctgacatgggaactgcagattctttgcgctacatatatccaaaacttaagacagatgtgctggtgctgagctgtgatctgataacagacgttgccttacatgaggttgtggacctgtttagagcttatgatgcatcacttgctatgttgatgagaaaaggccaagatagcatagaacctgttcccggtcaaaaggggaaaaaaaaagcagtggagcagcgtgacttcattggagtggacagcacaggaaagaggctgctcttcatggctaatgaagcagacttggatgaagagctggtcattaagggatccatcctacagaagcatcctagaatacgtttccacacgggtcttgtggatgcccacctctactgtttgaaaaaatacatcgtggatttcctaatggaaaatgggtcaataacttctatccggagtgaactgattccatatttagtgagaaaacagttttcctcagcttcctcacaacagggacaagaagaaaaagaggaggatctaaagaaaaaggagctgaagtccttagatatctacagttttataaaagaagccaatacactgaacctggctccctatgatgcctgctggaatgcctgtcgaggagacaggtgggaagacttgtccagatcacaggtgcgctgctatgtccacatcatgaaagaggggctctgctctcgagtgagcacactgggactctacatggaagcaaacagacaggtgcccaaattgctgtctgctctctgtccagaagaaccaccagtccattcgtcagcccagattgtcagcaaacacctggttggagttgacagcctcattgggccagagacacagattggagagaagtcatccattaagcgctcagtcattggctcatcctgtctcataaaagatagagtgactattaccaattgccttctcatgaactcagtcactgtggaggaaggggtatgtttccccctgtacccacttgaggcaaagataatggaaaaatgccttcaaaattctgaaggaaggttaattttaacctaaaattgtatacccaggcaaagtgctaatcaagagggcaatagaataaaaacattttcagatatc

SEQ ID NO: 24634 - DNA, 1521 bp, Homo sapiens
ccatcgagtttctcggccatcgcgcgcctgcgccattgggctgtcagtcagaggcggcgtggagatcgctgggagcggttgcggcgtgccgggagctgagttatagctgtgacttctgccctgccaggccgcacacaagctggctgacccggtttgtaaaaatggaatttcaagcagtagtgatggcagtaggtggaggatctcggatgacagacctaacttccagcattcccaaacctctgcttccagttgggaacaaacctttaatttggtacccattgaacctgcttgagcgtgttggatttgaagaagtcattgtggttacaaccagggatgttcaaaaggctctatgtgcagaattcaagatgaaaatgaagccagatattgtgtgtattcctgatgacgctgacatgggaactgcagattctttgcgctacatatatccaaaacttaagacagatgtgctggtgctgagctgtgatctgataacagacgttgccttacatgaggttgtggacctgtttagagcttatgatgcatcacttgctatgttgatgagaaaaggccaagatagcatagaacctgttcccggtcaaaaggggaaaaaaaaagcagtggagcagcgtgacttcattggagtggacagcacaggaaagaggctgctcttcatggctaatgaagcagacttggatgaagagctggtcattaagggatccatcctacagaagcatcctagaatacgtttccacacgggtcttgtggatgcccacctctactgtttgaaaaaatacatcgtggatttcctaatggaaaatgggtcaataacttctatccggagtgaactgattccatatttagtgagaaaacagttttcctcagcttcctcacaacagggacaagaagaaaaagaggaggatctaaagaaaaaggagctgaagtccttagatatctacagttttataaaagaagccaatacactgaacctggctccctatgatgcctgctggaatgcctgtcgaggagacaggtgggaagacttgtccagatcacaggtgcgctgctatgtccacatcatgaaagaggggctctgctctcgagtgagcacactgggactctacatggaagcaaacagacaggtgcccaaattgctgtctgctctctgtccagaagaaccaccagtccattcgtcagcccagattgtcagcaaacacctggttggagttgacagcctcattgggccagagacacagattggagagaagtcatccattaagcgctcagtcattggctcatcctgtctcataaaagatagagtgactattaccaattgccttctcatgaactcagtcactgtggaggaaggggtcatgagtagtttagaaagcctgtcaactcatcaaaaaagaaaagaacctccccatcctcagttactgagaagtttcatggctctttgccgaatattctctaagtcaatatctgaagcaggagcccgtgatacagtggagtgtcactttaggcctg

SEQ ID NO: 24635 - DNA, 1387 bp, Homo sapiens
ccatcgagtttctcggccatcgcgcgcctgcgccattgggctgtcagtcagaggcggcgtggagatcgctgggagcggttgcggcgtgccgggagctgagttatagctgtgacttctgccctgccaggccgcacacaagctggctgacccggtttgtaaaaatggaatttcaagcagtagtgatggcagtaggtggaggatctcggatgacagacctaacttccagcattcccaaacctctgcttccagttgggaacaaacctttaatttggtacccattgaacctgcttgagcgtgttggatttgaagaagtcattgtggttacaaccagggatgttcaaaaggctctatgtgcagaattcaagatgaaaatgaagccagatattgtgtgtattcctgatgacgctgacatgggaactgcagattctttgcgctacatatatccaaaacttaagacagatgtgctggtgctgagctgtgatctgataacagacgttgccttacatgaggttgtggacctgtttagagcttatgatgcatcacttgctatgttgatgagaaaaggccaagatagcatagaacctgttcccggtcaaaaggggaaaaaaaaagcagtggagcagcgtgacttcattggagtggacagcacaggaaagaggctgctcttcatggctaatgaagcagacttggatgaagagctggtcattaagggatccatcctacagaagcatcctagaatacgtttccacacgggtcttgtggatgcccacctctactgtttgaaaaaatacatcgtggatttcctaatggaaaatgggtcaataacttctatccggagtgaactgattccatatttagtgagaaaacagttttcctcagcttcctcacaacagggacaagaagaaaaagaggaggatctaaagaaaaaggagctgaagtccttagatatctacagttttataaaagaagccaatacactgaacctggctccctatgatgcctgctggaatgcctgtcgaggagacaggtgggaagacttgtccagatcacaggtgcgctgctatgtccacatcatgaaagaggggctctgctctcgagtgagcacactgggactctacatggaagcaaacagacaggtgcccaaattgctgtctgctctctgtccagaagaaccaccagtccattcgtcagcccagattgtcagcaaacacctggttggagttgacagcctcattgggccagagacacagattggagagaagtcatccattaagcgctcagtcattggctcatcctgtctcataaaagatagagtgactattaccaattgccttctcatgaactcagtcactgtggaggaaggcgaaagcacaaacagcaaggcaag

SEQ ID NO: 24636 - DNA, 1376 bp, Homo sapiens
ccatcgagtttctcggccatcgcgcgcctgcgccattgggctgtcagtcagaggcggcgtggagatcgctgggagcggttgcggcgtgccgggagctgagttatagctgtgacttctgccctgccaggccgcacacaagctggctgacccggtttgtaaaaatggaatttcaagcagtagtgatggcagtaggtggaggatctcggatgacagacctaacttccagcattcccaaacctctgcttccagttgggaacaaacctttaatttggtacccattgaacctgcttgagcgtgttggatttgaagaagtcattgtggttacaaccagggatgttcaaaaggctctatgtgcagaattcaagatgaaaatgaagccagatattgtgtgtattcctgatgacgctgacatgggaactgcagattctttgcgctacatatatccaaaacttaagacagatgtgctggtgctgagctgtgatctgataacagacgttgccttacatgaggttgtggacctgtttagagcttatgatgcatcacttgctatgttgatgagaaaaggccaagatagcatagaacctgttcccggtcaaaaggggaaaaaaaaagcagtggagcagcgtgacttcattggagtggacagcacaggaaagaggctgctcttcatggctaatgaagcagacttggatgaagagctggtcattaagggatccatcctacagaagcatcctagaatacgtttccacacgggtcttgtggatgcccacctctactgtttgaaaaaatacatcgtggatttcctaatggaaaatgggtcaataacttctatccggagtgaactgattccatatttagtgagaaaacagttttcctcagcttcctcacaacagggacaagaagaaaaagaggaggatctaaagaaaaaggagctgaagtccttagatatctacagttttataaaagaagccaatacactgaacctggctccctatgatgcctgctggaatgcctgtcgaggagacaggtgggaagacttgtccagatcacaggtgcgctgctatgtccacatcatgaaagaggggctctgctctcgagtgagcacactgggactctacatggaagcaaacagacaggtgcccaaattgctgtctgctctctgtccagaagaaccaccagtccattcgtcagcccagattgtcagcaaacacctgctaaacgagtgaatgaggtgatcgtggggaatgaccagctcatggagatctgagttctgagcaagtcagactccttccttttggcctccaaagccacagatgttggccggcccacctgtttaactctgtatttatttcccaataaagaagggcttccaaagg

SEQ ID NO: 24637 - DNA, 2174 bp, Homo sapiens
ccatcgagtttctcggccatcgcgcgcctgcgccattgggctgtcagtcagaggcggcgtggagatcgctgggagcggttgcggcgtgccgggagctgagttatagctgtgacttctgccctgccaggccgcacacaagctggctgacccggtttgtaaaaatggaatttcaagcagtagtgatggcagtaggtggaggatctcggatgacagacctaacttccagcattcccaaacctctgcttccagttgggaacaaacctttaatttggtacccattgaacctgcttgagcgtgttggatttgaagaagtcattgtggttacaaccagggatgttcaaaaggctctatgtgcagaattcaagatgaaaatgaagccagatattgtgtgtattcctgatgacgctgacatgggaactgcagattctttgcgctacatatatccaaaacttaagctacccaaacctctttccctgacttatcaagagagattattggttcattcattctcccaggccctggacagatgtgctggtgctgagctgtgatctgataacagacgttgccttacatgaggttgtggacctgtttagagcttatgatgcatcacttgctatgttgatgagaaaaggccaagatagcatagaacctgttcccggtcaaaaggggaaaaaaaaagcagcacctggcccagttatgtcccatggtgaacaatcaataaatattattgaatggcctgcttataaaggcagctcttcttgccccccaccccagtggagcagcgtgacttcattggagtggacagcacaggaaagaggctgctcttcatggctaatgaagcagacttggatgaagagctggtcattaagggatccatcctacagaagcatcctagaatacgtttccacacgggtcttgtggatgcccacctctactgtttgaaaaaatacatcgtggatttcctaatggaaaatgggtcaataacttctatccggagtgaactgattccatatttagtgagaaaacagttttcctcagcttcctcacaacagggacaagaagaaaaagaggaggatctaaagaaaaaggagctgaagtccttagatatctacagttttataaaagaagccaatacactgaacctggctccctatgatgcctgctggaatgcctgtcgaggagacaggtgggaagacttgtccagatcacaggtgcgctgctatgtccacatcatgaaagaggggctctgctctcgagtgagcacactgggactctacatggaagcaaacagacaggtgcccaaattgctgtctgctctctgtccagaagaaccaccagtccattcgtcagcccagattgtcagcaaacacctggttggagttgacagcctcattgggccagagacacagattggagagaagtcatccattaagcgctcagtcattggctcatcctgtctcataaaagatagagtgactattaccaattgccttctcatgaactcagtcactgtggaggaaggaagcaatatccaaggcagtgtcatctgcaacaatgctgtgatcgagaagggtgcagacatcaaggactgcttgattggaagtggccagaggattgaagccaaagctaaacgagtgaatgaggtgatcgtggggaatgaccagctcatggagatctgagttctgagcaagtcagactccttccttttggcctccaaagccacagatgttggccggcccacctgtttaactctgtatttatttcccaataaagaagggcttccaaaggcatgctggagacttgtggagcagtccaaagctccatgtcaggtgggctccaggtgtacacagtgtatgttcatgtgtcatgtggtaaagatcatctggagcaagtgtgtgggacaggacagatacagtggcctaactcttgtgtgccaagatgtatcggtggggcagcagctgtccaatgtaaagctcctaggaaggctactttctgactggctgacccaacccagtcctgaaagtatccctcacctaaaaggacctgggagtacttcagtcccttatcctaatcagcctttctagacccataggcctagctgctggcagtgccacgcctgagcatcagcccaggactctgctcccatacctaccatacagattcccagccccttc

SEQ ID NO: 24638 - DNA, 1096 bp, Homo sapiens
ccatcgagtttctcggccatcgcgcgcctgcgccattgggctgtcagtcagaggcggcgtggagatcgctgggagcggttgcggcgtgccgggagctgagttatagctgtgacttctgccctgccaggccgcacacaagctggctgacccggtttgtaaaaatggaatttcaagcagtagtgatggcagtaggtggaggatctcggatgacagacctaacttccagcattcccaaacctctgcttccagttgggaacaaacctttaatttggtacccattgaacctgcttgagcgtgttggatttgaagaagtcattgtggttacaaccagggatgttcaaaaggctctatgtgcagaattcaagatgaaaatgaagccagatattgtgtgtattcctgatgacgctgacatgggaactgcagattctttgcgctacatatatccaaaacttaagacagatgtgctggtgctgagctgtgatctgataacagacgttgccttacatgaggttgtggacctgtttagagcttatgatgcatcacttgctatgttgatgagaaaaggccaagatagcatagaacctgttcccggtcaaaaggggaaaaaaaaagcagtggagcagcgtgacttcattggagtggacagcacaggaaagaggctgctcttcatggctaatgaagcagacttggatgaagagctggtcattaagggatccatcctacagaagtaagccctagggttttttcttctggcaattctccttgtcttaaaacaaaataaaaccacccagtggatgggaaagagggaatgaaaactagactatactgtgtgaaattgacaaaagtatgtgaatatttttcccatgagacaggatgaaggcttttcttcactgcataagcctgtttccctgtcttttcttgccaaggtagagccaaatccatgtgtggcgtcatatgcctgtagtcccagctactggggaggctgaggcgggagaatcacttgaacccaggaggcggaggttgcagtgagccaagattgcgccactgcactccagttggacaacaagagtgaaatagctagtcggtcttactcggg

SEQ ID NO: 24639 - DNA, 1014 bp, Homo sapiens
tgaacccaggaggtggaggctgtagtgagccaagatcgtgccactacactccagcctgggtaatccgagacccctgtctcaaaaaaaaaaaaaaaaaaaggaactgaagtgaagtcagaatatcttcttttcaggccttagagaaagatcgttatgagcatagtcccaaatctggatttctctgaagccaggtcctcccttggcttaccattctgtcttccactgataacttgaggcacgtagccattaactggactgcccagctgttcctggcctagggaggagccagaacccccaaccaatagtaatgaggatggtgatgcgagccttgggtcctccctaacttggctactgtgttacagaagcaatatccaaggcagtgtcatctgcaacaatgctgtgatcgagaagggtgcagacatcaaggactgcttgattggaagtggccagaggattgaagccaaagctaaacgagtgaatgaggtgatcgtggggaatgaccagctcatggagatctgagttctgagcaagtcagactccttccttttggcctccaaagccacagatgttggccggcccacctgtttaactctgtatttatttcccaataaagaagggcttccaaaggcatgctggagacttgtggagcagtccaaagctccatgtcaggtgggctccaggtgtacacagtgtatgttcatgtgtcatgtggtaaagatcatctggagcaagtgtgtgggacaggacagatacagtggcctaactcttgtgtgccaagatgtatcggtggggcagcagctgtccaatgtaaagctcctaggaaggctactttctgactggctgacccaacccagtcctgaaagtatccctcacctaaaaggacctgggagtacttcagtcccttatcctaatcagcctttctagacccataggcctagctgctggcagtgccacgcctgagcatcagcccaggactctgctcccatacctaccatacagattcccagccccttc

SEQ ID NO: 24640 - DNA, 584 bp, Homo sapiens
tgaacccaggaggtggaggctgtagtgagccaagatcgtgccactacactccagcctgggtaatccgagacccctgtctcaaaaaaaaaaaaaaaaaaaggaactgaagtgaagtcagaatatcttcttttcaggccttagagaaagatcgttatgagcatagtcccaaatctggatttctctgaagccaggtcctcccttggcttaccattctgtcttccactgataacttgaggcacgtagccattaactggactgcccagctgttcctggcctagggaggagccagaacccccaaccaatagtaatgaggatggtgatgcgagccttgggtcctccctaacttggctactgtgttacagaagcaatatccaaggcagtgtcatctgcaacaatgctgtgatcgagaagggtgcagacatcaaggactgcttgattggaagtggccagaggattgaagccaaaggtaaaccagattacaatcacagattccatttttacttctcacaccagcactgataatgccaaaggctggtgaggatgtgggaaacaagcacatacgtacactaacgatcgagaactag

SEQ ID NO: 24641 - DNA, 372 bp, Homo sapiens
ctgccaggccgcacacaagctggctgacccgggtgagcagtgcggtggggccactcatctgagggaggcgggcatgtcgaactgggccgaggtggacccgaaggggtaggagagggtgctgagccccgaagttgtcagctcgactccctgctcgacccggtgtagctgtgtccgaagtagaagggaggttggggatgagaatccgagccaaccaccttatgcaacagatggaggaactaagtttctaatctcagctactcgagagtctgaggcaggagaatcgtttgaacccaggaggtggaggttgcagtgagcctaattcgcgccactgcactccagcctgggcaacatagtgagactctccgtttcaaa

SEQ ID NO: 24642 - DNA, 1629 bp, Homo sapiens
ccatcgagtttctcggccatcgcgcgcctgcgccattgggctgtcagtcagaggcggcgtggagatcgctgggagcggttgcggcgtgccgggagctgagttatagctgtgacttctgccctgccaggccgcacacaagctggctgacccggtttgtaaaaatggaatttcaagcagtagtgatggcagtaggtggaggatctcggatgacagacctaacttccagcattcccaaacctctgcttccagttgggaacaaacctttaatttggtacccattgaacctgcttgagcgtgttggatttgaagaagtcattgtggttacaaccagggatgttcaaaaggctctatgtgcagaattcaagatgaaaatgaagccagatattgtgtgtattcctgatgacgctgacatgggaactgcagattctttgcgctacatatatccaaaacttaagacagatgtgctggtgctgagctgtgatctgataacagacgttgccttacatgaggttgtggacctgtttagagcttatgatgcatcacttgctatgttgatgagaaaaggccaagatagcatagaacctgttcccggtcaaaaggggaaaaaaaaagcagtggagcagcgtgacttcattggagtggacagcacaggaaagaggctgctcttcatggctaatgaagcagacttggatgaagagctggtcattaagggatccatcctacagaagcatcctagaatacgtttccacacgggtcttgtggatgcccacctctactgtttgaaaaaatacatcgtggatttcctaatggaaaatgggtcaataacttctatccggagtgaactgattccatatttagtgagaaaacagttttcctcagcttcctcacaacagggacaagaagaaaaagaggaggatctaaagaaaaaggagctgaagtccttagatatctacagttttataaaagaagccaatacactgaacctggctccctatgatgcctgctggaatgcctgtcgaggagacaggtgggaagacttgtccagatcacaggtgcgctgctatgtccacatcatgaaagaggggctctgctctcgagtgagcacactgggactctacatggaagcaaacagacaggtgcccaaattgctgtctgctctctgtccagaagaaccaccagtccattcgtcagcccagattgtcagcaaacacctggttggagttgacagcctcattgggccagagacacagattggagagaagtcatccattaagcgctcagtcattggctcatcctgtctcataaaagatagagtgactattaccaattgccttctcatgaactcagtcactgtggaggaaggaagcaatatccaaggcagtgtcatctgcaacaatgctgtgatcgagaagggtgcagacatcaaggactgcttgattggaagtggccagaggattgaagccaaagctaaacgagtgaatgaggtgatcgtggggaatgaccagctcatggagatctgagttctgagcaagtcagactccttccttttggcctccaaagccacagatgttggccggcccacctgtttaactctgtatttatttcccaataaagaagggcttccaaagg

SEQ ID NO: 24643 - DNA, 804 bp, Homo sapiens
ccatcgagtttctcggccatcgcgcgcctgcgccattgggctgtcagtcagaggcggcgtggagatcgctgggagcggttgcggcgtgccgggagctgagttatagctgtgacttctgccctgccaggccgcacacaagctggctgacccggtttgtaaaaatggaatttcaagcagtagtgatggcagtaggtggaggatctcggatgacagacctaacttccagcattcccaaacctctgcttccagttgggaacaaacctttaatttggtacccattgaacctgcttgagcgtgttggatttgaagaagtcattgtggttacaaccagggatgttcaaaaggctctatgtgcagaattcaagatgaaaatgaagccagatattgtgtgtattcctgatgacgctgacatgggaactgcagattctttgcgctacatatatccaaaacttaagatggccctcagccttgatgaaattgtgttcttgatagagatgttcctgatgtacctgatatgtccagaagcccactgctcaggagctaacgtccaacacgatctcttgtcgcagtcctgccaataccatagctttatatttctctgatggattgagttctgtgcggacaatatctagctttccagaaagggtactgtttcaggcagcacagatagctggtgagcgactaaactcaccactgccatgctgatcacagaatatgtgagagcaggcagtgacccatgcatagccatagagtttgatgccacacttttgataattacaaagtagcatgtcttcacacaaagac

SEQ ID NO: 24644 - DNA, 673 bp, Homo sapiens
ccatcgagtttctcggccatcgcgcgcctgcgccattgggctgtcagtcagaggcggcgtggagatcgctgggagcggttgcggcgtgccgggagctgagttatagctgtgacttctgccctgccaggccgcacacaagctggctgacccggtttgtaaaaatggaatttcaagcagtagtgatggcagtaggtggaggatctcggatgacagacctaacttccagcattcccaaacctctgcttccagttgggaacaaacctttaatttggtacccattgaacctgcttgagcgtgttggatttgaagaagtcattgtggttacaaccagggatgttcaaaaggctctatgtgcagaattcaagatgaaaatgaagccagatattgtgtgtattcctgatgacgctgacatgggaactgcagattctttgcgctacatatatccaaaacttaaggtgaaaagcaattttttgactcttcttgtttattgaagatagatgatatcttatgttttcccagtgcattatagtcttttttttgagacagaacctcgctctgtcacctaggccggagtgcagtagtgtgatctcaattcactgcaacctccacctcccgggttcaagcaattctcctgcctcagcctcccaagtagctgggattacaggcatacgcc

SEQ ID NO: 24645 - DNA, 1985 bp, Homo sapiens
gcaagccgatctgaggaaaacacctgctacccacgagatgtttgagctggtgcgttcgccgggagctgagttatagctgtgacttctgccctgccaggccgcacacaagctggctgacccggtttgtaaaaatggaatttcaagcagtagtgatggcagtaggtggaggatctcggatgacagacctaacttccagcattcccaaacctctgcttccagttgggaacaaacctttaatttggtacccattgaacctgcttgagcgtgttggatttgaagaagtcattgtggttacaaccagggatgttcaaaaggctctatgtgcagaattcaagatgaaaatgaagccagatattgtgtgtattcctgatgacgctgacatgggaactgcagattctttgcgctacatatatccaaaacttaagacagatgtgctggtgctgagctgtgatctgataacagacgttgccttacatgaggttgtggacctgtttagagcttatgatgcatcacttgctatgttgatgagaaaaggccaagatagcatagaacctgttcccggtcaaaaggggaaaaaaaaagcagtggagcagcgtgacttcattggagtggacagcacaggaaagaggctgctcttcatggctaatgaagcagacttggatgaagagctggtcattaagggatccatcctacagaagcatcctagaatacgtttccacacgggtcttgtggatgcccacctctactgtttgaaaaaatacatcgtggatttcctaatggaaaatgggtcaataacttctatccggagtgaactgattccatatttagtgagaaaacagttttcctcagcttcctcacaacagggacaagaagaaaaagaggaggatctaaagaaaaaggagctgaagtccttagatatctacagttttataaaagaagccaatacactgaacctggctccctatgatgcctgctggaatgcctgtcgaggagacaggtgggaagacttgtccagatcacaggtgcgctgctatgtccacatcatgaaagaggggctctgctctcgagtgagcacactgggactctacatggaagcaaacagacaggtgcccaaattgctgtctgctctctgtccagaagaaccaccagtccattcgtcagcccagattgtcagcaaacacctggttggagttgacagcctcattgggccagagacacagattggagagaagtcatccattaagcgctcagtcattggctcatcctgtctcataaaagatagagtgactattaccaattgccttctcatgaactcagtcactgtggaggaaggaagcaatatccaaggcagtgtcatctgcaacaatgctgtgatcgagaagggtgcagacatcaaggactgcttgattggaagtggccagaggattgaagccaaagctaaacgagtgaatgaggtgatcgtggggaatgaccagctcatggagatctgagttctgagcaagtcagactccttccttttggcctccaaagccacagatgttggccggcccacctgtttaactctgtatttatttcccaataaagaagggcttccaaaggcatgctggagacttgtggagcagtccaaagctccatgtcaggtgggctccaggtgtacacagtgtatgttcatgtgtcatgtggtaaagatcatctggagcaagtgtgtgggacaggacagatacagtggcctaactcttgtgtgccaagatgtatcggtggggcagcagctgtccaatgtaaagctcctaggaaggctactttctgactggctgacccaacccagtcctgaaagtatccctcacctaaaaggacctgggagtacttcagtcccttatcctaatcagcctttctagacccataggcctagctgctggcagtgccacgcctgagcatcagcccaggactctgctcccatacctaccatacagattcccagccccttc

SEQ ID NO: 24646 - DNA, 1911 bp, Homo sapiens
ccatcgagtttctcggccatcgcgcgcctgcgccattgggctgtcagtcagaggcggcgtggagatcgctgggagcggttgcggcgtgccgggagctgagttatagctgtgacttctgccctgccaggccgcacacaagctggctgacccggtttgtaaaaatggaatttcaagcagtagtgatggcagtaggtggaggatctcggatgacagacctaacttccagcattcccaaacctctgcttccagttgggaacaaacctttaatttggtacccattgaacctgcttgagcgtgttggatttgaagaagtcattgtggttacaaccagggatgttcaaaaggctctatgtgcagaattcaagatgaaaatgaagccagatattgtgtgtattcctgatgacgctgacatgggaactgcagattctttgcgctacatatatccaaaacttaagacagatgtgctggtgctgagctgtgatctgataacagacgttgccttacatgaggttgtggacctgtttagagcttatgatgcatcacttgctatgttgatgagaaaaggccaagatagcatagaacctgttcccggtcaaaaggggaaaaaaaaagcagtggagcagcgtgacttcattggagtggacagcacaggaaagaggctgctcttcatggctaatgaagcagacttggatgaagagctggtcattaagggatccatcctacagaagcatcctagaatacgtttccacacgggtcttgtggatgcccacctctactgtttgaaaaaatacatcgtggatttcctaatggaaaatgggtcaataacttctatccggagtgaactgattccatatttagtgagaaaacagttttcctcagcttcctcacaacagggacaagaagaaaaagaggaggatctaaagaaaaaggagctgaagtccttagatatctacagttttataaaagaagccaatacactgaacctggctccctatgatgcctgctggaatgcctgtcgaggagacaggtgggaagacttgtccagatcacaggtgcgctgctatgtccacatcatgaaagaggggctctgctctcgagtgagcacactgggactctacatggaagcaaacagacaggtgcccaaattgctgtctgctctctgtccagaagaaccaccagtccattcgtcagcccagattgtcagcaaacacctggttggagttgacagcctcattgggccagagacacagattggagagaagtcatccattaagcgctcagtcattggctcatcctgtctcataaaagatagagtgactattaccaattgccttctcatgaactcagtcactgtggaggaaggctaaacgagtgaatgaggtgatcgtggggaatgaccagctcatggagatctgagttctgagcaagtcagactccttccttttggcctccaaagccacagatgttggccggcccacctgtttaactctgtatttatttcccaataaagaagggcttccaaaggcatgctggagacttgtggagcagtccaaagctccatgtcaggtgggctccaggtgtacacagtgtatgttcatgtgtcatgtggtaaagatcatctggagcaagtgtgtgggacaggacagatacagtggcctaactcttgtgtgccaagatgtatcggtggggcagcagctgtccaatgtaaagctcctaggaaggctactttctgactggctgacccaacccagtcctgaaagtatccctcacctaaaaggacctgggagtacttcagtcccttatcctaatcagcctttctagacccataggcctagctgctggcagtgccacgcctgagcatcagcccaggactctgctcccatacctaccatacagattcccagccccttc

SEQ ID NO: 24647 - DNA, 1915 bp, Homo sapiens
gggatcatagatgggacatacagaaaggtcatacacatctacaaaatgccagtatcaggcggctggcttcgaagcagtagtgatggcagtaggtggaggatctcggatgacagacctaacttccagcattcccaaacctctgcttccagttgggaacaaacctttaatttggtacccattgaacctgcttgagcgtgttggatttgaagaagtcattgtggttacaaccagggatgttcaaaaggctctatgtgcagaattcaagatgaaaatgaagccagatattgtgtgtattcctgatgacgctgacatgggaactgcagattctttgcgctacatatatccaaaacttaagacagatgtgctggtgctgagctgtgatctgataacagacgttgccttacatgaggttgtggacctgtttagagcttatgatgcatcacttgctatgttgatgagaaaaggccaagatagcatagaacctgttcccggtcaaaaggggaaaaaaaaagcagtggagcagcgtgacttcattggagtggacagcacaggaaagaggctgctcttcatggctaatgaagcagacttggatgaagagctggtcattaagggatccatcctacagaagcatcctagaatacgtttccacacgggtcttgtggatgcccacctctactgtttgaaaaaatacatcgtggatttcctaatggaaaatgggtcaataacttctatccggagtgaactgattccatatttagtgagaaaacagttttcctcagcttcctcacaacagggacaagaagaaaaagaggaggatctaaagaaaaaggagctgaagtccttagatatctacagttttataaaagaagccaatacactgaacctggctccctatgatgcctgctggaatgcctgtcgaggagacaggtgggaagacttgtccagatcacaggtgcgctgctatgtccacatcatgaaagaggggctctgctctcgagtgagcacactgggactctacatggaagcaaacagacaggtgcccaaattgctgtctgctctctgtccagaagaaccaccagtccattcgtcagcccagattgtcagcaaacacctggttggagttgacagcctcattgggccagagacacagattggagagaagtcatccattaagcgctcagtcattggctcatcctgtctcataaaagatagagtgactattaccaattgccttctcatgaactcagtcactgtggaggaaggaagcaatatccaaggcagtgtcatctgcaacaatgctgtgatcgagaagggtgcagacatcaaggactgcttgattggaagtggccagaggattgaagccaaagctaaacgagtgaatgaggtgatcgtggggaatgaccagctcatggagatctgagttctgagcaagtcagactccttccttttggcctccaaagccacagatgttggccggcccacctgtttaactctgtatttatttcccaataaagaagggcttccaaaggcatgctggagacttgtggagcagtccaaagctccatgtcaggtgggctccaggtgtacacagtgtatgttcatgtgtcatgtggtaaagatcatctggagcaagtgtgtgggacaggacagatacagtggcctaactcttgtgtgccaagatgtatcggtggggcagcagctgtccaatgtaaagctcctaggaaggctactttctgactggctgacccaacccagtcctgaaagtatccctcacctaaaaggacctgggagtacttcagtcccttatcctaatcagcctttctagacccataggcctagctgctggcagtgccacgcctgagcatcagcccaggactctgctcccatacctaccatacagattcccagccccttc

SEQ ID NO: 24648 - DNA, 2082 bp, Homo sapiens
ccatcgagtttctcggccatcgcgcgcctgcgccattgggctgtcagtcagaggcggcgtggagatcgctgggagcggttgcggcgtgccgggagctgagttatagctgtgacttctgccctgccaggccgcacacaagctggctgacccggtttgtaaaaatggaatttcaagcagtagtgatggcagtaggtggaggatctcggatgacagacctaacttccagcattcccaaacctctgcttccagttgggaacaaacctttaatttggtacccattgaacctgcttgagcgtgttggatttgaagaagtcattgtggttacaaccagggatgttcaaaaggctctatgtgcagaattcaagatgaaaatgaagccagatattgtgtgtattcctgatgacgctgacatgggaactgcagattctttgcgctacatatatccaaaacttaagctacccaaacctctttccctgacttatcaagagagattattggttcattcattctcccaggccctggacagatgtgctggtgctgagctgtgatctgataacagacgttgccttacatgaggttgtggacctgtttagagcttatgatgcatcacttgctatgttgatgagaaaaggccaagatagcatagaacctgttcccggtcaaaaggggaaaaaaaaagcagtggagcagcgtgacttcattggagtggacagcacaggaaagaggctgctcttcatggctaatgaagcagacttggatgaagagctggtcattaagggatccatcctacagaagcatcctagaatacgtttccacacgggtcttgtggatgcccacctctactgtttgaaaaaatacatcgtggatttcctaatggaaaatgggtcaataacttctatccggagtgaactgattccatatttagtgagaaaacagttttcctcagcttcctcacaacagggacaagaagaaaaagaggaggatctaaagaaaaaggagctgaagtccttagatatctacagttttataaaagaagccaatacactgaacctggctccctatgatgcctgctggaatgcctgtcgaggagacaggtgggaagacttgtccagatcacaggtgcgctgctatgtccacatcatgaaagaggggctctgctctcgagtgagcacactgggactctacatggaagcaaacagacaggtgcccaaattgctgtctgctctctgtccagaagaaccaccagtccattcgtcagcccagattgtcagcaaacacctggttggagttgacagcctcattgggccagagacacagattggagagaagtcatccattaagcgctcagtcattggctcatcctgtctcataaaagatagagtgactattaccaattgccttctcatgaactcagtcactgtggaggaaggaagcaatatccaaggcagtgtcatctgcaacaatgctgtgatcgagaagggtgcagacatcaaggactgcttgattggaagtggccagaggattgaagccaaagctaaacgagtgaatgaggtgatcgtggggaatgaccagctcatggagatctgagttctgagcaagtcagactccttccttttggcctccaaagccacagatgttggccggcccacctgtttaactctgtatttatttcccaataaagaagggcttccaaaggcatgctggagacttgtggagcagtccaaagctccatgtcaggtgggctccaggtgtacacagtgtatgttcatgtgtcatgtggtaaagatcatctggagcaagtgtgtgggacaggacagatacagtggcctaactcttgtgtgccaagatgtatcggtggggcagcagctgtccaatgtaaagctcctaggaaggctactttctgactggctgacccaacccagtcctgaaagtatccctcacctaaaaggacctgggagtacttcagtcccttatcctaatcagcctttctagacccataggcctagctgctggcagtgccacgcctgagcatcagcccaggactctgctcccatacctaccatacagattcccagccccttc

SEQ ID NO: 24649 - DNA, 1423 bp, Homo sapiens
ccatcgagtttctcggccatcgcgcgcctgcgccattgggctgtcagtcagaggcggcgtggagatcgctgggagcggttgcggcgtgccgggagctgagttatagctgtgacttctgccctgccaggccgcacacaagctggctgacccggtttgtaaaaatggaatttcaagcagtagtgatggcagtaggtggaggatctcggatgacagacctaacttccagcattcccaaacctctgcttccagttgggaacaaacctttaatttggtacccattgaacctgcttgagcgtgttggatttgaagaagtcattgtggttacaaccagggatgttcaaaaggctctatgtgcagaattcaagatgaaaatgaagccagatattgtgtgtattcctgatgacgctgacatgggaactgcagattctttgcgctacatatatccaaaacttaagacagatgtgctggtgctgagctgtgatctgataacagacgttgccttacatgaggttgtggacctgtttagagcttatgatgcatcacttgctatgttgatgagaaaaggccaagatagcatagaacctgttcccggtcaaaaggggaaaaaaaaagcagtggagcagcgtgacttcattggagtggacagcacaggaaagaggctgctcttcatggctaatgaagcagacttggatgaagagctggtcattaagggatccatcctacagaagcatcctagaatacgtttccacacgggtcttgtggatgcccacctctactgtttgaaaaaatacatcgtggatttcctaatggaaaatgggtcaataacttctatccggagtgaactgattccatatttagtgagaaaacagttttcctcagcttcctcacaacagggacaagaagaaaaagaggaggatctaaagaaaaaggagctgaagtccttagatatctacagttttataaaagaagccaatacactgaacctggctccctatgatgcctgctggaatgcctgtcgaggagacaggtgggaagacttgtccagatcacaggtgcgctgctatgtccacatcatgaaagaggggctctgctctcgagtgagcacactgggactctacatggaagcaaacagacaggtgcccaaattgctgtctgctctctgtccagaagaaccaccagtccattcgtcagcccagattgtcagcaaacacctgcattttgggaggctgaggcaggtgcatcacctgaggtcaggagttcgagattagcctggccaacatggtgtaaccccatctctactaaaaatacaaaaaaaaaaaaaattagccaggtgtggtggtgtgcacctgtagtcccagctactcaggaggctgaggcaggagaatggcttgaacccaggaggcagaggttgcagtgagctgag

SEQ ID NO: 24650 - DNA, 1060 bp, Homo sapiens
ccatcgagtttctcggccatcgcgcgcctgcgccattgggctgtcagtcagaggcggcgtggagatcgctgggagcggttgcggcgtgccgggagctgagttatagctgtgacttctgccctgccaggccgcacacaagctggctgacccggtttgtaaaaatggaatttcaagcagtagtgatggcagtaggtggaggatctcggatgacagacctaacttccagcattcccaaacctctgcttccagttgggaacaaacctttaatttggtacccattgaacctgcttgagcgtgttggatttgaagaagtcattgtggttacaaccagggatgttcaaaaggctctatgtgcagaattcaagatgaaaatgaagccagatattgtgtgtattcctgatgacgctgacatgggaactgcagattctttgcgctacatatatccaaaacttaagacagatgtgctggtgctgagctgtgatctgataacagacgttgccttacatgaggttgtggacctgtttagagcttatgatgcatcacttgctatgttgatgagaaaaggccaagatagcatagaacctgttcccggtcaaaaggggaaaaaaaaagcagtggagcagcgtgacttcattggagtggacagcacaggaaagaggctgctcttcatggctaatgaagcagacttggatgaagagctggtcattaagggatccatcctacagaaacatttgagttgctgccacctcttggctattgtgaatagtgctgcagtgaacgtgggtgtacagacatctcttcaagaccttgctttcagttcttttggatatatatttagaagtgggattactggatcatatggtagagaactatgatgtttaattttttgaggaaactacatactgtttccatggcattttcactattttacaatcccaccaacagtgcataagagccccagtttctccacaccagtacttacatggtagctggtctcagatacagaaggaaaagagaattcatttatgttatatcaaaacaaataaaacatctgggcaga

SEQ ID NO: 24651 - DNA, 459 bp, Homo sapiens
aaaactaagatcagtgaaatcacttcctatttgcgaggggaagataacgtccttgataacaacaaatgaaaagtctctctagtctcattgaaaagggttttattttgaagaatgtacaggttaagtattccttatctgaaatgctggggaccagaaatatttccgatttttttttttttagatatttgcattacatacttaacagttgagcatccttaatccccaaatccaaaattctccagtcagcatttcctttgagcatcatgtcattgctcaaaaagtttcagattttggagttttgaatttgggatactcaacttgtattagcttaagtaaaaaaaaaaaaaaaaaaaagcttaagaaacaacctatttcaatgagcttatatacctaggatcaatgtattcctgagtatagtcactgtcaggaattagggaaactacagaaaacataagatgc

SEQ ID NO: 24652 - DNA, 462 bp, Homo sapiens
cgatctccagccgtgatcggaggccatggatactggagtgtctctggagtgacctgattcacccagccctccttctaagaaatgctgtccttctcctctcccctgactagacagtccttgcttcacagcggtggattttctttcgttcccgttcactttcagggatctccccgttaaccagtgaaactgtacatttgttttacagtttgtttactaatgaaaacaggtaacagccggagttggctgacattggaaataggagacaaggtaccttctgcacttttggctattgtactcggctcagatggagacaaaggttgggtacagaccatatctcagtggccacctgagcctaggtgaaaagaattgataggagaggtcaggcctggtggctcacgcctgtaatcccagcactttgggaggctgaggcgggaggatcactggagcccaggagttgaagac

SEQ ID NO: 24653 - DNA, 504 bp, Homo sapiens
gcaaaaaaaagttcacagaagtacctgccaaatgtgccaactgactactatgaactaatttacttttgagaaacatgctatttcttatatgctactgacagtgcctataaaaatggtgcacattaactggctgttttattttctccccaatcttaatatctaatatccacagactgagattagagcaccaacgtatacaatgtaacttcatactagagttagaaggggatacaaagtgtagaaatcataatcttctccataaagttcctgtcaccttggaattaacctcccctttacatagtctcattgttcaccttgttcacatcttcatgggttcaggctcaggtctctgtggtcgcacagtgtgtctttttaccaaaaggaacacctcatgcacttttccaaaaggagaaaagtaaaggtttgaatggatttttagttctcggcatttttgaacagaaataatcaggtattaagttgctcaaagatccccacaagctttca

SEQ ID NO: 24654 - DNA, 1711 bp, Homo sapiens
gcctctgccccagcagtcagccagccgaccgcgcctgctccctcctgcttgcccaaggccgggcaagtcatccccactctgcttcgagaggccccgttttccagcgtgattgcgccgacactgctctgtgggtttctcttcttggcgtgggttgctgctgaggttccagaggagagcagcaggatggccgggagcggagccaggagtgaggaaggccgccggcagcatgccttcgtcccggaaccttttgatggggccaatgtcgtcccaaacctctggctgcacagctttgaagtcatcaatgacctcaaccattgggaccatatcaccaagctaaggttcctgaaagagtccctcagaggagaggccctgggtgtctacaataggctcagtccccaggaccagggagactatgggactgtgaaagaggccctcctgaaggcctttggggtccctggggctgcccccagccacctgcccaaagagatcgtctttgccaacagcatgggtaagggctactatctcaaggggaagattggcaaagtgcccgtgaggttcctggtggactctggggcccaggtctctgtggtccacccaaacttgtgggaggaggtcactgatggcgatctggacaccctgcagccctttgagaatgtggtaaaggtggccaatggtgctgaaatgaagatcctgggtgtctgggatacagcggtgtccctaggcaagctgaagctgaaggcacagttcctagtggccaatgcgagtgccgaggaagccatcattggcactgatgtgctccaggaccacaatgctatcctggactttgagcaccgcacatgcaccctgaaagggaagaagtttcgccttctgcctgtgggagggtccctggaagatgagtttgacctggagctcatagaggaggacccctcctcagaagaagggcggcaggagctatcccactgagaagccaccttttctttaacctcctaaatattggtgggaagacccaccgctgtggggggggttgcatatcctcatgggggtcactgggcttggccagtctgcttatcaactcttgctcttctctcccctttgcctccctctgcaggggccttaatctgcccctggtaggggaggcttccactgaacaggcacaggtgagggagagcaggctggcttagagggacagggtccccatggtcatcaagctgctgttgatgacaaagactcaaaggctggaagagctcccaaggaagctagaaatgcttgtctttgaaagaactgtgggaccccttcagattccctgaggtatggcttggtcactctcaggtcctcaaagcctgtcttagttgggctgggtcctagctgcagggtctttgtgagggtcacagttgctctgggacacctccctgaagagcctttccacctgtacaatcgtattttctttctgtcatttgctttgaagcccattgtgccttatgccaataattcaattgctgcaaacaccaataaagattgattcatggaaaaaccatgtaatgtgttgattgaggatgagaggaatgtgagagggagtcagcatcaaagacaagggagattcacatgtctactgagtgcctagctggaggtataagaacatatacacagggatgacaggtcttggattttctaagacagtctcagcataaaatattttgacttattccctcca

SEQ ID NO: 24655 - DNA, 196 bp, Homo sapiens
gaaccctgggcctgagataaatcttgaagagaattgatggggcagtggatcaataggtaatgtataaagaaatcggaacatatggcccatcccactctgtcatcttcaccgtcctcctgggcccccattctcgtggctgtgcgggcagttgccctagtgcatgcacacacggtcctgcctgtgtgcatgtgtgcat

SEQ ID NO: 24656 - DNA, 220 bp, Homo sapiens
ttttagttataagctgcacagcctagaaatcccatttgtccaagtgacatggattgaatgctcagtgctgtgtgggataccaaaggagacaccaccacgccagttcttgagaaattcacaggctggctgagcacaagctcaaacagaggataggaggtgcaattaattggtagcttgctgtttcggaccataaaaattttaaagattcagaaaaagtgtg

SEQ ID NO: 24657 - DNA, 432 bp, Homo sapiens
aggaagaagaaaccccttcaagtcaaaattgccctagtgtaccttctactcattctgccggcagggccagctcccaaagtggatgaagatgaagaagcactaaagcagttggctgagtgggtatcctgataaatctgggcttgtcttcctaatgctacctttgttggtcctttcttccttaagtgccaagtgctgagctaaaggaggataactttttggggaagtcatgctgagggtggtagtgtgaccctgcctgaaaaaagggtctcttaccctcccagccctggctcaactctgaagaaggatcttgctacagaaggagcccttgggctcccttctctttgatagcagttataatgcccttgttcccaataaaactgggcagatggaatcctagtgtctatactgccttgtctacccctgaaaatgttc

SEQ ID NO: 24658 - DNA, 262 bp, Homo sapiens
gcggccgcctactactactactgctcgaattcaagcttctaacgatgtacggggtcatgctgagggtggtagtgtgaccctgcctgaaaaaagggtctcttaccctcccagccctggctcaactctgaagaaggatcttgctacagaaggagcccttgggctcccttctctttgatagcagttataatgcccttgttcccaataaaactgggcagatggaatcctagtgtctatactgccttgtctacccctgaaaatgttc

SEQ ID NO: 24659 - DNA, 598 bp, Homo sapiens
ctatacagtcttttttttttaaacaaatttccatcatttcattacattcatgaaatattttgtcaagtggtatagttctcaatttttagcacacctgcgagtaccagaaatactgaacaggtacagttgccataagttatcttaagaagtttgatttaggtctgtcgcagtggctcatgcctgtgagtccagcgctttgggaggccaaggtgggaggatcacttgagcccaggagtctgagaccagcctaagcaacatagcaagacccccatctctaccaaaaagaaaaaaaaaattagccaggtgtggtggtgcacacctgtagtcccagctactcgggaggctgaggtaggaggatcacttgagcccaggagattgaggctgcagtgagctgtgatcacactgctgcactctagcctgggtgacagagactgtctcaaaaaacaaacaaaacaacaaagaagtttaaaatgttacctaacccatgtctaaattttaagtaggcatactgcagatagacactgaaactagtattccctcagtctgaacactggttcaccccaacatacccagtgacctcgctggcctacagcacatg

SEQ ID NO: 24660 - DNA, 2183 bp, Homo sapiens
  misc_feature (917)..(917): n is a, c, g, or t
  misc_feature (937)..(937): n is a, c, g, or t
  misc_feature (1016)..(1016): n is a, c, g, or t
  misc_feature (1106)..(1106): n is a, c, g, or t
  misc_feature (1146)..(1146): n is a, c, g, or t
  misc_feature (1209)..(1209): n is a, c, g, or t
  misc_feature (1225)..(1225): n is a, c, g, or t
  misc_feature (1230)..(1230): n is a, c, g, or t
  misc_feature (1291)..(1291): n is a, c, g, or t
  misc_feature (1369)..(1369): n is a, c, g, or t
  misc_feature (1518)..(1518): n is a, c, g, or t
  misc_feature (2139)..(2139): n is a, c, g, or t
gtccaggctggtctcgaacccttgagctcaagcaatccacctaccttggcctcccaaagtgctgggattacagccacaagccactgtgcctggctgcaatttatttcttaataaaataaactagttctagtaatatgcattgttccctaattttttttagaatagaacagttcatcatgtttatctcaaacttctagctccagttaggaagaccaagaaattacttaaggaagcttaagctgatgttagccagattggaaggaaaaccacgacccataagtaaatgcattctaaaccccatcctaactatctttgtccacagaggtggggttaatgctttatggcaggggccttttacctactttatttaatgaaaaacaggaagaaaaacttctgaaataggagtgtgttggtgaatttacgctgcaacccacataattcgaaaaatgattccatacctaacagagtacttttcctgatttactcctttagaagcttgaattacagccaggttgtatggaaatacaggttgagtgtcttaccttaggtatccaaaagcctgtaatctactcaaaagaaacattagtgagttggaattcaaataatccttttctattgttattttttgttacacacaaggcacatctgaaagcacaagagctcagtgttctagttgtgttataataatgaggtcacaagtcctgtactacgatgaggtaggagtgtgtgaaataccatggtggttaaaagcatgggctttggggtggagccaagatggccgaatacgaacagctccagtctacagctgccagtgtgagcgacgcagaagacgggtgatttctgcatttcccactgaggtaccgggttcatctcactggggagtgtcagaaagtgggtgcaggacagtgggcgcagcncaccgagcgtgagccgaagnagggcgaggcatcgcctcacccgggaagcgcaaggggtcagggagtaccctttcctagtcaaagaaggggtgacagacngcacttggaaaatcgggtcactcccaccctaatactgctcatttccaatggtcttagcaaacggcacaccaggagattatatcccacgcntggctctgagggtcctatgcccacggagcctcgctcattnctagcacagcagtctgagatcaaactgcaaggcagcagcgaggctaggggaggggcgccaacnattgccgaggcttgantaggnaaacaaagtggccatgaagctcgaactgggtggagcccaccgcagctcaaggaggcctgcntgcctctgtagactccacatctgggggcagggcacagccaaacaaaaggcagcagaaagctctgcaaacttaaatgtncctgtctgacaggcttgaagagagtaatggttctcccagcacacagctggacatctgagaatggacagactgcctcaagtgggtccctgacccccgagtagcctaactgggaggtatcccccagtacaggcagatggacacctcacacngccaggtactcctctgagacaaaacttccagactaatgatcaggcagcaacatctgctgttcaccaatatccgctgttctgcagcctccgctgctgatacccaggcaaacggtctggagtagacctccagcaaactccaacagacctgcagctgagggtcctgactgttagaaggaagactaacaaacagaaaggacatccacacaaaaaccccatctgtacgtcaccatcatcaaagaccaaaggtagataaaaccacaaagatggggaaaaaaacagagcagaaaaactggaaactctcaaaatcagagcgcctctcctcctctagaggaacgcggctcctcaccagtaacggaacaaagctggatggagaatgactttgacgagttgagagaagaaggcttcagacaatcaaactactctgagctaaaggaggaagtttgaacccatggcaaagaagttaaaaaccttgaaaaaaaattagatgaatggctaactagaataatcaatgcagagaagtccttaaaggacctgatggagctgaaaaccaaggcatgagaactatgtgacgaatgcacaagcctcagtagctgattcgatcaactggaagaaagggtatcngtgatggaagatgaaatgaatgaaatgaagcaagaagtttagag

SEQ ID NO: 24661 - DNA, 426 bp, Homo sapiens
tagaagcatcaaaagaaaaaatcatgttacttaaaaggaaaattacagttaaactgccagcagatttgtcaacaaaaagaaatagaagttagtagaataatagacgcaaagtattaagagaacattactgtcaatctagaatttaataataaaggcaaaacaaaattttactaacacaaatactaacaaaaactgagggcaaagaaacaacaaggtgaataacaagatgaaataaacacttaaacattttatgtaacatgccagagggtgatttaaagatttctgaagcctcggctgggtgcggtggctcacgcctgtaatcccagcactttgggaggctgaagcgggtggatcacaaggtgaggagattgagaccatactggctaacatggtgaaaccccgtctctactaaaaatacaaaaaaaa

SEQ ID NO: 24662 - DNA, 266 bp, Homo sapiens
agccacaggaagtaataaagctcaataattggaacagtaatgatattagctaccttttactgtgtgctcacttatgagcccaggtcctctgccagacacattctgttcatcatctctttcgtcatcacagcaaaccattttatagatgaggaaactgaagcttagagaagtaacttgcccaaaagtaaccagatctacactcctcagctccctgacacatccccactgcctcctgctactgtctgttttccttctttttcatcagc

SEQ ID NO: 24663 - DNA, 464 bp, Homo sapiens
ctccttgtagctctgtctaactccatggcacagctaatgcacctcatcataaaaacactgggctgggtatggtggctaatgcctgtaatcccaacactttgggaggccaaggcaggaggatcacttgaagccaggaatttgaaaccagcctgggcaacatagtgaaaccctgtctctacaaaagaataaaaaatgagctgggtatggtggtatgtgcctgtaaccccagccacttggggggctgaggtgggaggattacttgagcctgggcggtcaaggctacaatgagctgtgactgcatcactatgttacagtgagaccctctctcaggaaagaataaaaataaaaaacaacatctggtccatggattccatcaaacaagtgctattcctttttgtcttgtcataaaaactctctatcagtggatgctttctgcacgtccatttgctaatagtttcctgttc

SEQ ID NO: 24664 - DNA, 668 bp, Homo sapiens
caaggattctggtgttcctcaaatgtcttccacaggaactgtgcatatcacagttatagaccaaaatgacaatccttcacagtctcggacggtggagatatttgttaattattatggtaacttgtttcccggtgggattttaggctctgtgaagccacaggatccagatgtgttagacagcttccactgctcccttacttcaggagttaccagcctcttcagtattccagggggtacttgtgatctgaattcccagccaaggtccacagatggcacgtttgatctgactgtccttagcaatgatggagttcacagcacagtcacgagcaacatccgagttttctttgctggattttccaatgccacagtggataacagcatcttacttcgtctcggcgtaccaacagtaaaggacttcttgaccaaccactatcttcattttttacgcattgccagctcacagctgacaggcttagggactgctgtgcaactgtacagtgcatatgaagagaacaatagaacgtttcttttggcagctgtgaagcgaaatcataatcagtatgtgaatcccagtggcgtagccaccttctttgaaagcatcaaagagatccttctccggcagagtggagtaaaggtggaatctgtggatcatgactcctgtgtgcatg

SEQ ID NO: 24665 - DNA, 276 bp, Homo sapiens
caaagacaaacatgagctgaggctgttgaaacatgaaacctaagaattactttaaaaccttttagtgaaatccatagttgggtgaattaaggggaaagaaaaaagaataaaggtcacataaaacagaactgtgcagtgacatcggagcagaattaactgacagttgagccttagtttggaaaagaaaaaaaatcaagataattaaagcagagaaatgtgacgaggcagtaagtagtaacaggttttcaggcctaaacaaaaaatagttttcagcgt

SEQ ID NO: 24666 - DNA, 641 bp, Homo sapiens
  misc_feature (30)..(30): n is a, c, g, or t
tccctgcgatttatctgggaggtgtcaccnagcaacaggagaagcacagaaggctctggaatgtttttgtcaggcagcatctgaagtaggcaaagaggaattcttggatcgcttgattcgctcagaggatggggagatcgtgtctacccccaggctgcagtattatgacaaggttttacgactactagatgtcattggtttgcctgaactggttattcagttggctacatcagccataactgaagcaggtgatgactggaaaagtcaggctactctaaggacatgtattttcaaacatcatttggatttgggtcacaatagccaagcatatgaagccttaacccaaattcctgattccagcaggcaattagattgtttacggcagttggtggtagttctttgtgaacgctcacagctacaggatcttgtagagtttccctatgtgaatctgcataatgaggttgtgggaataattgagtcacgtgctagagctgtggaccttatgactcacaattactatgaacttctgtatgcctttcacatctatcgccacaattaccgcaaggctggcacagtgatgttgtagtatggatgcggctgccagagagtcgactctccgggactgcgccagcgtacggcct

SEQ ID NO: 24667 - DNA, 605 bp, Homo sapiens
tgatatcagaataaaatactgattttcacagttaaattgcttgttttgttttatcagtatgatcgccctggagcatcccctaagaggaatcatgatggagaatgcacagctgcccccagtgagtcaggagtctcacactggttctttgctagacagtagtaatgttgttattgttagttgtattatgatagaaatatgtagttaaataagctacatataatagtaatatataaatgttatagtagtaacagttgcccttgtaaaacacaagttttaactgcaggcacctattatacacagatttttgttttcaataagtatattggattctttttctggagattgtcacaatttgaaaaaactcccagttgaaccacatagcctagaaatattgaaaaagttaaggaagccgggtgtggtggctcacacctgtaatcccagcaccttgggaggccgaggcaggtggatcacctgaggtcaggtgttcaagaccagcctggtcagtgtggcgaaaccccatctctactaaaaatacaaaaattagctgggcagtagtggccctcacctgtaatcccagctactcaggaggcttgaggcaggagaat

SEQ ID NO: 24668 - DNA, 5191 bp, Homo sapiens
agccggccactggaaggttcccgcagatagagtctgcctcccctgcccccttctcttctggattcctcgctgcccaccctcattctcccggtggaagcctcgcaacgaagggccggagccgcctttctgctcccggaatgcttcacctgtccgcagctccgcccgccccacccccggaagtgacggcgaccgcgcggccctgcctttgttccgttgggcgtcgcggcgacggcgggaagatggcggcggcgggagccctggaacggagcttcgtggagctaagcggagctgagcgcgaaaggccgaggcactttcgggaattcacagtctgcagcattgggactgcaaatgccgtggctggcgccgtaaaatacagtgaaagcgcgggaggcttttactacgtggagagtggcaagttgttctccgtaaccagaaacaggttcattcattggaagacctctggagatacattggagctgatggaggagtcactggacataaatctgttgaataatgccattcgcctaaaattccaaaattgcagtgttttacctggaggggtttatgtctctgagactcagaatcgtgtgataatcttgatgttaaccaatcaaacagtgcacaggttacttttaccacacccctcccggatgtataggagtgagttggtagttgacagtcagatgcagtcaatattcactgacattggaaaagttgatttcacagatccttgcaactatcagttaattccagcagtacctggaatatctcctaattccaccgcctctacagcctggctcagcagtgatggggaggccctgtttgccttaccatgtgcttctgggggaatctttgttcttaagctacctccttatgacatacctggtatggtgtcagtcgtggaactgaaacagagttcagtaatgcaacgattgcttacaggctggatgccaacagctatcaggggtgaccagtcgccttcagatcgtcccctcagtcttgctgttcattgtgtggagcatgatgccttcatctttgctttgtgtcaggatcataaactacgaatgtggtcttacaaggagcaaatgtgcctaatggtagctgacatgctggagtatgtccctgtgaagaaagaccttcggcttactgctggaactggacacaaattacggcttgcttattcccccaccatgggactctacctggggatatacatgcatgcaccaaaacgaggacagttctgcattttccagttggtgagcactgagagtaatcgctatagtctcgatcatatttcttcactgttcacttctcaggagacactgattgactttgccttaacttccacggatatctgggccctgtggcatgatgctgagaaccaaacagtagtgaaatacatcaactttgaacataatgttgcaggtcagtggaatccagtttttatgcagcctctgccagaggaagagattgtcatcagagatgatcaagaccccagagagatgtatctgcaaagtctttttacaccaggacaattcacaaatgaagctttatgtaaggctttacagattttctgccgaggaactgagaggaatttggatctttcctggagtgaactgaagaaagaagttactttagctgttgaaaatgagcttcaaggaagtgtaacagagtatgaattctcccaggaggagtttcgaaatttacaacaagaattctggtgcaagttctatgcctgttgtcttcagtatcaagaagccctctctcaccctcttgccctacatttgaatccacacacaaacatggtgtgcctgctgaaaaaagggtacctgtctttccttattccctcatccttagtggatcatttgtatctcctgccttatgagaaccttttgacagaagatgagacaaccatatctgatgatgtggatatcgctcgggatgtcatatgtcttataaaatgcctccggctgattgaagagtcagtaactgtggatatgtcagttataatggaaatgagttgttataacctacagtctccggaaaaggctgcagagcagattctggaagatatgatcactattgatgtagaaaatgtgatggaggatatttgtagtaaactgcaagagattaggaacccaatccatgcaattggactacttatacgggaaatggattatgaaacagaagtggaaatggaaaagggattcaatccagctcagcctttgaatattcgaatgaatcttacccagctctatggtagtaacacagcagggtatattgtgtgcagaggggtgcataaaatcgccagtactcgtttcctgatctgcagagatcttttgatcttacagcagctgttaatgaggcttggagatgctgtgatttggggaactggtcagctctttcaagctcagcaagacctactacatcgaacagctcccctactcttatcttattacctcattaaatggggaagtgagtgcttggcaactgatgttccacttgacacactggagtctaatctccaacacttatcagtactggaattaacagactctggtgctttaatggcaaataggtttgtatctagtcctcagactattgtggagttattcttccaagaagttgcaagaaaacacattatatctcacctcttctctcagccaaaggcacctctgagccaaactggattgaattggcctgaaatgattactgcaattaccagttatttattgcagcttttatggcctagcaatcctggttgtctctttctagaatgtttgatgggaaattgccaatatgtacaattgcaggattatattcaactgctacatccctggtgtcaagtcaatgttggttcctgtcgatttatgctgggaaggtgttacctagttacaggagaaggacagaaggctctggaatgtttttgtcaggcagcatctgaagtaggcaaagaggaattcttggatcgcttgattcgctcagaggatggggagatcgtgtctacccccaggctgcagtattatgacaaggttttacgactactagatgtcattggtttgcctgaactggttattcagttggctacatcagccataactgaagcaggtgatgactggaaaagtcaggctactctaaggacatgtattttcaaacatcatttggatttgggtcacaatagccaagcatatgaagccttaacccaaattcctgattccagcaggcaattagattgtttacggcagttggtggtagttctttgtgaacgctcacagctacaggatcttgtagagtttccctatgtgaatctgcataatgaggttgtgggaataattgagtcacgtgctagagctgtggaccttatgactcacaattactatgaacttctgtatgcctttcacatctatcgccacaattaccgcaaggctggcacagtgatgtttgagtatggaatgcggcttggcagagaagttcgaactctccggggacttgagaaacaaggcaactgttatctggctgctctcaattgtttacgacttattcgtccagaatatgcgtggattgtgcagccagtgtctggtgcagtgtatgatcgccctggagcatcccctaagaggaatcatgatggagaatgcacagctgcccccacaaatcgacaaattgaaatcctggaactggaagatctggagaaagagtgttccttggctcgcatccgcctcactttggctcagcatgatccatcagcggttgcagttgctggaagttcatcagcagaggaaatggtcactctcttggttcaggcgggcctctttgacactgccatatcactctgtcagacttttaagcttcccttaacgccagtctttgaagggcttgccttcaaatgcatcaaattgcaatttggaggagaggcagcacaagcagaagcctgggcctggctagcagccaatcagctctcatctgtcatcactactaaggagtctagtgctacagatgaagcatggcgactattatccacttacctggagaggtacaaagtccagaataacttgtatcaccactgtgtaatcaacaagctcttgtctcatggagtgcctctgcctaattggcttataaacagttacaaggactaccagcaaaaagttgataaggcaacacgggatttattatatcgtcggaccttgtgatttggattgtcacctagcctttgtaaccgcttggtgcctcttaggacttaagactaccctacaggaaccctgtactcaaggccgatttttgtaactgtaaatgatgtgtacaacattcaagtctgcattctgcacaagataggagggcggaagagtcagaggaccctgtgcttgctggtggtgctaacacaatttctggtgttcaaccttggtctcaaatagctgcttttgtatatgattcacgagcttttttagagtttatatttttttaaactaccgaagacattcattatctgcaaattaagactcaccttcactttccaaaatagctgagggttgttggcttgttgtagctgaccaccaaaagcagtcactgcaaatcttttaattcttccctatcaccttttgtattttaatgcaattattttggtccagaactgacctgtattttctgtattgtacacaaaagctaataattttgtgtactttttatttattttggaggttttatatgatcttcaattgagtattaaataatttgcctagattaagcctaaaatgatgaccagctaattaaagaagatattttgaatctggttctgagctaaagttgagtaaattcttagctaagaaaaaattggaaatccatcatctatattagcaacagattctcagagtaaattgttaacttctatgatttatgataatcaagctggacttgatcatacaagttagtctcataatgtattggaccaaaatgtaaacttcattggtcagatttagaagcattcatgctcacaagttttgggaaagtgaaaaataataaaatcatcttggattttattctgtatattaaaatttatcttttaaggaaacaatctgtatactacttgcttgtatagccttttgacccttcttgagtttttcagaagcctttaatttttatactttcaataccatatttacattatatactttaattaacaatgtgagtttctctgtga

SEQ ID NO: 24669 - DNA, 5241 bp, Homo sapiens
agccggccactggaaggttcccgcagatagagtctgcctcccctgcccccttctcttctggattcctcgctgcccaccctcattctcccggtggaagcctcgcaacgaagggccggagccgcctttctgctcccggaatgcttcacctgtccgcagctccgcccgccccacccccggaagtgacggcgaccgcgcggccctgcctttgttccgttgggcgtcgcggcgacggcgggaagatggcggcggcgggagccctggaacggagcttcgtggagctaagcggagctgagcgcgaaaggccgaggcactttcgggaattcacagtctgcagcattgggactgcaaatgccgtggctggcgccgtaaaatacagtgaaagcgcgggaggcttttactacgtggagagtggcaagttgttctccgtaaccagaaacaggttcattcattggagttggtagttgacagtcagatgcagtcaatattcactgacattggaaaagttgatttcacagatccttgcaactatcagttaattccagcagtacctggaatatctcctaattccaccgcctctacagcctggctcagcagtgatggggaggccctgtttgccttaccatgtgcttctgggggaatctttgttcttaagctacctccttatgacatacctggtatggtgtcagtcgtggaactgaaacagagttcagtaatgcaacgattgcttacaggctggatgccaacagctatcaggggtgaccagtcgccttcagatcgtcccctcagtcttgctgttcattgtgtggagcatgatgccttcatctttgctttgtgtcaggatcataaactacgaatgtggtcttacaaggagcaaatgtgcctaatggtagctgacatgctggagtatgtccctgtgaagaaagaccttcggcttactgctggaactggacacaaattacggcttgcttattcccccaccatgggactctacctggggatatacatgcatgcaccaaaacgaggacagttctgcattttccagttggtgagcactgagagtaatcgctatagtctcgatcatatttcttcactgttcacttctcaggagacactgattgactttgccttaacttccacggatatctgggccctgtggcatgatgctgagaaccaaacagtagtgaaatacatcaactttgaacataatgttgcaggtcagtggaatccagtttttatgcagcctctgccagaggaagagattgtcatcagagatgatcaagaccccagagagatgtatctgcaaagtctttttacaccaggacaattcacaaatgaagctttatgtaaggctttacagattttctgccgaggaactgagaggaatttggatctttcctggagtgaactgaagaaagaagttactttagctgttgaaaatgagcttcaaggaagtgtaacagagtatgaattctcccaggaggagtttcgaaatttacaacaagaattctggtgcaagttctatgcctgttgtcttcagtatcaagaagccctctctcaccctcttgccctacatttgaatccacacacaaacatggtgtgcctgctgaaaaaagggtacctgtctttccttattccctcatccttagtggatcatttgtatctcctgccttatgagaaccttttgacagaagatgagacaaccatatctgatgatgtggatatcgctcgggatgtcatatgtcttataaaatgcctccggctgattgaagagtcagtaactgtggatatgtcagttataatggaaatgagttgttataacctacagtctccggaaaaggctgcagagcagattctggaagatatgatcactattgatgtagaaaatgtgatggaggatatttgtagtaaactgcaagagattaggaacccaatccatgcaattggactacttatacgggaaatggattatgaaacagaagtggaaatggaaaagggattcaatccagctcagcctttgaatattcgaatgaatcttacccagctctatggtagtaacacagcagggtatattgtgtgcagaggggtgcataaaatcgccagtactcgtttcctgatctgcagagatcttttgatcttacagcagctgttaatgaggcttggagatgctgtgatttggggaactggtcagctctttcaagctcagcaagacctactacatcgaacagctcccctactcttatcttattacctcattaaatggggaagtgagtgcttggcaactgatgttccacttgacacactggagtctaatctccaacacttatcagtactggaattaacagactctggtgctttaatggcaaataggtttgtatctagtcctcagactattgtggagttattcttccaagaagttgcaagaaaacacattatatctcacctcttctctcagccaaaggcacctctgagccaaactggattgaattggcctgaaatgattactgcaattaccagttatttattgcagcttttatggcctagcaatcctggttgtctctttctagaatgtttgatgggaaattgccaatatgtacaattgcaggattatattcaactgctacatccctggtgtcaagtcaatgttggttcctgtcgatttatgctgggaaggtgttacctagttacaggagaaggacagaaggctctggaatgtttttgtcaggcagcatctgaagtaggcaaagaggaattcttggatcgcttgattcgctcagaggatggggagatcgtgtctacccccaggctgcagtattatgacaaggttttacgactactagatgtcattggtttgcctgaactggttattcagttggctacatcagccataactgaagcaggtgatgactggaaaagtcaggctactctaaggacatgtattttcaaacatcatttggatttgggtcacaatagccaagcatatgaagccttaacccaaattcctgattccagcaggcaattagattgtttacggcagttggtggtagttctttgtgaacgctcacagctacaggatcttgtagagtttccctatgtgaatctgcataatgaggttgtgggaataattgagtcacgtgctagagctgtggaccttatgactcacaattactatgaacttctgtatgcctttcacatctatcgccacaattaccgcaaggctggcacagtgatgtttgagtatggaatgcggcttggcagagaagttcgaactctccggggacttgagaaacaaggcaactgttatctggctgctctcaattgtttacgacttattcgtccagaatatgcgtggattgtgcagccagtgtctggtgcagtgtatgatcgccctggagcatcccctaagaggaatcatgatggagaatgcacagctgcccccacaaatcgacaaattgaaatcctggaactggaagatctggagaaagagtgttccttggctcgcatccgcctcactttggctcagcatgatccatcagcggttgcagttgctggaagttcatcagcagaggaaatggtcactctcttggttcaggcgggcctctttgacactgccatatcactctgtcagacttttaagcttcccttaacgccagtctttgaagggcttgccttcaaatgcatcaaattgcaatttggaggagaggcagcacaagcagaagcctgggcctggctagcagccaatcagctctcatctgtcatcactactaaggagtctagtgctacagatgaagcatggcgactattatccacttacctggagaggtacaaagtccagaataacttgtatcaccactgtgtaatcaacaagctcttgtctcatggagtgcctctgcctaattggcttataaacagttacaagaaggttgatgctgctgaattgcttcgtttatacttaaactatgaccttttagaagaagctgtggatttggtgtcagaatatgtggatgctgtattgggaaaaggacatcaatacttcggaattgagtttccactgtccgcaacagccccaatggtgtggcttccatactcctctattgatcagcttctccaagctctgggagagaacagtgccaacagtcacaacatcgcactgtcccagaaaatacttgacaaattggaggactaccagcaaaaagttgataaggcaacacgggatttattatatcgtcggaccttgtgatttggattgtcacctagcctttgtaaccgcttggtgcctcttaggacttaagactaccctacaggaaccctgtactcaaggccgatttttgtaactgtaaatgatgtgtacaacattcaagtctgcattctgcacaagataggagggcggaagagtcagaggaccctgtgcttgctggtggtgctaacacaatttctggtgttcaaccttggtctcaaatagctgcttttgtatatgattcacgagcttttttagagtttatatttttttaaactaccgaagacattcattatctgcaaattaagactcaccttcactttccaaaatagctgagggttgttggcttgttgtagctgaccaccaaaagcagtcactgcaaatcttttaattcttccctatcaccttttgtattttaatgcaattattttggtccagaactgacctgtattttctgtattgtacacaaaagctaataattttgtgtactttttatttattttggaggttttatatgatcttcaattgagtattaaataatttgcctagattaagcctaaaatgatgaccagctaattaaagaagatattttgaatctggttctgagctaaagttgagtaaattcttagctaagaaaaaattggaaatccatcatctatattagcaacagattctcagagtaaattgttaacttctatgatttatgataatcaagctggacttgatcatacaagttagtctcataatgtattggaccaaaatgtaaacttcattggtcagatttagaagcattcatgctcacaagttttgggaaagtgaaaaataataaaatcatcttggattttattctgtatattaaaatttatcttttaaggaaacaatctgtatactacttgcttgtatagccttttgacccttcttgagtttttcagaagcctttaatttttatactttcaataccatatttacattatatactttaattaacaatgtgagtttctctgtga

SEQ ID NO: 24670 - DNA, 5712 bp, Homo sapiens
agccggccactggaaggttcccgcagatagagtctgcctcccctgcccccttctcttctggattcctcgctgcccaccctcattctcccggtggaagcctcgcaacgaagggccggagccgcctttctgctcccggaatgcttcacctgtccgcagctccgcccgccccacccccggaagtgacggcgaccgcgcggccctgcctttgttccgttgggcgtcgcggcgacggcgggaagatggcggcggcgggagccctggaacggagcttcgtggagctaagcggagctgagcgcgaaaggccgaggcactttcgggaattcacagtctgcagcattgggactgcaaatgccgtggctggcgccgtaaaatacagtgaaagcgcgggaggcttttactacgtggagagtggcaagttgttctccgtaaccagaaacaggttcattcattggaagacctctggagatacattggagctgatggaggagtcactggacataaatctgttgaataatgccattcgcctaaaattccaaaattgcagtgttttacctggaggggtttatgtctctgagactcagaatcgtgtgataatcttgatgttaaccaatcaaacagtgcacaggttacttttaccacacccctcccggatgtataggagtgtaagttggctaagtgcaatatcttttatttcccaaattactctgggtgtcacaaatgtagtgctggagcgatgtcttttggaattgaaggaaatttggattctcgttatccctcaccaagcatactttgatagctaccgcttaaaatgatcaggcatacattttaagttgagaattagttttcattaagaagaatagctttcttaaacttgacagttttttactttaaaaacttttttagcaatagagaggaactgagcaaaattctggttattttgatttaatagatttttctttttaattactcaacaggagttggtagttgacagtcagatgcagtcaatattcactgacattggaaaagttgatttcacagatccttgcaactatcagttaattccagcagtacctggaatatctcctaattccaccgcctctacagcctggctcagcagtgatggggaggccctgtttgccttaccatgtgcttctgggggaatctttgttcttaagctacctccttatgacatacctggtatggtgtcagtcgtggaactgaaacagagttcagtaatgcaacgattgcttacaggctggatgccaacagctatcaggggtgaccagtcgccttcagatcgtcccctcagtcttgctgttcattgtgtggagcatgatgccttcatctttgctttgtgtcaggatcataaactacgaatgtggtcttacaaggagcaaatgtgcctaatggtagctgacatgctggagtatgtccctgtgaagaaagaccttcggcttactgctggaactggacacaaattacggcttgcttattcccccaccatgggactctacctggggatatacatgcatgcaccaaaacgaggacagttctgcattttccagttggtgagcactgagagtaatcgctatagtctcgatcatatttcttcactgttcacttctcaggagacactgattgactttgccttaacttccacggatatctgggccctgtggcatgatgctgagaaccaaacagtagtgaaatacatcaactttgaacataatgttgcaggtcagtggaatccagtttttatgcagcctctgccagaggaagagattgtcatcagagatgatcaagaccccagagagatgtatctgcaaagtctttttacaccaggacaattcacaaatgaagctttatgtaaggctttacagattttctgccgaggaactgagaggaatttggatctttcctggagtgaactgaagaaagaagttactttagctgttgaaaatgagcttcaaggaagtgtaacagagtatgaattctcccaggaggagtttcgaaatttacaacaagaattctggtgcaagttctatgcctgttgtcttcagtatcaagaagccctctctcaccctcttgccctacatttgaatccacacacaaacatggtgtgcctgctgaaaaaagggtacctgtctttccttattccctcatccttagtggatcatttgtatctcctgccttatgagaaccttttgacagaagatgagacaaccatatctgatgatgtggatatcgctcgggatgtcatatgtcttataaaatgcctccggctgattgaagagtcagtaactgtggatatgtcagttataatggaaatgagttgttataacctacagtctccggaaaaggctgcagagcagattctggaagatatgatcactattgatgtagaaaatgtgatggaggatatttgtagtaaactgcaagagattaggaacccaatccatgcaattggactacttatacgggaaatggattatgaaacagaagtggaaatggaaaagggattcaatccagctcagcctttgaatattcgaatgaatcttacccagctctatggtagtaacacagcagggtatattgtgtgcagaggggtgcataaaatcgccagtactcgtttcctgatctgcagagatcttttgatcttacagcagctgttaatgaggcttggagatgctgtgatttggggaactggtcagctctttcaagctcagcaagacctactacatcgaacagctcccctactcttatcttattacctcattaaatggggaagtgagtgcttggcaactgatgttccacttgacacactggagtctaatctccaacacttatcagtactggaattaacagactctggtgctttaatggcaaataggtttgtatctagtcctcagactattgtggagttattcttccaagaagttgcaagaaaacacattatatctcacctcttctctcagccaaaggcacctctgagccaaactggattgaattggcctgaaatgattactgcaattaccagttatttattgcagcttttatggcctagcaatcctggttgtctctttctagaatgtttgatgggaaattgccaatatgtacaattgcaggattatattcaactgctacatccctggtgtcaagtcaatgttggttcctgtcgatttatgctgggaaggtgttacctagttacaggagaaggacagaaggctctggaatgtttttgtcaggcagcatctgaagtaggcaaagaggaattcttggatcgcttgattcgctcagaggatggggagatcgtgtctacccccaggctgcagtattatgacaaggttttacgactactagatgtcattggtttgcctgaactggttattcagttggctacatcagccataactgaagcaggtgatgactggaaaagtcaggctactctaaggacatgtattttcaaacatcatttggatttgggtcacaatagccaagcatatgaagccttaacccaaattcctgattccagcaggcaattagattgtttacggcagttggtggtagttctttgtgaacgctcacagctacaggatcttgtagagtttccctatgtgaatctgcataatgaggttgtgggaataattgagtcacgtgctagagctgtggaccttatgactcacaattactatgaacttctgtatgcctttcacatctatcgccacaattaccgcaaggctggcacagtgatgtttgagtatggaatgcggcttggcagagaagttcgaactctccggggacttgagaaacaaggcaactgttatctggctgctctcaattgtttacgacttattcgtccagaatatgcgtggattgtgcagccagtgtctggtgcagtgtatgatcgccctggagcatcccctaagaggaatcatgatggagaatgcacagctgcccccacaaatcgacaaattgaaatcctggaactggaagatctggagaaagagtgttccttggctcgcatccgcctcactttggctcagcatgatccatcagcggttgcagttgctggaagttcatcagcagaggaaatggtcactctcttggttcaggcgggcctctttgacactgccatatcactctgtcagacttttaagcttcccttaacgccagtctttgaagggcttgccttcaaatgcatcaaattgcaatttggaggagaggcagcacaagcagaagcctgggcctggctagcagccaatcagctctcatctgtcatcactactaaggagtctagtgctacagatgaagcatggcgactattatccacttacctggagaggtacaaagtccagaataacttgtatcaccactgtgtaatcaacaagctcttgtctcatggagtgcctctgcctaattggcttataaacagttacaagaagaagctgtggatttggtgtcagaatatgtggatgctgtattgggaaaaggacatcaatacttcggaattgagtttccactgtccgcaacagccccaatggtgtggcttccatactcctctattgatcagcttctccaagctctgggagagaacagtgccaacagtcacaacatcgcactgtcccagaaaatacttgacaaattggaggactaccagcaaaaagttgataaggcaacacgggatttattatatcgtcggaccttgtgatttggattgtcacctagcctttgtaaccgcttggtgcctcttaggacttaagactaccctacaggaaccctgtactcaaggccgatttttgtaactgtaaatgatgtgtacaacattcaagtctgcattctgcacaagataggagggcggaagagtcagaggaccctgtgcttgctggtggtgctaacacaatttctggtgttcaaccttggtctcaaatagctgcttttgtatatgattcacgagcttttttagagtttatatttttttaaactaccgaagacattcattatctgcaaattaagactcaccttcactttccaaaatagctgagggttgttggcttgttgtagctgaccaccaaaagcagtcactgcaaatcttttaattcttccctatcaccttttgtattttaatgcaattattttggtccagaactgacctgtattttctgtattgtacacaaaagctaataattttgtgtactttttatttattttggaggttttatatgatcttcaattgagtattaaataatttgcctagattaagcctaaaatgatgaccagctaattaaagaagatattttgaatctggttctgagctaaagttgagtaaattcttagctaagaaaaaattggaaatccatcatctatattagcaacagattctcagagtaaattgttaacttctatgatttatgataatcaagctggacttgatcatacaagttagtctcataatgtattggaccaaaatgtaaacttcattggtcagatttagaagcattcatgctcacaagttttgggaaagtgaaaaataataaaatcatcttggattttattctgtatattaaaatttatcttttaaggaaacaatctgtatactacttgcttgtatagccttttgacccttcttgagtttttcagaagcctttaatttttatactttcaataccatatttacattatatactttaattaacaatgtgagtttctctgtga

SEQ ID NO: 24671 - DNA, 4447 bp, Homo sapiens
agccggccactggaaggttcccgcagatagagtctgcctcccctgcccccttctcttctggattcctcgctgcccaccctcattctcccggtggaagcctcgcaacgaagggccggagccgcctttctgctcccggaatgcttcacctgtccgcagctccgcccgccccacccccggaagtgacggcgaccgcgcggccctgcctttgttccgttgggcgtcgcggcgacggcgggaagatggcggcggcgggagccctggaacggagcttcgtggagctaagcggagctgagcgcgaaaggccgaggcactttcgggaattcacagtctgcagcattgggactgcaaatgccgtggctggcgccgtaaaatacagtgaaagcgcgggaggcttttactacgtggagagtggcaagttgttctccgtaaccagaaacaggttcattcattggaagacctctggagatacattggagctgatggaggagtcactggacataaatctgttgaataatgccattcgcctaaaattccaaaattgcagtgttttacctggaggggtttatgtctctgagactcagaatcgtgtgataatcttgatgttaaccaatcaaacagtgcacaggttacttttaccacacccctcccggatgtataggagtgtaagttggctaagtgcaatatcttttatttcccaaattactctgggtgtcacaaatgtagtgctggagcgatgtcttttggaattgaaggaaatttggattctcgttatccctcaccaagcatactttgatagctaccgcttaaaatgatcaggcatacattttaagttgagaattagttttcattaagaagaatagctttcttaaacttgacagttttttactttaaaaacttttttagcaatagagaggaactgagcaaaattctggttattttgatttaatagatttttctttttaattactcaacaggagttggtagttgacagtcagatgcagtcaatattcactgacattggaaaagttgatttcacagatccttgcaactatcagttaattccagcagtacctggaatatctcctaattccaccgcctctacagcctggctcagcagtgatggggaggccctgtttgccttaccatgtgcttctgggggaatctttgttcttaagctacctccttatgacatacctggtatggtgtcagtcgtggaactgaaacagagttcagtaatgcaacgattgcttacaggctggatgccaacagctatcaggggtgaccagtcgccttcagatcgtcccctcagtcttgctgttcattgtgtggagcatgatgccttcatctttgctttgtgtcaggatcataaactacgaatgtggtcttacaaggagcaaatgtgcctaatggtagctgacatgctggagtatgtccctgtgaagaaagaccttcggcttactgctggaactggacacaaattacggcttgcttattcccccaccatgggactctacctggggatatacatgcatgcaccaaaacgaggacagttctgcattttccagttggtgagcactgagagtaatcgctatagtctcgatcatatttcttcactgttcacttctcaggagacactgattgactttgccttaacttccacggatatctgggccctgtggcatgatgctgagaaccaaacagtagtgaaatacatcaactttgaacataatgttgcaggtcagtggaatccagtttttatgcagcctctgccagaggaagagattgtcatcagagatgatcaagaccccagagagatgtatctgcaaagtctttttacaccaggacaattcacaaatgaagctttatgtaaggctttacagattttctgccgaggaactgagaggaatttggatctttcctggagtgaactgaagaaagaagttactttagctgttgaaaatgagcttcaaggaagtgtaacagagtatgaattctcccaggaggagtttcgaaatttacaacaagaattctggtgcaagttctatgcctgttgtcttcagtatcaagaagccctctctcaccctcttgccctacatttgaatccacacacaaacatggtgtgcctgctgaaaaaagggtacctgtctttccttattccctcatccttagtggatcatttgtatctcctgccttatgagaaccttttgacagaagatgagacaaccatatctgatgatgtggatatcgctcgggatgtcatatgtcttataaaatgcctccggctgattgaagagtcagtaactgtggatatgtcagttataatggaaatgagttgttataacctacagtctccggaaaaggctgcagagcagattctggaagatatgatcactattgatgtagaaaatgtgatggaggatatttgtagtaaactgcaagagattaggaacccaatccatgcaattggactacttatacgggaaatggattatgaaacagaagtggaaatggaaaagggattcaatccagctcagcctttgaatattcgaatgaatcttacccagctctatggtagtaacacagcagggtatattgtgtgcagaggggtgcataaaatcgccagtactcgtttcctgatctgcagagatcttttgatcttacagcagctgttaatgaggcttggagatgctgtgatttggggaactggtcagctctttcaagctcagcaagacctactacatcgaacagctcccctactcttatcttattacctcattaaatggggaagtgagtgcttggcaactgatgttccacttgacacactggagtctaatctccaacacttatcagtactggaattaacagactctggtgctttaatggcaaataggtttgtatctagtcctcagactattgtggagttattcttccaagaagttgcaagaaaacacattatatctcacctcttctctcagccaaaggcacctctgagccaaactggattgaattggcctgaaatgattactgcaattaccagttatttattgcagcttttatggcctagcaatcctggttgtctctttctagaatgtttgatgggaaattgccaatatgtacaattgcaggattatattcaactgctacatccctggtgtcaagtcaatgttggttcctgtcgatttatgctgggaaggtgttacctagttacaggagaaggacagaaggctctggaatgtttttgtcaggcagcatctgaagtaggcaaagaggaattcttggatcgcttgattcgctcagaggatggggagatcgtgtctacccccaggctgcagtattatgacaaggttttacgactactagatgtcattggtttgcctgaactggttattcagttggctacatcagccataactgaagcaggtgatgactggaaaagtcaggctactctaaggacatgtattttcaaacatcatttggatttgggtcacaatagccaagcatatgaagccttaacccaaattcctgattccagcaggcaattagattgtttacggcagttggtggtagttctttgtgaacgctcacagctacaggatcttgtagagtttccctatgtgaatctgcataatgaggttgtgggaataattgagtcacgtgctagagctgtggaccttatgactcacaattactatgaacttctgtatgcctttcacatctatcgccacaattaccgcaaggctggcacagtgatgtttgagtatggaatgcggcttggcagagaagttcgaactctccggggacttgagaaacaaggcaactgttatctggctgctctcaattgtttacgacttattcgtccagaatatgcgtggattgtgcagccagtgtctggtgcagtgtatgatcgccctggagcatcccctaagaggaatcatgatggagaatgcacagctgcccccagtgagtcaggagtctcacactggttctttgctagacagtagtaatgttgttattgttagttgtattatgatagaaatatgtagttaaataagctacatataatagtaatatataaatgttatagtagtaacagttgcccttgtaaaacacaagttttaactgcaggcacctattatacacagatttttgttttcaataagtatattggattctttttctggagattgtcacaatttgaaaaaactcccagttgaaccacatagcctagaaatattgaaaaagttaaggaagccgggtgtggtggctcacacctgtaatcccagcaccttgggaggccgaggcaggtggatcacctgaggtcaggtgttcaagaccagcctggtcagtgtggcgaaaccccatctctactaaaaatacaaaaattagctgggcagtagtggccctcacctgtaatcccagctactcaggaggcttgaggcaggagaat

SEQ ID NO: 24672 - DNA, 3987 bp, Homo sapiens
agccggccactggaaggttcccgcagatagagtctgcctcccctgcccccttctcttctggattcctcgctgcccaccctcattctcccggtggaagcctcgcaacgaagggccggagccgcctttctgctcccggaatgcttcacctgtccgcagctccgcccgccccacccccggaagtgacggcgaccgcgcggccctgcctttgttccgttgggcgtcgcggcgacggcgggaagatggcggcggcgggagccctggaacggagcttcgtggagctaagcggagctgagcgcgaaaggccgaggcactttcgggaattcacagtctgcagcattgggactgcaaatgccgtggctggcgccgtaaaatacagtgaaagcgcgggaggcttttactacgtggagagtggcaagttgttctccgtaaccagaaacaggttcattcattggaagacctctggagatacattggagctgatggaggagtcactggacataaatctgttgaataatgccattcgcctaaaattccaaaattgcagtgttttacctggaggggtttatgtctctgagactcagaatcgtgtgataatcttgatgttaaccaatcaaacagtgcacaggttacttttaccacacccctcccggatgtataggagtgtaagttggctaagtgcaatatcttttatttcccaaattactctgggtgtcacaaatgtagtgctggagcgatgtcttttggaattgaaggaaatttggattctcgttatccctcaccaagcatactttgatagctaccgcttaaaatgatcaggcatacattttaagttgagaattagttttcattaagaagaatagctttcttaaacttgacagttttttactttaaaaacttttttagcaatagagaggaactgagcaaaattctggttattttgatttaatagatttttctttttaattactcaacaggagttggtagttgacagtcagatgcagtcaatattcactgacattggaaaagttgatttcacagatccttgcaactatcagttaattccagcagtacctggaatatctcctaattccaccgcctctacagcctggctcagcagtgatggggaggccctgtttgccttaccatgtgcttctgggggaatctttgttcttaagctacctccttatgacatacctggtatggtgtcagtcgtggaactgaaacagagttcagtaatgcaacgattgcttacaggctggatgccaacagctatcaggggtgaccagtcgccttcagatcgtcccctcagtcttgctgttcattgtgtggagcatgatgccttcatctttgctttgtgtcaggatcataaactacgaatgtggtcttacaaggagcaaatgtgcctaatggtagctgacatgctggagtatgtccctgtgaagaaagaccttcggcttactgctggaactggacacaaattacggcttgcttattcccccaccatgggactctacctggggatatacatgcatgcaccaaaacgaggacagttctgcattttccagttggtgagcactgagagtaatcgctatagtctcgatcatatttcttcactgttcacttctcaggagacactgattgactttgccttaacttccacggatatctgggccctgtggcatgatgctgagaaccaaacagtagtgaaatacatcaactttgaacataatgttgcaggtcagtggaatccagtttttatgcagcctctgccagaggaagagattgtcatcagagatgatcaagaccccagagagatgtatctgcaaagtctttttacaccaggacaattcacaaatgaagctttatgtaaggctttacagattttctgccgaggaactgagaggaatttggatctttcctggagtgaactgaagaaagaagttactttagctgttgaaaatgagcttcaaggaagtgtaacagagtatgaattctcccaggaggagtttcgaaatttacaacaagaattctggtgcaagttctatgcctgttgtcttcagtatcaagaagccctctctcaccctcttgccctacatttgaatccacacacaaacatggtgtgcctgctgaaaaaagggtacctgtctttccttattccctcatccttagtggatcatttgtatctcctgccttatgagaaccttttgacagaagatgagacaaccatatctgatgatgtggatatcgctcgggatgtcatatgtcttataaaatgcctccggctgattgaagagtcagtaactgtggatatgtcagttataatggaaatgagttgttataacctacagtctccggaaaaggctgcagagcagattctggaagatatgatcactattgatgtagaaaatgtgatggaggatatttgtagtaaactgcaagagattaggaacccaatccatgcaattggactacttatacgggaaatggattatgaaacagaagtggaaatggaaaagggattcaatccagctcagcctttgaatattcgaatgaatcttacccagctctatggtagtaacacagcagggtatattgtgtgcagaggggtgcataaaatcgccagtactcgtttcctgatctgcagagatcttttgatcttacagcagctgttaatgaggcttggagatgctgtgatttggggaactggtcagctctttcaagctcagcaagacctactacatcgaacagctcccctactcttatcttattacctcattaaatggggaagtgagtgcttggcaactgatgttccacttgacacactggagtctaatctccaacacttatcagtactggaattaacagactctggtgctttaatggcaaataggtttgtatctagtcctcagactattgtggagttattcttccaagaagttgcaagaaaacacattatatctcacctcttctctcagccaaaggcacctctgagccaaactggattgaattggcctgaaatgattactgcaattaccagttatttattgcagcttttatggcctagcaatcctggttgtctctttctagaatgtttgatgggaaattgccaatatgtacaattgcaggattatattcaactgctacatccctggtgtcaagtcaatgttggttcctgtcgatttatgctgggaaggtgttacctagttacaggagaaggacagaaggctctggaatgtttttgtcaggcagcatctgaagtaggcaaagaggaattcttggatcgcttgattcgctcagaggatggggagatcgtgtctacccccaggctgcagtattatgacaaggttttacgactactagatgtcattggtttgcctgaactggttattcagttggctacatcagccataactgaagcaggtgatgactggaaaagtcaggctactctaaggacatgtattttcaaacatcatttggatttgggtcacaatagccaagcatatgaagccttaacccaaattcctgattccagcaggcaattagattgtttacggcagttggtggtagttctttgtgaacgctcacagctacaggatcttgtagagtttccctatgtgaatctgcataatgaggttgtgggaataattgagtcacgtgctagagctgtggaccttatgactcacaattactatgaacttctgtatgcctttcacatctatcgccacaattaccgcaaggctggcacagtgatgtttgagtatggaatgcggcttggcagagaagttcgaactctccggggacttgagaaacaaggcaactgttatctggctgctctcaattgtttacgacttattcgtccagaatatgcgtggattgtgcagccagtgtctggtgcagtggtatgaaaacatttcatcctggaatttgggggttcatcctggaacaagtaaatctacttgttttggtcctttcaaaactattgtgtca

SEQ ID NO: 24673 - DNA, 3324 bp, Homo sapiens
agccggccactggaaggttcccgcagatagagtctgcctcccctgcccccttctcttctggattcctcgctgcccaccctcattctcccggtggaagcctcgcaacgaagggccggagccgcctttctgctcccggaatgcttcacctgtccgcagctccgcccgccccacccccggaagtgacggcgaccgcgcggccctgcctttgttccgttgggcgtcgcggcgacggcgggaagatggcggcggcgggagccctggaacggagcttcgtggagctaagcggagctgagcgcgaaaggccgaggcactttcgggaattcacagtctgcagcattgggactgcaaatgccgtggctggcgccgtaaaatacagtgaaagcgcgggaggcttttactacgtggagagtggcaagttgttctccgtaaccagaaacaggttcattcattggaagacctctggagatacattggagctgatggaggagtcactggacataaatctgttgaataatgccattcgcctaaaattccaaaattgcagtgttttacctggaggggtttatgtctctgagactcagaatcgtgtgataatcttgatgttaaccaatcaaacagtgcacaggttacttttaccacacccctcccggatgtataggagtgtaagttggctaagtgcaatatcttttatttcccaaattactctgggtgtcacaaatgtagtgctggagcgatgtcttttggaattgaaggaaatttggattctcgttatccctcaccaagcatactttgatagctaccgcttaaaatgatcaggcatacattttaagttgagaattagttttcattaagaagaatagctttcttaaacttgacagttttttactttaaaaacttttttagcaatagagaggaactgagcaaaattctggttattttgatttaatagatttttctttttaattactcaacaggagttggtagttgacagtcagatgcagtcaatattcactgacattggaaaagttgatttcacagatccttgcaactatcagttaattccagcagtacctggaatatctcctaattccaccgcctctacagcctggctcagcagtgatggggaggccctgtttgccttaccatgtgcttctgggggaatctttgttcttaagctacctccttatgacatacctggtatggtgtcagtcgtggaactgaaacagagttcagtaatgcaacgattgcttacaggctggatgccaacagctatcaggggtgaccagtcgccttcagatcgtcccctcagtcttgctgttcattgtgtggagcatgatgccttcatctttgctttgtgtcaggatcataaactacgaatgtggtcttacaaggagcaaatgtgcctaatggtagctgacatgctggagtatgtccctgtgaagaaagaccttcggcttactgctggaactggacacaaattacggcttgcttattcccccaccatgggactctacctggggatatacatgcatgcaccaaaacgaggacagttctgcattttccagttggtgagcactgagagtaatcgctatagtctcgatcatatttcttcactgttcacttctcaggagacactgattgactttgccttaacttccacggatatctgggccctgtggcatgatgctgagaaccaaacagtagtgaaatacatcaactttgaacataatgttgcaggtcagtggaatccagtttttatgcagcctctgccagaggaagagattgtcatcagagatgatcaagaccccagagagatgtatctgcaaagtctttttacaccaggacaattcacaaatgaagctttatgtaaggctttacagattttctgccgaggaactgagaggaatttggatctttcctggagtgaactgaagaaagaagttactttagctgttgaaaatgagcttcaaggaagtgtaacagagtatgaattctcccaggaggagtttcgaaatttacaacaagaattctggtgcaagttctatgcctgttgtcttcagtatcaagaagccctctctcaccctcttgccctacatttgaatccacacacaaacatggtgtgcctgctgaaaaaagggtacctgtctttccttattccctcatccttagtggatcatttgtatctcctgccttatgagaaccttttgacagaagatgagacaaccatatctgatgatgtggatatcgctcgggatgtcatatgtcttataaaatgcctccggctgattgaagagtcagtaactgtggatatgtcagttataatggaaatgagttgttataacctacagtctccggaaaaggctgcagagcagattctggaagatatgatcactattgatgtagaaaatgtgatggaggatatttgtagtaaactgcaagagattaggaacccaatccatgcaattggactacttatacgggaaatggattatgaaacagaagtggaaatggaaaagggattcaatccagctcagcctttgaatattcgaatgaatcttacccagctctatggtagtaacacagcagggtatattgtgtgcagaggggtgcataaaatcgccagtactcgtttcctgatctgcagagatcttttgatcttacagcagctgttaatgaggcttggagatgctgtgatttggggaactggtcagctctttcaagctcagcaagacctactacatcgaacagctcccctactcttatcttattacctcattaaatggggaagtgagtgcttggcaactgatgttccacttgacacactggagtctaatctccaacacttatcagtactggaattaacagactctggtgctttaatggcaaataggtttgtatctagtcctcagactattgtggagttattcttccaagaagttgcaagaaaacacattatatctcacctcttctctcagccaaaggcacctctgagccaaactggattgaattggcctgaaatgattactgcaattaccagttatttattgcagcttttatggcctagcaatcctggttgtctctttctagaatgtttgatgggaaattgccaatatgtacaattgcaggtgagttcctgtgaacatttcatgtctacacattcttgtaaagcatgggattgctgaatttttttctttgtaaatgttaactgcattttaaagaaccacaataatttaaacttgattatgtgaagacataccccaaagagattgttctctatttctataccatcctgaacttgcttgattttgtctgatctacgaagct

SEQ ID NO: 24674 - DNA, 417 bp, Homo sapiens
catgatatatggaacaaaatttcatttagactttaccaaattcatgtggtaccatgttttgttttcatacatttacctctcctactgatgaaaaagtaagtcaccgtgaactactactttctttcttattttatccctttttttcccacatttcctcctaggagacactgattgactttgccttaacttccacggatatctgggccctgtggcatgatgctgagaaccaaacagtagtgaaatacatcaactttgaacagtatgggtcacttaattctgtcatcctacctcaccccaagcaatttcatgctaagaagacgagaggccgggcgccgtgtctcatgcctgtaatcctaacactttgagaggccgaggcaggcaaatcacttaagctcaggagttcgagaccaggctggg

SEQ ID NO: 24675 - DNA, 411 bp, Homo sapiens
cgagattcacattttcaataagataaaccatcctgtttgctctggctcctcattgaagggtcacgaagtgatattatgggcaacaatctatattataatgatttccaattttttttgtgctttcagtggagcttttatgtgcaatttattaattaaattgacagtgttcttcgtagaagagcttgtagaagtaatgtttagcataggagaatttactaagctgtcttttccccttttctcacagggagtctaatctccaacacttatcagtactggaattaacagactctggtgctttaatggcaaataggtttggtaaggagtggactatgtacacatttcattttaaactggggatttattgcatattcattaaagtggtcttttgccacctttgccatagaaaggttg

SEQ ID NO: 24676 - DNA, 710 bp, Homo sapiens
ggtacctgtctttccttattccctcatccttagtggatcatttgtatctcctgccttatgagaaccttttgacagaagatgagacaaccatatctgatggtaatagtaattgttatgtccatatttaatccccttcctatataaaccctatgcttcgtttcacatggatacaaaaaatatcgattgccacacctgtcttggtcactttaccacaccacaaatattttaatgaacacttaagagaccaaagcatctctgagacctcagatagatttcttgtcatttaattattaacattttaatgtaatatcaatcaatagattgtcattggcttaagacataaatgttaactttctcttatttgtagatgtggatatcgctcgggatgtcatatgtcttataaaatgcctccggctgattgaagagtcagtaactgtggatatgtcagttataatggaaatgagttgttataacctacagtctccggaaaaggctgcagagcagattctggaagatatgatcactattgatgtgtaaggagaattagggtaaagtgcatttcctaatggaaattcagcatttttagcgccaaagttggaattttaatgtatgttccagagcgtacagaatagtagcttaaagtcaaactgatgcgccatgattctaagtacatatttctacttttaacagaaaatttaacacgacttcaa

SEQ ID NO: 24677 - DNA, 204 bp, Homo sapiens
agcaaaagactagagatgaagttgtcatctatctctctagttttagtatcaaattaaagtggtacgtttcagcgttcagttttcaagtgtggaaccattttcattccagatgcatcaaattgcaatttggaggagaggcagcacaagcagaagcctgggcctggctagcagccaatcagctctcatctgtcatcactactaagg

SEQ ID NO: 24678 - DNA, 351 bp, Homo sapiens
aacagataagggcctcccaaactgcctagaggtaacggctcttagggatttaactttttttttttcctaactccccagatttgttatcagctcttatcctaagatacagatgagtaaaccaagccactggtttaattatattgagaaatacaaatgttagggaatcagccactcaacattctttggtcagtactcaagtaggagggaaataggtacatattcttaatcactgacttttcacagaaggttgatgctgctgaattgcttcgtttatacttaaactatgaccttttagaagaagctgtggatttggtgtcagaatatgtggatgctgtattgggaaaaggacat

SEQ ID NO: 24679 - DNA, 823 bp, Homo sapiens
gagctgttatgtaatgttttccttcttttctcttatagctgtcccagaaaatacttgacaaattggaggactaccagcaaaaagttgataaggcaacacgggatttattatatcgtcggaccttgtgatttggattgtcacctagcctttgtaaccgcttggtgcctcttaggacttaagactaccctacaggaaccctgtactcaaggccgatttttgtaactgtaaatgatgtgtacaacattcaagtctgcattctgcacaagataggagggcggaagagtcagaggaccctgtgcttgctggtggtgctaacacaatttctggtgttcaaccttggtctcaaatagctgcttttgtatatgattcacgagcttttttagagtttatatttttttaaactaccgaagacattcattatctgcaaattaagactcaccttcactttccaaaatagctgagggttgttggcttgttgtagctgaccaccaaaagcagtcactgcaaatcttttaattcttccctatcaccttttgtattttaatgcaattattttggtccagaactgacctgtattttctgtattgtacacaaaagctaataattttgtgtactttttatttattttggaggttttatatgatcttcaattgagtattaaataatttgcctagattaagcctaaaatgatgaccagctaattaaagaagatattttgaatctggttctgagctaaagttgagtaaattcttagctaagaaaaaattggaaatccatcatctatattagcaacagattctcagagtaaattgttaacttctat

SEQ ID NO: 24680 - DNA, 1544 bp, Homo sapiens
agccggccactggaaggttcccgcagatagagtctgcctcccctgcccccttctcttctggattcctcgctgcccaccctcattctcccggtggaagcctcgcaacgaagggccggagccgcctttctgctcccggaatgcttcacctgtccgcagctccgcccgccccacccccggaagtgacggcgaccgcgcggccctgcctttgttccgttgggcgtcgcggcgacggcgggaagatggcggcggcgggagccctggaacggagcttcgtggagctaagcggagctgagcgcgaaaggccgaggcactttcgggaattcacagtctgcagcattgggactgcaaatgccgtggctggcgccgtaaaatacagtgaaagcgcgggaggcttttactacgtggagagtggcaagttgttctccgtaaccagaaacaggttcattcattggaagacctctggagatacattggagctgatggaggagtcactggacataaatctgttgaataatgccattcgcctaaaattccaaaattgcagtgttttacctggaggggtttatgtctctgagactcagaatcgtgtgataatcttgatgttaaccaatcaaacagtgcacaggttacttttaccacacccctcccggatgtataggagtgtaagttggctaagtgcaatatcttttatttcccaaattactctgggtgtcacaaatgtagtgctggagcgatgtcttttggaattgaaggaaatttggattctcgttatccctcaccaagcatactttgatagctaccgcttaaaatgatcaggcatacattttaagttgagaattagttttcattaagaagaatagctttcttaaacttgacagttttttactttaaaaacttttttagcaatagagaggaactgagcaaaattctggttattttgatttaatagatttttctttttaattactcaacaggagttggtagttgacagtcagatgcagtcaatattcactgacattggaaaagttgatttcacagatccttgcaactatcagttaattccagcagtacctggaatatctcctaattccaccgcctctacagcctggctcagcagtgatggggaggccctgtttgccttaccatgtgcttctgggggaatctttgttcttaagctacctccttatgacatacctggtaagaatgggaactgagcatggatttaactttaaacaaggaatgttaacattgaaacagttcaacctcgtcatccaatgcagggattgcatctctactgccccggaactggtcattcattattgcttgcctaatgagtccctaatgctttacttttatacagtggataaggaactataaagcatattggagcacggaaaaacaaatagacaagtataagacagcctattctaaatcttgtagtagagatgggttgcctaattgtctgccctgagatggaggcattataacattataattaaattaattgaaacaaagacattaaataccctgcaccaagttgccac

SEQ ID NO: 24681 - DNA, 5764 bp, Homo sapiens
agccggccactggaaggttcccgcagatagagtctgcctcccctgcccccttctcttctggattcctcgctgcccaccctcattctcccggtggaagcctcgcaacgaagggccggagccgcctttctgctcccggaatgcttcacctgtccgcagctccgcccgccccacccccggaagtgacggcgaccgcgcggccctgcctttgttccgttgggcgtcgcggcgacggcgggaagatggcggcggcgggagccctggaacggagcttcgtggagctaagcggagctgagcgcgaaaggccgaggcactttcgggaattcacagtctgcagcattgggactgcaaatgccgtggctggcgccgtaaaatacagtgaaagcgcgggaggcttttactacgtggagagtggcaagttgttctccgtaaccagaaacaggttcattcattggaagacctctggagatacattggagctgatggaggagtcactggacataaatctgttgaataatgccattcgcctaaaattccaaaattgcagtgttttacctggaggggtttatgtctctgagactcagaatcgtgtgataatcttgatgttaaccaatcaaacagtgcacaggttacttttaccacacccctcccggatgtataggagtgtaagttggctaagtgcaatatcttttatttcccaaattactctgggtgtcacaaatgtagtgctggagcgatgtcttttggaattgaaggaaatttggattctcgttatccctcaccaagcatactttgatagctaccgcttaaaatgatcaggcatacattttaagttgagaattagttttcattaagaagaatagctttcttaaacttgacagttttttactttaaaaacttttttagcaatagagaggaactgagcaaaattctggttattttgatttaatagatttttctttttaattactcaacaggagttggtagttgacagtcagatgcagtcaatattcactgacattggaaaagttgatttcacagatccttgcaactatcagttaattccagcagtacctggaatatctcctaattccaccgcctctacagcctggctcagcagtgatggggaggccctgtttgccttaccatgtgcttctgggggaatctttgttcttaagctacctccttatgacatacctggtatggtgtcagtcgtggaactgaaacagagttcagtaatgcaacgattgcttacaggctggatgccaacagctatcaggggtgaccagtcgccttcagatcgtcccctcagtcttgctgttcattgtgtggagcatgatgccttcatctttgctttgtgtcaggatcataaactacgaatgtggtcttacaaggagcaaatgtgcctaatggtagctgacatgctggagtatgtccctgtgaagaaagaccttcggcttactgctggaactggacacaaattacggcttgcttattcccccaccatgggactctacctggggatatacatgcatgcaccaaaacgaggacagttctgcattttccagttggtgagcactgagagtaatcgctatagtctcgatcatatttcttcactgttcacttctcaggagacactgattgactttgccttaacttccacggatatctgggccctgtggcatgatgctgagaaccaaacagtagtgaaatacatcaactttgaacataatgttgcaggtcagtggaatccagtttttatgcagcctctgccagaggaagagattgtcatcagagatgatcaagaccccagagagatgtatctgcaaagtctttttacaccaggacaattcacaaatgaagctttatgtaaggctttacagattttctgccgaggaactgagaggaatttggatctttcctggagtgaactgaagaaagaagttactttagctgttgaaaatgagcttcaaggaagtgtaacagagtatgaattctcccaggaggagtttcgaaatttacaacaagaattctggtgcaagttctatgcctgttgtcttcagtatcaagaagccctctctcaccctcttgccctacatttgaatccacacacaaacatggtgtgcctgctgaaaaaagggtacctgtctttccttattccctcatccttagtggatcatttgtatctcctgccttatgagaaccttttgacagaagatgagacaaccatatctgatgatgtggatatcgctcgggatgtcatatgtcttataaaatgcctccggctgattgaagagtcagtaactgtggatatgtcagttataatggaaatgagttgttataacctacagtctccggaaaaggctgcagagcagattctggaagatatgatcactattgatgtagaaaatgtgatggaggatatttgtagtaaactgcaagagattaggaacccaatccatgcaattggactacttatacgggaaatggattatgaaacagaagtggaaatggaaaagggattcaatccagctcagcctttgaatattcgaatgaatcttacccagctctatggtagtaacacagcagggtatattgtgtgcagaggggtgcataaaatcgccagtactcgtttcctgatctgcagagatcttttgatcttacagcagctgttaatgaggcttggagatgctgtgatttggggaactggtcagctctttcaagctcagcaagacctactacatcgaacagctcccctactcttatcttattacctcattaaatggggaagtgagtgcttggcaactgatgttccacttgacacactggagtctaatctccaacacttatcagtactggaattaacagactctggtgctttaatggcaaataggtttgtatctagtcctcagactattgtggagttattcttccaagaagttgcaagaaaacacattatatctcacctcttctctcagccaaaggcacctctgagccaaactggattgaattggcctgaaatgattactgcaattaccagttatttattgcagcttttatggcctagcaatcctggttgtctctttctagaatgtttgatgggaaattgccaatatgtacaattgcaggattatattcaactgctacatccctggtgtcaagtcaatgttggttcctgtcgatttatgctgggaaggtgttacctagttacaggagaaggacagaaggctctggaatgtttttgtcaggcagcatctgaagtaggcaaagaggaattcttggatcgcttgattcgctcagaggatggggagatcgtgtctacccccaggctgcagtattatgacaaggttttacgactactagatgtcattggtttgcctgaactggttattcagttggctacatcagccataactgaagcaggtgatgactggaaaagtcaggctactctaaggacatgtattttcaaacatcatttggatttgggtcacaatagccaagcatatgaagccttaacccaaattcctgattccagcaggcaattagattgtttacggcagttggtggtagttctttgtgaacgctcacagctacaggatcttgtagagtttccctatgtgaatctgcataatgaggttgtgggaataattgagtcacgtgctagagctgtggaccttatgactcacaattactatgaacttctgtatgcctttcacatctatcgccacaattaccgcaaggctggcacagtgatgtttgagtatggaatgcggcttggcagagaagttcgaactctccggggacttgagaaacaaggcaactgttatctggctgctctcaattgtttacgacttattcgtccagaatatgcgtggattgtgcagccagtgtctggtgcagtgtatgatcgccctggagcatcccctaagaggaatcatgatggagaatgcacagctgcccccacaaatcgacaaattgaaatcctggaactggaagatctggagaaagagtgttccttggctcgcatccgcctcactttggctcagcatgatccatcagcggttgcagttgctggaagttcatcagcagaggaaatggtcactctcttggttcaggcgggcctctttgacactgccatatcactctgtcagacttttaagcttcccttaacgccagtctttgaagggcttgccttcaaatgcatcaaattgcaatttggaggagaggcagcacaagcagaagcctgggcctggctagcagccaatcagctctcatctgtcatcactactaaggagtctagtgctacagatgaagcatggcgactattatccacttacctggagaggtacaaagtccagaataacttgtatcaccactgtgtaatcaacaagctcttgtctcatggagtgcctctgcctaattggcttataaacagttacaagaaggttgatgctgctgaattgcttcgtttatacttaaactatgaccttttagaagaagctgtggatttggtgtcagaatatgtggatgctgtattgggaaaaggacatcaatacttcggaattgagtttccactgtccgcaacagccccaatggtgtggcttccatactcctctattgatcagcttctccaagctctgggagagaacagtgccaacagtcacaacatcgcactgtcccagaaaatacttgacaaattggaggactaccagcaaaaagttgataaggcaacacgggatttattatatcgtcggaccttgtgatttggattgtcacctagcctttgtaaccgcttggtgcctcttaggacttaagactaccctacaggaaccctgtactcaaggccgatttttgtaactgtaaatgatgtgtacaacattcaagtctgcattctgcacaagataggagggcggaagagtcagaggaccctgtgcttgctggtggtgctaacacaatttctggtgttcaaccttggtctcaaatagctgcttttgtatatgattcacgagcttttttagagtttatatttttttaaactaccgaagacattcattatctgcaaattaagactcaccttcactttccaaaatagctgagggttgttggcttgttgtagctgaccaccaaaagcagtcactgcaaatcttttaattcttccctatcaccttttgtattttaatgcaattattttggtccagaactgacctgtattttctgtattgtacacaaaagctaataattttgtgtactttttatttattttggaggttttatatgatcttcaattgagtattaaataatttgcctagattaagcctaaaatgatgaccagctaattaaagaagatattttgaatctggttctgagctaaagttgagtaaattcttagctaagaaaaaattggaaatccatcatctatattagcaacagattctcagagtaaattgttaacttctatgatttatgataatcaagctggacttgatcatacaagttagtctcataatgtattggaccaaaatgtaaacttcattggtcagatttagaagcattcatgctcacaagttttgggaaagtgaaaaataataaaatcatcttggattttattctgtatattaaaatttatcttttaaggaaacaatctgtatactacttgcttgtatagccttttgacccttcttgagtttttcagaagcctttaatttttatactttcaataccatatttacattatatactttaattaacaatgtgagtttctctgtga

SEQ ID NO: 24682 - DNA, 5187 bp, Homo sapiens
agccggccactggaaggttcccgcagatagagtctgcctcccctgcccccttctcttctggattcctcgctgcccaccctcattctcccggtggaagcctcgcaacgaagggccggagccgcctttctgctcccggaatgcttcacctgtccgcagctccgcccgccccacccccggaagtgacggcgaccgcgcggccctgcctttgttccgttgggcgtcgcggcgacggcgggaagatggcggcggcgggagccctggaacggagcttcgtggagctaagcggagctgagcgcgaaaggccgaggcactttcgggaattcacagtctgcagcattgggactgcaaatgccgtggctggcgccgtaaaatacagtgaaagcgcgggaggcttttactacgtggagagtggcaagttgttctccgtaaccagaaacaggttcattcattggaagacctctggagatacattggagctgatggaggagtcactggacataaatctgttgaataatgccattcgcctaaaattccaaaattgcagtgttttacctggaggggtttatgtctctgagactcagaatcgtgtgataatcttgatgttaaccaatcaaacagtgcacaggttacttttaccacacccctcccggatgtataggagtgagttggtagttgacagtcagatgcagtcaatattcactgacattggaaaagttgatttcacagatccttgcaactatcagttaattccagcagtacctggaatatctcctaattccaccgcctctacagcctggctcagcagtgatggggaggccctgtttgccttaccatgtgcttctgggggaatctttgttcttaagctacctccttatgacatacctggtatggtgtcagtcgtggaactgaaacagagttcagtaatgcaacgattgcttacaggctggatgccaacagctatcaggggtgaccagtcgccttcagatcgtcccctcagtcttgctgttcattgtgtggagcatgatgccttcatctttgctttgtgtcaggatcataaactacgaatgtggtcttacaaggagcaaatgtgcctaatggtagctgacatgctggagtatgtccctgtgaagaaagaccttcggcttactgctggaactggacacaaattacggcttgcttattcccccaccatgggactctacctggggatatacatgcatgcaccaaaacgaggacagttctgcattttccagttggtgagcactgagagtaatcgctatagtctcgatcatatttcttcactgttcacttctcaggagacactgattgactttgccttaacttccacggatatctgggccctgtggcatgatgctgagaaccaaacagtagtgaaatacatcaactttgaacataatgttgcaggtcagtggaatccagtttttatgcagcctctgccagaggaagagattgtcatcagagatgatcaagaccccagagagatgtatctgcaaagtctttttacaccaggacaattcacaaatgaagctttatgtaaggctttacagattttctgccgaggaactgagaggaatttggatctttcctggagtgaactgaagaaagaagttactttagctgttgaaaatgagcttcaaggaagtgtaacagagtatgaattctcccaggaggagtttcgaaatttacaacaagaattctggtgcaagttctatgcctgttgtcttcagtatcaagaagccctctctcaccctcttgccctacatttgaatccacacacaaacatggtgtgcctgctgaaaaaagggtacctgtctttccttattccctcatccttagtggatcatttgtatctcctgccttatgagaaccttttgacagaagatgagacaaccatatctgatgatgtggatatcgctcgggatgtcatatgtcttataaaatgcctccggctgattgaagagtcagtaactgtggatatgtcagttataatggaaatgagttgttataacctacagtctccggaaaaggctgcagagcagattctggaagatatgatcactattgatgtagaaaatgtgatggaggatatttgtagtaaactgcaagagattaggaacccaatccatgcaattggactacttatacgggaaatggattatgaaacagaagtggaaatggaaaagggattcaatccagctcagcctttgaatattcgaatgaatcttacccagctctatggtagtaacacagcagggtatattgtgtgcagaggggtgcataaaatcgccagtactcgtttcctgatctgcagagatcttttgatcttacagcagctgttaatgaggcttggagatgctgtgatttggggaactggtcagctctttcaagctcagcaagacctactacatcgaacagctcccctactcttatcttattacctcattaaatggggaagtgagtgcttggcaactgatgttccacttgacacactggagtctaatctccaacacttatcagtactggaattaacagactctggtgctttaatggcaaataggtttgtatctagtcctcagactattgtggagttattcttccaagaagttgcaagaaaacacattatatctcacctcttctctcagccaaaggcacctctgagccaaactggattgaattggcctgaaatgattactgcaattaccagttatttattgcagcttttatggcctagcaatcctggttgtctctttctagaatgtttgatgggaaattgccaatatgtacaattgcaggattatattcaactgctacatccctggtgtcaagtcaatgttggttcctgtcgatttatgctgggaaggtgttacctagttacaggagaaggacagaaggctctggaatgtttttgtcaggcagcatctgaagtaggcaaagaggaattcttggatcgcttgattcgctcagaggatggggagatcgtgtctacccccaggctgcagtattatgacaaggttttacgactactagatgtcattggtttgcctgaactggttattcagttggctacatcagccataactgaagcaggtgatgactggaaaagtcaggctactctaaggacatgtattttcaaacatcatttggatttgggtcacaatagccaagcatatgaagccttaacccaaattcctgattccagcaggcaattagattgtttacggcagttggtggtagttctttgtgaacgctcacagctacaggatcttgtagagtttccctatgtgaatctgcataatgaggttgtgggaataattgagtcacgtgctagagctgtggaccttatgactcacaattactatgaacttctgtatgcctttcacatctatcgccacaattaccgcaaggctggcacagtgatgtttgagtatggaatgcggcttggcagagaagttcgaactctccggggacttgagaaacaaggcaactgttatctggctgctctcaattgtttacgacttattcgtccagaatatgcgtggattgtgcagccagtgtctggtgcagtgtatgatcgccctggagcatcccctaagaggaatcatgatggagaatgcacagctgcccccacaaatcgacaaattgaaatcctggaactggaagatctggagaaagagtgttccttggctcgcatccgcctcactttggctcagcatgatccatcagcggttgcagttgctggaagttcatcagcagaggaaatggtcactctcttggttcaggcgggcctctttgacactgccatatcactctgtcagacttttaagcttcccttaacgccagtctttgaagggcttgccttcaaatgcatcaaattgcaatttggaggagaggcagcacaagcagaagcctgggcctggctagcagccaatcagctctcatctgtcatcactactaaggagtctagtgctacagatgaagcatggcgactattatccacttacctggagaggtacaaagtccagaataacttgtatcaccactgtgtaatcaacaagctcttgtctcatggagtgcctctgcctaattggcttataaacagttacaaggactaccagcaaaaagttgataaggcaacacgggatttattatatcgtcggaccttgtgatttggattgtcacctagcctttgtaaccgcttggtgcctcttaggacttaagactaccctacaggaaccctgtactcaaggccgatttttgtaactgtaaatgatgtgtacaacattcaagtctgcattctgcacaagataggagggcggaagagtcagaggaccctgtgcttgctggtggtgctaacacaatttctggtgttcaaccttggtctcaaatagctgcttttgtatatgattcacgagcttttttagagtttatatttttttaaactaccgaagacattcattatctgcaaattaagactcaccttcactttccaaaatagctgagggttgttggcttgttgtagctgaccaccaaaagcagtcactgcaaatcttttaattcttccctatcaccttttgtattttaatgcaattattttggtccagaactgacctgtattttctgtattgtacacaaaagctaataattttgtgtactttttatttattttggaggttttatatgatcttcaattgagtattaaataatttgcctagattaagcctaaaatgatgaccagctaattaaagaagatattttgaatctggttctgagctaaagttgagtaaattcttagctaagaaaaaattggaaatccatcatctatattagcaacagattctcagagtaaattgttaacttctatgatttatgataatcaagctggacttgatcatacaagttagtctcataatgtattggaccaaaatgtaaacttcattggtcagatttagaagcattcatgctcacaagttttgggaaagtgaaaaataataaaatcatcttggattttattctgtatattaaaatttatcttttaaggaaacaatctgtatactacttgcttgtatagccttttgacccttcttgagtttttcagaagccttttaaattatttcatatctcaactcccgataggcgcataatttagcaatatatagatataatact

SEQ ID NO: 24683 - DNA, 1248 bp, Homo sapiens
  misc_feature (24)..(24): n is a, c, g, or t
  misc_feature (28)..(28): n is a, c, g, or t
  misc_feature (30)..(30): n is a, c, g, or t
  misc_feature (47)..(47): n is a, c, g, or t
cctatagtgagtcgtatagggacnaggncnctatagtgagtcgtatnggtttccactgtccgcaacagccccaatggtgtggcttccatactcctctattgatcagcttctccaagctctgggagagaacagtgccaacagtcacaacatcgcactgtcccagaaaatacttgacaaattggaggactaccagcaaaaagttgataaggcaacacgggatttattatatcgtcggaccttgtgatttggattgtcacctagcctttgtaaccgcttggtgcctcttaggacttaagactaccctacaggaaccctgtactcaaggccgatttttgtaactgtaaatgatgtgtacaacattcaagtctgcattctgcacaagataggagggcggaagagtcagaggaccctgtgcttgctggtggtgctaacacaatttctggtgttcaaccttggtctcaaatagctgcttttgtatatgattcacgagcttttttagagtttatatttttttaaactaccgaagacattcattatctgcaaattaagactcaccttcactttccaaaatagctgagggttgttggcttgttgtagctgaccaccaaaagcagtcactgcaaatcttttaattcttccctatcaccttttgtattttaatgcaattattttggtccagaactgacctgtattttctgtattgtacacaaaagctaataattttgtgtactttttatttattttggaggttttatatgatcttcaattgagtattaaataatttgcctagattaagcctaaaatgatgaccagctaattaaagaagatattttgaatctggttctgagctaaagttgagtaaattcttagctaagaaaaaattggaaatccatcatctatattagcaacagattctcagagtaaattgttaacttctatgatttatgataatcaagctggacttgatcatacaagttagtctcataatgtattggaccaaaatgtaaacttcattggtcagatttagaagcattcatgctcacaagttttgggaaagtgaaaaataataaaatcatcttggattttattctgtatattaaaatttatcttttaaggaaacaatctgtatactacttgcttgtatagccttttgacccttcttgagtttttcagaagcctttaatttttatactttcaataccatatttacattatatactttaattaacaatgtgagtttctctgtga

SEQ ID NO: 24684 - DNA, 3978 bp, Homo sapiens
agccggccactggaaggttcccgcagatagagtctgcctcccctgcccccttctcttctggattcctcgctgcccaccctcattctcccggtggaagcctcgcaacgaagggccggagccgcctttctgctcccggaatgcttcacctgtccgcagctccgcccgccccacccccggaagtgacggcgaccgcgcggccctgcctttgttccgttgggcgtcgcggcgacggcgggaagatggcggcggcgggagccctggaacggagcttcgtggagctaagcggagctgagcgcgaaaggccgaggcactttcgggaattcacagtctgcagcattgggactgcaaatgccgtggctggcgccgtaaaatacagtgaaagcgcgggaggcttttactacgtggagagtggcaagttgttctccgtaaccagaaacaggttcattcattggaagacctctggagatacattggagctgatggaggagtcactggacataaatctgttgaataatgccattcgcctaaaattccaaaattgcagtgttttacctggaggggtttatgtctctgagactcagaatcgtgtgataatcttgatgttaaccaatcaaacagtgcacaggttacttttaccacacccctcccggatgtataggagtgtaagttggctaagtgcaatatcttttatttcccaaattactctgggtgtcacaaatgtagtgctggagcgatgtcttttggaattgaaggaaatttggattctcgttatccctcaccaagcatactttgatagctaccgcttaaaatgatcaggcatacattttaagttgagaattagttttcattaagaagaatagctttcttaaacttgacagttttttactttaaaaacttttttagcaatagagaggaactgagcaaaattctggttattttgatttaatagatttttctttttaattactcaacaggagttggtagttgacagtcagatgcagtcaatattcactgacattggaaaagttgatttcacagatccttgcaactatcagttaattccagcagtacctggaatatctcctaattccaccgcctctacagcctggctcagcagtgatggggaggccctgtttgccttaccatgtgcttctgggggaatctttgttcttaagctacctccttatgacatacctggtatggtgtcagtcgtggaactgaaacagagttcagtaatgcaacgattgcttacaggctggatgccaacagctatcaggggtgaccagtcgccttcagatcgtcccctcagtcttgctgttcattgtgtggagcatgatgccttcatctttgctttgtgtcaggatcataaactacgaatgtggtcttacaaggagcaaatgtgcctaatggtagctgacatgctggagtatgtccctgtgaagaaagaccttcggcttactgctggaactggacacaaattacggcttgcttattcccccaccatgggactctacctggggatatacatgcatgcaccaaaacgaggacagttctgcattttccagttggtgagcactgagagtaatcgctatagtctcgatcatatttcttcactgttcacttctcaggagacactgattgactttgccttaacttccacggatatctgggccctgtggcatgatgctgagaaccaaacagtagtgaaatacatcaactttgaacataatgttgcaggtcagtggaatccagtttttatgcagcctctgccagaggaagagattgtcatcagagatgatcaagaccccagagagatgtatctgcaaagtctttttacaccaggacaattcacaaatgaagctttatgtaaggctttacagattttctgccgaggaactgagaggaatttggatctttcctggagtgaactgaagaaagaagttactttagctgttgaaaatgagcttcaaggaagtgtaacagagtatgaattctcccaggaggagtttcgaaatttacaacaagaattctggtgcaagttctatgcctgttgtcttcagtatcaagaagccctctctcaccctcttgccctacatttgaatccacacacaaacatggtgtgcctgctgaaaaaagggtacctgtctttccttattccctcatccttagtggatcatttgtatctcctgccttatgagaaccttttgacagaagatgagacaaccatatctgatgatgtggatatcgctcgggatgtcatatgtcttataaaatgcctccggctgattgaagagtcagtaactgtggatatgtcagttataatggaaatgagttgttataacctacagtctccggaaaaggctgcagagcagattctggaagatatgatcactattgatgtagaaaatgtgatggaggatatttgtagtaaactgcaagagattaggaacccaatccatgcaattggactacttatacgggaaatggattatgaaacagaagtggaaatggaaaagggattcaatccagctcagcctttgaatattcgaatgaatcttacccagctctatggtagtaacacagcagggtatattgtgtgcagaggggtgcataaaatcgccagtactcgtttcctgatctgcagagatcttttgatcttacagcagctgttaatgaggcttggagatgctgtgatttggggaactggtcagctctttcaagctcagcaagacctactacatcgaacagctcccctactcttatcttattacctcattaaatggggaagtgagtgcttggcaactgatgttccacttgacacactggagtctaatctccaacacttatcagtactggaattaacagactctggtgctttaatggcaaataggtttgtatctagtcctcagactattgtggagttattcttccaagaagttgcaagaaaacacattatatctcacctcttctctcagccaaaggcacctctgagccaaactggattgaattggcctgaaatgattactgcaattaccagttatttattgcagcttttatggcctagcaatcctggttgtctctttctagaatgtttgatgggaaattgccaatatgtacaattgcaggattatattcaactgctacatccctggtgtcaagtcaatgttggttcctgtcgatttatgctgggaaggtgttacctagttacaggagaaggacagaaggctctggaatgtttttgtcaggcagcatctgaagtaggcaaagaggaattcttggatcgcttgattcgctcagaggatggggagatcgtgtctacccccaggctgcagtattatgacaaggttttacgactactagatgtcattggtttgcctgaactggttattcagttggctacatcagccataactgaagcaggtgatgactggaaaagtcaggctactctaaggacatgtattttcaaacatcatttggatttgggtcacaatagccaagcatatgaagccttaacccaaattcctgattccagcaggcaattagattgtttacggcagttggtggtagttctttgtgaacgctcacagctacaggatcttgtagagtttccctatgtgaatctgcataatgaggttgtgggaataattgagtcacgtgctagagctgtgcaagtgaatccacattaatgccttgtcgtggtgccattcccagcgcctgacgatacgctcttctatgtcttattctggcaggttttgacgttttaaattttttaaagaaattttattccttggaccaaaaggttggttaacaccccctcttacttgctttcacatttgagtgtccagaggaaacagaaaggaatgagtgtgtgacgttgctgcacgcctgactctgtgcgaacttctttctgtgtatatattgttattttccggtatattttaatcccgacagaacatcatgtgagatttctttaaaatg

SEQ ID NO: 24685 - DNA, 1421 bp, Homo sapiens
agccggccactggaaggttcccgcagatagagtctgcctcccctgcccccttctcttctggattcctcgctgcccaccctcattctcccggtggaagcctcgcaacgaagggccggagccgcctttctgctcccggaatgcttcacctgtccgcagctccgcccgccccacccccggaagtgacggcgaccgcgcggccctgcctttgttccgttgggcgtcgcggcgacggcgggaagatggcggcggcgggagccctggaacggagcttcgtggagctaagcggagctgagcgcgaaaggccgaggcactttcgggaattcacagtctgcagcattgggactgcaaatgccgtggctggcgccgtaaaatacagtgaaagcgcgggaggcttttactacgtggagagtggcaagttgttctccgtaaccagaaacaggttcattcattggaagacctctggagatacattggagctgatggaggagtcactggacataaatctgttgaataatgccattcgcctaaaattccaaaattgcagtgttttacctggaggggtttatgtctctgagactcagaatcgtgtgataatcttgatgttaaccaatcaaacagtgcacaggttacttttaccacacccctcccggatgtataggagtgtaagttggctaagtgcaatatcttttatttcccaaattactctgggtgtcacaaatgtagtgctggagcgatgtcttttggaattgaaggaaatttggattctcgttatccctcaccaagcatactttgatagctaccgcttaaaatgatcaggcatacattttaagttgagaattagttttcattaagaagaatagctttcttaaacttgacagttttttactttaaaaacttttttagcaatagagaggaactgagcaaaattctggttattttgatttaatagatttttctttttaattactcaacaggagttggtagttgacagtcagatgcagtcaatattcactgacattggaaaagttgatttcacagatccttgcaactatcagttaattccagcagtacctggaatatctcctaattccaccgcctctacagcctggctcagcagtgatggggaggccctgtttgccttaccatgtgcttctgggggaatctttgttcttaagctacctccttatgacatacctggtaagaatgggaactgagcatggatttaactttaaacaaggaatgttaacattgaaacagttcaacctcgtcatccaatgcagggattgcatctctactgccccggaactggtcattcattattgcttgcctaatgagtccctaatgctttacttttatacagtggataaggaactataaagcatattggagcacggaagtggatagagttcgaagatcctgtt

SEQ ID NO: 24686 - DNA, 544 bp, Homo sapiens
aagggggtgtgttttagcgtcttgtgtttaaacaggatctctaagtgagaacctgacttgatcaatcactcgaagagggtgatcctctctttttcttatgctttatcctctgcactcaaaaggagtccctttgtggcttgcaaaccaagtgtaatagcaaccaagtaacgtcgcgtgtaaggaggcaccttttctgagtgggggcttgatcaagggagggttttgggcaaactgtacctgtctaagaaatgaatagtgaggttagaaaagttcctttgagcatttattttaagtaaacctttttcttcagctccacagaaagggttacacgttaaacatgttatatccagagaagtagagtacttttcgtcagacagtacttttaagtaggagtgcacgtctcgctctgctcctgtagagacttgttttgttactcaaatagagttctcgtaactagttaagtgaacttggattaggtaattggacaaggtttttttttttttttttaggattttaaagctacaggccttgctaacaattacga

SEQ ID NO: 24687 - DNA, 432 bp, Homo sapiens
tctttatttacttcaagagtgttgtgcggaaaatatggaaggcacaaccaaattcattaattcattcaattgtttaccaagccccttctccatgtcaagcactaggttaggtgatggcagtaaaactctacaaattaatctggcctctgccctcaaagaccttcacgtacagatgtattctatcctagctatggtagggtggcagaatatgccacagcaaacttttccactttggcacaaggattactttgtgctgaaggcaattgagaagaaaaagatacaagaaaagctctctgttcttctgtcatctaaaagcaggacataaatttacaaagttgtcccccgctttctacaaggaaggacaaaacttaattaccagagacagctttagacccttacagcctgcagacagaatcagaggactgtatataa

SEQ ID NO: 24688 - DNA, 522 bp, Homo sapiens
agagaaactccatctcaaaaacaaaacaacacaaaacaaaaaaagaagagaaatcaaagcttgttccctgtctctctctctccacatgtgagcacacaaagaggtcacgtgaacacacaatgagaaggaggctgcctgcaagttaagagaagaggcctcagcatgaaacctgccttactggcactttggtcttgaacttcccagcctctaaaactgtgagaaataagtttctgttgttcaagccacccagtctatggtattctgtatggcagccagaattaagacaccagtgaagcaagataatcagtaactggatacttaactgtgtggtataaaacataggggctttagtagagaagaaaattggactttgttggggacatccttactacttctgctcatgtatcatgctttagcttgtttctgtctttggaggaggctgcatatttttaaaatacccccaaaagtacaaagactaatgttatagcccctgtgttctcattatccaggcttaataaatgt

SEQ ID NO: 24689 - DNA, 374 bp, Homo sapiens
gcaaattcaatcaaaacttactgacatcaattgaaatcacattagactttgtaaaaaataggataattatgctcgtcttgtaagttgcaggtattgtaacaactctaaaatgtgggcctgtttgaataaatgcttatgtttgctggctctacgcaagcagatgcagaaatgtataatctgcataaataaatcaggagattatttttcccccttatagctctttagttctatgagattcaattaattcaactttttttttttttaatgggcccagggtaatgaggtaagcaggtgttagtgtgttggccactgaagcaggatagcccctggtacagatttgtcacatggggttactttttaaatctcccttgatt

SEQ ID NO: 24690 - DNA, 131 bp, Homo sapiens
aaagtcacctgtgaaaactaaaaactccaagcctgaccaaatttatgtcatctatgggcatggacattcctagtttgaaaaattaacaataagacttatctaagtttggtgaaatccttggagcatccagc

SEQ ID NO: 24691 - DNA, 419 bp, Homo sapiens
cccgagaacaggagcaagagatatatgacaaagctatttcagtggctctttaatgtataaggaggcaaacacctgaaactctgaaaactctgaaattgagaggcaaaataaacttagagtcaagaaagaaatgccatttctgcagatcagaatataaacaccaaccacagctgtaaaaaagaaaagaatatatgcaacgaagggaaattatataaacaaaggatcattggaggtactgatgagttcatttagttcaatgaaaatagtgacgtattaggtagatctcttaattttattactagtattctactaaatgtggtagtataaagtcaaaaagcattccgaagtttctcaagacccttataattccatgatttttttcaggtcagtcaacatttgttgaatgataggtctgtgga

SEQ ID NO: 24692 - DNA, 374 bp, Homo sapiens
gtgccaccaagcccggctaatttttcatattttttagtagagacaaggtttcaccacgttggccaggctggtctcgacctcctgacctcatgatctgcccacctcggcctcccaaagtgctgggatgacaggcatgagccactgcacccatctggctttatactttatatagtctgtctggtaatgtaatacacataaagacagagttatattcatgagattgggggtggggcaaaacttataaacagcaaactgaaccataaacaagtgttgttttgttttattggcttccaacatttatgaaaatccttttccctcattttgatggtgaaaggcctaataaatgtactgcagcacaataaaacatctgttac

SEQ ID NO: 24693 - DNA, 716 bp, Homo sapiens
agtggttcttctgaggaaaaccagctgaagtattacagaaagaggaaatgctgcagagacccagccggaaacagtgctggccagctcacgcctgacccacccttattctaagcatagggtctgcctctgaagagctaaagacttcctgaaatttaaaaattagtgcttttatttgcttgtcctgctaagaccgtagcaaaggccatcctcctcccattgacagtttagagtgggcagaaacaaccacggttaccctagaagtaaatccagagctgcgggacgctggaggacaaaaccaaccttccagggaagccgaggagaagtcatgccttcaaaaggtgtctgcctttttttttttcaccctctctcctctaacctgtttgtaactgggaaatgaaatagttttggtttgcaagctgtcgccagggagtggagcaagactttgtaataaacaagagcaactgccagagcccccagcgagcctctccaaggccagactgccaagaaaagctggcagtgtgacagcaagtttcattcagcgtggccggtggtcactgaggagcgaccatgaggaggatggccagagggggtaccccccagtctcaccttggggaagagtacagcctcctattagtgagctgtgtgggctattaaaattcccccaggctgagtgtttcaggaagcaccataaataaataaaattgtctgtgtgtgtg

SEQ ID NO: 24694 - DNA, 2704 bp, Homo sapiens
tattggggtgggagcagggggacagaagatggtgacactggctcctctcacccctaggtctctgaaggtccagatagcactgatggcaagctttgggtctgcacactctggaaagaagagagaagtgaaggctctaggtagggaggacagggagacactgggcacaggcttctctcctcttgtttaaagaagcccagggagggatagatctccgactggacagaagactactctgcagcccgccttcctagagttgggttgtcactgtccggcagggggcagcagccaccagcaaacaccactgcctgcaggagcctgggctgactggttgggactcaccaaagatcccttcttcctgggcggtggcctgcaggaactggaacagctgttggagaggagaagaaaaagaagacatcaaaaagaaaatctagtgctgggtggatatagagtatgaagatgtggagctgggaaaacagaggatgtggtgggatggggaaggaaaggttgtggaaggcctgcaccccgtctcagttcctccactgcttcgtcccagattctgtttttgttttcctgaatcagacttagtctccctccattctcccgtcccctgtgtgcccccatcctggtcctgcctcactggacagcctctccgcggccttcctcctccctgctccagaattctacttggtgccccccaaccccactcgactcattgtccacctggcctctgaggccaggcaccctcattcccctctcccacccaccccacccaaggaagcccagcacagaccatctcatctcactccaccatcacttctttgccaaatgcatttccaaacaccctcatgagctttgctgatctctttgccatctctccctgccccactccgatggctcctcctgcctggtgaagactgccctgggtatcccagaactgaacctgcagcagccagcacagctgaccttggggcgataagcagccagggaaaggctttcttaaaaaaaaacaaaaaacaaaaccaataactcagtaagcagattaaacaaaggtagagacggagccctccacccctctcacacactcatcctcacacccagctataccacaccccacaaatgttgcttatgtttccttggtcattctgtccatcctcctgtctgtccaaagccaaggacactgctctactctaaattttttgtcccgaagcccccaaatactgcaaccctgacccaatgcacgaagccaccccaaaatacagcagaggacaccaggactttcattttccctcagtatggcccatcctttgggtatgccaactccatgtccaccaagcactgcatgtaggacagggcacagtttggaggccttggtccagccactgccccagacccaccttggctctctcctcactaacacccgagaagcccagacttcccagtgtttagcaacagattaaactctaagccaacaacaacagaacagggtggagtgagtggaaagcaaatgaaatgttaaaaaaaaaaaaaaagcaatacttgcattctcattagtaggaacatgtgagatgaagcatgttatgttattaggcattctcttgattcggtaaacacaagctgaataaatttataaatatcagcattaagcgagatttaacggggagctgtttatcttctgcctgtcaggcaggcggcaacactctccatgtatcactcgccagccgtgcagtcctcactctcttgcccaggtaagctggggaagagcctgctgccgcccagctctggttgtggaagggctggcaccaaggagctgcgagcttacctcaactcatctcacctcaccatgccggctgcgaggcggcccgtgcagtccgtgcgcaggaggtcacactcccatgctgcatcccagcccctccagaaggcagagcatgacctgggtgactttgaggatgctatttaacctctctaagctaaagctcctcgactgcagcatcaacagatcagtgccgacctgttaaggccgtcgagagcatcaaatgctactgttcagcaggtgcctgacacatagtaggtccacaagcaaatgattttcctgcttgcatcatttctagcacagagctggaggaaatggcgaggtgcaggtggccgctgggccctgctgttctacatgggagcaagacagctgctaggtgaaggggaatgaccaggcagccacagggaggacatgtggcctcaggaagcctgggtgtgtatcctggttctgctaggaacacgtgtggggctttgtgtgggtgactctctggctccccaagcctccctttcctactgttatatccttaaagtgcctctgaggccaaagcctttgtggcaattgtcaaatgagtccatatgcagtgagtaccgtgttgagggaggacaaggtcaccaagagctgagaatgtttctccgactgatgagacctagatattgggtacatggaggtccccggtccctttgtgattcctgcagcctgttgcctccttgcctggaccccgcctcagctcagaaagccaattccctagattccaaaggccttcccagaccaattagcatgtcctgcagctgtcagctccctgtgcctagcctggacctcagctcatgtctagcacccagtctcccaaccccacacatattcacaaataaaagaaaataacaaatgacatgaatt

SEQ ID NO: 24695 - DNA, 2780 bp, Homo sapiens
atgtgatgcatgctcacgtgtctccgcagccggctcgggaaagaatcccccaagctccatttcatgagtaagcgtgagagccgctcagtttcctccagctctgctgaagccagcacagaagtagcccaaactcttccctctgctgacagcaaattttaggcaaagtcttgagaaagaagaaattgggtccagaaagggaagtgaggagaatcagatcccagacctttggggagaaggagcaaccgcctctggcacagcccatcagggagaaagagcaggttgagaagagtcctaagctaacagccccaaacaggtgggtgttgctcagctccctgaggcatgtggttgtaaggcagaacccacagaccttgcaggaagaaggctctcggggccatggcccaggtcagcatcaacaatgactacagcgagtgggacttgagcacggatgccggggagcgggctcggctgctgcagagtccctgtgtggacacagcccccaagagtgagtgggaagcctctcctgggggtctggacagaggcaccacttccacacttggggccatcttcatcgtcgtcaacgcgtgcctgggtgcagggttactcaacttcccagcagccttcagcactgcggggggcgtggcagcaggcatcgcactgcagatgggtatgctggttttcatcatcagtggccttgtcatcctggcctactgctcccaggccagcaatgagaggacctaccaggaggtggtatgggctgtgtgtggcaagctgacaggtgtgctatgtgaggtggccatcgctgtctacacctttggcacctgcattgccttcctaatcatcattggcgaccagcaggacaagattatagctgtgatggcgaaagagccggagggggccagcggcccttggtacacagaccgcaagttcaccatcagcctcactgccttcctcttcatcctgcccctctccatccccagggagattggtttccagaaatatgccagcttcctgagcgtcgtgggtacctggtacgtcacagccatcgttatcatcaagtacatctggccagataaagagatgaccccagggaacatcctgaccaggccggcttcctggatggctgtgttcaatgccatgcccaccatctgcttcggatttcagtgccacgtcagcagtgtgcccgtcttcaacagcatgcagcagcctgaagtgaagacctggggtggagtggtgacagctgccatggtcatagccctcgctgtctacatggggacaggcatctgtggcttcctgacctttggagctgctgtggatcctgacgtgctcctgtcctatccctcggaggacatggccgtggccgttgcccgagccttcatcatcctgagcgtgctcacctcctaccctatcctgcacttctgtgggcgggcggtggtggaaggcctgtggctgcgctaccagggggtgccagtggaggaggacgtggggcgggagcggcggcggcgagtgctgcagacgctggtctggttcctgctcaccctgctgctggcgctcttcatccctgacatcggcaaggtgatctcagtcattggaggcctggccgcctgcttcatcttcgtcttcccagggctgtgcctcattcaagccaaactctctgagatggaagaggtcaaaccagccagctggtgggtgctggtcagctacggagtcctcttggtcaccctgggagccttcatcttcggccagaccacagccaacgccatctttgtggatctcttggcataaccactgcctcccagggaacacaaggcctttgccattggtcgcaggaacccatctcttagagctatggggccattcttagtccacgatcattccaactggtgggatgacatccggacatcctcttccagggactggggcaaactcaggccccacacctctggacagctcaaatccagtccccttcctgctccccagtcctggcagtgccgtggatggcggcaggaagtctcacatcatagaggacccctcctcctctcccagttctcaacttctccatgcctggaatccacgggtgaagagagtcggtagatctcataagaaagaatccagtctgacttccctctggagaatgactatggacagaaggccaccatcctccacagagcaccctgtcctgagtaggggttgtgctcattaccccaggccagtggtagcttcctcaggagcctggccacttccaacggtagcactgaagtcatgcaaatgcatagtcaggtagattcagaccttgtccacaccttcctgggcaacccccaccatgaacctgtcagcctctttcccatagctaatagacatttcccaggccttgaggggccccaccctgtctctttcatcaaacctgatggtccaggctgggcatccctctcctcctccatccccagacatcaccaggtctaatgtttacaaacggtgccagcccggctctgaagccaagggccgtcccgtgccacggtgctgtgagtattcctccgttagctttccccataaggttgggagtatctgcttttgtgtctgagatgggcccctcttttcagaggccgcagggtgggtgatggagaaggctgagaacctttcagaccctctgtgtgggctgggctggtcagaatcagggtgtacctccccgacaccttctttttcagtgatgttttctcttcttcctgcctttcctctgcctcctcccctgccagccctagcgtgactacccagagacaaaaaaa

SEQ ID NO: 24696 - DNA, 763 bp, Homo sapiens
agctgaaggtggatgtccctaggggtggaatcagataagaggcagctggggatgaggacacttagtctctccttcccggcagcttcctgagcgtcgtgggtacctggtacgtcacagccatcgttatcatcaagtacatctggccagataaagagatgaccccagggaacatcctgaccaggccggcttcctggatggctgtgttcaatgccatgcccaccatctgcttcggatttcaggtgccagtgccagttgcaaggtccctgctgtccccttagatcaccccaccctgggatggaacccagcaaggaggaggaacccaggcagaatggaggaaatcctggggggaaggatggaacaggggcctcaggacttgccccttgttcctggggtctttgttcccaaggtaccttcctctggaaactggggttgaggtcatttccccaccatgacggtgcccttcacctggacagtgccacgtcagcagtgtgcccgtcttcaacagcatgcagcagcctgaagtgaagacctggggtggagtggtgacagctgccatggtcatagccctcgctgtctacatggggacaggcatctgtggcttcctgacctttggagctgctgtggatcctgacgtgctcctgtcctatccctcggaggacatggccgtggccgttgcccgagccttcatcatcctgagcgtgctcacctcctaccctatcctgcacttctgtgggcggtgagcccccttccactccccagggcc

SEQ ID NO: 24697 - DNA, 2910 bp, Homo sapiens
atgtgatgcatgctcacgtgtctccgcagccggctcgggaaagaatcccccaagctccatttcatgagtaagcgtgagagccgctcagtttcctccagctctgctgaagccagcacagaagtagcccaaactcttccctctgctgacagcaaattttaggcaaagtcttgagaaagaagaaattgggtccagaaagggaagtgaggagaatcagatcccagacctttggggagaaggagcaaccgcctctggcacagcccatcagggagaaagagcaggttgagaagagtcctaagctaacagccccaaacaggtgggtgttgctcagctccctgaggcatgtggttgtaaggcagaacccacagaccttgcaggaagaaggctctcggggccatggcccaggtcagcatcaacaatgactacagcgagtgggacttgagcacggatgccggggagcgggctcggctgctgcagagtccctgtgtggacacagcccccaagagtgagtgggaagcctctcctgggggtctggacagaggcaccacttccacacttggggccatcttcatcgtcgtcaacgcgtgcctgggtgcagggttactcaacttcccagcagccttcagcactgcggggggcgtggcagcaggcatcgcactgcagatgggtatgctggttttcatcatcagtggccttgtcatcctggcctactgctcccaggccagcaatgagaggacctaccaggaggtggtatgggctgtgtgtggcaagctgacaggtgtgctatgtgaggtggccatcgctgtctacacctttggcacctgcattgccttcctaatcatcattggcgaccagcaggacaagattatagctgtgatggcgaaagagccggagggggccagcggcccttggtacacagaccgcaagttcaccatcagcctcactgccttcctcttcatcctgcccctctccatccccagggagattggtttccagaaatatgccagcttcctgagcgtcgtgggtacctggtacgtcacagccatcgttatcatcaagtacatctggccagataaagagatgaccccagggaacatcctgaccaggccggcttcctggatggctgtgttcaatgccatgcccaccatctgcttcggatttcagtgccacgtcagcagtgtgcccgtcttcaacagcatgcagcagcctgaagtgaagacctggggtggagtggtgacagctgccatggtcatagccctcgctgtctacatggggacagcagagacaaggtctcactatgttgcctagcctggtcttgaattcctgggctcaagcaattctcctgcctcggcctcccaaagtgctggggttacaggcatgagccaccaacccagcctaaaatggggaaggcatctgtggcttcctgacctttggagctgctgtggatcctgacgtgctcctgtcctatccctcggaggacatggccgtggccgttgcccgagccttcatcatcctgagcgtgctcacctcctaccctatcctgcacttctgtgggcgggcggtggtggaaggcctgtggctgcgctaccagggggtgccagtggaggaggacgtggggcgggagcggcggcggcgagtgctgcagacgctggtctggttcctgctcaccctgctgctggcgctcttcatccctgacatcggcaaggtgatctcagtcattggaggcctggccgcctgcttcatcttcgtcttcccagggctgtgcctcattcaagccaaactctctgagatggaagaggtcaaaccagccagctggtgggtgctggtcagctacggagtcctcttggtcaccctgggagccttcatcttcggccagaccacagccaacgccatctttgtggatctcttggcataaccactgcctcccagggaacacaaggcctttgccattggtcgcaggaacccatctcttagagctatggggccattcttagtccacgatcattccaactggtgggatgacatccggacatcctcttccagggactggggcaaactcaggccccacacctctggacagctcaaatccagtccccttcctgctccccagtcctggcagtgccgtggatggcggcaggaagtctcacatcatagaggacccctcctcctctcccagttctcaacttctccatgcctggaatccacgggtgaagagagtcggtagatctcataagaaagaatccagtctgacttccctctggagaatgactatggacagaaggccaccatcctccacagagcaccctgtcctgagtaggggttgtgctcattaccccaggccagtggtagcttcctcaggagcctggccacttccaacggtagcactgaagtcatgcaaatgcatagtcaggtagattcagaccttgtccacaccttcctgggcaacccccaccatgaacctgtcagcctctttcccatagctaatagacatttcccaggccttgaggggccccaccctgtctctttcatcaaacctgatggtccaggctgggcatccctctcctcctccatccccagacatcaccaggtctaatgtttacaaacggtgccagcccggctctgaagccaagggccgtcccgtgccacggtgctgtgagtattcctccgttagctttccccataaggttgggagtatctgcttttgtgtctgagatgggcccctcttttcagaggccgcagggtgggtgatggagaaggctgagaacctttcagaccctctgtgtgggctgggctggtcagaatcagggtgtacctccccgacaccttctttttcagtgatgttttctcttcttcctgcctttcctctgcctcctcccctgccagccctagcgtgactacccagagacaaaaaaa

SEQ ID NO: 24698 - DNA, 3255 bp, Homo sapiens
cggagacaggctctggagggtggaagtgttagatccccgaggtctgtggagcccctcagtccccgccaccgcggaaaagctcagaccctttccctgcaggggtccagatcctggcgtcctcgccccacgcccgtccctctgttgcgccagctctgccgcgcctttacccagccagagggtctccacccagtcctaggccgggatcgggtcccggagctcctccccaggttaccccacagtagcccacccttctcgctccaggcctgggaatcgccccgccccggcctcctggcccgggtgcgccctggctcacctcacaaagcctcacctcacaaagcagcccaccctttctatctcagggctccaaccccaggctggactgggagcacactccagttgggatctgaggggcctacatcgctggcctgagcatgtgggcatcaggcttctattctggctctgccagctacccactgtgaccttagtctaacctctccctcctgggcctgttttcctatctgtcctgaagctccatttcatgagtaagcgtgagagccgctcagtttcctccagctctgctgaagccagcacagaagtagcccaaactcttccctctgctgacagcaaattttaggcaaagtcttgagaaagaagaaattgggtccagaaagggaagtgaggagaatcagatcccagacctttggggagaaggagcaaccgcctctggcacagcccatcagggagaaagagcaggttgagaagagtcctaagctaacagccccaaacaggtgggtgttgctcagctccctgaggcatgtggttgtaaggcagaacccacagaccttgcaggaagaaggctctcggggccatggcccaggtcagcatcaacaatgactacagcgagtgggacttgagcacggatgccggggagcgggctcggctgctgcagagtccctgtgtggacacagcccccaagagtgagtgggaagcctctcctgggggtctggacagaggcaccacttccacacttggggccatcttcatcgtcgtcaacgcgtgcctgggtgcagggttactcaacttcccagcagccttcagcactgcggggggcgtggcagcaggcatcgcactgcagatgggtatgctggttttcatcatcagtggccttgtcatcctggcctactgctcccaggccagcaatgagaggacctaccaggaggtggtatgggctgtgtgtggcaagctgacaggtgtgctatgtgaggtggccatcgctgtctacacctttggcacctgcattgccttcctaatcatcattggcgaccagcaggacaagattatagctgtgatggcgaaagagccggagggggccagcggcccttggtacacagaccgcaagttcaccatcagcctcactgccttcctcttcatcctgcccctctccatccccagggagattggtttccagaaatatgccagcttcctgagcgtcgtgggtacctggtacgtcacagccatcgttatcatcaagtacatctggccagataaagagatgaccccagggaacatcctgaccaggccggcttcctggatggctgtgttcaatgccatgcccaccatctgcttcggatttcagtgccacgtcagcagtgtgcccgtcttcaacagcatgcagcagcctgaagtgaagacctggggtggagtggtgacagctgccatggtcatagccctcgctgtctacatggggacaggcatctgtggcttcctgacctttggagctgctgtggatcctgacgtgctcctgtcctatccctcggaggacatggccgtggccgttgcccgagccttcatcatcctgagcgtgctcacctcctaccctatcctgcacttctgtgggcgggcggtggtggaaggcctgtggctgcgctaccagggggtgccagtggaggaggacgtggggcgggagcggcggcggcgagtgctgcagacgctggtctggttcctgctcaccctgctgctggcgctcttcatccctgacatcggcaaggtgatctcagtcattggaggcctggccgcctgcttcatcttcgtcttcccagggctgtgcctcattcaagccaaactctctgagatggaagaggtcaaaccagccagctggtgggtgctggtcagctacggagtcctcttggtcaccctgggagccttcatcttcggccagaccacagccaacgccatctttgtggatctcttggcataaccactgcctcccagggaacacaaggcctttgccattggtcgcaggaacccatctcttagagctatggggccattcttagtccacgatcattccaactggtgggatgacatccggacatcctcttccagggactggggcaaactcaggccccacacctctggacagctcaaatccagtccccttcctgctccccagtcctggcagtgccgtggatggcggcaggaagtctcacatcatagaggacccctcctcctctcccagttctcaacttctccatgcctggaatccacgggtgaagagagtcggtagatctcataagaaagaatccagtctgacttccctctggagaatgactatggacagaaggccaccatcctccacagagcaccctgtcctgagtaggggttgtgctcattaccccaggccagtggtagcttcctcaggagcctggccacttccaacggtagcactgaagtcatgcaaatgcatagtcaggtagattcagaccttgtccacaccttcctgggcaacccccaccatgaacctgtcagcctctttcccatagctaatagacatttcccaggccttgaggggccccaccctgtctctttcatcaaacctgatggtccaggctgggcatccctctcctcctccatccccagacatcaccaggtctaatgtttacaaacggtgccagcccggctctgaagccaagggccgtcccgtgccacggtgctgtgagtattcctccgttagctttccccataaggttgggagtatctgcttttgtgtctgagatgggcccctcttttcagaggccgcagggtgggtgatggagaaggctgagaacctttcagaccctctgtgtgggctgggctggtcagaatcagggtgtacctccccgacaccttctttttcagtgatgttttctcttcttcctgcctttcctctgcctcctcccctgccagccctagcgtgactacccagagacaaaaaaa

SEQ ID NO: 24699 - DNA, 2760 bp, Homo sapiens
  misc_feature (24)..(25): n is a, c, g, or t
tcggctaggtacgaggctgggtgnngcccccaagctccatttcatgagtaagcgtgagagccgctcagtttcctccagctctgctgaagccagcacagaagtagcccaaactcttccctctgctgacagcaaattttaggcaaagtcttgagaaagaagaaattgggtccagaaagggaagtgaggagaatcagatcccagacctttggggagaaggagcaaccgcctctggcacagcccatcagggagaaagagcaggttgagaagagtcctaagctaacagccccaaacaggtgggtgttgctcagctccctgaggcatgtggttgtaaggcagaacccacagaccttgcaggaagaaggctctcggggccatggcccaggtcagcatcaacaatgactacagcgagtgggacttgagcacggatgccggggagcgggctcggctgctgcagagtccctgtgtggacacagcccccaagagtgagtgggaagcctctcctgggggtctggacagaggcaccacttccacacttggggccatcttcatcgtcgtcaacgcgtgcctgggtgcagggttactcaacttcccagcagccttcagcactgcggggggcgtggcagcaggcatcgcactgcagatgggtatgctggttttcatcatcagtggccttgtcatcctggcctactgctcccaggccagcaatgagaggacctaccaggaggtggtatgggctgtgtgtggcaagctgacaggtgtgctatgtgaggtggccatcgctgtctacacctttggcacctgcattgccttcctaatcatcattggcgaccagcaggacaagattatagctgtgatggcgaaagagccggagggggccagcggcccttggtacacagaccgcaagttcaccatcagcctcactgccttcctcttcatcctgcccctctccatccccagggagattggtttccagaaatatgccagcttcctgagcgtcgtgggtacctggtacgtcacagccatcgttatcatcaagtacatctggccagataaagagatgaccccagggaacatcctgaccaggccggcttcctggatggctgtgttcaatgccatgcccaccatctgcttcggatttcagtgccacgtcagcagtgtgcccgtcttcaacagcatgcagcagcctgaagtgaagacctggggtggagtggtgacagctgccatggtcatagccctcgctgtctacatggggacaggcatctgtggcttcctgacctttggagctgctgtggatcctgacgtgctcctgtcctatccctcggaggacatggccgtggccgttgcccgagccttcatcatcctgagcgtgctcacctcctaccctatcctgcacttctgtgggcgggcggtggtggaaggcctgtggctgcgctaccagggggtgccagtggaggaggacgtggggcgggagcggcggcggcgagtgctgcagacgctggtctggttcctgctcaccctgctgctggcgctcttcatccctgacatcggcaaggtgatctcagtcattggaggcctggccgcctgcttcatcttcgtcttcccagggctgtgcctcattcaagccaaactctctgagatggaagaggtcaaaccagccagctggtgggtgctggtcagctacggagtcctcttggtcaccctgggagccttcatcttcggccagaccacagccaacgccatctttgtggatctcttggcataaccactgcctcccagggaacacaaggcctttgccattggtcgcaggaacccatctcttagagctatggggccattcttagtccacgatcattccaactggtgggatgacatccggacatcctcttccagggactggggcaaactcaggccccacacctctggacagctcaaatccagtccccttcctgctccccagtcctggcagtgccgtggatggcggcaggaagtctcacatcatagaggacccctcctcctctcccagttctcaacttctccatgcctggaatccacgggtgaagagagtcggtagatctcataagaaagaatccagtctgacttccctctggagaatgactatggacagaaggccaccatcctccacagagcaccctgtcctgagtaggggttgtgctcattaccccaggccagtggtagcttcctcaggagcctggccacttccaacggtagcactgaagtcatgcaaatgcatagtcaggtagattcagaccttgtccacaccttcctgggcaacccccaccatgaacctgtcagcctctttcccatagctaatagacatttcccaggccttgaggggccccaccctgtctctttcatcaaacctgatggtccaggctgggcatccctctcctcctccatccccagacatcaccaggtctaatgtttacaaacggtgccagcccggctctgaagccaagggccgtcccgtgccacggtgctgtgagtattcctccgttagctttccccataaggttgggagtatctgcttttgtgtctgagatgggcccctcttttcagaggccgcagggtgggtgatggagaaggctgagaacctttcagaccctctgtgtgggctgggctggtcagaatcagggtgtacctccccgacaccttctttttcagtgatgttttctcttcttcctgcctttcctctgcctcctcccctgccagccctagcgtgactacccagagacaaaaaaa

SEQ ID NO: 24700 - DNA, 2764 bp, Homo sapiens
ctagacaggccgggcgtaatcgggcgaggatccccaagctccatttcatgagtaagcgtgagagccgctcagtttcctccagctctgctgaagccagcacagaagtagcccaaactcttccctctgctgacagcaaattttaggcaaagtcttgagaaagaagaaattgggtccagaaagggaagtgaggagaatcagatcccagacctttggggagaaggagcaaccgcctctggcacagcccatcagggagaaagagcaggttgagaagagtcctaagctaacagccccaaacaggtgggtgttgctcagctccctgaggcatgtggttgtaaggcagaacccacagaccttgcaggaagaaggctctcggggccatggcccaggtcagcatcaacaatgactacagcgagtgggacttgagcacggatgccggggagcgggctcggctgctgcagagtccctgtgtggacacagcccccaagagtgagtgggaagcctctcctgggggtctggacagaggcaccacttccacacttggggccatcttcatcgtcgtcaacgcgtgcctgggtgcagggttactcaacttcccagcagccttcagcactgcggggggcgtggcagcaggcatcgcactgcagatgggtatgctggttttcatcatcagtggccttgtcatcctggcctactgctcccaggccagcaatgagaggacctaccaggaggtggtatgggctgtgtgtggcaagctgacaggtgtgctatgtgaggtggccatcgctgtctacacctttggcacctgcattgccttcctaatcatcattggcgaccagcaggacaagattatagctgtgatggcgaaagagccggagggggccagcggcccttggtacacagaccgcaagttcaccatcagcctcactgccttcctcttcatcctgcccctctccatccccagggagattggtttccagaaatatgccagcttcctgagcgtcgtgggtacctggtacgtcacagccatcgttatcatcaagtacatctggccagataaagagatgaccccagggaacatcctgaccaggccggcttcctggatggctgtgttcaatgccatgcccaccatctgcttcggatttcagtgccacgtcagcagtgtgcccgtcttcaacagcatgcagcagcctgaagtgaagacctggggtggagtggtgacagctgccatggtcatagccctcgctgtctacatggggacaggcatctgtggcttcctgacctttggagctgctgtggatcctgacgtgctcctgtcctatccctcggaggacatggccgtggccgttgcccgagccttcatcatcctgagcgtgctcacctcctaccctatcctgcacttctgtgggcgggcggtggtggaaggcctgtggctgcgctaccagggggtgccagtggaggaggacgtggggcgggagcggcggcggcgagtgctgcagacgctggtctggttcctgctcaccctgctgctggcgctcttcatccctgacatcggcaaggtgatctcagtcattggaggcctggccgcctgcttcatcttcgtcttcccagggctgtgcctcattcaagccaaactctctgagatggaagaggtcaaaccagccagctggtgggtgctggtcagctacggagtcctcttggtcaccctgggagccttcatcttcggccagaccacagccaacgccatctttgtggatctcttggcataaccactgcctcccagggaacacaaggcctttgccattggtcgcaggaacccatctcttagagctatggggccattcttagtccacgatcattccaactggtgggatgacatccggacatcctcttccagggactggggcaaactcaggccccacacctctggacagctcaaatccagtccccttcctgctccccagtcctggcagtgccgtggatggcggcaggaagtctcacatcatagaggacccctcctcctctcccagttctcaacttctccatgcctggaatccacgggtgaagagagtcggtagatctcataagaaagaatccagtctgacttccctctggagaatgactatggacagaaggccaccatcctccacagagcaccctgtcctgagtaggggttgtgctcattaccccaggccagtggtagcttcctcaggagcctggccacttccaacggtagcactgaagtcatgcaaatgcatagtcaggtagattcagaccttgtccacaccttcctgggcaacccccaccatgaacctgtcagcctctttcccatagctaatagacatttcccaggccttgaggggccccaccctgtctctttcatcaaacctgatggtccaggctgggcatccctctcctcctccatccccagacatcaccaggtctaatgtttacaaacggtgccagcccggctctgaagccaagggccgtcccgtgccacggtgctgtgagtattcctccgttagctttccccataaggttgggagtatctgcttttgtgtctgagatgggcccctcttttcagaggccgcagggtgggtgatggagaaggctgagaacctttcagaccctctgtgtgggctgggctggtcagaatcagggtgtacctccccgacaccttctttttcagtgatgttttctcttcttcctgcctttcctctgcctcctcccctgccagccctagcgtgactacccagagacaaaaaaa

SEQ ID NO: 24701 - DNA, 464 bp, Homo sapiens
cttcctgagcgtcgtgggtacctggtacgtcacagccatcgttatcatcaagtacatctggccagataaagagatgaccccagggaacatcctgaccaggtgagggtgagggccctaggagacatggggaagaagccaccacttgggccccagcaggtgctgggtcaggaaccagaaggccacacaggtgctcttctcaaggctcatgagctcatcagggctgacttggtcattgtaggaaggaggaaagagcccctgctctgatgttactggaaggaagagcaagaatcagagacaggaggcactttgccacctacatccaacagatgagccagtgtgaggctaggccttgggttgtggaggaacctgagggtggaatcccagggtcgaattgcctgtgtttccagcatctgcttatctgtaatttctgtatctttgagggtgaatttattattaaaaaaaaa

SEQ ID NO: 24702 - DNA, 4289 bp, Homo sapiens
  misc_feature (1)..(3): n is a, c, g, or t
  misc_feature (5)..(5): n is a, c, g, or t
  misc_feature (7)..(7): n is a, c, g, or t
nnncngnctttctatgctgttcgtcacacagaaagctggaagctgatgagcacagatgatcaacagaaaatccaagcagctgcatttgacaaaggtgatgatcgaagacttggcaaaaagcctatattcagtagctcgcagcaaaggaaacaagtttctgactctggtgatataaaaatcaaatcttggaggggaaataacaagaaagagtgttggagttatctctctactaataaaaagatgaaatctgatggattaggagcatctggacattcgtcaagtaccaatagaaatagtataaataaaactctgaagcaagatgatgtaaaggaaaaagatggtacaaaaatagcatctaagattacaaaagaactaaaaactgggggaaaaaatgtttctggaaagcccaaaactgtaacaaaatccaaaacagaaaatggtgataaggcacggttggaaaacatgtcacctagacaagttgtagaaagatcagcaacagcagcagcagcagcaactggacagaagaatttactaaatggaaaaggagtgagaaatcaggaagggcaaatttcaggtgccagacccaaggtactcacaggaaacttaaatgtgcaagccaaagcaaagcctttgaagaaagctacagggaaggattcaccatgcctcagcatcgcaggaccctccagcagatccacagattcaagtatggaattctcaatttccactgaatgtctggatgaaccgaaagaaaatggatcaacagaagaagaaaagccttctggacataaactatccttttgtgattctccaggacagatgatgaaaaacagtgtagatagtgtcaaaaattccactgtagccataaaatctcgacctgtttcaagagttaccaatggaacttccaataaaaaaagtattcatgaacaagacactaatgtaaataacagtgtactaaagaaagtcagtggcaaaggatgtagtgagccagtaccacaggcaattttgaagaaaagaggaactagcaatggatgtactgcagctcagcagaggacaaagagtaccccatctaatcttactaaaactcaaggatcccaaggagagtcaccaaactcagtaaaatcttcagtctcttcaaggcagtctgatgaaaatgtggcaaagttggaccacaatacaactacagagaaacaagcacctaagagaaaaatggtcaagcaagtacacacagctttgcctaaggttaatgcaaaaatagtggcaatgcctaaaaatctaaatcagtcaaagaaaggtgaaactttgaataataaagattcaaaacagaaaatgcctcctggacaggttatatcaaaaactcagccttcctcccaaagacctttaaaacatgaaacatctactgtccaaaaaagtatgtttcatgatgtgcgtgataataacaacaaggacagtgtttctgaacagaagcctcacaaacctctcattaatcttgcatctgaaataagtgatgcagaagcactccagtcatcctgcaggcctgacccacaaaagccattaaacgatcaagaaaaagagaagttggcgttagaatgccaaaatatttcaaagctggataaatcattaaaacacgaactggaatcaaaacagatttgtttagataaaagtgaaacaaaatttcccaatcacaaagaaacagatgattgcgatgcagctaacatatgttgtcattctgttgggagtgataatgtaaattcaaaattttatagcaccacagccctaaaatacatggtttcaaatccaaatgaaaactccttgaactctaatccagtttgtgatttagactcaacaagtgcagggcaaatccatttgatatcagatagggagaaccaagtagggagaaaagatacaaacaaacaatcaagtattaaatgtgtggaagatgtttcactgtgtaatcctgaaaggacaaatggtaccttaaattctgctcaagaagacaaaaaatcgaaagttcctgtggaaggactgacaattcctagtaagttgtcagatgaatctgctatggatgaagacaaacatgctacagcagactcagatgtatcttccaagtgtttttcgggacagctatcagaaaaaaattctcctaaaaatatggaaacatcagaatctccagagagccatgaaactccagaaactccatttgtgggtcactggaatttgagtactggtgttctgcatcagcgagagagtcctgaatctgacactggcagtgctaccacctcctccgatgacataaagcccagatctgaagactatgatgctggagggtctcaggatgatgatgggtcaaatgacagaggtatctctaaatgtggcactatgctgtgccatgattttcttggaagaagtagcagtgataccagtactcctgaagaattaaaaatttatgatagtaatttaagaattgaagtaaaaatgaaaaagcaaagtaataatgatcttttccaagttaattcaacgagtgatgatgaaatccctaggaaaaggccagaaatttggtctcgatctgcaatagttcactctagggaaagagaaaatattccacgaggcagtgtccagtttgctcaggaaatagatcaggtatcttcttcagcagatgaaacagaagatgaaagatctgaagctgaaaacgttgcagaaaatttctctatatctaacccagctcctcagcagtttcagggaataattaatttagcttttgaagatgcaactgaaaatgaatgtcgtgaattttctgcaaataaaaagtttaaaaggtcagttttactttcagtcgatgaatgtgaagagctgggatcagatgaaggagaagtccatactccctttcaggcttctgtagattctttttcaccttctgatgtttttgatggcatttctcatgaacatcatggaaggacctgctattccagattctcacgagaaagtgaagataatattttagaatgtaaacaaaataaaggcaatagtgtatgtaaaaatgaaagcactgtcttggatcttagtagcattgactcttcaagaaaaaataaacagagtgtttcagccacagaaaaaaagaacacaatagacgtcctatccagtagaagcagacagcttcttcgagaagataaaaaagtaaacaatggaagcaatgtggaaaatgacattcagcaacgcagcaaattcttggatagtgatgtaaaatctcaagaaagaccatgtcacttggatcttcatcaaagagaacccaattctgacataccaaagaacagctctacaaaatctctagactcctttcggagtcaagttctgcctcaggaaggtccagtgaaagagagccattctacaactactgaaaaagctaatattgctttatctgcaggagacatagatgattgtgacacactggcacaaacccgcatgtatgaccatcggccttcaaaaaccctgtctccaatatatgagatggatgtaatagaagcatttgagcagaaagtggaatcagaaacacatgttacagatatggattttgaagatgaccaacattttgcaaaacaagattggacactactaaagcaactgctctctgaacaggattcaaacttagatgttacaaattccgttcctgaagacttaagtttagcacagtatctaatcaatcagacactacttttagcacgagatagctcaaaacctcagggtataacacatattgacactttgaacagatggagtgaactaacatctccacttgattcctcagcgagcatcaccatggctagtttttcctctgaagattgttcgcctcaaggcgagtggacaattctggaactggaaactcagcattaagtgttaacattttggaaaaatttatgccactcctttattttttgatgcctatattatatccaaatgataattgcattagccggatataaactttctttaatattgagtctttccaatttaatgaggtaaacatagtttatttattaatatatcacatatagaaaaatgtttttctaaagtttttgagcatgttttctctaattattagagaaattagaagacttataaggaaaccctagcttcagttttcctttcctagctgatgatttgttcacttaatcattattcaagaatttaaaatgtgaatgcagaagtagatcagtccctttactttttgctctgcatagggtaacatagtaatttaacaataaaaacttaccgtgcttgtgtccaaaaaaaaaaaa

SEQ ID NO: 24703 - DNA, 1886 bp, Homo sapiens
tgctgattctagaggatccacgtcgggatgcagtgtccagtttgctcaggaaatagatcaggtatcttcttcagcagatgaaacagaagatgaaagatctgaagctgaaaacgttgcagaaaatttctctatatctaacccagctcctcagcagtttcagggaataattaatttagcttttgaagatgcaactgaaaatgaatgtcgtgaattttctgcaaataaaaagtttaaaaggtcagttttactttcagtcgatgaatgtgaagagctgggatcagatgaaggagaagtccatactccctttcaggcttctgtagattctttttcaccttctgatgtttttgatggcatttctcatgaacatcatggaaggacctgctattccagattctcacgagaaagtgaagataatattttagaatgtaaacaaaataaaggcaatagtgtatgtaaaaatgaaagcactgtcttggatcttagtagcattgactcttcaagaaaaaataaacagagtgtttcagccacagaaaaaaagaacacaatagacgtcctatccagtagaagcagacagcttcttcgagaagataaaaaagtaaacaatggaagcaatgtggaaaatgacattcagcaacgcagcaaattcttggatagtgatgtaaaatctcaagaaagaccatgtcacttggatcttcatcaaagagaacccaattctgacataccaaagaacagctctacaaaatctctagactcctttcggagtcaagttctgcctcaggaaggtccagtgaaagagagccattctacaactactgaaaaagctaatattgctttatctgcaggtaatgtacagaaatagaaatgctaaatgcataagaaaataagtttataaaattttaaagttgtatgaagccctgaatgttatattttagtcagatagaataattacttaagcaacagattaaaattttaaatgaaaaatgtcttaatatgaaaattactcattctttattgttcacttaaaatcctaatgaagaagtaatatctagtaaaaattttgattgttatatagagctaacctactaagagattttaaatgaaagaataaaaagaaaaacttagtttgctgctatttagttatttatgtataatttaacacaagaattcttgactattagaaattttattatacattggatatgatttatagacttgatagtatataagaggcctgtgcaataactctagtaatatgtaactaaaagcactgaactattttaacaactagattgattattacaatttatatacattttacagagattaaaattttcaggatctgtctattctaaagttttcaaataaaaagataaatttcctaagagattatatttagaagcaatgataatatatgaaaaaagcccaggcttatttcatattgtttagatgattttctgtctaattgttttgtgttttttgtcttccttattatagtaattcagactaatgacccacatttaaaatatgcaatagtggctgactgagtagctattgtgtattataactaagaaaaatactgatcagtagtttcctgttcagcaaaatcggaagaataaggaggtctttaaagttgtactttttcgtttgtttgtccttgcttgcatcttcctttgcatgtgcaatatacaaataagcctttaggtgaaatgtatttatccctgccttttgcaacggacttaccctaaaagtcatcatcaaaacactatgtcttattttttttctctttttctattgtagtgaattagatatatgtgcacattctatgtttatgtttaaatgatttatgttttctgtatcacaagttttcaaattaaagtatggagaat

SEQ ID NO: 24704 - DNA, 4462 bp, Homo sapiens
  misc_feature (1)..(3): n is a, c, g, or t
  misc_feature (5)..(5): n is a, c, g, or t
  misc_feature (7)..(7): n is a, c, g, or t
nnncngnctttctatgctgttcgtcacacagaaagctggaagctgatgagcacagatgatcaacagaaaatccaagcagctgcatttgacaaaggtgatgatcgaagacttggcaaaaagcctatattcagtagctcgcagcaaaggaaacaagtttctgactctggtgatataaaaatcaaatcttggaggggaaataacaagaaagagtgttggagttatctctctactaataaaaagatgaaatctgatggattaggagcatctggacattcgtcaagtaccaatagaaatagtataaataaaactctgaagcaagatgatgtaaaggaaaaagatggtacaaaaatagcatctaagattacaaaagaactaaaaactgggggaaaaaatgtttctggaaagcccaaaactgtaacaaaatccaaaacagaaaatggtgataaggcacggttggaaaacatgtcacctagacaagttgtagaaagatcagcaacagcagcagcagcagcaactggacagaagaatttactaaatggaaaaggagtgagaaatcaggaagggcaaatttcaggtgccagacccaaggtactcacaggaaacttaaatgtgcaagccaaagcaaagcctttgaagaaagctacagggaaggattcaccatgcctcagcatcgcaggaccctccagcagatccacagattcaagtatggaattctcaatttccactgaatgtctggatgaaccgaaagaaaatggatcaacagaagaagaaaagccttctggacataaactatccttttgtgattctccaggacagatgatgaaaaacagtgtagatagtgtcaaaaattccactgtagccataaaatctcgacctgtttcaagagttaccaatggaacttccaataaaaaaagtattcatgaacaagacactaatgtaaataacagtgtactaaagaaagtcagtggcaaaggatgtagtgagccagtaccacaggcaattttgaagaaaagaggaactagcaatggatgtactgcagctcagcagaggacaaagagtaccccatctaatcttactaaaactcaaggatcccaaggagagtcaccaaactcagtaaaatcttcagtctcttcaaggcagtctgatgaaaatgtggcaaagttggaccacaatacaactacagagaaacaagcacctaagagaaaaatggtcaagcaagtacacacagctttgcctaaggttaatgcaaaaatagtggcaatgcctaaaaatctaaatcagtcaaagaaaggtgaaactttgaataataaagattcaaaacagaaaatgcctcctggacaggttatatcaaaaactcagccttcctcccaaagacctttaaaacatgaaacatctactgtccaaaaaagtatgtttcatgatgtgcgtgataataacaacaaggacagtgtttctgaacagaagcctcacaaacctctcattaatcttgcatctgaaataagtgatgcagaagcactccagtcatcctgcaggcctgacccacaaaagccattaaacgatcaagaaaaagagaagttggcgttagaatgccaaaatatttcaaagctggataaatcattaaaacacgaactggaatcaaaacagatttgtttagataaaagtgaaacaaaatttcccaatcacaaagaaacagatgattgcgatgcagctaacatatgttgtcattctgttgggagtgataatgtaaattcaaaattttatagcaccacagccctaaaatacatggtttcaaatccaaatgaaaactccttgaactctaatccagtttgtgatttagactcaacaagtgcagggcaaatccatttgatatcagatagggagaaccaagtagggagaaaagatacaaacaaacaatcaagtattaaatgtgtggaagatgtttcactgtgtaatcctgaaaggacaaatggtaccttaaattctgctcaagaagacaaaaaatcgaaagttcctgtggaaggactgacaattcctagtaagttgtcagatgaatctgctatggatgaagacaaacatgctacagcagactcagatgtatcttccaagtgtttttcgggacagctatcagaaaaaaattctcctaaaaatatggaaacatcagaatctccagagagccatgaaactccagaaactccatttgtgggtcactggaatttgagtactggtgttctgcatcagcgagagagtcctgaatctgacactggcagtgctaccacctcctccgatgacataaagcccagatctgaagactatgatgctggagggtctcaggatgatgatgggtcaaatgacagaggtatctctaaatgtggcactatgctgtgccatgattttcttggaagaagtagcagtgataccagtactcctgaagaattaaaaatttatgatagtaatttaagaattgaagtaaaaatgaaaaagcaaagtaataatgatcttttccaagttaattcaacgagtgatgatgaaatccctaggaaaaggccagaaatttggtctcgatctgcaatagttcactctagggaaagagaaaatattccacgaggcagtgtccagtttgctcaggaaatagatcaggtatcttcttcagcagatgaaacagaagatgaaagatctgaagctgaaaacgttgcagaaaatttctctatatctaacccagctcctcagcagtttcagggaataattaatttagcttttgaagatgcaactgaaaatgaatgtcgtgaattttctgcaaataaaaagtttaaaaggtcagttttactttcagtcgatgaatgtgaagagctgggatcagatgaaggagaagtccatactccctttcaggcttctgtagattctttttcaccttctgatgtttttgatggcatttctcatgaacatcatggaaggacctgctattccagattctcacgagaaagtgaagataatattttagaatgtaaacaaaataaaggcaatagtgtatgtaaaaatgaaagcactgtcttggatcttagtagcattgactcttcaagaaaaaataaacagagtgtttcagccacagaaaaaaagaacacaatagacgtcctatccagtagaagcagacagcttcttcgagaagataaaaaagtaaacaatggaagcaatgtggaaaatgacattcagcaacgcagcaaattcttggatagtgatgtaaaatctcaagaaagaccatgtcacttggatcttcatcaaagagaacccaattctgacataccaaagaacagctctacaaaatctctagactcctttcggagtcaagttctgcctcaggaaggtccagtgaaagagagccattctacaactactgaaaaagctaatattgctttatctgcaggtaatgtacagaaatagaaatgctaaatgcataagaaaataagtttataaaattttaaagttgtatgaagccctgaatgttatattttagtcagatagaataattacttaagcaacagattaaaattttaaatgaaaaatgtcttaatatgaaaattactcattctttattgttcacttaaaatcctaatgaagaagtaatatctagtaaaaattttgattgttatatagagctaacctactaagagattttaaatgaaagaataaaaagaaaaacttagtttgctgctatttagttatttatgtataatttaacacaagaattcttgactattagaaattttattatacattggatatgatttatagacttgatagtatataagaggcctgtgcaataactctagtaatatgtaactaaaagcactgaactattttaacaactagattgattattacaatttatatacattttacagagattaaaattttcaggatctgtctattctaaagttttcaaataaaaagataaatttcctaagagattatatttagaagcaatgataatatatgaaaaaagcccaggcttatttcatattgtttagatgattttctgtctaattgttttgtgttttttgtcttccttattatagtaattcagactaatgacccacatttaaaatatgcaatagtggctgactgagtagctattgtgtattataactaagaaaaatactgatcagtagtttcctgttcagcaaaatcggaagaataaggaggtctttaaagttgtactttttcgtttgtttgtccttgcttgcatcttcctttgcatgtgcaatatacaaataagcctttaggtgaaatgtatttatccctgccttttgcaacggacttaccctaaaagtcatcatcaaaacactatgtcttattttttttctctttttctattgtagtgaattagatatatgtgcacattctatgtttatgtttaaatgatttatgttttctgtatcacaagttttcaaattaaagtatggagaat

SEQ ID NO: 24705 - DNA, 591 bp, Homo sapiens
gatcaagcaaccctcccccatcggcttccccaaatgctgggattacaggtgtgagccactgtgcccagcctagtatcatattttatacaagataaattttaccaaaaattctaccatcaaatatagaagttactttagttttttaaaaaataatagttcacatattctgtttcatgtcttctcttgcctctcaccctgagcacccactgattcatacctgtttatctccccctcctttgcttcttagctcctgtttattcttcaggtctgagttttgggatcatttcatttggaaagcctcagggctgtgcccagggtgctctgcctggcccctgtactcccccgagccatctcttatgcctcactgtaatcccacctgtacttgtcagtggctttgctaccctgtgtgctctgaaagcacagggacgagtcttgtttgctcctgaatcctcatctgtcagggctggtcaggcacatagatgctacatggttagtaaatatttgtgcaatataaaggttggacttctttgttactatcattacagcttcttaaaaatgaacggccacaaaattatgaccggccgcaagctt

SEQ ID NO: 24706 - DNA, 323 bp, Homo sapiens
tttttggctaagcatactaaatgaactacaatcacgtattatgtaactccaaaaacggaattttctttaaatgctggaaagaaatgtaccattgctccatctccttttaagttactgtgtgataaatacaagtaaatattgtgacttccatctctactttcactttctaaaatactgctgtagaaaaatgaatgtaccattctgacagcttatgaaatggcagacaccacatgtaactgcatcaaagccaaacataaatttttagagaaaaattacaagaaagtttttctttccacttgggaggaaaaaagaaaacaggaaaa

SEQ ID NO: 24707 - DNA, 580 bp, Homo sapiens
cggaggtgggtagatagacccggagagacggcgaaggagctggaaaccgagccagggctgagccggctgacaacaggcatcgatcgaaggtttccggtaaccagcatacaccatctcatccgaaacagcggggttcggcttctcctatggcaggatctggggcgaaaagatcaagagatggtgaactggagaccagtctaaacacccaaggttgtaccacagagggagacctgctgtttgcccagaagtgtaaagaactccaaggatttatacctcctctcacagacctactcaatgggctgaagatgggtcgttttgagagaggattaagcagttttcagcagagtgtggcaatggacaggatccagcgtattgtaggtgttttgcagaagccacagatgggggaacgttacctaggaaccttgctacaggtagaagggatgttaaagacttggtttccacaaatagctgcccagaagtcatcattgggtggtggcaagcatcagctgaccaagcattttttccaaggccacccacaagtgaatttaagcttgcttttccttttccctggcattttccg

SEQ ID NO: 24708 - DNA, 2051 bp, Homo sapiens
cggaggtgggtagatagacccggagagacggcgaaggagctggaaaccgagccagggctgagccggctgacaacaggtaaggagattcggaggacaaagcgagctgttagggagtatttgggagtggatttgggggctgaatgcagatcttggtattgggagggtttgcatcacgtggcaggtgcgagcccagagagaccggcgcagggatcctgatcttgaaagattgggagagggcaggaggccagtctctatgggggcggttcccgtaggatcaccaggtgggttcgcgtgcccagattgactgcttgtgggtggcatggcctcaggtggagaggcttgctgcggactcaggctggcgaatagccctggcgaacaacgggcggaggggaaggtgtctttcaagtcggtatttactctgaactgagggaacgaaaagaacggaggccgcgtcagaccgagagctgctctgcggcggccagagagggaatcccaagctcttaatgggcgggggtgggggtagaaatgtctttttctattgtgtttgagaccggtaatattggggagggggagaacaagtattatcccacgcagtacaccccaatctcccagttcatttcctaatccttaaactccggtttcaaactccctcgctttgctcttcagttgcaggttccgatctttgggtactccaggagctgttctatagcccctgcttctggacctatggattctccatctagcgtttcttcctattcctcctactctctctcttcgtcttttcccacctccccagtgaacagtgactttggcttcccctctgatagtgagagggaggacaagggggcccatgggcccaggccagacactgttgggcagaggggaggttcacggcccagcccgggtcctatccgctgcaggcatcgatcgaaggtttccggtaaccagcatacaccatctcatccgaaacagcggggttcggcttctcctatggcaggatctggggcgaaaagatcaagagatggtgaactggagaccagtctaaacacccaaggttgtaccacagagggagacctgctgtttgcccagaagtgtaaagaactccaaggatttatacctcctctcacagacctactcaatgggctgaagatgggtcgttttgagagaggattaagcagttttcagcagagtgtggcaatggacaggatccagcgtattgtaggtgttttgcagaagccacagatgggggaacgttacctaggaaccttgctacaggtagaagggatgttaaagacttggtttccacaaatagctgcccagaagtcatcattgggtggtggcaagcatcagctgaccaagcattttccaagccaccacagtgattcagctgcttcctctcctgcatctcctatggaaaagatggaccagacacagctaggacatctagctttaaaaccaaagcagccttggcacctcacacaatggccagctatgaacctcacctggatccacaccactccaatttgcaacccccctctcagctccccaggtactatctcctttagccatggtcctttaggcactggaaccggcattggcgtcattcttttcctccagcatggagtgcaacccttcacccactctgccccaaccaccccagtcccacctactacagcatctcctgtcatccctggtgagcctatgaaactatctggagagggtcctcgttgctacagtttgccagtaactctgccatcagactggagctataccctatcccctcccagtctacccaccttggccagaaagatgaccataggacaccgggagcagcagagaagccatcctccagttgctgctgatgctcatcttctcaacctctagcccagggcatacagctgtccactgtgacttctaatttgtgtaaatatttatgtatatatgtatttttactattaatgtgtgcatttgtgttgagggaagataaatcctttctgattaaagaaatttttttatacctaaaaaaacaccacacacccacacacaccaac

SEQ ID NO: 24709 - DNA, 1461 bp, Homo sapiens
cggaggtgggtagatagacccggagagacggcgaaggagctggaaaccgagccagggctgagccggctgacaacagttgcaggttccgatctttgggtactccaggagctgttctatagcccctgcttctggacctatggattctccatctagcgtttcttcctattcctcctactctctctcttcgtcttttcccacctccccagtgaacagtgactttggcttcccctctgatagtgagagggaggacaagggggcccatgggcccaggccagacactgttgggcagaggggaggttcacggcccagcccgggtcctatccgctgcaggcatcgatcgaaggtttccggtaaccagcatacaccatctcatccgaaacagcggggttcggcttctcctatggcaggatctggggcgaaaagatcaagagatggtgaactggagaccagtctaaacacccaaggttgtaccacagagggagacctgctgtttgcccagaagtgtaaagaactccaaggatttatacctcctctcacagacctactcaatgggctgaagatgggtcgttttgagagaggattaagcagttttcagcagagtgtggcaatggacaggatccagcgtattgtaggtgttttgcagaagccacagatgggggaacgttacctaggaaccttgctacaggtagaagggatgttaaagacttggtttccacaaatagctgcccagaagtcatcattgggtggtggcaagcatcagctgaccaagcattttccaagccaccacagtgattcagctgcttcctctcctgcatctcctatggaaaagatggaccagacacagctaggacatctagctttaaaaccaaagcagccttggcacctcacacaatggccagctatgaacctcacctggatccacaccactccaatttgcaacccccctctcagctccccaggtactatctcctttagccatggtcctttaggcactggaaccggcattggcgtcattcttttcctccagcatggagtgcaacccttcacccactctgccccaaccaccccagtcccacctactacagcatctcctgtcatccctggtgagcctatgaaactatctggagagggtcctcgttgctacagtttgccagtaactctgccatcagactggagctataccctatcccctcccagtctacccaccttggccagaaagatgaccataggacaccgggagcagcagagaagccatcctccagttgctgctgatgctcatcttctcaacctctagcccagggcatacagctgtccactgtgacttctaatttgtgtaaatatttatgtatatatgtatttttactattaatgtgtgcatttgtgttgagggaagataaatcctttctgattaaagaaatttttttatacctaaaaaaacaccacacacccacacacaccaac

SEQ ID NO: 24710 - DNA, 1975 bp, Homo sapiens
cggaggtgggtagatagacccggagagacggcgaaggagctggaaaccgagccagggctgagccggctgacaacaggtaaggagattcggaggacaaagcgagctgttagggagtatttgggagtggatttgggggctgaatgcagatcttggtattgggagggtttgcatcacgtggcaggtgcgagcccagagagaccggcgcagggatcctgatcttgaaagattgggagagggcaggaggccagtctctatgggggcggttcccgtaggatcaccaggtgggttcgcgtgcccagattgactgcttgtgggtggcatggcctcaggtggagaggcttgctgcggactcaggctggcgaatagccctggcgaacaacgggcggaggggaaggtgtctttcaagtcggtatttactctgaactgagggaacgaaaagaacggaggccgcgtcagaccgagagctgctctgcggcggccagagagggaatcccaagctcttaatgggcgggggtgggggtagaaatgtctttttctattgtgtttgagaccggtaatattggggagggggagaacaagtattatcccacgcagtacaccccaatctcccagttcatttcctaatccttaaactccggtttcaaactccctcgctttgctcttcagttgcaggttccgatctttgggtactccaggagctgttctatagcccctgcttctggacctatggattctccatctagcgtttcttcctattcctcctactctctctcttcgtcttttcccacctccccagtgaacagtgactttggcttcccctctgatagtgagagggaggacaagggggcccatgggcccaggccagacactgttgggcagaggggaggttcacggcccagcccgggtcctatccgctgcaggcatcgatcgaaggtttccggtaaccagcatacaccatctcatccgaaacagcggggttcggcttctcctatggcaggatctggggcgaaaagatcaagagatggtgaactggagaccagtctaaacacccaaggttgtaccacagagggagacctgctgtttgcccagaaggattaagcagttttcagcagagtgtggcaatggacaggatccagcgtattgtaggtgttttgcagaagccacagatgggggaacgttacctaggaaccttgctacaggtagaagggatgttaaagacttggtttccacaaatagctgcccagaagtcatcattgggtggtggcaagcatcagctgaccaagcattttccaagccaccacagtgattcagctgcttcctctcctgcatctcctatggaaaagatggaccagacacagctaggacatctagctttaaaaccaaagcagccttggcacctcacacaatggccagctatgaacctcacctggatccacaccactccaatttgcaacccccctctcagctccccaggtactatctcctttagccatggtcctttaggcactggaaccggcattggcgtcattcttttcctccagcatggagtgcaacccttcacccactctgccccaaccaccccagtcccacctactacagcatctcctgtcatccctggtgagcctatgaaactatctggagagggtcctcgttgctacagtttgccagtaactctgccatcagactggagctataccctatcccctcccagtctacccaccttggccagaaagatgaccataggacaccgggagcagcagagaagccatcctccagttgctgctgatgctcatcttctcaacctctagcccagggcatacagctgtccactgtgacttctaatttgtgtaaatatttatgtatatatgtatttttactattaatgtgtgcatttgtgttgagggaagataaatcctttctgattaaagaaatttttttatacctaaaaaaacaccacacacccacacacaccaac

SEQ ID NO: 24711 - DNA, 1207 bp, Homo sapiens
cggaggtgggtagatagacccggagagacggcgaaggagctggaaaccgagccagggctgagccggctgacaacaggcatcgatcgaaggtttccggtaaccagcatacaccatctcatccgaaacagcggggttcggcttctcctatggcaggatctggggcgaaaagatcaagagatggtgaactggagaccagtctaaacacccaaggttgtaccacagagggagacctgctgtttgcccagaagtgtaaagaactccaaggatttatacctcctctcacagacctactcaatgggctgaagatgggtcgttttgagagaggattaagcagttttcagcagagtgtggcaatggacaggatccagcgtattgtaggtgttttgcagaagccacagatgggggaacgttacctaggaaccttgctacaggtagaagggatgttaaagacttggtttccacaaatagctgcccagaagtcatcattgggtggtggcaagcatcagctgaccaagcattttccaagccaccacagtgattcagctgcttcctctcctgcatctcctatggaaaagatggaccagacacagctaggacatctagctttaaaaccaaagcagccttggcacctcacacaatggccagctatgaacctcacctggatccacaccactccaatttgcaacccccctctcagctccccaggtactatctcctttagccatggtcctttaggcactggaaccggcattggcgtcattcttttcctccagcatggagtgcaacccttcacccactctgccccaaccaccccagtcccacctactacagcatctcctgtcatccctggtgagcctatgaaactatctggagagggtcctcgttgctacagtttgccagtaactctgccatcagactggagctataccctatcccctcccagtctacccaccttggccagaaagatgaccataggacaccgggagcagcagagaagccatcctccagttgctgctgatgctcatcttctcaacctctagcccagggcatacagctgtccactgtgacttctaatttgtgtaaatatttatgtatatatgtatttttactattaatgtgtgcatttgtgttgagggaagataaatcctttctgattaaagaaatttttttatacctaaaaaaacaccacacacccacacacaccaac

SEQ ID NO: 24712 - DNA, 1412 bp, Homo sapiens
cggaggtgggtagatagacccggagagacggcgaaggagctggaaaccgagccagggctgagccggctgacaacaggtaaggagattcggaggacaaagcgagctgttagggagtatttgggagtggatttgggggctgaatgcagatcttggtattgggagggtttgcatcacgtggcaggtgcgagcccagagagaccggcgcagggatcctgatcttgaaagattgggagagggcaggaggccagtctctatgggggcggttcccgtaggatcaccaggcatcgatcgaaggtttccggtaaccagcatacaccatctcatccgaaacagcggggttcggcttctcctatggcaggatctggggcgaaaagatcaagagatggtgaactggagaccagtctaaacacccaaggttgtaccacagagggagacctgctgtttgcccagaagtgtaaagaactccaaggatttatacctcctctcacagacctactcaatgggctgaagatgggtcgttttgagagaggattaagcagttttcagcagagtgtggcaatggacaggatccagcgtattgtaggtgttttgcagaagccacagatgggggaacgttacctaggaaccttgctacaggtagaagggatgttaaagacttggtttccacaaatagctgcccagaagtcatcattgggtggtggcaagcatcagctgaccaagcattttccaagccaccacagtgattcagctgcttcctctcctgcatctcctatggaaaagatggaccagacacagctaggacatctagctttaaaaccaaagcagccttggcacctcacacaatggccagctatgaacctcacctggatccacaccactccaatttgcaacccccctctcagctccccaggtactatctcctttagccatggtcctttaggcactggaaccggcattggcgtcattcttttcctccagcatggagtgcaacccttcacccactctgccccaaccaccccagtcccacctactacagcatctcctgtcatccctggtgagcctatgaaactatctggagagggtcctcgttgctacagtttgccagtaactctgccatcagactggagctataccctatcccctcccagtctacccaccttggccagaaagatgaccataggacaccgggagcagcagagaagccatcctccagttgctgctgatgctcatcttctcaacctctagcccagggcatacagctgtccactgtgacttctaatttgtgtaaatatttatgtatatatgtatttttactattaatgtgtgcatttgtgttgagggaagataaatcctttctgattaaagaaatttttttatacctaaaaaaacaccacacacccacacacaccaac

SEQ ID NO: 24713 - DNA, 1155 bp, Homo sapiens
cggaggtgggtagatagacccggagagacggcgaaggagctggaaaccgagccagggctgagccggctgacaacagcggggttcggcttctcctatggcaggatctggggcgaaaagatcaagagatggtgaactggagaccagtctaaacacccaaggttgtaccacagagggagacctgctgtttgcccagaagtgtaaagaactccaaggatttatacctcctctcacagacctactcaatgggctgaagatgggtcgttttgagagaggattaagcagttttcagcagagtgtggcaatggacaggatccagcgtattgtaggtgttttgcagaagccacagatgggggaacgttacctaggaaccttgctacaggtagaagggatgttaaagacttggtttccacaaatagctgcccagaagtcatcattgggtggtggcaagcatcagctgaccaagcattttccaagccaccacagtgattcagctgcttcctctcctgcatctcctatggaaaagatggaccagacacagctaggacatctagctttaaaaccaaagcagccttggcacctcacacaatggccagctatgaacctcacctggatccacaccactccaatttgcaacccccctctcagctccccaggtactatctcctttagccatggtcctttaggcactggaaccggcattggcgtcattcttttcctccagcatggagtgcaacccttcacccactctgccccaaccaccccagtcccacctactacagcatctcctgtcatccctggtgagcctatgaaactatctggagagggtcctcgttgctacagtttgccagtaactctgccatcagactggagctataccctatcccctcccagtctacccaccttggccagaaagatgaccataggacaccgggagcagcagagaagccatcctccagttgctgctgatgctcatcttctcaacctctagcccagggcatacagctgtccactgtgacttctaatttgtgtaaatatttatgtatatatgtatttttactattaatgtgtgcatttgtgttgagggaagataaatcctttctgattaaagaaatttttttatacctaaaaaaacaccacacacccacacacaccaac

SEQ ID NO: 24714 - DNA, 488 bp, Homo sapiens
ctttctccacatttctttttttctcatttctcccctctctagcattttccaagccaccacagtgattcagctgcttcctctcctgcatctcctatggaaaagatggaccagacacagctaggacatctagctttaaaaccaaagcagccttggcacctcacacaatggccagctatgaacctcacctggatccacaccactccaatttgcaacccccctctcagctccccaggtactatctcctttagccatggtcctttaggcactggaaccggcattggcgtcattcttttcctccagcatggagtgcaacccttcacccactctgccccaaccaccccagtcccacctactacagcatctcctgtcatccctggtgagcctatgaaactatctggagagggtcctcgttgctacagtttgccagtaactctgccatcagactggagctataccctatcccctcccagtctacccaccttggccag

SEQ ID NO: 24715 - DNA, 1189 bp, Homo sapiens
ggagagacgaccaaggaagctggaacgcgagccaggtctgataccggatgatgactaggcatcgatcgaaggtttccggtaaccagcatacaccatctcatccgaaacagcggggttcggcttctcctatggcaggatctggggcgaaaagatcaagagatggtgaactggagaccagtctaaacacccaaggttgtaccacagagggagacctgctgtttgcccagaagtgtaaagaactccaaggatttatacctcctctcacagacctactcaatgggctgaagatgggtcgttttgagagaggattaagcagttttcagcagagtgtggcaatggacaggatccagcgtattgtaggtgttttgcagaagccacagatgggggaacgttacctaggaaccttgctacaggtagaagggatgttaaagacttggtttccacaaatagctgcccagaagtcatcattgggtggtggcaagcatcagctgaccaagcattttccaagccaccacagtgattcagctgcttcctctcctgcatctcctatggaaaagatggaccagacacagctaggacatctagctttaaaaccaaagcagccttggcacctcacacaatggccagctatgaacctcacctggatccacaccactccaatttgcaacccccctctcagctccccaggtactatctcctttagccatggtcctttaggcactggaaccggcattggcgtcattcttttcctccagcatggagtgcaacccttcacccactctgccccaaccaccccagtcccacctactacagcatctcctgtcatccctggtgagcctatgaaactatctggagagggtcctcgttgctacagtttgccagtaactctgccatcagactggagctataccctatcccctcccagtctacccaccttggccagaaagatgaccataggacaccgggagcagcagagaagccatcctccagttgctgctgatgctcatcttctcaacctctagcccagggcatacagctgtccactgtgacttctaatttgtgtaaatatttatgtatatatgtatttttactattaatgtgtgcatttgtgttgagggaagataaatcctttctgattaaagaaatttttttatacctaaaaaaacaccacacacccacacacaccaac

SEQ ID NO: 24716 - DNA, 493 bp, Homo sapiens
taacatggtacttaggcacataaagttaacagcctattggatgcatactcaggcctgttaagtaatgaatccatgatcctggctgtgaactccaggtatgataagctatcatgctcttttatttcaccaattggatatattagtgaaatgttatatctttaaaaacatgcaattgtgaaagataagaaattactccaaacttcaccatcataatttggtgactactatttctttcttatactctttcccagtctttttgtattgcgtagacaagcagataatctttctagctgctgaggcaagcttcatttgccatcagtttgaagatgcatctcaatgtaagaaatactaagatgtgaaaaacatattatcattgattacagaaaatgggtcagtaatatatctcaactgtttaaagcttagcatggctttgtggacttggctgggaatgtaaccactctttgcattattatgtttatggagaaatatattc

SEQ ID NO: 24717 - DNA, 424 bp, Homo sapiens
gcccagcaactctcatttgaattgagggtggaagcggttctcgggcacagtatgccaaggcccagggcgtccaagggacagagcagagatcacagatgctgaacgggtggggaaggagcactaggcagggcatttctgatgagactttgatttgggaggtacgaaagttgtatgaggaatcttgataaactgcttagagtgaatggagatgagtaggaatcaccaccattcacatactggctctgcaagccactcagcacagctctgcacctgctcttatggaggagaagacaagcagaagagaatgttctgatctagaagagttcgtgtaagagcatgaaggcaacagcacttgagatgtggtgcacatgagcaaaatttcagtttatgtggaccatgtttaagtttaagttcatttaagttc

SEQ ID NO: 24718 - DNA, 575 bp, Homo sapiens
acccagagccagcaaatgagacacagggtttattgagaggactgacttacagggtgatccagtggcagtgggctggacaggagaatcccaatcgcttgcaaaaagcctgcagttgataaatcaccttcacttagcacctgctcctacatggcaatcctcatttaactcaaagcaaagggcctcaatcccttgtgtggtccatgttccacaggatgggccaggggttcacatgttccttatagacaaggaatgaatctctggattccttagctcggaattctgaacacacattcttcttctgaagttattgctgtcaggtgcacctacactgaatgctgccaactgccagacttagaggagtaattggctgagggattctggcttccccatcataaattccaaaaaaagcaggagatctcattaaaaaaaaaaaattgactatgatgctcatagatgacttttccacattttccatgatcgatttggaagttggttgaagatggagatcctgacattctatttttcctcgatagtcttggtttaaaataaaggcctaggaaaaatatgtgaacttt

SEQ ID NO: 24719 - DNA, 2665 bp, Homo sapiens
cccgcacccccaagctgccactgcagcagtcagagtggcagctgaaggctcggttcatgccgtgcccccgggcagttctggtgaggctaagcaagaggcctctgcatcttgacacctaggagagcagggacggagtctcccagggtggaggaccatgctgcgccgcaagccctccaatgccagtgagaaggagcccactcagaagaaaaagctctcccttcagcgctccagcagcttcaaggattttgccaaatccaaacccagctcccccgtggtgagcgagaaggagtttaatctggatgataacattccagaagatgactcaggtgtccccaccccagaagatgctgggaagagtggcaaaaagctggggaagaagtggagggcagtgatttcccgaaccatgaacaggaagatgggcaagatgatggtgaaggccctgtcagaagagatggcagacactctggaggagggctctgcctccccgacatctccagactacagcctggacagccctggccctgagaagatggcgctggccttttctgagcaagaggagcatgaacttccggtgctcagccgccaggcatcaacaggcagtgagctctgcagccccagcccaggttctggcagcttcggggaggaaccacctgccccccagtacacagggcctttctgtggccgggcacgagtccacaccgacttcactcccagcccctatgaccacgactcgctgaaactgcagaaaggagatgtgatccagatcattgaaaagccacctgtgggcacgtggctgggcctactcaatggcaaggtgggctctttcaaattcatctatgtggatgtgctgcccgaggaggccgtggggcatgcccgccccagccgccgacagagcaagggcaagaggcccaagcctaagaccctgcatgagctgctggagcgcatcggcctggaggagcacacatccaccctcctgctcaatggctaccagacactggaagacttcaaagagctgcgagaaacacacctcaatgagctgaacatcatggatccacagcaccgggccaagctgctcacggccgccgagctgctgctggactatgacactggcagtgaggaggctgaagagggcgccgagagcagccaggagccagtggcacacacagtgtcggaacccaaggtggacatcccgcgcgactcaggctgctttgagggctcggagagcgggcgcgatgacgcagagctggcaggcactgaggagcagctgcaaggcctctccctggccggggcaccttgaggtggcggtggcaataggccaaggctgggacccagctgcaaaggctgtaggagtgggcccagcctcccgtggtggcccaggtcctgaggactggcactgagcctggccctgcttccccagggacacttagggccacagaggccaggccagggccctacaggttccaggctcagctggagtggttggggagtcgcccaagggcacatcccacctgcctgagccccgccctccaccagcgactgacagcgcagcccctcctggcaccaactgctcccctgccatggccacggccacagcaagtggggcactgggaaaccctgcccatgtccctcaccaacaaggcctccaaatcctcctcacccccaaacacctacccctgtcgcactgctcctgaaaagggggccaagtcaatgtttcaggtcagtctaaaaaccctagggaagctggccatttaaaagaacccaaactgaccatgggtaaatccagttcccctaaataaggcctgaagaaatccacaggtaccattcccactttccttctccctagctttcttagaggtttggccactaaatcttatgagacttgaaccaagtggcttcctctttctaggcttaggacgggttggggttagaaagggtgatcactgaaggccttgcctgctctgacattctgtgacattaaatgtctattctcctgttacctgtggcctgggacaccagtggggtttatcgaggggaccagaggggcctcaggctttcagatgaaatggctcctcctactcacccactttattcctctccatgtaattcaggacaagctgcaacttcccccagcttaacacaatgcccatacctcatacgatatgcgccctcccgttccatccctggccccctcaaacgagacttctcacaaggctgattacagatggtcaaacctggcttccaaggacagaattgcctctcggaagccagctgtggatctgagtccagagttggccacttgtgtgggtcctcacaagcaaagagagcactaaacttgacattgggggtccaccactccaactttgctttctgaaggttttggtgtacattgagccccagaaggaaaggagagtatctgtgagtgggggcctcccttgaccccagtacgaagtctatgccctgaatccccagagtagcccttcctggtgcccaactggcctggggacaaacagcgtccactacatctaggactgccggctaagtggacacacttcttgacctcctaccaggaactttggtaaaagctagctttggggaaggggttgggtgtaaatatgagagggtggagggagaccagctggtagcaataaacatgggtagaactaaa

SEQ ID NO: 24720 - DNA, 2376 bp, Homo sapiens
cccgcacccccaagctgccactgcagcagtcagagtggcagctgaaggctcggttcatgccgtgcccccgggcagttctggtgaggctaagcaagaggcctctgcatcttgacacctaggagagcagggacggagtctcccagggtggaggaccatgctgcgccgcaagccctccaatgccagtgagaaggagcccactcagaagaaaaagctctcccttcagcgctccagcagcttcaaggattttgccaaatccaaacccagctcccccgtggtgagcgagaaggagtttaatctggatgataacattccagaagatgactcaggtgtccccaccccagaagatgctgggaagagtggcaaaaagctggggaagaagtggagggcagtgatttcccgaaccatgaacaggaagatgggcaagatgatggtgaaggccctgtcagaagagatggcagacactctggaggagggctctgcctccccgacatctccagactacagcctggacagccctggccctgagaagatggcgctggccttttctgagcaagaggagcatgaacttccggtgctcagccgccaggcatcaacaggcagtgagctctgcagccccagcccaggttctggcagcttcggggaggaaccacctgccccccagtacacagggcctttctgtggccgggcacgagtccacaccgacttcactcccagcccctatgaccacgactcgctgaaactgcagaaaggagatgtgatccagatcattgaaaagccacctgtgggcacgtggctgggcctactcaatggcaaggtgggctctttcaaattcatctatgtggatgtgctgcccgaggaggccgtggggcatgcccgccccagccgccgacagagcaagggcaagaggcccaagcctaagaccctgcatgagctgctggagcgcatcggcctggaggagcacacatccaccctcctgctcaatggctaccagacactggaagacttcaaagagctgcgagaaacacacctcaatgagctgaacatcatggatccacagcaccgggccaagctgctcacggccgccgagctgctgctggactatgacactggcagtgaggaggctgaagagggcgccgagagcagccaggagccagtggcacacacagtgtcggaacccaaggtggacatcccgcgcgactcaggctgctttgagggctcggagagcgggcgcgatgacgcagagctggcaggcactgaggagcagctgcaaggcctctccctggccggggcaccttgaggtggcggtggcaataggccaaggctgggacccagctgcaaaggctgtaggagtgggcccagcctcccgtggtggcccaggtcctgaggactggcactgagcctggccctgcttccccagggacacttagggccacagaggccaggccagggccctacaggttccaggctcagctggagtggttggggagtcgcccaagggcacatcccacctgcctgagccccgccctccaccagcgactgacagcgcagcccctcctggcaccaactgctcccctgccatggccacggccacagcaagtggggcactgggaaaccctgcccatgtccctcaccaacaaggcctccaaatcctcctcacccccaaacacctacccctgtcgcactgctcctgaaaagggggccaagtcaatgtttcaggtcagtctaaaaaccctagggaagctggccatttaaaagaacccaaactgaccatgggtaaatccagttcccctaaataaggcctgaagaaatccacaggtaccattcccactttcttcccccagcttaacacaatgcccatacctcatacgatatgcgccctcccgttccatccctggccccctcaaacgagacttctcacaaggctgattacagatggtcaaacctggcttccaaggacagaattgcctctcggaagccagctgtggatctgagtccagagttggccacttgtgtgggtcctcacaagcaaagagagcactaaacttgacattgggggtccaccactccaactttgctttctgaaggttttggtgtacattgagccccagaaggaaaggagagtatctgtgagtgggggcctcccttgaccccagtacgaagtctatgccctgaatccccagagtagcccttcctggtgcccaactggcctggggacaaacagcgtccactacatctaggactgccggctaagtggacacacttcttgacctcctaccaggaactttggtaaaagctagctttggggaaggggttgggtgtaaatatgagagggtggagggagaccagctggtagcaataaacatgggtagaactaaa

SEQ ID NO: 24721 - DNA, 2213 bp, Homo sapiens
  misc_feature (1996)..(1996): n is a, c, g, or t
cccgcacccccaagctgccactgcagcagtcagagtggcagctgaaggctcggttcatgccgtgcccccgggcagttctggtgaggctaagcaagaggcctctgcatcttgacacctaggagagcagggacggagtctcccagggtggaggaccatgctgcgccgcaagccctccaatgccagtgagaaggagcccactcagaagaaaaagctctcccttcagcgctccagcagcttcaaggattttgccaaatccaaacccagctcccccgtggtgagcgagaaggagtttaatctggatgataacattccagaagatgactcaggtgtccccaccccagaagatgctgggaagagtggcaaaaagctggggaagaagtggagggcagtgatttcccgaaccatgaacaggaagatgggcaagatgatggtgaaggccctgtcagaagagatggcagacactctggaggagggctctgcctccccgacatctccagactacagcctggacagccctggccctgagaagatggcgctggccttttctgagcaagaggagcatgaacttccggtgctcagccgccaggcatcaacaggcagtgagctctgcagccccagcccaggttctggcagcttcggggaggaaccacctgccccccagtacacagggcctttctgtggccgggcacgagtccacaccgacttcactcccagcccctatgaccacgactcgctgaaactgcagaaaggagatgtgatccagatcattgaaaagccacctgtgggcacgtggctgggcctactcaatggcaaggtgggctctttcaaattcatctatgtggatgtgctgcccgaggaggccgtggggcatgcccgccccagccgccgacagagcaagggcaagaggcccaagcctaagaccctgcatgagctgctggagcgcatcggcctggaggagcacacatccaccctcctgctcaatggctaccagacactggaagacttcaaagagctgcgagaaacacacctcaatgagctgaacatcatggatccacagcaccgggccaagctgctcacggccgccgagctgctgctggactatgacactggcagtgaggaggctgaagagggcgccgagagcagccaggagccagtggcacacacagtgtcggaacccaaggtggacatcccgcgcgactcaggctgctttgagggctcggagagcgggcgcgatgacgcagagctggcaggcactgaggagcagctgcaaggcctctccctggccggggcaccttgaggtggcggtggcaataggccaaggctgggacccagctgcaaaggctgtaggagtgggcccagcctcccgtggtggcccaggtcctgaggactggcactgagcctggccctgcttccccagggacacttagggccacagaggccaggccagggccctacaggttccaggctcagctggagtggttggggagtcgcccaagggcacatcccacctgcctgagccccgccctccaccagcgactgacagcgcagcccctcctggcaccaactgctcccctgccatggccacggccacagcaagtggggcactgggaaaccctgcccatgtccctcaccaacaaggcctccaaatcctcctcacccccaaacacctacccctgtcgcactgctcctgaaaagggggccaagtcaatgtttcaggtcagtctaaaaaccctagggaagctggccatttaaaagaacccaaactgaccatgggtaaatccagttcccctaaataaggcctgaagaaatccacaggtaccattcccactttccttctccctagctttcttagaggtttggccactaaatcttatgagacttgaaccaagtggcttcctctttctaggcttaggacgggttggggttagaaagggtgatcactgaaggccttgcctgctctgacattctgtgacattaaatgtctattctcctgttngaaaaaaaaaaaaaaaaaaaaaacaaaaaaaaaaaaaaaaaaaaaaaataaaaaaaaaaaaacaaaaaaaaaggacaaacaaaaaaaaaacaagaaaaaaaaaaaaaagggggcccggggtcccaaaaaggggccccgccctttgaaaaaccccctaaagatttgggaaaaaaaatttaattaaggggggaccccccctttgtctaaaaaaaaaagg

SEQ ID NO: 24722 - DNA, 2832 bp, Homo sapiens
cccgcacccccaagctgccactgcagcagtcagagtggcagctgaaggctcggttcatgccgtgcccccgggcagttctggtgaggctaagcaagaggcctctgcatcttgacacctaggagagcagggacggagtctcccagggtggaggaccatgctgcgccgcaagccctccaatgccagtgagaaggagcccactcagaagaaaaagctctcccttcagcgctccagcagcttcaaggattttgccaaatccaaacccagctcccccgtggtgagcgagaaggagtttaatctggatgataacattccagaagatgactcaggtgtccccaccccagaagatgctgggaagagtggcaaaaagctggggaagaagtggagggcagtgatttcccgaaccatgaacaggaagatgggcaagatgatggtgaaggccctgtcagaagagatggcagacactctggaggagggctctgcctccccgacatctccagactacagcctggacagccctggccctgagaagatggcgctggccttttctgagcaagaggagcatgaacttccggtgctcagccgccaggcatcaacaggcagtgagctctgcagccccagcccaggttctggcagcttcggggaggaaccacctgccccccagtacacagggcctttctgtggccgggcacgagtccacaccgacttcactcccagcccctatgaccacgactcgctgaaactgcagaaaggagatgtgatccagatcattgaaaagccacctgtgggcacgtggctgggcctactcaatggcaaggtgggctctttcaaattcatctatgtggatgtgctgcccgaggaggccgtggggcatgcccgccccagccgccgacagagcaagggcaagaggcccaagcctaagaccctgcatgagctgctggagcgcatcggcctggaggagcacacatccaccctcctgctcaatggctaccagacactggaagacttcaaagagctgcgagaaacacacctcaatgagctgaacatcatggatccacagcaccgggccaagctgctcacggccgccgagctgctgctggactatgacactggcagtgaggaggctgaagagggcgccgagagcagccaggagccagtggcacacacagtgtcggaacccaaggtggacatcccgcgcgactcaggctgctttgagggctcggagagcgggcgcgatgacgcagagctggcaggcactgaggagcagctgcaaggcctctccctggccggggcaccttgaggtggcggtggcaataggccaaggctgggacccagctgcaaaggctgtaggagtgggcccagcctcccgtggtggcccaggtcctgaggactggcactgagcctggccctgcttccccagggacacttagggccacagaggccaggccagggccctacaggttccaggctcagctggagtggttggggagtcgcccaagggcacatcccacctgcctgagccccgccctccaccagcgactgacagcgcagcccctcctggcaccaactgctcccctgccatggccacggccacagcaagtggggcactgggaaaccctgcccatgtccctcaccaacaaggcctccaaatcctcctcacccccaaacacctacccctgtcgcactgctcctgaaaagggggccaagtcaatgtttcaggtcagtctaaaaaccctagggaagctggccatttaaaagaacccaaactgaccatgggtaaatccagttcccctaaataaggcctgaagaaatccacaggtaccattcccactttccttctccctagctttcttagaggtttggccactaaatcttatgagacttgaaccaagtggcttcctctttctaggcttaggacgggttggggttagaaagggtgatcactgaaggccttgcctgctctgacattctgtgacattaaatgtctattctcctgttacctgtggcctgggacaccagtggggtttatcgaggggaccagaggggcctcaggctttcagatgaaatggctcctcctactcacccactttattcctctccatgtaattcaggacaagctgcaacttcccccagcttaacacaatgcccatacctcatacgatatgcgccctcccgttccatccctggccccctcaaacgagacttctcacaaggctgattacagatggtcaaacctggcttccaaggacagaattgcctctcggaagccagctgtggatctgagtccagagttggccacttgtgtgggtcctcacaagcaaagagagcactaaacttgacattgggggtccaccactccaactttgctttctgaaggttttggtgtacattgagccccagaaggaaaggagagtatctgtgagtgggggcctcccttgaccccagtacgaagtctatgccctgaatccccagagtagcccttcctggtgcccaactggcctggggacaaacagcgtccactacatctaggactgccggctaagtggacacacttcttgacctcctaccaggaactttggtaaaagctagctttggggaaggggttgggtgtaaatatgagagggtggagggagaccagctggtagcaataaacatgggtagaactaaaaaaaaacataaaaaaacaagggggcggtaaaaatacacaagggggaccagttaggatccggtttgtaaagggccaaaggggataaaagaagcacgggataaaggggagggaacgcgtggttgggagacactttggggatggaacagaaagaggaaaagtgagggcag

SEQ ID NO: 24723 - DNA, 1811 bp, Homo sapiens
ggaggctcgccctaccctgcctcgccgctgctgggccgccccctctactacacgtcgcccttctacggcaactacacaaactacgggaacttgaacgcggcgctgcagggccagggtctcctgcggtacaactctgcggccgcggcccccggcgaggccctgcacaccgcgccaaaggcggccagcgacgcgggcaaggcgggcgcgcacccgctcgagtcccactaccggtccccgggcggcggctacgagcccaagaaagatgccagcgagggctgcaccgtggttggcgggggcgtccagccctacctatagaagggccgagcacagcaatgcaagtaagtgggcaccctggtgcttcccagaccctgtggagcctcccagcaccaacttgcttaatgtgtttttcttgcttctggtcatggggttagaagacagagcatttcaatcttgtccagcttttctttccttaagggggaaactatattttctgttttatagattccctctttttggcacaagttctatcactcctttacctagggaaggaaaaaaaaatatatatatatatgtgtgtgtgtgtgtgtgtaatatatatatgtatatatatagtacatgtatatatatagtacatgtgtatatatatattacacactactgttgttttcttttgaaacaatagattattaaaatctgggcatttatatgcaatttagagccatttttactatgctagacacataatagacacatgctttgatgagcttgggctaccaaaacttggagtagcaaaaacctttatagatgatgtttgcaaaataagactgaagagacacgaggcgtactagtcttttatcagccctgcccaacctcccctccacccatgtccaagtggacaggactctgacattctcccggggctcacaacagtatctcaaaaaatatgttgctttgcaacgagtcagaattactaatcatagatcttgaagataagaaagatttggaaccacttcagatcaactcgtttttataatggtgttgttgtggaactgaaagattggggatgatttggttttttccttggtccacaggtaggtgtcacaattgctttgaaaaaaaaaaaaaaaaaaaaaagtcagcaggccattctctcttcccaagctcataaatttacagatacaacaaacagatgtctaaatccagaccacatcttgtgccactgtaaaagagaaggatccacacagcactgtcagcccacagactctaacaattggaacagactattgttggacatatgtgaatttgttggcatagtatagtttccccgatgtatgtgtgacttttgaaaacaatctgtttttctcaggatatcttgaattgatcacttcattgccacggtatatattctataggtgtgataggatttactgtaaagtttatttgtaaaagatgtacacagtagaaataaaacgtgatggaagaacttgagtacttcagaagtggaaacaaatttgatatttatttttataatgatataaagcttctagtaatttatgcaagttgtattgcaatggaatctaaactttttgtaaataaattctgcctggtttttatttgaacattgctggttatacaatctttgttggttgtttaacacgaattctttactaatttatatcttaaattgtaaataaaaacagactagtctacaataatatgatgtttggggcttatttttcctagaagaatgatttggggtagagctctagtgaataacctccaggtgatctgacctcacctttttaatgaaa

SEQ ID NO: 24724 - DNA, 1989 bp, Homo sapiens
ggaggctcgccctaccctgcctcgccgctgctgggccgccccctctactacacgtcgcccttctacggcaactacacaaactacgggaacttgaacgcggcgctgcagggccagggtctcctgcggtacaactctgcggccgcggcccccggcgaggccctgcacaccgcgccaaaggcggccagcgacgcgggcaaggcgggcgcgcacccgctcgagtcccactaccggtccccgggcggcggctacgagcccaagaaagatgccagcgagggctgcaccgtggttggcgggggcgtccagccctacctatagaagggccgagcacagcaatgcaagtaagtgggcaccctggtgcttcccagaccctgtggagcctcccagcaccaacttgcttaatgtgtttttcttgcttctggtcatggggttagaagacagagcatttcaatcttgtccagcttttctttccttaagggggaaactatattttctgttttatagattccctctttttggcacaagttctatcactcctttacctagggaaggaaaaaaaaatatatatatatatgtgtgtgtgtgtgtgtgtaatatatatatgtatatatatagtacatgtatatatatagtacatgtgtatatatatattacacactactgttgttttcttttgaaacaatagattattaaaatctgggcatttatatgcaatttagagccatttttactatgctagacacataatagacacatgctttgatgagcttgggctaccaaaacttggagtagcaaaaacctttatagatgatgtttgcaaaataagactgaagagacacgaggcgtactagtcttttatcagccctgcccaacctcccctccacccatgtccaagtggacaggactctgacattctcccggggctcacaacagtatctcaaaaaatatgttgctttgcaacgagtcagaattactaatcatagatcttgaagataagaaagatttggaaccacttcagatcaactcgtttttataatggtgttgttgtggaactgaaagattggggatgatttggttttttccttggtccacaggtaggtgtcacaattgctttgaaaaaaaaaaaaaaaaaaaaaagtcagcaggccattctctcttcccaagctcataaatttacagatacaacaaacagatgtctaaatccagaccacatcttgtgccactgtaaaagagaaggatccacacagcactgtcagcccacagactctaacaattggaacagactattgttggacatatgtgaatttgttggcatagtatagtttccccgatgtatgtgtgacttttgaaaacaatctgtttttctcaggatatcttgaattgatcacttcattgccacggtatatattctataggtgtgataggatttactgtaaagtttatttgtaaaagatgtacacagtagaaataaaacgtgatggaagaacttgagtacttcagaagtggaaacaaatttgatatttatttttataatgatataaagcttctagtaatttatgcaagttgtattgcaatggaatctaaactttttgtaaataaattctgcctggtttttatttgaaaaaaaaaaaaaaaaaaaaaaaaaaaaaaaaaaaaaaaaaaaaaaaaaaaaaaagaaaaaaaaaaaaccaaaagacgagcgggaagactaacaagaagagcaccacaaggaggaggatcgctgaaatagtgaatagggtctcggtgaagaaaatagcgaggagggagcggggagactaagccaaggagagtgaaaaaagaagaatgagagaaggtaggggtcagagacatgataaacagacaggaggtaagggaagaaaagcgggataagaacataaatagaggggagagacagaaccaggagatgggttggagacaaaagactggtcggaaactcgcgagagggcggagaaaagaacgacggaaaagaga

SEQ ID NO: 24725 - DNA, 876 bp, Homo sapiens
ggaggctcgccctaccctgcctcgccgctgctgggccgccccctctactacacgtcgcccttctacggcaactacacaaactacgggaacttgaacgcggcgctgcagggccagggtctcctgcggtacaactctgcggccgcggcccccggcgaggccctgcacaccgcgccaaaggcggccagcgacgcgggcaaggcgggcgcgcacccgctcgagtcccactaccggtccccgggcggcggctacgagcccaagaaagatgccagcgagggctgcaccgtggttggcgggggcgtccagccctacctatagaagggccgagcacagcaatgcaaatacaacaaacagatgtctaaatccagaccacatcttgtgccactgtaaaagagaaggatccacacagcactgtcagcccacagactctaacaattggaacagactattgttggacatatgtgaatttgttggcatagtatagtttccccgatgtatgtgtgacttttgaaaacaatctgtttttctcaggatatcttgaattgatcacttcattgccacggtatatattctataggtgtgataggatttactgtaaagtttatttgtaaaagatgtacacagtagaaataaaacgtgatggaagaacttgagtacttcagaagtggaaacaaatttgatatttatttttataatgatataaagcttctagtaatttatgcaagttgtattgcaatggaatctaaactttttgtaaataaattctgcctggtttttatttgaacattgctggttatacaatctttgttggttgtttaacacgaattctttactaatttatatcttaaattgtaaataaaaacagactagtctacaata

SEQ ID NO: 24726 - DNA, 1714 bp, Homo sapiens
ggaggctcgccctaccctgcctcgccgctgctgggccgccccctctactacacgtcgcccttctacggcaactacacaaactacgggaacttgaacgcggcgctgcagggccagggtctcctgcggtacaactctgcggccgcggcccccggcgaggccctgcacaccgcgccaaaggcggccagcgacgcgggcaaggcgggcgcgcacccgctcgagtcccactaccggtccccgggcggcggctacgagcccaagaaagatgccagcgagggctgcaccgtggttggcgggggcgtccagccctacctatagaagggccgagcacagcaatgcaagtaagtgggcaccctggtgcttcccagaccctgtggagcctcccagcaccaacttgcttaatgtgtttttcttgcttctggtcatggggttagaagacagagcatttcaatcttgtccagcttttctttccttaagggggaaactatattttctgttttatagattccctctttttggcacaagttctatcactcctttacctagggaaggaaaaaaaaatatatatatatatgtgtgtgtgtgtgtgtgtaatatatatatgtatatatatagtacatgtatatatatagtacatgtgtatatatatattacacactactgttgttttcttttgaaacaatagattattaaaatctgggcatttatatgcaatttagagccatttttactatgctagacacataatagacacatgctttgatgagcttgggctaccaaaacttggagtagcaaaaacctttatagatgatgtttgcaaaataagactgaagagacacgaggcgtactagtcttttatcagccctgcccaacctcccctccacccatgtccaagtggacaggactctgacattctcccggggctcacaacagtatctcaaaaaatatgttgctttgcaacgagtcagaattactaatcatagatcttgaagataagaaagatttggaaccacttcagatcaactcgtttttataatggtgttgttgtggaactgaaagattggggatgatttggttttttccttggtccacaggtaggtgtcacaattgctttgaaaaaaaaaaaaaaaaaaaaaagtcagcaggccattctctcttcccaagctcataaatttacagatacaacaaacagatgtctaaatccagaccacatcttgtgccactgtaaaagagaaggatccacacagcactgtcagcccacagactctaacaattggaacagactattgttggacatatgtgaatttgttggcatagtatagtttccccgatgtatgtgtgacttttgaaaacaatctgtttttctcaggatatcttgaattgatcacttcattgccacggtatatattctataggtgtgataggatttactgtaaagtttatttgtaaaagatgtacacagtagaaataaaacgtgatggaagaacttgagtacttcagaagtggaaacaaatttgatatttatttttataatgatataaagcttctagtaatttatgcaagttgtattgcaatggaatctaaactttttgtaaataaattctgcctggtttttatttgaacattgctggttatacaatctttgttggttgtttaacacgaattctttactaatttatatcttaaattgtaaataaaaacagactagtctacaata

SEQ ID NO: 24727 - DNA, 961 bp, Homo sapiens
ggaggctcgccctaccctgcctcgccgctgctgggccgccccctctactacacgtcgcccttctacggcaactacacaaactacgggaacttgaacgcggcgctgcagggccagggtctcctgcggtacaactctgcggccgcggcccccggcgaggccctgcacaccgcgccaaaggcggccagcgacgcgggcaaggcgggcgcgcacccgctcgagtcccactaccggtccccgggcggcggctacgagcccaagaaagatgccagcgagggctgcaccgtggttggcgggggcgtccagccctacctatagaagggccgagcacagcaatgcaagtaggtgtcacaattgctttgaaaaaaaaaaaaaaaaaaaaaagtcagcaggccattctctcttcccaagctcataaatttacagatacaacaaacagatgtctaaatccagaccacatcttgtgccactgtaaaagagaaggatccacacagcactgtcagcccacagactctaacaattggaacagactattgttggacatatgtgaatttgttggcatagtatagtttccccgatgtatgtgtgacttttgaaaacaatctgtttttctcaggatatcttgaattgatcacttcattgccacggtatatattctataggtgtgataggatttactgtaaagtttatttgtaaaagatgtacacagtagaaataaaacgtgatggaagaacttgagtacttcagaagtggaaacaaatttgatatttatttttataatgatataaagcttctagtaatttatgcaagttgtattgcaatggaatctaaactttttgtaaataaattctgcctggtttttatttgaacattgctggttatacaatctttgttggttgtttaacacgaattctttactaatttatatcttaaattgtaaataaaaacagactagtctacaata

SEQ ID NO: 24728 - DNA, 860 bp, Homo sapiens
ggaggctcgccctaccctgcctcgccgctgctgggccgccccctctactacacgtcgcccttctacggcaactacacaaactacgggaacttgaacgcggcgctgcagggccagggtctcctgcggtacaactctgcggccgcggcccccggcgaggccctgcacaccgcgccaaaggcggccagcgacgcgggcaaggcgggcgcgcacccgctcgagtcccactaccggtccccgggcggcggctacgagcccaagaaaggtaggcggcccgcggccggcggcgcccgggaggggagggagagccagccccggggaggcggagcgcccgggagacccgagggagggtccgggaagaagatccagggggccactcctgggacccagaattagcagagtgagggcggagggcgagatggaagccaaagaaggtgtggccctctttttagacttgccctgttattatttatttttacttaatttactgttattttgactattactatcgtggctgtcttagtttcggcaaacccagattgccacgaaattcaaattacagcgtgtcgccctaatgagcctgggtgtgtttcggtgtcttgttaaggagtcagagttgaatccgcttttctgccgttggctagaggcaaacagaacgttccagttactctcagaggcgttttgtcttcaaaagataaaatcaaatgttttttccgcttttctgatgccgtacgacgatcataaacaaagccgttatttgacgtgcactctcttcccggtggtgctcatggccttggctcctcagggagactacttagaagcgggacttacgaaaaatcagccattaaagtttacaacttttg

SEQ ID NO: 24729 - DNA, 4435 bp, Homo sapiens
cggggtttcaccgtgttggccaggatggtctcgatctcctgacctcgtgatctgtccacctcggcttccccaagtgctgggattacaggcatgagccaccgcgcccagcctagccatatttttatctgcatatatcagaatgtttctctcctttgaacttattaacaaaaaaggaacatgcttttcatacctagagtcctaatttcttcatcatgaaggttgctattcaaattgatccatcattttaattttaccaatggctcaaaaattctgttcagtaaatgtctttgtgactggccaatggcataaattatgtttaagattatgaacttttctgacagttgcagccaatgttttccctacgataccagatttccatcttggggcatattggattgttgtatttaagacagtcagaataatgatagtgtgtggtctccagaggtagtcagaatcctgctattgagttctttttatatcttccttttcaattttttattaccattttgtttgtttagactacactttgtagggattgaggggccaaatatctcttggagtggaattcctgtgttttgagccttaccacccggaaatatgagctatactagatagcctcatgatagcatttacgataagaacttatctcgtgtgttcatgtaattttttgagtaggaactgttttatcttgaatattgtagctaactatatatagcagaactgcctcagtctttttaagaaggaaataaataatatatgtgtatgaatttatatatacatatacactcatagacaaacttaacagttggggtcattctaacagttaaaacaattgttccattgtttaaatctcagatcctggtaaaatgttcttaatttgtctgtgtacattttcctttcatggacagaccattggagtacattaattttcttaatctgccatttggcagttcatttaatataccattttttggcaacttggtaactaagaatcacagccaaaatttgttaacatcaaagaaagctctgccatataccccgttactaaattattatacatccagcagattctgggatgtactaacttagggttaactttgttgttgttgataatactagattgctccctctttaattcttcttctggtgcaaggttgctgcttaagttaccctgggaaatactactacaaggtcaaattttctagtatcttacagcctgattgaaggtgattcagatctttgctcaatataaatggattttccaagattctctgggccatccttgacccacaggtgatctcgctggagtatattaacttaacttcagtgccagttggtttggtgccatgagatccataatgaatccagaacttcaccattgcttagatataagagtcccttggaagaataatgccactgatgatgggggtcagaaggtgtattaactcaacatagagggcttttagatttttcttcaaaaaaatttcgagaaaagtattcttttaccctccaaacagttaacagctcttagtttctccaaatatgctctttgatttacttatttttagttaaagatggtaatttattgaacaatgaaatccgtaatatattgatttaaggacaaaagtgaagttttagaattataaaagtacttaaatattatatattttccatttcataattgttttcctttctctgtggctttaaagtttttgactattttacaatgttaatcactaggtaacttgccatatttctggttctatattaagttctatcctttataatgctgttattataaagctggtttttagcatttgtctgtagcaatagaaattttactaagtctctgttctcccagtaagttttttcttttctcagtaagtccctaagaaaacatttgtttgccactcttactattcccaatcttggattgttcgagctgaaaaaaaatttgatgagaaacaggaggatccttttctggtgaatataggttcctgctttaagaatgtggaaatccattgctttatataactaatatacacacagattaattaaaattgtgagaaataattcacacatgacaagtaggtaacatgcatgagttttgaatttttttaaaaacccaactgtttgacaaaatatagaacccaaattggtactttcttagaccagtgtaacctcacacctcagttttgcttttccaaccctgacttgaaaggcatatttgtatctttttattagtgatagtgaagctgtgacactaaccttttatacaaaagagtaaagaaagaaaaactacagcgattaagatgagaacagttctgcagttgttgaactagatcacagcattgtaggcagaataaaaaatgttcatatctgagaatattcctttcgccatcttttcccaaggccagacctcctggtggagcacagttaaaagtaacattctgggcctttgtaatcggagggctgtgtctccagctggcagcctttgttttaatatataatgcaggactgtggaaaacagttggcatagaatattttcacctaaaaaaagaaagaaaagacatacaaaactggattaattgcaaaaagagaatacagtaaaataccatataactggacaaagctagaagaacctttagaagatttgtctgaaaacagatttcaagagtgagcttttatacactgctcactaatttgcttgattactaccaactcttcttaaagttaacacgtttaaataaggtatttctggacttcctagcctttcagcaagcttagaggaactagccattagctagtgatgtaaaaatattttggggactgatgcccttaaaggttatgcccttgaaagttcttaccttttctctagtgatattaaggaacgagtgggtagtgttctcagggtgaccagctgccctaaagtgcctgggattgagggtttccctggatgcgggactttccctggatacaaaacttttaagcagagttttgtatatatgtggatttttctgataagtagcacatcagaggccttaaccactgcccaaaagcgattctccattgagagtacatatcttgaacttaagaaattcatttgctctgatttttaatcttgtaaagtttttgctaaactcaaaacaagtcccaggcacaccagaaggagctgaccaccttaggtgttcttgtgatttatccttacttccctatgttgtcatagttgcttctaaactcagctgcactatggctgtcaacatttctgatacttattgggatatgtgccatccagtcatttagtactttgaatggaacatgagatttataacacaggtaatagctgaaggtaccagtatggtggtgagactcacacttagtgatccagctaaggtaactgatgttataatggaacagagaagaggccaactagatagctaagttcttctgaacctatgtgtatatgtaagtacaaatcatgcgtccttatggggttaaacttaatctgaaatttacatttttcatagtaaaaggaaaccaattgttgcagatttcttttcttgtgaggaaatacatggcctttgatgctctggcgtctactgcatttcccagtctgttctgctcgagaagccagaatgtgttgttaacatttttccgtgaatgttgtgttaaaatgattaaatgcatcagccaatggcaagtgaaggaattgggtgtcctgatgcagactgagcagtttctctcaattgtagcctcatactcataaggtgcttaccagctagaacattgagcacgtgaggtgagattttttttctctgatggcattaactttgtaatgcaatatgatggatgcagaccctgttcttgtttccctctggaagtccttagtggctgcatccttggtgcactgtgatggagatattaaatgtgttctttgtgagctttcgttctatgattgtcaaaagtacgatgtggttccttttttatttttattaaacaatgagctgaggctttattacagctggttttcaagttaaaattgttgaatactgatgtctttctcccacctacaccaaatattttagtctatttaaagtacaaaaaaagttctgcttaagaaaacattgcttacatgtcctgtgatttctggtcaatttttatatatatttgtgtgcatcatctgtatgtgctttcactttttaccttgtttgctcttacctgtgttaacagccctgtcaccgttgaaaggtggacagttttcctagcattaaaagaaagccatttgagttgtttaccatgttactatgggactaatttttaattgttttaatttttatttaaactgatctttttttatatgggattacattttggtgttcactccctaaattatatggaaaccaaaaaaagtgattgtatttcacatatggacata

SEQ ID NO: 24730 - DNA, 4381 bp, Homo sapiens
cggggtttcaccgtgttggccaggatggtctcgatctcctgacctcgtgatctgtccacctcggcttccccaagtgctgggattacaggcatgagccaccgcgcccagcctagccatatttttatctgcatatatcagaatgtttctctcctttgaacttattaacaaaaaaggaacatgcttttcatacctagagtcctaatttcttcatcatgaaggttgctattcaaattgatccatcattttaattttaccaatggctcaaaaattctgttcagtaaatgtctttgtgactggccaatggcataaattatgtttaagattatgaacttttctgacagttgcagccaatgttttccctacgataccagatttccatcttggggcatattggattgttgtatttaagacagtcagaataatgatagtgtgtggtctccagaggtagtcagaatcctgctattgagttctttttatatcttccttttcaattttttattaccattttgtttgtttagactacactttgtagggattgaggggccaaatatctcttggagtggaattcctgtgttttgagccttaccacccggaaatatgagctatactagatagcctcatgatagcatttacgataagaacttatctcgtgtgttcatgtaattttttgagtaggaactgttttatcttgaatattgtagctaactatatatagcagaactgcctcagtctttttaagaaggaaataaataatatatgtgtatgaatttatatatacatatacactcatagacaaacttaacagttggggtcattctaacagttaaaacaattgttccattgtttaaatctcagatcctggtaaaatgttcttaatttgtctgtgtacattttcctttcatggacagaccattggagtacattaattttcttaatctgccatttggcagttcatttaatataccattttttggcaacttggtaactaagaatcacagccatacatccagcagattctgggatgtactaacttagggttaactttgttgttgttgataatactagattgctccctctttaattcttcttctggtgcaaggttgctgcttaagttaccctgggaaatactactacaaggtcaaattttctagtatcttacagcctgattgaaggtgattcagatctttgctcaatataaatggattttccaagattctctgggccatccttgacccacaggtgatctcgctggagtatattaacttaacttcagtgccagttggtttggtgccatgagatccataatgaatccagaacttcaccattgcttagatataagagtcccttggaagaataatgccactgatgatgggggtcagaaggtgtattaactcaacatagagggcttttagatttttcttcaaaaaaatttcgagaaaagtattcttttaccctccaaacagttaacagctcttagtttctccaaatatgctctttgatttacttatttttagttaaagatggtaatttattgaacaatgaaatccgtaatatattgatttaaggacaaaagtgaagttttagaattataaaagtacttaaatattatatattttccatttcataattgttttcctttctctgtggctttaaagtttttgactattttacaatgttaatcactaggtaacttgccatatttctggttctatattaagttctatcctttataatgctgttattataaagctggtttttagcatttgtctgtagcaatagaaattttactaagtctctgttctcccagtaagttttttcttttctcagtaagtccctaagaaaacatttgtttgccactcttactattcccaatcttggattgttcgagctgaaaaaaaatttgatgagaaacaggaggatccttttctggtgaatataggttcctgctttaagaatgtggaaatccattgctttatataactaatatacacacagattaattaaaattgtgagaaataattcacacatgacaagtaggtaacatgcatgagttttgaatttttttaaaaacccaactgtttgacaaaatatagaacccaaattggtactttcttagaccagtgtaacctcacacctcagttttgcttttccaaccctgacttgaaaggcatatttgtatctttttattagtgatagtgaagctgtgacactaaccttttatacaaaagagtaaagaaagaaaaactacagcgattaagatgagaacagttctgcagttgttgaactagatcacagcattgtaggcagaataaaaaatgttcatatctgagaatattcctttcgccatcttttcccaaggccagacctcctggtggagcacagttaaaagtaacattctgggcctttgtaatcggagggctgtgtctccagctggcagcctttgttttaatatataatgcaggactgtggaaaacagttggcatagaatattttcacctaaaaaaagaaagaaaagacatacaaaactggattaattgcaaaaagagaatacagtaaaataccatataactggacaaagctagaagaacctttagaagatttgtctgaaaacagatttcaagagtgagcttttatacactgctcactaatttgcttgattactaccaactcttcttaaagttaacacgtttaaataaggtatttctggacttcctagcctttcagcaagcttagaggaactagccattagctagtgatgtaaaaatattttggggactgatgcccttaaaggttatgcccttgaaagttcttaccttttctctagtgatattaaggaacgagtgggtagtgttctcagggtgaccagctgccctaaagtgcctgggattgagggtttccctggatgcgggactttccctggatacaaaacttttaagcagagttttgtatatatgtggatttttctgataagtagcacatcagaggccttaaccactgcccaaaagcgattctccattgagagtacatatcttgaacttaagaaattcatttgctctgatttttaatcttgtaaagtttttgctaaactcaaaacaagtcccaggcacaccagaaggagctgaccaccttaggtgttcttgtgatttatccttacttccctatgttgtcatagttgcttctaaactcagctgcactatggctgtcaacatttctgatacttattgggatatgtgccatccagtcatttagtactttgaatggaacatgagatttataacacaggtaatagctgaaggtaccagtatggtggtgagactcacacttagtgatccagctaaggtaactgatgttataatggaacagagaagaggccaactagatagctaagttcttctgaacctatgtgtatatgtaagtacaaatcatgcgtccttatggggttaaacttaatctgaaatttacatttttcatagtaaaaggaaaccaattgttgcagatttcttttcttgtgaggaaatacatggcctttgatgctctggcgtctactgcatttcccagtctgttctgctcgagaagccagaatgtgttgttaacatttttccgtgaatgttgtgttaaaatgattaaatgcatcagccaatggcaagtgaaggaattgggtgtcctgatgcagactgagcagtttctctcaattgtagcctcatactcataaggtgcttaccagctagaacattgagcacgtgaggtgagattttttttctctgatggcattaactttgtaatgcaatatgatggatgcagaccctgttcttgtttccctctggaagtccttagtggctgcatccttggtgcactgtgatggagatattaaatgtgttctttgtgagctttcgttctatgattgtcaaaagtacgatgtggttccttttttatttttattaaacaatgagctgaggctttattacagctggttttcaagttaaaattgttgaatactgatgtctttctcccacctacaccaaatattttagtctatttaaagtacaaaaaaagttctgcttaagaaaacattgcttacatgtcctgtgatttctggtcaatttttatatatatttgtgtgcatcatctgtatgtgctttcactttttaccttgtttgctcttacctgtgttaacagccctgtcaccgttgaaaggtggacagttttcctagcattaaaagaaagccatttgagttgtttaccatgttactatgggactaatttttaattgttttaatttttatttaaactgatctttttttatatgggattacattttggtgttcactccctaaattatatggaaaccaaaaaaagtgattgtatttcacatatggacata

SEQ ID NO: 24731 - DNA, 2175 bp, Homo sapiens
cccgggtcgacaactaatactaaattctcggccgcgtcgaccagcgattaagatgagaacagttctgcagttgttgaactagatcacagcattgtaggcagaataaaaaatgttcatatctgagaatattcctttcgccatcttttcccaaggccagacctcctggtggagcacagttaaaagtaacattctgggcctttgtaatcggagggctgtgtctccagctggcagcctttgttttaatatataatgcaggactgtggaaaacagttggcatagaatattttcacctaaaaaaagaaagaaaagacatacaaaactggattaattgcaaaaagagaatacagtaaaataccatataactggacaaagctagaagaacctttagaagatttgtctgaaaacagatttcaagagtgagcttttatacactgctcactaatttgcttgattactaccaactcttcttaaagttaacacgtttaaataaggtatttctggacttcctagcctttcagcaagcttagaggaactagccattagctagtgatgtaaaaatattttggggactgatgcccttaaaggttatgcccttgaaagttcttaccttttctctagtgatattaaggaacgagtgggtagtgttctcagggtgaccagctgccctaaagtgcctgggattgagggtttccctggatgcgggactttccctggatacaaaacttttaagcagagttttgtatatatgtggatttttctgataagtagcacatcagaggccttaaccactgcccaaaagcgattctccattgagagtacatatcttgaacttaagaaattcatttgctctgatttttaatcttgtaaagtttttgctaaactcaaaacaagtcccaggcacaccagaaggagctgaccaccttaggtgttcttgtgatttatccttacttccctatgttgtcatagttgcttctaaactcagctgcactatggctgtcaacatttctgatacttattgggatatgtgccatccagtcatttagtactttgaatggaacatgagatttataacacaggtaatagctgaaggtaccagtatggtggtgagactcacacttagtgatccagctaaggtaactgatgttataatggaacagagaagaggccaactagatagctaagttcttctgaacctatgtgtatatgtaagtacaaatcatgcgtccttatggggttaaacttaatctgaaatttacatttttcatagtaaaaggaaaccaattgttgcagatttcttttcttgtgaggaaatacatggcctttgatgctctggcgtctactgcatttcccagtctgttctgctcgagaagccagaatgtgttgttaacatttttccgtgaatgttgtgttaaaatgattaaatgcatcagccaatggcaagtgaaggaattgggtgtcctgatgcagactgagcagtttctctcaattgtagcctcatactcataaggtgcttaccagctagaacattgagcacgtgaggtgagattttttttctctgatggcattaactttgtaatgcaatatgatggatgcagaccctgttcttgtttccctctggaagtccttagtggctgcatccttggtgcactgtgatggagatattaaatgtgttctttgtgagctttcgttctatgattgtcaaaagtacgatgtggttccttttttatttttattaaacaatgagctgaggctttattacagctggttttcaagttaaaattgttgaatactgatgtctttctcccacctacaccaaatattttagtctatttaaagtacaaaaaaagttctgcttaagaaaacattgcttacatgtcctgtgatttctggtcaatttttatatatatttgtgtgcatcatctgtatgtgctttcactttttaccttgtttgctcttacctgtgttaacagccctgtcaccgttgaaaggtggacagttttcctagcattaaaagaaagccatttgagttgtttaccatgttactatgggactaatttttaattgttttaatttttatttaaactgatctttttttatatgggattacattttggtgttcactccctaaattatatggaaaccaaaaaaagtgattgtatttcacatatggacata

SEQ ID NO: 24732 - DNA, 2779 bp, Homo sapiens
  misc_feature (2759)..(2759): n is a, c, g, or t
  misc_feature (2774)..(2774): n is a, c, g, or t
cggggtttcaccgtgttggccaggatggtctcgatctcctgacctcgtgatctgtccacctcggcttccccaagtgctgggattacaggcatgagccaccgcgcccagcctagccatatttttatctgcatatatcagaatgtttctctcctttgaacttattaacaaaaaaggaacatgcttttcatacctagagtcctaatttcttcatcatgaaggttgctattcaaattgatccatcattttaattttaccaatggctcaaaaattctgttcagtaaatgtctttgtgactggccaatggcataaattatgtttaagattatgaacttttctgacagttgcagccaatgttttccctacgataccagatttccatcttggggcatattggattgttgtatttaagacagtcagaataatgatagtgtgtggtctccagaggtagtcagaatcctgctattgagttctttttatatcttccttttcaattttttattaccattttgtttgtttagactacactttgtagggattgaggggccaaatatctcttggagtggaattcctgtgttttgagccttaccacccggaaatatgagctatactagatagcctcatgatagcatttacgataagaacttatctcgtgtgttcatgtaattttttgagtaggaactgttttatcttgaatattgtagctaactatatatagcagaactgcctcagtctttttaagaaggaaataaataatatatgtgtatgaatttatatatacatatacactcatagacaaacttaacagttggggtcattctaacagttaaaacaattgttccattgtttaaatctcagatcctggtaaaatgttcttaatttgtctgtgtacattttcctttcatggacagaccattggagtacattaattttcttaatctgccatttggcagttcatttaatataccattttttggcaacttggtaactaagaatcacagccaaaatttgttaacatcaaagaaagctctgccatataccccgttactaaattattatacatccagcagattctgggatgtactaacttagggttaactttgttgttgttgataatactagattgctccctctttaattcttcttctggtgcaaggttgctgcttaagttaccctgggaaatactactacaaggtcaaattttctagtatcttacagcctgattgaaggtgattcagatctttgctcaatataaatggattttccaagattctctgggccatccttgacccacaggtgatctcgctggagtatattaacttaacttcagtgccagttggtttggtgccatgagatccataatgaatccagaacttcaccattgcttagatataagagtcccttggaagaataatgccactgatgatgggggtcagaaggtgtattaactcaacatagagggcttttagatttttcttcaaaaaaatttcgagaaaagtattcttttaccctccaaacagttaacagctcttagtttctccaaatatgctctttgatttacttatttttagttaaagatggtaatttattgaacaatgaaatccgtaatatattgatttaaggacaaaagtgaagttttagaattataaaagtacttaaatattatatattttccatttcataattgttttcctttctctgtggctttaaagtttttgactattttacaatgttaatcactaggtaacttgccatatttctggttctatattaagttctatcctttataatgctgttattataaagctggtttttagcatttgtctgtagcaatagaaattttactaagtctctgttctcccagtaagttttttcttttctcagtaagtccctaagaaaacatttgtttgccactcttactattcccaatcttggattgttcgagctgaaaaaaaatttgatgagaaacaggaggatccttttctggtgaatataggttcctgctttaagaatgtggaaatccattgctttatataactaatatacacacagattaattaaaattgtgagaaataattcacacatgacaagtaggtaacatgcatgagttttgaatttttttaaaaacccaactgtttgacaaaatatagaacccaaattggtactttcttagaccagtgtaacctcacacctcagttttgcttttccaaccctgacttgaaaggcatatttgtatctttttattagtgatagtgaagctgtgacactaaccttttatacaaaagagtaaagaaagaaaaactacagcgattaagatgagaacagttctgcagttgttgaactagatcacagcattgtaggcagaataaaaaatgttcatatctgagaatattcctttcgccatcttttcccaaggccagacctcctggtggagcacagttaaaagtaacattctgggcctttgtaatcggagggctgtgtctccagctggcagcctttgttttaatatataatgcaggactgtggaaaacagttggcatagaatattttcacctaaaaaaagaaagaaaagacatacaaaactggattaattgcaaaaagagaatacagtaaaataccatataactggacaaagctagaagaacctttagaagatttgtctgaaaacagatttcaagagtgagcttttatacactgctcactaatttgcttgattactaccaactcttcttaaagttaacacgttttgatcaaaggagaancaataaagggataanccata

SEQ ID NO: 24733 - DNA, 286 bp, Homo sapiens
gcgtcgactatatcttctttttgtgttagttttggtcatctctttggacccatcatcaaggggtctaatataagtatagctggaatcccagagaagaagaaatagagaggggggtatgagaaatatttgagggaacaatggctgagattttcccccaaattaatgacatatactaaaccacagatctaagaagttaagaaaaaccaagcaggatcaataacaacaacagcaacaacagtgataaaacctacatatatcataataaaattgctaaaaggacaaagag

SEQ ID NO: 24734 - DNA, 492 bp, Homo sapiens
  misc_feature (86)..(86): n is a, c, g, or t
gacacttgaagttcctaggacacaagaagttggacgttaatgttgtcatgacaagacttcaaagctccaaggcctgtagagctganactctgcttttggagaagtaactgacagagtgtagcctgtcacagactaagtgttcagaatgtcaaactgttatgtttatatgtattttgaagtccactagttaaggtcagttactcacatggggtctgagaaagtgtaatgtaacattcccaagaggggaaggagttcaccccaagtactcacatatggagtttgtattggcattctccagagggacagaactaatgggatatatgtataagtggaaggaagtttattagggagaattggctcacctgatcacaagttgaagtctcacagtaggccgtctgcacgctgaggaagaaagaagccagtagtggcgcagtacaagtttgaaagtctcaaaaccagaagagccgacagtgctgccttcagtctgtggcc

SEQ ID NO: 24735 - DNA, 595 bp, Homo sapiens
caaataaaagacagactcctttttctatgctgtttcctccctcgggactcttttgtttgtttggggatctgtcgtttatgtggcagactctccttacctgtcccttcgcattagcagtgccatactgaaagggtacatggccgctgaatgtggggacaagccttttggcctggagaggctcagtagctgtgggaaggtagcttatccccagaggactcctcggcctcctgcctggctgcaggcaggacaatgggaagagccagttgataggcagactatcccttgacccctgtggcttgaccttgatgtcacacccccagtctcaactgtgccaccggtccctgagtgtagagcagcttggctcccctccccacatgggcagagcagggcagggcaagatgggaggcccaggggctctctgggcttccacccttgctgcagacaactcagtacagttttctctggtcaacgaagtagactactatttgcccaggctggtctcagacaatctgcctgccttggcctcccaaagtcctggaattacaggcatgagcaactgcacccggccgtcgacgcggccgcgaatatagtagta

SEQ ID NO: 24736 - DNA, 566 bp, Homo sapiens
  misc_feature (408)..(408): n is a, c, g, or t
  misc_feature (551)..(551): n is a, c, g, or t
accaaaaccaggcaaaggcattacaagaaaagaaaactacagagatatcttacataaacataaatgcaaatgtcctcaacaaaatattatcaaatcaaatccaacaatgttaaaaactattatacaccacaagtaagtgagatttattgtaagtctggttcagcattcaaaaaaagcagtgaatataatctgtcacatcaaaagactattgagataatcatgtggtttttgtgtttggttctgtttacatgctggactacatttattgattttcgtatgttgaaccagccttgcatcccagggatgaagcccccttgatcatggtggataagctttttgatgtgctgctggatttggtttgccagtattttattgaggatttttgcatcgatgttcatcagggatatnggtttaaaattctctttttttgttgtgtctctgccaggctttggtatcaggatgatgccggcctcataaaatgagttaggaaggattccctctttttgtattgattggaatagtttcagaaggaatggtaccagctcctcgtngacctctgtaccgat

SEQ ID NO: 24737 - DNA, 369 bp, Homo sapiens
accaaaaccaggcaaaggcattacaagaaaagaaaactacagagatatcttacataaacataaatgcaaatgtcctcaacaaaatattatcaaatcaaatccaacaatgttaaaaactattatacaccacaagtaagtgagatttattgtaagtctggttcagcattcaaaaaaagcagtgaatataatctgtcacatcaaaagactaaagaggaaaaatcacatgatcatatcaatagatgcagaaaaagcattcgacaaatcctgcatccattaatggataaaataacaataaaggctcagtaaactgacatagtgcacttcctcaacttgatttttaaaaacctattaacaaaatcctgtgaaaat

SEQ ID NO: 24738 - DNA, 510 bp, Homo sapiens
ctaagtgcatcctcagatcacccccacaactggcatcaccctgggagctctttattcactctcccctatggataataaaactcaggcccctgtaaggatgtgagatgcccatgctcaaacatcaagttaacagcagggagcacccacaccagggccactggcgcaactccagactccattccactgcccagctgctggaaaacatggccaaggcccaaagcagccaccatatgaagctgtaacaagaaacggggttgtaaacaaggaccactgggtaaagccctgagaatgctaggaatgcgagggggttaaattgctttttattctttttctttcagttggcctcattgttctaaaggaaatgtttattatagaacattaagagaaataaaaaccgccaagtgcaatggctcacacctgtaatcccagcactttgggaggctgaggcaggtggattacctgaggtcaggagttccaggccagcctggccaacatggtgaaaccccgttt

SEQ ID NO: 24739 - DNA, 1049 bp, Homo sapiens
atcacgtgcataatgtcacggtgtccaccggatttaccaggggtcatcgatgcccataacaagaacattttccgaggaactgtgagagtgaaagtctgactgtgggttaaagactgactggtaaatgaggaagtggagactgttttttcaaagcagcatgactggacaatgggagagggcgtgatcatttataaatagtgaggagaacagggtaaagctgcatcacggaccaaacagcaaggaaacagaacatggggaacatcaggatcagtaactcaccacaggaattcctactcctgggaaatagaattcttcactagtggctgactgtgacatatctttccaagagttaaccccagactccaaatcttaagaatatgggcttttcttccactatcattcacattctgcagttactggtagtattttacagtattttcagatgtaattttactaatttctaaaaatagttcatatctttaaaaatcatgggaaaatcatgactaataaattcaccaactttaaaatatattgttcaaaagtgtttttccaatgactctgtaaattggtaagatctggccacatttcatgttattgtctaaaaataagctaactatgagacaatgggtctaaatcattctccaaaatattgatgatgttcttcactttcaaactggctaaactgataattttactatcttatgcctcaggctgaggaggttatattgtaatgtccgggaatatttactataatttaaaattcaataaaaggacaatatggaataacatattaataatagtgactgttgatcaaaaaagctgatttctctgatatatgatcaaggtatgggatttaggttatatccataaccttagttttggccaggtggccttagctgggtgataactggatgtttaacctaagtttttcatacctgggtcataatacaaacttgaagaaactgcactggcatccttttaggctctctgatgcagaaggttgtctttggataactagcgcaattactactattaaaatattatggtac

SEQ ID NO: 24740 - DNA, 418 bp, Homo sapiens
ccaaaggtgatccgcccgcctggcctcccgaagtgctgggattacaggcgttagccactgcacccagccggaacaagtcttttatccattgtacatcttcagggcttttccattgttctgctgagctgtggttcaggctcagttgtgcgagtgattgattacctggctactgtaatgcttgtactttttttttttaaaaattattccatttcagctcacattggagaaccatggttttcgtatcctagctgattatattcttagcatttcagtcctttgcaacttggtttgttggggaaggcggttatagtcatctaatttttcttggggacagtactactgtggctacagtcatgagagagtttactttttcaatgtcttgtttccaaccaagtccacgctttcatgcttgcttttt

SEQ ID NO: 24741 - DNA, 2526 bp, Homo sapiens
ttcgctcctagggaagtcgctcgcgtcctcaagagcacctgagaggatctcggcgaagcggaaggctttggtgccagctgggagagtctgcgccggatttcctcagctccttggcgcgtttcctcggagccgggggaggcaaagcacggaccccggagtcggcgcccatagcgggacgccctcgcgaggggcgggagtgcgggagcgggggtgtgcgggcggcgcgctcgccctccagctgcagcccgcgccgagcgcgcagggccagcgagcgccggcgcctccagcatggagtgggaactcaacttgctgctctacctggcgctcttcttcttcctgctcttcttacttttcctcctgctcttcgtggtcatcaagcagctgaagaactccgtggccaacacggccggggcgctccagcccgggcgcctctcggtgcaccgcgagccttggggcttctcccgagagcaagcggtgtgacccgagtgcgggcactggcgggagggcaccgagctgcgcgggcgctgggctgggtctccgcctcgattctccgtcctcgcggcctcccagcttccagagccgagctgctgcccttgactggtgctcaggggaccacagctgcaatgacagtttgggcctgcaaaaagaaggctggaacaacgggagatggaagctttctgcaaatgcagcaccactggtatccatgaatttaacctgcccatcattcttcctagacaagagactattgaaaagtcagggtgttcaaaatggcttcagatcttatcaggacaatcttggttgttgcactaatttccaaacttggcacagctgtagatgcagaactgatgccatctggtgcgattctacagaataagagagaaaatttacccagagtgtgccatgcactggcttttctgggaatggcaaggtgccaggatttgtttttggttcgcttgcaggggtggaaacttggaactaggttccaagatggtccccgcagcaccccacaagaagaaggaggaagcccacagagaaaacggggcatgccagttcaaatccacttccttttaaagagcttcctcagcagcccaataacttttgccttcatctcattggccagaactgtgtcattggctactgctatctgcaagattgtctgagaaatgtagtttttgtagctggatatataactgcctttgacaaaaatccagtttctcttgatgaagaagaagatggtggtggatcttgggaggacaactaacattttatgccctggctacagaatacagttgcagaggagcataaagttcaaaaagatccaaaactctagttccttcacaactgtcaaagctccaagcagcactgctcccctctgacagagtgagcagagtgaaggcatgtcaggtgttctcacaaaactcttgacagggctgacctctctcagtcaatatccttgtcccacatcaggattttctagagggccctgggtacctgtgcacttccttggtggccgtaacctctttgtggagggttggtgtaggataaagaatgttctattacgctgctccctcatctgtatcatttctctcctctctaattttcctgtcagttatattttggtggagtctgggtttgtgtatttgattcctatagaaagaccatcgctttcatgcatggaggaggggaatctacgcaaagaaaggctaccttactcctttctgtgactccaccaccagtctaggaatatcctgggagaagaattgcctctcaaagctgcttctataagcagcctacatcctagctaagcaaagaagaaacacttcccacatctagggctgtctaaaagaactttctgtgatgacagaaatgttctatatctgcagtgtccaatatggtaaccatataggcacatgtggctagtgaacacttgaaatgtggctagtgtgactgaggaaggaaaatttaaattttgtttaattgtaattaatttaaattcagatagccaaatggggctactagctattgtgttagatagcacggtatactttattctctttcttgtgttgtagaaccagctgggagaggtgtgggtcagtcatgggcttggtatcccctggtcttcactattctagcttgccattgaatttgtctcccagaggaaaagaaagaatggtatttggaattaaattcaagatgttaacttgacatctatatattgcacatattcctgtatagtgaatggatgacctcctgggaatagttcctgtgactgattttagtgataattgatcatgaagaaatggcagtactgctccacttcaccttcctagtgactattatgtgttcctagtcagagtgactcagcagagattattttgttctcttgtgcaatttattctgtgtcattttatttttgtaatattgtggcagctaaatgattattctgtgtatgtttttcaaaatattaggtggcttatattttttaaaaggctatgaaataaaaataaactatacgtaacacagtta

SEQ ID NO: 24742 - DNA, 2154 bp, Homo sapiens
ttcgctcctagggaagtcgctcgcgtcctcaagagcacctgagaggatctcggcgaagcggaaggctttggtgccagctgggagagtctgcgccggatttcctcagctccttggcgcgtttcctcggagccgggggaggcaaagcacggaccccggagtcggcgcccatagcgggacgccctcgcgaggggcgggagtgcgggagagccgagctgctgcccttgactggtgctcaggggaccacagctgcaatgacagtttgggcctgcaaaaagaaggctggaacaacgggagatggaagctttctgcaaatgcagcaccactggtatccatgaatttaacctgcccatcattcttcctagacaagagactattgaaaagtcagggtgttcaaaatggcttcagatcttatcaggacaatcttggttgttgcactaatttccaaacttggcacagctgtagatgcagaactgatgccatctggtgcgattctacagaataagagagaaaatttacccagagtgtgccatgcactggcttttctgggaatggcaaggtgccaggatttgtttttggttcgcttgcaggggtggaaacttggaactaggttccaagatggtccccgcagcaccccacaagaagaaggaggaagcccacagagaaaacggggcatgccagttcaaatccacttccttttaaagagcttcctcagcagcccaataacttttgccttcatctcattggccagaactgtgtcattggctactgctatctgcaagattgtctgagaaatgtagtttttgtagctggatatataactgcctttgacaaaaatccagtttctcttgatgaagaagaagatggtggtggatcttgggaggacaactaacattttatgccctggctacagaatacagttgcagaggagcataaagttcaaaaagatccaaaactctagttccttcacaactgtcaaagctccaagcagcactgctcccctctgacagagtgagcagagtgaaggcatgtcaggtgttctcacaaaactcttgacagggctgacctctctcagtcaatatccttgtcccacatcaggattttctagagggccctgggtacctgtgcacttccttggtggccgtaacctctttgtggagggttggtgtaggataaagaatgttctattacgctgctccctcatctgtatcatttctctcctctctaattttcctgtcagttatattttggtggagtctgggtttgtgtatttgattcctatagaaagaccatcgctttcatgcatggaggaggggaatctacgcaaagaaaggctaccttactcctttctgtgactccaccaccagtctaggaatatcctgggagaagaattgcctctcaaagctgcttctataagcagcctacatcctagctaagcaaagaagaaacacttcccacatctagggctgtctaaaagaactttctgtgatgacagaaatgttctatatctgcagtgtccaatatggtaaccatataggcacatgtggctagtgaacacttgaaatgtggctagtgtgactgaggaaggaaaatttaaattttgtttaattgtaattaatttaaattcagatagccaaatggggctactagctattgtgttagatagcacggtatactttattctctttcttgtgttgtagaaccagctgggagaggtgtgggtcagtcatgggcttggtatcccctggtcttcactattctagcttgccattgaatttgtctcccagaggaaaagaaagaatggtatttggaattaaattcaagatgttaacttgacatctatatattgcacatattcctgtatagtgaatggatgacctcctgggaatagttcctgtgactgattttagtgataattgatcatgaagaaatggcagtactgctccacttcaccttcctagtgactattatgtgttcctagtcagagtgactcagcagagattattttgttctcttgtgcaatttattctgtgtcattttatttttgtaatattgtggcagctaaatgattattctgtgtatgtttttcaaaatattaggtggcttatattttttaaaaggctatgaaataaaaataaactatacgtaacacagtta

SEQ ID NO: 24743 - DNA, 2841 bp, Homo sapiens
ttcgctcctagggaagtcgctcgcgtcctcaagagcacctgagaggatctcggcgaagcggaaggctttggtgccagctgggagagtctgcgccggatttcctcagctccttggcgcgtttcctcggagccgggggaggcaaagcacggaccccggagtcggcgcccatagcgggacgccctcgcgaggggcgggagtgcgggagcgggggtgtgcgggcggcgcgctcgccctccagctgcagcccgcgccgagcgcgcagggccagcgagcgccggcgcctccagcatggagtgggaactcaacttgctgctctacctggcgctcttcttcttcctgctcttcttacttttcctcctgctcttcgtggtcatcaagcagctgaagaactccgtggccaacacggccggggcgctccagcccgggcgcctctcggtgcaccgcgagccttggggcttctcccgagagcaagcggtgtgacccgagtgcgggcactggcgggagggcaccgagctgcgcgggcgctgggctgggtctccgcctcgattctccgtcctcgcggcctcccagcttccagagccgagctgctgcccttgactggtgctcaggggaccacagctgcaatgacagtttgggcctgcaaaaagaaggctggaacaacgggagatggaagctttctgcaaatgcagcaccactggtatccatgaatttaacctgcccatcattcttcctagacaagagactattgaaaagtcagggtgttcaaaatggcttcagatcttatcaggacaatcttggttgttgcactaatttccaaacttgtaagtgcaatggatctgcagttctacttggcaagataaccattttaagttgaatgagaatgacatcacactcacacctgcaaaatctaaaatgtctaataaagtagattcctatgtctgaacttcaattttagggcacagctgtagatgcagaactgatgccatctggtgcgattctacagaataagagagaaaatttacccagagtgtgccatgcactggcttttctgggaatggcaaggtgccaggatttgtttttggttcgcttgcaggggtggaaacttggaactaggttccaagatggtccccgcagcaccccacaagaagaaggaggaagcccacagagaaaacggggcatgccagttcaaatccacttccttttaaagagcttcctcagcagcccaataacttttgccttcatctcattggccagaactgtgtcattggctactgctatctgcaagattgtctgagaaatgtagtttttgtagctggatatataactgcctttgacaaaaatccagtttctcttgatgaagaagaagatggtggtggatcttgggaggacaactaacattttatgccctggctacagaatacagttgcagaggagcataaagttcaaaaagatccaaaactctagttccttcacaactgtcaaagctccaagcagcactgctcccctctgacagagtgagcagagtgaaggcatgtcaggtgttctcacaaaactcttgacagggctgacctctctcagtcaatatccttgtcccacatcaggattttctagagggccctgggtacctgtgcacttccttggtggccgtaacctctttgtggagggttggtgtaggataaagaatgttctattacgctgctccctcatctgtatcatttctctcctctctaattttcctgtcagttatattttggtggagtctgggtttgtgtatttgattcctatagaaagaccatcgctttcatgcatggaggaggggaatctacgcaaagaaaggctaccttactcctttctgtgactccaccaccagtctaggaatatcctgggagaagaattgcctctcaaagctgcttctataagcagcctacatcctagctaagcaaagaagaaacacttcccacatctagggctgtctaaaagaactttctgtgatgacagaaatgttctatatctgcagtgtccaatatggtaaccatataggcacatgtggctagtgaacacttgaaatgtggctagtgtgactgaggaaggaaaatttaaattttgtttaattgtaattaatttaaattcagatagccaaatggggctactagctattgtgttagatagcacggtatactttattctctttcttgtgttgtagaaccagctgggagaggtgtgggtcagtcatgggcttggtatcccctggtcttcactattctagcttgccattgaatttgtctcccagaggaaaagaaagaatggtatttggaattaaattcaagatgttaacttgacatctatatattgcacatattcctgtatagtgaatggatgacctcctgggaatagttcctgtgactgattttagtgataattgatcatgaagaaatggcagtactgctccacttcaccttcctagtgactattatgtgttcctagtcagagtgactcagcagagattattttgttctcttgtgcaatttattctgtgtcattttatttttgtaatattgtggcagctaaatgattattctgtgtatgtttttcaaaatattaggtggcttatattttttaaaaggctatgaaataaaatactatcgtacccagtacaaaaaaaaaacaaaaaaaaaattgtggggggtggccaaaaagttttaacatttgtggggcggccaaaggatggaaaagggaaggtccaggacgggcggcagggtggttccaaaaaacgggacgggtgaaacagggctggttgggtttagaacgtccagcgggcgggggcaagaaaaaaaaggataa

SEQ ID NO: 24744 - DNA, 2660 bp, Homo sapiens
ttcgctcctagggaagtcgctcgcgtcctcaagagcacctgagaggatctcggcgaagcggaaggctttggtgccagctgggagagtctgcgccggatttcctcagctccttggcgcgtttcctcggagccgggggaggcaaagcacggaccccggagtcggcgcccatagcgggacgccctcgcgaggggcgggagtgcgggagcgggggtgtgcgggcggcgcgctcgccctccagctgcagcccgcgccgagcgcgcagggccagcgagcgccggcgcctccagcatggagtgggaactcaacttgctgctctacctggcgctcttcttcttcctgctcttcttacttttcctcctgctcttcgtggtcatcaagcagctgaagaactccgtggccaacacggccggggcgctccagcccgggcgcctctcggtgcaccgcgagccttggggcttctcccgagagcaagcggtgtgacccgagtgcgggcactggcgggagggcaccgagctgcgcgggcgctgggctgggtctccgcctcgattctccgtcctcgcggcctcccagcttccagagccgagctgctgcccttgactggtgctcaggggaccacagctgcaatgacagtttgggcctgcaaaaagaaggctggaacaacgggagatggaagctttctgcaaatgcagcaccactggtatccatgaatttaacctgcccatcattcttcctagacaagagactattgaaaagtcagggtgttcaaaatggcttcagatcttatcaggacaatcttggttgttgcactaatttccaaacttgtaagtgcaatggatctgcagttctacttggcaagataaccattttaagttgaatgagaatgacatcacactcacacctgcaaaatctaaaatgtctaataaagtagattcctatgtctgaacttcaattttagggcacagctgtagatgcagaactgatgccatctggtgcgattctacagaataagagagaaaatttacccagagtgtgccatgcactggcttttctgggaatggcaaggtgccaggatttgtttttggttcgcttgcaggggtggaaacttggaactaggttccaagatggtccccgcagcaccccacaagaagaaggaggaagcccacagagaaaacggggcatgccagttcaaatccacttccttttaaagagcttcctcagcagcccaataacttttgccttcatctcattggccagaactgtgtcattggctactgctatctgcaagattgtctgagaaatgtagtttttgtagctggatatataactgcctttgacaaaaatccagtttctcttgatgaagaagaagatggtggtggatcttgggaggacaactaacattttatgccctggctacagaatacagttgcagaggagcataaagttcaaaaagatccaaaactctagttccttcacaactgtcaaagctccaagcagcactgctcccctctgacagagtgagcagagtgaaggcatgtcaggtgttctcacaaaactcttgacagggctgacctctctcagtcaatatccttgtcccacatcaggattttctagagggccctgggtacctgtgcacttccttggtggccgtaacctctttgtggagggttggtgtaggataaagaatgttctattacgctgctccctcatctgtatcatttctctcctctctaattttcctgtcagttatattttggtggagtctgggtttgtgtatttgattcctatagaaagaccatcgctttcatgcatggaggaggggaatctacgcaaagaaaggctaccttactcctttctgtgactccaccaccagtctaggaatatcctgggagaagaattgcctctcaaagctgcttctataagcagcctacatcctagctaagcaaagaagaaacacttcccacatctagggctgtctaaaagaactttctgtgatgacagaaatgttctatatctgcagtgtccaatatggtaaccatataggcacatgtggctagtgaacacttgaaatgtggctagtgtgactgaggaaggaaaatttaaattttgtttaattgtaattaatttaaattcagatagccaaatggggctactagctattgtgttagatagcacggtatactttattctctttcttgtgttgtagaaccagctgggagaggtgtgggtcagtcatgggcttggtatcccctggtcttcactattctagcttgccattgaatttgtctcccagaggaaaagaaagaatggtatttggaattaaattcaagatgttaacttgacatctatatattgcacatattcctgtatagtgaatggatgacctcctgggaatagttcctgtgactgattttagtgataattgatcatgaagaaatggcagtactgctccacttcaccttcctagtgactattatgtgttcctagtcagagtgactcagcagagattattttgttctcttgtgcaatttattctgtgtcattttatttttgtaatattgtggcagctaaatgattattctgtgtatgtttttcaaaatattaggtggcttatattttttaaaaggctatgaaataaaaataaactatacgtaacacagtta

SEQ ID NO: 24745 - DNA, 102 bp, Homo sapiens
caccgagctgcgcgggcgctgggctgggtctccgcctcgattctccgtcctcgcggcctcccagcttccaggtgcggggctcggcggctctgacgggtccgt

SEQ ID NO: 24746 - DNA, 971 bp, Homo sapiens
  misc_feature (38)..(38): n is a, c, g, or t
  misc_feature (47)..(47): n is a, c, g, or t
  misc_feature (51)..(51): n is a, c, g, or t
aaccccccgagacctaagtaggaaatcccaccaccagntgcggtggncgancgacacccttgctggtcggtccccctgagtccatgcgggaacatgtggtcgctgcctccaaggccatgaagatgggtgactggaagacctgtcacagttttatcatcaatgagaagatgaatgggaaagtgtgggaccttttccccgaggctgacaaagtccgcaccatgctggttaggaagatccaggaagagtcactgaggacctacctcttcacctacagcagtgtctatgactccatcagcatggagacgctgtcagacatgtttgagctggatctgcccactgtgcactccatcatcagcaaaatgatcattaatgaggagctgatggcctccctggaccagccaacacagacagtggtgatgcaccgcactgagcccactgcccagcagaacctggctctgcagctggccgagaagctgggcagcctggtggagaacaacgaacgggtgtttgaccacaagcagggcacctacgggggctacttccgagaccagaaggacggctaccgcaaaaacgagggctacatgcgccgcggtggctaccgccagcagcagtctcagacggcctactgagctctccactctgtttcccgcctgggccatccaaccttgaagtcctaaaccacacctcagtcactaaaggtcgagactcactctgtagcccaggctggagtgcagtggcgcaatcttggctcactgcaagctccgcctcctggattctcaccattctcctgcctcagcctcctgagtagctgggactacaggcgcccgccacaacgcctggctaatttttgtgttttcagtagagacggggtttcactgtgttagccaggatgatcttgatctcctgaccttgtgatccgcccgcctcggcctcccaaagtgctgggattacaggcgtgagccaccacgccc

SEQ ID NO: 24747 - DNA, 647 bp, Homo sapiens
atcatcagcaaaatgatggagtgcacagtgggcagatccagctcaaacatgtctgacagcgtctccatgctgatggagtcatagacactgctgtaggtgaagaggtaggtcctcagtgactcttcctggatctgcccactgtgcactccatcatcagcaaaatgatcattaatgaggagctgatggcctccctggaccagccaacacagacagtggtgatgcaccgcactgagcccactgcccagcagaacctggctctgcagctggccgagaagctgggcagcctggtggagaacaacgaacgggtgtttgaccacaagcagggcacctacgggggctacttccgagaccagaaggacggctaccgcaaaaacgagggctacatgcgccgcggtggctaccgccagcagcagtctcagacggcctactgagctctccactctgtttcccgcctgggccatccaaccttgaagtcctaaaccacacctcagtcactaaaggtctgtttaaagttgttctggttgattgcttgttgccacaaaggtgtgttgagcccattcatttgctgattatatttctgagctgctaccacatgacagacacaaggctcagatgaagaggtgaattgaacacgttcctgacctcaa

SEQ ID NO: 24748 - DNA, 845 bp, Homo sapiens
  misc_feature (38)..(38): n is a, c, g, or t
  misc_feature (47)..(47): n is a, c, g, or t
  misc_feature (51)..(51): n is a, c, g, or t
aaccccccgagacctaagtaggaaatcccaccaccagntgcggtggncgancgacacccttgctggtcggtccccctgagtccatgcgggaacatgtggtcgctgcctccaaggccatgaagatgggtgactggaagacctgtcacagttttatcatcaatgagaagatgaatgggaaagtgtgggaccttttccccgaggctgacaaagtccgcaccatgctggttaggaagatccaggaagagtcactgaggacctacctcttcacctacagcagtgtctatgactccatcagcatggagacgctgtcagacatgtttgagctggatctgcccactgtgcactccatcatcagcaaaatgatcattaatgaggagctgatggcctccctggaccagccaacacagacagtggtgatgcaccgcactgagcccactgcccagcagaacctggctctgcagctggccgagaagctgggcagcctggtggagaacaacgaacgggtgtttgaccacaagcagggcacctacgggggctacttccgagaccagaaggacggctaccgcaaaaacgagggctacatgcgccgcggtggctaccgccagcagcagtctcagacggcctactgagctctccactctgtttcccgcctgggccatccaaccttgaagtcctaaaccacacctcagtcactaaaggtctgtttaaagttgttctggttgattgcttgttgccacaaaggtgtgttgagcccattcatttgctgattatatttctgagctgctaccacatgacagacacaaggctcagatgaagaggtgaattgaacacgttcctgacctcaa

SEQ ID NO: 24749 - DNA, 711 bp, Homo sapiens
aggaagagtcactgaggacctacctggatcttcctaaccaggcatggtgcggactttgtcagcctcggggaaaaggtccgcaccatgctggttaggaagatccaggaagagtcactgaggacctacctcttcacctacagcagtgtctatgactccatcagcatggagacgctgtcagacatgtttgagctggatctgcccactgtgcactccatcatcagcaaaatgatcattaatgaggagctgatggcctccctggaccagccaacacagacagtggtgatgcaccgcactgagcccactgcccagcagaacctggctctgcagctggccgagaagctgggcagcctggtggagaacaacgaacgggtgtttgaccacaagcagggcacctacgggggctacttccgagaccagaaggacggctaccgcaaaaacgagggctacatgcgccgcggtggctaccgccagcagcagtctcagacggcctactgagctctccactctgtttcccgcctgggccatccaaccttgaagtcctaaaccacacctcagtcactaaaggtctgtttaaagttgttctggttgattgcttgttgccacaaaggtgtgttgagcccattcatttgctgattatatttctgagctgctaccacatgacagacacaaggctcagatgaagaggtgaattgaacacgttcctgacctcaa

SEQ ID NO: 24750 - DNA, 828 bp, Homo sapiens
  misc_feature (38)..(38): n is a, c, g, or t
  misc_feature (47)..(47): n is a, c, g, or t
  misc_feature (51)..(51): n is a, c, g, or t
aaccccccgagacctaagtaggaaatcccaccaccagntgcggtggncgancgacacccttgctggtcggtccccctgagtccatgcgggaacatgtggtcgctgcctccaaggccatgaagatgggtgactggaagacctgtcacagttttatcatcaatgagaagatgaatgggaaagtgtgggaccttttccccgaggctgacaaagtccgcaccatgctggttaggaagatccaggaagagtcactgaggacctacctcttcacctacagcagtgtctatgactccatcagcatggagacgctgtcagacatgtttgagctggatctgcccactgtgcactccatcatcagcaaaatgatcattaatgaggagctgatggcctccctggaccagccaacacagacagtggtgatgcaccgcactgagcccactgcccagcagaacctggctctgcagctggccgagaagctgggcagcctggtggagaacaacgaacgggtgtttgaccacaagcagggcacctacgggggctacttccgagaccagaaggacggctaccgcaaaaacgagggctacatgcgccgcggtggctaccgccagcagcagtctcagacggcctactgagctctccactctgtttcccgcctgggccatccaaccttgaagtcctaaaccacactgtttaaagttgttctggttgattgcttgttgccacaaaggtgtgttgagcccattcatttgctgattatatttctgagctgctaccacatgacagacacaaggctcagatgaagaggtgaattgaacacgttcctgacctcaa

SEQ ID NO: 24751 - DNA, 568 bp, Homo sapiens
ggaataccgatggagaatagtggtgccggctctctctctcttctcttcctcgttctgtgcctctttccctcccccatgcttctgctctttctcccttttcattcaccctttatttttctttcttcttggctccctcctcttcccagctgcctactctgctcggatgttttgcctttttggatgttggtggctggctacaccctgcccactgtcccgaggtctgtggggaggcagcacctggaggcagcgacagcaaccacagggagcgccctggctcctccctgcccagcgcaaggccaaggcccttcccctcctgaaactggctctttacctctggagcctcagagagggaaaaaaaaaaaaacagaagtcattgccgccatatagattgatctccttgacacattccacttttaaagcatcaattcatttttgttaagctccaaatcattttaacagaaaagtctctttgttttgctctagttcaaaagattataattatttctgagtttatctgcttatatttttaaaagagtagaattttccctttaaggtcaataataagaaa

SEQ ID NO: 24752 - DNA, 414 bp, Homo sapiens
tcgacgtaacctggcagattgtataatctctgtggtcctcgttttgctcatctgtaggatggagtgataaaagtacccacttcatatggttgttggggagattaaatgaattaatacatgtaaagtgcttacaacaggagctggttcagagccagcgcttaatacattgaaataattatttttacattgtggtgcttttatgatggtttctgcagcatttaccaaatgccagggaaattattggcttgctttctgtgtgggttttgtcaaaatgattatggatttcaacaggatatttcagagaagaaataaactgctgaacagaaaccattgtgagcttgatagtttgcaggacattgtagaaaagagaatccagcacagtaattaagggcctttttaagtagggaagttgta

SEQ ID NO: 24753 - DNA, 722 bp, Homo sapiens
gggacctcttggggtccaatcgatcctcccacctgtaatcccagctactcaggaggctgaggcaggagaatcactggaacccaggaggcagagtttgcagtgagccgagatcgtgccactgcactctagcctctgtctcaaaaaaaaagaaaaaacaaggcgtgcatgctgtagtctgtgtgtatgtctgtttttgttctcctccttaacactagtcagtcttgtgtaaccaggctggccctgcttcctgcttagaagctattggtgtatcatctggagctgcaaatagggtgatagggcgtcagtagccttcccacactcaagagcttcctgacacccagcccctcatctccagccagcctctggctaccccaggaatcttggggctcaggcctaacactccagcatagagggctttgcccttctggtgtactctcgcttggaggcatcttggaacaggggtacaacagagctctggaagtgctgtctgttgcatcgataccccactgccactttcgtccaccttcctggggcagaatcctgggatgggtctttatttaagacaaaagggagagagaaggcatagaggctaggcatggtggctcactcctgtaatcccaggactttgggaggccgaggctggtggatcacttgaggtcacgggtttgagaccagcctggccaacacggtgaaaccgtctctactaaaaatacaaaaaaaat

SEQ ID NO: 24754 - DNA, 1311 bp, Homo sapiens
agtaatcgcaaaaagtcagttttatggatacagttttctctgaacagttttggtatagacaaaaagaggtgttaccatccacccggcgtgcattataattctgtccttgcctaatccccacccaaatgcccatttccatctacacgaactcattctttctgaatcataaatgccacaccctcagttgcacataaaactttgccatattatgtatacatcagtgtgtacgaagacaagttgtggcttagaagcagtccatttacagtttctggaactgtttatcatctcacttctccataactgattctaggtctgaaaggttttcttctaaaatttgatagcctgattttgaggatatgttttcaatgccttttctggttacaaatcctgatgttggcaggtctttttcctgtaagcatgaagaccaaccaagacaaggtacactgtgctgttaatcaaagtggcacagaacaactatgtgacaggtcatagccaggagtgtaatgtaacatggatatggagggccacaaagagtcccatagccctcctgctacacatctgaaaatctcctgaaattcagaataaacccattactgaaaaacaaaagtgtttattggcataccagactgtttcaggaattcatgaaagatagaaaacagatgggtcttgtgtgatggagaaataagaccaaagaaaagaccaaaggctaaaagatctacaggaggggccgggtgcagtggctcacgcctgtaatcccagcactttgaaggccgaggcgagtggatcacttgaggccaggagtttgagaccagcctagccaacatggtgaaaccccatctctattaaaaatacaaaaattagccagacatggtggctcacacctgtagttccagctactcgggaggctgaggcaggaaaattgctgaacccaggaggcggaggtttcagtgagccgaaatcttgccactgcactccagcctgggggacagagtgagactccgtctcaaaaaacaaacaaacaaaaaaatctataggagatgacttctgtgaaggtggctgtgagttctgagaaagctctgccctttatggaaatagggaacaggaaggagccctggggcaggagtcagggtgattatctgggggcttttggaggatcagccagctgccttcgcccccttccccacctctctcatgctaaactgtgtcacagtgagtatgtgcacacaggccagagcactggtgacaagaggcacagcaagaccctgggtagcaagaaatctgcactatttctaggtgggctagaaaggccct

SEQ ID NO: 24755 - DNA, 249 bp, Homo sapiens
attttaaagtcttttaggctaaggagtcaaaacttgattttgtaagaggtggaaagtcgtgaaggttttgaattcagtgtaaagaaatgtaaattttaatctaccactattgtgcagaatagattggaggactaagagtaaaaataggtctgttaggagttcaattaaggaattttggaaaatgtctgaggacccttgctaaaatgcagcaatgtgaatgaaaagtaaagttagaacatgctgtattgt

SEQ ID NO: 24756 - DNA, 125 bp, Homo sapiens
actgacctgtctccttcacatagtccatatcaccacaaatcacacaacaaaaaggagaagagatattttgggttcaaaaaaagtaaaaagataatgtagctgcatttctttagttattttgaacc

SEQ ID NO: 24757 - DNA, 238 bp, Homo sapiens
acaagggatggattgtgcagtcagaaagaaattctcattttaccaaaactgaagaaaaagtctctcctctacagaggaaaaaaaatactgaataaatgcaatgtataaaaatcaaaagaggccgggcgtggtggctcatacctgtaattccagcactttgggaggccgaggcaggtagatcacctgaggtcaggagttcaagaccagcctggccaacatggtgaaaccccgtctctac

SEQ ID NO: 24758 - DNA, 762 bp, Homo sapiens
catcctcatgacatcaaggcttcccatcatgaatgtggtgatttctctatttatttgttccctttaatgctattcaataagttttcaataatattctcttcaatgttcttgtgcatctttgtaagatatatttctagatatcctaagtacctaatagatttattgtcactttagatggtatcactatttttaaaagattttaactttttaatatgaaatttttaaacatacacataagtagacagactgcaatcaatacctgtgtttctatcactcagtttcaacaagtgccagttcatggctgttcttgttttatctgtggagtcatttccttattgaaagttgtaattgatgttttcttttcagtgtatatgaatgttacttatttttgtaggttgactttgaattcagaaatcttgctcaatttttttttaatcctgatgattcaaatcataggtaggtgtttgctcaatttttattctaatagtttgtctgtaggattgacgtcatagaaattctaagagaataatcacctgaaagggtaagttttgttttttcctatacattccttattcattctacttcctttatttttcttgtttcattgggtagcatatccattacaatgataaacaaaaggattagccaggcccagtgactcatacctgtaatctcagcactttgagaggctggggggtggggaggggggattacttgagcccagaaatttgagaccagcctgagcaacataaggacacccca

SEQ ID NO: 24759 - DNA, 517 bp, Homo sapiens
ataactgtatgcatactatgattccatttttgtactaaaagaaaagagaaagatgtatatatatattagtatatgcatagaaaagttgaaggattgagcactgatcatctctaggagggttgaatatgaagggacatttcttttttcctttacacatttctgattgatcaacttattcattacaggtattactttagacatgagaaaaaatagagaaaaattaagtgtgtgtcctcatatgtgcttataagtggactagagataaaagaaaaaaggtctcctgaaatcagaggttgggccaactgtcagattagtggaaggagcaaattatttccttctctagtttgtgaaatgactgtggggccttcagttgttgtagtagctatttaaaccatcaccatgttttgtaaccttttaaaattctcctgagctttttgcatgtttcttaatgaataaaggataaatacagtaaagtctgggttgatttttttctgtattttcattgatgatgtctgaa

SEQ ID NO: 24760 - DNA, 270 bp, Homo sapiens
ggcaactgaaatgcatttcagaaataggaggttttgtccaataccctctgcagccttggtgcctgtagctctggacttgcctggacccttccctgcgggagggccccatagaccccattggggtggggtgggatggggtggggatcacttggctaaaagggccgaggtctggtgatgaggttccagggatctagaacctctcctaccactcctgcagttggactgaattctttcctttcatttgaagaaacccactcgctgttttcagct

SEQ ID NO: 24761 - DNA, 476 bp, Homo sapiens
cactgtgaagttaggtagggggtctattgagaagttcaggaagatcttggtcagggaaatcatcttctccaactaacttgccaagcctgattcctgattttacctttcactatataacttacctacccactctttatacccaagtgtcttacccaggggtgaagaactgaaacatcttcctgaaccagcctctgtcaccactgtcctcctggcagcatcctgaattgcgaagagccaccccgccccccagacattcagtgacctagactcagacctctggggaaggacacagtctccaggctcagccagtaggcaggggactgtgacagaaagggacatatggccaagtccctctggtgagatacaaacctggactttggcaaacctggtgagaaagaggtttatctcaaatcaatctcgctcttcctttccacccccagctccctttccccactccctgccttctgctgtggttg

SEQ ID NO: 24762 - DNA, 680 bp, Homo sapiens
cagcatagtgagttcctgtctctacaaaaaataaaaaaaattagccaggcatggtggcgcatgcctgtaagctgagctacttgggaggctgcggcaggaggattgcttgagcccaggaattcaggcggaagtgggctgattgtgccattgcactctagctcaggcaacagagtgaaactctttctcaaaaaaaaattaggcatggtgcacagctgtcctagtacttgggcggctgaagtgggaggactgcttgagcccaggagattgaggctgcagtgagccatgatcgtgccactgcactccagtgtgggagacagagccaacaccctgtctcaaagagagaaaaaaagaagggctatttgatatatcccagcacctaatagagtgcctggcatagttgagcactcagtaaatgtgtcgaaggaaagaaagatgtcctgatcgccagtaattttccccaaatgttgtaaaggtaagtttccctattatgaagctgttgtagtccataacaacttctagtatgttaaaagtctgatcacacttgaggccgattttttttttctttttaaaagatgtagctaacatatattttctaatattatcctcacatgtcgctaagaggttgatgttattattttatccatttttaaagatgtcaaaattaaggcacaaaaatgata

SEQ ID NO: 24763 - DNA, 736 bp, Homo sapiens
cagcatagtgagttcctgtctctacaaaaaataaaaaaaattagccaggcatggtggcgcatgcctgtaagctgagctacttgggaggctgcggcaggaggattgcttgagcccaggaattcaggcggaagtgggctgattgtgccattgcactctagctcaggcaacagagtgaaactctttctcaaaaaaaaaaaaaaaagcaaccccgggcagcatggcaaaaccctatttctaccaaaatacaaaagttaggcatggtgcacagctgtcctagtacttgggcggctgaagtgggaggactgcttgagcccaggagattgaggctgcagtgagccatgatcgtgccactgcactccagtgtgggagacagagccaacaccctgtctcaaagagagaaaaaaagaagggctatttgatatatcccagcacctaatagagtgcctggcatagttgagcactcagtaaatgtgtcgaaggaaagaaagatgtcctgatcgccagtaattttccccaaatgttgtaaaggtaagtttccctattatgaagctgttgtagtccataacaacttctagtatgttaaaagtctgatcacacttgaggccgattttttttttctttttaaaagatgtagctaacatatattttctaatattatcctcacatgtcgctaagaggttgatgttattattttatccatttttaaagatgtcaaaattaaggcacaaaaatgata

SEQ ID NO: 24764 - DNA, 678 bp, Homo sapiens
ctcataggttaccactgtcaaaatttggtgcctatttttccagagttttaatcttaatagttgatatttaaatttattagattattttgtgtaaggtgaagattttaaaaataaaatctttaggtgtcaatttgagtgagagaatgtattttaatacattagaagacaaaaaacctattgggtgggatattgattccagtataatcttttatagtgtttgttatgctttaaatatttttcaacaaataaaaccattcaaaactaattgcatataaagaacaccagtttcactctcatagaatacttttgtgattactatgctgagctttagaaaaaaaggaactaagagatttcacataatgaaagttagtttaggggtggacgtggtagctcacatctgtaaccccaacactctgggaggctaaggcaggaggactgcttgaggcagtagttcaacaccagcctgggcaacacagcaaaacatggcaacccatccctagaagaaaaaaaaaaaatagttgggcatgatggtacacgcttgtagtcctagctccacaggaggctgaggattgagcccaggaattcgaggttacaatcacctatgaccccaccacagctccccagcttgggcgacatgagcaagaccccacatgagtaagaccccaagtcaaaaaaaaa

SEQ ID NO: 24765 - DNA, 453 bp, Homo sapiens
gcggccgtatactactacattaacggcccgtcgacactaattgcatataaagaacaccagtttcactctcatagaatacttttgtgattactatgctgagctttagaaaaaaaggaactaagagatttcacataatgaaagttagtttaggggtggacgtggtagctcacatctgtaaccccaacactctgggaggctaaggcaggaggactgcttgaggcagtagttcaacaccagcctgggcaacacagcaaaacatggcaacccatccctagaagaaaaaaaaaaaatagttgggcatgatggtacacgcttgtagtcctagctccacaggaggctgaggattgagcccaggaattcgaggttacaatcacctatgaccccaccacagctccccagcttgggcgacatgagcaagaccccacatgagtaagaccccaagtcaaaaaaaaa

SEQ ID NO: 24766 - DNA, 439 bp, Homo sapiens
tatatttaatcattctctttggctcacaacagcagtccagtccaaagatttactttttctattttcaaccccatcattatttttgtgtaaaaagtatgttttgagttacagcaattcatggagatcaagcttctactctgtagggagaagagagatgtcatttactacagagtttatacacacaaatgttctgctgcatgctgtgttcccactgaaatccagggggtttatttgcatttatacttaaagaagaatgaccgtatttggctgactctaagccaagatgatacaggcccaaagtttttcatggaggaatgggggagtaagggaaataggaacatttggaagaaatagttgttgtttttccctgttttattcagtgggcattttattcacagatcatttgatgcattgcatttactcgtgttattctggttcc

SEQ ID NO: 24767 - DNA, 4054 bp, Homo sapiens
ttccgggccgagtgtttccgggtcgctgctggcccccgggtactggtctcagtacccctgcagccggccggagaggctagagcccgacggggcccggctccggcggcagccgcgcctctcgcttgcttccctcggccgggccgtcctcggcggcagtgtcaggagcactccgctggtccaggcggcaacatgtccatgcttttagtgatgtccctgcctctaatccagaagccatggaggagataaggtagcccccctcgatcggatggggaagcccagttcaatggatactaaattcaaggatgacttatttcggaagtacgtgcagttccatgagagcaaagtggataccaccaccagcaggcagcggcctggcagcgatgagtgcctgcgggtggcagcctcaaccctgctcagcctgcacaaggtggatcccttttatcgattccggctgatccagttctatgaggtggtggagagctccttgcgctcgctcagctcctctagcctgcgggctctgcacggcgccttcagcatgctggagacggtgggcatcaacctcttcctctacccgtggaagaaggaattcagaagcatcaagacctacacgggcccttttgtttattatgtcaagtcgacattactggaagaggacatccgagccatcctgagctgcatgggctacacacctgagctgggcactgcatacaagctcagagagctcgtggagaccctccaggtgaagatggtctcctttgagctctttctggccaaagtcgagtgtgagcagatgctagaaatccactcacaagtgaaggacaagggctactccgagctggacattgtgagcgagcgcaagagcagtgcagaggatgtgcgcggctgctcggacgccctgcggcggcgggcagagggccgggagcacctgacggcctccatgtcacgagtggcactccagaagtcggccagcgagcgggcggccaaggactactacaagccccgcgtgaccaagccctcgaggtcagtggatgcctatgacagctactgggagagccggaagccacccctgaaggcctcattgagtcttcggaaggagcctgtggcaacggatgtgggggacgacctcaaggatgagatcatccgcccatccccttcgctgctgaccatggccagctccccccacggcagcccggatgtgcttccacccgcctcccccagcaacggcccggccctgctgcgcggtacctacttctccactcaggatgacgtggatctgtacacagactctgaacccagggccacctaccgtcggcaggatgctctgcggccggatgtgtggctgctcagaaacgatgcccactccctctaccacaagcgctcgccccctgccaaagagtccgccctctccaagtgccaaagctgcgggctgtcctgcagctcctccctctgccagcgctgtgacagcctgctcacctgtcctccagcttccaagcccagcgccttccccagcaaggcctcgactcatgacagcctggcccacggggcatctctgcgggagaagtacccaggccagactcagggcctcgaccgcctcccgcaccttcactccaaatccaagccctccaccacgcccacttcccgctgtggcttctgcaaccgcccaggcgccaccaacacctgcacccagtgttcaaaagtctcatgtgacgcctgcctcagcgcttaccattatgacccctgctacaaaaagagtgagctgcacaagttcatgcccaacaaccagctgaactacaagtccacccagctctcccatctcgtgtacagatagaccggcctcgccccttccagctccaagggctacatcaaccgacctttcgggtttcacggtgaagaagtactaacgcattgatctcagaggcggaggcctgcacttgaccatgtaggtggcagagatcgtgggctggctgtgtccacgtgggagttcacttagcgactcagatatctcaaccaatggctgctttgttgtctgacaagggagaaggtggcacttccgttcagattcattttgctaatctctccactccctgttcagttggttctttttttggggttttgttttgttttgttttgttgttttgttttttcctttaaagaggatttctgtctctgggaccctcgctgcacctacccctcccattgcaaagccaacttggactgggaagggcccttcaggtcaccaaacatccacctggagcggcgagctagaggcctgttggcttgtgaaatgagccctcctgccacacggggcctctcccaaaggctcatcccttggccgcccccttcctaaacacaaggatccccagctggactccccaccccctggcttccccacctctccaggtgtcaaaggtgaaccgagtccagtattagctgaatgtcatttcgtacaccacagctcagtcagcccatggccttcgtgaactttgctccaacacactgatgtgtgggcttcccacagcaggactgacttccccctttctgttgtttgcacatgcccctcttactgtactgtcaatagatatttttgagatttatttttaaataaatattcaacttgctgtgtgtttcaacgtggttaaaaaaatgaattatgtagctatttattaaatgccctgggttctttagtcttccaagggagggcctcgcgcccattcgtgttgtatcctccactcactatggcccgaggggagaggagagtttggggcagggaggaacagacatgaagcctccttttcttgagctggtggagagccactgtcttccctgcagtaactatctatacacctacctccagtgtgcacttagggggtgagcgcgggtgtcgaggtctgtgtgtctgcagactgctaacctatgacaattcagggacctcacctgtcggacctatagcttgctgagcaggaaccttgcacttcacacttcttgagtctcgtttcagaaggaaaatcatttgggattcctactgcccctccatctcaatcctcttctcttcaccagtttccaggactcatctgcaacatttgcaatctttttgcactaaaagtgggcaggagtcggcatgtgcccatcagagagacggctcctcagatgctcagctaagcctaagcgcttccaagcctgaaggccccttcagcttctcatgtgaattaccaacccctggattttccttgtgggggtacaagagcaggagtggggcaagagtttgaaaataaagccgcttccttgtgaactaactatattttagccataactgtttgtgatgtacacaatgttaagggatttatatgcagtgggcttttctgggagaaagttattcagctcttgagcaagtttaagtctggctgaatcctgaggccactgtgaatttgctgatgttcttccaactcagttgagtgattttaaggttttccaaatcttctatggctctctttttaatatatatatatatatatatatatatatatatatatatatatatatatctatctggtagatcacatgtagatgtacagtgtgtatattaagctgaatttcaaccaactttattactaagaccagcctagcagggcattcatctttgatgttcttccttttcacatttcagaatcggcaatgcctggcccactcctgagagctctagttttctagttttccatttccagattgcgccagcattacagtaactaactctttctaaccaaccgtgatgccacgtaacttaccctatggacaaaagcaggaatgactaacacatcctaggagggaaagtccagtgtacctgtcatcacggacgcactgtggtcacagactggaatacgaaatactacagccctgctcccaggtgtgcatcttactggatgaggttgctgtgattgagatagttaaatacatgctaatttaaaaatgcagatgttttacatttgatttctaccaagagttgaaatgttgagagatgattaaaaataataataataaagtgtcttccattgttaaa

SEQ ID NO: 24768 - DNA, 3837 bp, Homo sapiens
ttccgggccgagtgtttccgggtcgctgctggcccccgggtactggtctcagtacccctgcagccggccggagaggctagagcccgacggggcccggctccggcggcagccgcgcctctcgcttgcttccctcggccgggccgtcctcggcggcagtgtcaggagcactccgctggtccaggcggcaacatgtccatgcttttagtgatgtccctgcctctaatccagaagccatggaggagataaggtagcccccctcgatcggatggggaagcccagttcaatggatactaaattcaaggatgacttatttcggaagtacgtgcagttccatgagagcaaagtggataccaccaccagcaggcagcggcctggcagcgatgagtgcctgcgggtggcagcctcaaccctgctcagcctgcacaaggtggatcccttttatcgattccggctgatccagttctatgaggtggtggagagctccttgcgctcgctcagctcctctagcctgcgggctctgcacggcgccttcagcatgctggagacggtgggcatcaacctcttcctctacccgtggaagaaggaattcagaagcatcaagacctacacgggcccttttgtttattatgtcaagtcgacattactggaagaggacatccgagccatcctgagctgcatgggctacacacctgagctgggcactgcatacaagctcagagagctcgtggagaccctccaggtgaagatggtctcctttgagctctttctggccaaagtcgagtgtgagcagatgctagaaatccactcacaagtgaaggacaagggctactccgagctggacattgtgagcgagcgcaagagcagtgcagaggatgtgcgcggctgctcggacgccctgcggcggcgggcagagggccgggagcacctgacggcctccatgtcacgagtggcactccagaagtcggccagcgagcgggcggccaaggactactacaagccccgcgtgaccaagccctcgaggtcagtggatgcctatgacagctactgggagagccggaagccacccctgaaggcctcattgagtcttcggaaggagcctgtggcaacggatgtgggggacgacctcaaggatgagatcatccgcccatccccttcgctgctgaccatggccagctccccccacggcagcccggatgtgcttccacccgcctcccccagcaacggcccggccctgctgcgcggtacctacttctccactcaggatgacgtggatctgtacacagactctgaacccagggccacctaccgtcggcaggatgctctgcggccggatgtgtggctgctcagaaacgatgcccactccctctaccacaagcgctcgccccctgccaaagagtccgccctctccaagtgccaaagctgcgggctgtcctgcagctcctccctctgccagcgctgtgacagcctgctcacctgtcctccagcttccaagcccagcgccttccccagcaaggcctcgactcatgacagcctggcccacggggcatctctgcgggagaagtacccaggccagactcagggcctcgaccgcctcccgcaccttcactccaaatccaagccctccaccacgcccacttcccgctgtggcttctgcaaccgcccaggcgccaccaacacctgcacccagtgttcaaaagtctcatgtgacgcctgcctcagcgcttaccattatgacccctgctacaaaaagagtgagctgcacaagttcatgcccaacaaccagctgaactacaagtccacccagctctcccatctcgtgtacagatagaccggcctcgccccttccagctccaagggctacatcaaccgacctttcgggtttcacggtgaagaagtactaacgcattgatctcagaggcggaggcctgcacttgaccatgtaggtggcagagatcgtgggctggctgtgtccacgtgggagttcacttagcgactcagatatctcaaccaatggctgctttgttgtctgacaagggagaaggtggcacttccgttcagattcattttgctaatctctccactccctgttcagttggttctttttttggggttttgttttgttttgttttgttgttttgttttttcctttaaagaggatttctgtctctgggaccctcgctgcacctacccctcccattgcaaagccaacttggactgggaagggcccttcaggtcaccaaacatccacctggagcggcgagctagaggcctgttggcttgtgaaatgagccctcctgccacacggggcctctcccaaaggctcatcccttggccgcccccttcctaaacacaaggatccccagctggactccccaccccctggcttccccacctctccaggtgtcaaaggtgaaccgagtccagtattagctgaatgtcatttcgtacaccacagctcagtcagcccatggccttcgtgaactttgctccaacacactgatgtgtgggcttcccacagcaggactgacttccccctttctgttgtttgcacatgcccctcttactgtactgtcaatagatatttttgagatttatttttaaataaatattcaacttgctgtgtgtttcaacgtggttaaaaaaatgaattatgtagctatttattaaatgccctgggttctttagtcttccaagggagggcctcgcgcccattcgtgttgtatcctccactcactatggcccgaggggagaggagagtttggggcagggaggaacagacatgaagcctccttttcttgagctggtggagagccactgtcttccctgcagtaactatctatacacctacctccagtgtgcacttagggggtgagcgcgggtgtcgaggtctgtgtgtctgcagactgctaacctatgacaattcagggacctcacctgtcggacctatagcttgctgagcaggaaccttgcacttcacacttcttgagtctcgtttcagaaggaaaatcatttgggattcctactgcccctccatctcaatcctcttctcttcaccagtttccaggactcatctgcaacatttgcaatctttttgcactaaaagtgggcaggagtcggcatgtgcccatcagagagacggctcctcagatgctcagctaagcctaagcgcttccaagcctgaaggccccttcagcttctcatgtgaattaccaacccctggattttccttgtgggggtacaagagcaggagtggggcaagagtttgaaaataaagccgcttccttgtgaactaactatattttagccataactgtttgtgatgtacacaatgttaagggatttatatgcagtgggcttttctgggagaaagttattcagctcttgagcaagtttaagtctggctgaatcctgaggccactgtgaatttgctgatgttcttccaactcaaatcggcaatgcctggcccactcctgagagctctagttttctagttttccatttccagattgcgccagcattacagtaactaactctttctaaccaaccgtgatgccacgtaacttaccctatggacaaaagcaggaatgactaacacatcctaggagggaaagtccagtgtacctgtcatcacggacgcactgtggtcacagactggaatacgaaatactacagccctgctcccaggtgtgcatcttactggatgaggttgctgtgattgagatagttaaatacatgctaatttaaaaatgcagatgttttacatttgatttctaccaagagttgaaatgttgagagatgattaaaaataataataataaagtgtcttccattgttaaa

SEQ ID NO: 24769 - DNA, 3606 bp, Homo sapiens
ttccgggccgagtgtttccgggtcgctgctggcccccgggtactggtctcagtacccctgcagccggccggagaggctagagcccgacggggcccggctccggcggcagccgcgcctctcgcttgcttccctcggccgggccgtcctcggcggcagtgtcaggagcactccgctggtccaggcggcaacatgtccatgcttttagtgatgtccctgcctctaatccagaagccatggaggagataaggtagcccccctcgatcggatggggaagcccagttcaatggatactaaattcaaggatgacttatttcggaagtacgtgcagttccatgagagcaaagtggataccaccaccagcaggcagcggcctggcagcgatgagtgcctgcgggtggcagcctcaaccctgctcagcctgcacaaggtggatcccttttatcgattccggctgatccagttctatgaggtggtggagagctccttgcgctcgctcagctcctctagcctgcgggctctgcacggcgccttcagcatgctggagacggtgggcatcaacctcttcctctacccgtggaagaaggaattcagaagcatcaagacctacacgggcccttttgtttattatgtcaagtcgacattactggaagaggacatccgagccatcctgagctgcatgggctacacacctgagctgggcactgcatacaagctcagagagctcgtggagaccctccaggtgaagatggtctcctttgagctctttctggccaaagtcgagtgtgagcagatgctagaaatccactcacaagtgaaggacaagggctactccgagctggacattgtgagcgagcgcaagagcagtgcagaggatgtgcgcggctgctcggacgccctgcggcggcgggcagagggccgggagcacctgacggcctccatgtcacgagtggcactccagaagtcggccagcgagcgggcggccaaggactactacaagccccgcgtgaccaagccctcgaggtcagtggatgcctatgacagctactgggagagccggaagccacccctgaaggcctcattgagtcttcggaaggagcctgtggcaacggatgtgggggacgacctcaaggatgagatcatccgcccatccccttcgctgctgaccatggccagctccccccacggcagcccggatgtgcttccacccgcctcccccagcaacggcccggccctgctgcgcggtacctacttctccactcaggatgacgtggatctgtacacagactctgaacccagggccacctaccgtcggcaggatgctctgcggccggatgtgtggctgctcagaaacgatgcccactccctctaccacaagcgctcgccccctgccaaagagtccgccctctccaagtgccaaagctgcgggctgtcctgcagctcctccctctgccagcgctgtgacagcctgctcacctgtcctccagcttccaagcccagcgccttccccagcaaggcctcgactcatgacagcctggcccacggggcatctctgcgggagaagtacccaggccagactcagggcctcgaccgcctcccgcaccttcactccaaatccaagccctccaccacgcccacttcccgctgtggcttctgcaaccgcccaggcgccaccaacacctgcacccagtgttcaaaagtctcatgtgacgcctgcctcagcgcttaccattatgacccctgctacaaaaagagtgagctgcacaagttcatgcccaacaaccagctgaactacaagtccacccagctctcccatctcgtgtacagatagaccggcctcgccccttccagctccaagggctacatcaaccgacctttcgggtttcacggtgaagaagtactaacgcattgatctcagaggcggaggcctgcacttgaccatgtagcctctccaggtgtcaaaggtgaaccgagtccagtattagctgaatgtcatttcgtacaccacagctcagtcagcccatggccttcgtgaactttgctccaacacactgatgtgtgggcttcccacagcaggactgacttccccctttctgttgtttgcacatgcccctcttactgtactgtcaatagatatttttgagatttatttttaaataaatattcaacttgctgtgtgtttcaacgtggttaaaaaaatgaattatgtagctatttattaaatgccctgggttctttagtcttccaagggagggcctcgcgcccattcgtgttgtatcctccactcactatggcccgaggggagaggagagtttggggcagggaggaacagacatgaagcctccttttcttgagctggtggagagccactgtcttccctgcagtaactatctatacacctacctccagtgtgcacttagggggtgagcgcgggtgtcgaggtctgtgtgtctgcagactgctaacctatgacaattcagggacctcacctgtcggacctatagcttgctgagcaggaaccttgcacttcacacttcttgagtctcgtttcagaaggaaaatcatttgggattcctactgcccctccatctcaatcctcttctcttcaccagtttccaggactcatctgcaacatttgcaatctttttgcactaaaagtgggcaggagtcggcatgtgcccatcagagagacggctcctcagatgctcagctaagcctaagcgcttccaagcctgaaggccccttcagcttctcatgtgaattaccaacccctggattttccttgtgggggtacaagagcaggagtggggcaagagtttgaaaataaagccgcttccttgtgaactaactatattttagccataactgtttgtgatgtacacaatgttaagggatttatatgcagtgggcttttctgggagaaagttattcagctcttgagcaagtttaagtctggctgaatcctgaggccactgtgaatttgctgatgttcttccaactcagttgagtgattttaaggttttccaaatcttctatggctctctttttaatatatatatatatatatatatatatatatatatatatatatatatatctatctggtagatcacatgtagatgtacagtgtgtatattaagctgaatttcaaccaactttattactaagaccagcctagcagggcattcatctttgatgttcttccttttcacatttcagaatcggcaatgcctggcccactcctgagagctctagttttctagttttccatttccagattgcgccagcattacagtaactaactctttctaaccaaccgtgatgccacgtaacttaccctatggacaaaagcaggaatgactaacacatcctaggagggaaagtccagtgtacctgtcatcacggacgcactgtggtcacagactggaatacgaaatactacagccctgctcccaggtgtgcatcttactggatgaggttgctgtgattgagatagttaaatacatgctaatttaaaaatgcagatgttttacatttgatttctaccaagagttgaaatgttgagagatgattaaaaataataataataaagtgtcttccattgttaaa

SEQ ID NO: 24770 - DNA, 1730 bp, Homo sapiens
ttccgggccgagtgtttccgggtcgctgctggcccccgggtactggtctcagtacccctgcagccggccggagaggctagagcccgacggggcccggctccggcggcagccgcgcctctcgcttgcttccctcggccgggccgtcctcggcggcagtgtcaggagcactccgctggtccaggcggcaacatgtccatgcttttagtgatgtccctgcctctaatccagaagccatggaggagataaggtagcccccctcgatcggatggggaagcccagttcaatggatactaaattcaaggatgacttatttcggaagtacgtgcagttccatgagagcaaagtggataccaccaccagcaggcagcggcctggcagcgatgagtgcctgcgggtggcagcctcaaccctgctcagcctgcacaaggtggatcccttttatcgattccggctgatccagttctatgaggtggtggagagctccttgcgctcgctcagctcctctagcctgcgggctctgcacggcgccttcagcatgctggagacggtgggcatcaacctcttcctctacccgtggaagaaggaattcagaagcatcaagacctacacgggcccttttgtttattatgtcaagtcgacattactggaagaggacatccgagccatcctgagctgcatgggctacacacctgagctgggcactgcatacaagctcagagagctcgtggagaccctccaggtgaagatggtctcctttgagctctttctggccaaagtcgagtgtgagcagatgctagaaatccactcacaagtgaaggacaagggctactccgagctggacattgtgagcgagcgcaagagcagtgcagaggatgtgcgcggctgctcggacgccctgcggcggcgggcagagggccgggagcacctgacggcctccatgtcacgagtggcactccagaagtcggccagcgagcgggcggccaaggactactacaagccccgcgtgaccaagccctcgaggtcagtggatgcctatgacagctactgggagagccggaagccacccctgaaggcctcattgagtcttcggaaggagcctgtggcaacggatgtgggggacgacctcaaggatgagatcatccgcccatccccttcgctgctgaccatggccagctccccccacggcagcccggatgtgcttccacccgcctcccccagcaacggcccggccctgctgcgcggtacctacttctccactcaggatgacgtggatctgtacacagactctgaacccagggccacctaccgtcggcaggatgctctgcggccggatgtgtggctgctcagaaacgatgcccactccctctaccacaagcgctcgccccctgccaaagagtccgccctctccaagtgccaaagctgcgggctgtcctgcagctcctccctctgccagcgctgtgacagcctgctcacctgtcctccagcttccaagcccagcgccttccccagcaaggcctcgactcatgacagcctggcccacggggcatctctgcgggagaagtacccaggccagactcaggctcgacgctccgaacttgatcaatcaagcctccacagccattccgtgtgtttgaaacgcaggcacaaactgacatggtaagttatgtacctgctagtaacaatactgtaaaagggttgattccaactaaagcacaccatgagaaagccta

SEQ ID NO: 24771 - DNA, 2618 bp, Homo sapiens
ttccgggccgagtgtttccgggtcgctgctggcccccgggtactggtctcagtacccctgcagccggccggagaggctagagcccgacggggcccggctccggcggcagccgcgcctctcgcttgcttccctcggccgggccgtcctcggcggcagtgtcaggagcactccgctggtccaggcggcaacatgtccatgcttttagtgatgtccctgcctctaatccagaagccatggaggagataaggtagcccccctcgatcggatggggaagcccagttcaatggatactaaattcaaggatgacttatttcggaagtacgtgcagttccatgagagcaaagtggataccaccaccagcaggcagcggcctggcagcgatgagtgcctgcgggtggcagcctcaaccctgctcagcctgcacaaggtggatcccttttatcgattccggctgatccagttctatgaggtggtggagagctccttgcgctcgctcagctcctctagcctgcgggctctgcacggcgccttcagcatgctggagacggtgggcatcaacctcttcctctacccgtggaagaaggaattcagaagcatcaagacctacacgggcccttttgtttattatgtcaagtcgacattactggaagaggacatccgagccatcctgagctgcatgggctacacacctgagctgggcactgcatacaagctcagagagctcgtggagaccctccaggtgaagatggtctcctttgagctctttctggccaaagtcgagtgtgagcagatgctagaaatccactcacaagtgaaggacaagggctactccgagctggacattgtgagcgagcgcaagagcagtgcagaggatgtgcgcggctgctcggacgccctgcggcggcgggcagagggccgggagcacctgacggcctccatgtcacgagtggcactccagaagtcggccagcgagcgggcggccaaggactactacaagccccgcgtgaccaagccctcgaggtcagtggatgcctatgacagctactgggagagccggaagccacccctgaaggcctcattgagtcttcggaaggagcctgtggcaacggatgtgggggacgacctcaaggatgagatcatccgcccatccccttcgctgctgaccatggccagctccccccacggcagcccggatgtgcttccacccgcctcccccagcaacggcccggccctgctgcgcggtacctacttctccactcaggatgacgtggatctgtacacagactctgaacccagggccacctaccgtcggcaggatgctctgcggccggatgtgtggctgctcagaaacgatgcccactccctctaccacaagcgctcgccccctgccaaagagtccgccctctccaagtgccaaagctgcgggctgtcctgcagctcctccctctgccagcgctgtgacagcctgctcacctgtcctccagcttccaagcccagcgccttccccagcaaggcctcgactcatgacagcctggcccacggggcatctctgcgggagaagtacccaggccagactcagggcctcgaccgcctcccgcaccttcactccaaatccaagccctccaccacgcccacttcccgctgtggcttctgcaaccgcccaggcgccaccaacacctgcacccagtgttcaaaagtctcatgtgacgcctgcctcagcgcttaccattatgacccctgctacaaaaagagtgagctgcacaagttcatgcccaacaaccagctgaactacaagtccacccagctctcccatctcgtgtacagatagaccggcctcgccccttccagctccaagggctacatcaaccgacctttcgggtttcacggtgaagaagtactaacgcattgatctcagaggcggaggcctgcacttgaccatgtaggtggcagagatcgtgggctggctgtgtccacgtgggagttcacttagcgactcagatatctcaaccaatggctgctttgttgtctgacaagggagaaggtggcacttccgttcagattcattttgctaatctctccactccctgttcagttggttctttttttggggttttgttttgttttgttttgttgttttgttttttcctttaaagaggatttctgtctctgggaccctcgctgcacctacccctcccattgcaaagccaacttggactgggaagggcccttcaggtcaccaaacatccacctggagcggcgagctagaggcctgttggcttgtgaaatgagccctcctgccacacggggcctctcccaaaggctcatcccttggccgcccccttcctaaacacaaggatccccagctggactccccaccccctggcttccccacctctccaggtgtcaaaggtgaaccgagtccagtattagctgaatgtcatttcgtacaccacagctcagtcagcccatggccttcgtgaactttgctccaacacactgatgtgtgggcttcccacagcaggactgacttccccctttctgttgtttgcacatgcccctcttactgtactgtcaatagatatttttgagatttatttttaaataaatattcaacttgc

SEQ ID NO: 24772 - DNA, 4436 bp, Homo sapiens
  misc_feature (4260)..(4260): n is a, c, g, or t
ttccgggccgagtgtttccgggtcgctgctggcccccgggtactggtctcagtacccctgcagccggccggagaggctagagcccgacggggcccggctccggcggcagccgcgcctctcgcttgcttccctcggccgggccgtcctcggcggcagtgtcaggagcactccgctggtccaggcggcaacatgtccatgcttttagtgatgtccctgcctctaatccagaagccatggaggagataaggtagcccccctcgatcggatggggaagcccagttcaatggatactaaattcaaggatgacttatttcggaagtacgtgcagttccatgagagcaaagtggataccaccaccagcaggcagcggcctggcagcgatgagtgcctgcgggtggcagcctcaaccctgctcagcctgcacaaggtggatcccttttatcgattccggctgatccagttctatgaggtggtggagagctccttgcgctcgctcagctcctctagcctgcgggctctgcacggcgccttcagcatgctggagacggtgggcatcaacctcttcctctacccgtggaagaaggaattcagaagcatcaagacctacacgggcccttttgtttattatgtcaagtcgacattactggaagaggacatccgagccatcctgagctgcatgggctacacacctgagctgggcactgcatacaagctcagagagctcgtggagaccctccaggtgaagatggtctcctttgagctctttctggccaaagtcgagtgtgagcagatgctagaaatccactcacaagtgaaggacaagggctactccgagctggacattgtgagcgagcgcaagagcagtgcagaggatgtgcgcggctgctcggacgccctgcggcggcgggcagagggccgggagcacctgacggcctccatgtcacgagtggcactccagaagtcggccagcgagcgggcggccaaggactactacaagccccgcgtgaccaagccctcgaggtcagtggatgcctatgacagctactgggagagccggaagccacccctgaaggcctcattgagtcttcggaaggagcctgtggcaacggatgtgggggacgacctcaaggatgagatcatccgcccatccccttcgctgctgaccatggccagctccccccacggcagcccggatgtgcttccacccgcctcccccagcaacggcccggccctgctgcgcggtacctacttctccactcaggatgacgtggatctgtacacagactctgaacccagggccacctaccgtcggcaggatgctctgcggccggatgtgtggctgctcagaaacgatgcccactccctctaccacaagcgctcgccccctgccaaagagtccgccctctccaagtgccaaagctgcgggctgtcctgcagctcctccctctgccagcgctgtgacagcctgctcacctgtcctccagcttccaagcccagcgccttccccagcaaggcctcgactcatgacagcctggcccacggggcatctctgcgggagaagtacccaggccagactcagggcctcgaccgcctcccgcaccttcactccaaatccaagccctccaccacgcccacttcccgctgtggcttctgcaaccgcccaggcgccaccaacacctgcacccagtgttcaaaagtctcatgtgacgcctgcctcagcgcttaccattatgacccctgctacaaaaagagtgagctgcacaagttcatgcccaacaaccagctgaactacaagtccacccagctctcccatctcgtgtacagatagaccggcctcgccccttccagctccaagggctacatcaaccgacctttcgggtttcacggtgaagaagtactaacgcattgatctcagaggcggaggcctgcacttgaccatgtaggtggcagagatcgtgggctggctgtgtccacgtgggagttcacttagcgactcagatatctcaaccaatggctgctttgttgtctgacaagggagaaggtggcacttccgttcagattcattttgctaatctctccactccctgttcagttggttctttttttggggttttgttttgttttgttttgttgttttgttttttcctttaaagaggatttctgtctctgggaccctcgctgcacctacccctcccattgcaaagccaacttggactgggaagggcccttcaggtcaccaaacatccacctggagcggcgagctagaggcctgttggcttgtgaaatgagccctcctgccacacggggcctctcccaaaggctcatcccttggccgcccccttcctaaacacaaggatccccagctggactccccaccccctggcttccccacctctccaggtgtcaaaggtgaaccgagtccagtattagctgaatgtcatttcgtacaccacagctcagtcagcccatggccttcgtgaactttgctccaacacactgatgtgtgggcttcccacagcaggactgacttccccctttctgttgtttgcacatgcccctcttactgtactgtcaatagatatttttgagatttatttttaaataaatattcaacttgctgtgtgtttcaacgtggttaaaaaaatgaattatgtagctatttattaaatgccctgggttctttagtcttccaagggagggcctcgcgcccattcgtgttgtatcctccactcactatggcccgaggggagaggagagtttggggcagggaggaacagacatgaagcctccttttcttgagctggtggagagccactgtcttccctgcagtaactatctatacacctacctccagtgtgcacttagggggtgagcgcgggtgtcgaggtctgtgtgtctgcagactgctaacctatgacaattcagggacctcacctgtcggacctatagcttgctgagcaggaaccttgcacttcacacttcttgagtctcgtttcagaaggaaaatcatttgggattcctactgcccctccatctcaatcctcttctcttcaccagtttccaggactcatctgcaacatttgcaatctttttgcactaaaagtgggcaggagtcggcatgtgcccatcagagagacggctcctcagatgctcagctaagcctaagcgcttccaagcctgaaggccccttcagcttctcatgtgaattaccaacccctggattttccttgtgggggtacaagagcaggagtggggcaagagtttgaaaataaagccgcttccttgtgaactaactatattttagccataactgtttgtgatgtacacaatgttaagggatttatatgcagtgggcttttctgggagaaagttattcagctcttgagcaagtttaagtctggctgaatcctgaggccactgtgaatttgctgatgttcttccaactcagttgagtgattttaaggttttccaaatcttctatggctctctttttaatatatatatatatatatatatatatatatatatatatatatatatatctatctggtagatcacatgtagatgtacagtgtgtatattaagctgaatttcaaccaactttattactaagaccagcctagcagggcattcatctttgatgttcttccttttcacatttcagaatcggcaatgcctggcccactcctgagagctctagttttctagttttccatttccagattgcgccagcattacagtaactaactctttctaaccaaccgtgatgccacgtaacttaccctatggacaaaagcaggaatgactaacacatcctaggagggaaagtccagtgtacctgtcatcacggacgcactgtggtcacagactggaatacgaaatactacagccctgctcccaggtgtgcatcttactggatgaggttgctgtgattgagatagttaaatacatgctaatttaaaaatgcagatgttttacatttgatttctaccaagagttgaaatgttgagagatgattaaaaataataataataaagtgtcttccattgttaaacggcacgagctcgtgccgaattcggcacgagccagcctggccaacatggtgaaaccccgtctctgctaaaatatgcaaaaattagccgggcatgttggcaggcgacttaatcccagctacttgggaggcagaggcaagagaatcgtttgaacccggaaggcggaggttgctgtgagctgagatcgagccattgcactgaaacctgnggaataagagctagacttctctcaaaaaaaaaaaaaaaaaaaacttcagggggggcccggaccccaatttgcccttattgggaattcgaattacaaatcaactgggccgggctgttttaaaacaactctgagctggggaaaaaaccctggggggttcccccaaataataaatggct

SEQ ID NO: 24773 - DNA, 1847 bp, Homo sapiens
ttccgggccgagtgtttccgggtcgctgctggcccccgggtactggtctcagtacccctgcagccggccggagaggctagagcccgacggggcccggctccggcggcagccgcgcctctcgcttgcttccctcggccgggccgtcctcggcggcagtgtcaggagcactccgctggtccaggcggcaacatgtccatgcttttagtgatgtccctgcctctaatccagaagccatggaggagataaggtagcccccctcgatcggatggggaagcccagttcaatggatactaaattcaaggatgacttatttcggaagtacgtgcagttccatgagagcaaagtggataccaccaccagcaggcagcggcctggcagcgatgagtgcctgcgggtggcagcctcaaccctgctcagcctgcacaaggtggatcccttttatcgattccggctgatccagttctatgaggtggtggagagctccttgcgctcgctcagctcctctagcctgcgggctctgcacggcgccttcagcatgctggagacggtgggcatcaacctcttcctctacccgtggaagaaggaattcagaagcatcaagacctacacgggcccttttgtttattatgtcaagtcgacattactggaagaggacatccgagccatcctgagctgcatgggctacacacctgagctgggcactgcatacaagctcagagagctcgtggagaccctccaggtgaagatggtctcctttgagctctttctggccaaagtcgagtgtgagcagatgctagaaatccactcacaagtgaaggacaagggctactccgagctggacattgtgagcgagcgcaagagcagtgcagaggatgtgcgcggctgctcggacgccctgcggcggcgggcagagggccgggagcacctgacggcctccatgtcacgagtggcactccagaagtcggccagcgagcgggcggccaaggactactacaagccccgcgtgaccaagccctcgaggtcagtggatgcctatgacagctactgggagagccggaagccacccctgaaggcctcattgagtcttcggaaggagcctgtggcaacggatgtgggggacgacctcaaggatgagatcatccgcccatccccttcgctgctgaccatggccagctccccccacggcagcccggatgtgcttccacccgcctcccccagcaacggcccggccctgctgcgcggtacctacttctccactcaggatgacgtggatctgtacacagactctgaacccagggccacctaccgtcggcaggatgctctgcggccggatgtgtggctgctcagaaacgatgcccactccctctaccacaagcgctcgccccctgccaaagagtccgccctctccaagtgccaaagctgcgggctgtcctgcagctcctccctctgccagcgctgtgacagcctgctcacctgtcctccagcttccaagcccagcgccttccccagcaaggcctcgactcatgacagcctggcccacggggcatctctgcgggagaagtacccaggccagactcagggcctcgaccgcctcccgcaccttcactccaaatccaagcccctctccaggtgtcaaaggtgaaccgagtccagtattagctgaatgtcatttcgtacaccacagctcagtcagcccatggccttcgtgaactttgctccaacacactgatgtgtgggcttcccacagcaggactgacttccccctttctgttgtttgcacatgcccctcttactgtactgtcaatagatatttttgagatttatttttaaataaatattcaacttgc

SEQ ID NO: 24774 - DNA, 1174 bp, Homo sapiens
gttgcaggcacccaggtgttgactgcgtgtccattgttgttatagttggttgaatctgtcccattaattctccttccccaggcaagactcgtggctgtgacccatgggcctctgaggaggcgttgtaagtccgcccagctccccacttgctgtgctctcactcaatgcgaagggaaccaaggtaccagggccaagtgggtccagacatccacacggattctgaaagggcaggtcaagcaggcacgtggggcccaggttaccccttattccccgctgtggcatgggaagctgggaagggctgggggttggggtatcatgggatgtgcttccttaacggttcctttgtgtcactgccagactttgtccagccatcagccacggcctctcgacagcaccaagatggaagtcaaaggtcagctgatcagctctcctaccttcaatgccccagctgccctgttcggagaggctgccccccaggtgaagtcagagcgtctgcgggggctgcttgaccggcagcggaccctgcaggaggccctgagcctgaaacttcaggagctccgcaaagtgtgtctccaggaggcggtgagggcctggccctaggggtatcaggcggggaggttgggaggaggtgaggagctggggcccctaggtagacagacttgggtggcaattcctcaaccacttgtcttggctgtagattccctgtcacctactttctcctcaaagctcagcttagatgtgttagaatgaatgaaataggctgggcgctatggctcacgcctgtaatcccagcactttgggaggccgaggcaggtggatcacctgaggtcgggagttccagaccagcctgaccaacatggagaaatcccgtctctactaaaaatgcaaaattaggctgggcgcggtggctcacgcctgtaatcccagcactttgggaggccgaggtgggcggaacacgatgtcaggagatcgagaccatcctggctaacacggtgtaaccccgtctctactaaaaatacaaaaaattagtcaggcgtggtggcgggcacctatagttccagctactcgggaggctgaggcaggagaatggcatgaacccgggaggcggagcttgcagtgagccgagattgcgccactgcactccagcctgggtgacagagcaagactctgtctc

SEQ ID NO: 24775 - DNA, 381 bp, Homo sapiens
  misc_feature (30)..(30): n is a, c, g, or t
tctaatagaagatgaaactgaggcattganagttaagtaattttagccaggcacagtggcttacacctgtaatcccagcactctgggaggttaaggcggatggatcacttgaactcttgacctcgtgatctgcccgccttggcctcccaaagtgctgggattacagccgtgagccactgcacccagccccaatccaccactttttaagcaaacccacacaagttgtgttttctatgatacctgtctgtgattttcggagctgggggttcccctacccccttttcctggcgttaagcttttctttttataccagtggatctggacccaagacattacccacactggaaggggatttgtataataaatgtgtaaactgaaccc

SEQ ID NO: 24776 - DNA, 344 bp, Homo sapiens
acaggatgaggcggaaactggccagaaggtggcccaagtagaggtgcccacccagtggtgtaagggggcagcacccaggcctgggagtgagaggcccacttctccccctctcacctgtagaggacgtagttctgcactcagagagcagctccctctcagagtctggggccagccatgacaacggtgaggactcctatcccccaaacctgcccccgactcctacgtccctttagcccatccccttttcctggcgttaagcttttctttttataccagtggatctggacccaagacattacccacactggaaggggatttgtataataaatgtgtaaactgaaccc

SEQ ID NO: 24777 - DNA, 4464 bp, Homo sapiens
  misc_feature (3)..(3): n is a, c, g, or t
  misc_feature (5)..(5): n is a, c, g, or t
  misc_feature (7)..(7): n is a, c, g, or t
ggnangnggccaaggcatctgccactgctgctgactgccactaccagccggagccagggcctggtcgagacaactatttttgaggcaagactcgtggctgtgacccatgggcctctgaggaggcgttgtaagtccgcccagctccccacttgctgtgctctcactcaatgcgaagggaaccaaggtaccagggccaagtgggtccagacatccacacggattctgaaagggcaggtcaagcagactttgtccagccatcagccacggcctctcgacagcaccaagatggaagtcaaaggtcagctgatcagctctcctaccttcaatgccccagctgccctgttcggagaggctgccccccaggtgaagtcagagcgtctgcgggggctgcttgaccggcagcggaccctgcaggaggccctgagcctgaaacttcaggagctccgcaaagtgtgtctccaggaggcggagctgactggccagctgccccctgagtgcccactagagcctggtgaacggccccagttggtccgccggcggccccccacagcccgcgcctaccctccaccgcaccccaaccaagcacaccactccttgtgccctgctgaggagctggctcttgaggccctggaacgcgaggtgtcagtgcaacagcagatcgcggcggccgcccgccgcctggccttggcccctgatctgagcaccgagcagcgccggcgccggcgccaggtccaggcagatgcactgaggaggctgcatgagctagaggagcagctcagggatgtccgggcccgccttggcctcccagtgctcccgctgccccagccactgccactgtccacggggtcagtgatcaccacccagggagtctgcctgggcatgcgtcttgctcagctcagccaagaggacgtagttctgcactcagagagcagctccctctcagagtctggggccagccatgacaacgaggagccccatggctgcttctctctggccgagcgcccctcaccacccaaggcttgggaccagctgcgggcagtatctggggggagccctgagcggcgaaccccatggaaaccacctccatcagatctttatggggatctgaagagccggcggaactctgtggccagccccaccagccccacacgctcgctgcccaggagtgcctccagttttgaggggcgaagtgtgcctgccacccctgtcctcacccggggcgctggcccccagctctgcaaacctgaaggccttcattctcgtcagtggtccggcagccaggactcccagatgggcttcccccgggcggaccctgcctccgatcgcgcctccctcttcgtagctcgcacccgccgcagcaacagttctgaggccctgctggtggaccgggccgctggtgggggagctggctccccgcctgcccctctggctccctctgcctctggccccccagtctgcaagagcagtgaggtgctgtatgagcgcccccaaccaacccctgccttctcctcccgcacagcaggccccccagaccctccccgggccgcccggcctagctcagctgcccctgcctcccgaggtgccccccggctcccacctgtgtgtggagacttcctcttggactattccttggaccggggcctgccccgcagtggcggtggaacaggctggggggagctgccgcctgcagctgaggtcccaggacccctctcccgccgggatgggctcctcaccatgctccccggcccaccacctgtgtatgcagctgacagcaacagccccctcctccgcaccaaggacccccacacccgtgccacccgcactaagccctgtggcctgcccccagaggctgccgaaggccctgaggtgcatccaaaccctctgctgtggatgcccccacccacccgtatcccctcggctggtgaacgcagtggccacaagaacctggctctggaggggctgcgggactggtacatccggaactcgggactggctgcggggccccagcgccggcctgtgctcccttccgtgggcccgccacacccacccttcctccatgcccgctgctatgaggtgggccaggcgctgtacggggcccccagccaggcgccactcccacactcgaggagtttcacggcgccccctgtctctggcaggtatggggggtgcttttactgatgggtaggggtctcgtaaggcagatggcgaagatatccaggccagggagtggctagtcatgatagctaatgaattggaccatgaggaaactagctgctgtgatggcacagggtcactctactgcacatgacctgcattagtccatggggtcctggtggaggggatcttgggcactggtagcagcaattctttatcaagttataggctgaagatgagccttgaagccagggtgccgggaggaagggacatctcatgccccttgctgttttcttccttttttctccatgccccagagcctgaaagtgctgtcctgtgcctgcctccacctctttaacgagcctcttttcctttctttttctgtgtcttgtctgtcttttcttcttcttgtcttccccgccctgtcctccggattcctgctaccccttctaaagatactacgcggacttcctgtatcccccggagctgagcgctcgtttaagtgacctgacgctagagggggagcagtcctccagttctgacacccagaccccggggacactggtctgaccccttctgatatgtcccttgttggcctgggcacgattccaatctggggagcacacagctgacctcgctgggccctggggtgtggttgctctcagtcctgagcagagtgcgccaacctaatcttccaaggcccctggctccccgtaggcccaggaaggtgtctgacaccctgcttcttctctcacactgtgctggggactgggggccctcagctagcttaaaagaggggggatgatgtcatggggaccccaagccccttcctccatttatgtttacagttgtgacttaggtattcactgtcttcctccaacactaggcgttttacaaaagggaaactgtgatctcatctggttgggttcattcctgttcccatgcccaaccaggttccattcaggaaccccctccataaaatggaccatatcgggtctcagggccatttagggcagccaggagactccggtgtgaacagaaatccctgccacgcatcgccagggcagttggggcagtgggctctctgcccacacttggaaggactgcagtctgggtgggatgcctgaaagagcccaaccccctctgtgcccatggcctctgccctgaccacccccagtcaggaggccccacaggaggggcacccggtagatgccagtgaaatcctcaggggaggtctgcctgaaagagcccaaccccctctgtgcccatggcctctgccctgaccacccccagtcaggaggccccacaggaggggcacccggtagatgccagtgaaatcctcaggtgaggtctgcctacgggccacgggccactcaccactcacaccttccttggctttccttccacccttttttttttctcgagacggagtcttgctctgtcaccaggctggagtgcagcggcgcaatctcagctcactgcaacctctgcctcctgggttctcctgcctcaccctcccgagtagctgggattacaggcacacgccaccatgcccggctaatttttgtattcttagtagagacaaggtttcaccatattggccaggctggtcttgaactcttgacctcgtgatctgcccgccttggcctcccaaagtgctgggattacagccgtgagccactgcacccagccccaatccaccactttttaagcaaacccacacaagttgtgttttctatgatacctgtctgtgattttcggagctgggggttcccctacccccttttcctggcgttaagcttttctttttataccagtggatctggacccaagacattacccacactggaaggggatttgtataataaatgtgtaaactgaacccatgtgttgctgctctgtctgcctcaccttgaggacccacacctctagtcaagaccagataatatatttttgcaggaaaaaacataccttgggaatagcctgtgatagtgtcatctgttttgactttacttgctttgtgatgtggggcaacttctttgcctgtctgcactcagatttctagccaacctcaagcaataactcttggtaatataaatggtgataacaaagactctgtccttaacctccctatacattttttaaaaatttttatttttttgagacaatgtctcactctgttgcccaggctgaaatgtagtggcgcgataacggctcactgcagccttgacctcctggactcacaatcttcccacctcagccgcctgaatagctgaaactacagttgtgcaccaccatacccgctaatta

SEQ ID NO: 24778 - DNA, 2874 bp, Homo sapiens
  misc_feature (3)..(3): n is a, c, g, or t
  misc_feature (5)..(5): n is a, c, g, or t
  misc_feature (7)..(7): n is a, c, g, or t
ggnangnggccaaggcatctgccactgctgctgactgccactaccagccggagccagggcctggtcgagacaactatttttgaggcaagactcgtggctgtgacccatgggcctctgaggaggcgttgtaagtccgcccagctccccacttgctgtgctctcactcaatgcgaagggaaccaaggtaccagggccaagtgggtccagacatccacacggattctgaaagggcaggtcaagcagactttgtccagccatcagccacggcctctcgacagcaccaagatggaagtcaaaggtcagctgatcagctctcctaccttcaatgccccagctgccctgttcggagaggctgccccccaggtgaagtcagagcgtctgcgggggctgcttgaccggcagcggaccctgcaggaggccctgagcctgaaacttcaggagctccgcaaagtgtgtctccaggaggcggagctgactggccagctgccccctgagtgcccactagagcctggtgaacggccccagttggtccgccggcggccccccacagcccgcgcctaccctccaccgcaccccaaccaagcacaccactccttgtgccctgctgaggagctggctcttgaggccctggaacgcgaggtgtcagtgcaacagcagatcgcggcggccgcccgccgcctggccttggcccctgatctgagcaccgagcagcgccggcgccggcgccaggtccaggcagatgcactgaggaggctgcatgagctagaggagcagctcagggatgtccgggcccgccttggcctcccagtgctcccgctgccccagccactgccactgtccacggggtcagtgatcaccacccagggagtctgcctgggcatgcgtcttgctcagctcagccaagaggacgtagttctgcactcagagagcagctccctctcagagtctggggccagccatgacaacgaggagccccatggctgcttctctctggccgagcgcccctcaccacccaaggcttgggaccagctgcgggcagtatctggggggagccctgagcggcgaaccccatggaaaccacctccatcagatctttatggggatctgaagagccggcggaactctgtggccagccccaccagccccacacgctcgctgcccaggagtgcctccagttttgaggggcgaagtgtgcctgccacccctgtcctcacccggggcgctggcccccagctctgcaaacctgaaggccttcattctcgtcagtggtccggcagccaggactcccagatgggcttcccccgggcggaccctgcctccgatcgcgcctccctcttcgtagctcgcacccgccgcagcaacagttctgaggccctgctggtggaccgggccgctggtgggggagctggctccccgcctgcccctctggctccctctgcctctggccccccagtctgcaagagcagtgaggtgctgtatgagcgcccccaaccaacccctgccttctcctcccgcacagcaggccccccagaccctccccgggccgcccggcctagctcagctgcccctgcctcccgaggtgccccccggctcccacctgtgtgtggagacttcctcttggactattccttggaccggggcctgccccgcagtggcggtggaacaggctggggggagctgccgcctgcagctgaggtcccaggacccctctcccgccgggatgggctcctcaccatgctccccggcccaccacctgtgtatgcagctgacagcaacagccccctcctccgcaccaaggacccccacacccgtgccacccgcactaagccctgtggcctgcccccagaggctgccgaaggccctgaggtgcatccaaaccctctgctgtggatgcccccacccacccgtatcccctcggctggtgaacgcagtggccacaagaacctggctctggaggggctgcgggactggtacatccggaactcgggactggctgcggggccccagcgccggcctgtgctcccttccgtgggcccgccacacccacccttcctccatgcccgctgctatgaggtgggccaggcgctgtacggggcccccagccaggcgccactcccacactcgaggagtttcacggcgccccctgtctctggcaggtatggggggtgcttttactgatgggtaggggtctcgtaaggcagatggcgaagatatccaggccagggagtggctagtcatgatagctaatgaattggaccatgaggaaactagctgctgtgatggcacagggtcactctactgcacatgacctgcattagtccatggggtcctggtggaggggatcttgggcactggtagcagcaattctttatcaagttataggctgaagatgagccttgaagccagggtgccgggaggaagggacatctcatgccccttgctgttttcttccttttttctccatgccccagagcctgaaagtgctgtcctgtgcctgcctccacctctttaacgagcctcttttcctttctttttctgtgtcttgtctgtcttttcttcttcttgtcttccccgccctgtcctccggattcctgctaccccttctaaagatactacgcggacttcctgtatcccccggagctgagcgctcgtttaagtgacctgacgctagagggggagcagtcctccagttctgacacccagaccccggggacactggtctgaccccagttggtccgcggcggccccccacagcccgcgcctaccctccaccgcaccccaaccaagcacaccactccttgtgccctgctgaggagctggctcttgaggccctggaacgcgaggtgtcagtgcaacagcagatcgcggcggccc

SEQ ID NO: 24779 - DNA, 3980 bp, Homo sapiens
  misc_feature (3)..(3): n is a, c, g, or t
  misc_feature (5)..(5): n is a, c, g, or t
  misc_feature (7)..(7): n is a, c, g, or t
ggnangnggccaaggcatctgccactgctgctgactgccactaccagccggagccagggcctggtcgagacaactatttttgaggcaagactcgtggctgtgacccatgggcctctgaggaggcgttgtaagtccgcccagctccccacttgctgtgctctcactcaatgcgaagggaaccaagactttgtccagccatcagccacggcctctcgacagcaccaagatggaagtcaaaggtcagctgatcagctctcctaccttcaatgccccagctgccctgttcggagaggctgccccccaggtgaagtcagagcgtctgcgggggctgcttgaccggcagcggaccctgcaggaggccctgagcctgaaacttcaggagctccgcaaagtgtgtctccaggaggcggagctgactggccagctgccccctgagtgcccactagagcctggtgaacggccccagttggtccgccggcggccccccacagcccgcgcctaccctccaccgcaccccaaccaagcacaccactccttgtgccctgctgaggagctggctcttgaggccctggaacgcgaggtgtcagtgcaacagcagatcgcggcggccgcccgccgcctggccttggcccctgatctgagcaccgagcagcgccggcgccggcgccaggtccaggcagatgcactgaggaggctgcatgagctagaggagcagctcagggatgtccgggcccgccttggcctcccagtgctcccgctgccccagccactgccactgtccacggggtcagtgatcaccacccagggagtctgcctgggcatgcgtcttgctcagctcagccaagaggacgtagttctgcactcagagagcagctccctctcagagtctggggccagccatgacaacgaggagccccatggctgcttctctctggccgagcgcccctcaccacccaaggcttgggaccagctgcgggcagtatctggggggagccctgagcggcgaaccccatggaaaccacctccatcagatctttatggggatctgaagagccggcggaactctgtggccagccccaccagccccacacgctcgctgcccaggagtgcctccagttttgaggggcgaagtgtgcctgccacccctgtcctcacccggggcgctggcccccagctctgcaaacctgaaggccttcattctcgtcagtggtccggcagccaggactcccagatgggcttcccccgggcggaccctgcctccgatcgcgcctccctcttcgtagctcgcacccgccgcagcaacagttctgaggccctgctggtggaccgggccgctggtgggggagctggctccccgcctgcccctctggctccctctgcctctggccccccagtctgcaagagcagtgaggtgctgtatgagcgcccccaaccaacccctgccttctcctcccgcacagcaggccccccagaccctccccgggccgcccggcctagctcagctgcccctgcctcccgaggtgccccccggctcccacctgtgtgtggagacttcctcttggactattccttggaccggggcctgccccgcagtggcggtggaacaggctggggggagctgccgcctgcagctgaggtcccaggacccctctcccgccgggatgggctcctcaccatgctccccggcccaccacctgtgtatgcagctgacagcaacagccccctcctccgcaccaaggacccccacacccgtgccacccgcactaagccctgtggcctgcccccagaggctgccgaaggccctgaggtgcatccaaaccctctgctgtggatgcccccacccacccgtatcccctcggctggtgaacgcagtggccacaagaacctggctctggaggggctgcgggactggtacatccggaactcgggactggctgcggggccccagcgccggcctgtgctcccttccgtgggcccgccacacccacccttcctccatgcccgctgctatgaggtgggccaggcgctgtacggggcccccagccaggcgccactcccacactcgaggagtttcacggcgccccctgtctctggcaggtatggggggtgcttttactgatgggtaggggtctcgtaaggcagatggcgaagatatccaggccagggagtggctagtcatgatagctaatgaattggaccatgaggaaactagctgctgtgatggcacagggtcactctactgcacatgacctgcattagtccatggggtcctggtggaggggatcttgggcactggtagcagcaattctttatcaagttataggctgaagatgagccttgaagccagggtgccgggaggaagggacatctcatgccccttgctgttttcttccttttttctccatgccccagagcctgaaagtgctgtcctgtgcctgcctccacctctttaacgagcctcttttcctttctttttctgtgtcttgtctgtcttttcttcttcttgtcttccccgccctgtcctccggattcctgctaccccttctaaagatactacgcggacttcctgtatcccccggagctgagcgctcgtttaagtgacctgacgctagagggggagcagtcctccagttctgacacccagaccccggggacactggtctgaccccttctgatatgtcccttgttggcctgggcacgattccaatctggggagcacacagctgacctcgctgggccctggggtgtggttgctctcagtcctgagcagagtgcgccaacctaatcttccaaggcccctggctccccgtaggcccaggaaggtgtctgacaccctgcttcttctctcacactgtgctggggactgggggccctcagctagcttaaaagaggggggatgatgtcatggggaccccaagccccttcctccatttatgtttacagttgtgacttaggtattcactgtcttcctccaacactaggcgttttacaaaagggaaactgtgatctcatctggttgggttcattcctgttcccatgcccaaccaggttccattcaggaaccccctccataaaatggaccatatcgggtctcagggccatttagggcagccaggagactccggtgtgaacagaaatccctgccacgcatcgccagggcagttggggcagtgggctctctgcccacacttggaaggactgcagtctgggtgggatgcctgaaagagcccaaccccctctgtgcccatggcctctgccctgaccacccccagtcaggaggccccacaggaggggcacccggtagatgccagtgaaatcctcaggggaggtctgcctgaaagagcccaaccccctctgtgcccatggcctctgccctgaccacccccagtcaggaggccccacaggaggggcacccggtagatgccagtgaaatcctcaggtgaggtctgcctacgggccacgggccactcaccactcacaccttccttggctttccttccacccttttttttttctcgagacggagtcttgctctgtcaccaggctggagtgcagcggcgcaatctcagctcactgcaacctctgcctcctgggttctcctgcctcaccctcccgagtagctgggattacaggcacacgccaccatgcccggctaatttttgtattcttagtagagacaaggtttcaccatattggccaggctggtcttgaactcttgacctcgtgatctgcccgccttggcctcccaaagtgctgggattacagccgtgagccactgcacccagccccaatccaccactttttaagcaaacccacacaagttgtgttttctatgatacctgtctgtgattttcggagctgggggttcccctacccccttttcctggcgttaagcttttctttttataccagtggatctggacccaagacattacccacactggaaggggatttgtataataaatgtgtaaactgaaccc

SEQ ID NO: 24780 - DNA, 3580 bp, Homo sapiens
agccatgagaacggccttagcagggggaggggtcagctggattaggaacagcccctgcccggcatctactctgctagcctttcctctgagtccctacacagatttacacctcccttggagctaacagtgccaggcctcccccacgcatttctacccctgaccgcctagcctaggatagaacctcagctgccctttacatgtcactacctgccacctttatacacacagcttccaaccttgggcccatttggagatgtgaaagtgaaggcttagaaagggctggggtagggagggcactgcacgccttctgcctgatttttctgaccctattcccatgaccctcgcctctcaccccagacctgaaggccttcattctcgtcagtggtccggcagccaggactcccagatgggcttcccccgggcggaccctgcctccgatcgcgcctccctcttcgtagctcgcacccgccgcagcaacagttctgaggccctgctggtggaccgggccgctggtgggggagctggctccccgcctgcccctctggctccctctgcctctggccccccagtctgcaagagcagtgaggtgctgtatgagcgcccccaaccaacccctgccttctcctcccgcacagcaggccccccagaccctccccgggccgcccggcctagctcagctgcccctgcctcccgaggtgccccccggctcccacctgtgtgtggagacttcctcttggactattccttggaccggggcctgccccgcagtggcggtggaacaggctggggggagctgccgcctgcagctgaggtcccaggacccctctcccgccgggatgggctcctcaccatgctccccggcccaccacctgtgtatgcagctgacagcaacagccccctcctccgcaccaaggacccccacacccgtgccacccgcactaagccctgtggcctgcccccagaggctgccgaaggccctgaggtgcatccaaaccctctgctgtggatgcccccacccacccgtatcccctcggctggtgaacgcagtggccacaagaacctggctctggaggggctgcgggactggtacatccggaactcgggactggctgcggggccccagcgccggcctgtgctcccttccgtgggcccgccacacccacccttcctccatgcccgctgctatgaggtgggccaggcgctgtacggggcccccagccaggcgccactcccacactcgaggagtttcacggcgccccctgtctctggcaggtatggggggtgcttttactgatgggtaggggtctcgtaaggcagatggcgaagatatccaggccagggagtggctagtcatgatagctaatgaattggaccatgaggaaactagctgctgtgatggcacagggtcactctactgcacatgacctgcattagtccatggggtcctggtggaggggatcttgggcactggtagcagcaattctttatcaagttataggctgaagatgagccttgaagccagggtgccgggaggaagggacatctcatgccccttgctgttttcttccttttttctccatgccccagagcctgaaagtgctgtcctgtgcctgcctccacctctttaacgagcctcttttcctttctttttctgtgtcttgtctgtcttttcttcttcttgtcttccccgccctgtcctccggattcctgctaccccttctaaagatactacgcggacttcctgtatcccccggagctgagcgctcgtttaagtgacctgacgctagagggggagcagtcctccagttctgacacccagaccccggggacactggtctgaccccttctgatatgtcccttgttggcctgggcacgattccaatctggggagcacacagctgacctcgctgggccctggggtgtggttgctctcagtcctgagcagagtgcgccaacctaatcttccaaggcccctggctccccgtaggcccaggaaggtgtctgacaccctgcttcttctctcacactgtgctggggactgggggccctcagctagcttaaaagaggggggatgatgtcatggggaccccaagccccttcctccatttatgtttacagttgtgacttaggtattcactgtcttcctccaacactaggcgttttacaaaagggaaactgtgatctcatctggttgggttcattcctgttcccatgcccaaccaggttccattcaggaaccccctccataaaatggaccatatcgggtctcagggccatttagggcagccaggagactccggtgtgaacagaaatccctgccacgcatcgccagggcagttggggcagtgggctctctgcccacacttggaaggactgcagtctgggtgggatgcctgaaagagcccaaccccctctgtgcccatggcctctgccctgaccacccccagtcaggaggccccacaggaggggcacccggtagatgccagtgaaatcctcaggggaggtctgcctgaaagagcccaaccccctctgtgcccatggcctctgccctgaccacccccagtcaggaggccccacaggaggggcacccggtagatgccagtgaaatcctcaggtgaggtctgcctacgggccacgggccactcaccactcacaccttccttggctttccttccacccttttttttttctcgagacggagtcttgctctgtcaccaggctggagtgcagcggcgcaatctcagctcactgcaacctctgcctcctgggttctcctgcctcaccctcccgagtagctgggattacaggcacacgccaccatgcccggctaatttttgtattcttagtagagacaaggtttcaccatattggccaggctggtcttgaactcttgacctcgtgatctgcccgccttggcctcccaaagtgctgggattacagccgtgagccactgcacccagccccaatccaccactttttaagcaaacccacacaagttgtgttttctatgatacctgtctgtgattttcggagctgggggttcccctacccccttttcctggcgttaagcttttctttttataccagtggatctggacccaagacattacccacactggaaggggatttgtataataaatgtgtaaactgaacccatgtgttgctgctctgtctgcctcaccttgaggacccacacctctagtcaagaccagataatatatttttgcaggaaaaaacataccttgggaatagcctgtgatagtgtcatctgttttgactttacttgctttgtgatgtggggcaacttctttgcctgtctgcactcagatttctagccaacctcaagcaataactcttggtaatataaatggtgataacaaagactctgtccttaacctccctatacattttttaaaaatttttatttttttgagacaatgtctcactctgttgcccaggctgaaatgtagtggcgcgataacggctcactgcagccttgacctcctggactcacaatcttcccacctcagccgcctgaatagctgaaactacagttgtgcaccaccatacccgctaatta

SEQ ID NO: 24781 - DNA, 1380 bp, Homo sapiens
gtgcagcgcaccagcatggcacgtgtatacatatgtaactaacctgcacaatgtgcacatgtaccctaaaacttaaagtataataaaaaaaaaagaaaaaaatcaaaagctttatagtattctgttgagtaagagtattattatttgtttatacaacctctttttggtgaacatttgaattgtgtttagatagttactaatgcaaacaatacttccagtgaacttttgtaaatatatatttgtatatataagagaataaatcttatacctgcagagtaaatttctaaaagtgaatcactaattctgagattatgtgcatctccagagatgttaacaaacatacacacccagcaacagtgcaagacagtgtatttcccaactgctccctcactgagatttttaaaaaacatataaatactattataagttacctctggagttaaagaataacttttgctttttactttcatagacatctgtactatgtaaacttgatatagtgaggatgttttcttttgtaattaaaagattaaagagattcagaatacttgtttgtaattggttttggaatgaaatttcacttggaaaataaaggcctagaatatgagactattcatcaatagaaaaccattgtagggagcagttaacaggtaaagctctatttaataagggcaagctgatggcagggaaaggaacagaccttaaaaaggactcacctgtgagaattggagacggtaaccctgtggtatcaaaatgcaggagaccagagatagctataaatctcttgcagtgttactgcctccgcatgaagtcataatccctagaatgagaatttatttttcatgatacaccgataatgcaagggacaatgatcaggaagtactgcacttagtctttctttctcatacctaaaatgtttttcattttatgctttttttagaatagagtgtacttacttcctctcttcctcacatagacttgaaaactcggcgactttaggatgcaactccaggttgacacattttcattagtttagaaaacccacgtgtcccactctcagaatcattattatagtagaggagatattcagggcaaggattccttgggaaacaacatccagattcaagggaagacatctgagtcacgacaacttaaaatccatcctggcctgccacaaagtgtttctgtaacattaagtacctcatatgcaattcttgaaaaggaaaattatgtcaatataacgtgaaatttgtgaaactcaaacatgatcatctaggcaaggagagctgaaatagaagaaataaaattatagcctctaatatgaaaggaaatacttttagtgtggttgctgctaagcagtagtttttttcaactatattt

SEQ ID NO: 24782 - DNA, 484 bp, Homo sapiens
caggaggcggaggttgcagtgagctaagatgatgctactgtactccagcctgagcggcagagtgagactgtgtctctctcacacacacacacaaatgaaatccaagtgtctttaagacttaaaagcagtacatctctatgactccccacaggctggactttgctaatcaatctggtgggctagaagagaaatcctaagaaaaccttcctgcttaatccatctgtacacctaatagataagcatcggtataccaatacaatgaagcgatcttcaaatgctttatcattcagcgctggggccccaggctgaggtgattaggagttagtagtagcagctggggccacttgcagagcggctcccattgtcagcttcagtgccctcagccctttctgcagctgcacagctgagcaagaagaaaccctggtgagaaggtgagaaagccccatgactcaacccgagggcaggtcccactcttaccagccct

SEQ ID NO: 24783 - DNA, 378 bp, Homo sapiens
aggaagttcaggctgtagggaacctgataggaagtaaaaaattaaaagtttccctaaagcaaatgtgaagttaggatttcattaagccgtcattgataatagtgagattttaaactagaaaatatttgtttcctttaaatattgctttgattcacgtttaaattaattattagaaatattaacatagggaatgttttacttataagtgactggtatttataagcatgtgccccacccaaaccccttgctacaattaaatagatgatacttcaaaaaagacatcaaacctttagagaatgtgtagattcagaagtttcaaaccagcaactacataggaagttgacaaagagggttaggtgtcaagtggtgctgtaccaa

SEQ ID NO: 24784 - DNA, 465 bp, Homo sapiens
aatataaatatcagaaaacttgattataaacactattgatgggaagaaaaaaaaacttgattaaaatatcctgaattgtaaggggacccattcattaagatattgattataatagtgaaatttaaagtcaactggtttttctaatttatgttaatcataattaaccctccataacattgtaatacatgttggtaatagtctgaagcagactgttgtatgtatagaaacaatttcttcatatttttaactacctgaaaatatgagtaagttaacagtagttgagagtagtacagatttttggttttgaaataccattagaatagcagtgtcactttttaagcactgtgcagcgtcctgtgttattcccttctttgtccaactgttactttttcttatgagaggcttccacaccctatttggtatccactttctttttatcaaataaagataattgcataatgaaac

SEQ ID NO: 24785 - DNA, 369 bp, Homo sapiens
  misc_feature (169)..(169): n is a, c, g, or t
  misc_feature (182)..(182): n is a, c, g, or t
  misc_feature (270)..(271): n is a, c, g, or t
  misc_feature (306)..(306): n is a, c, g, or t
  misc_feature (335)..(335): n is a, c, g, or t
cattcgcctactccgtgaagtctagggacaggaagatggttggcgacgtgaccggggcccaggcctatgcctccaccgccaagtgcctgaacatctgggccctgattctgggcatcctcatgaccattggattcatcctgttactggtattcggctctgtgacagtctnccatattatgttncagataatacaggaaaaacggggttactagtagccgcccatagcctgcaacctttgcactccactgtgcaatgctggccctgcacgcnnggctgttgcccctgcccccttggtcctgcccctanatacagcagtttatacccacacacctgtntacagtgtcattcaataaagcgcacgtgcttgtg

SEQ ID NO: 24786 - DNA, 267 bp, Homo sapiens
cattcgcctactccgtgaagtctagggacaggaagatggttggcgacgtgaccggggcccaggcctatgcctccaccgccaagtgcctgaacatctgggccctgattctgggcatcctcatgaccattctgctcatcgtcatcccagtgctgatcttccaggcctatggatagatcaggaggcatcactgaggccaggagctctgcccatgacctgtatgccacgtactccaacttccactcctcgccctgcccccggagccaagtc

SEQ ID NO: 24787 - DNA, 157 bp, Homo sapiens
aggggcaccacagtaaagaaagaactggtaaatgcacatcaaatgtggatattatcaggaaagtttttatactttgtgataatctaagacagaactattctacctggatgaattattctctttcataaccagaacagtgctgtgggaaggcactctt

SEQ ID NO: 24788 - DNA, 444 bp, Homo sapiens
gatccatgagagtgcggtgacccttcaaggatgttcacagtcttaataactgcatgagaaaatgagaagaccgtgttaataagcaaaacaagcagcttaagaagctggacaggccaggtgcggtggctcaggcctgtaatcccagcactttgggaggccaaggcgggcggatcaagaggtcaggagattgagaccatcctggccaacatggtgaaaccccgtctgtaccaaaaatacaaaaattagctgggtatggtggcgcatatctgtagtcccagctactcaggaggctgaggtaggagaatcgcttgaacctgggaggcagaggttgcagtgagccaagatcgcgccattgcactgcagactgggcgacagagtgagacactgtctcaaaaaaaaaagaagctggacaaggctgggcatgatggctcacacctggaatcc

SEQ ID NO: 24789 - DNA, 389 bp, Homo sapiens
tcctgtcaataaataatttggtaagtaacttttgtaagacatcttattgtttacaaagtaaacatctaacattattttatttgagacatataacaatccagtgtggaaaatattattatactgattttatatatgagtaaaatgagactgagggaattaggtatcttgttcagggtcgctcagaaagttgtgaaagtagggtttgaatcttggtctctgaatactctgcttaatacaatacaaagtagttattctttaaagactttgaattctgcagtgggagcaagaaaaagatagattatgggctgttcctccctcccgcaacccacaaacaactaaaataactccacttttacccttttctatgtaaattaggcagtatggcaaac

SEQ ID NO: 24790 - DNA, 476 bp, Homo sapiens
cctggccaatatggtcgacaaccccgtctctactaaaattacaaaaaaattagccaggcgtggtggcaggctcctatagtcccagctacttgggagactgagtcaggagaatagcttgaacccgagaggcagaggttgcagtgagctgagattgcgccactgccctccaaccccaagcgacagggtgagactccctctcagaaaaaaaacaaaaacaaaaaaacatttaaccaaaccctggggcaccatggcccgccctagtgcacccataaaatcagccatcaccccacgtatccactcagaactcagctctccagcacctgtcaccagcttgtcattattggccacgggaatttattaggaaggggtgaccggcccttgctttgctcccagcggggaggcggacagagtcgtccctgctggccaggtggcacaggtggttctgatcggccggtgagtctccctccagcgcagct

SEQ ID NO: 24791 - DNA, 2252 bp, Homo sapiens
tccggagttcgggggtcggcggaagatggcggccggcgaaaggagctggtgcctgtgcaagttgttgaggagttgtggagtgtatggcagctggcacaattatccttgcacacaattcggggggcccaaagcttgacattgtggttcctcacgaaggagatataactggctttctggctgagagtgaagaagactatgctgaaactatcgctcacattctttccatgtctgcagaaaagagactccaaatcagaaaaagtgctcgtgcatctgtaagcagattctctgatcaggaatttgaagtgacattcctatcatctgtggaaaagttatttaagtaatgccatatctgtaaaattaaagatattttatataaactggttaaacaccttcatatgtaaatatttttctaaattcaatctcatttgtcaaatcattttactttagaaaacagacaaaatttccttttagaataaaaggaagtgttgaaaagaaaatggatgactagccttcggcttccattcttggtatacatgagagaggctggctgctgagatgaatgtgaaccaggttgcagagaatctggctttgagccaccaggaagaactagtggatttgccaaaaaactaccccttgagtgaaaatgaagatgagggggacagtgatggagagagaaagcatcaaaagcttctggaagcaatcatttcccttgatggaaagaataggcggaaattggctgagaggtctgaggctagtctgaaagtgtcagagttcagtgtcagttctgaaggatcaggagaaaagctgggccttgcagatctgcttgagcccgttaaaacttcatcttctttggccactgtaaaaaagcaactgaatagagtcaaatcaaagaaggtggtggagttacctcttaacaaagaaaaaattgaacagatccacagagaagtagcattcagtaaaacctcacaggtcctctccaaatgggaccctatcatcctgaagaaccagcaggcagagcagctggtttttcccctggggaaggagcagccagccattgctcccattgaacatgcgctcagtggctggaaggcaagaactcccctggagcaggaaatttttaacctcctccataagaacaagcagccagtgacagatcctttactgactcccatggaaaaggcctctctccaagccatgagcctggaagaggcaaagatgcaccgagcagagcttcagagggctcgggctctgcagtcctactatgaggccaaggctcgaaaagagaagaaaatcaaaagtaaaaagtatcacaaagtcgtgaagaaaggaaaggccaagaaagccttaaaagagtttgagcagctacagaaggttaatccaactgtggcattggaagaaatggaaaaaattgaaaatgccagaatgatggaaagaatgagccttaagcaccaaaacagtgggaaatgggccaagtcaaaggcaattatggccaaatatgacctggaggctcgccaagctatgcaggaacagttggccaagaacaaagaactgacacagaaactccaggtagcctctgagagtgaggaagaggagggaggcacagaagtggaagaactccttgtccctcatgtagcgaatgaagtgcagatgaatgtggacggaccgaatccctggatgttcaggagctgcaccagtgacaccaaagaggctgcaacacaggaggaccctgagcaagtgccagagcttgcagctcatgaggtttctgcaagtgaggcagaagaaagaccagtggcagaggaagaaattttgttgagagaatttgaggaaaggcaatcccttagaaaaagatctgagctcaaccaggatgctgagccagcaagcagtcaagaaacaaaagattctagcagccaggaggtgctgtccgaattgagggcactatctcagaaattgaaggaaaaacatcagtccaggaagcaaaaagcaagttcagaggggactgttccccaggtccagagagaggaacctgccccagaagaagcggaacccctattgctacagaggtcagagagagtacaaactctggaagagctagaagagctgggaaaagaagattgttttcaaaataaggagcttcccagacctgtgttagaaggacagcagtcagagaggaccccaaataatcggcctgatgccctaaggagaagaaagagaaggagcaactgatcaacctacagaacttcctgaccacacag

SEQ ID NO: 24792 - DNA, 2835 bp, Homo sapiens
tccggagttcgggggtcggcggaagatggcggccggcgaaaggagctggtgcctgtgcaagttgttgaggtttttttattcattattcttccctgggctcattgtatgtggaactttatgtgtgtgtttggtcattgtcctttggggaatcagactgctgctacagagaaagaaaaaattagtgtcaactagcaaaaatgggaaaaatcaaatggtgattgcattttttcatccatactgcaatgctggtggaggaggagaaagagttttatggtgtgctttaagagccctgcagaaaaaacatttctggacattcccttacatgagaaaaagatgaccccaggacatttgctggtttctgttggccagtttaggccggaaaagaatcatccattgcagatcagagcctttgctaaattgctgaataagaagatggttgagtcacctccttcgcttaaacttgtcctcattggaggttgtcgtaacaaagatgatgaacttagggtaaaccaactgagaaggctgtctgaggatttaggagttcaagaatatgtggaatttaaaataaacattccatttgatgaattaaagaattatttgtctgaagcaacaattggtctgcataccatgtggaacgagcattttgggattggagttgtggagtgtatggcagctggcacaattatccttgcacacaattcggggggcccaaagcttgacattgtggttcctcacgaaggagatataactggctttctggctgagagtgaagaagactatgctgaaactatcgctcacattctttccatgtctgcagaaaagagactccaaatcagaaaaagtgctcgtgcatctgtaagcagattctctgatcaggaatttgaagtgacattcctatcatctgtggaaaagttatttaagtaatgccatatctgtaaaattaaagatattttatataaactggttaaacaccttcatatgtaaatatttttctaaattcaatctcatttgtcaaatcattttactttagaaaacagacaaaatttccttttagaataaaaggaagtgttgaaaagaaaatggatgactagccttcggcttccattcttggtatacatgagagaggctggctgctgagatgaatgtgaaccaggttgcagagaatctggctttgagccaccaggaagaactagtggatttgccaaaaaactaccccttgagtgaaaatgaagatgagggggacagtgatggagagagaaagcatcaaaagcttctggaagcaatcatttcccttgatggaaagaataggcggaaattggctgagaggtctgaggctagtctgaaagtgtcagagttcagtgtcagttctgaaggatcaggagaaaagctgggccttgcagatctgcttgagcccgttaaaacttcatcttctttggccactgtaaaaaagcaactgaatagagtcaaatcaaagaaggtggtggagttacctcttaacaaagaaaaaattgaacagatccacagagaagtagcattcagtaaaacctcacaggtcctctccaaatgggaccctatcatcctgaagaaccagcaggcagagcagctggtttttcccctggggaaggagcagccagccattgctcccattgaacatgcgctcagtggctggaaggcaagaactcccctggagcaggaaatttttaacctcctccataagaacaagcagccagtgacagatcctttactgactcccatggaaaaggcctctctccaagccatgagcctggaagaggcaaagatgcaccgagcagagcttcagagggctcgggctctgcagtcctactatgaggccaaggctcgaaaagagaagaaaatcaaaagtaaaaagtatcacaaagtcgtgaagaaaggaaaggccaagaaagccttaaaagagtttgagcagctacagaaggttaatccaactgtggcattggaagaaatggaaaaaattgaaaatgccagaatgatggaaagaatgagccttaagcaccaaaacagtgggaaatgggccaagtcaaaggcaattatggccaaatatgacctggaggctcgccaagctatgcaggaacagttggccaagaacaaagaactgacacagaaactccaggtagcctctgagagtgaggaagaggagggaggcacagaagtggaagaactccttgtccctcatgtagcgaatgaagtgcagatgaatgtggacggaccgaatccctggatgttcaggagctgcaccagtgacaccaaagaggctgcaacacaggaggaccctgagcaagtgccagagcttgcagctcatgaggtttctgcaagtgaggcagaagaaagaccagtggcagaggaagaaattttgttgagagaatttgaggaaaggcaatcccttagaaaaagatctgagctcaaccaggatgctgagccagcaagcagtcaagaaacaaaagattctagcagccaggaggtgctgtccgaattgagggcactatctcagaaattgaaggaaaaacatcagtccaggaagcaaaaagcaagttcagaggggactgttccccaggtccagagagaggaacctgccccagaagaagcggaacccctattgctacagaggtcagagagagtacaaactctggaagagctagaagagctgggaaaagaagattgttttcaaaataaggagcttcccagacctgtgttagaaggacagcagtcagagaggaccccaaataatcggcctgatgccctaaggagaagaaagagaaggagcaactgatcaacctacagaacttcctgaccacacag

SEQ ID NO: 24793 - DNA, 2254 bp, Homo sapiens
aagtagaagcaaaagtcagactatgagcaaaaatcaaaagtcaagcactcagaagtgaacaagtagagttggagttgtggagtgtatggcagctggcacaattatccttgcacacaattcggggggcccaaagcttgacattgtggttcctcacgaaggagatataactggctttctggctgagagtgaagaagactatgctgaaactatcgctcacattctttccatgtctgcagaaaagagactccaaatcagaaaaagtgctcgtgcatctgtaagcagattctctgatcaggaatttgaagtgacattcctatcatctgtggaaaagttatttaagtaatgccatatctgtaaaattaaagatattttatataaactggttaaacaccttcatatgtaaatatttttctaaattcaatctcatttgtcaaatcattttactttagaaaacagacaaaatttccttttagaataaaaggaagtgttgaaaagaaaatggatgactagccttcggcttccattcttggtatacatgagagaggctggctgctgagatgaatgtgaaccaggttgcagagaatctggctttgagccaccaggaagaactagtggatttgccaaaaaactaccccttgagtgaaaatgaagatgagggggacagtgatggagagagaaagcatcaaaagcttctggaagcaatcatttcccttgatggaaagaataggcggaaattggctgagaggtctgaggctagtctgaaagtgtcagagttcagtgtcagttctgaaggatcaggagaaaagctgggccttgcagatctgcttgagcccgttaaaacttcatcttctttggccactgtaaaaaagcaactgaatagagtcaaatcaaagaaggtggtggagttacctcttaacaaagaaaaaattgaacagatccacagagaagtagcattcagtaaaacctcacaggtcctctccaaatgggaccctatcatcctgaagaaccagcaggcagagcagctggtttttcccctggggaaggagcagccagccattgctcccattgaacatgcgctcagtggctggaaggcaagaactcccctggagcaggaaatttttaacctcctccataagaacaagcagccagtgacagatcctttactgactcccatggaaaaggcctctctccaagccatgagcctggaagaggcaaagatgcaccgagcagagcttcagagggctcgggctctgcagtcctactatgaggccaaggctcgaaaagagaagaaaatcaaaagtaaaaagtatcacaaagtcgtgaagaaaggaaaggccaagaaagccttaaaagagtttgagcagctacagaaggttaatccaactgtggcattggaagaaatggaaaaaattgaaaatgccagaatgatggaaagaatgagccttaagcaccaaaacagtgggaaatgggccaagtcaaaggcaattatggccaaatatgacctggaggctcgccaagctatgcaggaacagttggccaagaacaaagaactgacacagaaactccaggtagcctctgagagtgaggaagaggagggaggcacagaagtggaagaactccttgtccctcatgtagcgaatgaagtgcagatgaatgtggacggaccgaatccctggatgttcaggagctgcaccagtgacaccaaagaggctgcaacacaggaggaccctgagcaagtgccagagcttgcagctcatgaggtttctgcaagtgaggcagaagaaagaccagtggcagaggaagaaattttgttgagagaatttgaggaaaggcaatcccttagaaaaagatctgagctcaaccaggatgctgagccagcaagcagtcaagaaacaaaagattctagcagccaggaggtgctgtccgaattgagggcactatctcagaaattgaaggaaaaacatcagtccaggaagcaaaaagcaagttcagaggggactgttccccaggtccagagagaggaacctgccccagaagaagcggaacccctattgctacagaggtcagagagagtacaaactctggaagagctagaagagctgggaaaagaagattgttttcaaaataaggagcttcccagacctgtgttagaaggacagcagtcagagaggaccccaaataatcggcctgatgccctaaggagaagaaagagaaggagcaactgatcaacctacagaacttcctgaccacacag

SEQ ID NO: 24794 - DNA, 3415 bp, Homo sapiens
tccggagttcgggggtcggcggaagatggcggccggcgaaaggagctggtgcctgtgcaagttgttgaggtttttttattcattattcttccctgggctcattgtatgtggaactttatgtgtgtgtttggtcattgtcctttggggaatcagactgctgctacagagaaagaaaaaattagtgtcaactagcaaaaatgggaaaaatcaaatggtgattgcattttttcatccatactgcaatgctggtggaggaggagaaagagttttatggtgtgctttaagagccctgcagaaaaagtatcctgaagcagtttatgttgtttataccggcgatgttaatgtcaacggtcaacagatactagaaggtgctttcagaagatttaacatcagattaattcacccagtgcagtttgtttttttaaggaaacgctatcttgtggaagattcactgtatcctcacttcacactgctgggccaaagtctaggatccatttttcttggctgggaagctctaatgcagtgtgttcctgatgtttacattgattcaatgggatacgcttttacgcttcctctgtttaagtatatagggggttgccaagttggaagctatgttcattatcctactatcagcaccgacatgctctctgtagtgaagaatcaaaatattggatttaataatgcagccttcattaccaggaatccttttctcagcaaagtaaagctcatctactactatttatttgcttttatttatggacttgttggttcttgcagtgatgtagtcatggtcaattcttcttggacactaaaccatattctctcactatggaaagttgggaattgcactaacattgtttatccaccttgtgatgtgcagacatttctggacattcccttacatgagaaaaagatgaccccaggacatttgctggtttctgttggccagtttaggccggaaaagaatcatccattgcagatcagagcctttgctaaattgctgaataagaagatggttgagtcacctccttcgcttaaacttgtcctcattggaggttgtcgtaacaaagatgatgaacttagggtaaaccaactgagaaggctgtctgaggatttaggagttcaagaatatgtggaatttaaaataaacattccatttgatgaattaaagaattatttgtctgaagcaacaattggtctgcataccatgtggaacgagcattttgggattggagttgtggagtgtatggcagctggcacaattatccttgcacacaattcggggggcccaaagcttgacattgtggttcctcacgaaggagatataactggctttctggctgagagtgaagaagactatgctgaaactatcgctcacattctttccatgtctgcagaaaagagactccaaatcagaaaaagtgctcgtgcatctgtaagcagattctctgatcaggaatttgaagtgacattcctatcatctgtggaaaagttatttaagtaatgccatatctgtaaaattaaagatattttatataaactggttaaacaccttcatatgtaaatatttttctaaattcaatctcatttgtcaaatcattttactttagaaaacagacaaaatttccttttagaataaaaggaagtgttgaaaagaaaatggatgactagccttcggcttccattcttggtatacatgagagaggctggctgctgagatgaatgtgaaccaggttgcagagaatctggctttgagccaccaggaagaactagtggatttgccaaaaaactaccccttgagtgaaaatgaagatgagggggacagtgatggagagagaaagcatcaaaagcttctggaagcaatcatttcccttgatggaaagaataggcggaaattggctgagaggtctgaggctagtctgaaagtgtcagagttcagtgtcagttctgaaggatcaggagaaaagctgggccttgcagatctgcttgagcccgttaaaacttcatcttctttggccactgtaaaaaagcaactgaatagagtcaaatcaaagaaggtggtggagttacctcttaacaaagaaaaaattgaacagatccacagagaagtagcattcagtaaaacctcacaggtcctctccaaatgggaccctatcatcctgaagaaccagcaggcagagcagctggtttttcccctggggaaggagcagccagccattgctcccattgaacatgcgctcagtggctggaaggcaagaactcccctggagcaggaaatttttaacctcctccataagaacaagcagccagtgacagatcctttactgactcccatggaaaaggcctctctccaagccatgagcctggaagaggcaaagatgcaccgagcagagcttcagagggctcgggctctgcagtcctactatgaggccaaggctcgaaaagagaagaaaatcaaaagtaaaaagtatcacaaagtcgtgaagaaaggaaaggccaagaaagccttaaaagagtttgagcagctacagaaggttaatccaactgtggcattggaagaaatggaaaaaattgaaaatgccagaatgatggaaagaatgagccttaagcaccaaaacagtgggaaatgggccaagtcaaaggcaattatggccaaatatgacctggaggctcgccaagctatgcaggaacagttggccaagaacaaagaactgacacagaaactccaggtagcctctgagagtgaggaagaggagggaggcacagaagtggaagaactccttgtccctcatgtagcgaatgaagtgcagatgaatgtggacggaccgaatccctggatgttcaggagctgcaccagtgacaccaaagaggctgcaacacaggaggaccctgagcaagtgccagagcttgcagctcatgaggtttctgcaagtgaggcagaagaaagaccagtggcagaggaagaaattttgttgagagaatttgaggaaaggcaatcccttagaaaaagatctgagctcaaccaggatgctgagccagcaagcagtcaagaaacaaaagattctagcagccaggaggtgctgtccgaattgagggcactatctcagaaattgaaggaaaaacatcagtccaggaagcaaaaagcaagttcagaggggactgttccccaggtccagagagaggaacctgccccagaagaagcggaacccctattgctacagaggtcagagagagtacaaactctggaagagctagaagagctgggaaaagaagattgttttcaaaataaggagcttcccagacctgtgttagaaggacagcagtcagagaggaccccaaataatcggcctgatgccctaaggagaagaaagagaaggagcaactgatcaacctacagaacttcctgaccacacag

SEQ ID NO: 24795 - DNA, 1651 bp, Homo sapiens
tccggagttcgggggtcggcggaagatggcggccggcgaaaggagctggtgcctgtgcaagttgttgaggtttttttattcattattcttccctgggctcattgtatgtggaactttatgtgtgtgtttggtcattgtcctttggggaatcagactgctgctacagagaaagaaaaaattagtgtcaactagcaaaaatgggaaaaatcaaatggtgattgcattttttcatccatactgcaatgctggtggaggaggagaaagagttttatggtgtgctttaagagccctgcagaaaaagtatcctgaagcagtttatgttgtttataccggcgatgttaatgtcaacggtcaacagatactagaaggtgctttcagaagatttaacatcagattaattcacccagtgcagtttgtttttttaaggaaacgctatcttgtggaagattcactgtatcctcacttcacactgctgggccaaagtctaggatccatttttcttggctgggaagctctaatgcagtgtgttcctgatgtttacattgattcaatgggatacgcttttacgcttcctctgtttaagtatatagggggttgccaagttggaagctatgttcattatcctactatcagcaccgacatgctctctgtagtgaagaatcaaaatattggatttaataatgcagccttcattaccaggaatccttttctcagcaaagtaaagctcatctactactatttatttgcttttatttatggacttgttggttcttgcagtgatgtagtcatggtcaattcttcttggacactaaaccatattctctcactatggaaagttgggaattgcactaacattgtttatccaccttgtgatgtgcagacatttctggacattcccttacatgagaaaaagatgaccccaggacatttgctggtttctgttggccagtttaggccggaaaagaatcatccattgcagatcagagcctttgctaaattgctgaataagaagatggttgagtcacctccttcgcttaaacttgtcctcattggaggttgtcgtaacaaagatgatgaacttagggtaaaccaactgagaaggctgtctgaggatttaggagttcaagaatatgtggaatttaaaataaacattccatttgatgaattaaagaattatttgtctgaagcaacaattggtctgcataccatgtggaacgagcattttgggattggagttgtggagtgtatggcagctggcacaattatccttgcacacaattcggggggcccaaagcttgacattgtggttcctcacgaaggagatataactggctttctggctgagagtgaagaagactatgctgaaactatcgctcacattctttccatgtctgcagaaaagagactccaaatcagaaaaagtgctcgtgcatctgtaagcagattctctgatcaggaatttgaagtgacattcctatcatctgtggaaaagttatttaagtaatgccatatctgtaaaattaaagatattttatataaactggttaaacaccttcatatgtaaatatttttctaaattcaatctcatttgtcaaatcattttactttagaaaacagacaaaatttccttttagaataaaaggaagtgttg

SEQ ID NO: 24796 - DNA, 581 bp, Homo sapiens
gtggtacttacgcatttatgcttctgtatgctgggttctgacccgcagatcctgacccagtgatggatgagagacatacactgacacagatattttgcctgtcagttaggctgaggggctgggccactcacagacactgaggaaggtgctgtaaagagttgtagctgcggtcccatcagccagcgaagctcacatttattcagtatagattaaatgacaaaggtcttgagtagacaccactagagggtaattgacattgcctacctcctgagtagagagcaattatgtggtcctaagaccaattaaaggttggtcttaggaccacatgagtaaacaagctgtttagataaactcctctgtgtctacgagctcagcttttaagagaattcagctgccttcagccaaacactttatgcaacccccaggcattccaagagggtttttgtttatttcctataattttacaatttctctcatcatcctgaccgagcccccacatctggatgaactagtcaagtttaaaaaaaaaaatcctaggggccagcacatgtatgaaaagatgttttcttttactcacagtt

SEQ ID NO: 24797 - DNA, 347 bp, Homo sapiens
aaggtttacctcattgcaagaatgaaagcctaggtcacttctcttttcactgtaccataccatctcctcttatgtatcttggccaggcatgttggcttatgcttgtaatcccagaactttaggaggctgaagcaggaggattgcttgagtccaggagtttgagaccttcctgggcaacatagggagacgctgtctctacaaaaaattaaaaattagccagctgtggtagtgcgcacctgttcctagccacttaggaggctgaggtgggaggattgcttaagcctgggaggtcaaggttgcagcctggatgacagagcaagactgtctcaaaaataaaaaagaaaaat

SEQ ID NO: 24798 - DNA, 367 bp, Homo sapiens
tttttttgagacagagtctcgctctgtcgtccaggctggagcgcagtggtgtgatctcactgcaacctccacctcctgggttcacgccattctcctgcctcagcttcccgagtagctgggactacaggtgcccaccatcacgcccagctaatttttgcattttcagtagggacggaatttcaccgttttagccaggatagtcttggtctcctgacttcaggatccacccacctcggcctcccaagtgctgggattacaggccaggcgtgagccaccacgcccggcctgcaataaagattcttatcatcagaattgatttggcctgcaataaagattcttatcatcggaattgattagcatgatttta

SEQ ID NO: 24799 - DNA, 829 bp, Homo sapiens
  misc_feature (616)..(616): n is a, c, g, or t
  misc_feature (618)..(618): n is a, c, g, or t
  misc_feature (632)..(632): n is a, c, g, or t
  misc_feature (637)..(637): n is a, c, g, or t
  misc_feature (647)..(647): n is a, c, g, or t
  misc_feature (655)..(655): n is a, c, g, or t
  misc_feature (661)..(662): n is a, c, g, or t
  misc_feature (664)..(665): n is a, c, g, or t
  misc_feature (682)..(682): n is a, c, g, or t
  misc_feature (685)..(685): n is a, c, g, or t
  misc_feature (687)..(688): n is a, c, g, or t
  misc_feature (691)..(691): n is a, c, g, or t
  misc_feature (696)..(696): n is a, c, g, or t
ggccgaataggaacagctccggtctacagctcccagcgtgagcgacgcagaagacgggtgatttctgcatttccatctgagaccagtgaccttttctatttcatagtaaacaaacttcatgagtacttgccggagtctagggataagaatgcactacaaaatcaaagccaaagggttgatgagctggtggcatgcattgaaattatacagaccctagtattgatgttcagagaaacagaaaccgagtcatcacgcctgaacacattggcagctaagaattacagaagcttattctggagtatacaaatactgctacagcacttttatatgagatacttctgtgtctttcagcagggaaatctcggattgggatccacaaagtttgctattagctggataatgtcctttctacaaagctgtcctcccatcattacttttgtggccagtattgtgacaacaagtggtgaggggtctttcagcttcatttcagctgctaagtccctgccaagcagttctgttgtaccagcaattttacatcctcaagagctgtctgcggcacagaaggactctagctgagtatattaggaataactacagagaagaattccaggtactntnatcacatgccagcntgcgnagaggtcccnttgtgttncccatnntnnacctacattcattttcntgnannctngaatnggtgaatagaaccaacatgtcgctgtttacggttactgttcccggtccctgtttccgggaacatttttttggaacctggtcctgggccaacgcatattggggccccacccctggaggaatacacaatttttcc

SEQ ID NO: 24800 - DNA, 953 bp, Homo sapiens
  misc_feature (740)..(740): n is a, c, g, or t
  misc_feature (742)..(742): n is a, c, g, or t
  misc_feature (756)..(756): n is a, c, g, or t
  misc_feature (761)..(761): n is a, c, g, or t
  misc_feature (771)..(771): n is a, c, g, or t
  misc_feature (779)..(779): n is a, c, g, or t
  misc_feature (785)..(786): n is a, c, g, or t
  misc_feature (788)..(789): n is a, c, g, or t
  misc_feature (806)..(806): n is a, c, g, or t
  misc_feature (809)..(809): n is a, c, g, or t
  misc_feature (811)..(812): n is a, c, g, or t
  misc_feature (815)..(815): n is a, c, g, or t
  misc_feature (820)..(820): n is a, c, g, or t
ggccgaataggaacagctccggtctacagctcccagcgtgagcgacgcagaagacgggtgatttctgcatttccatctgagaccagtgaccttttctatttcatagtaaacaaacttcatgagtacttgccggagtctagggataagaatgcactacaaaatcaaagccaaagggttgatgagctggtggcatgcattgaaattatacagaccctagtattgatgttcagagaaacagaaaccgagtcatcacgcctgaacacattggcagctaagaagggagcactatttaatctcttggtaattttaattagtgagcctcagattccaaaatcttgtcctgtgtttgatatccagttggtggctgattcagctttagtcagaatgtcttttgacgctgagttacagaagcttattctggagtatacaaatactgctacagcacttttatatgagatacttctgtgtctttcagcagggaaatctcggattgggatccacaaagtttgctattagctggataatgtcctttctacaaagctgtcctcccatcattacttttgtggccagtattgtgacaacaagtggtgaggggtctttcagcttcatttcagctgctaagtccctgccaagcagttctgttgtaccagcaattttacatcctcaagagctgtctgcggcacagaaggactctagctgagtatattaggaataactacagagaagaattccaggtactntnatcacatgccagcntgcgnagaggtcccnttgtgttncccatnntnnacctacattcattttcntgnannctngaatnggtgaatagaaccaacatgtcgctgtttacggttactgttcccggtccctgtttccgggaacatttttttggaacctggtcctgggccaacgcatattggggccccacccctggaggaatacacaatttttcc

SEQ ID NO: 24801 - DNA, 1079 bp, Homo sapiens
agcgtggtgttcctgcggcggcatctgccgcccgaggtctacgacgcggtccgcgcctacgagccatgcatcgtggtgtccaactctgagaaccacatcctcaagtatgtggtgctaagcgaccggctcgtctacctaaccgagaacccgcccaagtccatccggcgggtagtggctctgcgggacgtcgtggccattgacctgattgatgattacccggaatttttgagttcgccagatagagaaatcagccaacacattcgtatcatctattcttcaaccgttttgaaaaaagagtgtaaaaagtcaaacagtgtcaggaaattcctatttccatttcatcatactaaagctaacaacaagaaagtcaaggaagaaaagaacggccttgccttttggagaagcaaagagtccagaagtctgaaagaatctcctctcaggtctgaggagaaaattaagcacttcagtcaacttaaatctgaactttttcttaaagacaattctttgaggaggatactttctttacttatggaacttaaagtagcagcccagaaaaacttcattctgaaaaggcttttctggaagaccagtgaccttttctatttcatagtaaacaaacttcatgagtacttgccggagtctagggataagaatgcactacaaaatcaaagccaaagggttgatgagctggtggcatgcattgaaattatacagaccctagtattgatgttcagagaaacagaaaccgagtcatcacgcctgaacacattggcagctaagaagggagcactatttaatctcttggtaattttaattagtgagcctcagattccaaaatcttgtcctgtgtttgatatccagttggtggctgattcagctttagtcagaatgtcttttgacgctgagttacagaagcttattctggagtatacaaatactgctacagcacttttatatgagatacttctgtgtctttcagcagggaaatctcggattgggatccacaaagtttgctattagctggataatgtcctttctacaaagctgtcctcccatcgtaagtatctagaagtcaaaac

SEQ ID NO: 24802 - DNA, 575 bp, Homo sapiens
ggccgaataggaacagctccggtctacagctcccagcgtgagcgacgcagaagacgggtgatttctgcatttccatctgagaccagtgaccttttctatttcatagtaaacaaacttcatgagtacttgccggagtctagggataagaatgcactacaaaatcaaagccaaagggttgatgagctggtggcatgcattgaaattatacagaccctagtattgatgttcagagaaacagaaaccgagtcatcacgcctgaacacattggcagctaagaagggagcactatttaatctcttggtaattttaattagtgagcctcagattccaaaatcttgtcctgtgtttgatatccagttggtggctgattcagctttagtcagaatgtcttttgacgctgagttacagaagcttattctggagtatacaaatactgctacagcacttttatatgagatacttctgtgtctttcagcagggaaatctcggattgggatccacaaagtttgctattagctggataatgtcctttctacaaagctgtcctcccatcgtaagtatctagaagtcaaaac

SEQ ID NO: 24803 - DNA, 759 bp, Homo sapiens
ctcatcaatatttctgcacttaaaaagtcatggaacaattatattataaaagctactctgtggaagatcccttctatgctagtgagttcagtcctgctatggaagtcaaaagccatataggtctgaggagaaaattaagcacttcagtcaacttaaatctgaactttttcttaaagacaattctttgaggaggatactttctttacttatggaacttaaagtagcagcccagaaaaacttcattctgaaaaggcttttctggaagaccagtgaccttttctatttcatagtaaacaaacttcatgagtacttgccggagtctagggataagaatgcactacaaaatcaaagccaaagggttgatgagctggtggcatgcattgaaattatacagaccctagtattgatgttcagagaaacagaaaccgagtcatcacgcctgaacacattggcagctaagaagggagcactatttaatctcttggtaattttaattagtgagcctcagattccaaaatcttgtcctgtgtttgatatccagttggtggctgattcagctttagtcagaatgtcttttgacgctgagttacagaagcttattctggagtatacaaatactgctacagcacttttatatgagatacttctgtgtctttcagcagggaaatctcggattgggatccacaaagtttgctattagctggataatgtcctttctacaaagctgtcctcccatcgtaagtatctagaagtcaaaac

SEQ ID NO: 24804 - DNA, 437 bp, Homo sapiens
cctgaagtatatgttgcagacggccactggcacacttttctaattgggaaaaatggaacagcaacagtattgtctgttgacagaatatataacagagatattatccaccctactcaggacttcggtggccttgatgtgcttactatatcacttggaggaattccacccaatcaagcacatcgagatgcccaaacaggtaaatgcctttattaagtagagtcacaagggaagtaaaattgttcttcaaaaagtaattgctttttcttgtggcaagactacacatttaacatgaatctcatatacagaacaatttcattcaataaaatttatgtttaaaaaagtagtttgatgtctgataatatcaattataaatatcctaagaatgtcataactatcttcagaaagtttgtaataaactattagccaccaaaaaaaaa

SEQ ID NO: 24805 - DNA, 611 bp, Homo sapiens
tatttttagtagagatggggtttcaccgtgtaggccaggaaggtgaattatattttctaattgacacaaaagatgtgaaaataagtaacatacaatgataatggatgggaagctttcacgattggaaagatgtcaatgttccacaaaataagtgatacatttcatgtaatttccatccaaataccagtggaattttttttatgtgataaaagtagcctaagattaactttgaaaattaaatgaaaattgtgtaaaagaataatgagaaaagatttgctatgctgtatcattataaaaatattatgccaaggttcaacaactaaatctacagaatttgtacgaaaataaatccacagagaaaccaaaaacttgaacacagattctaatatagataagaatttcaaatatgataaagatgatgtttcaaatcagttaaataaatggagctgggacatttggattaacatctgattaaaaaaaagcttgattctcttacaacacatatcaaaataagttttaggtaacttcagaattacatataaactgaaaactttagaactaggaaataatacaaatatttacctaccttcagagtagaaaagacttattta

SEQ ID NO: 24806 - DNA, 367 bp, Homo sapiens
gggaggctgaggcaggggaatggtgtgaacccaggaggcagagcttgcagtgagctgagatcacgccactgcactccagcctgggcaacagagtgagactctgtttaaaaaaaaaaaatgtccaaagggcagggtggctaagtcattggacccctgtgctgttataaaagttgcagaggaggtcacacatgcactcatgagttagcagtctccagggccttgcaggagaaaacctgtctctaccaagcatggatttttgtcagccagaaggctgcggcaggagaattgcttgaacctgggaggcggaggttgcagtgagccgagatcgcgccattgcactccagcccaggcaacagagcgagactcc

SEQ ID NO: 24807 - DNA, 447 bp, Homo sapiens
tgaagtcaaatatttagaaaagcttgagaaattcatttgtagaaggaatctgaatgacaggttctgtgtaactttaaattcagcctttctgggtcctaggttaaatgctgaatggacttgaaaacagagagaagctgaggacatttaagaactaagtcagttcctttagctattaggggtgggtagagagctgggtggtgggttaaaagggctgatcaaggtccttaaatatccgatgttaagtaaaggtatcacagagagtaattttaggaaactaattcctctgctttgtttccctgtcagtgtgcttctgcagtttagcatttgatcaaacactttcttttcatctccattttaagttaacttaacaggcctgcctctaaaaattgacttggtctaatagaacaattgtgtgctgacagctgacctggatttagacagaaaggg

SEQ ID NO: 24808 - DNA, 751 bp, Homo sapiens
ctataggaatgcttggtatccttccaagaactcctcctttagaggagcctcacagaagttgctgggtaaacatgggctcaaaccaaggaaagtcaggtaacctgggtggaggttatcccaccaccaatggcaggggacagcttgcaagtatttgggcttatagtctcccagcccacagcctctctcccttgctagtgttagagagatgctgatcacgtttactcttctcttattttctctgcgtatccccttaccttaactttttgaccatgttcttgagcctagagttcagttagtctcatttctccaggagtcctggagacagtgtccttccacctaccatgtgtggagtttacctgccaccccaatggcaaagatagtaagcctgagcataattgattctcgatttcttttgaattaataactggtatatataaccattaattccaattataattcacatgaaaatgtcagagcttctattgagagcaaaagcaaactttagcattagcctggtaatattatattatggttttatattcatataatatggagtaaactgtcattacattaatgcaaccaaaattcctggagctgtccagaaacttggtagcaattgtaacataaacagttaattttccagttatttggaggcttggaaaattaacacaaactagtagtaatacctgaacagcaattggaaccatttttgtacaatatgggtgaattgtattcaaaatgccttttaatg

SEQ ID NO: 24809 - DNA, 674 bp, Homo sapiens
tagagatccaggctacggagcctccactatctgccctgtcctcaggaagagggaagggtgtgtagtgaatcaaggataggcttttaagatcttctgccttgaagtggccattttgaatcattggccaaagaaagtcacattgtggtgcctaatttcaaatggttgccgggaagtgcgaagtccttcctaagcacgccgtaaatcctttaatactaatttccgcttcatctctgagcatttgcacatgttgtttgctcttcctggaacatcctttcctttctctcctctgccttataaagtcctaattcaaaacacagttcacaggtcccctatgtcagtggtcaccaaactttttggcaccaggggccaatttcatggaagacaaattttccctggacaagggctgttgtgtgtgtggagtgggggtgggtttcaggatgaaactgctcctcctcagatcatcaggcattagattcttataaggagcgcacaacctagatcccttggatgcgaaggtcacaatagggtttgcactcctgtgagaatctactgccccctgctaatctgacaggaggaggagctcagatagtaatgcttacctctgctatgtggcccagttactaacacgccacagaccagtaccagtctgctgtccaggggttgggggtccctgc

SEQ ID NO: 24810 - DNA, 705 bp, Homo sapiens
cactgcactccagtctacgtgatagagtgagactctgtcttaaaagaagcctgggcgcggtggctcatgcctataatcccagcactttgggaggctgaggtgggtggatcacctgaggtcaggagttcgagaccagcctggccaacatggtgaaaccctgtctctactaaaaatacaaaaattagccaggcgtggtggccacgcgccttgtagtcccttctacttgggaggctgaggcaggagaattgctcaaacccaggaggtggagattgttgcagttacctgagactgtaccactgcactccagcctgggcgacagagtgagactccatctcaaaaaaagaaagaaaaaaatactgaaaataaagggataaaaatataccatgtaaattcgaaccaaaagaaagctgatataccaagtgtagtatcacaaagataggataagggggaaaagccactaatagagataaagagggatcctatctaataaacagttcatcaataagatataatagtcatgaacttgaatgcaccttacatagtcatgaaatgcataaactaataatgacaattacaaggagaaactgactttcacaaatatagtagcagattaaaattgacctttacagaatacaatcagaaaaaattattagtagagctatagacattttgaactatcaggttagttatttagttgtaattgac

SEQ ID NO: 24811 - DNA, 1194 bp, Homo sapiens
gttgccgctgcatcggattttaacagacatcctggaagttcggcagaagcccatcctgatgacctagctgcgtgcggagcctgcgcagagccccggccgggcccagccctcggagtgctgccaagtgcctacctgtccaccgccaccggggtctgcgatggcacgccagtgctggagccgcagccaggcgaggccactcgactcccggggccggggccgactccacgaacaccagcccaaactgaagtgcctcttccctcccctgctggcgctgctccgccctgtgccccccgcccatcgccccccacccatctctggagagccctctgcacccaaagaggactagagatgccgagcggccatgagagagagcggaaggagcagctgatgcccagagcggggccagagcggcgggtctatgttcacgtccccccagcagcaggcggaaccacccagccagggcactcagtgcattggactgtccacatgttcttgaggaaagccggtggaagattctggaatgccgtgcggatgaacttcagcgcccgagtcagtcccagctcatcctccccagtttaccactttgttctaataggagatgggaacacgagaagtttgatggctttgccctgggctgggaatacctcacccacgcccagttccagaaaggcctccagctgagcagacggccccgatcccgccagaacggccttttgcttccagccaaagaacaccgccaacacgcacacctccaacctgggacatcccacgctgggcctcgcacggaggaacctgcagaatttggattctgagggtagtcgggaggcctcggtagccaggcagaacaggatatctgccaaagggtgtctgatgtggggtggggctggcatcctcccaggaaggttctaggtgggaccccgtcttctgggggcgggggtgtcttttcatcttccctggtttcctagaactcacttcctttgacggcgtgtgttggtcccatctctcagaccagctcactgaggcagaggagttgctcagaggctcacatgggcacccccattggttcgtgtgagcagctgcccagccccaggcctgccctcggcctggtccagcatgaaggcgtttccatctgcaaggatgcacggtaccctccccgagagcaggcctgtcccctacccaactgggaataaactg

SEQ ID NO: 24812 - DNA, 662 bp, Homo sapiens
gaggacgacgagggggacgcgcgcgcccgggctcgcatcgcgctctacagcgtcttcccgcgtgaccaggtggaccgcgtgatggccgcgttcccggagctctcagacctcgccaggctcatcctcctggtacagagatgccagagcgcgggggcgcccctgggcaagccctaagggaccaacacgcacttgcagggaatggcccagcctcgccttgcgtcttggacgggtggacctgtggttgccagcctggacctgagtgggcccatcatggtgcccccttttctttaaagatggtcagggaagcctgcttcctcctcctgagcggggttgtgggggcctggtggcacttggtgatcctcactgaggccggggcctgctgcggggaggtccacccacttccgtggagggaatgattttccatgtgcacggagactgcgggtccaagctgcagtagaacccacaagtgggtcacaaaatcaatttagtgggtcaccaccacaaacacagtggactgggacagggcaaagcgcaccctgtgccatcaggctgagtctgaactcttgttacctatcctgtgtccccacccccttggcagccatgtaactaacctcaatgtgggtcgtagtcagaagtttaaaaaagactgtgaatgctcttga

SEQ ID NO: 24813 - DNA, 129 bp, Homo sapiens
agttcacttgcccaaggtcacacagcttatatgtggtggaaccagttcttgaatctaggtccagctggttctaaaacctttgccagctgttattttcaaaaagtgacacatatggccaaaatggccact

SEQ ID NO: 24814 - DNA, 348 bp, Homo sapiens
gaaaagagttgagtctaagactaagcaagcatcaccgtttcaggctactagagaactcttacgctttgcctactgccatttccatatttccctcttatcactgtgtggcatagtatagacagtgtattctgtattctggtaggagacaagcctatgcatgagtggagtactaaaatggtctgaagagctttcaaaaagttttcaaactacacagtccctaatctccatatccattatggatggatggtttagaagactatccatctgttttcagttgattttgaatatctgagagcaatctgaagaaaaagtttaaataaggctcatgtttcaaccataggaaaaaaa

SEQ ID NO: 24815 - DNA, 192 bp, Homo sapiens
accaccaccaccaccaagtgtaattcaattatgaaaactggcagaaactacatacatccatggtacaagatgctcacaagcccagttttaatcaataactcctcagcaacctgcatttaccttgtctaaaacaactgaaaccttctgtagctcaaaaaaccaagtatgtctcaaacaaccacagaaaaatgg

SEQ ID NO: 24816 - DNA, 427 bp, Homo sapiens
ggaaaaaataaatccccataagtgtccaagatgcccatagagagcagagctgttctggtttaaacccctgctcttagcactgtgtttttccagctgtgggtggtgggggatgagtatctttttatttccatgagatgagaaaaatgaattactagaagtgtgaaatacaaaacacagctgctcttttttttagccatagactcagcagccataaaattgctgtatccagttgcagaaattcctgctgcttactcttgaccctctctcggtttgtgtgcatctcctctcaggctggctcccagatgggagcttggctccaggcgacactgggtgctctgctccagggagggtccttatgtggggtcctgccctagcctagcccctctctttatgggactctgttcactgtgggtttatgattcactct

SEQ ID NO: 24817 - DNA, 512 bp, Homo sapiens
catgaagacaaagtgctttttgttgtctattcatgaaactgtagaagaatattttgagtttttattcttatattatgaagggattctttgcctagcagtggccgtcaaactgatgtagcattgtacttctcaacagtgaagcctgtgtaataccatacagtaggatgaaagactattctgagcaaaataaaatgggatgtcagaatctttgaaaattattttatcattttttctattttttcatttttataaattagaaggattttccattcaataaggataatctctcttcctatcattctgtcaaaatggcagtttcttttggtaattatccaacctagtttcattacatttagaaggaggtttcagagcttattcttgataactataataatgatttgaatgttttatatcatgaagttttttctatgaggaaggctattctcaatgtatctgtcgtctaattttttattttctatctataaagaatatttaaataataaaaagtgtat

SEQ ID NO: 24818 - DNA, 346 bp, Homo sapiens
atcagaacatttggtcatttcgcctgtgagtctgtactgattcatgcactccctgatcctcagtcattgctgagcatccgaagattctgagagactgcaggtctataaacaatgggacagggagccaaggcatggccagagtgttacaaaccctggctttctgtgtgataagccactcaccttgaggacgtttttggaatatgcattaacctttcagacctttcgggatagcataaaaaggtacgaaggaaaaacataattgaagccatagatgaatcataggaactcaaaaaccattcttcattggaaagtgttgcagtgaattggtgagcgtttctagtgattc

SEQ ID NO: 24819 - DNA, 382 bp, Homo sapiens
agttcaacaccagcctggccaatatggcgaaaccccgcctctactaaatacacaaagattagctgggcatggtggcgcacgcctgtaatcctagcacactcaggaggctgaggcatgagaaaagcttgaacccaggaagcagaggttgcagtgcgccaacgtcgcgcactgcactccagcctgggcgacagagtgaggtgagagtctgtcgcaaaaaaaacacaaaacaaaacaaaaagatgcagtattaatatatagtctccaacttagataaccattacatttcagaaggtctcataaaatcttgcctaagagcaccatgagatataatttctacgactcttctaccagcactaacagtcttactgttttttatattgtg

SEQ ID NO: 24820 - DNA, 452 bp, Homo sapiens
tagagctcactgataaaatatgggaaataggtcaagacgggatggtcaagttacactggcatattcctaaatctcctgaagccagcattactagataatagatgatgggactgggttgattgtgattttaacgaagtagagattggagaggcctcggtggtgaatccccttagaatggccatccagtggcaaacagaatgaagccagcagccacatccaggtaagaagcaatatgttgggaaagattctgttttttgagacggagtctagctctgtcacctagactggagtgcagttggcgctgtctcagttcagtgcaacctctgcctcccgggttctagcgattctcctgcctcacccttccaagtacctgggactacaggcacgtgtcaccacaatcggctgatttttgtatttttagtattttgtgtttttaaacctctttacttgaa

SEQ ID NO: 24821 - DNA, 484 bp, Homo sapiens
attttaaataggatactatgtataaaactgcttagcacagtgctccatcaatgttagtttggttaatctggttaaagcaaagttgggtaggggggcattctagcagctgtacatgcctagtccctaccttatcccatgtggtggctcctgagatagcttcctagaacccttctatagatgcagtttgaaaatctctaatcttggctaggtgcgatggctcaatctgtaatctcagcactttgggaggctgaggcaggcagatcatttgaggtcaggagttcaaggccagcctggccaacatggtgaaaccccactctctactaaaaatacaaaaattagctgggcgtggtaatgcatgcctgtaatcccagctacctggcaggctgaggcaggagaattgcttgaaccctggaggcggtggttgcagtgagtcaagagcacgccactgcactctggcctgggcaacagagcaagactctctctc

SEQ ID NO: 24822 - DNA, 349 bp, Homo sapiens
tacaaatagttctaatttattttgatttattggtttaaaaattacaaaaataataaactgctgttaacatggagagaaagtgaaaaataaagaaatacatcaccaataccagcaatctgaaagaatcacttttatcattttgctgaatttcctatcaaatgtttcatatatttgttttacaaaaattttatatcttgcctttttcatataacatatcataaataatttctactcctagaaatttcatatttttaaataactaagctttgtaaattacaattattttttctgataaaaataatatatactcactgaaaaaaactgaaaaatagagacaaacaggaaaaaa

SEQ ID NO: 24823 - DNA, 1868 bp, Homo sapiens
ttattcaataaataatcctcatataatgcacagtattgccacaaatgcccacttcatttgtctgcatagacatattaagaatttttcaatgatgtaatttaattatcctaaaagaaatgacagattcttctgtaggaaaaaataaaaacatgaatatctcaaattataatggttaatctctaaaatatgcttaaagtaagatgtttctatgttatgtggttatgttatcaataatatttggttgatcttcacatattttatatgcatatatatatcaagaagttatatatatataactcaagaaactcaagttatatatatatgtcaagaaatgtatgattattttggagagaatgggcccaaatgtgaaaaagatataaaaaaaacaaaaaaaacaaaaaaaaaacactattttcccctacgaaatatactgtatatttcaaaagaagaaaagttaaaagatatttgaagattgcaggggcaaaacaaaaacctaccagggctcagcacttaagcacttttcccacatccagggtcaaagcagcagtaactacatggacttttaagtgcggtatgaaatgcaacattacgcttacaaacagtactgtcaaacctcaaatgctttctttcttcagatgctttttcgtgtacatgatactagtagacacttttctctttatatttactgatagtgaaaatcatacgcaataaaatattgatgtttgaaggcagtggtcaccaattggttaaaaaactatgaaatgtaaactgaattgttatatctctatcctttttgcttttctctgtgtttttaatgtatggaataaatctcataaatagaaagaaaaataatctagaaatttttcaaagctagtactctttctccttataaatgtacacaattttaatctttttacaaatttatttaactgtacctactgtacttattgtagattcaatgacgcagttaagtcatcacccaaggatttatgaatttgagattactgacctgttttcttcatattgcattcacatcaatatttgtgaatttgttgttcagcttttcattcaaacaaaaaatattccctcaagaaagctccatttttatcataaacatttcaacataaccaacattagaacaagtctgccatgttaaaaataatttaaagacttatctctgaaaacggtatccagaaacgcaggtgttcccagtaatgtagcttcaaaaataaaatgtgctatttatatgacatgaaattcataacttttggaagggtatatttatgacagcataaaaaataaattctgtgctataaagaagatccaacaaattaaccatataagcacagaaagtagagaaacacagttattgaatctactcttgtcattaacattttcaaaaaacaaaatgcatattgtaatatttggtacatgacacttgcatgttgatatgcctatatacttacaaagtattcaatgtgtacttagcggcgcttaaaatatgtcatgtacaactcttataaacatttttacagggttcccatttgcacttcatctttcagtaaagtcttgtcagaaaaaaattgtctgataaatatggaaaaataaaatttgaattttagttatctgttggacattactgaattgtctattcatttagtacattttcttaaccttgaaaacagacattgaaagatggaactttcttttttccagtgacaggtccattaaatcgatggtacaaaacatacttctttatgccaaacacattattttgaatacctttttttcaacttcatacattatccatccattttagttttcctcgatgatgcccattttctttgtaaatttctaagtggaagttt

SEQ ID NO: 24824 - DNA, 455 bp, Homo sapiens
caaagaacagacctcatatggggcccactctcaagcactggttctatctcccactcttccatctttcctctaaaggacaccatggatcctccaaggcaggtgcacccatccactcaccatgtacacaaccacagtcaccacagagcaggataatactaacagtaatagcagagttacagtaattgagtgcatactatgtgccaggtacaatgcaaagtatcttgtgtatattgtctcatttaatcttcataatgacccagtgttaatagttttgcacaactattaacctcactttatttacaaggaaactggggttcagaaaggttaagtcacttttcgagattgcacagctcataagtggagtggctggtactcaaagcccttacagactgccccagaaccctacttcttaatcattctattatgctcataataaaaatttactgaggactcta

SEQ ID NO: 24825 - DNA, 375 bp, Homo sapiens
gggcttataccatgaaataataaagtctgtataatgtactcttaattatgagttcatttctatgactttttatttctctctcacttcttattttatataaggtgattaattatagattgacaatgaaagaaacacagacttacatacccacggattaaagaaatcagtcattacatttaatggtgagcctaacaatgagagatgtgcttcccttacggtgtttctcgttcagggttagtgttaactagaatcctgagggaaatttggcaaggagaatactattgaattaaaacttcgctgagtcttagtccattgagcttaggagcaagaaagaaaaccacattggtcagtgtggagaggtgttaataaaagcat

SEQ ID NO: 24826 - DNA, 439 bp, Homo sapiens
gagctttacctcctcacacctggctttttatagtgctcttctcgatcatgtatagtgagtgctcaccctgaaaatctcatttttccatcttgttacttttccagtgatctcctggggactttatagattggctaccaggaaaccgagtggttggcttaccccctaattcatctctggctgagagttttctaaaagatattttaaattaggccgggtgtggtggctcacgcctgtaatcccagcactttgggaggccgaggcaagtggatcacctgaggtcaggagttcgaaaccagcctggccaacatggtgaaaccccgtctctacgaaaaatataaaaattagccaggcgtggtggcacgtgcctgtaatcccagctactcaggaggctgaagcaggagaatcacttgaaccctggaggtggaggttccagtgagcc

SEQ ID NO: 24827 - DNA, 1024 bp, Homo sapiens
tttttataccacgacttcattagtcatatccctgtcagacctgtgaccagtgtcaaatgttttcaaaaagcacaccaggacaggcatggaactcatcagcctgtgtcaaaggtcgctctcattaaggagtcaaaatgaaaactttcagtgtctctaacacatcgcatagctctccctggtactcccacccccagtcctgaaatccagggccagctaagcacctccagctccccagacattcaaataagatcaagatgacagggcaagaaaatgaatagagttcttacccggctggacctcataatctggtactgattgaaacaaccagaaagctgtttgccaggtcttatagcaccatttcctgaggttaaacataacatctcaaaatgaagcaattaggggtttctccaaaacaagagtcttcagtaattaaaaaagaaaaaaaaaggcagaaagcaagaaagaagaaaataaagactatcatggtaggagctgattaggcccattaggtagggtttgatggtggaggaactgcttttttttgccacctgggaggtcaacttttgattatggaagcagtaggtaaagaagaacttatcgataatagtgctataaagatggacattaaggaatctgaagatcagagataagaagaaaaccatctttcccaggactcatttggacaatatggaatatcagagattcggtgctccttttcttgtttcattttgttttgaatcattactgcttttctgaagacctgttcactatgtgagcatagcctctgtgttatgatgctataagggatttccaaagaggtctgagtgatggtttcttattttccttcagaatcttcttcaagccacattctggtgttggtgttggtgttggatttgggttcctaggagacttgaaacatggattacatcctgtcaccacaatatttggctggttacagtggctttaagattgatgaacagatatttccagtatcacgtggggtaaatgtcaaggaagcctctag

SEQ ID NO: 24828 - DNA, 476 bp, Homo sapiens
gacctcaggtgatccacctgcctcggcctcccaaagtgctgggattacagggttgagccaccacgcctggccaaccatctgttttttaagccactcagtctgtggtctgtgaagacagccccggcagactcatccatccagcttcaagtgctgcagtgctcctagcacaatcgatcgctgtccctgacaacaaagacctccctggtcaactctgtgtctgtgtcccatcccatccacttgctcatgtcctgtagtccaagccctactttggacctccactggggctgttgcaaaagtaaaggcagccagcaatgaagagcctgttggaacacgagttttaaaaattcccttggctgggcgcagtggctcacgtctgtaatcccagcactttgggaggccgaggcgggcggatcacaaggccaggagtttgagaccagcctggccaatatggtgaaaccccgtctctactaaaaata

SEQ ID NO: 24829 - DNA, 454 bp, Homo sapiens
gctacagcggcagagctgatccgttgtgagagagatcacgtggcctgctaaactgaaaatcttaactgtctgaccctttactgtaaaagtttgccaaccactgttctaagaaggcctgtgataaggatggatttttaaaagcagtacatagaaatgctaccaaatgtgaacatgcacacacgcatacctccagccaaacttcagccatctggagcgttttggaggctttgggagcctcatttctggagagttaagctttacttttaaggaatttttctaaactctatcacccatttattttcctgccttctcaaatagagtacgctgaatgtgtgtgaagccttccttgaagaatccagccatcatttcaagcactaggttttagattcgtgctaaaagcactgatggttgcgcacgggcatccaaaatgctgtagctcttcactcagtgaccc

SEQ ID NO: 24830 - DNA, 350 bp, Homo sapiens
aacagggatgcaaaggaactgggtctttctaatattgctgatgggaatgtaaaatggtacaaccattctagaaaacagtttaggagtttcttctaaaattaaacatgcagtcaccatacagcccagcaattgtactcttgatatttatcccagaaaattgatgtttatgttcacccaaaaaccttgacatgaatgcagtagctagaaacaagaaacagctcaagtatccatcaatgagtgactgttaaacaaactgttatatactcataccactaaatactacacaacaatttaaaggaatgaactactgatactcaatattcacaactccaatggatgtcaagagcacc

SEQ ID NO: 24831 - DNA, 317 bp, Homo sapiens
ggactatgttaggagatatttagtagttcaacatatgaaaaatttgatagcgctgtagaagataatacaaaagccatgtttcgtaagagatttctccagtgccttgtttttgttttagggatagacaaggaaaatgaatggtttttgttttagggatagacaaggaaactgaatggtttcagattaaaagctcccttgaatttccttgagtagctttttcccaccttacagctgtttttttcatcttttaagatactgacttcagatgtcctgggtatgattctgtttttgcctgtgacttttcataatccttttag

SEQ ID NO: 24832 - DNA, 372 bp, Homo sapiens
acaagtagtcagcacattgcaggcaaaaggagccatcctacatagatatggggacaggtgaggcctagctgtcaccttcaggactgtaaagtaggccaggcgcggtggctcatgactgtaatcccagcactttgggaggccgaggcaggtggatcacttgaggtcagaaggtcaagaccagcctgaacaacatggtgaaaccccgtctctactaaaaatacaaaagaatttagttgggcgtggtggtccacgcctgtaatcccagctacctgggaggcttgaagaagaatcgtttgaacccgggaggcggaggttacagtgagctgagattgcgccattgcactccagcctgggcaacaagagtgaaactca

SEQ ID NO: 24833 - DNA, 588 bp, Homo sapiens
aatcataatttaatatatagatcactgacctttccccagattatgttttcctttttttgagggggaagctggatataaactggcagttaaaaaaattgtaaagaaatcaacttgctcattttcattgtgtatttttgctctcaagcattttgcatgaactgtgtgtggattcattgcctacattggatgatgaagacttgagtgttgctactaaggtaaagtggtctcttgtaaaattaatcttctcactctgagtgtagttttgcatagtatttacttttcaaatttagcagtggtttacctatcattgttttatggtggtaatggaaagctggtcagagaaaaacatacacatggctagttgattcaaaaaatgtgtttaactttggtaactaataaagattggtaagtactgtgacagggtgggagctgaaaaataaatgaactggaaaacaagtagtcacaggaaaatcacattaggaaatgctttctccaatagaggaaatatgaaatttggttaaagtttatttggataaatactactactttgacttttaaatcatacgagtgtgactttcttaatattta

SEQ ID NO: 24834 - DNA, 986 bp, Homo sapiens
  misc_feature (4)..(4): n is a, c, g, or t
  misc_feature (10)..(11): n is a, c, g, or t
gggngccggnnccgcgccgggccggctccagggcggccgcggcggtggggcgcaggccgccgcgcgagtgaatcgaggcggcgggcccatccggaaccggccggccatcgcccgcggcgcggccggcggaggcggcaggaaccgaccggcgccctacagcaggccaaaacaacttcccgacaagtggcagcacgatcttttcgacagtggcttcggcggtggtgccggcgtggagacaggtgggaaactgctggtgtccaatctggattttggagtctcagacgccgatattcaggaactctttgctgaatttggaacgctgaagaaggcggctgtgcactatgatcgctctggtcgcagcttaggaacagcagacgtgcactttgagcggaaggcagatgccctgaaggccatgaagcagtacaacggcgtccctctggatggccgccccatgaacattcagcttgtcacgtcacagattgacgcacagcggaggcctgcacagagcgtaaacagaggtggcatgactagaaaccgtggcgctggaggttttggtggtggtggaggcacccggagaggcacccgcggaggcgcccgtggaagaggcagaggtgccggcaggaattcaaagcagcagctttcggcagaggagctggatgcccagctggacgcctataatgcgagaatggacaccagttaaacagaccagcaaatccgcgtgcggaacaggacccaggcgtctcctcttgctccctggttggggggcggtggctggggctgtgcggccaatgatggatttgtttcttttatgttttaaaataggatttaaaaactcatgtaaaggttttttttttttctttttttttttttttaattctgaaacagacctgttttgtaccgagttatttttgggataaattttactggttgctgttgtggagaaggtggcgtttccaccttttccataataaaatagaaatgtgtgt

SEQ ID NO: 24835 - DNA, 1509 bp, Homo sapiens
  misc_feature (4)..(4): n is a, c, g, or t
  misc_feature (10)..(11): n is a, c, g, or t
gggngccggnnccgcgccgggccggctccagggcggccgcggcggtggggcgcaggccgccgcgcgagtgaatcgaggcggcgggcccatccggaaccggccggccatcgcccgcggcgcggccggcggaggcggcaggaaccgaccggcgccctacagcaggccaaaacaacttcccgacaagtggcagcacgatcttttcgacagtggcttcggcggtggtgccggcgtggagacaggtgggaaactgctggtgtccaatctggattttggagtctcagacgccgatattcaggaactctttgctgaatttggaacgctgaagaaggcggctgtgcactatgatcgctctggtcgcagcttaggaacagcagacgtgcactttgagcggaaggcagatgccctgaaggccatgaagcagtacaacggcgtccctctggatggccgccccatgaacattcagcttgtcacgtcacagattgacgcacagcggaggcctgcacagagcgtaaacagaggtggcatgactagaaaccgtggcgctggaggttttggtggtggtggaggcacccggagaggcacccgcggaggcgcccgtggaagaggcagaggtgccggcaggaattcaaagcagcagctttcggcagaggagctggatgcccagctggacgcctataatgcgagaatggacaccagttaaacagaccagcaaatccgcgtgcggaacaggacccaggcgtctcctcttgctccctggttggggggcggtggctggggctgtgcggccaatgatggatttgtttcttttatgttttaaaataggatttaaaaactcatgtaaaggttttttttttttctttttttttttttttaattctgaaacagacctgttttgtaccgagttatttttgggataaattttactggttgctgttgtggagaaggtggcgtttccaccttttccataataaaatagaaatgtgtgtgaaaaaaaaaaaaaaaaaaaacaaaaaaaaaaaaaaaagacaaaaaagagaatagaaacaaaaagaaaaaagagagaggagaaaaagagaacaacacagagagcgaaaaagagaaaaagcagagcaagacgaagaagagagcccaaagacaggagagaaggagaagacagacagagagagaagagaaaaaaaagaggaaggagagaagaacgaaaggagaacggagaggacgacacagagagaggagcgcacggagaacacaaccgaagaaagagaggcacgagggaaaacagacgaaagggaacagcggcggcaagcaagaaaggagacgaggaaaaaaagaaagacggagacagagccaaaaacacatctgagggagggacagaagagaaggggagggagagcaggagacgagaggagaggaaaaaaacacgcaagagcagcagccagcagggcaggaagaaggagaccgagaggacggaacgcagcgagacgccaggccagccgaggcacgacaccagct

SEQ ID NO: 24836 - DNA, 1055 bp, Homo sapiens
gcggtggctggggctgtgcggcaatgatggattagttgcctttggtggaccccaggacttcggcccactccggggcctcccctccctgctaggaggcaactcgtcacacccaagctgctggcctccagtcccatccgtcccccaacacatgtgacccgccaagaaagtgagccaggcacctctgtttcctgcatgtttattgacaaccagcaccggcgccctacaagcaggcccaaaacaacttcccgacaagtggcagcacgatcttttcgacagtggcttcggcggtggtgccggcgtggagacaggtgggaaactgctggtgtccaatctggattttggagtctcagacgccgatattcaggaactctttgctgaatttggaacgctgaagaaggcggctgtgcactatgatcgctctggtcgcagcttaggaacagcagacgtgcactttgagcggaaggcagatgccctgaaggccatgaagcagtacaacggcgtccctctggatggccgccccatgaacattcagcttgtcacgtcacagattgacgcacagcggaggcctgcacagagcgtaaacagaggtggcatgactagaaaccgtggcgctggaggttttggtggtggtggaggcacccggagaggcacccgcggaggcgcccgtggaagaggcagaggtgccggcaggaattcaaagcagcagctttcggcagaggagctggatgcccagctggacgcctataatgcgagaatggacaccagttaaacagaccagcaaatccgcgtgcggaacaggacccaggcgtctcctcttgctccctggttggggggcggtggctggggctgtgcggccaatgatggatttgtttcttttatgttttaaaataggatttaaaaactcatgtaaaggttttttttttttctttttttttttttttaattctgaaacagacctgttttgtaccgagttatttttgggataaattttactggttgctgttgtggagaaggtggcgtttccaccttttccataataaaatagaaatgtgtgt

SEQ ID NO: 24837 - DNA, 728 bp, Homo sapiens
ttccatctgcatcaatctgtttccatcggtgcttcaggaactctttgctgaatttggaacgctgaagaaggcggctgtgcactatgatcgctctggtcgcagcttaggaacagcagacgtgcactttgagcggaaggcagatgccctgaaggccatgaagcagtacaacggcgtccctctggatggccgccccatgaacattcagcttgtcacgtcacagattgacgcacagcggaggcctgcacagagcgtaaacagaggtggcatgactagaaaccgtggcgctggaggttttggtggtggtggaggcacccggagaggcacccgcggaggcgcccgtggaagaggcagaggtgccggcaggaattcaaagcagcagctttcggcagaggagctggatgcccagctggacgcctataatgcgagaatggacaccagttaaacagaccagcaaatccgcgtgcggaacaggacccaggcgtctcctcttgctccctggttggggggcggtggctggggctgtgcggccaatgatggatttgtttcttttatgttttaaaataggatttaaaaactcatgtaaaggttttttttttttctttttttttttttttaattctgaaacagacctgttttgtaccgagttatttttgggataaattttactggttgctgttgtggagaaggtggcgtttccaccttttccataataaaatagaaatgtgtgt

SEQ ID NO: 24838 - DNA, 922 bp, Homo sapiens
  misc_feature (4)..(4): n is a, c, g, or t
  misc_feature (10)..(11): n is a, c, g, or t
gggngccggnnccgcgccgggccggctccagggcggccgcggcggtggggcgcaggccgccgcgcgagtgaatcgaggcggcgggcccatccggaaccggccggccatcgcccgcggcgcggccggcggaggcggcaggaaccgaccggcgccctacagcaggccaaaacaacttcccgacaagtggcagcacgatcttttcgacagtggcttcggcggtggtgccggcgtggagacaggtgggaaactgctggtgtccaatctggattttggagtctcagacgccgatattcaggaactctttgctgaatttggaacgctgaagaaggcggctgtgcactatgatcgctctggtcgcagcttaggaacagcagacgtgcactttgagcggaaggcagatgccctgaaggccatgaagcagtacaacggcgtccctctggatgcgtaaacagaggtggcatgactagaaaccgtggcgctggaggttttggtggtggtggaggcacccggagaggcacccgcggaggcgcccgtggaagaggcagaggtgccggcaggaattcaaagcagcagctttcggcagaggagctggatgcccagctggacgcctataatgcgagaatggacaccagttaaacagaccagcaaatccgcgtgcggaacaggacccaggcgtctcctcttgctccctggttggggggcggtggctggggctgtgcggccaatgatggatttgtttcttttatgttttaaaataggatttaaaaactcatgtaaaggttttttttttttctttttttttttttttaattctgaaacagacctgttttgtaccgagttatttttgggataaattttactggttgctgttgtggagaaggtggcgtttccaccttttccataataaaatagaaatgtgtgt

SEQ ID NO: 24839 - DNA, 716 bp, Homo sapiens
gcggccgcggtgggaccgtgcggcctcgggctggggcagctgcagcgccggagggagcgctggcggccccgtttcggccggatcctctcaggccgggaagaggaagggtccggagtagccgtgagggtcaggaaagccctggactgagactcacagatctgctcttgttgcggtttttttttcagccaaaacaacttcccgacaagtggcagcacgatcttttcgacagtggcttcggcggtggtgccggcgtggagacaggtgggaaactgctggtgtccaatctggattttggagtctcagacgccgatattcaggtaagagacgagggcttctcggtgagccgttcgccctgcacaggacggatcgtgattttggggatgtggccctgagtccccttcccgccttagcgaagggagccctcccagctctgaagggctgcaggacagacccagtgctagtaaagccggggtcagtgcgcaggcaggtgcgagcctagctgagcctgaggaactgctgctgttagtctgaagatgggttctgtgagtgaaaatcccctgccagggcttccagtttctaacagggacaaagactgaccaaatgtgagtggtttttggctgttagacccagcccagttgctttttaaattttgtgcctgtcttagtgggttaatgtgagaaaaagaatcttctttatgtatcttgtgaagcacaggg

SEQ ID NO: 24840 - DNA, 954 bp, Homo sapiens
  misc_feature (4)..(4): n is a, c, g, or t
  misc_feature (10)..(11): n is a, c, g, or t
gggngccggnnccgcgccgggccggctccagggcggccgcggcggtggggcgcaggccgccgcgcgagtgaatcgaggcggcgggcccatccggaaccggccggccatcgcccgcggcgcggccggcggaggcggcaggaaccgaccggcgccctacagcaggccaaaacaacttcccgacaagtggcagcacgatcttttcgacagtggcttcggcggtggtgccggcgtggagacaggtgggaaactgctggtgtccaatctggattttggagtctcagacgccgatattcaggaactctttgctgaatttggaacgctgaagaaggcggctgtgcactatgatcgctctggtcgcagcttaggaacagcagacgtgcactttgagcggaaggcagatgccctgaaggccatgaagcagtacaacggcgtccctctggatggccgccccatgaacattcagcttgtcacgtcacagattgacgcacagcggaggcctgcacagagcgtaaacagaggtggcatgactagaaaccgtggcgctggaggttttggtggtggtggaggcacccggagaggcacccgcggaggcgcccgtggaagaggcagaggtgccggcaggaattcaaagcagcagctttcggcagaggagctggatgcccagctggacgcctataatgcgagaatggacaccagttaaacagaccagcaaatccgcgtgcggaacaggacccaggcgtctcctcttgctccctggttggggggcggtggctggggctgtgcggccaatgatggatttgtttcttttatgttttaaaataggatttaaaaactcatgtaaaggttttttttttttcttttttttttttttttttttttttttttttttttttttttttttttttttattatttttattttttaaccttaatcagggggacccccaaaaaacaa

SEQ ID NO: 24841 - DNA, 1194 bp, Homo sapiens
gcggccgcggtgggaccgtgcggcctcgggctggggcagctgcagcgccggagggagcgctggcggccccgtttcggccggatcctctcaggccgggaagaggaagggtccggagtagccgtgagggtcaggaaagccctggactgagactcacagatctgctcttgttgcggtttttttttcagccaaaacaacttcccgacaagtggcagcacgatcttttcgacagtggcttcggcggtggtgccggcgtggagacaggtgggaaactgctggtgtccaatctggattttggagtctcagacgccgatattcaggtggtttctagcatccactggaaaccgcttttggtgaactccagttcccgctgtgtgcctgcggccggagtatccccacactctgggttccctctccaactcccagcctgcctgaggtcagggcagtttccatgacagcgcttgacttcagactttgcgcaggcttgagtaggaggagagggaaaggaactctttgctgaatttggaacgctgaagaaggcggctgtgcactatgatcgctctggtcgcagcttaggaacagcagacgtgcactttgagcggaaggcagatgccctgaaggccatgaagcagtacaacggcgtccctctggatggccgccccatgaacattcagcttgtcacgtcacagattgacgcacagcggaggcctgcacagagcgtaaacagaggtggcatgactagaaaccgtggcgctggaggttttggtggtggtggaggcacccggagaggcacccgcggaggcgcccgtggaagaggcagaggtgccggcaggaattcaaagcagcagctttcggcagaggagctggatgcccagctggacgcctataatgcgagaatggacaccagttaaacagaccagcaaatccgcgtgcggaacaggacccaggcgtctcctcttgctccctggttggggggcggtggctggggctgtgcggccaatgatggatttgtttcttttatgttttaaaataggatttaaaaactcatgtaaaggttttttttttttctttttttttttttttaattctgaaacagacctgttttgtaccgagttatttttgggataaattttactggttgctgttgtggagaaggtggcgtttccaccttttccataataaaatagaaatgtgtgt

SEQ ID NO: 24842 - DNA, 1100 bp, Homo sapiens
  misc_feature (4)..(4): n is a, c, g, or t
  misc_feature (10)..(11): n is a, c, g, or t
gggngccggnnccgcgccgggccggctccagggcggccgcggcggtggggcgcaggccgccgcgcgagtgaatcgaggcggcgggcccatccggaaccggccggccatcgcccgcggcgcggccggcggaggcggcaggaaccgaccggcgccctacagcaggccaaaacaacttcccgacaagtggcagcacgatcttttcgacagtggcttcggcggtggtgccggcgtggagacaggtgggaaactgctggtgtccaatctggattttggagtctcagacgccgatattcaggaactctttgctgaatttggaacgctgaagaaggcggctgtgcactatgatcgctctggtcgcagcttaggaacagcagacgtgcactttgagcggaaggcagatgccctgaaggccatgaagcagtacaacggcgtccctctggatgcaagctacatccctcccctccttcagctccttccggaagattcacttctgtgaagccttctcagaaccgccatagtacacctctgagtgcggggctgtagtcgtaaagacaaaggccgccccatgaacattcagcttgtcacgtcacagattgacgcacagcggaggcctgcacagagcgtaaacagaggtggcatgactagaaaccgtggcgctggaggttttggtggtggtggaggcacccggagaggcacccgcggaggcgcccgtggaagaggcagaggtgccggcaggaattcaaagcagcagctttcggcagaggagctggatgcccagctggacgcctataatgcgagaatggacaccagttaaacagaccagcaaatccgcgtgcggaacaggacccaggcgtctcctcttgctccctggttggggggcggtggctggggctgtgcggccaatgatggatttgtttcttttatgttttaaaataggatttaaaaactcatgtaaaggttttttttttttctttttttttttttttaattctgaaacagacctgttttgtaccgagttatttttgggataaattttactggttgctgttgtggagaaggtggcgtttccaccttttccataataaaatagaaatgtgtgt

SEQ ID NO: 24843 - DNA, 500 bp, Homo sapiens
tcataattaagcaattcagcatgagatggatttatagatggactatcttagatttggtgttctctagcaggcagacttagtttcagtctggtggaaacactggatggtttcagcccagtatctgtttgcttttactccctaaacccacaactggactttgaggaggaggtgggaaggatgtcatgggaggtcacttcaggtagagtcagttcctgtgatactgactggcagctcccaggtcatgagcaaatggcaaccttggtagtatgcctccactgctgtccaggccttcagttccacttcttgtcttggaattcatgacacttgaaagagaagaagtcatctcataaagtgctgcatagtatttccagagagctgcatggctgtgaaaacataattggagttctaaaagctggcacagtcttttataacaacaggtaaatgcagtgaccagtttatttgtggcttttggtttcccactgcctgaaagcaaaaaaaaa

SEQ ID NO: 24844 - DNA, 370 bp, Homo sapiens
ggccacagtaggagaattgcttgaggccaggagttcaagaccaccttggccaacgtagtgagaccctatctgtgtaaaaacaataaataggccaggtgcagtggctcacacctgtaatcccagcacttcagaaacagaggtgggcagattgcttgagcccagaagctcaagaccagtctgggcaatatggcaaaaccccaactcgaggaaaaaaaaaaaaaattaactgggcatagggtcacgtgcctgtagtcccagctactggggtgggaggattgcttgaacccgagaggtcaaggctacagtgaggtgtgattgcaccactgcatttcagcctggtggtgacagagcgagaccccgtctcaaaaaa

SEQ ID NO: 24845 - DNA, 773 bp, Homo sapiens
ttttagaagtttcaatagcacaactctagtgaatctttagaactgacacaccagagacactggggaagtgacttttatctttctgaaaacgaggactctcaagtcagttaacagagaatgatttggaaggttatgtatcaaattgtttttcttgtgcaggaatatattgggagtttaattttcattgtaattggtatcatgtttttgttaccctaaaacagggcgagagggtaggaaaataaaattgtagtacggtaactaagcggtaatatttatctagtacttaagcacctagtactgggcgaagcacattaccaacattctattacattttattcttgctattgaggcacagagacattaagtaatttgtcgagggtcatactgttagtggtggagctgggattcagattaaagtctgtctggcccaagagtcagctcttgatcattgttctgttcttcgtttacatttcagaaagatagaaaaatacaggccaggtgaggtggctcacacctgtaatcccagcacttcagaaacagaggtgggcagattgcttgagcccagaagctcaagaccagtctgggcaatatggcaaaaccccaactcgaggaaaaaaaaaaaaaattaactgggcatagggtcacgtgcctgtagtcccagctactggggtgggaggattgcttgaacccgagaggtcaaggctacagtgaggtgtgattgcaccactgcatttcagcctggtggtgacagagcgagaccccgtctcaaaaaa

SEQ ID NO: 24846 - DNA, 773 bp, Homo sapiens
cctagttttagaagtttcaatagccacctagttttagaaccccccaggcagcaatgacactggggaagtgacttttatctttctgaaaacgaggactctcaagtcagttaacagagaatgatttggaaggttatgtatcaaattgtttttcttgtgcaggaatatattgggagtttaattttcattgtaattggtatcatgtttttgttaccctaaaacagggcgagagggtaggaaaataaaattgtagtacggtaactaagcggtaatatttatctagtacttaagcacctagtactgggcgaagcacattaccaacattctattacattttattcttgctattgaggcacagagacattaagtaatttgtcgagggtcatactgttagtggtggagctgggattcagattaaagtctgtctggcccaagagtcagctcttgatcattgttctgttcttcgtttacatttcagaaagatagaaaaatacaggccaggtgaggtggctcacacctgtaatcccagcacttcagaaacagaggtgggcagattgcttgagcccagaagctcaagaccagtctgggcaatatggcaaaaccccaactcgaggaaaaaaaaaaaaaattaactgggcatagggtcacgtgcctgtagtcccagctactggggtgggaggattgcttgaacccgagaggtcaaggctacagtgaggtgtgattgcaccactgcatttcagcctggtggtgacagagcgagaccccgtctcaaaaaa

SEQ ID NO: 24847 - DNA, 547 bp, Homo sapiens
acgatacgatcgagctcggtaccgtacggtaactaagcggtaatatttatctagtacttaagcacctagtactgggcgaagcacattaccaacattctattacattttattcttgctattgaggcacagagacattaagtaatttgtcgagggtcatactgttagtggtggagctgggattcagattaaagtctgtctggcccaagagtcagctcttgatcattgttctgttcttcgtttacatttcagaaagatagaaaaatacaggccaggtgaggtggctcacacctgtaatcccagcacttcagaaacagaggtgggcagattgcttgagcccagaagctcaagaccagtctgggcaatatggcaaaaccccaactcgaggaaaaaaaaaaaaaattaactgggcatagggtcacgtgcctgtagtcccagctactggggtgggaggattgcttgaacccgagaggtcaaggctacagtgaggtgtgattgcaccactgcatttcagcctggtggtgacagagcgagaccccgtctcaaaaaa

SEQ ID NO: 24848 - DNA, 359 bp, Homo sapiens
ggagaagcccgtggactggagctgtgtcagctctgatggaacaaaaacggaggcacagagaggtcaattgattggtctaatgacacagatctagcaagtggtggaaccaggactgaatccaggtgtgtgtccggaattggtgggttcttggtctcactgacttcaagaatgaagccgcggacccttgcggaactgtgaagactagagtgaccttggagatctcatctggaagatggtagaactgctatcagcctggcttcccaaatgacctcctggatcacagctacccatggcctgaaatgttgaccttggagttgttgcataggaaagaaataaacttctttgttctttgaaacaca

SEQ ID NO: 24849 - DNA, 363 bp, Homo sapiens
cctctccctccacacctcccggcaagctgagggagtaggctctggccttggccagcccagaaaggggctcccatagtgcagcggtgggctgaagggctcctcaagtgccgccaaagtgggagcccaggcagaggaggcgcccagagcgagcgacggctgtgaggactgccagcacgctgtcacctctcacagggaactgtgaagactagagtgaccttggagatctcatctggaagatggtagaactgctatcagcctggcttcccaaatgacctcctggatcacagctacccatggcctgaaatgttgaccttggagttgttgcataggaaagaaataaacttctttgttctttgaaacaca

SEQ ID NO: 24850 - DNA, 347 bp, Homo sapiens
ggtggccaagtcagaagagaagcacagaacaaaaacggaggcacagagaggtcaattgattggtctaatgacacagatctagcaagtggtggaaccaggactgaatccaggtgtgtgtccggaattggtgggttcttggtctcactgacttcaagaatgaagccgcggacccttgcggaactgtgaagactagagtgaccttggagatctcatctggaagatggtagaactgctatcagcctggcttcccaaatgacctcctggatcacagctacccatggcctgaaatgttgaccttggagttgttgcataggaaagaaataaacttctttgttctttgaaacaca

SEQ ID NO: 24851 - DNA, 416 bp, Homo sapiens
tcagggtgggaaagagtgactgggaagtgggttgtccctgaaggtgtctgggagtcactatatcccagcagcgttcagagggcaaagaggagttcgctcccattgaagatgaagaaggtaggaaggcaggtgcagagttgtcagacagcctgaggacaccacccactctcagccctctgtggtggctgcatagggtggggagggggacagatgagatcagggtaggccacaaagggcttggtgcttctggggtctctgtttctatgtgtctctgaatccagtagccaaggatcctgaaatccaagattctgagattccttctgatttgtttttctgagtttgacatagatctccaccaagcgccatctggaatccgtttttaaaaaagactcgggattggattttaaagagggcgg

SEQ ID NO: 24852 - DNA, 967 bp, Homo sapiens
gtagagacggggtttcaccatgttagccaggatggtctcaatctcctgaccttgtgatccgcccgcctcggcctcccaaagtgctgggattacaggtgtgagccaccgcgcccagcctattctttacttaaacttgttttcactttgctgtatggactcaattctttcttgcacaagatccaagaatcctctcttggcgtctggatccagaccctttctggtatcagtggtaagctctgtttaagacaactgtcatacccaagagaattcttaaattgtggcagttaaaaatgtatttatcccctcgagggccgggcgcagtcgctcaagcccgtaatcccagcactttgggaggccgaggaggcggatcatgaggtcaggagttcgagaccagcctgaccagcactgtgaaaccctgtctctactaaaaatacaaaaaaaattagccaggcgtggtggtgggcacctgtaatcccagctactcgggaggctgaggcaggagaatcacttgaacccgggaggcagaggttgcagtgagccgagatgacaccactgccctccagcctgggtgacagttgttagactgcgtatcaaaaaaaaaaaaaaaaatttatttactcccttgcttcaaaaaggacataagttggcttgcaaatcacattttgtagaaatgaagtttttaagattagtctcatactcattacataatatttattgactacttacatattgagtgctaaattcagtggaataatatgaacaataaagacccagccttgtttatgctcttcagggagcataaatagagtacagctggcaaaacaaaatgtgcatatcccaaacctgtaaatcatgatctaagacaatatacaaacactcaaatagggaacttaccagctagcagactttgattatgaaccacagaacctagaataaataaatactctcttgaaagaaccatcattgg

SEQ ID NO: 24853 - DNA, 255 bp, Homo sapiens
aataaaatctacgctagcagctttatttagtaagattgatttaaattcaacaccttggcaaagaccatccttaacttaaaaatcaaagacaacaggttaaagtttatcaatgttttatcaaaagaaaagcagcaggctgggcatggtggctcacaccgataatcccagcactttgggaggccaaggcaggagaattgcttgaggccaggagtttaagaccagcttgggcaacatagtgagaccttgtctatacgg

SEQ ID NO: 24854 - DNA, 169 bp, Homo sapiens
ctcgatttactgccagaagtaccaatctcctcatgtaaaagagagtgccttcctttgctccaaaactatcatgagattctttagaagaccctctgttaataatattaatagtatcagctaccacctattgagggccaactttatttctattatctcatttaatcatttc

SEQ ID NO: 24855 - DNA, 345 bp, Homo sapiens
gacaggagtccagaccaaatctgtctgactacacagtacaattcttaaactaaaccatactgtgtttctccttacatgaaaaacagggtgttagaagacattagctgtgatcacatagtaaagaatagatcaagtaccaaattgaactcaaggagaaaatagtgagggcttgtagaattaaaatatatgataataataaagtgatctatgatactattgttatccaagaggagaataaaggtattagttgatattggacttgaattatccagtaataggaaaagaaactataacatccaaactaaagagtatgggctaataaaaaataatggacccaaagtaggc

SEQ ID NO: 24856 - DNA, 476 bp, Homo sapiens
taagttgagggaacagcatgagcaaaggatcattactcagggagcaatgacacatttctgctccgtgggcagagggttcactgatggcaacagagagggctgaggttacgtaggaccagaccacaaaaggacttccatgtcacgtagtagctttgccttgtgggcagcagggaggtccactggtggttctcgagtgacagaggagcattatagaatttaaaatttgtattgtaagcagatccttctggctgcagcatggagctgtattagagggggacagaaatggagggagggagatattcacagttataaacacccactatgtgccaggcatgtttctagagactagaaatagagcaaaagagggccaggcacagtggcttatgtttgtaatcccagcactttgggaggccaaggcaggtggatcacgaggtcaggagattaagacaatcctggctaacacagtgaaatgccat

SEQ ID NO: 24857 - DNA, 418 bp, Homo sapiens
tgtatatacctgtatctacttctaattctctgtcctatccatcattctatagcaaagctattctgttttattctactagcttgtataagtccattctcctataaagaaatagttaagactgggtaatttataaagaaaagaggtttaacaggaagtatagtggcttctccttctggggaggcctcagaaaacttacagtcctggggaagcaggcacgtcttacacggccagaacaggagtgggaagggagttgttacacacttttcaacaacctggtctcatgataactcactagcttgagaacagaacctaggggatggagctaacccattcatgagaactctgtcccatggtctatccacctcccaccagggcccacctccaacactggggattacatttcaacatgagattcggt

SEQ ID NO: 24858 - DNA, 192 bp, Homo sapiens
taaataaaagaaaatacaactttaaagtgtcagttggctaatttgggaagaggtgtgggtgtcagtgtatggggggagggggacctgcctttaggtgtcattaccaaaggctatgatgatgtcatacagcccatttcaaatgtacaaggagaattactggggagaagaaagagaagggaagtggggaaggta

SEQ ID NO: 24859 - DNA, 856 bp, Homo sapiens
ctttgtctgcaccacacctccccaacagaggaaagaaaatgccacttggctgacaaagccatttttacactgacagtttaaatatacctccagctgccctcaacttcccagacagctcaattggcataaacctggctcttggttccccgcaccatgaatacatttgtaaaatcagccaatgactttatggggctggccagaaagcagccttttctttaaaatatctgctagtgttgctgttcatcaaacagtgtttgatgaacaagtgttttatgagtcttcctcccttgtttctattacatctttgaaaagctggtcattagcagcttctttgactttacaaataaactacattaaagaagaagaaaacaaaacaaaatacattatgctccaaatctccacagatcatccatgatcattcaagaaacttaatccagatattctgaagaacaaataggaattcattggtctattttaagttatggtccaaagtagaaaggaagctgaccaacttaccatgttatctttgaatggacctcccactctaaaatcaatcaaggaaaaagtaaagaccagtgtctggtattgcatttctcccaagaaagcagaatttcatcctgagataaacaaaaaaaggatcttccctttgacattggtcacgatacagataaaatcctaaataaacacttgcctgtgagttactgaagctcccttaagttttactgtcctgatggctacatgtatgtgatgacccatatccctcacagacataataatcatatgggggaaaaaaatgatgtttacctctgtaaataaacaggttgtagtcttaataaacttggagcattttctttta

SEQ ID NO: 24860 - DNA, 485 bp, Homo sapiens
  misc_feature (7)..(7): n is a, c, g, or t
  misc_feature (25)..(25): n is a, c, g, or t
ggcaganacggtagtgatacccagngaaggctgcacaggcgagctcggggctgtcacactgctgtgtgcttggtcggtactaaatcccgtgatactcgtaagcatgatcaaaagcaaagctctgaagtcaggctgcctgggttggacgttagctcgaccacttgctagcatacaacttaggcaagtgacttgttctctgaatgcccgtgtctctctgtatgtaattccttcagtggcaaaatagggtaaccacagtttcctacatatagggttactaggctcaagtgagatgttccacgtaaaggatgtagaacagttaccttggcagaccatgctcaatactgtttgattataactataactaagctgggcgcggtggctcatgcctgtaatcctggcactttgggaggctgaggcgggtggatcatctgaggtcaggagttcgagaccagcctggccaacatggtgaaaactccgtctctact

SEQ ID NO: 24861 - DNA, 472 bp, Homo sapiens
aggaatgcatatggtatgcgcagcgttcagtaaagagaacctggttgaagtacagaatttgtggggaggaatagtgccagataagttaggtagaccaaagaagacaggcttggaatgctaggcacggagtgtctgttggcacctgaagggaattggggcgaggtaataaggtagcacgtcagccagagactggagagtacatctctgtctgagtaattttggccccaaatttgtaatgtggggatgggaagtgtattggtcagtcctgataaagagttatgtgtgcatctgtgtgacgtgttaaaattgcttcctgccactgctcgtgtttggtcagatagtaggttaggctgaaggaaagagaggtagtagccacaggacagataagctttgagaagccagagtggttggtaaagtatttggctttcatttagtatctctcatatatatatatatatatatatattttttt

SEQ ID NO: 24862 - DNA, 178 bp, Homo sapiens
aggaatgcatatggtatgcgcagcgttcagtaaagagaacctggttgaagtacagaatttgtggggaggaatagtgccagataagttaggtagaccaaagaagacaggcttggaatgctaggcacggagtgtctgtcgggctagtcgggggggtaccgagcgcggaatcgtaactcag

SEQ ID NO: 24863 - DNA, 329 bp, Homo sapiens
cctctagcccagccgtgagctttacagatggggaaaccaagggcccacaggcacggggacttacccagagccctggcctggccaccaggacctggcatctcacactttggcggtcccctgactctagacaccatgagtacctccgtctcctgcccggtcctgttgtctactgacagcagcgctggctgaggaagggaggaggtgccacgtggtacaaccccttctccacccctgggaacagcaccaagcccagtgcccgcacacttagctcccctgagcaggagcagagggcactggagcttcaagggcagagcgggacacaccgccac

SEQ ID NO: 24864 - DNA, 413 bp, Homo sapiens
ccagcaattgtgcttccacctcagaggcctggacagttactacaaacaaacaaacaaacaaacaaacaaataaatcaacctctcctggtaattctaatgtgcagcagtagctgtgagtctctgccctattccacattgccttaccaggagctgcgttatctggtgtgttgttaccctgtaatcccagcagtttggaaggcggaggtgggaggattgcttgagcccaggagtttaagaacagcctgggcaacatagcaagaccccatctctacaaaaaatacacagaaaaattagccaggcatggtggcgcatgcctgcagtcccagctactcaaaagtctgaggtgggagactcaactgagcccagaaggtcgagattgtagtgagccgagattataatactgcacttcagcc

SEQ ID NO: 24865 - DNA, 479 bp, Homo sapiens
ccttatacaaactgccatgaaattcttcagtgacattaattttaagtgtgtgtgtgtgtgtgtgcacatctcaagggtagagaatatgtattataaatcaaacttaagtgtcacaactgcaaaacagctggaaataattgatttacatcagtatggcttagctgctgctgacccaaaaattcctttgattgtctttaaggatctgtgtgagttttaacccttttaaccagaatcagatcaagtatcaatggatatagtgcaatttagtattacaagacaccaacaacatgctcagtttataaattgagtatatttgtcaatttaattaaaacattatttcacattttccttaggtggaaaagaaactggatgatcattttatgtgttttatttattaagaacatcaagtaaatgtattgagatatctaattatatgatttatcttttccacatgcctttattattgttagtctccttgt

SEQ ID NO: 24866 - DNA, 1175 bp, Homo sapiens
taattttgcaccttgattttctgacatagtattatattcagagatattaatactcagattaacataaacattctccttgattcgttgtactggttgcaaagtgttccattgtgcatggataatttttgtaaccttttccctactgctgaatatttaagttgtttccaaatttttactaattataaaaaactgtacagttcgtttatgtgtaatttgttttacttctgcaagtatatcaataggggaaacttcttgcagtaaaattgctgccccaaggttatatgtattttaagtgctgataaatattcctagattgcctccccaccgggtttcatcagaccttactgattgtcagtatgatctgtgaaacaaatctctcagttttgatttgcattttttaaattatgagagcttgaacaccattttacatgtttattggctgttgttatttcctttttgagatctgttcgttatatgctttgcccgtttttctgttgggtggttattatttttcttattgaatggtataagctctttgtaagttaaggacattagcccttagtcagatattttgacttaggttttaatttttttccacacagaagttttaagctctgtggcaaatttatcagtcttatatcactacagggttataaatattagttatcacttcgggtttgtgtcttgcttagaaagcctcatttgaagattgtaaatgttagtaagtttccccatattttcctctaggacttccatggtttaatttgttttgtttaaactaggaattggcattcacatcctcttttgtcccaggtctcagaggtcccttgtatcttatagagcagtattgttttatgttattttcccatgtataatttaaaaacaaaatacgttgttcaaaacaaaatacagtggcagcagataatggcagtatctctgtaactgctggtaaactgtatttcatagtgaagtgttcataaactaaagagtcattgatttggtttcctggctaattaaaatctgaattccatttgaagttccattgaaatcatggttttactctatagcagtggatgttttttcccaacctttctgatatttttttccttcctgagacagggtcttgctctgtcacctgggatggagtgtagttgcaccatcaaggcttactgcag

SEQ ID NO: 24867 - DNA, 536 bp, Homo sapiens
taatcccttgtcagatgggtagtttgcaaatattttctcccattctgtgggttgcctcctcatttgaagattgtaaatgttagtaagtttccccatattttcctctaggacttccatggtttaatttgttttgtttaaactaggaattggcattcacatcctcttttgtcccaggtctcagaggtcccttgtatcttatagagcagtattgttttatgttattttcccatgtataatttaaaaacaaaatacgttgttcaaaacaaaatacagtggcagcagataatggcagtatctctgtaactgctggtaaactgtatttcatagtgaagtgttcataaactaaagagtcattgatttggtttcctggctaattaaaatctgaattccatttgaagttccattgaaatcatggttttactctatagcagtggatgttttttcccaacctttctgatatttttttccttcctgagacagggtcttgctctgtcacctgggatggagtgtagttgcaccatcaaggcttactgcag

SEQ ID NO: 24868 - DNA, 335 bp, Homo sapiens
aacaaagttataataaatatgatcaggcatgactcaatgaagagtatctaaattataatcacataattttatctttcattttaacaataccttgtaatttatgtagtgatctgaagaagctatgggctctcactatgtaatgttagcaaaataattacaaacgatccctatgcagaccatgtgaacgagccagaagtggaagcatatagcaaaactatgtaaaaagtagcaaaaaacctctaaggatgtccatttgactgatgtgaatgatgaatggaagcttctaaaaatactagtaacaataaacactgttgatttggctataatccaagcca

SEQ ID NO: 24869 - DNA, 327 bp, Homo sapiens
gagaagtgataaacgtccatgaaatattcacaatttatgttcagagattgcagtaaaggcaggtgtaagaaattataaaagtattaattttgggaactgataaatgtccatgaaatcttcacaatttatgttcttcgccttggctccagccggtccctccattcagggtccctgacttcccgtaacacactttctaattgatttgcatctaatacagatgtacatacacaatcttactgtactctctggagatcaggaaatatgatgaaagagtgttaaagacttacatttcaaaagactaggcagtcaaaaggatatttttatttt

SEQ ID NO: 24870 - DNA, 1222 bp, Homo sapiens
tcatccaacaaaaaacaaggccaagcgcgcctttggcgcttaaccctcggcggcttcccgtggaattccgggatgagaaaaccagatggacctgttagtactacatttttaaggcattttatatttgatggtgccgtacttttaataataataaaactgaagttttttagtggcaatactgatttattttttaaaccagaaagataatccatattgattacttactacaaaaaagggaaaatatgccaaaaaataaaaaaccttaaaattcatatgaagcaacgtaacagataactgagcacttggctcaagtggtcagacttttcataatgttactgtgtaagtttggaattacctaataaccccaggctcaggattaacagaaggttctgggtgagttttaaaacatttaatatacctatgatttgttttacaacttgaagaaaaggcaggcagtcttgtgtctaatgagcttaatgcaaattctaattatactgcaaataatttaaagttttgattgcattctacaattgtctgtttggaaaattacatattatgaagtcattatatattttatcaaatcagaaaaagtcagctcaggaactgtagcagcagggagttctaaagatgacatgaactatactataggggtgccctactctatatggcctagggctttggtttgggtcagtcttgttctttcagatacataacaccagcagtactttcgggctcacttcaagaaccagataactctcccaaaccatgatacatgaagtgtataatcaagatttttaattaagctttagaattctttatttgtgtagagtgatggaaatgaccaagaagtaataatataaagcaaaagaattgggagagatcaggttttaagtatataaatattttttttttctcatggcatattctcaaaggtgttttgttacaaaccagattttcattttttaaaaaatgagacttggtggtatttaaaacctacacctaccatgttgctatttcactttcattgctttagttgcttaatatttaagctttgcttcatgctaccttttgtctgtatttcaatcttcataagcctattttgttttgtagacttgaatgataaaaattgtttctcatcttaagtatgctcagagttttaaatgttaaagaatgttgtgtaacctttatccaataaagtctttgattttttaaaaaaaaaata

SEQ ID NO: 24871 - DNA, 888 bp, Homo sapiens
cagcctgggtgacagagtgagactctatctgaagacaaaaaatagaaacttgtgtggctggcggatggtgtctcttgcctgtaatcccagcactttgggagactgaggcaggaagatcacatgaaccctgaggtttgaaccagccttggcaacatactgagaccccatctcttaaaaaaatgcttgggcattttaattttgtggtatgtgcatattaaagggggtagctagctgtatttcagaattgatgtttttacaaatactgtgtgtgtgtacatgggggtactgttggattaaaaataattgatgatttccttaggaaacttcagttttcactaagttcttgaaagcaatttgtagaaaatttacgtgttttttgaggaaatataaaccaagacaatgatttcttttctttacagagaccatgaaacgtatggtgcaatagccctacttttggtgggaaaaatatacagccattctggtgaagcagtgagtagtggtatcagtagcttatactacagtgtccaggttgagaacttaggccctcaagtagtatgcttgaatgattgtgttgtggtacattataagtaatatttttttggtgattattctgcttatatgccaagatgtcaataaaggctttacacagtgaaacagagaagaggcaagtgccagtcactccctgacccacacagctttaggacgcccactactgtgcagtatgtgttgagagtgagctcttccattgcatgttgcattaatatgatctttttcagaagtgattattagttgggcattaaacctggtttcattctgagtctaaagaatcctccgggccactctgcctatggggtagccctgctctgtctatggagaagctactctaga

SEQ ID NO: 24872 - DNA, 4110 bp, Homo sapiens
cgctgcagccggagttggaggagggagaagctaggaagaaaatggcggccgtggctgcagaggcggcagcgactgcagcgtcccccggggaggggggcgccggcgaggccgagccggagatggagcccatccccggcagtgaggccggcactgaccccctcccggtcacggccactgaagcgtctgtgccggatggcgagactgacgggcagcaatccgctcctcaggccgacgagccgccgctcccgccgccaccgccgccgccgggggagctcgcccgcagcccagaggcggtggggccggagctggaggctgaggagaaactgtccgttcgggtggcggagtcggcggcagccgcgcctcagggagggccggaacttccaccttctcctgcatcgccgccggagcagcccccggctcccgaggagcgcgaggagccgccgctgcctcagcccgtagccccggcgctcgtgccgccggcgggcggggactccacggtgtcgcaactgatcccgggctcggaggtgcgggtcacgctggaccacatcattgaggacgcgcttgtcgtgtcgttccgcttcggggagaagctcttctccggggtcctcatggatctgtccaaaaggtttgggccccatggtatccctgtgacagtatttcccaaaagggaatataaggataaaccagaagccatgccgctccaaagtaatacattccaagaagggacagaagtcaagtgtgaagcaaatggtgctgttcccgatgacccttctcctgtcccgcatcccgagctgagcttggctgaaagcctgtggacttccaaaccaccacctctcttccatgaaggagcaccttatcctccccctttgtttatcagggacacatataaccaatcaatacctcagccacctcctcggaaaattaagcgacccaaacgaaaaatgtacagggaagaacccacttcaataatgaatgctattaaactacgacccaggcaagttctgtgtgataaatgtaaaaacagtgttgttgctgaaaaaaaggaaattagaaaaggtagtagtgcaactgactcttctaaatatgaagataaaaaacggagaaatgaaagtgtaactactgtgaacaaaaaactgaaaactgaccataaagtggatgggaaaaaccaaaatgaaagccagaaaagaaatgctgtggttaaggtttcaaatattgctcacagcagaggcagagtagtaaaagtttctgctcaggcaaatacatcaaaagctcagttaagtactaaaaaagttctccagagtaagaacatggatcatgcgaaagctcgggaagtgttaaaaattgccaaagaaaaggcacaaaagaagcaaaatgaaacctctacttccaaaaatgcacattcaaaagtccatttcacacgtcgatatcagaatcctagctcaggttcccttccaccccgggttcgtttaaaaccacagaggtacaggaatgaagaaaatgactcttctctgaagacaggacttgagaaaatgcggagtggcaagatggcacccaagccccagtctcgctgcacctctacccgctcagcagaatttatagaccaggaagctgactaatcattgggaaggaacatccattcaactctcatttacagatgtggaaccaaagaccaaacaattatctgtgagaggccaggtctcaacaaatggcagctattacatcagacagtgacgagtcctgctgctcccttacagtgtctgacagaccactgtggattcagactgggagcattgaagttaacagtgaaacgggcagcacaaagacattagcaggctgctggtttcatggacctgtaccacaatgacacagagaacaccagagcatcaggactgaatgaaattggagtttttaaagctgcactaagaagtaaatgttaaggcagtggttaaaaacaacagtctataaaggggcacttgcaaattgtgctgtcttaaaccgaagaaaaggtattagggaatattttataaaaaataaacttgcaataaattatgcatgagatgaggagaaaaatgatgtgaattacacacgtaagaactcacttgaattttatatatgaagaaacactgacagtaacttctttggaatgtgaagttcttatcagtacagtttggacaggcctaaaaggcatgggatgatgcagaaatgctgaattatttttcatacttaaactttgtgctttctccaaggtttaggttaatcagttcagatatgagcaaaggtatttctaaaatggctcttctatgaaaagcaatagtcacatatgccaaggccaatgtttccttcaaggtgccagtagaaacaacagaaaataacatcctgctgaaaggatggcaaagtgccccgccccaccccacaaacacaatttggatcttttccttctttaataaagcagggctgtattatcttgaatatatgtttgcttgttagaacatattaagatatatttatttgccactagtatttaacattttgtgcacattttcataattacattcttacctttcaaattttgactcaaagtggataggctagtgttgatattggagtgcaaatgtatatactccaagagctagttcttaattctgctgagttggaaagccttttattattgtctgtatccttactggttttatctagttcaaaaaaggtgacaacgtctaaattttgatgtggacctctctccatagagagccgctcctaagtgcaagaaattccaacaggtgtcagtaggacttggccctgggggacaacaagtggcaggaacaggatcctttaaaacagtgtcaaacttctcatgcatggagcatgaattcttactaatagagactgtagttttttttcttgtctttggtaaatatataaaagaccttaatttttcttttttaatgaatggagaaaacatgagaaaaccagatggacctgttagtactacatttttaaggcattttatatttgatggtgccgtacttttaataataataaaactgaagttttttagtggcaatactgatttattttttaaaccagaaagataatccatattgattacttactacaaaaaagggaaaatatgccaaaaaataaaaaaccttaaaattcatatgaagcaacgtaacagataactgagcacttggctcaagtggtcagacttttcataatgttactgtgtaagtttggaattacctaataaccccaggctcaggattaacagaaggttctgggtgagttttaaaacatttaatatacctatgatttgttttacaacttgaagaaaaggcaggcagtcttgtgtctaatgagcttaatgcaaattctaattatactgcaaataatttaaagttttgattgcattctacaattgtctgtttggaaaattacatattatgaagtcattatatattttatcaaatcagaaaaagtcagctcaggaactgtagcagcagggagttctaaagatgacatgaactatactataggggtgccctactctatatggcctagggctttggtttgggtcagtcttgttctttcagatacataacaccagcagtactttcgggctcacttcaagaaccagataactctcccaaaccatgatacatgaagtgtataatcaagatttttaattaagctttagaattctttatttgtgtagagtgatggaaatgaccaagaagtaataatataaagcaaaagaattgggagagatcaggttttaagtatataaatattttttttttctcatggcatattctcaaaggtgttttgttacaaaccagattttcattttttaaaaaatgagacttggtggtatttaaaacctacacctaccatgttgctatttcactttcattgctttagttgcttaatatttaagctttgcttcatgctaccttttgtctgtatttcaatcttcataagcctattttgttttgtagacttgaatgataaaaattgtttctcatcttaagtatgctcagagttttaaatgttaaagaatgttgtgtaacctttatccaataaagtctttgattttttaaaaaaaaaata

SEQ ID NO: 24873 - DNA, 3675 bp, Homo sapiens
ttgaaagctgttataaccagaggaagaaatatatgtgtgtttcacaaagttgtagctgcatttactgaaaatgttgtatatggttcagtgaatgtaatgtatgtgatgcttaacataaagctatctgagaaaacattctgattcaagactggaaatatctactttaagtatagtcaactattctgtcattgcttagggcagctgtttgtttttaccaaaaatgtagaacctaaagaaatgaaggtctttggacttttgggggaagagatagtagatttttgtagtcttgttttttaatatgaaatagttttcgggaaaggttatataaataagcatcagatgttgtttacgtttaagaaattgaattatagatgttaacttaatgtcttctttttttcttccatttctttcaaaggtttgggccccatggtatccctgtgacagtatttcccaaaagggaatataaggataaaccagaagccatgccgctccaaagtaatacattccaagaagggacagaagtcaagtgtgaagcaaatggtgctgttcccgatgacccttctcctgtcccgcatcccgagctgagcttggctgaaagcctgtggacttccaaaccaccacctctcttccatgaaggagcaccttatcctccccctttgtttatcagggacacatataaccaatcaatacctcagccacctcctcggaaaattaagcgacccaaacgaaaaatgtacagggaagaacccacttcaataatgaatgctattaaactacgacccaggcaagttctgtgtgataaatgtaaaaacagtgttgttgctgaaaaaaaggaaattagaaaaggtagtagtgcaactgactcttctaaatatgaagataaaaaacggagaaatgaaagtgtaactactgtgaacaaaaaactgaaaactgaccataaagtggatgggaaaaaccaaaatgaaagccagaaaagaaatgctgtggttaaggtttcaaatattgctcacagcagaggcagagtagtaaaagtttctgctcaggcaaatacatcaaaagctcagttaagtactaaaaaagttctccagagtaagaacatggatcatgcgaaagctcgggaagtgttaaaaattgccaaagaaaaggcacaaaagaagcaaaatgaaacctctacttccaaaaatgcacattcaaaagtccatttcacacgtcgatatcagaatcctagctcaggttcccttccaccccgggttcgtttaaaaccacagaggtacaggaatgaagaaaatgactcttctctgaagacaggacttgagaaaatgcggagtggcaagatggcacccaagccccagtctcgctgcacctctacccgctcagcagcacaaagacattagcaggctgctggtttcatggacctgtaccacaatgacacagagaacaccagagcatcaggactgaatgaaattggagtttttaaagctgcactaagaagtaaatgttaaggcagtggttaaaaacaacagtctataaaggggcacttgcaaattgtgctgtcttaaaccgaagaaaaggtattagggaatattttataaaaaataaacttgcaataaattatgcatgagatgaggagaaaaatgatgtgaattacacacgtaagaactcacttgaattttatatatgaagaaacactgacagtaacttctttggaatgtgaagttcttatcagtacagtttggacaggcctaaaaggcatgggatgatgcagaaatgctgaattatttttcatacttaaactttgtgctttctccaaggtttaggttaatcagttcagatatgagcaaaggtatttctaaaatggctcttctatgaaaagcaatagtcacatatgccaaggccaatgtttccttcaaggtgccagtagaaacaacagaaaataacatcctgctgaaaggatggcaaagtgccccgccccaccccacaaacacaatttggatcttttccttctttaataaagcagggctgtattatcttgaatatatgtttgcttgttagaacatattaagatatatttatttgccactagtatttaacattttgtgcacattttcataattacattcttacctttcaaattttgactcaaagtggataggctagtgttgatattggagtgcaaatgtatatactccaagagctagttcttaattctgctgagttggaaagccttttattattgtctgtatccttactggttttatctagttcaaaaaaggtgacaacgtctaaattttgatgtggacctctctccatagagagccgctcctaagtgcaagaaattccaacaggtgtcagtaggacttggccctgggggacaacaagtggcaggaacaggatcctttaaaacagtgtcaaacttctcatgcatggagcatgaattcttactaatagagactgtagttttttttcttgtctttggtaaatatataaaagaccttaatttttcttttttaatgaatggagaaaacatgagaaaaccagatggacctgttagtactacatttttaaggcattttatatttgatggtgccgtacttttaataataataaaactgaagttttttagtggcaatactgatttattttttaaaccagaaagataatccatattgattacttactacaaaaaagggaaaatatgccaaaaaataaaaaaccttaaaattcatatgaagcaacgtaacagataactgagcacttggctcaagtggtcagacttttcataatgttactgtgtaagtttggaattacctaataaccccaggctcaggattaacagaaggttctgggtgagttttaaaacatttaatatacctatgatttgttttacaacttgaagaaaaggcaggcagtcttgtgtctaatgagcttaatgcaaattctaattatactgcaaataatttaaagttttgattgcattctacaattgtctgtttggaaaattacatattatgaagtcattatatattttatcaaatcagaaaaagtcagctcaggaactgtagcagcagggagttctaaagatgacatgaactatactataggggtgccctactctatatggcctagggctttggtttgggtcagtcttgttctttcagatacataacaccagcagtactttcgggctcacttcaagaaccagataactctcccaaaccatgatacatgaagtgtataatcaagatttttaattaagctttagaattctttatttgtgtagagtgatggaaatgaccaagaagtaataatataaagcaaaagaattgggagagatcaggttttaagtatataaatattttttttttctcatggcatattctcaaaggtgttttgttacaaaccagattttcattttttaaaaaatgagacttggtggtatttaaaacctacacctaccatgttgctatttcactttcattgctttagttgcttaatatttaagctttgcttcatgctaccttttgtctgtatttcaatcttcataagcctattttgttttgtagacttgaatgataaaaattgtttctcatcttaagtatgctcagagttttaaatgttaaagaatgttgtgtaacctttatccaataaagtctttgattttttaaaaaaaaaata

SEQ ID NO: 24874 - DNA, 3955 bp, Homo sapiens
cgctgcagccggagttggaggagggagaagctaggaagaaaatggcggccgtggctgcagaggcggcagcgactgcagcgtcccccggggaggggggcgccggcgaggccgagccggagatggagcccatccccggcagtgaggccggcactgaccccctcccggtcacggccactgaagcgtctgtgccggatggcgagactgacgggcagcaatccgctcctcaggccgacgagccgccgctcccgccgccaccgccgccgccgggggagctcgcccgcagcccagaggcggtggggccggagctggaggctgaggagaaactgtccgttcgggtggcggagtcggcggcagccgcgcctcagggagggccggaacttccaccttctcctgcatcgccgccggagcagcccccggctcccgaggagcgcgaggagccgccgctgcctcagcccgtagccccggcgctcgtgccgccggcgggcggggactccacggtgtcgcaactgatcccgggctcggaggtgcgggtcacgctggaccacatcattgaggacgcgcttgtcgtgtcgttccgcttcggggagaagctcttctccggggtcctcatggatctgtccaaaagagaccatgaaacgtatggtgcaatagccctacttttggtgggaaaaatatacagccattctggtgaagcagtttgggccccatggtatccctgtgacagtatttcccaaaagggaatataaggataaaccagaagccatgccgctccaaagtaatacattccaagaagggacagaagtcaagtgtgaagcaaatggtgctgttcccgatgacccttctcctgtcccgcatcccgagctgagcttggctgaaagcctgtggacttccaaaccaccacctctcttccatgaaggagcaccttatcctccccctttgtttatcagggacacatataaccaatcaatacctcagccacctcctcggaaaattaagcgacccaaacgaaaaatgtacagggaagaacccacttcaataatgaatgctattaaactacgacccaggcaagttctgtgtgataaatgtaaaaacagtgttgttgctgaaaaaaaggaaattagaaaaggtagtagtgcaactgactcttctaaatatgaagataaaaaacggagaaatgaaagtgtaactactgtgaacaaaaaactgaaaactgaccataaagtggatgggaaaaaccaaaatgaaagccagaaaagaaatgctgtggttaaggtttcaaatattgctcacagcagaggcagagtagtaaaagtttctgctcaggcaaatacatcaaaagctcagttaagtactaaaaaagttctccagagtaagaacatggatcatgcgaaagctcgggaagtgttaaaaattgccaaagaaaaggcacaaaagaagcaaaatgaaacctctacttccaaaaatgcacattcaaaagtccatttcacacgtcgatatcagaatcctagctcaggttcccttccaccccgggttcgtttaaaaccacagaggtacaggaatgaagaaaatgactcttctctgaagacaggacttgagaaaatgcggagtggcaagatggcacccaagccccagtctcgctgcacctctacccgctcagcagcacaaagacattagcaggctgctggtttcatggacctgtaccacaatgacacagagaacaccagagcatcaggactgaatgaaattggagtttttaaagctgcactaagaagtaaatgttaaggcagtggttaaaaacaacagtctataaaggggcacttgcaaattgtgctgtcttaaaccgaagaaaaggtattagggaatattttataaaaaataaacttgcaataaattatgcatgagatgaggagaaaaatgatgtgaattacacacgtaagaactcacttgaattttatatatgaagaaacactgacagtaacttctttggaatgtgaagttcttatcagtacagtttggacaggcctaaaaggcatgggatgatgcagaaatgctgaattatttttcatacttaaactttgtgctttctccaaggtttaggttaatcagttcagatatgagcaaaggtatttctaaaatggctcttctatgaaaagcaatagtcacatatgccaaggccaatgtttccttcaaggtgccagtagaaacaacagaaaataacatcctgctgaaaggatggcaaagtgccccgccccaccccacaaacacaatttggatcttttccttctttaataaagcagggctgtattatcttgaatatatgtttgcttgttagaacatattaagatatatttatttgccactagtatttaacattttgtgcacattttcataattacattcttacctttcaaattttgactcaaagtggataggctagtgttgatattggagtgcaaatgtatatactccaagagctagttcttaattctgctgagttggaaagccttttattattgtctgtatccttactggttttatctagttcaaaaaaggtgacaacgtctaaattttgatgtggacctctctccatagagagccgctcctaagtgcaagaaattccaacaggtgtcagtaggacttggccctgggggacaacaagtggcaggaacaggatcctttaaaacagtgtcaaacttctcatgcatggagcatgaattcttactaatagagactgtagttttttttcttgtctttggtaaatatataaaagaccttaatttttcttttttaatgaatggagaaaacatgagaaaaccagatggacctgttagtactacatttttaaggcattttatatttgatggtgccgtacttttaataataataaaactgaagttttttagtggcaatactgatttattttttaaaccagaaagataatccatattgattacttactacaaaaaagggaaaatatgccaaaaaataaaaaaccttaaaattcatatgaagcaacgtaacagataactgagcacttggctcaagtggtcagacttttcataatgttactgtgtaagtttggaattacctaataaccccaggctcaggattaacagaaggttctgggtgagttttaaaacatttaatatacctatgatttgttttacaacttgaagaaaaggcaggcagtcttgtgtctaatgagcttaatgcaaattctaattatactgcaaataatttaaagttttgattgcattctacaattgtctgtttggaaaattacatattatgaagtcattatatattttatcaaatcagaaaaagtcagctcaggaactgtagcagcagggagttctaaagatgacatgaactatactataggggtgccctactctatatggcctagggctttggtttgggtcagtcttgttctttcagatacataacaccagcagtactttcgggctcacttcaagaaccagataactctcccaaaccatgatacatgaagtgtataatcaagatttttaattaagctttagaattctttatttgtgtagagtgatggaaatgaccaagaagtaataatataaagcaaaagaattgggagagatcaggttttaagtatataaatattttttttttctcatggcatattctcaaaggtgttttgttacaaaccagattttcattttttaaaaaatgagacttggtggtatttaaaacctacacctaccatgttgctatttcactttcattgctttagttgcttaatatttaagctttgcttcatgctaccttttgtctgtatttcaatcttcataagcctattttgttttgtagacttgaatgataaaaattgtttctcatcttaagtatgctcagagttttaaatgttaaagaatgttgtgtaacctttatccaataaagtctttgattttttaaaaaaaaaata

SEQ ID NO: 24875 - DNA, 3885 bp, Homo sapiens
cgctgcagccggagttggaggagggagaagctaggaagaaaatggcggccgtggctgcagaggcggcagcgactgcagcgtcccccggggaggggggcgccggcgaggccgagccggagatggagcccatccccggcagtgaggccggcactgaccccctcccggtcacggccactgaagcgtctgtgccggatggcgagactgacgggcagcaatccgctcctcaggccgacgagccgccgctcccgccgccaccgccgccgccgggggagctcgcccgcagcccagaggcggtggggccggagctggaggctgaggagaaactgtccgttcgggtggcggagtcggcggcagccgcgcctcagggagggccggaacttccaccttctcctgcatcgccgccggagcagcccccggctcccgaggagcgcgaggagccgccgctgcctcagcccgtagccccggcgctcgtgccgccggcgggcggggactccacggtgtcgcaactgatcccgggctcggaggtgcgggtcacgctggaccacatcattgaggacgcgcttgtcgtgtcgttccgcttcggggagaagctcttctccggggtcctcatggatctgtccaaaaggtttgggccccatggtatccctgtgacagtatttcccaaaagggaatataaggataaaccagaagccatgccgctccaaagtaatacattccaagaagggacagaagtcaagtgtgaagcaaatggtgctgttcccgatgacccttctcctgtcccgcatcccgagctgagcttggctgaaagcctgtggacttccaaaccaccacctctcttccatgaaggagcaccttatcctccccctttgtttatcagggacacatataaccaatcaatacctcagccacctcctcggaaaattaagcgacccaaacgaaaaatgtacagggaagaacccacttcaataatgaatgctattaaactacgacccaggcaagttctgtgtgataaatgtaaaaacagtgttgttgctgaaaaaaaggaaattagaaaaggtagtagtgcaactgactcttctaaatatgaagataaaaaacggagaaatgaaagtgtaactactgtgaacaaaaaactgaaaactgaccataaagtggatgggaaaaaccaaaatgaaagccagaaaagaaatgctgtggttaaggtttcaaatattgctcacagcagaggcagagtagtaaaagtttctgctcaggcaaatacatcaaaagctcagttaagtactaaaaaagttctccagagtaagaacatggatcatgcgaaagctcgggaagtgttaaaaattgccaaagaaaaggcacaaaagaagcaaaatgaaacctctacttccaaaaatgcacattcaaaagtccatttcacacgtcgatatcagaatcctagctcaggttcccttccaccccgggttcgtttaaaaccacagaggtacaggaatgaagaaaatgactcttctctgaagacaggacttgagaaaatgcggagtggcaagatggcacccaagccccagtctcgctgcacctctacccgctcagcagcacaaagacattagcaggctgctggtttcatggacctgtaccacaatgacacagagaacaccagagcatcaggactgaatgaaattggagtttttaaagctgcactaagaagtaaatgttaaggcagtggttaaaaacaacagtctataaaggggcacttgcaaattgtgctgtcttaaaccgaagaaaaggtattagggaatattttataaaaaataaacttgcaataaattatgcatgagatgaggagaaaaatgatgtgaattacacacgtaagaactcacttgaattttatatatgaagaaacactgacagtaacttctttggaatgtgaagttcttatcagtacagtttggacaggcctaaaaggcatgggatgatgcagaaatgctgaattatttttcatacttaaactttgtgctttctccaaggtttaggttaatcagttcagatatgagcaaaggtatttctaaaatggctcttctatgaaaagcaatagtcacatatgccaaggccaatgtttccttcaaggtgccagtagaaacaacagaaaataacatcctgctgaaaggatggcaaagtgccccgccccaccccacaaacacaatttggatcttttccttctttaataaagcagggctgtattatcttgaatatatgtttgcttgttagaacatattaagatatatttatttgccactagtatttaacattttgtgcacattttcataattacattcttacctttcaaattttgactcaaagtggataggctagtgttgatattggagtgcaaatgtatatactccaagagctagttcttaattctgctgagttggaaagccttttattattgtctgtatccttactggttttatctagttcaaaaaaggtgacaacgtctaaattttgatgtggacctctctccatagagagccgctcctaagtgcaagaaattccaacaggtgtcagtaggacttggccctgggggacaacaagtggcaggaacaggatcctttaaaacagtgtcaaacttctcatgcatggagcatgaattcttactaatagagactgtagttttttttcttgtctttggtaaatatataaaagaccttaatttttcttttttaatgaatggagaaaacatgagaaaaccagatggacctgttagtactacatttttaaggcattttatatttgatggtgccgtacttttaataataataaaactgaagttttttagtggcaatactgatttattttttaaaccagaaagataatccatattgattacttactacaaaaaagggaaaatatgccaaaaaataaaaaaccttaaaattcatatgaagcaacgtaacagataactgagcacttggctcaagtggtcagacttttcataatgttactgtgtaagtttggaattacctaataaccccaggctcaggattaacagaaggttctgggtgagttttaaaacatttaatatacctatgatttgttttacaacttgaagaaaaggcaggcagtcttgtgtctaatgagcttaatgcaaattctaattatactgcaaataatttaaagttttgattgcattctacaattgtctgtttggaaaattacatattatgaagtcattatatattttatcaaatcagaaaaagtcagctcaggaactgtagcagcagggagttctaaagatgacatgaactatactataggggtgccctactctatatggcctagggctttggtttgggtcagtcttgttctttcagatacataacaccagcagtactttcgggctcacttcaagaaccagataactctcccaaaccatgatacatgaagtgtataatcaagatttttaattaagctttagaattctttatttgtgtagagtgatggaaatgaccaagaagtaataatataaagcaaaagaattgggagagatcaggttttaagtatataaatattttttttttctcatggcatattctcaaaggtgttttgttacaaaccagattttcattttttaaaaaatgagacttggtggtatttaaaacctacacctaccatgttgctatttcactttcattgctttagttgcttaatatttaagctttgcttcatgctaccttttgtctgtatttcaatcttcataagcctattttgttttgtagacttgaatgataaaaattgtttctcatcttaagtatgctcagagttttaaatgttaaagaatgttgtgtaacctttatccaataaagtctttgattttttaaaaaaaaaata

SEQ ID NO: 24876 - DNA, 3307 bp, Homo sapiens
cgctgcagccggagttggaggagggagaagctaggaagaaaatggcggccgtggctgcagaggcggcagcgactgcagcgtcccccggggaggggggcgccggcgaggccgagccggagatggagcccatccccggcagtgaggccggcactgaccccctcccggtcacggccactgaagcgtctgtgccggatggcgagactgacgggcagcaatccgctcctcaggccgacgagccgccgctcccgccgccaccgccgccgccgggggagctcgcccgcagcccagaggcggtggggccggagctggaggctgaggagaaactgtccgttcgggtggcggagtcggcggcagccgcgcctcagggagggccggaacttccaccttctcctgcatcgccgccggagcagcccccggctcccgaggagcgcgaggagccgccgctgcctcagcccgtagccccggcgctcgtgccgccggcgggcggggactccacggtgtcgcaactgatcccgggctcggaggtgcgggtcacgctggaccacatcattgaggacgcgcttgtcgtgtcgttccgcttcggggagaagctcttctccggggtcctcatggatctgtccaaaaggtttgggccccatggtatccctgtgacagtatttcccaaaagggaatataaggataaaccagaagccatgccgctccaaagtaatacattccaagaagggacagaagtcaagtgtgaagcaaatggtgctgttcccgatgacccttctcctgtcccgcatcccgagctgagcttggctgaaagcctgtggacttccaaaccaccacctctcttccatgaaggagcaccttatcctccccctttgtttatcagggacacatataaccaatcaatacctcagccacctcctcggaaaattaagcgacccaaacgaaaaatgtacagggaagaacccacttcaataatgaatgctattaaactacgacccaggcaagttctgtgtgataaatgtaaaaacagtgttgttgctgaaaaaaaggaaattagaaaaggtagtagtgcaactgactcttctaaatatgaagataaaaaacggagaaatgaaagtgtaactactgtgaacaaaaaactgaaaactgaccataaagtggatgggaaaaaccaaaatgaaagccagaaaagaaatgctgtggttaaggtttcaaatattgctcacagcagaggcagagtagtaaaagtttctgctcaggcaaatacatcaaaagctcagttaagtactaaaaaagttctccagagtaagaacatggatcatgcgaaagctcgggaagtgttaaaaattgccaaagaaaaggcacaaaagaagcaaaatgaaacctctacttccaaaaatgcacattcaaaagtccatttcacacgtcgatatcagaatcctagctcaggttcccttccaccccgggttcgtttaaaaccacagaggtacaggaatgaagaaaatgactcttctctgaagacaggacttgagaaaatgcggagtggcaagatggcacccaagccccagtctcgctgcacctctacccgctcagcaggtgaggccccttcagaaaatcagagtccctcaaaaggccctgaagaggccagcagtgaggttcaggacacaaatgaagtgcatgtgcctggtgatcaggatgaaccacagacattgggcaaaaagggcagcaaaaacaatatctctgtttatatgaccctaaatcaaaagaaatctgactcttccagtgcttcagtgtgtagcattgatagcacagatgatttgaaatcttccaactctgagtgtagttcttctgaaagctttgattttcctccaggcagtatgcatgcaccttccacctcctccacttcctcctcttcaaaggaagagaaaaagctcagtaattccttgaaaatgaaagtcttttccaaaaacgtctctaaatgcgtcacaccagatggcaggaccatatgtgtaggggacattgtttgggccaagatatatggcttcccttggtggccagcccgtattcttactataactgtgagccggaaagataacggccttttagtccgacaggaggcccgtatttcatggtttgggtctccaacaacatctttccttgctctttcacaactctccccctttttagaaaacttccagtcacgctttaataagaagagaaagggcctgtatcgcaaggctatcacagaggcagctaaggctgccaagcagctgacccccgaagtgcgggctttgttgacacagtttgaaacgtgaacatgggcagtaaggtaggcaagaccattggaagtcaccacagattttctagtctagttaggaataatttctacaaaatagcgtggccagattggagagagaagttgcactcagttggctggctttttaatacttaccttatagccatttttagactgagagcttaaactgaacatataatcaaattttgtgttaaggaagtgagattttagcagtatttttcagttttgaagttcgaaaccatcccaaggcataggagccatagcctcaactgaaattgaatttttgtagggactgttaattgccatttgtacctaatactgtatatatacatatatatacgtgtgtgtgtgtgtatatatatatatccgtgtatgtatatatacacacatatatatgtatatatacacatatatatatatgaaatacagcctgtcactgtgtgacacagattgcatatttgggattgcaataagggcttggtgagctgggggaatagtggatatttaatgactacttgttttttaaataatgaacacttagcctttctatgcgcataatggtgtaaaagttagatggttaggtgtttgacaaacagatggttgcaattcagttacagactggggaaatagcccagtgtttgggattaaaactgtcaagactggataggtgttagtcatcactgtctttcgtccagtggggatttaataaatactttcaagcttctggtttgggagtttagataggtttgattttggatttgtaaatagtgattgctaaatttggtcagatttctcctgactggctgttcctaaattcttaggatatgtcccagtaaaattatactttgtgaattaattgtcatatgtgtaattgttgcattttggatgtacctaatttgataattaaaacaaaataatttccgtttaaggtatctgtttgcaggtcagaaaatgagaaaatgtaattgtgtaatgctctgaaatgtaaaaaaaaaa

SEQ ID NO: 24877 - DNA, 2062 bp, Homo sapiens
agaggtttgcgggagtcagtggcacggtctctgaagaagatggattgggagtgtgtgggaatcaataaatgcgagttctgtgaaatgtcttgattttcagggtgcatggggctctttctggcaaaggtaatgacatacgcatctgtgccagcatcccaagagtgaggctggtttctggaaatccattctgactctgtgacagcggggatggatgtgaccttgcccgtggttagaaaacaaatttactgagttctctgggtgccctgcagacctttggatcctgccaccttgctggacgggagggctctctagctcctgccagcccttagagccacaggaccttggtcacaacatctacagaaggccctgcagctaagtgatctaatccaggatcatatgctgcctttaggtgacacatccctttagtctcctttaatcaggagcagtttctcagtgttcatcttccatgaagtcgacatttttgaagagtataggtgtcagatctttttcaagaacagcagaaaatgatcgaataccagatacctgtgtcattcaaagatgtggttgtgggcttcacccaagaggagtggcaccggctgagtcctgctcagagggccctgtaccgggatgtgatgctggaaacctatagcaacctcgtctcagtgggttatgaaggcaccaaaccagatgtgatcctcagactggagcaggaagaagcaccatggattggtgaggcagcatgcccgggctgccactgttgggaagacatctggcgagttaatatccagaggaaaagacggcaagacatgcttttgaggccaggcgcacataagcaagaaaacattgcccaaggagaaaagctgtgaatataataagtttgggaaaatatcacttctgagcactgatcttttttcttcaatccagagccctagtaactggaacccccgtctctactaaaaatacaaaaattagctgggcatggtggcaggcacctgtgatcccagctactcgggaggctgaggcaggagaatcacttgaacccaggaggcagaggttgcagtgagccaagatcgcgccattgcactccaacctgggcaacagagcaaaaagattccatctcaaaagaaaagaaaagaaatctgttaatattattaaaatatttatgtcactttggagaatcttcccttagaagtaaaagctccaatacataaaagacagatgaacatgtgaacatggacatttattgtaaaaattgttcttaatggcaaaaaaacccccaaaaccaaagcaaacactagaatcaaagtaaatacccatcaactgggaaattgtagaaaggaaaaaactatagtgtatccattccatagaatgttaatatagccattaaggtggacaaattaaaactatgctagtggacttgagtggaattccacaatgttctcttgagtgaaaaatgcaaggtagatattaagtatgttaaatatgactccatttttttaaatcattaacaaaatgtctctaggtgtttgtcagcaataaacggtatctatatatgtttatttgattttatgtgcatgaagaaaagtatagaagagtatgcattgacttggagggaggtgggtaatgcaggtaggttatgggggagtcaggggtgtagggaaaaggaaaaccaaaaaagaaaaatacataaatgactgaatcacgggtgataccacaaatgtgtgagttagtaaatttggctggggatgggggagctagaattttgctaatttgtggggatgttcatggtatatattgtaaaaagggaaaatttcataataatgtatacgattctatttttaaaaaaagtaaaaactcctgtgtgtgtatatatgcatgtggatgtttatatgaacatagaaaagtgtagaagaatacacacgaaggtgttaacattcattggttaccttggtggagaagggtaataagttttctgaatacctttgcattgtcttgttcacatatattgcttttgtaatttgaaaaacaaaataaagggggaaaacatttcaaactgaatgaa

SEQ ID NO: 24878 - DNA, 1813 bp, Homo sapiens
agcttcatccctgagccagaagctgagcaagaccaaacctgaagacgttactctttccagggactctccatggctaaatgaagggaggatggttggcccaagatccaggaagacagagtgaagggagaggatctaatccaggatcatatgctgcctttaggtgacacatccctttagtctcctttaatcaggagcagtttctcagtgttcatcttccatgaagtcgacatttttgaagagtataggtgtcagatctttttcaagaacagcagaaaatgatcgaataccagatacctgtgtcattcaaagatgtggttgtgggcttcacccaagaggagtggcaccggctgagtcctgctcagagggccctgtaccgggatgtgatgctggaaacctatagcaacctcgtctcagtgggttatgaaggcaccaaaccagatgtgatcctcagactggagcaggaagaagcaccatggattggtgaggcagcatgcccgggctgccactgttgggaagacatctggcgagttaatatccagaggaaaagacggcaagacatgcttttgaggccaggcgcacataagcaagaaaacattgcccaaggagaaaagctgtgaatataataagtttgggaaaatatcacttctgagcactgatcttttttcttcaatccagagccctagtaactggaacccccgtctctactaaaaatacaaaaattagctgggcatggtggcaggcacctgtgatcccagctactcgggaggctgaggcaggagaatcacttgaacccaggaggcagaggttgcagtgagccaagatcgcgccattgcactccaacctgggcaacagagcaaaaagattccatctcaaaagaaaagaaaagaaatctgttaatattattaaaatatttatgtcactttggagaatcttcccttagaagtaaaagctccaatacataaaagacagatgaacatgtgaacatggacatttattgtaaaaattgttcttaatggcaaaaaaacccccaaaaccaaagcaaacactagaatcaaagtaaatacccatcaactgggaaattgtagaaaggaaaaaactatagtgtatccattccatagaatgttaatatagccattaaggtggacaaattaaaactatgctagtggacttgagtggaattccacaatgttctcttgagtgaaaaatgcaaggtagatattaagtatgttaaatatgactccatttttttaaatcattaacaaaatgtctctaggtgtttgtcagcaataaacggtatctatatatgtttatttgattttatgtgcatgaagaaaagtatagaagagtatgcattgacttggagggaggtgggtaatgcaggtaggttatgggggagtcaggggtgtagggaaaaggaaaaccaaaaaagaaaaatacataaatgactgaatcacgggtgataccacaaatgtgtgagttagtaaatttggctggggatgggggagctagaattttgctaatttgtggggatgttcatggtatatattgtaaaaagggaaaatttcataataatgtatacgattctatttttaaaaaaagtaaaaactcctgtgtgtgtatatatgcatgtggatgtttatatgaacatagaaaagtgtagaagaatacacacgaaggtgttaacattcattggttaccttggtggagaagggtaataagttttctgaatacctttgcattgtcttgttcacatatattgcttttgtaatttgaaaaacaaaataaagggggaaaacatttcaaactgaatgaa

SEQ ID NO: 24879 - DNA, 827 bp, Homo sapiens
agaggtttgcgggagtcagtggcacggtctctgaagaagatggattgggagtgtgtgggaatcaataaatgcgagttctgtgaaatgtcttgattttcagggtgcatggggctctttctggcaaaggtaatgacatacgcatctgtgccagcatcccaagagtgaggctggtttctggaaatccattctgactctgtgacagcggggatggatgtgaccttgcccgtggttagaaaacaaatttactgagatctaatccaggatcatatgctgcctttaggtgacacatccctttagtctcctttaatcaggagcagtttctcagtgttcatcttccatgaagtcgacatttttgaagagtataggtgtcagatctttttcaagaacagcagaaaatgatcgaataccagatacctgtgtcattcaaagatgtggttgtgggcttcacccaagaggagtggcaccggctgagtcctgctcagagggccctgtaccgggatgtgatgctggaaacctatagcaacctcgtctcagtgggttatgaaggcaccaaaccagatgtgatcctcagactggagcaggaagaagcaccatggattggtgaggcagcatgcccgggctgccactgttgggccttgaaagtcctccgagagcttcagccacgttaatgactcttcaacctccatgcaaccccaccgcccatatctgagtgtttttctcggctctacttgattgcacctctgcccttatgtgcttggtccatctctctttctccagaatctttcccatgcaggtattcttacaaataaaagcttctatgattctct

SEQ ID NO: 24880 - DNA, 320 bp, Homo sapiens
ccatggattggtgaggcagcatgcccgggctgccactgttggggtaagtgtgataaatctagcaaaaggggtactgaaggaggctggcacctttggaattttgttcagcattcttctcttaaaagccttgaaagtcctccgagagcttcagccacgttaatgactcttcaacctccatgcaaccccaccgcccatatctgagtgtttttctcggctctacttgattgcacctctgcccttatgtgcttggtccatctctctttctccagaatctttcccatgcaggtattcttacaaataaaagcttctatgattctctg

SEQ ID NO: 24881 - DNA, 1933 bp, Homo sapiens
agaggtttgcgggagtcagtggcacggtctctgaagaagatggattgggagtgtgtgggaatcaataaatgcgagttctgtgaaatgtcttgattttcagggtgcatggggctctttctggcaaaggtaatgacatacgcatctgtgccagcatcccaagagtgaggctggtttctggaaatccattctgactctgtgacagcggggatggatgtgaccttgcccgtggttagaaaacaaatttactgagatctaatccaggatcatatgctgcctttaggtgacacatccctttagtctcctttaatcaggagcagtttctcagtgttcatcttccatgaagtcgacatttttgaagagtataggtgtcagatctttttcaagaacagcagaaaatgatcgaataccagatacctgtgtcattcaaagatgtggttgtgggcttcacccaagaggagtggcaccggctgagtcctgctcagagggccctgtaccgggatgtgatgctggaaacctatagcaacctcgtctcagtgggttatgaaggcaccaaaccagatgtgatcctcagactggagcaggaagaagcaccatggattggtgaggcagcatgcccgggctgccactgttgggaagacatctggcgagttaatatccagaggaaaagacggcaagacatgcttttgaggccaggcgcacataagcaagaaaacattgcccaaggagaaaagctgtgaatataataagtttgggaaaatatcacttctgagcactgatcttttttcttcaatccagagccctagtaactggaacccccgtctctactaaaaatacaaaaattagctgggcatggtggcaggcacctgtgatcccagctactcgggaggctgaggcaggagaatcacttgaacccaggaggcagaggttgcagtgagccaagatcgcgccattgcactccaacctgggcaacagagcaaaaagattccatctcaaaagaaaagaaaagaaatctgttaatattattaaaatatttatgtcactttggagaatcttcccttagaagtaaaagctccaatacataaaagacagatgaacatgtgaacatggacatttattgtaaaaattgttcttaatggcaaaaaaacccccaaaaccaaagcaaacactagaatcaaagtaaatacccatcaactgggaaattgtagaaaggaaaaaactatagtgtatccattccatagaatgttaatatagccattaaggtggacaaattaaaactatgctagtggacttgagtggaattccacaatgttctcttgagtgaaaaatgcaaggtagatattaagtatgttaaatatgactccatttttttaaatcattaacaaaatgtctctaggtgtttgtcagcaataaacggtatctatatatgtttatttgattttatgtgcatgaagaaaagtatagaagagtatgcattgacttggagggaggtgggtaatgcaggtaggttatgggggagtcaggggtgtagggaaaaggaaaaccaaaaaagaaaaatacataaatgactgaatcacgggtgataccacaaatgtgtgagttagtaaatttggctggggatgggggagctagaattttgctaatttgtggggatgttcatggtatatattgtaaaaagggaaaatttcataataatgtatacgattctatttttaaaaaaagtaaaaactcctgtgtgtgtatatatgcatgtggatgtttatatgaacatagaaaagtgtagaagaatacacacgaaggtgttaacattcattggttaccttggtggagaagggtaataagttttctgaatacctttgcattgtcttgttcacatatattgcttttgtaatttgaaaaacaaaataaagggggaaaacatttcaaactgaatgaa

SEQ ID NO: 24882 - DNA, 354 bp, Homo sapiens
aagtgctgtactaagcagccatgccaattgacgtgttttagtcctgtgaggtttacctgttgtctttcccaaatttcccagaattttatcctggaaggctctggctgatcctgaattcatatttgggtgtaccttgagtctttgttctggaacccagctgggaagggctcagtctgcctagcccaggcaaggcctggaagcagacctcagggagggccaaactacccctggatggccaggagaacctgggctgtatggggccatgctgtgagggtgtactgctttactgggagagagcagaccaggacagaccttcagagtccaggcattcaaccacgtagaagggaattagag

SEQ ID NO: 24883 - DNA, 357 bp, Homo sapiens
acaaaatgttctttaacgggtgaactggtaaacaacctgtgttgcattcatacagtgagatagtaattagcaataaaaaggaatgaattactgatacctgtcaacaatgacattctggaaaaggcaaaactatagggacagaaaacaaatcagtagttaccagttgtgactagcgggaagggaattgatgacaaaagagcatcagaaggcttgtgggggtgatggagctattttacatcttgcttttggtggtagtggttacacaactgcatgtgtgtgccagcagaactgcacactaacatgggttaatttactctgggatatcaataaatctgacttaagcatgagtaaaatgga

SEQ ID NO: 24884 - DNA, 592 bp, Homo sapiens
gtttaaatacatagtatttgtaaatctaaagcataacaagaaatgtgagaaaaacaacacatttagaaattgttaaaaaataagttattcagagatagggacaggttcttggtttgtatgactatgagaccgtgaagtattagccatctccgccttcctagaaagatgtctccctcctgcttcggactcctccttcctcctaaaccttgtttatcgtctgctgctcttgcactggccacaagagagactttttacagacttaagtctgccaagagaccttgcttttgttctacagcacctgttttaaatttcacccttcccaggaggcattttcctattaagtgagagtgagatgtagattctaccctctgtaacacaaacgacacacgaacacttcagtgcaagaaagaaaagtacaaagatggtgatactttgtgcggttcgtcagttgctgtctgttagcgtgtaagccccatgtgggcagggaccacatgcattgctctgcgctcatccaagcacctcatctaagaatactcaatatgtattattttgtggtgtttcctattttgaaatatgtgttggccgtgtacag

SEQ ID NO: 24885 - DNA, 318 bp, Homo sapiens
tgctgcatactagcagtcccagctgtgtgacctcaggcagatcacttaccctctctgagtctcagccatttcttctctgtgaaatgggagtactgatcactgcctttacaggactgtcatgatgcccaggtgaaactggctctgaagtcttcagatagacctgtggggctggctgcagggtccttgctggatccacctctcctaacccctctggcctcttctgccccaaacactgtgctaagggtggggctgtgtattagtccattttcacgctgctgacaaagacatacacgagactggataatttacaaaaaaaaa

SEQ ID NO: 24886 - DNA, 385 bp, Homo sapiens
ccattagcaagttgcttttatttttatgtaataaaatgatggcaaaatatataacgtatttgaaggcatttgcataagtaatcttgaaggcatttgcataagaagcatcgctgagaatctggaagttaaaggaaataaaaaagctgagaatctatctggaagttaaaggaaataaaaaaggtcacagattctacaaattcacacaacttacttgtagaacaaaccctcaggtcctctgtcagagcctatttactctaattttagcacatttcaaatgggcgtggtagtgtttaaatggtttcccagcccacagtaagtcagaggtagcaaattagataagagatggaggaagcactctgaggcttcaagaagtgacagctgacag

SEQ ID NO: 24887 - DNA, 120 bp, Homo sapiens
tctttgaggatggggtggcctgccaggcctaaggagaggatcccggggataccatgtggtgccttgttttgtactttgcaggtttctgcatattctcacatcagtgccatgggtcttaag

SEQ ID NO: 24888 - DNA, 639 bp, Homo sapiens
gtttttctatgttaatacatacaaccctccatctgagatttttaataacaatatagtgtttcattgattgcatgtgacatactttaagcaatatcctcctgatgaacatttatttccattttgtcaatattataataataactgagatgaacatcattgtacatacatgtatgcccttgcctgcagatttcctttagatgaaaatcttagcatggtattttgaggtcacattttacttagtgatatatactgacaagtggccttctacgaatgtcctatcaattgacatattcaccaacagtgagaagcgagcccatttctctcaccaacatttaatactggtgttttcatctatgcccattgtataggtgactaataatattaccatgtgcttatttgcatttctttgattactgatgaggtacaatatagttattatctagagctaaattgcctaaatttgaatcctagttccactggttcaaagttacttaacctcatggtgcctcagtttcctcaactgcaaagcaaggataataatagtatctaccatatgagttactgggaaaattaaattgtctaatacctatgaagtgctcacaaccatgccaataaacagtgctaccattaatattttaa

SEQ ID NO: 24889 - DNA, 375 bp, Homo sapiens
aaatatttaaagaagaattaatgccaattattcacaactcttccaaaaaatagaagaggaggaaacatgtcccaactcattctacagggtcactatgaccctgatggcaaatccagacaacgatcacaaggaaggaaaactgtaggtcaatgtcttttatgaatacatacacaaaatccttaacaaaatactagcaaaccaaatacagcaacatttaaaacataaccaagtgtgatttatcttaggaatgcaaggttggtttgacattgaacagtctattaatataatatgctacaccaaaagaataaaggtgattgtatcagtagacacagaaaaagtatttgacaaaacctgacaatctttcatgataaacac

SEQ ID NO: 24890 - DNA, 284 bp, Homo sapiens
ggattaacccaaattaaggatggggaagccagaaaaggcttcctgggaaaggttgaatctagagagagctgtaagttgttgaggtgaaagaacaggagaggaggaatatgtggtcaattatagaatctatatatagagagggagcttattaaaaatattgttcttggccaggcgcgatggctcacgcctctaatcccagcactttgggaggccaaggcgggtggatcacgaggtcaggagatcgagaccatcctggctaacatggtgaaaccctgtcgtcgacg

SEQ ID NO: 24891 - DNA, 145 bp, Homo sapiens
agtaatcttttcaatgagggaataaatgaatgaagcagcccaaattaatgattaggccaaattaaagatatgtgggcctcagttttgatctggcaatcatttcattttgttgaacacatccctgaaactctcttggggccacttt

SEQ ID NO: 24892 - DNA, 603 bp, Homo sapiens
tagggtagactttctgggtcatattatagccctgtgtttaacattttgaggaactgccaaattgtttttcaaaaatggctgtaccattttacatttccaccagagttcaagtttcttcatcttgttctctcttaagccaactttaatcaggtttttcctctatttcccaaacttcttagctgaacgtgcccttgacaaggtcattagtaacatcaaagtgcctaaattcaacagtcagttcacagtcctcattttgtttgacctatgcccagcatttgacacaattattcattcctccgtaatacactttattcacttttggcttccaggatactgcatgttgtgtgcagctccccctgtcccccaaccccacacacacattttattggtcaatccttgtcagtttcctttgttatttactcctttctctcctgcctttaaaaattggcgtgtccattggagatctttatctagacttacacatctttaagtactatccttgaactggctcccaagttgatatctctaacctagatcttcttctttttgtccttccgagccatgtgtccagctgcctgcccaccaggatgttagacattttaa

SEQ ID NO: 24893 - DNA, 655 bp, Homo sapiens
gtttctaggctccagggttgggcctactgacatggtcccagaaggccaaaggggttttgcttgtggaagaatgggagatccagtcgtcttctcagtatgttacaacaacaggtaaagcaaggcttccactgatccttgcttgctgtgttgttgggttgacactgggatggcatgggaacctcattttccacaacatgaccaaattctggagcaaaatgataataaaaccactcctccaagctgtgcatgagccaaatctggctgaggcattaataattgttctaataattgtttttacatttttaaagtgttataaaaagaagaagaagaaacaacaaaaaactatacaatagagatagtttatggcccacaattcctacaatattttcgcactttgccaaaaaagcttcccagcccctattcttaactccagtttacagaggagacaactgaggctcagagaggaaaagcaactggcctgaggtcacacagctgagtactggtagagctgggactagacccaggtctgtctggcccacatcagagctttgtccatcacagaaggcagctgggctgggtgcagtggctcacacctgtaatcccagcactttgggaggccaaggtgggtggatcatctgaggtcaggagatcgaga

SEQ ID NO: 24894 - DNA, 371 bp, Homo sapiens
ctttattcatttatcaataaatgtattcatgtatttgttagtgctaaagtctctttaagagctgcatggtttttccactgttgatgtactataatttatttatccaaagccctattgataggttttttggttgttttccagatttttttctactggactcttacagtgagcatccttgtattttagttagtatgagcactggtatgtggatttttctagttttgattcctagaagtggaatagctgtagctgaatcaaagagtattttacatttacaagttttaacaatattaaattactcattcaagtttgtgccaatttagacaactgccaatagtgaacaaaaggccatactgcttctgcctggaata

SEQ ID NO: 24895 - DNA, 335 bp, Homo sapiens
acaatcagagggcctgcctggacatagaaatcagggagagattatatcgtttacttcaatgatagctctgtaactttcaaaaggaaactatgtttatattgctggtattttgagagattactttgtcagtgaaatccattgagaaataggtatcggaggaaaacagaaatcatttttatcctgataaggctgttataaggatatgccatatattctggcaacaataggtttgcagaatgatatagaatcagttaccctccctgtctcaggcagaggtggaaaaacagaggggttcctggtagaggcttgtctctctaatactaccccatggagta

SEQ ID NO: 24896 - DNA, 625 bp, Homo sapiens
gaaagtgacttagaaatcagcctggagtccctagagcaggtctaacaatgaggctaggctccgtgattggtctttatccatgagccttgggtctctctgcacgactagaacgctaatcagagaaataacaacaacgtatttcaggagatggggtgagagggaaggtggataaaaataggcagcccagtttcacaaaggcttggttttgctttacaaatctgacagtgttttgagaaaggaacacagaacattgccagaaggagcctatgattgaggtgaacctcacgaatgtctttgaaaacctgactctaaccaaaaagtatgagggagggagagttctggctgctgtagacgacactacctcatgaaagtgacttagaaatcagcctggagtccctagagcaggtctaacaatgagggaggcaagattaaaatggagaaagaagcctgctaggggttgcatgagctggttgagttcaccaagccagattttccaacgcaacattttatgtgtgtgtgcttgtattcgtttatctggggagagaatgaataactttccatcagattttcagaggaacctgtgaacccttcccctgcctactccctgctcccaattaaaaactac

SEQ ID NO: 24897 - DNA, 330 bp, Homo sapiens
gtccatttatgtaatgcagtaagtagtagtaaaagtatgtgcttaacaactgacatcaaataaatgaatactgtgtgtcttgggaagtgagagaactctaaattaggcattggcaaacttttttggtaaagggtcagaccatctcttgtaattattcacctctgccactgtaccatgaaagtagcccttgatgacatttaaatgggttgatgtccatgtgttccaataaaactttatttacataaacaagagctgggctggatttgagctctagtttactgatttctgttttcagttttcatttttatcctggactgacaaaagctgtga

SEQ ID NO: 24898 - DNA, 548 bp, Homo sapiens
gctcatagacccagcatggtagagcagtgagttgatgattagactggaggtacacagggagtgcagggaaggggacagcccagccatcctgtgcagggcgcagcgacgtccccgtgaagcagcatcacaagccaggtgctgaggaatgaggggaattgtgagatgttggcaagaggagaggtggttcagtaggtggcaggagcatatgctggcatcaccaagtggctaaatgggtttattcaggcagccaggcacccgaaggagatggacctatcaaatgtcatcatggccttgctgtgtcgtgaggccaccgtgcaaatgaatgaggccagaggaagcatccacagacacctgcaggagagcaggcaggcatacagtagcgcctagcagcaacttgcagccattgaccctctcactagatgggctccaagtatccatccctcagaaatttcaataattgtgaccatcggtttacttcaagatttatttttgtcttgacctgaaccattgttcaaaatgtgccttgagaaactgttaattggaatttg

SEQ ID NO: 24899 - DNA, 471 bp, Homo sapiens
tttttttctgcacggaggttttgccagtggactggacaggggtatgagtgaaagctaggagtcaaggatgactcctacatgcttaaaacgagcaaatagaaggatggaattactattcgctgaaattgtgaagactgaatgtgggtggagcagatttaatggaaaaagcaggcgttcatcaaggcacgttacaaactaccatgtaaaagcgatatatctaggttttatgcaagaatttcgcaaaatgagggaatgggaactagttctgaactgaaggattttgttagagcatgttttgggaggggataggattaatagaaataagtaaatgaataaatgattactgataactagttgtaatatattagctcttccaagcaattagattatgctaagaaacatttaaaaaatatatagcccaaaggactgaatctaattgtgggatttcaaacaatacatggtatggtggta

SEQ ID NO: 24900 - DNA, 460 bp, Homo sapiens
ccgttctctgtattcttgtccagatgctgtggacagtgatgatgggaaaatagtccctgctgcacactagggcctgttaggagatttgagggctagaggagcacaaggggccagactgctgctacttctgaattttataggacatgcatttttttcatataaacttagaactagcacgcctaattttttttttatttttattttttttgaggcagagtctcactttgtcacctaggcgggaatgcagtggcacagtctcggcttactgcaacctctacctcctgggttcaagcaattctcctgccttagcctccctagtagctgggactacagacatctgccaccatggactggctaatttttttttttattaggagacagggttttcaccatgttgggccaggctggtctcaaactcctgacctcaagtgatctgcccgcctcagcctcctaaagtgct

SEQ ID NO: 24901 - DNA, 789 bp, Homo sapiens
ccataatcttgccttgacccagaaacattgtgttcacaggactttcagcttcccacccccataagtaagcttcctaattatgatatcttggtcttgccaagcatttagagggccttactctgtggccctccagatagtgatttgaatgattaagtaaacctctttttagataagtgttctagtccagtctaacatcagcttgttggtctttttggcactgtcattgtccagtaccagcacattcttggctccttgccacatctctggcctcaatgtgggaggcaaagacagtgagcatttccagagtggtgagatgggtgcagcacataatgaggcgatgaccacacagcatctctgaacagcatgtccacacagggctcgaagtcattatgctgcatgtccacctcatgtccacaatagctgagcagttgagattggtggagtggaccttctcattactcatcatctagaggaaggtcctcatcatctctacttctcaaaggggtagaattgaacctgaacctgcttgacagacaagagcccaagcctaaccaaggtggctgccatggtgacccttgccctgaaagccatttccattaatttaaaaattgtaggtatataggaactataataacaggcttaaaattaaaatttgctctgtttgttgggtcacacgtgtaatcccaatactttgggaggctaagccgggacgatcacttgagctcagaagtttgagactagcctgggcaacatagtgagatcccggtctctaccaaaaaaaaaaaaaaa

SEQ ID NO: 24902 - DNA, 280 bp, Homo sapiens
tgatcaatttggttgttaatgctcccactgagttttttatttcattctttatattctttagccccagaatttgtttgatatttaaaattatttccatttccttgttaattttcttattttgttcacctattgccttccttatttccttgtttctctgaattttcttgaaatttgccaagtccttaaaacagttatataattagaatactgaaataattagaatattcaaatagacacatgcattgtatgcttattgtgcatacatcttcgccaacaattt

SEQ ID NO: 24903 - DNA, 228 bp, Homo sapiens
aaaacatataaaccacagccaccctgttctgcctaggataatgaagttatgacatcatagaccgagcacatcatccaatctttgctccttccctctggaccaatggctagtggaattttcccaacaattaaagctatcactggtaagggagcatttgtttgggtttggggtttttgatttttaaaaaatttccaatctgtcatgaaccaaaatctgtaccaaatataa

SEQ ID NO: 24904 - DNA, 452 bp, Homo sapiens
tttcttcctttttttaagacagggtctttgtcacccaggttggagtgcagcgatgcaatcatagctcactgtaaactcaaacgccccagttcaaatgacccacctcagcctccaagtagctgggactacaggcatgcgccaccacacccagctaattttttttttttttaagagatggggtcttgccatgttgcccaggctggtctcaaacacctgccctcaatccctcaagatatcctcccacgtcagcatcccaaagtgctgagattacagtcatgagccactgtgcccagctatatccctgtttcttgaccaaggagaaattagccattcttgaatcaggaggacattgctatcagagacctcaaatggagaatactgaggaatcatccagaagcagaaaactgcaggaaggggacaacttccactgaagaccataggaacaagctaac

SEQ ID NO: 24905 - DNA, 172 bp, Homo sapiens
tgaattcctaattttgtaggctatgccacttttaagacataagtgcctaaaaggatgaaaagtaatagaaagtagaatggggaagtggaaacactggaatcaccccttgcactgaacgcatagtaatttttaatgatcacagagtggctcttcgttgtaattagtgtaattt

SEQ ID NO: 24906 - DNA, 587 bp, Homo sapiens
ggaattcatccaaaaaggattataaaacaccaaacaaattaaaaagtgggataattattaattctagggaaacagccatttgtttcagaaaagaaagtcattgtagtgtactatgtagtatgctgtaaacaacaaaatttccatctaaatagtaaaagaaattgattaaataataacaaaaatatgatataactaaattgaaaaatgtaagcaaggatgaagtaaaatatgttggtgagcaaggctatgataaaagctgagtcctcatcatccaaggtagaatatcaaaacttactgtctctaaattttttaaaaagataaaaatacatttaaaaacagaggcaaaattagaagaaataatttgaagagctgaaaaagttgtatgaaaaagtgtcatctgtgtataggaaaggctggggcaggagaccttgatcattctttatcagccttgacttttttaaataaaaatttttaaaaagcaggtgatgcttctggaaacctcggtgaagaatgatttatttcagaatgtataacactaaagcagaagttcattcttaatgtgttctcctattatatagaagtattta

SEQ ID NO: 24907 - DNA, 379 bp, Homo sapiens
agaccatattggatgtggccttaactcccatcattagtccttgtcctgaactcagtagaaagctctcttctgtcagagtaattggctgagacttagaacagaacctgaagtttaagacaacaaactctaaaataattgtggaattacagttcccatagaatataggaaatgcgaggcaaagtaatgaagtctttaattggatgggattgtgaattattctaccctctgcatcctgggcaggaatggcaagacagtagtaggactggctcttatcactgaaagttcacctatatacagaacctctcatttcccaattccatgtttctggaactgcatacaaaattttgttctctgcaagatttgaacaaactaagctaaa

SEQ ID NO: 24908 - DNA, 1111 bp, Homo sapiens
gcagactcggacttctgagcctgcagagcaggacctgggacaggaaagagaggaaccaataccttcaaggctcttcttcctcaccgagcatgcttccctaggatcccgtcttccagagaacctgtgggctgactgccctccgaagagagttctggatgtctggctcaaagcagcaggactgtgggaaagagcctaacatctccatggggaggcctcaccccagggacagggccctggagctcagggtccttgtttctgccctgccagctgcagcctggttggcagcatctgctccatcggggcagggggtatgcagagcttgtggtggggcaggaacggtggaggcagaggtgacagttcccagagtgggctttggtggccagggaggcagcctagcctatgtctggcagatgagggctggctgccgttttctgggctgatgggtgccctttcctggcagtctcagtccaaaagtgttgactgtgtcattagtcctttgtctaagtagggccagggcaccgtaattcctctcccaggtgtttgtggggctggaaggacctgctcccacaggggccatgtcctctcttaataggtggcactaccccaaacccatcttttgttctcctatatcctccttctcctgttccatttcagttcagtttcagcggtgccaacctctttgcgtttcctttttgttgatgaggacccagagctgctgcacacactcacctctaaccccctcccctcgctgctgggccccatctccacaggagagactggttcggctctagggcctcagtctggagtgggataggagcagtgagtgacaaagcctctgaaagatgcatcatctcttcctcacacccatttagtggggggatgggtcctctagacttgaggggctacctggggaagctgcctagcttcagccagggcaagaaagcttccttcaacctgcatagccggtgggtgaggagattcccaccttccatagcctccaaacatgttcccaaggccccactttcaagaatcagacagcaggaagccatagatgctggctgggttccaggttatggggagaagaaatacagtcaataaaaggtttttgtat

SEQ ID NO: 24909 - DNA, 774 bp, Homo sapiens
gaggggcgggacccaactgattgtcaaaggcggcagattgtagtttttgttttggccggaaaggcttaccatgagttgccagggctgagagagatggagaaggattcgcggcggtgacagattaaattccccagttacattatagacttggagacttgtccttgtgtggacgggagccggaaagccttgagaacttattcctcgacccggacatggcacaggagaaaatgaaactaggtttcaagtcgctgccgagttccactaccgcagacggcaacattctgagaagagtcaacagtgcccctttgatcaatggacttggttttaattcacaggtgttgcaagctgacatgttaagaattaggacaaacagaacaacatttaggaatcgacgctctctggaaattacttcacccacttctgttgaacagaagcccaaagacctcttctgaccttgagactatgccttctcccaaatcgcccctttgctttatctcctaagaactctgaagttgccatgcctgttcctttctctcccaccaggaattctggcacttctgctcaagccggatgtcactgcgtcacttctccatccccaccccctcctcttccaaaggaagcaggggaaatgtctcatcttcctaagagaaaaggttgtgcttttcttgagcaattcatctgttctaattttaggcctactgacatctgtctcattaggttttgcttttcctattggcaaccacaaaccccaaatctagtgtatggcccacaaag

SEQ ID NO: 24910 - DNA, 766 bp, Homo sapiens
tggtgcgcgaccaacttgatggttcaaggccgcaatggtagttgggttgggcggaaaggctacatggagttgcaggactgagagagattgagaaggactcgcgcgttgaaagaataatccccaaggtccttatgacctttggagaacttgtccttgtgtggacgggagccggaaagccttgagaacttattcctcgacccggacatggcacaggagaaaatgaaactaggtttcaagtcgctgccgagttccactaccgcagacggcaacattctgagaagagtcaacagtgcccctttgatcaatggacttggttttaattcacaggtgttgcaagctgacatgttaagaattaggacaaacagaacaacatttaggaatcgacgctctctggaaattacttcacccacttctgttgaacagaagcccaaagacctcttctgaccttgagactatgccttctcccaaatcgcccctttgctttatctcctaagaactctgaagttgccatgcctgttcctttctctcccaccaggaattctggcacttctgctcaagccggatgtcactgcgtcacttctccatccccaccccctcctcttccaaaggaagcaggggaaatgtctcatcttcctaagagaaaaggttgtgcttttcttgagcaattcatctgttctaattttaggcctactgacatctgtctcattaggttttgcttttcctattggcaaccacaaaccccaaatctagtgtatggcccacaaag

SEQ ID NO: 24911 - DNA, 479 bp, Homo sapiens
tgcttccaaatcttaggtattgtaaacagtgctgcaataaacatgggaatgtagatatctcttctatatgctgatttcctttttggtgggtgatataccttggagtgagattgctggatcatatggtaactctatttttcattttttgaggaacctccaaacttgaacaacatggatttgaatggcgtgtgatgtgaaaccctcctatacgtatgggtgactttttgtatcctcgggttccagaaggcccactgtggacttgaggatgtgtggattttggtattgcagtgggggggtgctggaaccaattccccacatataccaagggatgactgtaagtaattatgcataatgccaagagtactgcattaaaaaaaatctttttaaatggaaaatttaaaacatggaatatagaatcttcatgtacctaacaccctgccaaatccccctctgcgagaaacacgcaagaatgatcaata

SEQ ID NO: 24912 - DNA, 479 bp, Homo sapiens
gaggggcgggacccaactgattgtcaaaggcggcagattgtagtttttgttttggccggaaaggcttaccatgagttgccagggctgagagagatggagaaggattcgcggcggtgacagattaaattccccagttacattatagacttggagacttgtccttgtgtggacgggagccggaaagccttgagaacttattcctcgacccggacatggcacaggagaaaatgaaactaggtttcaagtcgctgccgagttccactaccgcagacggcaacattctgagaagagtcaacagtgcccctttgatcaatggacttggctgctttgtcacctctgaccttcacctccagccgcttgaatggaaatggttgtcaagcaaataagctttggacttttttacatttttttttttgtctttttttgagacggagtcttgctctgtcgcccaggctggagtgcattggcacgatctcagc

SEQ ID NO: 24913 - DNA, 985 bp, Homo sapiens
gaggggcgggacccaactgattgtcaaaggcggcagattgtagtttttgttttggccggaaaggcttaccatgagttgccagggctgagagagatggagaaggattcgcggcggtgacagattaaattccccagttacattatagacttggaggtgggggatcttctcatcgttagaggccccgatcatgggagataggcggttcggagccagttctgcctaactttgtgttcactgatgttagggctgctagggctgcaaaggtgggcacccctactcgcctaagagctttctcctctcttctctttttcccctttgcctctctccttacatcacctgcccactaagtagacttgtccttgtgtggacgggagccggaaagccttgagaacttattcctcgacccggacatggcacaggagaaaatgaaactaggtttcaagtcgctgccgagttccactaccgcagacggcaacattctgagaagagtcaacagtgcccctttgatcaatggacttggttttaattcacaggtgttgcaagctgacatgttaagaattaggacaaacagaacaacatttaggaatcgacgctctctgttgttgccacctcctccctttcatggttccatcagccgccttcatcaaatcaaacaggaacctccaaacttgaacaacatggatttgaatggcgtgtgatgtgaaaccctcctatacgtatgggtgactttttgtatcctcgggttccagaaggcccactgtggacttgaggatgtgtggattttggtattgcagtgggggggtgctggaaccaattccccacatataccaagggatgactgtaagtaattatgcataatgccaagagtactgcattaaaaaaaatctttttaaatggaaaatttaaaacatggaatatagaatcttcatgtacctaacaccctgccaaatccccctctgcgagaaacacgcaagaatgatcaata

SEQ ID NO: 24914 - DNA, 800 bp, Homo sapiens
gaggggcgggacccaactgattgtcaaaggcggcagattgtagtttttgttttggccggaaaggcttaccatgagttgccagggctgagagagatggagaaggattcgcggcggtgacagattaaattccccagttacattatagacttggaggtgggggatcttctcatcgttagaggccccgatcatgggagataggcggttcggagccagttctgcctaactttgtgttcactgatgttagggctgctagggctgcaaaggtgggcacccctactcgcctaagagctttctcctctcttctctttttcccctttgcctctctccttacatcacctgcccactaagtagacttgtccttgtgtggacgggagccggaaagccttgagaacttattcctcgacccggacatggcacaggagaaaatgaaactaggtttcaagtcgctgccgagttccactaccgcagacggcaacattctgagaagagtcaacagtgcccctttgatcaatggacttggttttaattcacaggtgttgcaagctgacatgttaagaattaggacaaacagaacaacatttaggaatcgacgctctctgttgttgccacctcctccctttcatggttccatcagccgccttcatcaaatcaaacaggtaagaagactttccaaactgacagctgttcatttaaaaaagtaaattttatttttctttgtgaaaatacctatgtttcagtaattctaagtgaggtcacgtgtaatattaagtttttatttctaggaatgatttcttcaaaaa

SEQ ID NO: 24915 - DNA, 313 bp, Homo sapiens
cattgtaaaaaaaaaaaaaaaaaaaaaaactgttccctcacaattattttgtttaattaagtgcaaatattttcttcacttctctcaggaaattacttcacccacttctgttgaacagaagcccaaagacctcttctgaccttgagactatgccttctcccaaatcgcccctttgctttatctcctaagaactctgaagttgccatgcctgttcctttctctcccaccaggaattctggcacttctgctcaagccggatgtcactgcgtcacttctccatccccaccccctcctcttccaaaggaagcagggg

SEQ ID NO: 24916 - DNA, 1375 bp, Homo sapiens
gaggggcgggacccaactgattgtcaaaggcggcagattgtagtttttgttttggccggaaaggcttaccatgagttgccagggctgagagagatggagaaggattcgcggcggtgacagattaaattccccagttacattatagacttggaggtgggggatcttctcatcgttagaggccccgatcatgggagataggcggttcggagccagttctgcctaactttgtgttcactgatgttagggctgctagggctgcaaaggtgggcacccctactcgcctaagagctttctcctctcttctctttttcccctttgcctctctccttacatcacctgcccactaagtagacttgtccttgtgtggacgggagccggaaagccttgagaacttattcctcgacccggacatggcacaggagaaaatgaaactaggtttcaagtcgctgccgagttccactaccgcagacggcaacattctgagaagagtcaacagtgcccctttgatcaatggacttggttttaattcacaggtgttgcaagctgacatgttaagaattaggacaaacagaacaacatttaggaatcgacgctctctgttgttgccacctcctccctttcatggttccatcagccgccttcatcaaatcaaacaggaagaagccatggatttaataaatagagaaacaatgtctgaatggaagctacaaagtgagatacagataagtcactcttgggaagaaggcttgaaactggtgaaatggcatttcaatatcaaccaaaaaagattttccaaggcacaaccaacatgctttcttctgatacttcccaactgtcagaaaataatgtgtatctacttccagctacttttgatggaaacgacagcaatgctggatcttctggtaattcgtcagctgaaatcggcactgtcacaaactctcctgtgtcaccttctgatactggttctcatttgttctagtagacaaactttcaactaaatgattcacccatcccaagactttctcaccagtggagaaacacacacatcaagcaaaccaagtcagagcaatgagaattgtactgtataatttaaactatctcctatttatcttttttcctcaatttcctaaaattctatttatctacagaacttgcgtgtataattcttgtgtacatccttaaatttaatgtaataacatgttaaagatgttttccaaatcagaaccatgttgaagatacaagcgtaaattgttaggctgctattttctagaaaatgctgtaccttgactttttaaaataatcttatgaaacataattctgataaaatataattgttcaattaacaaagtaaaatgatgtttgacaattatgtact

SEQ ID NO: 24917 - DNA, 744 bp, Homo sapiens
gacgcaccctgtcaggggttgtgagaaagctgcagtgtccagtttcccacccctgtttcctgctgtctctctcccactcatccctgtttcttactcatcccttttccttctttgcccaaacatcatatttctaggcaaagataagagaggagatagtgatgtcctgaaaggggttcagaacaacgtagcatggcctttggtgaaagcgtcaccgatgggaaataattgagaattgtgcagtgcttgcagcgtcagaatcagcactgttttttgtgttggtgaaaatattccatgtgcgtaaagggagagcatcagggactttgcaaattcttcacaaggacccagaaatagcttaaagattcatggttttcctgttggcttaaatagccttaatctttcattttctactaccattaagtcggggaaatgacattgaactacctcattagcagccttcccttgattaactactgactaaaagtgtgctgaaaatggcctttgtttttgtgaagctcatcctatacactaacatttgcttaaccatggattattttgtctctacaaagctgtgccctgtattcgatttttacttcaatgagtggttattgctagaattcctacaaaaaaaaaaaaaaccgttgcagatatttttgtatgtagcttaatagatatttagtttaaggagactgcaacatttgcataaggtgcctaaaaactcaagaaccattgataagtgagatcact

SEQ ID NO: 24918 - DNA, 318 bp, Homo sapiens
aataatgatagacttaaaatatcaccattttgaaacccctaatgaattaatggatctaggttgattatccatggctgcttacatcacaaaagacaaacagctattaaatgccttttgatactagaccataagaccacctatcaaatagtcttacaaataagtaaacttgaatgtgatctgaactctagatccaaccaccataacaggaaatacagaggatggggacatcatggcaaatggtaaatgacacctaggggatgcaatcagcaaaatccaggccatggaaaactccagggcaaatgacttcatttttttcaa

SEQ ID NO: 24919 - DNA, 633 bp, Homo sapiens
gtaattaagttactaatcatttgactttagtttaaaaaggagacctaggtgtgcctattctaattacatgagctgttttaaaaacataaagttttctctggctcaaagcagaactgcaagtcagagcaatttgaaagatgagaaggacttttcctgttgctggcttgaagatggacggggccatgtgagaagaaatgtgagaggtcttgagctaagagaggcttgtggttaacaacccatcagaaacggggacctcagtcctataccttaagggaactgaattctgccaacaaccaaacgagcctgtaagcagattcttttccagacaagaacccagcctggctggcaccttgattttggccttgagagatcagaccccaagcagagaacccagtcagctccacctaaacttctgacctacagaactgaaaaattttaaataaatgttgttttttagcctctaagttggtagtggtttgttatatggcaatagaaaattgatatgcaaggccacttggcaaccatgtgaataaatgctatggaagaaatggaaatctcatgagtgaaaaaaacaaaataaaaattataggtacaacctgataatagtcatatgaaacattcacatgggaaaag

SEQ ID NO: 24920 - DNA, 492 bp, Homo sapiens
gaatacagccctgtcaacactgtgattttagcccaatgagattaaattctgatttttgaccttccaaaactataagatagatttacattgtttaaaccattaaatttgtggtaatttgttacagcagtgataggaaattaatataggccccaagtgagaactacccagtagagcccagtcgactcatagaaacatgagaaataatttttaaaaatgaagtttgaaccactaagttttactgcatagcaatagataactggaatagcaaggaagttaccaagtctattaggctatctgaatagaattcataagccaaactgaaaaggtttccattaggcaaagggggaataaatggagcatcaataaggataacactttaatagagtaaatgatcaaatacatttaaattcataacttcataaagatacaacaaaattgatcacctttgcaggatgtcaaagaataaattcattatttgtaaaactgttaggt

SEQ ID NO: 24921 - DNA, 2272 bp, Homo sapiens
aatgatgtttcagtagagagtggacagagctgtgcagatacctcaggaaaacccaattttatctatttattttactggagtgctgtagtctgaatgtttgtgtcctatcaaaattcatatgttcaaatcctgacccccaaggtgatgatattaagaggcaggacctttgggaggtgattaggcagagacctcatgaatgagattagtgcctttataaaagaggcctgggggagctcagtcacatcatgtgatgacagagcaagaaggcaccatctacaaaccaggtcctcaccagacagcaaatctgccggcaccttgatcttcgacttcctagtctccagaagtatgagaaatttctgttttttataaacaatctggtttatggttttttgttttgttttgttttgtttttgacagagtgtcgctctgtcatctgggccagaatgcagtggcgcgatctcggctcactgcaacctccacctcccaggttcaagcagttctcctgcctcagcctcccaagtagctgggattacaggtgcctgccatgacgcccagctaattttctcgtctttttagtaaagacggggtttcaccatgttggtgaggctggtttcgaactcctgacctcaagtgatccacccgccttggcctcccaaagtgctaggattactggcgtgagccaccacgcctggccagttttatggtattctgtaattgcagcccaaactgactaagacgtgaagtttaggtaaacatttgcagtttgctatgctgatattgaagtattatctgttggtaaatattctttgctgatacttaataagtattcttattaataacaagtattaataatatgtattcctcactaatgcttaatacaaatccttactaatagcagtattagtattaattagtattaatcagtattctttgccaataagggttctgacagaaaatcagttgttcattaaatattattgagatacttcttgatcttatagtagacaggtactgttttagattctggggattcagtcgtaactgagatagatgtaatccctaccctcaaagggttgccagagaaaacacaggactcaattgaattggaatttcagataaaaaacacataatttttagtataaatatgtttatgtgatacttatactgaatataccatgtgatatttggaatatacttatactaaaatgtacactaaatgtgttgataacctgaaatccaaatttaactgggcttcctatgtttttatttgctgagtctggcaattctatgccctcactacgcttataagctaacatgctggaagcagagatttgtaaatacaaatagcatacagtgaacaatgctgtataacctggggagccataaattagaaggcactgggaccctaaatgtatggagaaaaactgtcagccaaccaggaacatccacccttaaagcaagaaataaacttctgtcgtatttgagccattatgttttggaaccatttgtgccatggtctatttgttatgccagcttaacctaactaacaatatgtcctgaaatctactatcatttccaaatttactacagaatcaaaagttttaatataatataccaacaactaataaaatatatgtaaataaaggcaacaggaagatggggcaaaccctaaaaatgcttatgctgtagtcatcattctattaacaatatagctttaaacctaagtattttcaaaatggtcatgagggacatcagatcattttaggaaaattacataactcgatggcttccctaagcaactaatactacacatttatacattattcctggcgattaaaacattttctttcagctaattatcgaatgtaaagacaggttttgtaggctctaaaattttaattaagacatggtttttgccttcagaaagtatatggcctaatagaggaaataaggatacaaaatactagcagaatatgatcagtgccaaaagatatgtgcaaattatatctctaattggagtgagaaattcattcagattagaggggattaaaaagaagctgaatgaggaagcattttttccctcaaagctttacaattttctgtcttttgaatttaaaagtagagcttattgtcaagaatttgcaaaatacaaatagagaaaaacaaatatcacttctaatctcactacccagagatagccactaataacatttttgtatgtattccctcctttatgttttaaataaaattggggtcttattatctattcttt

SEQ ID NO: 24922 - DNA, 476 bp, Homo sapiens
ctgtatgccttcagtcctgggacgctgatctgcttaattctgcctcattagaaaggggccacctgctggatttgttactgagccttttgtgttctaccttggtgctgtgggagaagctgagtggcctggagaagagctagggagtgggcttatgggtgagtacctgagcctgaggctgaacctggctttgacttgcaattctttcagtaggtgagggttgccaaaactttaatgtgatccagttcacctggaagatcttattaaagttcagctttggttttaatagtgtggggtggaggtctggaatcttgcctttctgacagctgccaggcattgttaaggtagctggttcttggaccacactttgagtagcagcaaggaatcaggcaatgggttcttcttcagtagttcttccatgcatagatctaaaagagtcagggtttccacacttttgtgtggatcccagatgggcaggg

SEQ ID NO: 24923 - DNA, 765 bp, Homo sapiens
ctctctcaggcgcctaaaccacattgaggtgctccttcctctgtgtgtgtttgtacctcatgtacacttcgggtctagctcatttcactcttactgtaattctttgaaaatctctctaaattataagctgtttgactcaatgattgtagcgacacatatttgtaacaccattgtctgaggtaattcctggcatgtgtaggtggtcacccctccataaacactgaataaatttttaaacgtatttctctatgcttttcaaggagtttcctctatactttctcactgtacctcatcactaagaaggaaataggaccagtgttattggccttcttttacagagaaagaaactaatgcttaggaaacttgagtggtttaaaggcacggcgctcagtttttggaagggccaaactttcagatcttctgactgaagtgtcttaatgtgtggggaagctctttgtcttataaactgtaaaataccgtaataattgaggtctgcgcaggccccaacctatccatggtttggggctgctatctgcctcataaagcaaagtggagggtttgtcttttggaaaaacaaagtcgttttctcctctgaaaaagcctcctacatagttggttttgccatttgccaagaataagagggcacagattgaggcctcttgagtatgggttttcagttgaggttgaagagagaagacagggattgtaaccagaaaattcagaatggaatgcagttccctccagaactcctgggcttcatgacag

SEQ ID NO: 24924 - DNA, 431 bp, Homo sapiens
aatgcccaatactttgacgaacttctgagactgatagactaaagaagggaatggggaatatgcaataaaaggattttataaaagtgaagctacagggctctgatttatataataggactaaggcttaggcatataaaaatgattaatcggctgggctcacgcctgcaatcccagcagtttgggaggcggaggcgggtggatcacctgaggtcaggagttcgagaccaacctggccaacatggtgaaaccccatctctactaaaaatacaaaaatttgccggacgtggtggcgggcacctgtaatcccagctactcgggaggctgaggcacgagaatcgcttaaaacaggaggcagaggtttgcagtgagccaaggtcatgtatgccattgcactccagcatgggcaaaagagtgagactcggtctcaaaaa

SEQ ID NO: 24925 - DNA, 794 bp, Homo sapiens
aatcatgtcactgcactccagcctgggagacagaggggaaactgtctcaaatataaataaaaataaataaataaataaatactaattaaaaaaataaaccaaacaaatcaaagaaatgcagagagcaagaatttggcagtgtctgtcaaatatcaccacgcacacaccattttatattctactcccttataccctctacctcattccattcatattaatttgcattttcaatatttttcacttctccctattttgagtgggttcccagtttctctcaatgggagaaagtacatcttccattgctttcctgggactggggatttttcccaggcaaaatttaccagcaatagagtcaaagcctcctcttgggttttgtaaaaatcccaaggcccttgaagagaattatgaagagtttcctggaggaaagagaagagggcaaatactttctttctttctttctttctttttaacttttggagagaaatggtaattctctccagaaattcccctggatggagaaagggggagccacagggaatctcacactgctcagcagcagtttccgggaagcatcagcagaggctggctgcatgttgtatctaagggctaggatctcagcaccaggggcccagtctcagcgaagattcctgaacctgagcactgggtgtgtggaaggagaatgctgctggcttttaagggaccataggctgggtccatgacctcattgccattctcaatttatagagacagaattgaaagctaattcagttttctagcttggctgatccaaaaaa

SEQ ID NO: 24926 - DNA, 304 bp, Homo sapiens
gcagatcgaccgccacctgctggtgggacgtggcccgctggggagaccccgctctgccccgaattccgcctctgcagtcgccctccgatttgcagtcagccctggggagggtgggggaaacgaggtggacccgaaccccgaagaaggggaggagggcgcaggcccactggcgggtggagcgtttcccaaggaggagcaggagatgctgaagacatatctcaagactcaagatctggccaaggacccgcgctcccccaaagcaaagcagtgttttgagaagaaaaataataataataaagctttg

SEQ ID NO: 24927 - DNA, 378 bp, Homo sapiens
atcttcactgaggtgtcctgacccttccttctctgtcagagattcctgttgctttgctcagtttccctctcctgggaggtgcagcagagttcctctgcacagaggcactgggcttcctgtcagggcatctgagccaagcagctgtcaccccagctggctggtgctgatcacctctgaaccaggccccaggcatgttgagtacttcacatgcagcttctgagtccatcttctctgcagtctcacatcagctctcatcggcccttgccatgtgacgcattcttctagatgtgcttcatacacagagcaccccaaaaagtcttagtgcaggtttaagctgggattctttcagacataaatgtctccaacttacacacctct

SEQ ID NO: 24928 - DNA, 354 bp, Homo sapiens
gtttcatctgccaagattgacctgtacattctagaattgcttcttggctcctggaacatcatatgcaggaagagaacagagacagcaaagccatggagtcagcccagctcagggaggagaggtctccagcgactggggcatctggccctgggaagcgcgacccagactctcagcttctcaacacagcacatccttccccacttggatatacagggtgcacctgtcaggaggaggtgccaaccaggtctcctgagtgagctggcctggtgatcccatgtggagtcaaagtccttctgtccccccaccccaccccattttccaagtaaggaaatccaaggtcacaaatcctgtact

SEQ ID NO: 24929 - DNA, 337 bp, Homo sapiens
ccaaagtgctgggattacaggcatgagccaccatgcccagcttctagattctttaatggttgctgtccttacctacccactgtcctccatgttctagtctattcctattaggtatgccagggtttttgctttaaagatatatccttattgtagaaacctttgggatgtgatcaagccgcacttacagaaaatttgagctttctgatggaggggctgtagaaagtagtagtagaagccatgagatggctgtcccaactatgtaagtgaaggtaacatggactgaaagggaatcttctggtcaaatctctcactagtcatagacagatattcccatttt

SEQ ID NO: 24930 - DNA, 343 bp, Homo sapiens
atgaagaaacagaggctcaggtgaggtcacaagcctaaaccaagctcccccagtgaagaggcagtagagctgggactagcacctgggtgtcttcccccagctggggctcctccaccccagtaatgctgtgtttgaggtaggctctccccactgggcagttctccttttggtaagtggaaaggaaatgtcctttctgaaggttacttggcctggcctcctgagctggtgtgtgggctggggggaataacagcttccagctccatgaaggtaactcagatctctgtaccaggttttcaagttcagcttccagcaacgaagtcaaatatgagaagagtgctgagct

SEQ ID NO: 24931 - DNA, 394 bp, Homo sapiens
ggtcgaccaggagacccaggagagacctctccctatcgggaggccccacctcctgaccttatcaccctggagttaatatttcaacatgggaatctggggtgcacgtgtagatcacgtgctgggtgccttgtgtcacgtgtgtgtcctgactcgaggcccgtgtgtaggtcgtgtgctgggtgcatcctgtcatgcatgtgatcctggctcatggcccgtgtgtaggtcgtgtgctgggtgcatcctgtcatgcgtgtgtcctggctcgtggcccgtgtgtaggtcgtgtgctgggtgcatcctgtcatgcgtgtgtcctgcctcgtggtgtgtgtgtaggttgtgtgctgggtgcatcctgtcatgcgtgtgtcctggctcgtggcccgtgtgt

SEQ ID NO: 24932 - DNA, 716 bp, Homo sapiens
ggtgaggaacagggggaatattacagcagccatagcctgagggggaataatctccacgtggactctggaacaaagctatattttgtcagaagcgctgcaacaattaccattccccttaagtactgatgaaatctttttgcagttggggtatggaaacagggaaaaaaccctcagcccctgaggaaggggtaggaatatctacagtgataaaaactatactaggggaggagaaggatcatggagaaggctgtacacctcagacttagggtcacagtgttcacctaagactgaggctgagtcagaagaccaaagaagaccttcctccgtttcttactctgctgttaggatcataagtaccttggtaaataacttttttgagtacaaaggaaagacgtgacttagtatgtaggtagtggttctgaaaatgaagaaagaaatatttttacaaactaaatcccacaccccaatataaggtatcatttaggaatggtagcctgtagagcactgagtgtagcgtagaagtaacaaacttcaaacctagctcactttctaattatgttgatgcaaacccctgtgctaaagttttagcagaaggaaacatgtggccatatccaagcaatgaaaactgttttagtctttactgtcatacatctgatgacaataatacatgagaatttaaacaaaaagttaaaagcatatgaacgcgcaaaaaaaaa

SEQ ID NO: 24933 - DNA, 668 bp, Homo sapiens
atttgaaaccagactcattttataccagacttttttattttaaaccagactttttaatattttataatatatacctattctcttatctactgtaccctttctcatttctgcacatttctttgtatttattttataatacctagtagtatttctgttacatgaaaaagagaatcaggttttgaggtgtaaaggtacctgataactcctctggttcgtgctgcgtgtttgaagagtagagccatagcggcatcccggcatttaggcttccaggccaatgctcttgtcaccccaagttggtcttagaagtatgagcctgttggtaaaactacttgaatgaaaatttatcctggaattgagagggtaactttaaatcacttaattattctggtgttttctctagccctgttctcttttgtcacccatattgatgatagaatgccacttgtaaagtacatcttaagcaccctcctcctagttagatctcagccagaataactactgtacataaacaaatcatgtaaagatatacctaatatttgctaaggtgttatgtcttagctgaaaaaactgctgtaacaaatgtttgctgaataaatgccataaatatattcaatataaaaaaactatatcttcaaagtaaatgaatgaataaataaatatccatgtat

SEQ ID NO: 24934 - DNA, 379 bp, Homo sapiens
ttgagaagatgctgccttgggagactgaccctccacccatcgtgagattttgtcctgatttcacatttcacatacattaacatgtaaaacaggttgggtacagtggctcacgtctgtaatcccggcagtttgagaggcaaggcaggagaattgcttgagcccaggagctcgagaccagcctgaacaacatagtgagaccccatatgtacaaataattaaaaaattgtccgggtgcggtcgctcacacctgtaatcccagcattttacgaggccgaggcaggtggatcatgaggtcagaagatcaagaccatcctggccaacatggtgaaaccccatctctactaaaaatacaaaaattaactgggtgtggtggcgcatg

SEQ ID NO: 24935 - DNA, 314 bp, Homo sapiens
cagaaaggaatccattatagagaaagactttcttcatactatggcatttgtttttgttttagttttcactctagaaagggagccctcccccagccaacttttccttttatctcattggctacaactgggtcatatgttgagcctaagccaatcataacttgtcctttgggtctgggggaggggttctgcattctctgaggtcatgggatctctaccagcttaaaaaaaaattatgtttcatttgaaaggaagaaagtgaatagacaattaacagtgtctgtcatagagttggttggaagcagacacgctagcaa

SEQ ID NO: 24936 - DNA, 563 bp, Homo sapiens
tgcagttcctccatgtgacattgtgacctgagattggtttcttagtctgccatagctgtacttctctgacctgaaggatggttttaattgtaatttggattgcttatcttacagggttagttgagaattcagtaaaatcgcacgagtgaaagcactttggaacaagaaacttacttgtagactttggttttggcttttttactacctggattcagttttctcatttacaaaatataaatgttatactagaatagatgatctttcaggtcccatttatgactggcattgtataaaacacctcacccataaagctgtaagtgatagtaaatattacaaataaacaatatattttattggaaatatgtggctattccccccattttgctccattcgtaaacttttcaagctaatcatagaattctgtgtacctttgcagagttaactgattttctattccatttctctactgtttctacttttccaatcctcttttctcatcttaagacttgtaatactttttcacctatattaattttggacaaataaaaacatatagcataaaa

SEQ ID NO: 24937 - DNA, 355 bp, Homo sapiens
gaacatggtggcatataagacaaatatagggaatcgagatataaaacacagaatgttaaaatgtgtttgctggattactgtggctttgttggactacatcagcctcagagagaaagtgtcatagtacatccagggagagatttttaaaactgaggaaaccagggtataccagtaaattatttacatagggttaagtcccttgcctccccaccacctccgtaacctgggagataacaaaatttacccaaatttccatcctaagcttttaaggtttcattccatgtatagagtccaggtttccacagagcgcagttagggtgcttgatgttacctaacatactccatgtgcaaaact

SEQ ID NO: 24938 - DNA, 423 bp, Homo sapiens
gaaactgaggacatacgtgacacaagagatgtgagggttgtgaggtgaagcacggagttaagctggcaggctcgggttggtgacgtctgggttcaatccccggccgctcatctccccagctatgtgacctgaggcctgcccttcagacccatctgagcttcactttcctccctcataaagcagttcagcagggccagacgtggtggttcccagcacttgtaatcccaacacatagagaggctgaggtgggaggatcgctccagctcaggagtttgagaccatcctcagtagcatggcgaaacctcatctctacaaaaaatacaaaaaatttgccaggcacagtggctcacgcctgtaatcccagcactttgggaggccgtggtgggtggatcccttgaagccaggaggaattcaagaccagcc

SEQ ID NO: 24939 - DNA, 2941 bp, Homo sapiens
ggagcagctcgggactgaaccgagaggtgccgaaggaaccggcgggccgcttgatcccgctgcagacgtaggagatgcctgggacaaggaggccaccttctcagggcaaaagaaaaagaaggtgacaggcgttgagaccaccgaagggaacccatggctaggatcagtttttcctacctctgcccagcctcctggtacttcactgtgcccacagtgagtccatttctccgtcagcgggtggcattcctgggactcttcttcatatcctgtctccttttacttatgttaatcatagactttcgacattggagtgcttcattaccacgagataggcaatacgaaaggtatttggctcgagtaggggagcttgaagctactgacactgaagacccaaatctgaattatggacttgttgttgactgtggcagcagtggttcccggatttttgtttatttctggccaagacataatgggaacccccatgacttgctggacatcaaacagatgagagaccgcaacagccaaccagtggttaaaaaaatcaagccaggaatctctgcaatggcagacactccagaacatgccagtgattaccttcgtcctctgctgagctttgctgctgctcatgtgcctgtgaagaagcacaaggagacccctctttacatcctctgcacagcaggcatgaggcttctccctgagaggaagcagttggctatcttggctgacctagtgaaagatttacccctggagtttgacttcctcttttcacagtctcaagcagaagtgatctctgggaagcaggaaggggtttatgcatggattggaatcaactttgttttgggaagattcgaccacgaggatgaatcagatgctgaggctacccaggaattggcagcaggacggagaaggacagtagggatactggatatgggaggagcctctctccaaattgcttatgaagttcctacctcaacctctgtccttcctgcaaagcaggaagaagctgccaagatcctgctggctgagttcaacctgggctgtgatgtgcaacacactgaacacgtgtacagggtttatgtcacaacttttctgggtttcggaggcaactttgcccggcagcgctacgaagaccttgttctgaatgaaactcttaacaaaaacagattgcttggtcagaagacaggtctgagtcccgacaatccatttctggatccctgcctgccagtgggactcacagatgtggtggagaggaacagccaagtcttacatgtccgaggaagaggagactgggtgtcttgtggggcaatgctgagccccctgctggctcgctccaacaccagccaggcctcactcaatggcatatatcaatcgcctattgacttcaacaacagcgagttctacggcttctctgagtttttttattgtacagaggatgtgttgcgcattggtggccgctaccatgggccaacatttgccaaggctgctcaggattactgtggcatggcttggtcggtactaactcagagattcaagaatggcctcttttcatcacatgcagatgagcatcgactcaaatatcagtgttttaaatcggcttggatgtaccaagtcttacatgaaggattccactttccctatgactacccaaacctgcggacagcccagctggtgtatgaccgagaggttcagtggacgctgggagccattctatataaaacacgattcttaccactcagggatcttcggcaggaaggtgtccgacaagcccatggtagctggttccgtctctcctttgtatacaaccactatctcttctttgcctgtatcctggtggtgctactggccatcttcctataccttctgcggctacgccgaattcaccaccgacaaacacgagcctcagctccattggacttgctgtggcttgaagaggtggtgcccatgatgggagtacaggtggggccgtgaggctggaccaggactagagaagcttgagcacccccgagttgctgctcattgaattcctccactttcttatatagcctcagatgctgtgataattccttctccgtacccaggtcttctctgagagaagctataatttaatctgtgaggaactaaatgacaggagattggtgctaatacgggggaccaagctttgtccaagtgaagcaggcttcgactccttctgagaggtctggtgtgttcctagaatctcaccttttcttcccttgctaaagcatgaagtttggcatttggcacactggaagcctggttgaaatgaaatttgtagcatctgatacaaagccagagacattctagcaagtgcagcagccccttctttctctgtaacagagatatcatttatgtggagatccacaacctttaacagggatccaagatctttgcagttcaatcgaccacataggaatttccaggcaccaaaatgatataacttccttgcttccttgacaaagaagccatcatgggtgtgatccaagatccctgtcgtagtgttgatgatgttagtacatgattttaaaggttagaaccccttctaaatgaatggtctgtggaagattttagtatcttatctgatgcctggtatgatgaggatagaaaatttttccatttttatgtgcctcacaggctgtttgggcattaattttgctttttgagccttaagtgtgttagtaggatggagaaactgtgatgggggactgggaacctggatttgtctgattttaggtcactgttccctgggcctgtttttgtgagcccttacacaggaagatataaagagagttctttcatttccctgctaaaatcagtatgtagtatggggaatgtatttgggttgtttttaaagaaaaggggaacagaatcaggagagtgggcaaaggcaataaaatcaaagtttttattaattatttctgagaaa

SEQ ID NO: 24940 - DNA, 475 bp, Homo sapiens
tttcgatatcttcgtgacattcagatgatttatacttcttagacatttgttatacaattaatttctattcattgaggaaatttagaagatgcaaataattttaaaagggaaaaaaatcacaagatgaaagatttgaaattcctacattgagagtatggaataaaatactatgattactttttccaagaaaaagaggaaagagaagccctaagggagaggtgtatacatggcatagcagtagagaattaagtgagggcttttctgtttcttacttaggggtttatgcatggattggaatcaactttgttttgggaagattcgaccacgaggatggtgagtaatattgtctttttatgacagtttacctaagggctgaagatttaagttataacctatcagtagcatgtaaatgcaaattttgagttgtttttcttttttcaaacataagatgcttcattttccagtcctaatttgc

SEQ ID NO: 24941 - DNA, 2845 bp, Homo sapiens
tggtgttttatgtctggcttcttttatttagcaaaatgttttcaaggttcagccatctcgtggtatgggtatttcattcctttttaatggctgaacagcattccattgtatgaccaaccatgctgtattttgtttatccatttatcagctgatgaacatttcagtggttttccctttttggctattatgcacagtgctgctgtgaacattcatatacacatttttctatgtacataagtttttttgtttttttttttttttttgagatggggtttcactcttgtcactcaggctggagtgccatggcacgatctcggctcactgcactccagcctggtgacacagtgagactccgtctcaaaaaaaaaaagaaaagaaaaagaaaaggccacagaatagatcttatgatgatccacagagttccttaaatttatttttattaaaggattttttcctattaaaataacacattcccattgagggaattggaaaatacagaaaaatacatgtgagaaaatgatatctgtagtaattctacctcctatataactacagatagtgttttgggtttctaatttcatatttagttcttaatttagtgtctaatttgtaccttttagtgcagtcttgtcattttgtgtctttgtttaaaataatgctatgaggatgaaagaatgcttaagatgttttaaagagtagtcatagaaatgaagcctcgtgtattagcaatgtcatagctttctagaaggcaaccaaaactaaaattccctttttctcttggtattgtattataggaagaagctgccaagatcctgctggctgagttcaacctgggctgtgatgtgcaacacactgaacacgtgtacagggtttatgtcacaacttttctgggtttcggaggcaactttgcccggcagcgctacgaagaccttgttctgaatgaaactcttaacaaaaacagattgcttggtcagaagacaggtctgagtcccgacaatccatttctggatccctgcctgccagtgggactcacagatgtggtggagaggaacagccaagtcttacatgtccgaggaagaggagactgggtgtcttgtggggcaatgctgagccccctgctggctcgctccaacaccagccaggcctcactcaatggcatatatcaatcgcctattgacttcaacaacagcgagttctacggcttctctgagtttttttattgtacagaggatgtgttgcgcattggtggccgctaccatgggccaacatttgccaaggctgctcagctggtagcccacaagtaactttagaaatggaacagctgtgactgtggggaaggtagagagtttgcctccaaattcatgttgcactatttctctgtggttgatccaggattactgtggcatggcttggtcggtactaactcagagattcaagaatggcctcttttcatcacatgcagatgagcatcgactcaaatatcagtgttttaaatcggcttggatgtaccaagtcttacatgaaggattccactttccctatgactacccaaacctgcggacagcccagctggtgtatgaccgagaggttcagtggacgctgggagccattctatataaaacacgattcttaccactcagggatcttcggcaggaaggtgtccgacaagcccatggtagctggttccgtctctcctttgtatacaaccactatctcttctttgcctgtatcctggtggtgctactggccatcttcctataccttctgcggctacgccgaattcaccaccgacaaacacgagcctcagctccattggacttgctgtggcttgaagaggtggtgcccatgatgggagtacaggtggggccgtgaggctggaccaggactagagaagcttgagcacccccgagttgctgctcattgaattcctccactttcttatatagcctcagatgctgtgataattccttctccgtacccaggtcttctctgagagaagctataatttaatctgtgaggaactaaatgacaggagattggtgctaatacgggggaccaagctttgtccaagtgaagcaggcttcgactccttctgagaggtctggtgtgttcctagaatctcaccttttcttcccttgctaaagcatgaagtttggcatttggcacactggaagcctggttgaaatgaaatttgtagcatctgatacaaagccagagacattctagcaagtgcagcagccccttctttctctgtaacagagatatcatttatgtggagatccacaacctttaacagggatccaagatctttgcagttcaatcgaccacataggaatttccaggcaccaaaatgatataacttccttgcttccttgacaaagaagccatcatgggtgtgatccaagatccctgtcgtagtgttgatgatgttagtacatgattttaaaggttagaaccccttctaaatgaatggtctgtggaagattttagtatcttatctgatgcctggtatgatgaggatagaaaatttttccatttttatgtgcctcacaggctgtttgggcattaattttgctttttgagccttaagtgtgttagtaggatggagaaactgtgatgggggactgggaacctggatttgtctgattttaggtcactgttccctgggcctgtttttgtgagcccttacacaggaagatataaagagagttctttcatttccctgctaaaatcagtatgtagtatggggaatgtatttgggttgtttttaaagaaaaggggaacagaatcaggagagtgggcaaaggcaataaaatcaaagtttttattaattatttctgagaaa

SEQ ID NO: 24942 - DNA, 1445 bp, Homo sapiens
tggtgttttatgtctggcttcttttatttagcaaaatgttttcaaggttcagccatctcgtggtatgggtatttcattcctttttaatggctgaacagcattccattgtatgaccaaccatgctgtattttgtttatccatttatcagctgatgaacatttcagtggttttccctttttggctattatgcacagtgctgctgtgaacattcatatacacatttttctatgtacataagtttttttgtttttttttttttttttgagatggggtttcactcttgtcactcaggctggagtgccatggcacgatctcggctcactgcactccagcctggtgacacagtgagactccgtctcaaaaaaaaaaagaaaagaaaaagaaaaggccacagaatagatcttatgatgatccacagagttccttaaatttatttttattaaaggattttttcctattaaaataacacattcccattgagggaattggaaaatacagaaaaatacatgtgagaaaatgatatctgtagtaattctacctcctatataactacagatagtgttttgggtttctaatttcatatttagttcttaatttagtgtctaatttgtaccttttagtgcagtcttgtcattttgtgtctttgtttaaaataatgctatgaggatgaaagaatgcttaagatgttttaaagagtagtcatagaaatgaagcctcgtgtattagcaatgtcatagctttctagaaggcaaccaaaactaaaattccctttttctcttggtattgtattataggaagaagctgccaagatcctgctggctgagttcaacctgggctgtgatgtgcaacacactgaacacgtgtacagggtttatgtcacaacttttctgggtttcggaggcaactttgcccggcagcgctacgaagaccttgttctgaatgaaactcttaacaaaaacaggtacatttgatatgggatctgagtttctgaaatataatgtcaggctgcagatattagggagaaatactcacatcctcctaagacagataagtccctgcttcctccttctttctgactacccctgccaatggggtagcatctcttaaagacctctattagcagtcccactctgggtgagggtgcattctgatctttgttattaggactcataaagtacagtagcttattgtgatctcttgctgtttcccatattcagacctaacatcatgggaaaagggagatgaattaaattgccagtttaaaatgtacaatatatagtgtagctgctagcagttccttctgcatggaagtgttcaagacatgtttgttgaattacagtgcagttgcatcttttgtgagagttcagttctgtagtatgtctaaaagataaaaagcaagcatagttaaaattaacttttaaaatggtctctcatcaaattcataa

SEQ ID NO: 24943 - DNA, 1727 bp, Homo sapiens
tggtgttttatgtctggcttcttttatttagcaaaatgttttcaaggttcagccatctcgtggtatgggtatttcattcctttttaatggctgaacagcattccattgtatgaccaaccatgctgtattttgtttatccatttatcagctgatgaacatttcagtggttttccctttttggctattatgcacagtgctgctgtgaacattcatatacacatttttctatgtacataagtttttttgtttttttttttttttttgagatggggtttcactcttgtcactcaggctggagtgccatggcacgatctcggctcactgcactccagcctggtgacacagtgagactccgtctcaaaaaaaaaaagaaaagaaaaagaaaaggccacagaatagatcttatgatgatccacagagttccttaaatttatttttattaaaggattttttcctattaaaataacacattcccattgagggaattggaaaatacagaaaaatacatgtgagaaaatgatatctgtagtaattctacctcctatataactacagatagtgttttgggtttctaatttcatatttagttcttaatttagtgtctaatttgtaccttttagtgcagtcttgtcattttgtgtctttgtttaaaataatgctatgaggatgaaagaatgcttaagatgttttaaagagtagtcatagaaatgaagcctcgtgtattagcaatgtcatagctttctagaaggcaaccaaaactaaaattccctttttctcttggtattgtattataggaagaagctgccaagatcctgctggctgagttcaacctgggctgtgatgtgcaacacactgaacacgtgtacagggtttatgtcacaacttttctgggtttcggaggcaactttgcccggcagcgctacgaagaccttgttctgaatgaaactcttaacaaaaacagattgcttggtcagaagacaggtctgagtcccgacaatccatttctggatccctgcctgccagtgggactcacagatgtggtggagaggaacagccaagtcttacatgtccgaggaagaggagactgggtgtcttgtggggcaatgctgagccccctgctggctcgctccaacaccagccaggcctcactcaatggcatatatcaatcgcctattgacttcaacaacagcgagttctacggcttctctgagtttttttattgtacagaggatgtgttgcgcattggtggccgctaccatgggccaacatttgccaaggctgctcaggattactgtggcatggcttggtcggtactaactcagagattcaagaatggcctcttttcatcacatgcagatgagcatcgactcaaatatcagtgttttaaatcggcttggatgtaccaagtcttacatgaaggattccactttccctatgactacccaaacctgcggacagcccagctggtgtatgaccgagaggttcagtggacgctgggagccattctatataaaacacgattcttaccactcagatgtggaattattcagtggttgtctactgtatcaatatttcaacccaatttggcttctctgtgggaatgactgccaagacaacacgtccagtccttactgggatctagctactagctccaagtacctaatggatgattcgacttaagagtcctgctgtcatctcaaacttttctccaggaacagcttactcag

SEQ ID NO: 24944 - DNA, 494 bp, Homo sapiens
aagaggtggtgcccatgatgggagtacaggtggggccgtgaggctggaccaggactagagaagcttgagcacccccgagttgctgctcattgaattcctccactttcttatatagcctcagatgctgtgatgtctgaccttgtggatatttgcccttggaatttctactttactttctaccgtaattccttctccgtacccaggtcttctctgagagaagctataatttaatctgtgaggaactaaatgacaggagattggtgctaatacgggggaccaagctttgtccaagtgaagcaggcttcgactccttctgagaggtctggtgtgttcctagaatctcaccttttcttcccttgctaaagcatgaagtttggcatttggcacactggaagcctggttgaaatgaaatttgtagcatctgatacaaagccagagacattctagcaagtgcagcagccccttctttctctgtaacagagatatcatttatg

SEQ ID NO: 24945 - DNA, 2739 bp, Homo sapiens
tggtgttttatgtctggcttcttttatttagcaaaatgttttcaaggttcagccatctcgtggtatgggtatttcattcctttttaatggctgaacagcattccattgtatgaccaaccatgctgtattttgtttatccatttatcagctgatgaacatttcagtggttttccctttttggctattatgcacagtgctgctgtgaacattcatatacacatttttctatgtacataagtttttttgtttttttttttttttttgagatggggtttcactcttgtcactcaggctggagtgccatggcacgatctcggctcactgcactccagcctggtgacacagtgagactccgtctcaaaaaaaaaaagaaaagaaaaagaaaaggccacagaatagatcttatgatgatccacagagttccttaaatttatttttattaaaggattttttcctattaaaataacacattcccattgagggaattggaaaatacagaaaaatacatgtgagaaaatgatatctgtagtaattctacctcctatataactacagatagtgttttgggtttctaatttcatatttagttcttaatttagtgtctaatttgtaccttttagtgcagtcttgtcattttgtgtctttgtttaaaataatgctatgaggatgaaagaatgcttaagatgttttaaagagtagtcatagaaatgaagcctcgtgtattagcaatgtcatagctttctagaaggcaaccaaaactaaaattccctttttctcttggtattgtattataggaagaagctgccaagatcctgctggctgagttcaacctgggctgtgatgtgcaacacactgaacacgtgtacagggtttatgtcacaacttttctgggtttcggaggcaactttgcccggcagcgctacgaagaccttgttctgaatgaaactcttaacaaaaacagattgcttggtcagaagacaggtctgagtcccgacaatccatttctggatccctgcctgccagtgggactcacagatgtggtggagaggaacagccaagtcttacatgtccgaggaagaggagactgggtgtcttgtggggcaatgctgagccccctgctggctcgctccaacaccagccaggcctcactcaatggcatatatcaatcgcctattgacttcaacaacagcgagttctacggcttctctgagtttttttattgtacagaggatgtgttgcgcattggtggccgctaccatgggccaacatttgccaaggctgctcaggattactgtggcatggcttggtcggtactaactcagagattcaagaatggcctcttttcatcacatgcagatgagcatcgactcaaatatcagtgttttaaatcggcttggatgtaccaagtcttacatgaaggattccactttccctatgactacccaaacctgcggacagcccagctggtgtatgaccgagaggttcagtggacgctgggagccattctatataaaacacgattcttaccactcagggatcttcggcaggaaggtgtccgacaagcccatggtagctggttccgtctctcctttgtatacaaccactatctcttctttgcctgtatcctggtggtgctactggccatcttcctataccttctgcggctacgccgaattcaccaccgacaaacacgagcctcagctccattggacttgctgtggcttgaagaggtggtgcccatgatgggagtacaggtggggccgtgaggctggaccaggactagagaagcttgagcacccccgagttgctgctcattgaattcctccactttcttatatagcctcagatgctgtgataattccttctccgtacccaggtcttctctgagagaagctataatttaatctgtgaggaactaaatgacaggagattggtgctaatacgggggaccaagctttgtccaagtgaagcaggcttcgactccttctgagaggtctggtgtgttcctagaatctcaccttttcttcccttgctaaagcatgaagtttggcatttggcacactggaagcctggttgaaatgaaatttgtagcatctgatacaaagccagagacattctagcaagtgcagcagccccttctttctctgtaacagagatatcatttatgtggagatccacaacctttaacagggatccaagatctttgcagttcaatcgaccacataggaatttccaggcaccaaaatgatataacttccttgcttccttgacaaagaagccatcatgggtgtgatccaagatccctgtcgtagtgttgatgatgttagtacatgattttaaaggttagaaccccttctaaatgaatggtctgtggaagattttagtatcttatctgatgcctggtatgatgaggatagaaaatttttccatttttatgtgcctcacaggctgtttgggcattaattttgctttttgagccttaagtgtgttagtaggatggagaaactgtgatgggggactgggaacctggatttgtctgattttaggtcactgttccctgggcctgtttttgtgagcccttacacaggaagatataaagagagttctttcatttccctgctaaaatcagtatgtagtatggggaatgtatttgggttgtttttaaagaaaaggggaacagaatcaggagagtgggcaaaggcaataaaatcaaagtttttattaattatttctgagaaa

SEQ ID NO: 24946 - DNA, 1614 bp, Homo sapiens
tgggactgcccaggccagcttgaaactagggcaggcctactgcttgggtctgcagggcctagcctggcaccagggttaactggagaaggcctgatactggggttcactatgaactcattgctcgatccattcttctccccacatgctaaaggtatcattctccatgttgtgctgcatggttttcggggaaggttgatgcaggtaatataaaactgtcctccttaccatctgctgtgcatcttttcttattctcgtgcttcgctcaagtgctgtaatctttcacctgcattccttagagcatggtaaggtattttctggtgcggatggttgttcaaatggatatttttgtgaagggaaactcctattccaccatgttgctgatgatacccctcttcttatttaattatttttaaatcatgcagcttaaaatactgaacatctggatacctccccaaatcaacataggtcatgttcagtaaatttaagcatgcttgtgttagacagcagcttacatttagaattttttttaattgaagacataattttaaaatactttgctttaaatacattgaaactttttgaaacattttcaaagatattacaccaacatttatttaaacagaatctataaaaatcatatgcattttaaaatttgtttggtttataatagaagtacaagctcaaaaagtcgcattcccagggtccaatatctggcttggtgacttgcttattgtgtggctttggacaattggcttacctctgtgcatgttctcttatctgtaggataggggtaattgtagctacataatggagtttaagtaaggaggggttgacataggtcaagctcatgaaacagtagctggcacacagtaagtgttccaagaatgttggctcatactactagctttttttttttttttttttttgagacggattctcactctattgcccaggctggggtgcactggtgtgatctcggctcactgcagcttccacctccctggttcaagcagttcccctgcctcagccccctgagtagctgggattgcaggcacacaccaccatgcccaggtgatttttttgcatttttattagagatggggtttcacaatgttggtcaggctggtcttgaactgctaaccttgtgatctgcccagcttggcctcccaaagtactgggattgcaggcatgagccaccgcgcccagcccatactactagttttaactcaagtttgtcaaaccattgaaagggagagtttattaaataatttgaaaaattaattgtctaataagagtggtacagttacaattcagtgtccattctcaggagatgctaagtagcactggtcatagactcttgcctgaaaaagttgcccctaaaaaccacacagtcaaaacagccaacaagcaacaacaacaaaaacaaaacaaaaatgcaccccaactgcaaacaaacaaaaaacaaaagacaaaaaactattccacaggcagcctgatatggagtaatagtgcaaaacaggagaaaataaaatccaaaacacagaaagccttcctttttaattcactcatttgaatatttaaagcaagttagatttgagtgactgcaaaaaaaaa

SEQ ID NO: 24947 - DNA, 3180 bp, Homo sapiens
ggcgggaggagcgcgcgcgggtgctaattggcccgggcggcggccccgcccgcgagtggtgagcggtcacgtgacgcgacggctgggggctcccggcgcgggggacgctggtgaccaagatggcggcggagctggtggaggccaaaaacatggtgatgagttttcgagtctccgaccttcagatgctcctgggtttcgtgggccggagtaagagtggactgaagcacgagctcgtcaccagggccctccagctggtgcagtttgactgtagccctgagctgttcaagaagatcaaggagctgtacgagacccgctacgccaagaagaactcggagcctgccccacagccgcaccggcccctggaccccctgaccatgcactccacctacgaccgggccggcgctgtgcccaggactccgctggcaggccccaatattgactaccccgtgctctacggaaagtacttaaacggactgggacggttgcccgccaagaccctcaagccagaagtccgcctggtgaagctgccgttctttaatatgctggatgagctgctgaagcccaccgaattagtcccacagaacaacgagaagcttcaggagagcccgtgcatcttcgcattgacgccaagacaggtggagttgatccggaactccagggaactgcagcccggagttaaagccgtgcaggtcgtcctgagaatctgttactcagacaccagctgccctcaggaggaccagtacccgcccaacatcgctgtgaaggtcaaccacagctactgctccgtcccgggctactacccctccaataagcccggggtggagcccaagaggccgtgccgccccatcaacctcactcacctcatgtacctgtcctcggccaccaaccgcatcactgtcacctgggggaactacggcaagagctactcggtggccctgtacctggtgcggcagctgacctcatcggagctgctgcagaggctgaagaccattggggtaaagcacccggagctgtgcaaggcactggtcaaggagaagctgcgccttgatcctgacagcgagatcgccaccaccggtgtgcgggtgtccctcatctgtccgctggtgaagatgcggctctccgtgccctgccgggcagagacctgcgcccacctgcagtgcttcgacgccgtcttctacctgcagatgaacgagaagaagcccacctggatgtgccccgtgtgcgacaagccagccccctacgaccagctcatcatcgacgggctcctctcgaagatcctgagcgagtgtgaggacgccgacgagatcgagtacctggtggacggctcgtggtgcccgatccgcgccgaaaaggagcgcagctgcagcccgcagggcgccatcctcgtgctgggcccctcggacgccaatgggctcctgcccgcccccagcgtcaacgggagcggtgccctgggcagcacgggtggcggcggcccggtgggcagcatggagaatgggaagccgggcgccgatgtggtggacctcacgctggacagctcatcgtcctcggaggatgaggaggaggaggaagaggaggaggaagacgaggacgaagaggggccccggcccaagcgccgctgccccttccagaagggcctggtgccggcctgctgaccccggccgcacactcgactttcctggtgctcaccacgcagaggggcacgggccagcctcgggcgcagagggaggagtgacctttctttttctttttattgtcgttcgttttgtttttccacccttttgcctggctcctggcacctgtacctctggactctcctatcgggggattaaaaaaaaaagtaaaatgacaaaaaaagatacaaaaaagaaaaatgaaacaaaaaagtcaaactcttaaaaacaaggccggccacccacacagccgcctccccggctggagtccgagccgggaaggggtagtgggcgggagggaccaggacgccgccccgcgccctcccctccggatgccccgccgcccgccgccctctgcccacgaccattccagccagtgcgcggggacccgggcggcgggcggtggggcgcagcccctctctggcgaccactttgacgtttgtctcttcctttgctttttctctgcaaatgcatcctcgcccagagaccctcacgcgccgagcagcgagcgttttagccgagaagccatggagtgggttggggcggggaggggcagtagggtggggggatgggtgggcaggatgggggtacagtgggcggctggggagggtttagccacagatgtgttgtattttttgaaagtgcaataatttggtattttgaagacccggcgtgtggtcaggaacccccggggaaggcgggggcccagggtgcggcaccgtgtggcgtgggggggtctcagttttctagccagctacctcggtaattccaattcaggttaacttccctacggaacagcacagatgtccacagatgtccacagctgccgccgccgccgccgccaccataccccggtccttggggcatgggttgcggtcgcttcccaaggggcagcagggaccccggccaccccggctctcggtttgggttgattcctctcctttttgctcttggttttccgacgggtacgaggctggcccggcaccctgtcccccgggagcctcactcttccagcaggaccagaccaggggcctccttcctgtccccaggcgttcccggcccctcgcaggccccacccatgcccttggcctcagggtccaacaactgggggagctaccagggctctgccttcaggagcccacagctgggcaccccccttgccccccaggagaccggggcgcaggcggggcaccggcctcacctggttctccaacaccgctgcctgcggtctgttttgcttttgtcctccccagcccagaattttcctttgtataaacagaactcctagtcaggaagcaatatcatttcaggtctaaagaaagggacgtgcatctggccgagggcagttcagtctcactgcagagcccgcagcccgctgcgcagctcggcccctcccgcccgcacgggcagctgaaggccgctgttttctaatatttgtattctaatttaattgtttttaaaaaatgcaaataaaaaaggtcgaggtgaagccaaccaggcgtccgctttt

SEQ ID NO: 24948 - DNA, 366 bp, Homo sapiens
ttttttttttaaaaacaattaaattagaatacaaatattagaaaacaccggcctcacctggttctccaacaccgctgcctgcggtctgttttgcttttgtcctccccagcccagaattttcctttgtataaacagaactcctagtcaggaagcaatatcatttcaggtctaaagaaagggacgtgcatctggccgagggcagttcagtctcactgcagagcccgcagcccgctgcgcagctcggcccctcccgcccgcacgggcagctgaaggccgctgttttctaatatttgtattctaatttaattgtttttaaaaaatgcaaataaaaaaggtcgaggtgaagccaaccaggcgtccgctttt

SEQ ID NO: 24949 - DNA, 1860 bp, Homo sapiens
ggcgggaggagcgcgcgcgggtgctaattggcccgggcggcggccccgcccgcgagtggtgagcggtcacgtgacgcgacggctgggggctcccggcgcgggggacgctggtgaccaagatggcggcggagctggtggaggccaaaaacatggtgatgagttttcgagtctccgaccttcagatgctcctgggtttcgtgggccggagtaagagtggactgaagcacgagctcgtcaccagggccctccagctggtgcagtttgactgtagccctgagctgttcaagaagatcaaggagctgtacgagacccgctacgccaagaagaactcggagcctgccccacagccgcaccggcccctggaccccctgaccatgcactccacctacgaccgggccggcgctgtgcccaggactccgctggcaggccccaatattgactaccccgtgctctacggaaagtacttaaacggactgggacggttgcccgccaagaccctcaagccagaagtccgcctggtgaagctgccgttctttaatatgctggatgagctgctgaagcccaccgaattagtcccacagaacaacgagaagcttcaggagagcccgtgcatcttcgcattgacgccaagacaggtggagttgatccggaactccagggaactgcagcccggagttaaagccgtgcaggtcgtcctgagaatctgttactcagacaccagctgccctcaggaggaccagtacccgcccaacatcgctgtgaaggtcaaccacagctactgctccgtcccgggctactacccctccaataagcccggggtggagcccaagaggccgtgccgccccatcaacctcactcacctcatgtacctgtcctcggccaccaaccgcatcactgtcacctgggggaactacggcaagagctactcggtggccctgtacctggtgcggcagctgacctcatcggagctgctgcagaggctgaagaccattggggtaaagcacccggagctgtgcaaggcactggtcaaggagaagctgcgccttgatcctgacagcgagatcgccaccaccggtgtgcgggtgtccctcatctgtccgctggtgaagatgcggctctccgtgccctgccgggcagagacctgcgcccacctgcagtgcttcgacgccgtcttctacctgcagatgaacgagaagaagcccacctggatgtgccccgtgtgcgacaagccagccccctacgaccagctcatcatcgacgggctcctctcgaagatcctgagcgagtgtgaggacgccgacgagatcgagtacctggtggacggctcgtggtgcccgatccgcgccgaaaaggagcgcagctgcagcccgcagggcgccatcctcgtgctgggcccctcggacgccaatgggctcctgcccgcccccagcgtcaacgggagcggtgccctgggcagcacgggtggcggcggcccggtgggcagcatggagaatgggaagccgggcgccgatgtggtggacctcacgctggacagctcatcgtcctcggaggatgaggaggaggaggaagaggaggaggaagacgaggacgaagaggggccccggcccaagcgccgctgccccttccagaagggcctggtgccggcctgctgaccccggccgcacactcgactttcctggtgctcaccacgcagaggggcacgggccagcctcgggcgcagagggaggagtgacctttctttttctttttattgtcgttcgttttgtttttccacccttttgcctggctcctggcacctgtacctctggactctcctatcgggggattaaaaaaaaaagtaaaatgacaaaaaaagataca

SEQ ID NO: 24950 - DNA, 2191 bp, Homo sapiens
cgcggtttgtacgggtgctttacccaatggtctcacctctgcagcagctccgatgaggtcagctgccgcaccaggtacaggtccaccgagtagctcttgccgtagtcccccctggtgaagatgcggctctccgtgccctgccgggcagagacctgcgcccacctgcagtgcttcgacgccgtcttctacctgcagatgaacgagaagaagcccacctggatgtgccccgtgtgcgacaagccagccccctacgaccagctcatcatcgacgggctcctctcgaagatcctgagcgagtgtgaggacgccgacgagatcgagtacctggtggacggctcgtggtgcccgatccgcgccgaaaaggagcgcagctgcagcccgcagggcgccatcctcgtgctgggcccctcggacgccaatgggctcctgcccgcccccagcgtcaacgggagcggtgccctgggcagcacgggtggcggcggcccggtgggcagcatggagaatgggaagccgggcgccgatgtggtggacctcacgctggacagctcatcgtcctcggaggatgaggaggaggaggaagaggaggaggaagacgaggacgaagaggggccccggcccaagcgccgctgccccttccagaagggcctggtgccggcctgctgaccccggccgcacactcgactttcctggtgctcaccacgcagaggggcacgggccagcctcgggcgcagagggaggagtgacctttctttttctttttattgtcgttcgttttgtttttccacccttttgcctggctcctggcacctgtacctctggactctcctatcgggggattaaaaaaaaaagtaaaatgacaaaaaaagatacaaaaaagaaaaatgaaacaaaaaagtcaaactcttaaaaacaaggccggccacccacacagccgcctccccggctggagtccgagccgggaaggggtagtgggcgggagggaccaggacgccgccccgcgccctcccctccggatgccccgccgcccgccgccctctgcccacgaccattccagccagtgcgcggggacccgggcggcgggcggtggggcgcagcccctctctggcgaccactttgacgtttgtctcttcctttgctttttctctgcaaatgcatcctcgcccagagaccctcacgcgccgagcagcgagcgttttagccgagaagccatggagtgggttggggcggggaggggcagtagggtggggggatgggtgggcaggatgggggtacagtgggcggctggggagggtttagccacagatgtgttgtattttttgaaagtgcaataatttggtattttgaagacccggcgtgtggtcaggaacccccggggaaggcgggggcccagggtgcggcaccgtgtggcgtgggggggtctcagttttctagccagctacctcggtaattccaattcaggttaacttccctacggaacagcacagatgtccacagatgtccacagctgccgccgccgccgccgccaccataccccggtccttggggcatgggttgcggtcgcttcccaaggggcagcagggaccccggccaccccggctctcggtttgggttgattcctctcctttttgctcttggttttccgacgggtacgaggctggcccggcaccctgtcccccgggagcctcactcttccagcaggaccagaccaggggcctccttcctgtccccaggcgttcccggcccctcgcaggccccacccatgcccttggcctcagggtccaacaactgggggagctaccagggctctgccttcaggagcccacagctgggcaccccccttgccccccaggagaccggggcgcaggcggggcaccggcctcacctggttctccaacaccgctgcctgcggtctgttttgcttttgtcctccccagcccagaattttcctttgtataaacagaactcctagtcaggaagcaatatcatttcaggtctaaagaaagggacgtgcatctggccgagggcagttcagtctcactgcagagcccgcagcccgctgcgcagctcggcccctcccgcccgcacgggcagctgaaggccgctgttttctaatatttgtattctaatttaattgtttttaaaaaatgcaaataaaaaaggtcgaggtgaagccaaccaggcgtccgctttt

SEQ ID NO: 24951 - DNA, 1070 bp, Homo sapiens
ggcgggaggagcgcgcgcgggtgctaattggcccgggcggcggccccgcccgcgagtggtgagcggtcacgtgacgcgacggctgggggctcccggcgcgggggacgctggtgaccaagatggcggcggagctggtggaggccaaaaacatggtgatgagttttcgagtctccgaccttcagatgctcctgggtttcgtgggccggagtaagagtggactgaagcacgagctcgtcaccagggccctccagctggtgcagtttgactgtagccctgagctgttcaagaagatcaaggagctgtacgagacccgctacgccaagaagaactcggagcctgccccacagccgcaccggcccctggaccccctgaccatgcactccacctacgaccgggccggcgctgtgcccaggactccgctggcaggccccaatattgactaccccgtgctctacggaaagtacttaaacggactgggacggttgcccgccaagaccctcaagccagaagtccgcctggtgaagctgccgttctttaatatgctggatgagctgctgaagcccaccgaattagtcccacagaacaacgagaagcttcaggagagcccgtgcatcttcgcattgacgccaagacaggtggagttgatccggaactccagggaactgcagcccggagttaaagccgtgcaggtcgtcctgagaatctgttactcagacaccagctgccctcaggaggaccagtacccgcccaacatcgctgtgaaggtcaaccacagctactgctccgtcccgggctactacccctccaataagcccggggtggagcccaagaggccgtgccgccccatcaacctcactcacctcatgtacctgtcactcgactttcctggtgctcaccacgcagaggggcacgggccagcctcgggcgcagagggaggagtgacctttctttttctttttattgtcgttcgttttgtttttccacccttttgcctggctcctggcacctgtacctctggactctcctatcgggggattaaaaaaaaaagtaaaatgacaaaaaaagataca

SEQ ID NO: 24952 - DNA, 3054 bp, Homo sapiens
cccacgcgtcggaggccaaaaacatggtgatgagttttcgagtctccgaccttcagatgctcctgggtttcgtgggccggagtaagagtggactgaagcacgagctcgtcaccagggccctccagctggtgcagtttgactgtagccctgagctgttcaagaagatcaaggagctgtacgagacccgctacgccaagaagaactcggagcctgccccacagccgcaccggcccctggaccccctgaccatgcactccacctacgaccgggccggcgctgtgcccaggactccgctggcaggccccaatattgactaccccgtgctctacggaaagtacttaaacggactgggacggttgcccgccaagaccctcaagccagaagtccgcctggtgaagctgccgttctttaatatgctggatgagctgctgaagcccaccgaattagtcccacagaacaacgagaagcttcaggagagcccgtgcatcttcgcattgacgccaagacaggtggagttgatccggaactccagggaactgcagcccggagttaaagccgtgcaggtcgtcctgagaatctgttactcagacaccagctgccctcaggaggaccagtacccgcccaacatcgctgtgaaggtcaaccacagctactgctccgtcccgggctactacccctccaataagcccggggtggagcccaagaggccgtgccgccccatcaacctcactcacctcatgtacctgtcctcggccaccaaccgcatcactgtcacctgggggaactacggcaagagctactcggtggccctgtacctggtgcggcagctgacctcatcggagctgctgcagaggctgaagaccattggggtaaagcacccggagctgtgcaaggcactggtcaaggagaagctgcgccttgatcctgacagcgagatcgccaccaccggtgtgcgggtgtccctcatctgtccgctggtgaagatgcggctctccgtgccctgccgggcagagacctgcgcccacctgcagtgcttcgacgccgtcttctacctgcagatgaacgagaagaagcccacctggatgtgccccgtgtgcgacaagccagccccctacgaccagctcatcatcgacgggctcctctcgaagatcctgagcgagtgtgaggacgccgacgagatcgagtacctggtggacggctcgtggtgcccgatccgcgccgaaaaggagcgcagctgcagcccgcagggcgccatcctcgtgctgggcccctcggacgccaatgggctcctgcccgcccccagcgtcaacgggagcggtgccctgggcagcacgggtggcggcggcccggtgggcagcatggagaatgggaagccgggcgccgatgtggtggacctcacgctggacagctcatcgtcctcggaggatgaggaggaggaggaagaggaggaggaagacgaggacgaagaggggccccggcccaagcgccgctgccccttccagaagggcctggtgccggcctgctgaccccggccgcacactcgactttcctggtgctcaccacgcagaggggcacgggccagcctcgggcgcagagggaggagtgacctttctttttctttttattgtcgttcgttttgtttttccacccttttgcctggctcctggcacctgtacctctggactctcctatcgggggattaaaaaaaaaagtaaaatgacaaaaaaagatacaaaaaagaaaaatgaaacaaaaaagtcaaactcttaaaaacaaggccggccacccacacagccgcctccccggctggagtccgagccgggaaggggtagtgggcgggagggaccaggacgccgccccgcgccctcccctccggatgccccgccgcccgccgccctctgcccacgaccattccagccagtgcgcggggacccgggcggcgggcggtggggcgcagcccctctctggcgaccactttgacgtttgtctcttcctttgctttttctctgcaaatgcatcctcgcccagagaccctcacgcgccgagcagcgagcgttttagccgagaagccatggagtgggttggggcggggaggggcagtagggtggggggatgggtgggcaggatgggggtacagtgggcggctggggagggtttagccacagatgtgttgtattttttgaaagtgcaataatttggtattttgaagacccggcgtgtggtcaggaacccccggggaaggcgggggcccagggtgcggcaccgtgtggcgtgggggggtctcagttttctagccagctacctcggtaattccaattcaggttaacttccctacggaacagcacagatgtccacagatgtccacagctgccgccgccgccgccgccaccataccccggtccttggggcatgggttgcggtcgcttcccaaggggcagcagggaccccggccaccccggctctcggtttgggttgattcctctcctttttgctcttggttttccgacgggtacgaggctggcccggcaccctgtcccccgggagcctcactcttccagcaggaccagaccaggggcctccttcctgtccccaggcgttcccggcccctcgcaggccccacccatgcccttggcctcagggtccaacaactgggggagctaccagggctctgccttcaggagcccacagctgggcaccccccttgccccccaggagaccggggcgcaggcggggcaccggcctcacctggttctccaacaccgctgcctgcggtctgttttgcttttgtcctccccagcccagaattttcctttgtataaacagaactcctagtcaggaagcaatatcatttcaggtctaaagaaagggacgtgcatctggccgagggcagttcagtctcactgcagagcccgcagcccgctgcgcagctcggcccctcccgcccgcacgggcagctgaaggccgctgttttctaatatttgtattctaatttaattgtttttaaaaaatgcaaataaaaaaggtcgaggtgaagccaaccaggcgtccgctttt

SEQ ID NO: 24953 - DNA, 443 bp, Homo sapiens
cttaccttaacctagagaattagaagagcgctcaggagctaggccgtattatgagtaaattgtctttgtcttcataattgtactttttcttcagagcttcttttgtgtctttatgggatgtgccaacagagcttatgaagtcaaatcttacagataagaaggaagagtctgggaaaaccaggatgattgattaccctatctacaaaccgattttgaccatttccagggtttgttgtctgtaaccattgcattaattcaatagtaaaaattatcaaccaaagacaatacctaaactaagcatcacacaaaattgtctccacaatagctttatgtagagagaaaccaatgtgcaaggtatcaatggcacctggtgtctatactatgagaatagatatagggaagatcatgcacaggttaaaagcctgatgttttgagctaaaaaa

SEQ ID NO: 24954 - DNA, 533 bp, Homo sapiens
gtgatatatttattcttaacatttatctaaggccaaatagaagctgtatagggacttgacttttcagatcactgctcctttcctgaggcttgtactgtgcagccaaaatcacttcttactggacacctcatcagaaaacatgccaagtgaccaaggagttactttagagggttggagagaaagattttcaaggaaaaattttatttacccttgtttctgcctccttcatttttgcccttttgggttaaaagaaatacctgactcttgattgaaatatatatgtatatattaaatactatcatatataatcatatatttataattttctatatagtattactacatgaaaattagcctgtatttcatgtgtgaccagcagacaaccttaagataaatgtctttaaataagtctggttgaagatttagagcaggagtgtccagtcgtttgtcttccctgggccacactgggagaagaactgtctcgggccacacataaaatacattaacacgaacaacagctgatgacctgaaaa

SEQ ID NO: 24955 - DNA, 338 bp, Homo sapiens
agcctgcctgggtttcatagtggaagagctagacctgtagctagctcttggttgtggaggtcccatctgtttgagagatcatctgctttaagctagatttctttattttgaagccaggcaacacatttatttaggtggttatgctaaagctatgtgttatttttcttccttcccttgcccgtttgacctgctgttgactctgtctgatttttgtccctctaaggagtgaaagcaatggcccatttttgtatttcaattacagaaactatttttcttcctactgaaaagagaacagaatgaatattcaataaaataagcactcttgtgaagttaactaa

SEQ ID NO: 24956 - DNA, 416 bp, Homo sapiens
ccaattttgcccagatgaatctttccgacttcaaggatgcaagggatccaatgtaatcatctgttactgactggctgttggtcttatcaagaagtagcaccattttggggattgagcattgctctgttgctggcagattagttattcagctgtggctaaatgtgccatcccaattcaccatcagtgtgcatattaagagtttcagtgttactgaatgccaagaactattatcacaccatctatttcaagtggtgaggtcctcattgccagctatcatgaagtgatctagtgtctcttttcctggacaacttctgattttaatggttgtttgttcagtacctcggtaatagactctgagatggagatttgcatacaagcaatttattagagtgtgtttccaggaacaattgtaatgg

SEQ ID NO: 24957 - DNA, 511 bp, Homo sapiens
ttccaggagaagaagagcagatgtgtactctgtagaagaaaaattcaaagccctagatattaatcagtatggttactgaacaagaacttaaaataagtatatcagttccatcaagataaagccctctgttgagaataaaagatcacaaaatcttggattcaaaactggggaaaaagctgatttcactattctttctgaggtgcccatgaacaaatcacctgacatctcttctgagggcctcaatttaagtctgtgaaaaatggggttgacagccccatcccttcacacatctcacagttaactaaatgaagtgatatgacagtgaaagcatcagagaactctaagagactgtaaagatggtggggggcagggtcagtgtggtaagaatatcattctaggcaaagtccagcctgtacatgttgaacatcatatctctagagggatggtttaggcctgaaacccttcttctatctctgagagactcaaaatgctcatatgattataaaaaaca

SEQ ID NO: 24958 - DNA, 1367 bp, Homo sapiens
  misc_feature (54)..(54): n is a, c, g, or t
  misc_feature (56)..(56): n is a, c, g, or t
  misc_feature (60)..(62): n is a, c, g, or t
  misc_feature (64)..(64): n is a, c, g, or t
  misc_feature (1334)..(1335): n is a, c, g, or t
  misc_feature (1339)..(1343): n is a, c, g, or t
  misc_feature (1347)..(1347): n is a, c, g, or t
  misc_feature (1352)..(1352): n is a, c, g, or t
  misc_feature (1358)..(1358): n is a, c, g, or t
  misc_feature (1360)..(1360): n is a, c, g, or t
  misc_feature (1362)..(1362): n is a, c, g, or t
  misc_feature (1367)..(1367): n is a, c, g, or t
gcacaattcagaggtaacagcgcctgcgttttctccatgataacatagacaaananttcnnncnagctgcagattggatattgggaagcaaatttgggtgtgaaatcttcagcaaaggagcacgcagagtccatgatggctcagaccaagtgagtgagaggcagagcgaggacgcccctctgctctggcgcgcccggactcggactcgcagactcgcgctggctccagtctctccacgattctctctcccagacttttccccggtcttaagagatcctgtgtccagagggggccttagctgctccagcccgcgatgaggaaaagtccaggtctgtctgactgtctttgggcctggatcctccttctgagcacactgactggaagaagctatggacagccgtcattacaagatgaacttaaagacaataccactgtcttcaccaggattttggacagactcctagatggctatgacaatcgcctgagaccaggattgggagagcgtgtaaccgaagtgaagactgatatcttcgtcaccagtttcggacccgtttcagaccatgatatggaatatacaatagatgtatttttccgtcaaagctggaaggatgaaaggttaaaatttaaaggacctatgacagtcctccggttaaataacctaatggcaagtaaaatccggactccggacacatttatgcccaacaaactcctgcggatcacagaggatggcaccttgctgtacaccatgaggctgacagtgagagctgaatgtccgatgcatttggaggacttccctatggatgcccatgcttgcccactaaaatttggaagttatgcttatacaagagcagaagttgtttatgaatggaccagagagccagcacgctcagtggttgtagcagaagatggatcacgtctaaaccagtatgaccttcttggacaaacagtagactctggaattgtccagtcaagtacaggagaatatgttgttatgaccactcatttccacttgaagagaaagattggctactttgttattcaaacatacctgccatgcataatgacagtgattctctcacaagtctccttctggctcaacagagagtctgtaccagcaagaactgtctttggagtaacaactgtgctcaccatgacaacattgagcatcagtgccagaaactccctccctaaggtggcttatgcaacagctatggattggtttattgccgtgtgctatgcctttgtgttctcagctctgattgagtttgccacagtaaactatttcactaagagaggttatgcatgggatggcaaaagtgtggttccagaaaagnnaaannnnntaanggtcncttatncncnaattn

SEQ ID NO: 24959 - DNA, 2818 bp, Homo sapiens
  misc_feature (54)..(54): n is a, c, g, or t
  misc_feature (56)..(56): n is a, c, g, or t
  misc_feature (60)..(62): n is a, c, g, or t
  misc_feature (64)..(64): n is a, c, g, or t
gcacaattcagaggtaacagcgcctgcgttttctccatgataacatagacaaananttcnnncnagctgcagattggatattgggaagcaaatttgggtgtgaaatcttcagcaaaggagcacgcagagtccatgatggctcagaccaagtgagtgagaggcagagcgaggacgcccctctgctctggcgcgcccggactcggactcgcagactcgcgctggctccagtctctccacgattctctctcccagacttttccccggtcttaagagatcctgtgtccagagggggccttagctgctccagcccgcgatgaggaaaagtccaggtctgtctgactgtctttgggcctggatcctccttctgagcacactgactggaagaagctatggacagccgtcattacaagatgaacttaaagacaataccactgtcttcaccaggattttggacagactcctagatggctatgacaatcgcctgagaccaggattgggagagcgtgtaaccgaagtgaagactgatatcttcgtcaccagtttcggacccgtttcagaccatgatatggaatatacaatagatgtatttttccgtcaaagctggaaggatgaaaggttaaaatttaaaggacctatgacagtcctccggttaaataacctaatggcaagtaaaatccggactccggacacatttttccacaatggaaagaagtcagtggcccacaacatgaccatgcccaacaaactcctgcggatcacagaggatggcaccttgctgtacaccatgaggctgacagtgagagctgaatgtccgatgcatttggaggacttccctatggatgcccatgcttgcccactaaaatttggaagttatgcttatacaagagcagaagttgtttatgaatggaccagagagccagcacgctcagtggttgtagcagaagatggatcacgtctaaaccagtatgaccttcttggacaaacagtagactctggaattgtccagtcaagtacaggagaatatgttgttatgaccactcatttccacttgaagagaaagattggctactttgttattcaaacatacctgccatgcataatgacagtgattctctcacaagtctccttctggctcaacagagagtctgtaccagcaagaactgtctttggagtaacaactgtgctcaccatgacaacattgagcatcagtgccagaaactccctccctaaggtggcttatgcaacagctatggattggtttattgccgtgtgctatgcctttgtgttctcagctctgattgagtttgccacagtaaactatttcactaagagaggttatgcatgggatggcaaaagtgtggttccagaaaagccaaagaaagtaaaggatcctcttattaagaaaaacaacacttacgctccaacagcaaccagctacacccctaatttggccaggggcgacccgggcttagccaccattgctaaaagtgcaaccatagaacctaaagaggtcaagcccgaaacaaaaccaccagaacccaagaaaacctttaacagtgtcagcaaaattgaccgactgtcaagaatagccttcccgctgctatttggaatctttaacttagtctactgggctacgtatttaaacagagagcctcagctaaaagcccccacaccacatcaatagatcttttactcacattctgttgttcagtcctctgcactgggaatttatttatgttctcaacgcagtaattcccatctgctttattgcctctgtcttaaagaatttgaaagtttccttattttcataattcatttaagaacaagagacccctgtctggcagtctggagcaaagcagactatgcagcttggagacaggattctgacagagcaagcgaaagagcaaagtcatgtcagaaggagacagaatgagagagaaaagagggggaagatggttcaaagatacaagaaaaagtagaaaaaaaaataacacttaactaaaacccctaggtcatttgtagatatatatttccaaatattctaaaaaagatactgtatatgtcaaaaatatttttatgtgaaggtgtttcaaagggtaaattataaatgtttcatgaagaaaaaattttaaaaatctacgtctttattacacaaactatggtgtgcttatgtttttgttttgctttttaaactgatgtatagctttaacattttgtttccaaagctgaagatccccattctttctctttgaaaaaaaaaaaggcctaatgcattattttgtcataaaatgctattttaaaattcatggaactttcatacgtaaaggtgcagttgctcattgtagagcacatttagtccaatgaagataaatgctttaaatagtttacttcactttcatctgagcttttaccactagactcaaggaagaataattttaacagacatgtatactccatagaaactaaactaaaatagtttaaaaatattccctttttcaccctattttcagatagcacatgagcccaacactcacttaattctcattatgaagatgtttttagaggggcaaaaatattttgcaagctctggaattgttgaatgtattcttttatataactacattaaaagctttagattgaaatttatgactagcaaacaaaaatagaatatataaacgatatatgtaaatatacagcatgagattgtacattttttacttttttaaaattgtgttcttaaaatattgtgtaagaatcacctggccccccttattcttggggaaagtttggtaaaaggctttggggaaaaaccttttag

SEQ ID NO: 24960 - DNA, 2872 bp, Homo sapiens
  misc_feature (54)..(54): n is a, c, g, or t
  misc_feature (56)..(56): n is a, c, g, or t
  misc_feature (60)..(62): n is a, c, g, or t
  misc_feature (64)..(64): n is a, c, g, or t
gcacaattcagaggtaacagcgcctgcgttttctccatgataacatagacaaananttcnnncnagctgcagattggatattgggaagcaaatttgggtgtgaaatcttcagcaaaggagcacgcagagtccatgatggctcagaccaagtgagtgagaggcagagcgaggacgcccctctgctctggcgcgcccggactcggactcgcagactcgcgctggctccagtctctccacgattctctctcccagacttttccccggtcttaagagatcctgtgtccagagggggccttagctgctccagcccgcgatgaggaaaagtccaggtctgtctgactgtctttgggcctggatcctccttctgagcacactgactggaagaagctatggacagccgtcattacaagatgaacttaaagacaataccactgtcttcaccaggattttggacagactcctagatggctatgacaatcgcctgagaccaggattgggagagcgtgtaaccgaagtgaagactgatatcttcgtcaccagtttcggacccgtttcagaccatgatatggaatatacaatagatgtatttttccgtcaaagctggaaggatgaaaggttaaaatttaaaggacctatgacagtcctccggttaaataacctaatggcaagtaaaatccggactccggacacatttttccacaatggaaagaagtcagtggcccacaacatgaccatgcccaacaaactcctgcggatcacagaggatggcaccttgctgtacaccatgaggctgacagtgagagctgaatgtccgatgcatttggaggacttccctatggatgcccatgcttgcccactaaaatttggaagttatgcttatacaagagcagaagttgtttatgaatggaccagagagccagcacgctcagtggttgtagcagaagatggatcacgtctaaaccagtatgaccttcttggacaaacagtagactctggaattgtccagtcaagtacaggagaatatgttgttatgaccactcatttccacttgaagagaaagattggctactttgttattcaaacatacctgccatgcataatgacagtgattctctcacaagtctccttctggctcaacagagagtctgtaccagcaagaactgtctttggagtaacaactgtgctcaccatgacaacattgagcatcagtgccagaaactccctccctaaggtggcttatgcaacagctatggattggtttattgccgtgtgctatgcctttgtgttctcagctctgattgagtttgccacagtaaactatttcactaagagaggttatgcatgggatggcaaaagtgtggttccagaaaagccaaagaaagtaaaggatcctcttattaagaaaaacaacacttacgctccaacagcaaccagctacacccctaatttggccaggggcgacccgggcttagccaccattgctaaaagtgcaaccatagaacctaaagaggtcaagcccgaaacaaaaccaccagaacccaagaaaacctttaacagtgtcagcaaaattgaccgactgtcaagaatagccttcccgctgctatttggaatctttaacttagtctactgggctacgtatttaaacagagagcctcagctaaaagcccccacaccacatcaatagatcttttactcacattctgttgttcagtcctctgcactgggaatttatttatgttctcaacgcagtaattcccatctgctttattgcctctgtcttaaagaatttgaaagtttccttattttcataattcatttaagaacaagagacccctgtctggcagtctggagcaaagcagactatgcagcttggagacaggattctgacagagcaagcgaaagagcaaagtcatgtcagaaggagacagaatgagagagaaaagagggggaagatggttcaaagatacaagaaaaagtagaaaaaaaaataacacttaactaaaacccctaggtcatttgtagatatatatttccaaatattctaaaaaagatactgtatatgtcaaaaatatttttatgtgaaggtgtttcaaagggtaaattataaatgtttcatgaagaaaaaattttaaaaatctacgtctttattacacaaactatggtgtgcttatgtttttgttttgctttttaaactgatgtatagctttaacattttgtttccaaagctgaagatccccattctttctctttgaaaaaaaaaaaggcctaatgcattattttgtcataaaatgctattttaaaattcatggaactttcatacgtaaaggtgcagttgctcattgtagagcacatttagtccaatgaagataaatgctttaaatagtttacttcactttcatctgagcttttaccactagactcaaggaagaataattttaacagacatgtatactccatagaaactaaactaaaatagtttaaaaatattccctttttcaccctattttcagatagcacatgagcccaacactcacttaattctcattatgaagatgtttttagaggggcaaaaatattttgcaagctctggaattgttgaatgtattcttttatataactacattaaaagctttagattgaaatttatgactagcaaacaaaaatagaatatataaacgatatatgtaaatatacagcatgagattgtacattttttacttttttaaaattgtgttcttaaaatattgtgtaagaatcactgcacttagctgttggaatgttgttaaatgctatggaaatacatttagaacctgcatttaagaacagaacagcaagtatgaaccacatggaacttaaaacatatgggtgtgaa

SEQ ID NO: 24961 - DNA, 457 bp, Homo sapiens
aaccctgtcactagtaaaaatacaaaaatcagcccggcatgctggcaggtgcctgaaatgtaatcccagctactcgggaggctgaggcaggagaatcacttgaacacaggaggcggaggttgcagtgagctgagaccacaccattgtactccagcctggctgacagagtgagacttggtctcaaaaaaaaataaataaataaaaataaaaataaaaatggccaaaggatttgaataaacatttttccaaagctagaacaaaggccaataagcaaatgaaaagatgctcaacatcattactcatcagagaagtgcaaaaaccacactgaagtagaacttattggaatgactatcatttttaaaaacagccaaacagataataagttccaatgaaatgtggagaagctgtaaaactcatacactgctggtgggattgcaaaatggtgcagccttttcgg

SEQ ID NO: 24962 - DNA, 402 bp, Homo sapiens
ttccaaaaatcaaagcctcatacaaagaatgagtatttgttagactcaaaaatattcacaagaatgtgccacatgctttaaaggtaatttttaaaggattccggaaatgtttggggcaatagcaacatcaatggaagcatcaaagagttctatctatcccaaggtcactactttgaagacagcaaaatccatttagactgtgtgtctgacttttttaattcagcagcagcaactaaagtcattcctctcttaactgtcaacattatccaatatcagagtcaaggcactgcactgagaacgccctaggagtggacgttggggccagcattataaattatgccatatccttacaaagagcatgtcattcaacacaaggctcacacggtggttgtaaattactgc

SEQ ID NO: 24963 - DNA, 1037 bp, Homo sapiens
caaaaaagaaaaaggtaatggcaaaaccacagttacttttgcaccgacctaatagtaggattacacttttaaatagtacatttcattccatttttattttacatattttatagattttcttgcttatttaagacaagttgaagcttatgtttctatttactgtgccatttagcatttcttatttctccctaacattattatgctacatataatattgattagtctggcttcaaaccttaccttaattagccttaaaaaaaaaatctagttggccaagcacactggctcacacctgtagcctcaacactttgggaggccaaggcagaaggatcacttgaacccaggaactggagaccagcctgggcaacgtagtgagatcgtctcactaaaaaaagttaaaaattagctgggcatggtggtgctcactgtagtcttagctactttggagactgaggagggaggattgcttgagcccaggaggtcaaggctgcagtgagccaaaatcgtgccactgcaccccagcctgggcaacaaagtgagatcccgtctccaaaaacaaaaagtctagttaatcattgcctttttactcaaaatgtgtttctaccaccctttttggatttttaaaaaatatgtattttatttttatgggtaaatttggcctaattacattttactgatataactcttaacttaaatttctctttattgttgaattgttgatccttttcttttttctaattcacagtatctctgtcctaggctttctgatctatttaaggaagattgagtgaacagcctaattgaccctctgaatgtcccctgagccttctaatccgccctgccttgagcctcctcttgtaactgaaattcactttctgatgcagaaccattgagcccttctgaaaccttttcaaaactatatatttaaattttcttatcaaactgtactgttattagattacatgtctagcatagcagcaaattatacttcattatattaaccttgccacttccctctacaatgagacccgatcttt

SEQ ID NO: 24964 - DNA, 3686 bp, Homo sapiens
gactttagccttcccattttatggagtttgtcatgagtgtgatcgtatttgctgctcgtgagatttcgctcactaataaatttgattcatttaattatgtgttttctcttcctagattttaatttgatttgaaaatgagtaagtgcagaaagacaccagttcagcagctagcaagtcccgcgtcattcagcccagatattcttgctgacatttttgaactctttgccaagaacttttcttatggcaagccacttaataatgagtggcagttaccagatcccagtgagattttcacctgtgaccacactgaatttaatgcatttcttgatttgaagaactccctaaatgaagtaaaaaacctactgagtgataagaaactggatgagtggcatgagcacactgctttcactaataaagcagggaaaatcatttctcatgttagaaaatctgtgaatgctgaactttgtactcaagcatggtgtaagttccatgagattttgtgcagctttccacttattccacaggaagcttttcagaatggaaaactgaattctctacacctttgtgaagctccaggagcttttatagctagtctcaaccactacttaaaatcccatcggtttccttgtcattggagttgggtagcgaatactctgaatccataccatgaagcaaatgacgacctcatgatgattatggatgaccggcttattgcaaataccttgcactggtggtactttggtccagataacactggtgatatcatgaccctgaaattcttgactggacttcagaatttcataagcagcatggctactgttcacttggtcactgcagatgggagttttgattgccaaggaaacccaggtgaacaagaagctttagtttcttctttgcattactgtgaagttgtcactgctctgaccactcttggaaacggtggctcttttgttctaaagatgtttactatgtttgaacattgttccataaacttgatgtacctgctaaactgttgttttgaccaagtccatgttttcaaacctgctactagcaaggcaggaaactccgaagtctatgtggtttgcctccactataaggggagagaggccatccatcctctgttatctaagatgaccttgaattttgggactgaaatgaaaaggaaagccctttttccccatcatgtgattcctgattcttttcttaagagacatgaagaatgttgtgtgttctttcataaatatcagctagagactatttctgaaaacattcgtctatttgagtgcatgggaaaggcggaacaagaaaagctgaataatttaagggattgtgctatacaatattttatgcaaaaatttcaactgaaacatctttccagaagtaattggctagtaaaaaaatctagtattggttgtagtacaaatacaaaatggtttgggcagaggaacaaatattttaaaacttataatgaaaggaagatgctagaagccctttcatggaaagataaagtagccaaaggatactttaatagttgggctgaagaacatggtgtatatcatcctgggcagagttctattttagaaggaacagcttccaatcttgagtgtcacttatggcatattttggagggaaagaaactgccaaaggtaaaatgttctcctttttgcaatggtgaaattttaaaaactcttaatgaagcaattgaaaagtcattaggaggagcttttaatttggattccaagtttaggccaaaacagcagtattcttgttcttgtcatgttttttctgaagaactgatattttccgagttgtgtagccttactgagtgccttcaggatgagcaggttgtagtacccagcaatcaaataaagtgcctgctggtgggcttttcgactctccgtaatatcaaaatgcatataccgttggaagttcgactcctagaatcagctgaactcacaacttttagctgttcattgcttcatgatggagatccaacttaccagcgtttatttttggactgccttctacattcattgcgggagcttcatacaggagatgttatgattttgcctgtactttcttgcttcacaagatttatggctggtttgatctttgtactccacagttgttttagattcatcacttttgtttgtcccacatcctctgatcccctgaggacctgcgcagtcctgctatgtgttggttatcaggaccttccaaatccagttttccgatatttgcagagtgtgaatgaattgttgagcactttgctcaactctgactcaccccagcaggttttacagtttgtgccaatggaggtactccttaagggggccctgcttgattttttgtgggatttgaatgctgccattgctaaaaggcatttgcatttcattattcaaagagagagagaagaaattatcaacagccttcagttacaaaactgaacatatgctttctgagattcaactttatgatttcttataatttgcccagtatttgcatcctgttgctctattaatttaaaaaccttttattttggggaaaggccaacatttgcatcattcaaagtctcattaattctggaaaaccatccattctgatctctagggtatatacacccacaggcatagagctcttccacgtggtggaatctatgcaatgatagatattcacactctaaatatgaggtgtgtgtatgtgtatgggtggccacagccatgcttacctatgccatttagttggtcttacttaatctgcttaagatttgcatctgtgtacctttgttcagattagttttttttttccagccgatttcctcttagtggctaatgctgttagtgaattttccaactaatttcctctcattggttaatgttgttaatgaattgagagaggtaattgaggaaaggaaatgagtaaatcactgttcagcaacactgatttccgttaacacatcagttatgaatttcagggaattcatctcgccagattcttgataacatgccattcattgcccttaggtgattgaccctattttcttacatggctcaaataaaactagtatgctgttgtatgaatcttttactgaccacaccatccaactataaaaatataacgggacagctttaaaccaaagatcatgtttagaacaatgaaaaattatttgttgtatctaatacacgcctgtattgtgaaaagcttcatttagcaatgatgtaataatttttaacttccaggaaataatctgtgaatggaaagattttttaagattttgagatagtgtttagtctcatgttgggaacacatgaatgtgatgaacatagtgaatactaaagaaaacgcttcagactttcagaatgatggttcagaatttaaaatttttaatcttttctaatttctttttttcagtgtgaaaatagcactttaccaaaagattagccatgaaatggttattttgccagttacatttgatttcttttgtatctgcaatgtaatgagttattttatttcttctgtatttgcagtgtaatgagtttttgtggcaaagtgtattaagcaatttttcattatcttgaagttccacaaagtggagaatatttatattctcacatgcattttaggcacttttgatatgtgaaaatagatgtattttctgatgcatttggttaataaatattaatctg

SEQ ID NO: 24965 - DNA, 4185 bp, Homo sapiens
ttcgggacggagccaaagaatgctccgcctgcgcgcgccgcttccgttgccgtagtggccgggggcgggaggctggcgcctcccagcttctgtactccgcgaagcaaaacctagggagctgaggcctaggcgaggcgagagtcgccggcgtgcgtaacgttggcgcacgtgactccggcccggcctacagggcgcgtgcgcagtgggacttgagtgcctcctggtccctgtctgccggcattcgcggctgcggggcccggaggtgggactggcttcccggtgccgcgagggcgggtccggacagccttccccccagtccggcgcaccatctccctgccttgtggctggaggcgccgcggacccaaagggagggaccatcccgggaagcagccccgagagcggaagtgcagaatggcttcctcgagagagtaaagtgcagcctctccagacactggggccccagtgggcgtgggcgaagttgctggtaggaggagttggcggaagcacttggaactcctttataagtgtcagctgtgagattttaatttgatttgaaaatgagtaagtgcagaaagacaccagttcagcagctagcaagtcccgcgtcattcagcccagatattcttgctgacatttttgaactctttgccaagaacttttcttatggcaagccacttaataatgagtggcagttaccagatcccagtgagattttcacctgtgaccacactgaatttaatgcatttcttgatttgaagaactccctaaatgaagtaaaaaacctactgagtgataagaaactggatgagtggcatgagcacactgctttcactaataaagcagggaaaatcatttctcatgttagaaaatctgtgaatgctgaactttgtactcaagcatggtgtaagttccatgagattttgtgcagctttccacttattccacaggaagcttttcagaatggaaaactgaattctctacacctttgtgaagctccaggagcttttatagctagtctcaaccactacttaaaatcccatcggtttccttgtcattggagttgggtagcgaatactctgaatccataccatgaagcaaatgacgacctcatgatgattatggatgaccggcttattgcaaataccttgcactggtggtactttggtccagataacactggtgatatcatgaccctgaaattcttgactggacttcagaatttcataagcagcatggctactgttcacttggtcactgcagatgggagttttgattgccaaggaaacccaggtgaacaagaagctttagtttcttctttgcattactgtgaagttgtcactgctctgaccactcttggaaacggtggctcttttgttctaaagatgtttactatgtttgaacattgttccataaacttgatgtacctgctaaactgttgttttgaccaagtccatgttttcaaacctgctactagcaaggcaggaaactccgaagtctatgtggtttgcctccactataaggggagagaggccatccatcctctgttatctaagatgaccttgaattttgggactgaaatgaaaaggaaagccctttttccccatcatgtgattcctgattcttttcttaagagacatgaagaatgttgtgtgttctttcataaatatcagctagagactatttctgaaaacattcgtctatttgagtgcatgggaaaggcggaacaagaaaagctgaataatttaagggattgtgctatacaatattttatgcaaaaatttcaactgaaacatctttccagaagtaattggctagtaaaaaaatctagtattggttgtagtacaaatacaaaatggtttgggcagaggaacaaatattttaaaacttataatgaaaggaagatgctagaagccctttcatggaaagataaagtagccaaaggatactttaatagttgggctgaagaacatggtgtatatcatcctgggcagagttctattttagaaggaacagcttccaatcttgagtgtcacttatggcatattttggagggaaagaaactgccaaaggtaaaatgttctcctttttgcaatggtgaaattttaaaaactcttaatgaagcaattgaaaagtcattaggaggagcttttaatttggattccaagtttaggccaaaacagcagtattcttgttcttgtcatgttttttctgaagaactgatattttccgagttgtgtagccttactgagtgccttcaggatgagcaggttgtagtacccagcaatcaaataaagtgcctgctggtgggcttttcgactctccgtaatatcaaaatgcatataccgttggaagttcgactcctagaatcagctgaactcacaacttttagctgttcattgcttcatgatggagatccaacttaccagcgtttatttttggactgccttctacattcattgcgggagcttcatacaggagatgttatgattttgcctgtactttcttgcttcacaagatttatggctggtttgatctttgtactccacagttgttttagattcatcacttttgtttgtcccacatcctctgatcccctgaggacctgcgcagtcctgctatgtgttggttatcaggaccttccaaatccagttttccgatatttgcagagtgtgaatgaattgttgagcactttgctcaactctgactcaccccagcaggttttacagtttgtgccaatggaggtactccttaagggggccctgcttgattttttgtgggatttgaatgctgccattgctaaaaggcatttgcatttcattattcaaagagagagagaagaaattatcaacagccttcagttacaaaactgaacatatgctttctgagattcaactttatgatttcttataatttgcccagtatttgcatcctgttgctctattaatttaaaaaccttttattttggggaaaggccaacatttgcatcattcaaagtctcattaattctggaaaaccatccattctgatctctagggtatatacacccacaggcatagagctcttccacgtggtggaatctatgcaatgatagatattcacactctaaatatgaggtgtgtgtatgtgtatgggtggccacagccatgcttacctatgccatttagttggtcttacttaatctgcttaagatttgcatctgtgtacctttgttcagattagttttttttttccagccgatttcctcttagtggctaatgctgttagtgaattttccaactaatttcctctcattggttaatgttgttaatgaattgagagaggtaattgaggaaaggaaatgagtaaatcactgttcagcaacactgatttccgttaacacatcagttatgaatttcagggaattcatctcgccagattcttgataacatgccattcattgcccttaggtgattgaccctattttcttacatggctcaaataaaactagtatgctgttgtatgaatcttttactgaccacaccatccaactataaaaatataacgggacagctttaaaccaaagatcatgtttagaacaatgaaaaattatttgttgtatctaatacacgcctgtattgtgaaaagcttcatttagcaatgatgtaataatttttaacttccaggaaataatctgtgaatggaaagattttttaagattttgagatagtgtttagtctcatgttgggaacacatgaatgtgatgaacatagtgaatactaaagaaaacgcttcagactttcagaatgatggttcagaatttaaaatttttaatcttttctaatttctttttttcagtgtgaaaatagcactttaccaaaagattagccatgaaatggttattttgccagttacatttgatttcttttgtatctgcaatgtaatgagttattttatttcttctgtatttgcagtgtaatgagtttttgtggcaaagtgtattaagcaatttttcattatcttgaagttccacaaagtggagaatatttatattctcacatgcattttaggcacttttgatatgtgaaaatagatgtattttctgatgcatttggttaataaatattaatctgaacattttcatgttctttgctattttgaattccattatagattcatgaataaagtcattactagagaaaaaaaaag

SEQ ID NO: 24966 - DNA, 4235 bp, Homo sapiens
ttcgggacggagccaaagaatgctccgcctgcgcgcgccgcttccgttgccgtagtggccgggggcgggaggctggcgcctcccagcttctgtactccgcgaagcaaaacctagggagctgaggcctaggcgaggcgagagtcgccggcgtgcgtaacgttggcgcacgtgactccggcccggcctacagggcgcgtgcgcagtgggacttgagtgcctcctggtccctgtctgccggcattcgcggctgcggggcccggaggtgggactggcttcccggtgccgcgagggcgggtccggacagccttccccccagtccggcgcaccatctccctgccttgtggctggaggcgccgcggacccaaagggagggaccatcccgggaagcagccccgagagcggaagtgcagaatggcttcctcgagagagtaaagtgcagcctctccagacactggggccccagtgggcgtgggcgaaggtaatccaggcctgggtacgattccgggccctccttcgacttcccagcggttgctggtaggaggagttggcggaagcacttggaactcctttataagtgtcagctgtgagattttaatttgatttgaaaatgagtaagtgcagaaagacaccagttcagcagctagcaagtcccgcgtcattcagcccagatattcttgctgacatttttgaactctttgccaagaacttttcttatggcaagccacttaataatgagtggcagttaccagatcccagtgagattttcacctgtgaccacactgaatttaatgcatttcttgatttgaagaactccctaaatgaagtaaaaaacctactgagtgataagaaactggatgagtggcatgagcacactgctttcactaataaagcagggaaaatcatttctcatgttagaaaatctgtgaatgctgaactttgtactcaagcatggtgtaagttccatgagattttgtgcagctttccacttattccacaggaagcttttcagaatggaaaactgaattctctacacctttgtgaagctccaggagcttttatagctagtctcaaccactacttaaaatcccatcggtttccttgtcattggagttgggtagcgaatactctgaatccataccatgaagcaaatgacgacctcatgatgattatggatgaccggcttattgcaaataccttgcactggtggtactttggtccagataacactggtgatatcatgaccctgaaattcttgactggacttcagaatttcataagcagcatggctactgttcacttggtcactgcagatgggagttttgattgccaaggaaacccaggtgaacaagaagctttagtttcttctttgcattactgtgaagttgtcactgctctgaccactcttggaaacggtggctcttttgttctaaagatgtttactatgtttgaacattgttccataaacttgatgtacctgctaaactgttgttttgaccaagtccatgttttcaaacctgctactagcaaggcaggaaactccgaagtctatgtggtttgcctccactataaggggagagaggccatccatcctctgttatctaagatgaccttgaattttgggactgaaatgaaaaggaaagccctttttccccatcatgtgattcctgattcttttcttaagagacatgaagaatgttgtgtgttctttcataaatatcagctagagactatttctgaaaacattcgtctatttgagtgcatgggaaaggcggaacaagaaaagctgaataatttaagggattgtgctatacaatattttatgcaaaaatttcaactgaaacatctttccagaagtaattggctagtaaaaaaatctagtattggttgtagtacaaatacaaaatggtttgggcagaggaacaaatattttaaaacttataatgaaaggaagatgctagaagccctttcatggaaagataaagtagccaaaggatactttaatagttgggctgaagaacatggtgtatatcatcctgggcagagttctattttagaaggaacagcttccaatcttgagtgtcacttatggcatattttggagggaaagaaactgccaaaggtaaaatgttctcctttttgcaatggtgaaattttaaaaactcttaatgaagcaattgaaaagtcattaggaggagcttttaatttggattccaagtttaggccaaaacagcagtattcttgttcttgtcatgttttttctgaagaactgatattttccgagttgtgtagccttactgagtgccttcaggatgagcaggttgtagtacccagcaatcaaataaagtgcctgctggtgggcttttcgactctccgtaatatcaaaatgcatataccgttggaagttcgactcctagaatcagctgaactcacaacttttagctgttcattgcttcatgatggagatccaacttaccagcgtttatttttggactgccttctacattcattgcgggagcttcatacaggagatgttatgattttgcctgtactttcttgcttcacaagatttatggctggtttgatctttgtactccacagttgttttagattcatcacttttgtttgtcccacatcctctgatcccctgaggacctgcgcagtcctgctatgtgttggttatcaggaccttccaaatccagttttccgatatttgcagagtgtgaatgaattgttgagcactttgctcaactctgactcaccccagcaggttttacagtttgtgccaatggaggtactccttaagggggccctgcttgattttttgtgggatttgaatgctgccattgctaaaaggcatttgcatttcattattcaaagagagagagaagaaattatcaacagccttcagttacaaaactgaacatatgctttctgagattcaactttatgatttcttataatttgcccagtatttgcatcctgttgctctattaatttaaaaaccttttattttggggaaaggccaacatttgcatcattcaaagtctcattaattctggaaaaccatccattctgatctctagggtatatacacccacaggcatagagctcttccacgtggtggaatctatgcaatgatagatattcacactctaaatatgaggtgtgtgtatgtgtatgggtggccacagccatgcttacctatgccatttagttggtcttacttaatctgcttaagatttgcatctgtgtacctttgttcagattagttttttttttccagccgatttcctcttagtggctaatgctgttagtgaattttccaactaatttcctctcattggttaatgttgttaatgaattgagagaggtaattgaggaaaggaaatgagtaaatcactgttcagcaacactgatttccgttaacacatcagttatgaatttcagggaattcatctcgccagattcttgataacatgccattcattgcccttaggtgattgaccctattttcttacatggctcaaataaaactagtatgctgttgtatgaatcttttactgaccacaccatccaactataaaaatataacgggacagctttaaaccaaagatcatgtttagaacaatgaaaaattatttgttgtatctaatacacgcctgtattgtgaaaagcttcatttagcaatgatgtaataatttttaacttccaggaaataatctgtgaatggaaagattttttaagattttgagatagtgtttagtctcatgttgggaacacatgaatgtgatgaacatagtgaatactaaagaaaacgcttcagactttcagaatgatggttcagaatttaaaatttttaatcttttctaatttctttttttcagtgtgaaaatagcactttaccaaaagattagccatgaaatggttattttgccagttacatttgatttcttttgtatctgcaatgtaatgagttattttatttcttctgtatttgcagtgtaatgagtttttgtggcaaagtgtattaagcaatttttcattatcttgaagttccacaaagtggagaatatttatattctcacatgcattttaggcacttttgatatgtgaaaatagatgtattttctgatgcatttggttaataaatattaatctgaacattttcatgttctttgctattttgaattccattatagattcatgaataaagtcattactagagaaaaaaaaag

SEQ ID NO: 24967 - DNA, 3122 bp, Homo sapiens
  misc_feature (3057)..(3058): n is a, c, g, or t
  misc_feature (3090)..(3091): n is a, c, g, or t
gactttagccttcccattttatggagtttgtcatgagtgtgatcgtatttgctgctcgtgagatttcgctcactaataaatttgattcatttaattatgtgttttctcttcctagattttaatttgatttgaaaatgagtaagtgcagaaagacaccagttcagcagctagcaagtcccgcgtcattcagcccagatattcttgctgacatttttgaactctttgccaagaacttttcttatggcaagccacttaataatgagtggcagttaccagatcccagtgagattttcacctgtgaccacactgaatttaatgcatttcttgatttgaagaactccctaaatgaagtaaaaaacctactgagtgataagaaactggatgagtggcatgagcacactgctttcactaataaagcagggaaaatcatttctcatgttagaaaatctgtgaatgctgaactttgtactcaagcatggtgtaagttccatgagattttgtgcagctttccacttattccacaggaagcttttcagaatggaaaactgaattctctacacctttgtgaagctccaggagcttttatagctagtctcaaccactacttaaaatcccatcggtttccttgtcattggagttgggtagcgaatactctgaatccataccatgaagcaaatgacgacctcatgatgattatggatgaccggcttattgcaaataccttgcactggtggtactttggtccagataacactggtgatatcatgaccctgaaattcttgactggacttcagaatttcataagcagcatggctactgttcacttggtcactgcagatgggagttttgattgccaaggaaacccaggtgaacaagaagctttagtttcttctttgcattactgtgaagttgtcactgctctgaccactcttggaaacggtggctcttttgttctaaagatgtttactatgtttgaacattgttccataaacttgatgtacctgctaaactgttgttttgaccaagtccatgttttcaaacctgctactagcaaggcaggaaactccgaagtctatgtggtttgcctccactataaggggagagaggccatccatcctctgttatctaagatgaccttgaattttgggactgaaatgaaaaggaaagccctttttccccatcatgtgattcctgattcttttcttaagagacatgaagaatgttgtgtgttctttcataaatatcagctagagactatttctgaaaacattcgtctatttgagtgcatgggaaaggcggaacaagaaaagctgaataatttaagggattgtgctatacaatattttatgcaaaaatttcaactgaaacatctttccagaagtaattggctagtaaaaaaatctagtattggttgtagtacaaatacaaaatggtttgggcagaggaacaaatattttaaaacttataatgaaaggaagatgctagaagccctttcatggaaagataaagtagccaaaggatactttaatagttgggctgaagaacatggtgtatatcatcctgggcagagttctattttagaaggaacagcttccaatcttgagtgtcacttatggcatattttggagggaaagaaactgccaaaggtaaaatgttctcctttttgcaatggtgaaattttaaaaactcttaatgaagcaattgaaaagtcattaggaggagcttttaatttggattccaagtttaggccaaaacagcagtattcttgttcttgtcatgttttttctgaagaactgatattttccgagttgtgtagccttactgagtgccttcaggatgagcaggttgtagtacccagcaatcaaataaagtgcctgctggtgggcttttcgactctccgtaatatcaaaatgcatataccgttggaagttcgactcctagaatcagctgaactcacaacttttagctgttcattgcttcatgatggagatccaacttaccagcgtttatttttggactgccttctacattcattgcgggagcttcatacaggagatgttatgattttgcctgtactttcttgcttcacaagatttatggctggtttgatctttgtactccacagttgttttagattcatcacttttgtttgtcccacatcctctgatcccctgaggacctgcgcagtcctgctatgtgttggttatcaggaccttccaaatccagttttccgatatttgcagagtgtgaatgaattgttgagcactttgctcaactctgactcaccccagcaggttttacagtttgtgccaatggaggtactccttaagggggccctgcttgattttttgtgggatttgaatgctgccattgctaaaaggcatttgcatttcattattcaaagagagagagaagaaattatcaacagccttcagttacaaaactgaacatatgctttctgagattcaactttatgatttcttataatttgcccagtatttgcatcctgttgctctattaatttaaaaaccttttattttggggaaaggccaacatttgcatcattcaaagtctcattaattctggaaaaccatccattctgatctctagggtatatacacccacaggcatagagctcttccacgtggtggaatctatgcaatgatagatattcacactctaaatatgaggtgtgtgtatgtgtatgggtggccacagccatgcttacctatgccatttagttggtcttacttaatctgcttaagatttgcatctgtgtacctttgttcagattagttttttttttccagccgatttcctcttagtggctaatgctgttagtgaattttccaactaatttcctctcattggttaatgttgttaatgaattgagagaggtaattgaggaaaggaaatgagtaaatcactgttcagcaacactgatttccgttaacacatcagttatgaatttcagggaattcatctcgccagattcttgataacatgccattcattgcccttaggtgattgaccctattttcttaaaagattcatacnncagcatactagttttatttgagccatggtcgnncggccgccaatttagtagtagtaggcgccgc

SEQ ID NO: 24968 - DNA, 3318 bp, Homo sapiens
ggcacgagatgattttccctgctttattagtgaaagcagtgtgctcatgccactcatccagtttctcatgttagaaaatctgtgaatgctgaactttgtactcaagcatggtgtaagttccatgagattttgtgcagctttccacttattccacaggaagcttttcagaatggaaaactgaattctctacacctttgtgaagctccaggagcttttatagctagtctcaaccactacttaaaatcccatcggtttccttgtcattggagttgggtagcgaatactctgaatccataccatgaagcaaatgacgacctcatgatgattatggatgaccggcttattgcaaataccttgcactggtggtactttggtccagataacactggtgatatcatgaccctgaaattcttgactggacttcagaatttcataagcagcatggctactgttcacttggtcactgcagatgggagttttgattgccaaggaaacccaggtgaacaagaagctttagtttcttctttgcattactgtgaagttgtcactgctctgaccactcttggaaacggtggctcttttgttctaaagatgtttactatgtttgaacattgttccataaacttgatgtacctgctaaactgttgttttgaccaagtccatgttttcaaacctgctactagcaaggcaggaaactccgaagtctatgtggtttgcctccactataaggggagagaggccatccatcctctgttatctaagatgaccttgaattttgggactgaaatgaaaaggaaagccctttttccccatcatgtgattcctgattcttttcttaagagacatgaagaatgttgtgtgttctttcataaatatcagctagagactatttctgaaaacattcgtctatttgagtgcatgggaaaggcggaacaagaaaagctgaataatttaagggattgtgctatacaatattttatgcaaaaatttcaactgaaacatctttccagaagtaattggctagtaaaaaaatctagtattggttgtagtacaaatacaaaatggtttgggcagaggaacaaatattttaaaacttataatgaaaggaagatgctagaagccctttcatggaaagataaagtagccaaaggatactttaatagttgggctgaagaacatggtgtatatcatcctgggcagagttctattttagaaggaacagcttccaatcttgagtgtcacttatggcatattttggagggaaagaaactgccaaaggtaaaatgttctcctttttgcaatggtgaaattttaaaaactcttaatgaagcaattgaaaagtcattaggaggagcttttaatttggattccaagtttaggccaaaacagcagtattcttgttcttgtcatgttttttctgaagaactgatattttccgagttgtgtagccttactgagtgccttcaggatgagcaggttgtagtacccagcaatcaaataaagtgcctgctggtgggcttttcgactctccgtaatatcaaaatgcatataccgttggaagttcgactcctagaatcagctgaactcacaacttttagctgttcattgcttcatgatggagatccaacttaccagcgtttatttttggactgccttctacattcattgcgggagcttcatacaggagatgttatgattttgcctgtactttcttgcttcacaagatttatggctggtttgatctttgtactccacagttgttttagattcatcacttttgtttgtcccacatcctctgatcccctgaggacctgcgcagtcctgctatgtgttggttatcaggaccttccaaatccagttttccgatatttgcagagtgtgaatgaattgttgagcactttgctcaactctgactcaccccagcaggttttacagtttgtgccaatggaggtactccttaagggggccctgcttgattttttgtgggatttgaatgctgccattgctaaaaggcatttgcatttcattattcaaagagagagagaagaaattatcaacagccttcagttacaaaactgaacatatgctttctgagattcaactttatgatttcttataatttgcccagtatttgcatcctgttgctctattaatttaaaaaccttttattttggggaaaggccaacatttgcatcattcaaagtctcattaattctggaaaaccatccattctgatctctagggtatatacacccacaggcatagagctcttccacgtggtggaatctatgcaatgatagatattcacactctaaatatgaggtgtgtgtatgtgtatgggtggccacagccatgcttacctatgccatttagttggtcttacttaatctgcttaagatttgcatctgtgtacctttgttcagattagttttttttttccagccgatttcctcttagtggctaatgctgttagtgaattttccaactaatttcctctcattggttaatgttgttaatgaattgagagaggtaattgaggaaaggaaatgagtaaatcactgttcagcaacactgatttccgttaacacatcagttatgaatttcagggaattcatctcgccagattcttgataacatgccattcattgcccttaggtgattgaccctattttcttacatggctcaaataaaactagtatgctgttgtatgaatcttttactgaccacaccatccaactataaaaatataacgggacagctttaaaccaaagatcatgtttagaacaatgaaaaattatttgttgtatctaatacacgcctgtattgtgaaaagcttcatttagcaatgatgtaataatttttaacttccaggaaataatctgtgaatggaaagattttttaagattttgagatagtgtttagtctcatgttgggaacacatgaatgtgatgaacatagtgaatactaaagaaaacgcttcagactttcagaatgatggttcagaatttaaaatttttaatcttttctaatttctttttttcagtgtgaaaatagcactttaccaaaagattagccatgaaatggttattttgccagttacatttgatttcttttgtatctgcaatgtaatgagttattttatttcttctgtatttgcagtgtaatgagtttttgtggcaaagtgtattaagcaatttttcattatcttgaagttccacaaagtggagaatatttatattctcacatgcattttaggcacttttgatatgtgaaaatagatgtattttctgatgcatttggttaataaatattaatctg

SEQ ID NO: 24969 - DNA, 1221 bp, Homo sapiens
catctgtgtactttgttcagatgcaaatcttaagcagattaagtaagaccaactaaatggcataggtaagcatggctgtggccacccatacacatacacaccacctcatatttagagtgtgaatatctatcattgcatagattccaccacgtggaagagctctatgcctgtgggtgtatataccctagagatcagaatggttggtcttacttaatctgcttaagatttgcatctgtgtacctttgttcagattagttttttttttccagccgatttcctcttagtggctaatgctgttagtgaattttccaactaatttcctctcattggttaatgttgttaatgaattgagagaggtaattgaggaaaggaaatgagtaaatcactgttcagcaacactgatttccgttaacacatcagttatgaatttcagggaattcatctcgccagattcttgataacatgccattcattgcccttaggtgattgaccctattttcttacatggctcaaataaaactagtatgctgttgtatgaatcttttactgaccacaccatccaactataaaaatataacgggacagctttaaaccaaagatcatgtttagaacaatgaaaaattatttgttgtatctaatacacgcctgtattgtgaaaagcttcatttagcaatgatgtaataatttttaacttccaggaaataatctgtgaatggaaagattttttaagattttgagatagtgtttagtctcatgttgggaacacatgaatgtgatgaacatagtgaatactaaagaaaacgcttcagactttcagaatgatggttcagaatttaaaatttttaatcttttctaatttctttttttcagtgtgaaaatagcactttaccaaaagattagccatgaaatggttattttgccagttacatttgatttcttttgtatctgcaatgtaatgagttattttatttcttctgtatttgcagtgtaatgagtttttgtggcaaagtgtattaagcaatttttcattatcttgaagttccacaaagtggagaatatttatattctcacatgcattttaggcacttttgatatgtgaaaatagatgtattttctgatgcatttggttaataaatattaatctgaacattttcatgttctttgctattttgaattccattatagattcatgaataaagtcattactagagaaaaaaaaag

SEQ ID NO: 24970 - DNA, 3762 bp, Homo sapiens
gactttagccttcccattttatggagtttgtcatgagtgtgatcgtatttgctgctcgtgagatttcgctcactaataaatttgattcatttaattatgtgttttctcttcctagattttaatttgatttgaaaatgagtaagtgcagaaagacaccagttcagcagctagcaagtcccgcgtcattcagcccagatattcttgctgacatttttgaactctttgccaagaacttttcttatggcaagccacttaataatgagtggcagttaccagatcccagtgagattttcacctgtgaccacactgaatttaatgcatttcttgatttgaagaactccctaaatgaagtaaaaaacctactgagtgataagaaactggatgagtggcatgagcacactgctttcactaataaagcagggaaaatcatttctcatgttagaaaatctgtgaatgctgaactttgtactcaagcatggtgtaagttccatgagattttgtgcagctttccacttattccacaggaagcttttcagaatggaaaactgaattctctacacctttgtgaagctccaggagcttttatagctagtctcaaccactacttaaaatcccatcggtttccttgtcattggagttgggtagcgaatactctgaatccataccatgaagcaaatgacgacctcatgatgattatggatgaccggcttattgcaaataccttgcactggtggtactttggtccagataacactggtgatatcatgaccctgaaattcttgactggacttcagaatttcataagcagcatggctactgttcacttggtcactgcagatgggagttttgattgccaaggaaacccaggtgaacaagaagctttagtttcttctttgcattactgtgaagttgtcactgctctgaccactcttggaaacggtggctcttttgttctaaagatgtttactatgtttgaacattgttccataaacttgatgtacctgctaaactgttgttttgaccaagtccatgttttcaaacctgctactagcaaggcaggaaactccgaagtctatgtggtttgcctccactataaggggagagaggccatccatcctctgttatctaagatgaccttgaattttgggactgaaatgaaaaggaaagccctttttccccatcatgtgattcctgattcttttcttaagagacatgaagaatgttgtgtgttctttcataaatatcagctagagactatttctgaaaacattcgtctatttgagtgcatgggaaaggcggaacaagaaaagctgaataatttaagggattgtgctatacaatattttatgcaaaaatttcaactgaaacatctttccagaagtaattggctagtaaaaaaatctagtattggttgtagtacaaatacaaaatggtttgggcagaggaacaaatattttaaaacttataatgaaaggaagatgctagaagccctttcatggaaagataaagtagccaaaggatactttaatagttgggctgaagaacatggtgtatatcatcctgggcagagttctattttagaaggaacagcttccaatcttgagtgtcacttatggcatattttggagggaaagaaactgccaaaggtaaaatgttctcctttttgcaatggtgaaattttaaaaactcttaatgaagcaattgaaaagtcattaggaggagcttttaatttggattccaagtttaggccaaaacagcagtattcttgttcttgtcatgttttttctgaagaactgatattttccgagttgtgtagccttactgagtgccttcaggatgagcaggttgtagtacccagcaatcaaataaagtgcctgctggtgggcttttcgactctccgtaatatcaaaatgcatataccgttggaagttcgactcctagaatcagctgaactcacaacttttagctgttcattgcttcatgatggagatccaacttaccagcgtttatttttggactgccttctacattcattgcgggagcttcatacaggagatgttatgattttgcctgtactttcttgcttcacaagatttatggctggtttgatctttgtactccacagttgttttagattcatcacttttgtttgtcccacatcctctgatcccctgaggacctgcgcagtcctgctatgtgttggttatcaggaccttccaaatccagttttccgatatttgcagagtgtgaatgaattgttgagcactttgctcaactctgactcaccccagcaggttttacagtttgtgccaatggaggtactccttaagggggccctgcttgattttttgtgggatttgaatgctgccattgctaaaaggcatttgcatttcattattcaaagagagagagaagaaattatcaacagccttcagttacaaaactgaacatatgctttctgagattcaactttatgatttcttataatttgcccagtatttgcatcctgttgctctattaatttaaaaaccttttattttggggaaaggccaacatttgcatcattcaaagtctcattaattctggaaaaccatccattctgatctctagggtatatacacccacaggcatagagctcttccacgtggtggaatctatgcaatgatagatattcacactctaaatatgaggtgtgtgtatgtgtatgggtggccacagccatgcttacctatgccatttagttggtcttacttaatctgcttaagatttgcatctgtgtacctttgttcagattagttttttttttccagccgatttcctcttagtggctaatgctgttagtgaattttccaactaatttcctctcattggttaatgttgttaatgaattgagagaggtaattgaggaaaggaaatgagtaaatcactgttcagcaacactgatttccgttaacacatcagttatgaatttcagggaattcatctcgccagattcttgataacatgccattcattgcccttaggtgattgaccctattttcttacatggctcaaataaaactagtatgctgttgtatgaatcttttactgaccacaccatccaactataaaaatataacgggacagctttaaaccaaagatcatgtttagaacaatgaaaaattatttgttgtatctaatacacgcctgtattgtgaaaagcttcatttagcaatgatgtaataatttttaacttccaggaaataatctgtgaatggaaagattttttaagattttgagatagtgtttagtctcatgttgggaacacatgaatgtgatgaacatagtgaatactaaagaaaacgcttcagactttcagaatgatggttcagaatttaaaatttttaatcttttctaatttctttttttcagtgtgaaaatagcactttaccaaaagattagccatgaaatggttattttgccagttacatttgatttcttttgtatctgcaatgtaatgagttattttatttcttctgtatttgcagtgtaatgagtttttgtggcaaagtgtattaagcaatttttcattatcttgaagttccacaaagtggagaatatttatattctcacatgcattttaggcacttttgatatgtgaaaatagatgtattttctgatgcatttggttaataaatattaatctgaacattttcatgttctttgctattttgaattccattatagattcatgaataaagtcattactagagaaaaaaaaag

SEQ ID NO: 24971 - DNA, 3969 bp, Homo sapiens
ttcgggacggagccaaagaatgctccgcctgcgcgcgccgcttccgttgccgtagtggccgggggcgggaggctggcgcctcccagcttctgtactccgcgaagcaaaacctagggagctgaggcctaggcgaggcgagagtcgccggcgtgcgtaacgttggcgcacgtgactccggcccggcctacagggcgcgtgcgcagtgggacttgagtgcctcctggtccctgtctgccggcattcgcggctgcggggcccggagttgctggtaggaggagttggcggaagcacttggaactcctttataagtgtcagctgtgagattttaatttgatttgaaaatgagtaagtgcagaaagacaccagttcagcagctagcaagtcccgcgtcattcagcccagatattcttgctgacatttttgaactctttgccaagaacttttcttatggcaagccacttaataatgagtggcagttaccagatcccagtgagattttcacctgtgaccacactgaatttaatgcatttcttgatttgaagaactccctaaatgaagtaaaaaacctactgagtgataagaaactggatgagtggcatgagcacactgctttcactaataaagcagggaaaatcatttctcatgttagaaaatctgtgaatgctgaactttgtactcaagcatggtgtaagttccatgagattttgtgcagctttccacttattccacaggaagcttttcagaatggaaaactgaattctctacacctttgtgaagctccaggagcttttatagctagtctcaaccactacttaaaatcccatcggtttccttgtcattggagttgggtagcgaatactctgaatccataccatgaagcaaatgacgacctcatgatgattatggatgaccggcttattgcaaataccttgcactggtggtactttggtccagataacactggtgatatcatgaccctgaaattcttgactggacttcagaatttcataagcagcatggctactgttcacttggtcactgcagatgggagttttgattgccaaggaaacccaggtgaacaagaagctttagtttcttctttgcattactgtgaagttgtcactgctctgaccactcttggaaacggtggctcttttgttctaaagatgtttactatgtttgaacattgttccataaacttgatgtacctgctaaactgttgttttgaccaagtccatgttttcaaacctgctactagcaaggcaggaaactccgaagtctatgtggtttgcctccactataaggggagagaggccatccatcctctgttatctaagatgaccttgaattttgggactgaaatgaaaaggaaagccctttttccccatcatgtgattcctgattcttttcttaagagacatgaagaatgttgtgtgttctttcataaatatcagctagagactatttctgaaaacattcgtctatttgagtgcatgggaaaggcggaacaagaaaagctgaataatttaagggattgtgctatacaatattttatgcaaaaatttcaactgaaacatctttccagaagtaattggctagtaaaaaaatctagtattggttgtagtacaaatacaaaatggtttgggcagaggaacaaatattttaaaacttataatgaaaggaagatgctagaagccctttcatggaaagataaagtagccaaaggatactttaatagttgggctgaagaacatggtgtatatcatcctgggcagagttctattttagaaggaacagcttccaatcttgagtgtcacttatggcatattttggagggaaagaaactgccaaaggtaaaatgttctcctttttgcaatggtgaaattttaaaaactcttaatgaagcaattgaaaagtcattaggaggagcttttaatttggattccaagtttaggccaaaacagcagtattcttgttcttgtcatgttttttctgaagaactgatattttccgagttgtgtagccttactgagtgccttcaggatgagcaggttgtagtacccagcaatcaaataaagtgcctgctggtgggcttttcgactctccgtaatatcaaaatgcatataccgttggaagttcgactcctagaatcagctgaactcacaacttttagctgttcattgcttcatgatggagatccaacttaccagcgtttatttttggactgccttctacattcattgcgggagcttcatacaggagatgttatgattttgcctgtactttcttgcttcacaagatttatggctggtttgatctttgtactccacagttgttttagattcatcacttttgtttgtcccacatcctctgatcccctgaggacctgcgcagtcctgctatgtgttggttatcaggaccttccaaatccagttttccgatatttgcagagtgtgaatgaattgttgagcactttgctcaactctgactcaccccagcaggttttacagtttgtgccaatggaggtactccttaagggggccctgcttgattttttgtgggatttgaatgctgccattgctaaaaggcatttgcatttcattattcaaagagagagagaagaaattatcaacagccttcagttacaaaactgaacatatgctttctgagattcaactttatgatttcttataatttgcccagtatttgcatcctgttgctctattaatttaaaaaccttttattttggggaaaggccaacatttgcatcattcaaagtctcattaattctggaaaaccatccattctgatctctagggtatatacacccacaggcatagagctcttccacgtggtggaatctatgcaatgatagatattcacactctaaatatgaggtgtgtgtatgtgtatgggtggccacagccatgcttacctatgccatttagttggtcttacttaatctgcttaagatttgcatctgtgtacctttgttcagattagttttttttttccagccgatttcctcttagtggctaatgctgttagtgaattttccaactaatttcctctcattggttaatgttgttaatgaattgagagaggtaattgaggaaaggaaatgagtaaatcactgttcagcaacactgatttccgttaacacatcagttatgaatttcagggaattcatctcgccagattcttgataacatgccattcattgcccttaggtgattgaccctattttcttacatggctcaaataaaactagtatgctgttgtatgaatcttttactgaccacaccatccaactataaaaatataacgggacagctttaaaccaaagatcatgtttagaacaatgaaaaattatttgttgtatctaatacacgcctgtattgtgaaaagcttcatttagcaatgatgtaataatttttaacttccaggaaataatctgtgaatggaaagattttttaagattttgagatagtgtttagtctcatgttgggaacacatgaatgtgatgaacatagtgaatactaaagaaaacgcttcagactttcagaatgatggttcagaatttaaaatttttaatcttttctaatttctttttttcagtgtgaaaatagcactttaccaaaagattagccatgaaatggttattttgccagttacatttgatttcttttgtatctgcaatgtaatgagttattttatttcttctgtatttgcagtgtaatgagtttttgtggcaaagtgtattaagcaatttttcattatcttgaagttccacaaagtggagaatatttatattctcacatgcattttaggcacttttgatatgtgaaaatagatgtattttctgatgcatttggttaataaatattaatctgaacattttcatgttctttgctattttgaattccattatagattcatgaataaagtcattactagagaaaaaaaaag

SEQ ID NO: 24972 - DNA, 3159 bp, Homo sapiens
gtaccggacacactgtaacccgatcagctatacctttgtgaagctccaggagcttttatagctagtctcaaccactacttaaaatcccatcggtttccttgtcattggagttgggtagcgaatactctgaatccataccatgaagcaaatgacgacctcatgatgattatggatgaccggcttattgcaaataccttgcactggtggtactttggtccagataacactggtgatatcatgaccctgaaattcttgactggacttcagaatttcataagcagcatggctactgttcacttggtcactgcagatgggagttttgattgccaaggaaacccaggtgaacaagaagctttagtttcttctttgcattactgtgaagttgtcactgctctgaccactcttggaaacggtggctcttttgttctaaagatgtttactatgtttgaacattgttccataaacttgatgtacctgctaaactgttgttttgaccaagtccatgttttcaaacctgctactagcaaggcaggaaactccgaagtctatgtggtttgcctccactataaggggagagaggccatccatcctctgttatctaagatgaccttgaattttgggactgaaatgaaaaggaaagccctttttccccatcatgtgattcctgattcttttcttaagagacatgaagaatgttgtgtgttctttcataaatatcagctagagactatttctgaaaacattcgtctatttgagtgcatgggaaaggcggaacaagaaaagctgaataatttaagggattgtgctatacaatattttatgcaaaaatttcaactgaaacatctttccagaagtaattggctagtaaaaaaatctagtattggttgtagtacaaatacaaaatggtttgggcagaggaacaaatattttaaaacttataatgaaaggaagatgctagaagccctttcatggaaagataaagtagccaaaggatactttaatagttgggctgaagaacatggtgtatatcatcctgggcagagttctattttagaaggaacagcttccaatcttgagtgtcacttatggcatattttggagggaaagaaactgccaaaggtaaaatgttctcctttttgcaatggtgaaattttaaaaactcttaatgaagcaattgaaaagtcattaggaggagcttttaatttggattccaagtttaggccaaaacagcagtattcttgttcttgtcatgttttttctgaagaactgatattttccgagttgtgtagccttactgagtgccttcaggatgagcaggttgtagtacccagcaatcaaataaagtgcctgctggtgggcttttcgactctccgtaatatcaaaatgcatataccgttggaagttcgactcctagaatcagctgaactcacaacttttagctgttcattgcttcatgatggagatccaacttaccagcgtttatttttggactgccttctacattcattgcgggagcttcatacaggagatgttatgattttgcctgtactttcttgcttcacaagatttatggctggtttgatctttgtactccacagttgttttagattcatcacttttgtttgtcccacatcctctgatcccctgaggacctgcgcagtcctgctatgtgttggttatcaggaccttccaaatccagttttccgatatttgcagagtgtgaatgaattgttgagcactttgctcaactctgactcaccccagcaggttttacagtttgtgccaatggaggtactccttaagggggccctgcttgattttttgtgggatttgaatgctgccattgctaaaaggcatttgcatttcattattcaaagagagagagaagaaattatcaacagccttcagttacaaaactgaacatatgctttctgagattcaactttatgatttcttataatttgcccagtatttgcatcctgttgctctattaatttaaaaaccttttattttggggaaaggccaacatttgcatcattcaaagtctcattaattctggaaaaccatccattctgatctctagggtatatacacccacaggcatagagctcttccacgtggtggaatctatgcaatgatagatattcacactctaaatatgaggtgtgtgtatgtgtatgggtggccacagccatgcttacctatgccatttagttggtcttacttaatctgcttaagatttgcatctgtgtacctttgttcagattagttttttttttccagccgatttcctcttagtggctaatgctgttagtgaattttccaactaatttcctctcattggttaatgttgttaatgaattgagagaggtaattgaggaaaggaaatgagtaaatcactgttcagcaacactgatttccgttaacacatcagttatgaatttcagggaattcatctcgccagattcttgataacatgccattcattgcccttaggtgattgaccctattttcttacatggctcaaataaaactagtatgctgttgtatgaatcttttactgaccacaccatccaactataaaaatataacgggacagctttaaaccaaagatcatgtttagaacaatgaaaaattatttgttgtatctaatacacgcctgtattgtgaaaagcttcatttagcaatgatgtaataatttttaacttccaggaaataatctgtgaatggaaagattttttaagattttgagatagtgtttagtctcatgttgggaacacatgaatgtgatgaacatagtgaatactaaagaaaacgcttcagactttcagaatgatggttcagaatttaaaatttttaatcttttctaatttctttttttcagtgtgaaaatagcactttaccaaaagattagccatgaaatggttattttgccagttacatttgatttcttttgtatctgcaatgtaatgagttattttatttcttctgtatttgcagtgtaatgagtttttgtggcaaagtgtattaagcaatttttcattatcttgaagttccacaaagtggagaatatttatattctcacatgcattttaggcacttttgatatgtgaaaatagatgtattttctgatgcatttggttaataaatattaatctg

SEQ ID NO: 24973 - DNA, 601 bp, Homo sapiens
cgatggggcaaatcctgaagcgtacatggctatctctcacagctaaagcatccctcacccctatccagtgcttcttacccctggcgcaagagaatcacctgcggggaggaaaactttcaaaatcccttaaacccaagttgtaaccgcacaactaaatcagaatccttggagctggatctgaaaaaaatacggttgaaagtcgtgcaggtgattacaatgtgtaggcaagccagaaaaccatggctttaacgagcagcttttgttagaaatgatttctccaatgaatgtgaaaacgtttgctgctgaattgtgacctttccattttacctgcttttcctgcaaagtatattttgcagacccaggctgtgcttctccttctgttcctggttcacccagtgccgtgtgtgctcagtgcatcctgtgcacgggtcactgtgtgccctggcctgggtgagcatcattcttcggggagaaccttgatgaaaacaaagctgcattccaaaaagttaaaaccatgctacttactgtgttgaagtaaaaattaaaagacccaggggggctcacccaaaagttaaaacataaataaataacttggaacatt

SEQ ID NO: 24974 - DNA, 1992 bp, Homo sapiens
cgccaacagctgccgtaccgtgccgcgtcgcagccgcacgctagcggggtcaacggcgcggcaggcgcaggggtcctcgccaaggttcggaagaggaccttgaaaatggcttctgggcatgcgccacagcggccgttacgagacgcaaaaccgacgccttggaactgagagcctagagggacggagctcggcgcaccatgaggctcccggggcccaaggccgaccgtgagagcgcacgaggttggcgagccccgcggggaggccgaggcgcgggtgcgggcgccggcgtagccgcggcggtagcgtcacgcagcgaggccgtgcgtgcgcgggcgtcagggcggcgctgagttgaggacgctggcggctccgcgacgagctttgttttttcggttgggcatgctgcttaccgcaggatgatggaagcgacggcccgtacaaagacagaagcgttggtttcactgagtcagtgctgattctctcaaatagagcttgaaggataaatcttcatttttgtttcaacaaaacttcgaaacaaaatggaagaaaataatctacagtgcagtagtgtggttgacggtaattttgaagaagttcccagggagacggcaattcagtttaaacctccactatacagacagcggtaccagttcgttaaaaatttagtggatcaacatgagcctaagaaggttgcagacctgggatgtggtgatacttcactcttaaggctgctaaaagtcaatccatgcattgaattgcttgttggagtagatattaatgaggataaattacgatggagaggggattcgttagctcctttcctgggggattttctgaaacctcgggatctgaatttgaccatcacattgtatcatggctccgttgtggagagagactctcgtttgcttggatttgacttgataacgtgtattgaattaatagaacatttggattcaggtgatctggccagatttcctgaagtggtatttgggtacctgtctccatccatgattgtcatcagcacaccaaactctgaattcaatcccctgtttccatcagtgaccttaagagattcagatcataaatttgagtggaccagaatggagtttcagacctgggctttatatgtggcaaatcgctatgattactctgtggagtttactggtgtcggggaaccaccagctggagctgagaatgttggatactgtacccagataggaatcttccggaaaaatggaggaaaggcaacagaatcatgtctttcagagcagcatgatcagcatgtttataaagctgtttttaccacctcatacccaagcttacagcaggaaaggttctttaaacttgtgttggttaatgaggtgtcccaacaagtggaaagcttaagagtgagccacctgccaaggcggaaagaacaggctggggaacggggtgataagcccaaagacattggtggctcaaaggcccctgtcccatgctttggaccagtcttcacagaggttgagaaggccaagatagagaactctcccacacccttctgtgttggagataaatttttcgtacctctgcagagactccttgcgtatcccaagttgaaccgcttatgtgctaatgaagagatgatgagatcagtcattgctgactcaattcctctgagcagtgatggttctgcagtggtggctgacctgcgtaattattttgatgaacagtttgagttttgaaccatgtttatttcctgaaatttcagggtctcagcgatagttgtgctcacttagaatttagttttttttgtgtaatcctaattcaagtaatgtttttaaagtttcactgcaaaagtctatgttccaagccattggacagacctgcttgagatatggccagactgcagtgagccctgagaaagatatgagggtttaaaacgggtgctttcctttgattttggacttttttgttttctcaagaataaagaagttggatgtggtaatatgttaa

SEQ ID NO: 24975 - DNA, 1291 bp, Homo sapiens
ctttaactcttgaccttgggtgatccatccaccttggcctcccaaagtgttgggattacaggcgtgagccactgtgcctggcccgaataattgttcttaggtcatataagcattattacatattcaaagaagggagaaatcgatacacagatggaaattgtttttgataaatcaattagaaaaataggtgcaagtgaagctagattttattatgtctttctcattaaccattttagaatagaacatttggattcaggtgatctggccagatttcctgaagtggtatttgggtacctgtctccatccatgattgtcatcagcacaccaaactctgaattcaatcccctgtttccatcagtgaccttaagagattcagatcataaatttgagtggaccagaatggagtttcagacctgggctttatatgtggcaaatcgctatgattactctgtggagtttactggtgtcggggaaccaccagctggagctgagaatgttggatactgtacccagataggaatcttccggaaaaatggaggaaaggcaacagaatcatgtctttcagagcagcatgatcagcatgtttataaagctgtttttaccacctcatacccaagcttacagcaggaaaggttctttaaacttgtgttggttaatgaggtgtcccaacaagtggaaagcttaagagtgagccacctgccaaggcggaaagaacaggctggggaacggggtgataagcccaaagacattggtggctcaaaggcccctgtcccatgctttggaccagtcttcacagaggttgagaaggccaagatagagaactctcccacacccttctgtgttggagataaatttttcgtacctctgcagagactccttgcgtatcccaagttgaaccgcttatgtgctaatgaagagatgatgagatcagtcattgctgactcaattcctctgagcagtgatggttctgcagtggtggctgacctgcgtaattattttgatgaacagtttgagttttgaaccatgtttatttcctgaaatttcagggtctcagcgatagttgtgctcacttagaatttagttttttttgtgtaatcctaattcaagtaatgtttttaaagtttcactgcaaaagtctatgttccaagccattggacagacctgcttgagatatggccagactgcagtgagccctgagaaagatatgagggtttaaaacgggtgctttcctttgattttggacttttttgttttctcaagaataaagaagttggatgtggtaatatgttaa

SEQ ID NO: 24976 - DNA, 1771 bp, Homo sapiens
cgccaacagctgccgtaccgtgccgcgtcgcagccgcacgctagcggggtcaacggcgcggcaggcgcaggggtcctcgccaaggttcggaagaggaccttgaaaatggcttctgggcatgcgccacagcggccgttacgagacgcaaaaccgacgccttggaactgagagcctagagggacggagctcggcgcaccatgaggctcccggggcccaaggccgaccgtgagagcgcacgagctgagtcagtgctgattctctcaaatagagcttgaaggataaatcttcatttttgtttcaacaaaacttcgaaacaaaatggaagaaaataatctacagtgcagtagtgtggttgacggtaattttgaagaagttcccagggagacggcaattcagtttaaacctccactatacagacagcggtaccagttcgttaaaaatttagtggatcaacatgagcctaagaaggttgcagacctgggatgtggtgatacttcactcttaaggctgctaaaagtcaatccatgcattgaattgcttgttggagtagatattaatgaggataaattacgatggagaggggattcgttagctcctttcctgggggattttctgaaacctcgggatctgaatttgaccatcacattgtatcatggctccgttgtggagagagactctcgtttgcttggatttgacttgataacgtgtattgaattaatagaacatttggattcaggtgatctggccagatttcctgaagtggtatttgggtacctgtctccatccatgattgtcatcagcacaccaaactctgaattcaatcccctgtttccatcagtgaccttaagagattcagatcataaatttgagtggaccagaatggagtttcagacctgggctttatatgtggcaaatcgctatgattactctgtggagtttactggtgtcggggaaccaccagctggagctgagaatgttggatactgtacccagataggaatcttccggaaaaatggaggaaaggcaacagaatcatgtctttcagagcagcatgatcagcatgtttataaagctgtttttaccacctcatacccaagcttacagcaggaaaggttctttaaacttgtgttggttaatgaggtgtcccaacaagtggaaagcttaagagtgagccacctgccaaggcggaaagaacaggctggggaacggggtgataagcccaaagacattggtggctcaaaggcccctgtcccatgctttggaccagtcttcacagaggttgagaaggccaagatagagaactctcccacacccttctgtgttggagataaatttttcgtacctctgcagagactccttgcgtatcccaagttgaaccgcttatgtgctaatgaagagatgatgagatcagtcattgctgactcaattcctctgagcagtgatggttctgcagtggtggctgacctgcgtaattattttgatgaacagtttgagttttgaaccatgtttatttcctgaaatttcagggtctcagcgatagttgtgctcacttagaatttagttttttttgtgtaatcctaattcaagtaatgtttttaaagtttcactgcaaaagtctatgttccaagccattggacagacctgcttgagatatggccagactgcagtgagccctgagaaagatatgagggtttaaaacgggtgctttcctttgattttggacttttttgttttctcaagaataaagaagttggatgtggtaatatgttaa

SEQ ID NO: 24977 - DNA, 2374 bp, Homo sapiens
cgccaacagctgccgtaccgtgccgcgtcgcagccgcacgctagcggggtcaacggcgcggcaggcgcaggggtcctcgccaaggttcggaagaggaccttgaaaatggcttctgggcatgcgccacagcggccgttacgagacgcaaaaccgacgccttggaactgagagcctagagggacggagctcggcgcaccatgaggctcccggggcccaaggccgaccgtgagagcgcacgaggttggcgagccccgcggggaggccgaggcgcgggtgcgggcgccggcgtagccgcggcggtagcgtcacgcagcgaggccgtgcgtgcgcgggcgtcagggcggcgctgagttgaggacgctggcggctccgcgacgagctttgttttttcggttgggcatgctgcttaccgcaggatgatggaagcgacggcccgtacaaagacagaagcgttggtttcactgagtcagtgctgattctctcaaatagagcttgaaggataaatcttcatttttgtttcaacaaaacttcgaaacaaaatggaagaaaataatctacagtgcagtagtgtggttgacggtaattttgaagaagttcccagggagacggcaattcagtttaaacctccactatacagacagcggtaccagttcgttaaaaatttagtggatcaacatgagcctaagaaggttgcagacctgggatgtggtgatacttcactcttaaggctgctaaaagtcaatccatgcattgaattgcttgttggagtagatattaatgaggataaattacgatggagaggggattcgttagctcctttcctgggggattttctgaaacctcgggatctgaatttgaccatcacattgtatcatggctccgttgtggagagagactctcgtttgcttggatttgacttgataacgtgtattgaattaatagaacatttggattcaggtgatctggccagatttcctgaagtggtatttgggtacctgtctccatccatgattgtcatcagcacaccaaactctgaattcaatcccctgtttccatcagtgaccttaagagattcagatcataaatttgagtggaccagaatggagtttcagacctgggctttatatgtggcaaatcgctatgattactctgtggagtttactggtgtcggggaaccaccagctggagctgagaatgttggatactgtacccagataggaatcttccggaaaaatggaggaaaggcaacagaatcatgtctttcagagcagcatgatcagcatgtttataaagctgtttttaccacctcatacccaagcttacagcaggaaaggttctttaaacttgtgttggttaatgaggtgtcccaacaagtggaaagcttaagagtgagccacctgccaaggcggaaagaacaggctggggaacggggtgataagcccaaagacattggtggctcaaaggcccctgtcccatgctttggaccagtcttcacagaggttgagaaggccaagatagagaactctcccacacccttctgtgttggagataaatttttcgtacctctgcagagactccttgcgtatcccaagttgaaccgcttatgtgctaatgaagagatgatgagatcagtcattgctgactcaattcctctgagcagtgatggttctgcagtggtggctgacctgcgtaattattttgatgaacagtttgagttttgaaccatgtttatttcctgaaatttcagggtctcagcgatagttgtgctcacttagaatttagttttttttgtgtaatcctaattcaagtaatgtttttaaagtttcactgcaaaagtctatgttccaagccattggacagacctgcttgagatatggccagactgcagtgagccctgagaaagatatgagggtttaaaacgggtgctttcctttgattttggacttttttgttttctcaagaataaagaagttggatgtggtaatatgttaaaaaaaaaaaaaaaaaaaaaaaaaaaaaaaaaaaaaaaaaaaaaaaaaaaaacaacaaaaaaaaaaaaaaaaaaaaacaaaaacacaaaaaaaaaacacaaacaataagcagcgcgcgccggcccgcccacgcaccccccggaccggtaacctcggctaactcgccctagtgaactgcagattatttatattacataagcatccgtccacacgtcatagacattaataggtgtatatttatttattaggactcaataatgagccgcttcgtgctccatcaaaaacatcaactctatcgtcggtaaaaaccaccacaagtctcatgactgtctgatactatttttcttaagagctgcactactctactcttgattttggatgaa

SEQ ID NO: 24978 - DNA, 397 bp, Homo sapiens
ccaaaaataggtatattttattatttaaacagtgtctactctgaggtcctcaaaactctttcagggggcccacagatcaaaactattttcataataacaccaagacattgtttgcatctttcattgtcattctcttaggagtgtacagtggagttttccagaaggcatatgccatgtgcatcaccacagcttaaatgcagaaacagacatgaggatctagctgtgtcctactaagccagacattcaggacatctaaaagtgtaaaacaatgccactcttctcactaacttttttgttttggaaaatatatctttcataaaatattgattatgttgatatattacgggtttgttgttattattttaaatgaattaataaataattttctgatttaatt

SEQ ID NO: 24979 - DNA, 10401 bp, Homo sapiens
gtttctctctctggtcggaagcggcggtaatggcggatggtgggttgtggcgccggcggcggctgctgtgagggacgatgagtgcctccttcgtgccgaacggggccagcctggaagattgtcactgtaacctcttctgcctggctgacttgacaggaattaagtggaaaaaatatgtatggcaaggcccaacttctgcccctattctgtttcctgtgacagaagaagaccccattttgagcagttttagtcgctgccttaaggcagatgtacttggtgtttggcggcgagatcaaagacctggaagaagagaattgtggatattttggtggggtgaagaccccagttttgctgaccttattcaccatgacttatcagaagaagaagatggagtgtgggagaatggactttcctatgaatgccgtactctgcttttcaaagcagttcacaatctattggaacggtgtttaatgaacaggaattttgtacgtattggcaagtggtttgtaaagccttatgaaaaagatgaaaaacctataaataaaagtgaacacttgtcctgctccttcacctttttcttgcatggagacagcaatgtttgtaccagtgtggaaattaaccaacatcaacctgtataccttctcagtgaagagcatatcacccttgctcaacagtctaatagcccatttcaagttatcttatgcccatttggactaaatggcactctcacaggacaggcattcaagatgtctgattcagctacaaaaaaattaattggtgaatggaaacagttctatcctatctcatgttgcttgaaggagatgtctgaagaaaaacaggaagatatggattgggaagatgattctttagctgcagtagaagttcttgttgctggtgtccgaatgatctacccagcatgctttgttctagtccctcagtcagacattcctactcctagccctgtgggatccactcactgttcatcttcttgcttgggtgtccaccaagtgcctgcttccacaagagatcctgctatgtcttcggttacgcttacaccacctacgtctcctgaggaagtccaaacagttgatcctcagtctgtccagaagtgggtcaaattttcttcagtatctgatggcttcaactccgatagtactagccaccatggtgggaaaatacccagaaaattagcaaatcatgtggtggatagagtttggcaagaatgcaatatgaacagagcacagaacaagaggaagtattctgcttcatcaggtggtctatgcgaagaagcgacagctgctaaagtggcatcctgggattttgttgaagccacacaaagaacaaattgcagttgtttgaggcacaaaaatctcaagtcaagaaatgctggacaacaaggacaggcaccatctttaggtcagcaacaacaaatacttcctaagcacaagaccaatgagaagcaagaaaagagtgaaaagccacagaaacgccccttgactccttttcaccatcgtgtgtctgttagtgatgatgttggcatggacgcagattcagccagccaaagacttgtgatctctgctccagacagtcaagtgagattttcaaatatccgaactaatgatgtagcaaagactcctcagatgcatggcaccgaaatggcaaattcacctcaaccacccccacttagtcctcacccttgtgatgtggttgatgaaggagtgactaaaacaccttcaactcctcagagtcaacatttttatcaaatgccaacaccagatcccttggttccttctaaaccaatggaagataggatagacagtttgtcccagtctttcccacctcaatatcaggaagctgtagaacctacagtatatgttggtacagcagtaaacttggaagaagatgaagccaatatagcctggaagtattacaagttcccaaagaaaaaagatgtagagtttttaccacctcaacttccaagtgataaattcaaggatgatccagttggaccttttggacaggaaagtgtaacatcagttacagagttaatggtgcaatgtaagaaacctttaaaagtttctgatgaattagtgcagcaatatcaaattaaaaaccagtgtctttcagcaatagcatctgatgcagaacaagaacctaaaattgatccatatgcatttgttgaaggagatgaggaattcctttttcctgataaaaaagatagacaaaatagtgagagagaagctggaaaaaaacacaaggtagaagatgggacatctagtgtaacagtgttatcacatgaagaagatgctatgtcattatttagtccctctatcaagcaagatgctccacgccctactagtcatgcccgtcctccatcaacaagtttgatttatgactcagacctggctgtctcttatactgaccttgataatctcttcaattctgatgaagatgaactaacacctggatctaaaagatcagcaaatggatcagatgataaagccagctgcaaggaatcaaagacaggaaatctggacccgttatcttgcataagcactgcagatcttcataaaatgtatcctacaccaccatcattggaacaacatattatgggattttccccaatgaatatgaataataaagaatatggtagtatggatacaacacctggaggaactgttctagaaggaaatagttctagtataggagcgcagttcaaaattgaggttgatgagggattctgtagccccaaaccttctgaaattaaagatttttcttatgtctataagcctgaaaattgtcaaattctagtgggatgttccatgtttgcacctctaaaaactctaccaagccaatatctgccccttatcaaattgccagaagagtgtatttaccgtcagagttggactgttggaaaattggaattgctttcttcagggccttcaatgccattcatcaaagagggtgatggaagtaatatggatcaagaatatggcactgcttatacacctcaaactcatacttcttgtgggatgcctcctagcagtgcacctcctagtaacagcggagcaggaattcttccttctccatccacccctcggtttccaactccaaggactccaaggactcctcggactcctcgtggagctggtggacctgctagtgctcaaggttcagtcaaatatgaaaattcagacttgtattcaccagcttctaccccatctacatgcagaccccttaattctgttgaacctgcaactgtcccttccatccctgaagcacacagtctttatgtaaacctcatcctttcagaatcagttatgaatttgtttaaagactgtaactctgatagttgttgcatctgtgtttgcaacatgaacatcaagggtgccgatgttggagtttacattccagatccaacgcaggaagcacaatataggtgtacctgtggcttcagtgctgtcatgaacagaaaatttggaaacaattcaggattatttcttgaagatgaactagatatcataggacgcaatacagactgtggcaaagaagcagaaaaacgttttgaagctctcagggctacctctgctgaacatgttaatggaggactaaaggaatctgaaaaattatctgatgatttgatattattgctacaagatcagtgcactaatttattttcaccctttggagcagcagaccaagatccttttcctaaaagtggtgtaattagcaattgggtacgtgttgaagagcgtgactgttgcaatgactgctaccttgcattagaacatgggcgtcagttcatggataacatgtcaggaggaaaagttgatgaagcacttgtgaaaagttcatgcttacacccctggtccaaaagaaacgatgtgagtatgcagtgctcacaggatatacttcgaatgctcctctctcttcagccagttcttcaggatgccattcagaaaaaaagaacagtaagaccttggggtgttcagggtcctctcacttggcaacaatttcataaaatggctggccgaggctcttatggaactgatgaatccccagaaccactgccaatccccacatttttgttgggttatgattatgattatctggtgctttctccatttgctcttccttattgggagagacttatgctggaaccctatggatctcaaagagatatagcctatgttgtactgtgtccagaaaatgaagccttgttaaatggagcaaaaagcttttttagagatcttactgcaatatatgagtcctgtcgattaggtcaacatagacctgtttctcgactgttaacagatgggatcatgagagttggatctactgcatcaaagaaactatcagaaaagttggtagcagaatggttttctcaggcagctgatggtaacaatgaagcattttctaaactcaagctttatgcacaagtctgcagatatgacctaggtccttatcttgcttccctgccattggacagctctctactttcccagccaaatttagttgcccctacaagtcagtctttgattactccacctcagatgacaaatactggaaatgctaatactccatctgccaccttagcatctgcagcgagcagcactatgacagtgacttcaggtgttgccatatctacttcagttgccacagctaattcaactttgaccacagcttcaacttcatcttcatcatcctccaacttgaatagtggagtatcatcaaataaactaccttcgtttccaccctttggcagtatgaacagtaatgctgcaggatccatgtctacacaagcaaatacagttcagagtggtcagctaggagggcaacagacatcagctctacagacagctgggatttctggagaatcatcttcacttcccactcagccgcatcctgatgtgtctgaaagcacgatggatcgggataaagtgggaatccccacagatggtgattcacatgcagtcacgtatccacctgcaattgttgtttatataattgatccttttacatacgaaaatacagacgagagcactaactcttctagtgtgtggacattggggctacttcgatgctttctagaaatggtccagactcttcctcctcatatcaagagtactgtttctgtacagattattccttgtcagtacctgttgcaacctgtgaagcatgaagatagagaaatctatccccagcatttaaaatccctggctttttcggcctttacccagtgtcggaggccacttccaacatcaaccaatgtgaaaacattgactggctttggtccaggtttagccatggaaactgcccttagaagtcctgatagaccagagtgtattcgactttatgcacctccttttattctggctccagtgaaggacaaacagacagagctaggagaaacatttggagaagctggacagaaatataatgttctttttgtgggatactgtttatcacatgatcaaaggtggattcttgcatcttgcacagatctatatggagaacttttagaaacttgtatcattaacatcgatgttccaaatagggctcgtcggaaaaaaagttctgctagaaaatttggtctacagaaactttgggagtggtgcttaggacttgtacaaatgagttcattgccatggagagttgtaattggtcgtctaggaaggattggtcatggagaattgaaagattggagctgtttgctgagtcgtcgaaacttgcagtctctaagtaaaaggctcaaagacatgtgtagaatgtgtggtatatctgctgcagactcccctagcattctcagtgcttgcttggtggcaatggagccgcaaggctcttttgttattatgccagattctgtgtcaactggttctgtatttggaagaagcacgactctaaatatgcagacatctcagctaaataccccacaggatacatcatgtactcatatacttgtgtttcctacttctgcttctgtgcaagtagcttcagctacttataccactgaaaatttggatttagctttcaatcccaacaatgatggagcagatggaatgggtatctttgatttgttagacacaggagatgatcttgaccctgatatcattaatatccttcctgcttctccaactggttctcctgtacattctccaggatctcattacccccatggaggtgatgcgggcaagggtcagagtactgatcggctactatcaacagaacctcatgaggaagtacctaatattcttcagcaaccattggcccttggttactttgtatcaactgccaaagcaggtccattacctgactggttctggtcagcatgtcctcaagcacaatatcagtgtcccctttttcttaaggcctctttgcacctccacgtgccttcagtgcaatctgacgagctgcttcacagtaaacactcccacccacttgactcaaatcagacttcagatgtcctcaggtttgttttggaacagtacaatgcactctcctggctaacctgtgaccctgcaacccaggacagacgctcatgtctcccaattcattttgtggtgctgaatcagttatataactttattatgaatatgctgtgatcttcatttgatggaactgtgcaagaaaagaacaaggaaaaatggatgtttcgctgcaggattaagttacaattatcttctcagtgaaggtcatttgtgatggggtctaattcttattacttcaacaaatattgttttgacttggggggaggggctataaccctgctatttttcattgactctattgaactctttaggatgatgactgatcatacaaaacgtattataacattttcgtagcaaaattaaccttttttttttccagtcacagtatttgtgaaaagtaatgagccatagtacccagtcatgttaaatgaatattaaaagcatggagaggaaacatgaggaacaatgaatttcaacatatggcttcagaacatgaagatgttcttgtatggattatagtatctagtattcaaaaatgcctgcatctcttctcttatttattgtaagtttttaaatgtataaattgtcttatatttcttaacctcttttataaaaattttcctagaaggtttatactgccttcttgctttaaagcaattggtctaaaatatatgtaatcgtcttaattaaaaagttgcagtagggttgcttttagagtattatttttttgtaagggggtgggtgggacagtaaatttgtattgtctcgatgtacagtttaacggggatagagggggaataatgtccataccattgtgtgtggaggatttacagctaagctgtagttgcagagtacatgtacagtaatgaagttcactgtgtttataaattgaaaaggtaccaggtcttacagcattttatatatcacatctttacagaataacatgatggcaatatacaagtggtattgttaggtggtttaacttagaataaaatgagaattcttcagttatattttgtactatggtttagggctatgactaatatttcaggccatttccggtgaaagaaacttagttttacaagaaaaaccatttgctactgaatgcttaaactaattttagtgtttaatgttacatgcttaaatttttttcagttttaacagtggcatatttaggcatggaaatattattatgaaatttattttcaggatctgctataaggttgaaatttagcccagctctaggcattttacaaattatttttcaagcagtcattcttgattgtttgacttttttttttaaattaaagattgggaatgtatgtgagagtatgcatatgtatgggtgtgtgtgtgtgcgcgcaatcaaactgtggtgtaaatagattctcagtgaattctgggtattcagactctattccactagtgaaagaaccattttttaaacttcccttgccttttttatttatttaattttcttggtttggagatgtcagtcccaaacaccagagtctgtacttttctataacacagctcagattaaggtagggcatatgccaaggaggttctcacctccctaaagaagggacttgaattttagggactttaattcacccctccttcaatacaactttcccccttcttgtttgcacatgccaagataactgcttttatgcaggctgtacccccttgaaaaatcctttctacagtgctgctcacaaaagagcccaagttcgcctcctacctgcattgctgacttgaattcacagtcgccgagtctacctagctttcttggaagcagtctagcaaaatttctatttgtacgttcactaattatctacaaggacaaaatcagttgtatttacaaaactctacttcagtgtttgttttagtttttttttttactgaaacttgtttttgtgaatactctgtgcttagaattaaatatcactttcttatgaacaacataacttcttcagattgtgtatatgaaaacattagcaagtcttgttttttctatgaagcaaacacaattggtgacaaaggttgtcaatcatttcttcaaaattataatgcagttctaatggtcagcatattttgatattaaatttaaagatcacctctctgcatttgtttttaaattatgctaatacaccacacattatgttggtatgttttgttctgtactttctttaaaaaaaaaaaaaaaacttgtctgagatttgaaggaaaatgtgcttatttggaatttccataaaaagagtatcctttttatacacttaatagtgactttacaaaataaaagttatattctcagttgtttaaaatcactaacctatgataaccacacctcaatttgaaagtagatttaaaattattccctgacaggttatttaatatggagccataaggagggaacccagtacacaattattttttatttgggaatcagggaatagttcccaaatatacaggatttattgataagattttttttcttcccttcatatatccattcaaactcaatggaaagttattaaataaccattagaaaagctcagtagacttatttgagaaattaagccttgtgcaggatgatggatttgacttactaatgtactgtcacagacaaatatgggtagttttgtttaaataggtaagcaaaatattatactttatagcagtggattaccaacaccttgacttctttgttacagtgctaacatcttttttttgtgcaggtatccatgattattaagcagggtggaagttcagtattttgtcatttaaaaagattagttatataatgtctgcttccagccagtgagaaacatctagccatacctttcttatgcaagccattgagttatcaggactgtgaattaacactgtatgaataaatttctgtacaccttattgtttggccagaaggccaccaagtgtacttatatgtaatccttaaattttaaagtagctgtaatttttaaatatttctaaacttttcttaaaccactaaaattaagctcttactacttagtcaactatcctcagctgtattcgtactcaattgtcagtatggcacagattactgtattaaaatattctcctttcgtcttcatatttaccttctgaggtaattttttaacttaatgtgttactacaaagatttgcagatctttaatcaagcactatgttaatactgtaatatcagaatactatgttgcattatttaaaatgttcaaattgaatagattaaaaagtttttaaatgctattgcatcatataatttgctattcatccactatggcattgcatatcaatcagttaatacacttaatgttgcatgagtgatattttggtctgggtttcctcttaagattttagtttgtctgaattaaggaaaaatgtttttaatatacattcttattttgtcccacccctccagaaataagctggaaatcttaactttttggggggtcttttttggtgttttaatgggcccagaactgtggtttaaatttttatgtatgtattttcttttttgtggagtataaatttaaaaactggatttgggacctaaaatactcctcaggttgatgtattcatgaagttttaaaacatctttagttttcaaagtaaactggatatgtggaccttaaagttattgagtttaagctacaaattgtaacgtcattactggacatgtcagcatcaaccctctcaaaatagcttggtcactttatgaaggggcgttttaaagttgttgtttagcagtgacatttaatatggtccaattgcttttctttttaacgtgacaaaaagagaataaggaacaaacactattgctgccgaatgccataacactgagttgtacaaattgtgattgaggaaatgaaaaggtttatacttttta

SEQ ID NO: 24980 - DNA, 9559 bp, Homo sapiens
gtttctctctctggtcggaagcggcggtaatggcggatggtgggttgtggcgccggcggcggctgctgtgagggacgatgagtgcctccttcgtgccgaacggggccagcctggaagattgtcactgtaacctcttctgcctggctgacttgacaggaattaagtggaaaaaatatgtatggcaaggcccaacttctgcccctattctgtttcctgtgacagaagaagaccccattttgagcagttttagtcgctgccttaaggcagatgtacttggtgtttggcggcgagatcaaagacctggaagaagagaattgtggatattttggtggggtgaagaccccagttttgctgaccttattcaccatgacttatcagaagaagaagatggagtgtgggagaatggactttcctatgaatgccgtactctgcttttcaaagcagttcacaatctattggaacggtgtttaatgaacaggaattttgtacgtattggcaagtggtttgtaaagccttatgaaaaagatgaaaaacctataaataaaagtgaacacttgtcctgctccttcacctttttcttgcatggagacagcaatgtttgtaccagtgtggaaattaaccaacatcaacctgtataccttctcagtgaagagcatatcacccttgctcaacagtctaatagcccatttcaagttatcttatgcccatttggactaaatggcactctcacaggacaggcattcaagatgtctgattcagctacaaaaaaattaattggtgaatggaaacagttctatcctatctcatgttgcttgaaggagatgtctgaagaaaaacaggaagatatggattgggaagatgattctttagctgcagtagaagttcttgttgctggtgtccgaatgatctacccagcatgctttgttctagtccctcagtcagacattcctactcctagccctgtgggatccactcactgttcatcttcttgcttgggtgtccaccaagtgcctgcttccacaagagatcctgctatgtcttcggttacgcttacaccacctacgtctcctgaggaagtccaaacagttgatcctcagtctgtccagaagtgggtcaaattttcttcagtatctgatggcttcaactccgatagtactagccaccatggtgggaaaatacccagaaaattagcaaatcatgtggtggatagagtttggcaagaatgcaatatgaacagagcacagaacaagaggaagtattctgcttcatcaggtggtctatgcgaagaagcgacagctgctaaagtggcatcctgggattttgttgaagccacacaaagaacaaattgcagttgtttgaggcacaaaaatctcaagtcaagaaatgctggacaacaaggacaggcaccatctttaggtcagcaacaacaaatacttcctaagcacaagaccaatgagaagcaagaaaagagtgaaaagccacagaaacgccccttgactccttttcaccatcgtgtgtctgttagtgatgatgttggcatggacgcagattcagccagccaaagacttgtgatctctgctccagacagtcaagtgagattttcaaatatccgaactaatgatgtagcaaagactcctcagatgcatggcaccgaaatggcaaattcacctcaaccacccccacttagtcctcacccttgtgatgtggttgatgaaggagtgactaaaacaccttcaactcctcagagtcaacatttttatcaaatgccaacaccagatcccttggttccttctaaaccaatggaagataggatagacagtttgtcccagtctttcccacctcaatatcaggaagctgtagaacctacagtatatgttggtacagcagtaaacttggaagaagatgaagccaatatagcctggaagtattacaagttcccaaagaaaaaagatgtagagtttttaccacctcaacttccaagtgataaattcaaggatgatccagttggaccttttggacaggaaagtgtaacatcagttacagagttaatggtgcaatgtaagaaacctttaaaagtttctgatgaattagtgcagcaatatcaaattaaaaaccagtgtctttcagcaatagcatctgatgcagaacaagaacctaaaattgatccatatgcatttgttgaaggagatgaggaattcctttttcctgataaaaaagatagacaaaatagtgagagagaagctggaaaaaaacacaaggtagaagatgggacatctagtgtaacagtgttatcacatgaagaagatgctatgtcattatttagtccctctatcaagcaagatgctccacgccctactagtcatgcccgtcctccatcaacaagtttgatttatgactcagacctggctgtctcttatactgaccttgataatctcttcaattctgatgaagatgaactaacacctggatctaaaagatcagcaaatggatcagatgataaagccagctgcaaggaatcaaagacaggaaatctggacccgttatcttgcataagcactgcagatcttcataaaatgtatcctacaccaccatcattggaacaacatattatgggattttccccaatgaatatgaataataaagaatatggtagtatggatacaacacctggaggaactgttctagaaggaaatagttctagtataggagcgcagttcaaaattgaggttgatgagggattctgtagccccaaaccttctgaaattaaagatttttcttatgtctataagcctgaaaattgtcaaattctagtgggatgttccatgtttgcacctctaaaaactctaccaagccaatatctgccccttatcaaattgccagaagagtgtatttaccgtcagagttggactgttggaaaattggaattgctttcttcagggccttcaatgccattcatcaaagagggtgatggaagtaatatggatcaagaatatggcactgcttatacacctcaaactcatacttcttgtgggatgcctcctagcagtgcacctcctagtaacagcggagcaggaattcttccttctccatccacccctcggtttccaactccaaggactccaaggactcctcggactcctcgtggagctggtggacctgctagtgctcaaggttcagtcaaatatgaaaattcagacttgtattcaccagcttctaccccatctacatgcagaccccttaattctgttgaacctgcaactgtcccttccatccctgaagcacacagtctttatgtaaacctcatcctttcagaatcagttatgaatttgtttaaagactgtaactctgatagttgttgcatctgtgtttgcaacatgaacatcaagggtgccgatgttggagtttacattccagatccaacgcaggaagcacaatataggtgtacctgtggcttcagtgctgtcatgaacagaaaatttggaaacaattcaggattatttcttgaagatgaactagatatcataggacgcaatacagactgtggcaaagaagcagaaaaacgttttgaagctctcagggctacctctgctgaacatgttaatggaggactaaaggaatctgaaaaattatctgatgatttgatattattgctacaagatcagtgcactaatttattttcaccctttggagcagcagaccaagatccttttcctaaaagtggtgtaattagcaattgggtacgtgttgaagagcgtgactgttgcaatgactgctaccttgcattagaacatgggcgtcagttcatggataacatgtcaggaggaaaagttgatgaagcacttgtgaaaagttcatgcttacacccctggtccaaaagaaacgatgtgagtatgcagtgctcacaggatatacttcgaatgctcctctctcttcagccagttcttcaggatgccattcagaaaaaaagaacagtaagaccttggggtgttcagggtcctctcacttggcaacaatttcataaaatggctggccgaggctcttatggaactgatgaatccccagaaccactgccaatccccacatttttgttgggttatgattatgattatctggtgctttctccatttgctcttccttattgggagagacttatgctggaaccctatggatctcaaagagatatagcctatgttgtactgtgtccagaaaatgaagccttgttaaatggagcaaaaagcttttttagagatcttactgcaatatatgagtcctgtcgattaggtcaacatagacctgtttctcgactgttaacagatgggatcatgagagttggatctactgcatcaaagaaactatcagaaaagttggtagcagaatggttttctcaggcagctgatggtaacaatgaagcattttctaaactcaagctttatgcacaagtctgcagatatgacctaggtccttatcttgcttccctgccattggacagctctctactttcccagccaaatttagttgcccctacaagtcagtctttgattactccacctcagatgacaaatactggaaatgctaatactccatctgccaccttagcatctgcagcgagcagcactatgacagtgacttcaggtgttgccatatctacttcagttgccacagctaattcaactttgaccacagcttcaacttcatcttcatcatcctccaacttgaatagtggagtatcatcaaataaactaccttcgtttccaccctttggcagtatgaacagtaatgctgcaggatccatgtctacacaagcaaatacagttcagagtggtcagctaggagggcaacagacatcagctctacagacagctgggatttctggagaatcatcttcacttcccactcagccgcatcctgatgtgtctgaaagcacgatggatcgggataaagtgggaatccccacagatggtgattcacatgcagtcacgtatccacctgcaattgttgtttatataattgatccttttacatacgaaaatacagacgagagcactaactcttctagtgtgtggacattggggctacttcgatgctttctagaaatggtccagactcttcctcctcatatcaagagtactgtttctgtacagattattccttgtcagtacctgttgcaacctgtgaagcatgaagatagagaaatctatccccagcatttaaaatccctggctttttcggcctttacccagtgtcggaggccacttccaacatcaaccaatgtgaaaacattgactggctttggtccaggtttagccatggaaactgcccttagaagtcctgatagaccagagtgtattcgactttatgcacctccttttattctggctccagtgaaggacaaacagacagagctaggagaaacatttggagaagctggacagaaatataatgttctttttgtgggatactgtttatcacatgatcaaaggtggattcttgcatcttgcacagatctatatggagaacttttagaaacttgtatcattaacatcgatgttccaaatagggctcgtcggaaaaaaagttctgctagaaaatttggtctacagaaactttgggagtggtgcttaggacttgtacaaatgagttcattgccatggagagttgtaattggtcgtctaggaaggattggtcatggagaattgaaagattggagctgtttgctgagtcgtcgaaacttgcagtctctaagtaaaaggctcaaagacatgtgtagaatgtgtggtatatctgctgcagactcccctagcattctcagtgcttgcttggtggcaatggagccgcaaggctcttttgttattatgccagattctgtgtcaactggttctgtatttggaagaagcacgactctaaatatgcagacatctcagctaaataccccacaggatacatcatgtactcatatacttgtgtttcctacttctgcttctgtgcaagtagcttcagctacttataccactgaaaatttggatttagctttcaatcccaacaatgatggagcagatggaatgggtatctttgatttgttagacacaggagatgatcttgaccctgatatcattaatatccttcctgcttctccaactggttctcctgtacattctccaggatctcattacccccatggaggtgatgcgggcaagggtcagagtactgatcggctactatcaacagaacctcatgaggaagtacctaatattcttcagcaaccattggcccttggttactttgtatcaactgccaaagcaggtccattacctgactggttctggtcagcatgtcctcaagcacaatatcagtgtcccctttttcttaaggcctctttgcacctccacgtgccttcagtgcaatctgacgagctgcttcacagtaaacactcccacccacttgactcaaatcagacttcagatgtcctcaggtttgttttggaacagtacaatgcactctcctggctaacctgtgaccctgcaacccaggacagacgctcatgtctcccaattcattttgtggtgctgaatcagttatataactttattatgaatatgctgtgatcttcatttgatggaactgtgcaagaaaagaacaaggaaaaatggatgtttcgctgcaggattaagttacaattatcttctcagtgaaggtcatttgtgatggggtctaattcttattacttcaacaaatattgttttgacttggggggaggggctataaccctgctatttttcattgactctattgaactctttaggatgatgactgatcatacaaaacgtattataacattttcgtagcaaaattaaccttttttttttccagtcacagtatttgtgaaaagtaatgagccatagtacccagtcatgttaaatgaatattaaaagcatggagaggaaacatgaggaacaatgaatttcaacatatggcttcagaacatgaagatgttcttgtatggattatagtatctagtattcaaaaatgcctgcatctcttctcttatttattgtaagtttttaaatgtataaattgtcttatatttcttaacctcttttataaaaattttcctagaaggtttatactgccttcttgctttaaagcaattggtctaaaatatatgtaatcgtcttaattaaaaagttgcagtagggttgcttttagagtattatttttttgtaagggggtgggtgggacagtaaatttgtattgtctcgatgtacagtttaacggggatagagggggaataatgtccataccattgtgtgtggaggatttacagctaagctgtagttgcagagtacatgtacagtaatgaagttcactgtgtttataaattgaaaaggtaccaggtcttacagcattttatatatcacatctttacagaataacatgatggcaatatacaagtggtattgttaggtggtttaacttagaataaaatgagaattcttcagttatattttgtactatggtttagggctatgactaatatttcaggccatttccggtgaaagaaacttagttttacaagaaaaaccatttgctactgaatgcttaaactaattttagtgtttaatgttacatgcttaaatttttttcagttttaacagtggcatatttaggcatggaaatattattatgaaatttattttcaggatctgctataaggttgaaatttagcccagctctaggcattttacaaattatttttcaagcagtcattcttgattgtttgacttttttttttaaattaaagattgggaatgtatgtgagagtatgcatatgtatgggtgtgtgtgtgtgcgcgcaatcaaactgtggtgtaaatagattctcagtgaattctgggtattcagactctattccactagtgaaagaaccattttttaaacttcccttgccttttttatttatttaattttcttggtttggagatgtcagtcccaaacaccagagtctgtacttttctataacacagctcagattaaggtagggcatatgccaaggaggttctcacctccctaaagaagggacttgaattttagggactttaattcacccctccttcaatacaactttcccccttcttgtttgcacatgccaagataactgcttttatgcaggctgtacccccttgaaaaatcctttctacagtgctgctcacaaaagagcccaagttcgcctcctacctgcattgctgacttgaattcacagtcgccgagtctacctagctttcttggaagcagtctagcaaaatttctatttgtacgttcactaattatctacaaggacaaaatcagttgtatttacaaaactctacttcagtgtttgttttagtttttttttttactgaaacttgtttttgtgaatactctgtgcttagaattaaatatcactttcttatgaacaacataacttcttcagattgtgtatatgaaaacattagcaagtcttgttttttctatgaagcaaacacaattggtgacaaaggttgtcaatcatttcttcaaaattataatgcagttctaatggtcagcatattttgatattaaatttaaagatcacctctctgcatttgtttttaaattatgctaatacaccacacattatgttggtatgttttgttctgtactttctttaaaaaaaaaaaaaaaacttgtctgagatttgaaggaaaatgtgcttatttggaatttccataaaaagagtatcctttttatacacttaatagtgactttacaaaataaaagttatattctcagttgtttaaaatcactaacctatgataaccacacctcaatttgaaagtagatttaaaattattccctgacaggttatttaatatggagccataaggagggaacccagtacacaattattttttatttgggaatcagggaatagttcccaaatatacaggatttattgataagattttttttcttcccttcatatatccattcaaactcaatggaaagttattaaataaccattagaaaagctcagtagacttatttgagaaattaagccttgtgcaggatgatggatttgacttactaatgtactgtcacagacaaatatgggtagttttgtttaaataggtaagcaaaatattatactttatagcagtggattaccaacaccttgacttctttgttacagtgctaacatcttttttttgtgcaggtatccatgattattaagcagggtggaagttcagtattttgtcatttaaaaagattagttatataatgtctgcttccagccagtgagaaacatctagccatacctttcttatgcaagccattgagttatcaggactgtgaattaacactgtatgaataaatttctgtacaccttattgtttggccagaaggccaccaagtgtacttatatgtaatccttaaattttaaagtagctgtaatttttaaatatttctaaacttttcttaaaccactaaaattaagctcttaaaaaaaagtcaaaaatcctctctgcgtttgggggatcggtat

SEQ ID NO: 24981 - DNA, 9635 bp, Homo sapiens
acggaatctcgctctgtcgctgctcaggctggagtgcaatggcgtgatctctgctcactgcaacctccacctcccgggctcaagcagttctcctgcctcaccctcccaagtagctgggattacagctggtgtccgaatgatctacccagcatgctttgttctagtccctcagtcagacattcctactcctagccctgtgggatccactcactgttcatcttcttgcttgggtgtccaccaagtgcctgcttccacaagagatcctgctatgtcttcggttacgcttacaccacctacgtctcctgaggaagtccaaacagttgatcctcagtctgtccagaagtgggtcaaattttcttcagtatctgatggcttcaactccgatagtactagccaccatggtgggaaaatacccagaaaattagcaaatcatgtggtggatagagtttggcaagaatgcaatatgaacagagcacagaacaagaggaagtattctgcttcatcaggtggtctatgcgaagaagcgacagctgctaaagtggcatcctgggattttgttgaagccacacaaagaacaaattgcagttgtttgaggcacaaaaatctcaagtcaagaaatgctggacaacaaggacaggcaccatctttaggtcagcaacaacaaatacttcctaagcacaagaccaatgagaagcaagaaaagagtgaaaagccacagaaacgccccttgactccttttcaccatcgtgtgtctgttagtgatgatgttggcatggacgcagattcagccagccaaagacttgtgatctctgctccagacagtcaagtgagattttcaaatatccgaactaatgatgtagcaaagactcctcagatgcatggcaccgaaatggcaaattcacctcaaccacccccacttagtcctcacccttgtgatgtggttgatgaaggagtgactaaaacaccttcaactcctcagagtcaacatttttatcaaatgccaacaccagatcccttggttccttctaaaccaatggaagataggatagacagtttgtcccagtctttcccacctcaatatcaggaagctgtagaacctacagtatatgttggtacagcagtaaacttggaagaagatgaagccaatatagcctggaagtattacaagttcccaaagaaaaaagatgtagagtttttaccacctcaacttccaagtgataaattcaaggatgatccagttggaccttttggacaggaaagtgtaacatcagttacagagttaatggtgcaatgtaagaaacctttaaaagtttctgatgaattagtgcagcaatatcaaattaaaaaccagtgtctttcagcaatagcatctgatgcagaacaagaacctaaaattgatccatatgcatttgttgaaggagatgaggaattcctttttcctgataaaaaagatagacaaaatagtgagagagaagctggaaaaaaacacaaggtagaagatgggacatctagtgtaacagtgttatcacatgaagaagatgctatgtcattatttagtccctctatcaagcaagatgctccacgccctactagtcatgcccgtcctccatcaacaagtttgatttatgactcagacctggctgtctcttatactgaccttgataatctcttcaattctgatgaagatgaactaacacctggatctaaaagatcagcaaatggatcagatgataaagccagctgcaaggaatcaaagacaggaaatctggacccgttatcttgcataagcactgcagatcttcataaaatgtatcctacaccaccatcattggaacaacatattatgggattttccccaatgaatatgaataataaagaatatggtagtatggatacaacacctggaggaactgttctagaaggaaatagttctagtataggagcgcagttcaaaattgaggttgatgagggattctgtagccccaaaccttctgaaattaaagatttttcttatgtctataagcctgaaaattgtcaaattctagtgggatgttccatgtttgcacctctaaaaactctaccaagccaatatctgccccttatcaaattgccagaagagtgtatttaccgtcagagttggactgttggaaaattggaattgctttcttcagggccttcaatgccattcatcaaagagggtgatggaagtaatatggatcaagaatatggcactgcttatacacctcaaactcatacttcttgtgggatgcctcctagcagtgcacctcctagtaacagcggagcaggaattcttccttctccatccacccctcggtttccaactccaaggactccaaggactcctcggactcctcgtggagctggtggacctgctagtgctcaaggttcagtcaaatatgaaaattcagacttgtattcaccagcttctaccccatctacatgcagaccccttaattctgttgaacctgcaactgtcccttccatccctgaagcacacagtctttatgtaaacctcatcctttcagaatcagttatgaatttgtttaaagactgtaactctgatagttgttgcatctgtgtttgcaacatgaacatcaagggtgccgatgttggagtttacattccagatccaacgcaggaagcacaatataggtgtacctgtggcttcagtgctgtcatgaacagaaaatttggaaacaattcaggattatttcttgaagatgaactagatatcataggacgcaatacagactgtggcaaagaagcagaaaaacgttttgaagctctcagggctacctctgctgaacatgttaatggaggactaaaggaatctgaaaaattatctgatgatttgatattattgctacaagatcagtgcactaatttattttcaccctttggagcagcagaccaagatccttttcctaaaagtggtgtaattagcaattgggtacgtgttgaagagcgtgactgttgcaatgactgctaccttgcattagaacatgggcgtcagttcatggataacatgtcaggaggaaaagttgatgaagcacttgtgaaaagttcatgcttacacccctggtccaaaagaaacgatgtgagtatgcagtgctcacaggatatacttcgaatgctcctctctcttcagccagttcttcaggatgccattcagaaaaaaagaacagtaagaccttggggtgttcagggtcctctcacttggcaacaatttcataaaatggctggccgaggctcttatggaactgatgaatccccagaaccactgccaatccccacatttttgttgggttatgattatgattatctggtgctttctccatttgctcttccttattgggagagacttatgctggaaccctatggatctcaaagagatatagcctatgttgtactgtgtccagaaaatgaagccttgttaaatggagcaaaaagcttttttagagatcttactgcaatatatgagtcctgtcgattaggtcaacatagacctgtttctcgactgttaacagatgggatcatgagagttggatctactgcatcaaagaaactatcagaaaagttggtagcagaatggttttctcaggcagctgatggtaacaatgaagcattttctaaactcaagctttatgcacaagtctgcagatatgacctaggtccttatcttgcttccctgccattggacagctctctactttcccagccaaatttagttgcccctacaagtcagtctttgattactccacctcagatgacaaatactggaaatgctaatactccatctgccaccttagcatctgcagcgagcagcactatgacagtgacttcaggtgttgccatatctacttcagttgccacagctaattcaactttgaccacagcttcaacttcatcttcatcatcctccaacttgaatagtggagtatcatcaaataaactaccttcgtttccaccctttggcagtatgaacagtaatgctgcaggatccatgtctacacaagcaaatacagttcagagtggtcagctaggagggcaacagacatcagctctacagacagctgggatttctggagaatcatcttcacttcccactcagccgcatcctgatgtgtctgaaagcacgatggatcgggataaagtgggaatccccacagatggtgattcacatgcagtcacgtatccacctgcaattgttgtttatataattgatccttttacatacgaaaatacagacgagagcactaactcttctagtgtgtggacattggggctacttcgatgctttctagaaatggtccagactcttcctcctcatatcaagagtactgtttctgtacagattattccttgtcagtacctgttgcaacctgtgaagcatgaagatagagaaatctatccccagcatttaaaatccctggctttttcggcctttacccagtgtcggaggccacttccaacatcaaccaatgtgaaaacattgactggctttggtccaggtttagccatggaaactgcccttagaagtcctgatagaccagagtgtattcgactttatgcacctccttttattctggctccagtgaaggacaaacagacagagctaggagaaacatttggagaagctggacagaaatataatgttctttttgtgggatactgtttatcacatgatcaaaggtggattcttgcatcttgcacagatctatatggagaacttttagaaacttgtatcattaacatcgatgttccaaatagggctcgtcggaaaaaaagttctgctagaaaatttggtctacagaaactttgggagtggtgcttaggacttgtacaaatgagttcattgccatggagagttgtaattggtcgtctaggaaggattggtcatggagaattgaaagattggagctgtttgctgagtcgtcgaaacttgcagtctctaagtaaaaggctcaaagacatgtgtagaatgtgtggtatatctgctgcagactcccctagcattctcagtgcttgcttggtggcaatggagccgcaaggctcttttgttattatgccagattctgtgtcaactggttctgtatttggaagaagcacgactctaaatatgcagacatctcagctaaataccccacaggatacatcatgtactcatatacttgtgtttcctacttctgcttctgtgcaagtagcttcagctacttataccactgaaaatttggatttagctttcaatcccaacaatgatggagcagatggaatgggtatctttgatttgttagacacaggagatgatcttgaccctgatatcattaatatccttcctgcttctccaactggttctcctgtacattctccaggatctcattacccccatggaggtgatgcgggcaagggtcagagtactgatcggctactatcaacagaacctcatgaggaagtacctaatattcttcagcaaccattggcccttggttactttgtatcaactgccaaagcaggtccattacctgactggttctggtcagcatgtcctcaagcacaatatcagtgtcccctttttcttaaggcctctttgcacctccacgtgccttcagtgcaatctgacgagctgcttcacagtaaacactcccacccacttgactcaaatcagacttcagatgtcctcaggtttgttttggaacagtacaatgcactctcctggctaacctgtgaccctgcaacccaggacagacgctcatgtctcccaattcattttgtggtgctgaatcagttatataactttattatgaatatgctgtgatcttcatttgatggaactgtgcaagaaaagaacaaggaaaaatggatgtttcgctgcaggattaagttacaattatcttctcagtgaaggtcatttgtgatggggtctaattcttattacttcaacaaatattgttttgacttggggggaggggctataaccctgctatttttcattgactctattgaactctttaggatgatgactgatcatacaaaacgtattataacattttcgtagcaaaattaaccttttttttttccagtcacagtatttgtgaaaagtaatgagccatagtacccagtcatgttaaatgaatattaaaagcatggagaggaaacatgaggaacaatgaatttcaacatatggcttcagaacatgaagatgttcttgtatggattatagtatctagtattcaaaaatgcctgcatctcttctcttatttattgtaagtttttaaatgtataaattgtcttatatttcttaacctcttttataaaaattttcctagaaggtttatactgccttcttgctttaaagcaattggtctaaaatatatgtaatcgtcttaattaaaaagttgcagtagggttgcttttagagtattatttttttgtaagggggtgggtgggacagtaaatttgtattgtctcgatgtacagtttaacggggatagagggggaataatgtccataccattgtgtgtggaggatttacagctaagctgtagttgcagagtacatgtacagtaatgaagttcactgtgtttataaattgaaaaggtaccaggtcttacagcattttatatatcacatctttacagaataacatgatggcaatatacaagtggtattgttaggtggtttaacttagaataaaatgagaattcttcagttatattttgtactatggtttagggctatgactaatatttcaggccatttccggtgaaagaaacttagttttacaagaaaaaccatttgctactgaatgcttaaactaattttagtgtttaatgttacatgcttaaatttttttcagttttaacagtggcatatttaggcatggaaatattattatgaaatttattttcaggatctgctataaggttgaaatttagcccagctctaggcattttacaaattatttttcaagcagtcattcttgattgtttgacttttttttttaaattaaagattgggaatgtatgtgagagtatgcatatgtatgggtgtgtgtgtgtgcgcgcaatcaaactgtggtgtaaatagattctcagtgaattctgggtattcagactctattccactagtgaaagaaccattttttaaacttcccttgccttttttatttatttaattttcttggtttggagatgtcagtcccaaacaccagagtctgtacttttctataacacagctcagattaaggtagggcatatgccaaggaggttctcacctccctaaagaagggacttgaattttagggactttaattcacccctccttcaatacaactttcccccttcttgtttgcacatgccaagataactgcttttatgcaggctgtacccccttgaaaaatcctttctacagtgctgctcacaaaagagcccaagttcgcctcctacctgcattgctgacttgaattcacagtcgccgagtctacctagctttcttggaagcagtctagcaaaatttctatttgtacgttcactaattatctacaaggacaaaatcagttgtatttacaaaactctacttcagtgtttgttttagtttttttttttactgaaacttgtttttgtgaatactctgtgcttagaattaaatatcactttcttatgaacaacataacttcttcagattgtgtatatgaaaacattagcaagtcttgttttttctatgaagcaaacacaattggtgacaaaggttgtcaatcatttcttcaaaattataatgcagttctaatggtcagcatattttgatattaaatttaaagatcacctctctgcatttgtttttaaattatgctaatacaccacacattatgttggtatgttttgttctgtactttctttaaaaaaaaaaaaaaaacttgtctgagatttgaaggaaaatgtgcttatttggaatttccataaaaagagtatcctttttatacacttaatagtgactttacaaaataaaagttatattctcagttgtttaaaatcactaacctatgataaccacacctcaatttgaaagtagatttaaaattattccctgacaggttatttaatatggagccataaggagggaacccagtacacaattattttttatttgggaatcagggaatagttcccaaatatacaggatttattgataagattttttttcttcccttcatatatccattcaaactcaatggaaagttattaaataaccattagaaaagctcagtagacttatttgagaaattaagccttgtgcaggatgatggatttgacttactaatgtactgtcacagacaaatatgggtagttttgtttaaataggtaagcaaaatattatactttatagcagtggattaccaacaccttgacttctttgttacagtgctaacatcttttttttgtgcaggtatccatgattattaagcagggtggaagttcagtattttgtcatttaaaaagattagttatataatgtctgcttccagccagtgagaaacatctagccatacctttcttatgcaagccattgagttatcaggactgtgaattaacactgtatgaataaatttctgtacaccttattgtttggccagaaggccaccaagtgtacttatatgtaatccttaaattttaaagtagctgtaatttttaaatatttctaaacttttcttaaaccactaaaattaagctcttactacttagtcaactatcctcagctgtattcgtactcaattgtcagtatggcacagattactgtattaaaatattctcctttcgtcttcatatttaccttctgaggtaattttttaacttaatgtgttactacaaagatttgcagatctttaatcaagcactatgttaatactgtaatatcagaatactatgttgcattatttaaaatgttcaaattgaatagattaaaaagtttttaaatgctattgcatcatataatttgctattcatccactatggcattgcatatcaatcagttaatacacttaatgttgcatgagtgatattttggtctgggtttcctcttaagattttagtttgtctgaattaaggaaaaatgtttttaatatacattcttattttgtcccacccctccagaaataagctggaaatcttaactttttggggggtcttttttggtgttttaatgggcccagaactgtggtttaaatttttatgtatgtattttcttttttgtggagtataaatttaaaaactggatttgggacctaaaatactcctcaggttgatgtattcatgaagttttaaaacatctttagttttcaaagtaaactggatatgtggaccttaaagttattgagtttaagctacaaattgtaacgtcattactggacatgtcagcatcaaccctctcaaaatagcttggtcactttatgaaggggcgttttaaagttgttgtttagcagtgacatttaatatggtccaattgcttttctttttaacgtgacaaaaagagaataaggaacaaacactattgctgccgaatgccataacactgagttgtacaaattgtgattgaggaaatgaaaaggtttatacttttta

SEQ ID NO: 24982 - DNA, 9024 bp, Homo sapiens
tccttcaacaatgcatatggatcgattttaggttctgttctgcatcagatgctattgctgaaagacactggtttttaatttgatattgctgcactaattcatcagaaacttttaaaggtttcttacattgcaccattaactctgttagtgatgatgttggcatggacgcagattcagccagccaaagacttgtgatctctgctccagacagtcaagtgagattttcaaatatccgaactaatgatgtagcaaagactcctcagatgcatggcaccgaaatggcaaattcacctcaaccacccccacttagtcctcacccttgtgatgtggttgatgaaggagtgactaaaacaccttcaactcctcagagtcaacatttttatcaaatgccaacaccagatcccttggttccttctaaaccaatggaagataggatagacagtttgtcccagtctttcccacctcaatatcaggaagctgtagaacctacagtatatgttggtacagcagtaaacttggaagaagatgaagccaatatagcctggaagtattacaagttcccaaagaaaaaagatgtagagtttttaccacctcaacttccaagtgataaattcaaggatgatccagttggaccttttggacaggaaagtgtaacatcagttacagagttaatggtgcaatgtaagaaacctttaaaagtttctgatgaattagtgcagcaatatcaaattaaaaaccagtgtctttcagcaatagcatctgatgcagaacaagaacctaaaattgatccatatgcatttgttgaaggagatgaggaattcctttttcctgataaaaaagatagacaaaatagtgagagagaagctggaaaaaaacacaaggtagaagatgggacatctagtgtaacagtgttatcacatgaagaagatgctatgtcattatttagtccctctatcaagcaagatgctccacgccctactagtcatgcccgtcctccatcaacaagtttgatttatgactcagacctggctgtctcttatactgaccttgataatctcttcaattctgatgaagatgaactaacacctggatctaaaagatcagcaaatggatcagatgataaagccagctgcaaggaatcaaagacaggaaatctggacccgttatcttgcataagcactgcagatcttcataaaatgtatcctacaccaccatcattggaacaacatattatgggattttccccaatgaatatgaataataaagaatatggtagtatggatacaacacctggaggaactgttctagaaggaaatagttctagtataggagcgcagttcaaaattgaggttgatgagggattctgtagccccaaaccttctgaaattaaagatttttcttatgtctataagcctgaaaattgtcaaattctagtgggatgttccatgtttgcacctctaaaaactctaccaagccaatatctgccccttatcaaattgccagaagagtgtatttaccgtcagagttggactgttggaaaattggaattgctttcttcagggccttcaatgccattcatcaaagagggtgatggaagtaatatggatcaagaatatggcactgcttatacacctcaaactcatacttcttgtgggatgcctcctagcagtgcacctcctagtaacagcggagcaggaattcttccttctccatccacccctcggtttccaactccaaggactccaaggactcctcggactcctcgtggagctggtggacctgctagtgctcaaggttcagtcaaatatgaaaattcagacttgtattcaccagcttctaccccatctacatgcagaccccttaattctgttgaacctgcaactgtcccttccatccctgaagcacacagtctttatgtaaacctcatcctttcagaatcagttatgaatttgtttaaagactgtaactctgatagttgttgcatctgtgtttgcaacatgaacatcaagggtgccgatgttggagtttacattccagatccaacgcaggaagcacaatataggtgtacctgtggcttcagtgctgtcatgaacagaaaatttggaaacaattcaggattatttcttgaagatgaactagatatcataggacgcaatacagactgtggcaaagaagcagaaaaacgttttgaagctctcagggctacctctgctgaacatgttaatggaggactaaaggaatctgaaaaattatctgatgatttgatattattgctacaagatcagtgcactaatttattttcaccctttggagcagcagaccaagatccttttcctaaaagtggtgtaattagcaattgggtacgtgttgaagagcgtgactgttgcaatgactgctaccttgcattagaacatgggcgtcagttcatggataacatgtcaggaggaaaagttgatgaagcacttgtgaaaagttcatgcttacacccctggtccaaaagaaacgatgtgagtatgcagtgctcacaggatatacttcgaatgctcctctctcttcagccagttcttcaggatgccattcagaaaaaaagaacagtaagaccttggggtgttcagggtcctctcacttggcaacaatttcataaaatggctggccgaggctcttatggaactgatgaatccccagaaccactgccaatccccacatttttgttgggttatgattatgattatctggtgctttctccatttgctcttccttattgggagagacttatgctggaaccctatggatctcaaagagatatagcctatgttgtactgtgtccagaaaatgaagccttgttaaatggagcaaaaagcttttttagagatcttactgcaatatatgagtcctgtcgattaggtcaacatagacctgtttctcgactgttaacagatgggatcatgagagttggatctactgcatcaaagaaactatcagaaaagttggtagcagaatggttttctcaggcagctgatggtaacaatgaagcattttctaaactcaagctttatgcacaagtctgcagatatgacctaggtccttatcttgcttccctgccattggacagctctctactttcccagccaaatttagttgcccctacaagtcagtctttgattactccacctcagatgacaaatactggaaatgctaatactccatctgccaccttagcatctgcagcgagcagcactatgacagtgacttcaggtgttgccatatctacttcagttgccacagctaattcaactttgaccacagcttcaacttcatcttcatcatcctccaacttgaatagtggagtatcatcaaataaactaccttcgtttccaccctttggcagtatgaacagtaatgctgcaggatccatgtctacacaagcaaatacagttcagagtggtcagctaggagggcaacagacatcagctctacagacagctgggatttctggagaatcatcttcacttcccactcagccgcatcctgatgtgtctgaaagcacgatggatcgggataaagtgggaatccccacagatggtgattcacatgcagtcacgtatccacctgcaattgttgtttatataattgatccttttacatacgaaaatacagacgagagcactaactcttctagtgtgtggacattggggctacttcgatgctttctagaaatggtccagactcttcctcctcatatcaagagtactgtttctgtacagattattccttgtcagtacctgttgcaacctgtgaagcatgaagatagagaaatctatccccagcatttaaaatccctggctttttcggcctttacccagtgtcggaggccacttccaacatcaaccaatgtgaaaacattgactggctttggtccaggtttagccatggaaactgcccttagaagtcctgatagaccagagtgtattcgactttatgcacctccttttattctggctccagtgaaggacaaacagacagagctaggagaaacatttggagaagctggacagaaatataatgttctttttgtgggatactgtttatcacatgatcaaaggtggattcttgcatcttgcacagatctatatggagaacttttagaaacttgtatcattaacatcgatgttccaaatagggctcgtcggaaaaaaagttctgctagaaaatttggtctacagaaactttgggagtggtgcttaggacttgtacaaatgagttcattgccatggagagttgtaattggtcgtctaggaaggattggtcatggagaattgaaagattggagctgtttgctgagtcgtcgaaacttgcagtctctaagtaaaaggctcaaagacatgtgtagaatgtgtggtatatctgctgcagactcccctagcattctcagtgcttgcttggtggcaatggagccgcaaggctcttttgttattatgccagattctgtgtcaactggttctgtatttggaagaagcacgactctaaatatgcagacatctcagctaaataccccacaggatacatcatgtactcatatacttgtgtttcctacttctgcttctgtgcaagtagcttcagctacttataccactgaaaatttggatttagctttcaatcccaacaatgatggagcagatggaatgggtatctttgatttgttagacacaggagatgatcttgaccctgatatcattaatatccttcctgcttctccaactggttctcctgtacattctccaggatctcattacccccatggaggtgatgcgggcaagggtcagagtactgatcggctactatcaacagaacctcatgaggaagtacctaatattcttcagcaaccattggcccttggttactttgtatcaactgccaaagcaggtccattacctgactggttctggtcagcatgtcctcaagcacaatatcagtgtcccctttttcttaaggcctctttgcacctccacgtgccttcagtgcaatctgacgagctgcttcacagtaaacactcccacccacttgactcaaatcagacttcagatgtcctcaggtttgttttggaacagtacaatgcactctcctggctaacctgtgaccctgcaacccaggacagacgctcatgtctcccaattcattttgtggtgctgaatcagttatataactttattatgaatatgctgtgatcttcatttgatggaactgtgcaagaaaagaacaaggaaaaatggatgtttcgctgcaggattaagttacaattatcttctcagtgaaggtcatttgtgatggggtctaattcttattacttcaacaaatattgttttgacttggggggaggggctataaccctgctatttttcattgactctattgaactctttaggatgatgactgatcatacaaaacgtattataacattttcgtagcaaaattaaccttttttttttccagtcacagtatttgtgaaaagtaatgagccatagtacccagtcatgttaaatgaatattaaaagcatggagaggaaacatgaggaacaatgaatttcaacatatggcttcagaacatgaagatgttcttgtatggattatagtatctagtattcaaaaatgcctgcatctcttctcttatttattgtaagtttttaaatgtataaattgtcttatatttcttaacctcttttataaaaattttcctagaaggtttatactgccttcttgctttaaagcaattggtctaaaatatatgtaatcgtcttaattaaaaagttgcagtagggttgcttttagagtattatttttttgtaagggggtgggtgggacagtaaatttgtattgtctcgatgtacagtttaacggggatagagggggaataatgtccataccattgtgtgtggaggatttacagctaagctgtagttgcagagtacatgtacagtaatgaagttcactgtgtttataaattgaaaaggtaccaggtcttacagcattttatatatcacatctttacagaataacatgatggcaatatacaagtggtattgttaggtggtttaacttagaataaaatgagaattcttcagttatattttgtactatggtttagggctatgactaatatttcaggccatttccggtgaaagaaacttagttttacaagaaaaaccatttgctactgaatgcttaaactaattttagtgtttaatgttacatgcttaaatttttttcagttttaacagtggcatatttaggcatggaaatattattatgaaatttattttcaggatctgctataaggttgaaatttagcccagctctaggcattttacaaattatttttcaagcagtcattcttgattgtttgacttttttttttaaattaaagattgggaatgtatgtgagagtatgcatatgtatgggtgtgtgtgtgtgcgcgcaatcaaactgtggtgtaaatagattctcagtgaattctgggtattcagactctattccactagtgaaagaaccattttttaaacttcccttgccttttttatttatttaattttcttggtttggagatgtcagtcccaaacaccagagtctgtacttttctataacacagctcagattaaggtagggcatatgccaaggaggttctcacctccctaaagaagggacttgaattttagggactttaattcacccctccttcaatacaactttcccccttcttgtttgcacatgccaagataactgcttttatgcaggctgtacccccttgaaaaatcctttctacagtgctgctcacaaaagagcccaagttcgcctcctacctgcattgctgacttgaattcacagtcgccgagtctacctagctttcttggaagcagtctagcaaaatttctatttgtacgttcactaattatctacaaggacaaaatcagttgtatttacaaaactctacttcagtgtttgttttagtttttttttttactgaaacttgtttttgtgaatactctgtgcttagaattaaatatcactttcttatgaacaacataacttcttcagattgtgtatatgaaaacattagcaagtcttgttttttctatgaagcaaacacaattggtgacaaaggttgtcaatcatttcttcaaaattataatgcagttctaatggtcagcatattttgatattaaatttaaagatcacctctctgcatttgtttttaaattatgctaatacaccacacattatgttggtatgttttgttctgtactttctttaaaaaaaaaaaaaaaacttgtctgagatttgaaggaaaatgtgcttatttggaatttccataaaaagagtatcctttttatacacttaatagtgactttacaaaataaaagttatattctcagttgtttaaaatcactaacctatgataaccacacctcaatttgaaagtagatttaaaattattccctgacaggttatttaatatggagccataaggagggaacccagtacacaattattttttatttgggaatcagggaatagttcccaaatatacaggatttattgataagattttttttcttcccttcatatatccattcaaactcaatggaaagttattaaataaccattagaaaagctcagtagacttatttgagaaattaagccttgtgcaggatgatggatttgacttactaatgtactgtcacagacaaatatgggtagttttgtttaaataggtaagcaaaatattatactttatagcagtggattaccaacaccttgacttctttgttacagtgctaacatcttttttttgtgcaggtatccatgattattaagcagggtggaagttcagtattttgtcatttaaaaagattagttatataatgtctgcttccagccagtgagaaacatctagccatacctttcttatgcaagccattgagttatcaggactgtgaattaacactgtatgaataaatttctgtacaccttattgtttggccagaaggccaccaagtgtacttatatgtaatccttaaattttaaagtagctgtaatttttaaatatttctaaacttttcttaaaccactaaaattaagctcttactacttagtcaactatcctcagctgtattcgtactcaattgtcagtatggcacagattactgtattaaaatattctcctttcgtcttcatatttaccttctgaggtaattttttaacttaatgtgttactacaaagatttgcagatctttaatcaagcactatgttaatactgtaatatcagaatactatgttgcattatttaaaatgttcaaattgaatagattaaaaagtttttaaatgctattgcatcatataatttgctattcatccactatggcattgcatatcaatcagttaatacacttaatgttgcatgagtgatattttggtctgggtttcctcttaagattttagtttgtctgaattaaggaaaaatgtttttaatatacattcttattttgtcccacccctccagaaataagctggaaatcttaactttttggggggtcttttttggtgttttaatgggcccagaactgtggtttaaatttttatgtatgtattttcttttttgtggagtataaatttaaaaactggatttgggacctaaaatactcctcaggttgatgtattcatgaagttttaaaacatctttagttttcaaagtaaactggatatgtggaccttaaagttattgagtttaagctacaaattgtaacgtcattactggacatgtcagcatcaaccctctcaaaatagcttggtcactttatgaaggggcgttttaaagttgttgtttagcagtgacatttaatatggtccaattgcttttctttttaacgtgacaaaaagagaataaggaacaaacactattgctgccgaatgccataacactgagttgtacaaattgtgattgaggaaatgaaaaggtttatacttttta

SEQ ID NO: 24983 - DNA, 8868 bp, Homo sapiens
cgcggccgcgcgacacggctgcgagagacgacgaagggatctctgctccagacagtcaagtgagattttcaaatatccgaactaatgatgtagcaaagactcctcagatgcatggcaccgaaatggcaaattcacctcaaccacccccacttagtcctcacccttgtgatgtggttgatgaaggagtgactaaaacaccttcaactcctcagagtcaacatttttatcaaatgccaacaccagatcccttggttccttctaaaccaatggaagataggatagacagtttgtcccagtctttcccacctcaatatcaggaagctgtagaacctacagtatatgttggtacagcagtaaacttggaagaagatgaagccaatatagcctggaagtattacaagttcccaaagaaaaaagatgtagagtttttaccacctcaacttccaagtgataaattcaaggatgatccagttggaccttttggacaggaaagtgtaacatcagttacagagttaatggtgcaatgtaagaaacctttaaaagtttctgatgaattagtgcagcaatatcaaattaaaaaccagtgtctttcagcaatagcatctgatgcagaacaagaacctaaaattgatccatatgcatttgttgaaggagatgaggaattcctttttcctgataaaaaagatagacaaaatagtgagagagaagctggaaaaaaacacaaggtagaagatgggacatctagtgtaacagtgttatcacatgaagaagatgctatgtcattatttagtccctctatcaagcaagatgctccacgccctactagtcatgcccgtcctccatcaacaagtttgatttatgactcagacctggctgtctcttatactgaccttgataatctcttcaattctgatgaagatgaactaacacctggatctaaaagatcagcaaatggatcagatgataaagccagctgcaaggaatcaaagacaggaaatctggacccgttatcttgcataagcactgcagatcttcataaaatgtatcctacaccaccatcattggaacaacatattatgggattttccccaatgaatatgaataataaagaatatggtagtatggatacaacacctggaggaactgttctagaaggaaatagttctagtataggagcgcagttcaaaattgaggttgatgagggattctgtagccccaaaccttctgaaattaaagatttttcttatgtctataagcctgaaaattgtcaaattctagtgggatgttccatgtttgcacctctaaaaactctaccaagccaatatctgccccttatcaaattgccagaagagtgtatttaccgtcagagttggactgttggaaaattggaattgctttcttcagggccttcaatgccattcatcaaagagggtgatggaagtaatatggatcaagaatatggcactgcttatacacctcaaactcatacttcttgtgggatgcctcctagcagtgcacctcctagtaacagcggagcaggaattcttccttctccatccacccctcggtttccaactccaaggactccaaggactcctcggactcctcgtggagctggtggacctgctagtgctcaaggttcagtcaaatatgaaaattcagacttgtattcaccagcttctaccccatctacatgcagaccccttaattctgttgaacctgcaactgtcccttccatccctgaagcacacagtctttatgtaaacctcatcctttcagaatcagttatgaatttgtttaaagactgtaactctgatagttgttgcatctgtgtttgcaacatgaacatcaagggtgccgatgttggagtttacattccagatccaacgcaggaagcacaatataggtgtacctgtggcttcagtgctgtcatgaacagaaaatttggaaacaattcaggattatttcttgaagatgaactagatatcataggacgcaatacagactgtggcaaagaagcagaaaaacgttttgaagctctcagggctacctctgctgaacatgttaatggaggactaaaggaatctgaaaaattatctgatgatttgatattattgctacaagatcagtgcactaatttattttcaccctttggagcagcagaccaagatccttttcctaaaagtggtgtaattagcaattgggtacgtgttgaagagcgtgactgttgcaatgactgctaccttgcattagaacatgggcgtcagttcatggataacatgtcaggaggaaaagttgatgaagcacttgtgaaaagttcatgcttacacccctggtccaaaagaaacgatgtgagtatgcagtgctcacaggatatacttcgaatgctcctctctcttcagccagttcttcaggatgccattcagaaaaaaagaacagtaagaccttggggtgttcagggtcctctcacttggcaacaatttcataaaatggctggccgaggctcttatggaactgatgaatccccagaaccactgccaatccccacatttttgttgggttatgattatgattatctggtgctttctccatttgctcttccttattgggagagacttatgctggaaccctatggatctcaaagagatatagcctatgttgtactgtgtccagaaaatgaagccttgttaaatggagcaaaaagcttttttagagatcttactgcaatatatgagtcctgtcgattaggtcaacatagacctgtttctcgactgttaacagatgggatcatgagagttggatctactgcatcaaagaaactatcagaaaagttggtagcagaatggttttctcaggcagctgatggtaacaatgaagcattttctaaactcaagctttatgcacaagtctgcagatatgacctaggtccttatcttgcttccctgccattggacagctctctactttcccagccaaatttagttgcccctacaagtcagtctttgattactccacctcagatgacaaatactggaaatgctaatactccatctgccaccttagcatctgcagcgagcagcactatgacagtgacttcaggtgttgccatatctacttcagttgccacagctaattcaactttgaccacagcttcaacttcatcttcatcatcctccaacttgaatagtggagtatcatcaaataaactaccttcgtttccaccctttggcagtatgaacagtaatgctgcaggatccatgtctacacaagcaaatacagttcagagtggtcagctaggagggcaacagacatcagctctacagacagctgggatttctggagaatcatcttcacttcccactcagccgcatcctgatgtgtctgaaagcacgatggatcgggataaagtgggaatccccacagatggtgattcacatgcagtcacgtatccacctgcaattgttgtttatataattgatccttttacatacgaaaatacagacgagagcactaactcttctagtgtgtggacattggggctacttcgatgctttctagaaatggtccagactcttcctcctcatatcaagagtactgtttctgtacagattattccttgtcagtacctgttgcaacctgtgaagcatgaagatagagaaatctatccccagcatttaaaatccctggctttttcggcctttacccagtgtcggaggccacttccaacatcaaccaatgtgaaaacattgactggctttggtccaggtttagccatggaaactgcccttagaagtcctgatagaccagagtgtattcgactttatgcacctccttttattctggctccagtgaaggacaaacagacagagctaggagaaacatttggagaagctggacagaaatataatgttctttttgtgggatactgtttatcacatgatcaaaggtggattcttgcatcttgcacagatctatatggagaacttttagaaacttgtatcattaacatcgatgttccaaatagggctcgtcggaaaaaaagttctgctagaaaatttggtctacagaaactttgggagtggtgcttaggacttgtacaaatgagttcattgccatggagagttgtaattggtcgtctaggaaggattggtcatggagaattgaaagattggagctgtttgctgagtcgtcgaaacttgcagtctctaagtaaaaggctcaaagacatgtgtagaatgtgtggtatatctgctgcagactcccctagcattctcagtgcttgcttggtggcaatggagccgcaaggctcttttgttattatgccagattctgtgtcaactggttctgtatttggaagaagcacgactctaaatatgcagacatctcagctaaataccccacaggatacatcatgtactcatatacttgtgtttcctacttctgcttctgtgcaagtagcttcagctacttataccactgaaaatttggatttagctttcaatcccaacaatgatggagcagatggaatgggtatctttgatttgttagacacaggagatgatcttgaccctgatatcattaatatccttcctgcttctccaactggttctcctgtacattctccaggatctcattacccccatggaggtgatgcgggcaagggtcagagtactgatcggctactatcaacagaacctcatgaggaagtacctaatattcttcagcaaccattggcccttggttactttgtatcaactgccaaagcaggtccattacctgactggttctggtcagcatgtcctcaagcacaatatcagtgtcccctttttcttaaggcctctttgcacctccacgtgccttcagtgcaatctgacgagctgcttcacagtaaacactcccacccacttgactcaaatcagacttcagatgtcctcaggtttgttttggaacagtacaatgcactctcctggctaacctgtgaccctgcaacccaggacagacgctcatgtctcccaattcattttgtggtgctgaatcagttatataactttattatgaatatgctgtgatcttcatttgatggaactgtgcaagaaaagaacaaggaaaaatggatgtttcgctgcaggattaagttacaattatcttctcagtgaaggtcatttgtgatggggtctaattcttattacttcaacaaatattgttttgacttggggggaggggctataaccctgctatttttcattgactctattgaactctttaggatgatgactgatcatacaaaacgtattataacattttcgtagcaaaattaaccttttttttttccagtcacagtatttgtgaaaagtaatgagccatagtacccagtcatgttaaatgaatattaaaagcatggagaggaaacatgaggaacaatgaatttcaacatatggcttcagaacatgaagatgttcttgtatggattatagtatctagtattcaaaaatgcctgcatctcttctcttatttattgtaagtttttaaatgtataaattgtcttatatttcttaacctcttttataaaaattttcctagaaggtttatactgccttcttgctttaaagcaattggtctaaaatatatgtaatcgtcttaattaaaaagttgcagtagggttgcttttagagtattatttttttgtaagggggtgggtgggacagtaaatttgtattgtctcgatgtacagtttaacggggatagagggggaataatgtccataccattgtgtgtggaggatttacagctaagctgtagttgcagagtacatgtacagtaatgaagttcactgtgtttataaattgaaaaggtaccaggtcttacagcattttatatatcacatctttacagaataacatgatggcaatatacaagtggtattgttaggtggtttaacttagaataaaatgagaattcttcagttatattttgtactatggtttagggctatgactaatatttcaggccatttccggtgaaagaaacttagttttacaagaaaaaccatttgctactgaatgcttaaactaattttagtgtttaatgttacatgcttaaatttttttcagttttaacagtggcatatttaggcatggaaatattattatgaaatttattttcaggatctgctataaggttgaaatttagcccagctctaggcattttacaaattatttttcaagcagtcattcttgattgtttgacttttttttttaaattaaagattgggaatgtatgtgagagtatgcatatgtatgggtgtgtgtgtgtgcgcgcaatcaaactgtggtgtaaatagattctcagtgaattctgggtattcagactctattccactagtgaaagaaccattttttaaacttcccttgccttttttatttatttaattttcttggtttggagatgtcagtcccaaacaccagagtctgtacttttctataacacagctcagattaaggtagggcatatgccaaggaggttctcacctccctaaagaagggacttgaattttagggactttaattcacccctccttcaatacaactttcccccttcttgtttgcacatgccaagataactgcttttatgcaggctgtacccccttgaaaaatcctttctacagtgctgctcacaaaagagcccaagttcgcctcctacctgcattgctgacttgaattcacagtcgccgagtctacctagctttcttggaagcagtctagcaaaatttctatttgtacgttcactaattatctacaaggacaaaatcagttgtatttacaaaactctacttcagtgtttgttttagtttttttttttactgaaacttgtttttgtgaatactctgtgcttagaattaaatatcactttcttatgaacaacataacttcttcagattgtgtatatgaaaacattagcaagtcttgttttttctatgaagcaaacacaattggtgacaaaggttgtcaatcatttcttcaaaattataatgcagttctaatggtcagcatattttgatattaaatttaaagatcacctctctgcatttgtttttaaattatgctaatacaccacacattatgttggtatgttttgttctgtactttctttaaaaaaaaaaaaaaaacttgtctgagatttgaaggaaaatgtgcttatttggaatttccataaaaagagtatcctttttatacacttaatagtgactttacaaaataaaagttatattctcagttgtttaaaatcactaacctatgataaccacacctcaatttgaaagtagatttaaaattattccctgacaggttatttaatatggagccataaggagggaacccagtacacaattattttttatttgggaatcagggaatagttcccaaatatacaggatttattgataagattttttttcttcccttcatatatccattcaaactcaatggaaagttattaaataaccattagaaaagctcagtagacttatttgagaaattaagccttgtgcaggatgatggatttgacttactaatgtactgtcacagacaaatatgggtagttttgtttaaataggtaagcaaaatattatactttatagcagtggattaccaacaccttgacttctttgttacagtgctaacatcttttttttgtgcaggtatccatgattattaagcagggtggaagttcagtattttgtcatttaaaaagattagttatataatgtctgcttccagccagtgagaaacatctagccatacctttcttatgcaagccattgagttatcaggactgtgaattaacactgtatgaataaatttctgtacaccttattgtttggccagaaggccaccaagtgtacttatatgtaatccttaaattttaaagtagctgtaatttttaaatatttctaaacttttcttaaaccactaaaattaagctcttactacttagtcaactatcctcagctgtattcgtactcaattgtcagtatggcacagattactgtattaaaatattctcctttcgtcttcatatttaccttctgaggtaattttttaacttaatgtgttactacaaagatttgcagatctttaatcaagcactatgttaatactgtaatatcagaatactatgttgcattatttaaaatgttcaaattgaatagattaaaaagtttttaaatgctattgcatcatataatttgctattcatccactatggcattgcatatcaatcagttaatacacttaatgttgcatgagtgatattttggtctgggtttcctcttaagattttagtttgtctgaattaaggaaaaatgtttttaatatacattcttattttgtcccacccctccagaaataagctggaaatcttaactttttggggggtcttttttggtgttttaatgggcccagaactgtggtttaaatttttatgtatgtattttcttttttgtggagtataaatttaaaaactggatttgggacctaaaatactcctcaggttgatgtattcatgaagttttaaaacatctttagttttcaaagtaaactggatatgtggaccttaaagttattgagtttaagctacaaattgtaacgtcattactggacatgtcagcatcaaccctctcaaaatagcttggtcactttatgaaggggcgttttaaagttgttgtttagcagtgacatttaatatggtccaattgcttttctttttaacgtgacaaaaagagaataaggaacaaacactattgctgccgaatgccataacactgagttgtacaaattgtgattgaggaaatgaaaaggtttatacttttta

SEQ ID NO: 24984 - DNA, 5643 bp, Homo sapiens
tttttttttgagacggagtctcgctcttgttgcccaggctggggtgcagtggcgcaatcttggctcactgcaacctccacctcccaggttcaagcaattctcccgcctcagcctcccaagtaactgggattacaggtgtgagccaccacacctggccagaaagttttataggttttaaatagtcctttaattcagaacccattggtaaaattggctacttattaaaagcctacataatagataagaaaacaatcgttaaattttcatttaaattaggttttgtgtaaattttctagtaaaaagtttttagagttttagacccacagttcctgttattctcttttggaagtttaacatttgtaatatttgcctatacttcttagattattccttgtcagtacctgttgcaacctgtgaagcatgaagatagagaaatctatccccagcatttaaaatccctggctttttcggcctttacccagtgtcggaggccacttccaacatcaaccaatgtgaaaacattgactggctttggtccaggtttagccatggaaactgcccttagaagtcctgatagaccagagtgtattcgactttatgcacctccttttattctggctccagtgaaggacaaacagacagagctaggagaaacatttggagaagctggacagaaatataatgttctttttgtgggatactgtttatcacatgatcaaaggtggattcttgcatcttgcacagatctatatggagaacttttagaaacttgtatcattaacatcgatgttccaaatagggctcgtcggaaaaaaagttctgctagaaaatttggtctacagaaactttgggagtggtgcttaggacttgtacaaatgagttcattgccatggagagttgtaattggtcgtctaggaaggattggtcatggagaattgaaagattggagctgtttgctgagtcgtcgaaacttgcagtctctaagtaaaaggctcaaagacatgtgtagaatgtgtggtatatctgctgcagactcccctagcattctcagtgcttgcttggtggcaatggagccgcaaggctcttttgttattatgccagattctgtgtcaactggttctgtatttggaagaagcacgactctaaatatgcagacatctcagctaaataccccacaggatacatcatgtactcatatacttgtgtttcctacttctgcttctgtgcaagtagcttcagctacttataccactgaaaatttggatttagctttcaatcccaacaatgatggagcagatggaatgggtatctttgatttgttagacacaggagatgatcttgaccctgatatcattaatatccttcctgcttctccaactggttctcctgtacattctccaggatctcattacccccatggaggtgatgcgggcaagggtcagagtactgatcggctactatcaacagaacctcatgaggaagtacctaatattcttcagcaaccattggcccttggttactttgtatcaactgccaaagcaggtccattacctgactggttctggtcagcatgtcctcaagcacaatatcagtgtcccctttttcttaaggcctctttgcacctccacgtgccttcagtgcaatctgacgagctgcttcacagtaaacactcccacccacttgactcaaatcagacttcagatgtcctcaggtttgttttggaacagtacaatgcactctcctggctaacctgtgaccctgcaacccaggacagacgctcatgtctcccaattcattttgtggtgctgaatcagttatataactttattatgaatatgctgtgatcttcatttgatggaactgtgcaagaaaagaacaaggaaaaatggatgtttcgctgcaggattaagttacaattatcttctcagtgaaggtcatttgtgatggggtctaattcttattacttcaacaaatattgttttgacttggggggaggggctataaccctgctatttttcattgactctattgaactctttaggatgatgactgatcatacaaaacgtattataacattttcgtagcaaaattaaccttttttttttccagtcacagtatttgtgaaaagtaatgagccatagtacccagtcatgttaaatgaatattaaaagcatggagaggaaacatgaggaacaatgaatttcaacatatggcttcagaacatgaagatgttcttgtatggattatagtatctagtattcaaaaatgcctgcatctcttctcttatttattgtaagtttttaaatgtataaattgtcttatatttcttaacctcttttataaaaattttcctagaaggtttatactgccttcttgctttaaagcaattggtctaaaatatatgtaatcgtcttaattaaaaagttgcagtagggttgcttttagagtattatttttttgtaagggggtgggtgggacagtaaatttgtattgtctcgatgtacagtttaacggggatagagggggaataatgtccataccattgtgtgtggaggatttacagctaagctgtagttgcagagtacatgtacagtaatgaagttcactgtgtttataaattgaaaaggtaccaggtcttacagcattttatatatcacatctttacagaataacatgatggcaatatacaagtggtattgttaggtggtttaacttagaataaaatgagaattcttcagttatattttgtactatggtttagggctatgactaatatttcaggccatttccggtgaaagaaacttagttttacaagaaaaaccatttgctactgaatgcttaaactaattttagtgtttaatgttacatgcttaaatttttttcagttttaacagtggcatatttaggcatggaaatattattatgaaatttattttcaggatctgctataaggttgaaatttagcccagctctaggcattttacaaattatttttcaagcagtcattcttgattgtttgacttttttttttaaattaaagattgggaatgtatgtgagagtatgcatatgtatgggtgtgtgtgtgtgcgcgcaatcaaactgtggtgtaaatagattctcagtgaattctgggtattcagactctattccactagtgaaagaaccattttttaaacttcccttgccttttttatttatttaattttcttggtttggagatgtcagtcccaaacaccagagtctgtacttttctataacacagctcagattaaggtagggcatatgccaaggaggttctcacctccctaaagaagggacttgaattttagggactttaattcacccctccttcaatacaactttcccccttcttgtttgcacatgccaagataactgcttttatgcaggctgtacccccttgaaaaatcctttctacagtgctgctcacaaaagagcccaagttcgcctcctacctgcattgctgacttgaattcacagtcgccgagtctacctagctttcttggaagcagtctagcaaaatttctatttgtacgttcactaattatctacaaggacaaaatcagttgtatttacaaaactctacttcagtgtttgttttagtttttttttttactgaaacttgtttttgtgaatactctgtgcttagaattaaatatcactttcttatgaacaacataacttcttcagattgtgtatatgaaaacattagcaagtcttgttttttctatgaagcaaacacaattggtgacaaaggttgtcaatcatttcttcaaaattataatgcagttctaatggtcagcatattttgatattaaatttaaagatcacctctctgcatttgtttttaaattatgctaatacaccacacattatgttggtatgttttgttctgtactttctttaaaaaaaaaaaaaaaacttgtctgagatttgaaggaaaatgtgcttatttggaatttccataaaaagagtatcctttttatacacttaatagtgactttacaaaataaaagttatattctcagttgtttaaaatcactaacctatgataaccacacctcaatttgaaagtagatttaaaattattccctgacaggttatttaatatggagccataaggagggaacccagtacacaattattttttatttgggaatcagggaatagttcccaaatatacaggatttattgataagattttttttcttcccttcatatatccattcaaactcaatggaaagttattaaataaccattagaaaagctcagtagacttatttgagaaattaagccttgtgcaggatgatggatttgacttactaatgtactgtcacagacaaatatgggtagttttgtttaaataggtaagcaaaatattatactttatagcagtggattaccaacaccttgacttctttgttacagtgctaacatcttttttttgtgcaggtatccatgattattaagcagggtggaagttcagtattttgtcatttaaaaagattagttatataatgtctgcttccagccagtgagaaacatctagccatacctttcttatgcaagccattgagttatcaggactgtgaattaacactgtatgaataaatttctgtacaccttattgtttggccagaaggccaccaagtgtacttatatgtaatccttaaattttaaagtagctgtaatttttaaatatttctaaacttttcttaaaccactaaaattaagctcttactacttagtcaactatcctcagctgtattcgtactcaattgtcagtatggcacagattactgtattaaaatattctcctttcgtcttcatatttaccttctgaggtaattttttaacttaatgtgttactacaaagatttgcagatctttaatcaagcactatgttaatactgtaatatcagaatactatgttgcattatttaaaatgttcaaattgaatagattaaaaagtttttaaatgctattgcatcatataatttgctattcatccactatggcattgcatatcaatcagttaatacacttaatgttgcatgagtgatattttggtctgggtttcctcttaagattttagtttgtctgaattaaggaaaaatgtttttaatatacattcttattttgtcccacccctccagaaataagctggaaatcttaactttttggggggtcttttttggtgttttaatgggcccagaactgtggtttaaatttttatgtatgtattttcttttttgtggagtataaatttaaaaactggatttgggacctaaaatactcctcaggttgatgtattcatgaagttttaaaacatctttagttttcaaagtaaactggatatgtggaccttaaagttattgagtttaagctacaaattgtaacgtcattactggacatgtcagcatcaaccctctcaaaatagcttggtcactttatgaaggggcgttttaaagttgttgtttagcagtgacatttaatatggtccaattgcttttctttttaacgtgacaaaaagagaataaggaacaaacactattgctgccgaatgccataacactgagttgtacaaattgtgattgaggaaatgaaaaggtttatacttttta

SEQ ID NO: 24985 - DNA, 1466 bp, Homo sapiens
agcagcatagatattaccacatgacacatgtttatctatatagcacctacatgttctgcacttgtatcctttttatacacttaatagtgactttacaaaataaaagttatattctcagttgtttaaaatcactaacctatgataaccacacctcaatttgaaagtagatttaaaattattccctgacaggttatttaatatggagccataaggagggaacccagtacacaattattttttatttgggaatcagggaatagttcccaaatatacaggatttattgataagattttttttcttcccttcatatatccattcaaactcaatggaaagttattaaataaccattagttatataatgtctgcttccagccagtgagaaacatctagccatacctttcttatgcaagccattgagttatcaggactgtgaattaacactgtatgaataaatttctgtacaccttattgtttggccagaaggccaccaagtgtacttatatgtaatccttaaattttaaagtagctgtaatttttaaatatttctaaacttttcttaaaccactaaaattaagctcttactacttagtcaactatcctcagctgtattcgtactcaattgtcagtatggcacagattactgtattaaaatattctcctttcgtcttcatatttaccttctgaggtaattttttaacttaatgtgttactacaaagatttgcagatctttaatcaagcactatgttaatactgtaatatcagaatactatgttgcattatttaaaatgttcaaattgaatagattaaaaagtttttaaatgctattgcatcatataatttgctattcatccactatggcattgcatatcaatcagttaatacacttaatgttgcatgagtgatattttggtctgggtttcctcttaagattttagtttgtctgaattaaggaaaaatgtttttaatatacattcttattttgtcccacccctccagaaataagctggaaatcttaactttttggggggtcttttttggtgttttaatgggcccagaactgtggtttaaatttttatgtatgtattttcttttttgtggagtataaatttaaaaactggatttgggacctaaaatactcctcaggttgatgtattcatgaagttttaaaacatctttagttttcaaagtaaactggatatgtggaccttaaagttattgagtttaagctacaaattgtaacgtcattactggacatgtcagcatcaaccctctcaaaatagcttggtcactttatgaaggggcgttttaaagttgttgtttagcagtgacatttaatatggtccaattgcttttctttttaacgtgacaaaaagagaataaggaacaaacactattgctgccgaatgccataacactgagttgtacaaattgtgattgaggaaatgaaaaggtttatacttttta

SEQ ID NO: 24986 - DNA, 2166 bp, Homo sapiens
gtttctctctctggtcggaagcggcggtaatggcggatggtgggttgtggcgccggcggcggctgctgtgagggacgatgagtgcctccttcgtgccgaacggggccagcctggaagattgtcactgtaacctcttctgcctggctgacttgacaggaattaagtggaaaaaatatgtatggcaaggcccaacttctgcccctattctgtttcctgtgacagaagaagaccccattttgagcagttttagtcgctgccttaaggcagatgtacttggtgtttggcggcgagatcaaagacctggaagaagagaattgtggatattttggtggggtgaagaccccagttttgctgaccttattcaccatgacttatcagaagaagaagatggagtgtgggagaatggactttcctatgaatgccgtactctgcttttcaaagcagttcacaatctattggaacggtgtttaatgaacaggaattttgtacgtattggcaagtggtttgtaaagccttatgaaaaagatgaaaaacctataaataaaagtgaacacttgtcctgctccttcacctttttcttgcatggagacagcaatgtttgtaccagtgtggaaattaaccaacatcaacctgtataccttctcagtgaagagcatatcacccttgctcaacagtctaatagcccatttcaagttatcttatgcccatttggactaaatggcactctcacaggacaggcattcaagatgtctgattcagctacaaaaaaattaattggtgaatggaaacagttctatcctatctcatgttgcttgaaggagatgtctgaagaaaaacaggaagatatggattgggaagatgattctttagctgcagtagaagttcttgttgctggtgtccgaatgatctacccagcatgctttgttctagtccctcagtcagacattcctactcctagccctgtgggatccactcactgttcatcttcttgcttgggtgtccaccaagtgcctgcttccacaagagatcctgctatgtcttcggttacgcttacaccacctacgtctcctgaggaagtccaaacagttgatcctcagtctgtccagaagtgggtcaaattttcttcagtatctgatggcttcaactccgatagtactagccaccatggtgggaaaatacccagaaaattagcaaatcatgtggtggatagagtttggcaagaatgcaatatgaacagagcacagaacaagaggaagtattctgcttcatcaggtggtctatgcgaagaagcgacagctgctaaagtggcatcctgggattttgttgaagccacacaaagaacaaattgcagttgtttgaggcacaaaaatctcaagtcaagaaatgctggacaacaaggacaggcaccatctttaggtcagcaacaacaaatacttcctaagcacaagaccaatgagaagcaagaaaagagtgaaaagccacagaaacgccccttgactccttttcaccatcgtgtgtctgttagtgatgatgttggcatggacgcagattcagccagccaaagacttgtgatctctgctccagacagtcaagtgagattttcaaatatccgaactaatgatgtagcaaagactcctcagatgcatggcaccgaaatggcaaattcacctcaaccacccccacttagtcctcacccttgtgatgtggttgatgaaggagtgactaaaacaccttcaactcctcagagtcaacatttttatcaaatgccaacaccagatcccttggttccttctaaaccaatggaagataggatagacagtttgtcccagtctttcccacctcaatatcaggaagctgtagaacctacagtatatgttggtacagcagtaaacttggaagaagatgaagccaatatagcctggaagtattacaagttcccaaagaaaaaagatgtagagtttttaccacctcaacttccaagtgataaattcaaggatgatccagttggaccttttggacaggaaagtgtaacatcagttacagagtatgtattttttttaatagtcaccattataatttaagggtggaagtgatgcaagttcttaatactaggactcagtattggattcaaggtaggatttacaagaataaattcattgagtatta

SEQ ID NO: 24987 - DNA, 2246 bp, Homo sapiens
gtttctctctctggtcggaagcggcggtaatggcggatggtgggttgtggcgccggcggcggctgctgtgagggacgatgagtgcctccttcgtgccgaacggggccagcctggaagattgtcactgtaacctcttctgcctggctgacttgacaggaattaagtggaaaaaatatgtatggcaaggcccaacttctgcccctattctgtttcctgtgacagaagaagaccccattttgagcagttttagtcgctgccttaaggcagatgtacttggtgtttggcggcgagatcaaagacctggaagaagagaattgtggatattttggtggggtgaagaccccagttttgctgaccttattcaccatgacttatcagaagaagaagatggagtgtgggagaatggactttcctatgaatgccgtactctgcttttcaaagcagttcacaatctattggaacggtgtttaatgaacaggaattttgtacgtattggcaagtggtttgtaaagccttatgaaaaagatgaaaaacctataaataaaagtgaacacttgtcctgctccttcacctttttcttgcatggagacagcaatgtttgtaccagtgtggaaattaaccaacatcaacctgtataccttctcagtgaagagcatatcacccttgctcaacagtctaatagcccatttcaagttatcttatgcccatttggactaaatggcactctcacaggacaggcattcaagatgtctgattcagctacaaaaaaattaattggtgaatggaaacagttctatcctatctcatgttgcttgaaggagatgtctgaagaaaaacaggaagatatggattgggaagatgattctttagctgcagtagaagttcttgttgctggtgtccgaatgatctacccagcatgctttgttctagtccctcagtcagacattcctactcctagccctgtgggatccactcactgttcatcttcttgcttgggtgtccaccaagtgcctgcttccacaagagatcctgctatgtcttcggttacgcttacaccacctacgtctcctgaggaagtccaaacagttgatcctcagtctgtccagaagtgggtcaaattttcttcagtatctgatggcttcaactccgatagtactagccaccatggtgggaaaatacccagaaaattagcaaatcatgtggtggatagagtttggcaagaatgcaatatgaacagagcacagaacaagaggaagtattctgcttcatcaggtggtctatgcgaagaagcgacagctgctaaagtggcatcctgggattttgttgaagccacacaaagaacaaattgcagttgtttgaggcacaaaaatctcaagtcaagaaatgctggacaacaaggacaggcaccatctttaggtcagcaacaacaaatacttcctaagcacaagaccaatgagaagcaagaaaagagtgaaaagccacagaaacgccccttgactccttttcaccatcgtgtgtctgttagtgatgatgttggcatggacgcagattcagccagccaaagacttgtgatctctgctccagacagtcaagtgagattttcaaatatccgaactaatgatgtagcaaagactcctcagatgcatggcaccgaaatggcaaattcacctcaaccacccccacttagtcctcacccttgtgatgtggttgatgaaggagtgactaaaacaccttcaactcctcagagtcaacatttttatcaaatgccaacaccagatcccttggttccttctaaaccaatggaagataggatagacagtttgtcccagtctttcccacctcaatatcaggaagctgtagaacctacagtatatgttggtacagcagtaaacttggaagaagatgaagccaatatagcctggaagtattacaagttcccaaagaaaaaagatgtagagtttttaccacctcaacttccaagtgataaattcaaggatgatccagttggaccttttggacaggaaagtgtaacatcagttacagagtatgtattttttttaatagtcaccattataatttaagggtggaagtgatgcaagttcttaatactaggactcagtattggattcaaggtaggatttacaagaataaattcattgagtattaactttgcattattcctttactgtgttttttcctcagggaacttcttcattatgaaataactttagccacaaaaagtggag

SEQ ID NO: 24988 - DNA, 1897 bp, Homo sapiens
gtttctctctctggtcggaagcggcggtaatggcggatggtgggttgtggcgccggcggcggctgctgtgagggacgatgagtgcctccttcgtgccgaacggggccagcctggaagattgtcactgtaacctcttctgcctggctgacttgacaggaattaagtggaaaaaatatgtatggcaaggcccaacttctgcccctattctgtttcctgtgacagaagaagaccccattttgagcagttttagtcgctgccttaaggcagatgtacttggtgtttggcggcgagatcaaagacctggaagaagagaattgtggatattttggtggggtgaagaccccagttttgctgaccttattcaccatgacttatcagaagaagaagatggagtgtgggagaatggactttcctatgaatgccgtactctgcttttcaaagcagttcacaatctattggaacggtgtttaatgaacaggaattttgtacgtattggcaagtggtttgtaaagccttatgaaaaagatgaaaaacctataaataaaagtgaacacttgtcctgctccttcacctttttcttgcatggagacagcaatgtttgtaccagtgtggaaattaaccaacatcaacctgtataccttctcagtgaagagcatatcacccttgctcaacagtctaatagcccatttcaagttatcttatgcccatttggactaaatggcactctcacaggacaggcattcaagatgtctgattcagctacaaaaaaattaattggtgaatggaaacagttctatcctatctcatgttgcttgaaggagatgtctgaagaaaaacaggaagatatggattgggaagatgattctttagctgcagtagaagttcttgttgctggtgtccgaatgatctacccagcatgctttgttctagtccctcagtcagacattcctactcctagccctgtgggatccactcactgttcatcttcttgcttgggtgtccaccaagtgcctgcttccacaagagatcctgctatgtcttcggttacgcttacaccacctacgtctcctgaggaagtccaaacagttgatcctcagtctgtccagaagtgggtcaaattttcttcagtatctgatggcttcaactccgatagtactagccaccatggtgggaaaatacccagaaaattagcaaatcatgtggtggatagagtttggcaagaatgcaatatgaacagagcacagaacaagaggaagtattctgcttcatcaggtggtctatgcgaagaagcgacagctgctaaagtggcatcctgggattttgttgaagccacacaaagaacaaattgcagttgtttgaggtagattatttcccgatcgattgatgcctatgtgtgatagtttgttacgccactgaatgcttatgcccactttatttgaaacagcttacatgaacatatgtcaggattttttttcaaaagaaaattcaggaaaaatatttcaggaatttgaagctgattatagaagtacatgtaaatataagctttcagttcattcactgttaccagaggcagactctgaaagttttgtttcctagtagctaaataaaagacaattttatatggagctatggtatatatagtatctataagctatacagccatataaatctcttgagaaaagcattccttcctcaatggcactacctgagaaatttatcccaagagttctttctttttttaaaaaatgaagagacagggtcttgctttgttacccaggctggagtgatcatggctcactgcaacctcaaacttctggcctcagtcgatcctcctgccccagcctcccaagtagctagggttataggcatgtgccaccacacctggctaattaaaaga

SEQ ID NO: 24989 - DNA, 469 bp, Homo sapiens
cttatgcccactttatttgaaacagcttacatgaacatatgtcaggattttttttcaaaagaaaattcaggaaaaatatttcaggaatttgaagctgattatagaagtacatgtaaatataagctttcagttcattcactgttaccagaggcagactctgaaagttttgtttcctagtagctaaataaaagacaattttatatggagctatggtatatatagtatctataagctatacagccatataaatctcttgagaaaagcattccttcctcaatggcactacctgagaaatttatcccaagagttctttctttttttaaaaaatgaagagacagggtcttgctttgttacccaggctggagtgatcatggctcactgcaacctcaaacttctggcctcagtcgatcctcctgccccagcctcccaagtagctagggttataggcatgtgccaccacacctggcta

SEQ ID NO: 24990 - DNA, 559 bp, Homo sapiens
ttatgaattttaaagaattttgtaactttaaatcttaggaggaagtattctgcttcatcaggtggtctatgcgaagaagcgacagctgctaaagtggcatcctgggattttgttgaagccacacaaagaacaaattgcagttgtttgaggtagattatttcccgatcgattgatgcctatgtgtgatagtttgttacgccactgaatgcttatgcccactttatttgaaacagcttacatgaacatatgtcaggattttttttcaaaagaaaattcaggaaaaatatttcaggaatttgaagctgattatagaagtacatgtaaatataagctttcagttcattcactgttaccagaggcagactctgaaagttttgtttcctagtagctaaataaaagacaattttatatggagctatggtatatatagtatctataagctatacagccatataaatctcttgagaaaagcattccttcctcaatggcactacctgagaaatttatcccaagagttctttctttttttaaaaaatgaagagacagggtcttgctttgt

SEQ ID NO: 24991 - DNA, 312 bp, Homo sapiens
agcaagtgtaggtcacaccattagcaagcaatttcggggctataattaccaagaaaacatcaactggattatgattctgtttacacagtagaatttaaaaaaaccagtcagtgaaataaagaattaaatttcgtacctgtttttattctttaggtccttatcttgcttccctgccattggacagctctctactttcccagccaaatttagttgcccctacaagtcagtctttgattactccacctcagatgacaaatactggaaatgctaatactccatctgccaccttagcatctgcagcgagcagcacta

SEQ ID NO: 24992 - DNA, 373 bp, Homo sapiens
cttcaggatgccattcagaaaaaaagaacagtaagaccttggggtgttcagggtcctctcacttggcaacaatttcataaaatggctggccgaggctcttatggtaagtaatttatagtgatatataatgactaattttatatcagtcctcagatttctgtgcccaactagaataagcacattagttttctttaaatatatttgtgatatattcttaaggccactgtggtccaatcctagctttttttcccaccatttccaacattcagcttactcaactctccaactccacttcaaaaggagtggcttctcttaggtctgttcttacacatagggggctttccctcaagattttacatgaagaaagggacat

SEQ ID NO: 24993 - DNA, 325 bp, Homo sapiens
gaatagaaaaccagtttgaaggttttatatatattaaaatattaagatgtggggttgtgggtgctttttacttttttctttagtgaatgtttatattgtataactaacataattaaaaataattttgattaatctattatatgaacaaaaaagattaaggtcactaacttctgtgtcataaagcttgaggcaattattttagctgaacatttttgaaagatgtaaaaaaatggtctagtaaagtatctatagaacatttaaacttttctcatgtaccatctaagatatagcccctaataaactgagtaagttaacttcatttact

SEQ ID NO: 24994 - DNA, 10482 bp, Homo sapiens
gtttctctctctggtcggaagcggcggtaatggcggatggtgggttgtggcgccggcggcggctgctgtgagggacgatgagtgcctccttcgtgccgaacggggccagcctggaagattgtcactgtaacctcttctgcctggctgacttgacaggaattaagtggaaaaaatatgtatggcaaggcccaacttctgcccctattctgtttcctgtgacagaagaagaccccattttgagcagttttagtcgctgccttaaggcagatgtacttggtgtttggcggcgagatcaaagacctggaagaagagaattgtggatattttggtggggtgaagaccccagttttgctgaccttattcaccatgacttatcagaagaagaagatggagtgtgggagaatggactttcctatgaatgccgtactctgcttttcaaagcagttcacaatctattggaacggtgtttaatgaacaggaattttgtacgtattggcaagtggtttgtaaagccttatgaaaaagatgaaaaacctataaataaaagtgaacacttgtcctgctccttcacctttttcttgcatggagacagcaatgtttgtaccagtgtggaaattaaccaacatcaacctgtataccttctcagtgaagagcatatcacccttgctcaacagtctaatagcccatttcaagttatcttatgcccatttggactaaatggcactctcacaggacaggcattcaagatgtctgattcagctacaaaaaaattaattggtgaatggaaacagttctatcctatctcatgttgcttgaaggagatgtctgaagaaaaacaggaagatatggattgggaagatgattctttagctgcagtagaagttcttgttgctggtgtccgaatgatctacccagcatgctttgttctagtccctcagtcagacattcctactcctagccctgtgggatccactcactgttcatcttcttgcttgggtgtccaccaagtgcctgcttccacaagagatcctgctatgtcttcggttacgcttacaccacctacgtctcctgaggaagtccaaacagttgatcctcagtctgtccagaagtgggtcaaattttcttcagtatctgatggcttcaactccgatagtactagccaccatggtgggaaaatacccagaaaattagcaaatcatgtggtggatagagtttggcaagaatgcaatatgaacagagcacagaacaagaggaagtattctgcttcatcaggtggtctatgcgaagaagcgacagctgctaaagtggcatcctgggattttgttgaagccacacaaagaacaaattgcagttgtttgaggcacaaaaatctcaagtcaagaaatgctggacaacaaggacaggcaccatctttaggtcagcaacaacaaatacttcctaagcacaagaccaatgagaagcaagaaaagagtgaaaagccacagaaacgccccttgactccttttcaccatcgtgtgtctgttagtgatgatgttggcatggacgcagattcagccagccaaagacttgtgatctctgctccagacagtcaagtgagattttcaaatatccgaactaatgatgtagcaaagactcctcagatgcatggcaccgaaatggcaaattcacctcaaccacccccacttagtcctcacccttgtgatgtggttgatgaaggagtgactaaaacaccttcaactcctcagagtcaacatttttatcaaatgccaacaccagatcccttggttccttctaaaccaatggaagataggatagacagtttgtcccagtctttcccacctcaatatcaggaagctgtagaacctacagtatatgttggtacagcagtaaacttggaagaagatgaagccaatatagcctggaagtattacaagttcccaaagaaaaaagatgtagagtttttaccacctcaacttccaagtgataaattcaaggatgatccagttggaccttttggacaggaaagtgtaacatcagttacagagttaatggtgcaatgtaagaaacctttaaaagtttctgatgaattagtgcagcaatatcaaattaaaaaccagtgtctttcagcaatagcatctgatgcagaacaagaacctaaaattgatccatatgcatttgttgaaggagatgaggaattcctttttcctgataaaaaagatagacaaaatagtgagagagaagctggaaaaaaacacaaggtagaagatgggacatctagtgtaacagtgttatcacatgaagaagatgctatgtcattatttagtccctctatcaagcaagatgctccacgccctactagtcatgcccgtcctccatcaacaagtttgatttatgactcagacctggctgtctcttatactgaccttgataatctcttcaattctgatgaagatgaactaacacctggatctaaaagatcagcaaatggatcagatgataaagccagctgcaaggaatcaaagacaggaaatctggacccgttatcttgcataagcactgcagatcttcataaaatgtatcctacaccaccatcattggaacaacatattatgggattttccccaatgaatatgaataataaagaatatggtagtatggatacaacacctggaggaactgttctagaaggaaatagttctagtataggagcgcagttcaaaattgaggttgatgagggattctgtagccccaaaccttctgaaattaaagatttttcttatgtctataagcctgaaaattgtcaaattctagtgggatgttccatgtttgcacctctaaaaactctaccaagccaatatctgccccttatcaaattgccagaagagtgtatttaccgtcagagttggactgttggaaaattggaattgctttcttcagggccttcaatgccattcatcaaagagggtgatggaagtaatatggatcaagaatatggcactgcttatacacctcaaactcatacttcttgtgggatgcctcctagcagtgcacctcctagtaacagcggagcaggaattcttccttctccatccacccctcggtttccaactccaaggactccaaggactcctcggactcctcgtggagctggtggacctgctagtgctcaaggttcagtcaaatatgaaaattcagacttgtattcaccagcttctaccccatctacatgcagaccccttaattctgttgaacctgcaactgtcccttccatccctgaagcacacagtctttatgtaaacctcatcctttcagaatcagttatgaatttgtttaaagactgtaactctgatagttgttgcatctgtgtttgcaacatgaacatcaagggtgccgatgttggagtttacattccagatccaacgcaggaagcacaatataggtgtacctgtggcttcagtgctgtcatgaacagaaaatttggaaacaattcaggattatttcttgaagatgaactagatatcataggacgcaatacagactgtggcaaagaagcagaaaaacgttttgaagctctcagggctacctctgctgaacatgttaatggaggactaaaggaatctgaaaaattatctgatgatttgatattattgctacaagatcagtgcactaatttattttcaccctttggagcagcagaccaagatccttttcctaaaagtggtgtaattagcaattgggtacgtgttgaagagcgtgactgttgcaatgactgctaccttgcattagaacatgggcgtcagttcatggataacatgtcaggaggaaaagttgatgaagcacttgtgaaaagttcatgcttacacccctggtccaaaagaaacgatgtgagtatgcagtgctcacaggatatacttcgaatgctcctctctcttcagccagttcttcaggatgccattcagaaaaaaagaacagtaagaccttggggtgttcagggtcctctcacttggcaacaatttcataaaatggctggccgaggctcttatggaactgatgaatccccagaaccactgccaatccccacatttttgttgggttatgattatgattatctggtgctttctccatttgctcttccttattgggagagacttatgctggaaccctatggatctcaaagagatatagcctatgttgtactgtgtccagaaaatgaagccttgttaaatggagcaaaaagcttttttagagatcttactgcaatatatgagtcctgtcgattaggtcaacatagacctgtttctcgactgttaacagatgggatcatgagagttggatctactgcatcaaagaaactatcagaaaagttggtagcagaatggttttctcaggcagctgatggtaacaatgaagcattttctaaactcaagctttatgcacaagtctgcagatatgacctaggtccttatcttgcttccctgccattggacagctctctactttcccagccaaatttagttgcccctacaagtcagtctttgattactccacctcagatgacaaatactggaaatgctaatactccatctgccaccttagcatctgcagcgagcagcactatgacagtgacttcaggtgttgccatatctacttcagttgccacagctaattcaactttgaccacagcttcaacttcatcttcatcatcctccaacttgaatagtggagtatcatcaaataaactaccttcgtttccaccctttggcagtatgaacagtaatgctgcaggatccatgtctacacaagcaaatacagttcagagtggtcagctaggagggcaacagacatcagctctacagacagctgggatttctggagaatcatcttcacttcccactcagccgcatcctgatgtgtctgaaagcacgatggatcgggataaagtgggaatccccacagatggtgattcacatgcagtcacgtatccacctgcaattgttgtttatataattgatccttttacatacgaaaatacagacgagagcactaactcttctagtgtgtggacattggggctacttcgatgctttctagaaatggtccagactcttcctcctcatatcaagagtactgtttctgtacagattattccttgtcagtacctgttgcaacctgtgaagcatgaagatagagaaatctatccccagcatttaaaatccctggctttttcggcctttacccagtgtcggaggccacttccaacatcaaccaatgtgaaaacattgactggctttggtccaggtttagccatggaaactgcccttagaagtcctgatagaccagagtgtattcgactttatgcacctccttttattctggctccagtgaaggacaaacagacagagctaggagaaacatttggagaagctggacagaaatataatgttctttttgtgggatactgtttatcacatgatcaaaggtggattcttgcatcttgcacagatctatatggagaacttttagaaacttgtatcattaacatcgatgttccaaatagggctcgtcggaaaaaaagttctgctagaaaatttggtctacagaaactttgggagtggtgcttaggacttgtacaaatgagttcattgccatggagagttgtaattggtcgtctaggaaggattggtcatggagaattgaaagattggagctgtttgctgagtcgtcgaaacttgcagtctctaagtaaaaggctcaaagacatgtgtagaatgtgtggtatatctgctgcagactcccctagcattctcagtgcttgcttggtggcaatggagccgcaaggctcttttgttattatgccagattctgtgtcaactggttctgtatttggaagaagcacgactctaaatatgcagacatctcagctaaataccccacaggatacatcatgtactcatatacttgtgtttcctacttctgcttctgtgcaagtagcttcagctacttataccactgaaaatttggatttagctttcaatcccaacaatgatggagcagatggaatgggtatctttgatttgttagacacaggagatgatcttgaccctgatatcattaatatccttcctgcttctccaactggttctcctgtacattctccaggatctcattacccccatggaggtgatgcgggcaagggtcagagtactgatcggctactatcaacagaacctcatgaggaagtacctaatattcttcagcaaccattggcccttggttactttgtatcaactgccaaagcaggtccattacctgactggttctggtcagcatgtcctcaagcacaatatcagtgtcccctttttcttaaggcctctttgcacctccacgtgccttcagtgcaatctgacgagctgcttcacagtaaacactcccacccacttgactcaaatcagacttcagatgtcctcaggtttgttttggaacagtacaatgcactctcctggctaacctgtgaccctgcaacccaggacagacgctcatgtctcccaattcattttgtggtgctgaatcagttatataactttattatgaatatgctgtgatcttcatttgatggaactgtgcaagaaaagaacaaggaaaaatggatgtttcgctgcaggattaagttacaattatcttctcagtgaaggtcatttgtgatggggtctaattcttattacttcaacaaatattgttttgacttggggggaggggctataaccctgctatttttcattgactctattgaactctttaggatgatgactgatcatacaaaacgtattataacattttcgtagcaaaattaaccttttttttttccagtcacagtatttgtgaaaagtaatgagccatagtacccagtcatgttaaatgaatattaaaagcatggagaggaaacatgaggaacaatgaatttcaacatatggcttcagaacatgaagatgttcttgtatggattatagtatctagtattcaaaaatgcctgcatctcttctcttatttattgtaagtttttaaatgtataaattgtcttatatttcttaacctcttttataaaaattttcctagaaggtttatactgccttcttgctttaaagcaattggtctaaaatatatgtaatcgtcttaattaaaaagttgcagtagggttgcttttagagtattatttttttgtaagggggtgggtgggacagtaaatttgtattgtctcgatgtacagtttaacggggatagagggggaataatgtccataccattgtgtgtggaggatttacagctaagctgtagttgcagagtacatgtacagtaatgaagttcactgtgtttataaattgaaaaggtaccaggtcttacagcattttatatatcacatctttacagaataacatgatggcaatatacaagtggtattgttaggtggtttaacttagaataaaatgagaattcttcagttatattttgtactatggtttagggctatgactaatatttcaggccatttccggtgaaagaaacttagttttacaagaaaaaccatttgctactgaatgcttaaactaattttagtgtttaatgttacatgcttaaatttttttcagttttaacagtggcatatttaggcatggaaatattattatgaaatttattttcaggatctgctataaggttgaaatttagcccagctctaggcattttacaaattatttttcaagcagtcattcttgattgtttgacttttttttttaaattaaagattgggaatgtatgtgagagtatgcatatgtatgggtgtgtgtgtgtgcgcgcaatcaaactgtggtgtaaatagattctcagtgaattctgggtattcagactctattccactagtgaaagaaccattttttaaacttcccttgccttttttatttatttaattttcttggtttggagatgtcagtcccaaacaccagagtctgtacttttctataacacagctcagattaaggtagggcatatgccaaggaggttctcacctccctaaagaagggacttgaattttagggactttaattcacccctccttcaatacaactttcccccttcttgtttgcacatgccaagataactgcttttatgcaggctgtacccccttgaaaaatcctttctacagtgctgctcacaaaagagcccaagttcgcctcctacctgcattgctgacttgaattcacagtcgccgagtctacctagctttcttggaagcagtctagcaaaatttctatttgtacgttcactaattatctacaaggacaaaatcagttgtatttacaaaactctacttcagtgtttgttttagtttttttttttactgaaacttgtttttgtgaatactctgtgcttagaattaaatatcactttcttatgaacaacataacttcttcagattgtgtatatgaaaacattagcaagtcttgttttttctatgaagcaaacacaattggtgacaaaggttgtcaatcatttcttcaaaattataatgcagttctaatggtcagcatattttgatattaaatttaaagatcacctctctgcatttgtttttaaattatgctaatacaccacacattatgttggtatgttttgttctgtactttctttaaaaaaaaaaaaaaaacttgtctgagatttgaaggaaaatgtgcttatttggaatttccataaaaagagtatcctttttatacacttaatagtgactttacaaaataaaagttatattctcagttgtttaaaatcactaacctatgataaccacacctcaatttgaaagtagatttaaaattattccctgacaggttatttaatatggagccataaggagggaacccagtacacaattattttttatttgggaatcagggaatagttcccaaatatacaggatttattgataagattttttttcttcccttcatatatccattcaaactcaatggaaagttattaaataaccattagaaaagctcagtagacttatttgagaaattaagccttgtgcaggatgatggatttgacttactaatgtactgtcacagacaaatatgggtagttttgtttaaataggtaagcaaaatattatactttatagcagtggattaccaacaccttgacttctttgttacagtgctaacatcttttttttgtgcaggtatccatgattattaagcagggtggaagttcagtattttgtcatttaaaaagattagttatataatgtctgcttccagccagtgagaaacatctagccatacctttcttatgcaagccattgagttatcaggactgtgaattaacactgtatgaataaatttctgtacaccttattgtttggccagaaggccaccaagtgtacttatatgtaatccttaaattttaaagtagctgtaatttttaaatatttctaaacttttcttaaaccactaaaattaagctcttactacttagtcaactatcctcagctgtattcgtactcaattgtcagtatggcacagattactgtattaaaatattctcctttcgtcttcatatttaccttctgaggtaattttttaacttaatgtgttactacaaagatttgcagatctttaatcaagcactatgttaatactgtaatatcagaatactatgttgcattatttaaaatgttcaaattgaatagattaaaaagtttttaaatgctattgcatcatataatttgctattcatccactatggcattgcatatcaatcagttaatacacttaatgttgcatgagtgatattttggtctgggtttcctcttaagattttagtttgtctgaattaaggaaaaatgtttttaatatacattcttattttgtcccacccctccagaaataagctggaaatcttaactttttggggggtcttttttggtgttttaatgggcccagaactgtggtttaaatttttatgtatgtattttcttttttgtggagtataaatttaaaaactggatttgggacctaaaatactcctcaggttgatgtattcatgaagttttaaaacatctttagttttcaaagtaaactggatatgtggaccttaaagttattgagtttaagctacaaattgtaacgtcattactggacatgtcagcatcaaccctctcaaaatagcttggtcactttatgaaggggcgttttaaagttgttgtttagcagtgacatttaatatggtccaattgcttttctttttaacgtgacaaaaagagaataaggaacaaacactattgctgccgaatgccataacactgagttgtacaaattgtgattgaggaaatgaaaaggtttatactttttaaaaaaaaaaacaaaaacaacaaacaaaacttcaaatggaataaattattcatgaagccttaacaaaaacacaacacaaaac

SEQ ID NO: 24995 - DNA, 9147 bp, Homo sapiens
gtttctctctctggtcggaagcggcggtaatggcggatggtgggttgtggcgccggcggcggctgctgtgagggacgatgagtgcctccttcgtgccgaacggggccagcctggaagattgtcactgtaacctcttctgcctggctgacttgacaggaattaagtggaaaaaatatgtatggcaaggcccaacttctgcccctattctgtttcctgtgacagaagaagaccccattttgagcagttttagtcgctgccttaaggcagatgtacttggtgtttggcggcgagatcaaagacctggaagaagagaattgtggatattttggtggggtgaagaccccagttttgctgaccttattcaccatgacttatcagaagaagaagatggagtgtgggagaatggactttcctatgaatgccgtactctgcttttcaaagcagttcacaatctattggaacggtgtttaatgaacaggaattttgtacgtattggcaagtggtttgtaaagccttatgaaaaagatgaaaaacctataaataaaagtgaacacttgtcctgctccttcacctttttcttgcatggagacagcaatgtttgtaccagtgtggaaattaaccaacatcaacctgtataccttctcagtgaagagcatatcacccttgctcaacagtctaatagcccatttcaagttatcttatgcccatttggactaaatggcactctcacaggacaggcattcaagatgtctgattcagctacaaaaaaattaattggtgaatggaaacagttctatcctatctcatgttgcttgaaggagatgtctgaagaaaaacaggaagatatggattgggaagatgattctttagctgcagtagaagttcttgttgctggtgtccgaatgatctacccagcatgctttgttctagtccctcagtcagacattcctactcctagccctgtgggatccactcactgttcatcttcttgcttgggtgtccaccaagtgcctgcttccacaagagatcctgctatgtcttcggttacgcttacaccacctacgtctcctgaggaagtccaaacagttgatcctcagtctgtccagaagtgggtcaaattttcttcagtatctgatggcttcaactccgatagtactagccaccatggtgggaaaatacccagaaaattagcaaatcatgtggtggatagagtttggcaagaatgcaatatgaacagagcacagaacaagaggaagtattctgcttcatcaggtggtctatgcgaagaagcgacagctgctaaagtggcatcctgggattttgttgaagccacacaaagaacaaattgcagttgtttgaggcacaaaaatctcaagtcaagaaatgctggacaacaaggacaggcaccatctttaggtcagcaacaacaaatacttcctaagcacaagaccaatgagaagcaagaaaagagtgaaaagccacagaaacgccccttgactccttttcaccatcgtgtgtctgttagtgatgatgttggcatggacgcagattcagccagccaaagacttgtgatctctgctccagacagtcaagtgagattttcaaatatccgaactaatgatgtagcaaagactcctcagatgcatggcaccgaaatggcaaattcacctcaaccacccccacttagtcctcacccttgtgatgtggttgatgaaggagtgactaaaacaccttcaactcctcagagtcaacatttttatcaaatgccaacaccagatcccttggttccttctaaaccaatggaagataggatagacagtttgtcccagtctttcccacctcaatatcaggaagctgtagaacctacagtatatgttggtacagcagtaaacttggaagaagatgaagccaatatagcctggaagtattacaagttcccaaagaaaaaagatgtagagtttttaccacctcaacttccaagtgataaattcaaggatgatccagttggaccttttggacaggaaagtgtaacatcagttacagagttaatggtgcaatgtaagaaacctttaaaagtttctgatgaattagtgcagcaatatcaaattaaaaaccagtgtctttcagcaatagcatctgatgcagaacaagaacctaaaattgatccatatgcatttgttgaaggagatgaggaattcctttttcctgataaaaaagatagacaaaatagtgagagagaagctggaaaaaaacacaaggtagaagatgggacatctagtgtaacagtgttatcacatgaagaagatgctatgtcattatttagtccctctatcaagcaagatgttaatggaggactaaaggaatctgaaaaattatctgatgatttgatattattgctacaagatcagtgcactaatttattttcaccctttggagcagcagaccaagatccttttcctaaaagtggtgtaattagcaattgggtacgtgttgaagagcgtgactgttgcaatgactgctaccttgcattagaacatgggcgtcagttcatggataacatgtcaggaggaaaagttgatgaagcacttgtgaaaagttcatgcttacacccctggtccaaaagaaacgatgtgagtatgcagtgctcacaggatatacttcgaatgctcctctctcttcagccagttcttcaggatgccattcagaaaaaaagaacagtaagaccttggggtgttcagggtcctctcacttggcaacaatttcataaaatggctggccgaggctcttatggaactgatgaatccccagaaccactgccaatccccacatttttgttgggttatgattatgattatctggtgctttctccatttgctcttccttattgggagagacttatgctggaaccctatggatctcaaagagatatagcctatgttgtactgtgtccagaaaatgaagccttgttaaatggagcaaaaagcttttttagagatcttactgcaatatatgagtcctgtcgattaggtcaacatagacctgtttctcgactgttaacagatgggatcatgagagttggatctactgcatcaaagaaactatcagaaaagttggtagcagaatggttttctcaggcagctgatggtaacaatgaagcattttctaaactcaagctttatgcacaagtctgcagatatgacctaggtccttatcttgcttccctgccattggacagctctctactttcccagccaaatttagttgcccctacaagtcagtctttgattactccacctcagatgacaaatactggaaatgctaatactccatctgccaccttagcatctgcagcgagcagcactatgacagtgacttcaggtgttgccatatctacttcagttgccacagctaattcaactttgaccacagcttcaacttcatcttcatcatcctccaacttgaatagtggagtatcatcaaataaactaccttcgtttccaccctttggcagtatgaacagtaatgctgcaggatccatgtctacacaagcaaatacagttcagagtggtcagctaggagggcaacagacatcagctctacagacagctgggatttctggagaatcatcttcacttcccactcagccgcatcctgatgtgtctgaaagcacgatggatcgggataaagtgggaatccccacagatggtgattcacatgcagtcacgtatccacctgcaattgttgtttatataattgatccttttacatacgaaaatacagacgagagcactaactcttctagtgtgtggacattggggctacttcgatgctttctagaaatggtccagactcttcctcctcatatcaagagtactgtttctgtacagattattccttgtcagtacctgttgcaacctgtgaagcatgaagatagagaaatctatccccagcatttaaaatccctggctttttcggcctttacccagtgtcggaggccacttccaacatcaaccaatgtgaaaacattgactggctttggtccaggtttagccatggaaactgcccttagaagtcctgatagaccagagtgtattcgactttatgcacctccttttattctggctccagtgaaggacaaacagacagagctaggagaaacatttggagaagctggacagaaatataatgttctttttgtgggatactgtttatcacatgatcaaaggtggattcttgcatcttgcacagatctatatggagaacttttagaaacttgtatcattaacatcgatgttccaaatagggctcgtcggaaaaaaagttctgctagaaaatttggtctacagaaactttgggagtggtgcttaggacttgtacaaatgagttcattgccatggagagttgtaattggtcgtctaggaaggattggtcatggagaattgaaagattggagctgtttgctgagtcgtcgaaacttgcagtctctaagtaaaaggctcaaagacatgtgtagaatgtgtggtatatctgctgcagactcccctagcattctcagtgcttgcttggtggcaatggagccgcaaggctcttttgttattatgccagattctgtgtcaactggttctgtatttggaagaagcacgactctaaatatgcagacatctcagctaaataccccacaggatacatcatgtactcatatacttgtgtttcctacttctgcttctgtgcaagtagcttcagctacttataccactgaaaatttggatttagctttcaatcccaacaatgatggagcagatggaatgggtatctttgatttgttagacacaggagatgatcttgaccctgatatcattaatatccttcctgcttctccaactggttctcctgtacattctccaggatctcattacccccatggaggtgatgcgggcaagggtcagagtactgatcggctactatcaacagaacctcatgaggaagtacctaatattcttcagcaaccattggcccttggttactttgtatcaactgccaaagcaggtccattacctgactggttctggtcagcatgtcctcaagcacaatatcagtgtcccctttttcttaaggcctctttgcacctccacgtgccttcagtgcaatctgacgagctgcttcacagtaaacactcccacccacttgactcaaatcagacttcagatgtcctcaggtttgttttggaacagtacaatgcactctcctggctaacctgtgaccctgcaacccaggacagacgctcatgtctcccaattcattttgtggtgctgaatcagttatataactttattatgaatatgctgtgatcttcatttgatggaactgtgcaagaaaagaacaaggaaaaatggatgtttcgctgcaggattaagttacaattatcttctcagtgaaggtcatttgtgatggggtctaattcttattacttcaacaaatattgttttgacttggggggaggggctataaccctgctatttttcattgactctattgaactctttaggatgatgactgatcatacaaaacgtattataacattttcgtagcaaaattaaccttttttttttccagtcacagtatttgtgaaaagtaatgagccatagtacccagtcatgttaaatgaatattaaaagcatggagaggaaacatgaggaacaatgaatttcaacatatggcttcagaacatgaagatgttcttgtatggattatagtatctagtattcaaaaatgcctgcatctcttctcttatttattgtaagtttttaaatgtataaattgtcttatatttcttaacctcttttataaaaattttcctagaaggtttatactgccttcttgctttaaagcaattggtctaaaatatatgtaatcgtcttaattaaaaagttgcagtagggttgcttttagagtattatttttttgtaagggggtgggtgggacagtaaatttgtattgtctcgatgtacagtttaacggggatagagggggaataatgtccataccattgtgtgtggaggatttacagctaagctgtagttgcagagtacatgtacagtaatgaagttcactgtgtttataaattgaaaaggtaccaggtcttacagcattttatatatcacatctttacagaataacatgatggcaatatacaagtggtattgttaggtggtttaacttagaataaaatgagaattcttcagttatattttgtactatggtttagggctatgactaatatttcaggccatttccggtgaaagaaacttagttttacaagaaaaaccatttgctactgaatgcttaaactaattttagtgtttaatgttacatgcttaaatttttttcagttttaacagtggcatatttaggcatggaaatattattatgaaatttattttcaggatctgctataaggttgaaatttagcccagctctaggcattttacaaattatttttcaagcagtcattcttgattgtttgacttttttttttaaattaaagattgggaatgtatgtgagagtatgcatatgtatgggtgtgtgtgtgtgcgcgcaatcaaactgtggtgtaaatagattctcagtgaattctgggtattcagactctattccactagtgaaagaaccattttttaaacttcccttgccttttttatttatttaattttcttggtttggagatgtcagtcccaaacaccagagtctgtacttttctataacacagctcagattaaggtagggcatatgccaaggaggttctcacctccctaaagaagggacttgaattttagggactttaattcacccctccttcaatacaactttcccccttcttgtttgcacatgccaagataactgcttttatgcaggctgtacccccttgaaaaatcctttctacagtgctgctcacaaaagagcccaagttcgcctcctacctgcattgctgacttgaattcacagtcgccgagtctacctagctttcttggaagcagtctagcaaaatttctatttgtacgttcactaattatctacaaggacaaaatcagttgtatttacaaaactctacttcagtgtttgttttagtttttttttttactgaaacttgtttttgtgaatactctgtgcttagaattaaatatcactttcttatgaacaacataacttcttcagattgtgtatatgaaaacattagcaagtcttgttttttctatgaagcaaacacaattggtgacaaaggttgtcaatcatttcttcaaaattataatgcagttctaatggtcagcatattttgatattaaatttaaagatcacctctctgcatttgtttttaaattatgctaatacaccacacattatgttggtatgttttgttctgtactttctttaaaaaaaaaaaaaaaacttgtctgagatttgaaggaaaatgtgcttatttggaatttccataaaaagagtatcctttttatacacttaatagtgactttacaaaataaaagttatattctcagttgtttaaaatcactaacctatgataaccacacctcaatttgaaagtagatttaaaattattccctgacaggttatttaatatggagccataaggagggaacccagtacacaattattttttatttgggaatcagggaatagttcccaaatatacaggatttattgataagattttttttcttcccttcatatatccattcaaactcaatggaaagttattaaataaccattagaaaagctcagtagacttatttgagaaattaagccttgtgcaggatgatggatttgacttactaatgtactgtcacagacaaatatgggtagttttgtttaaataggtaagcaaaatattatactttatagcagtggattaccaacaccttgacttctttgttacagtgctaacatcttttttttgtgcaggtatccatgattattaagcagggtggaagttcagtattttgtcatttaaaaagattagttatataatgtctgcttccagccagtgagaaacatctagccatacctttcttatgcaagccattgagttatcaggactgtgaattaacactgtatgaataaatttctgtacaccttattgtttggccagaaggccaccaagtgtacttatatgtaatccttaaattttaaagtagctgtaatttttaaatatttctaaacttttcttaaaccactaaaattaagctcttactacttagtcaactatcctcagctgtattcgtactcaattgtcagtatggcacagattactgtattaaaatattctcctttcgtcttcatatttaccttctgaggtaattttttaacttaatgtgttactacaaagatttgcagatctttaatcaagcactatgttaatactgtaatatcagaatactatgttgcattatttaaaatgttcaaattgaatagattaaaaagtttttaaatgctattgcatcatataatttgctattcatccactatggcattgcatatcaatcagttaatacacttaatgttgcatgagtgatattttggtctgggtttcctcttaagattttagtttgtctgaattaaggaaaaatgtttttaatatacattcttattttgtcccacccctccagaaataagctggaaatcttaactttttggggggtcttttttggtgttttaatgggcccagaactgtggtttaaatttttatgtatgtattttcttttttgtggagtataaatttaaaaactggatttgggacctaaaatactcctcaggttgatgtattcatgaagttttaaaacatctttagttttcaaagtaaactggatatgtggaccttaaagttattgagtttaagctacaaattgtaacgtcattactggacatgtcagcatcaaccctctcaaaatagcttggtcactttatgaaggggcgttttaaagttgttgtttagcagtgacatttaatatggtccaattgcttttctttttaacgtgacaaaaagagaataaggaacaaacactattgctgccgaatgccataacactgagttgtacaaattgtgattgaggaaatgaaaaggtttatacttttta

SEQ ID NO: 24996 - DNA, 9020 bp, Homo sapiens
gcgagcagcatactactactaattccgcggccgctcgacgcaacaacaaatacttcctaagcacaagaccaatgagaagcaagaaaagagtgaaaagccacagaaacgccccttgactccttttcaccatcgtgtgtctgttagtgatgatgttggcatggacgcagattcagccagccaaagacttgtgatctctgctccagacagtcaagtgagattttcaaatatccgaactaatgatgtagcaaagactcctcagatgcatggcaccgaaatggcaaattcacctcaaccacccccacttagtcctcacccttgtgatgtggttgatgaaggagtgactaaaacaccttcaactcctcagagtcaacatttttatcaaatgccaacaccagatcccttggttccttctaaaccaatggaagataggatagacagtttgtcccagtctttcccacctcaatatcaggaagctgtagaacctacagtatatgttggtacagcagtaaacttggaagaagatgaagccaatatagcctggaagtattacaagttcccaaagaaaaaagatgtagagtttttaccacctcaacttccaagtgataaattcaaggatgatccagttggaccttttggacaggaaagtgtaacatcagttacagagttaatggtgcaatgtaagaaacctttaaaagtttctgatgaattagtgcagcaatatcaaattaaaaaccagtgtctttcagcaatagcatctgatgcagaacaagaacctaaaattgatccatatgcatttgttgaaggagatgaggaattcctttttcctgataaaaaagatagacaaaatagtgagagagaagctggaaaaaaacacaaggtagaagatgggacatctagtgtaacagtgttatcacatgaagaagatgctatgtcattatttagtccctctatcaagcaagatgctccacgccctactagtcatgcccgtcctccatcaacaagtttgatttatgactcagacctggctgtctcttatactgaccttgataatctcttcaattctgatgaagatgaactaacacctggatctaaaagatcagcaaatggatcagatgataaagccagctgcaaggaatcaaagacaggaaatctggacccgttatcttgcataagcactgcagatcttcataaaatgtatcctacaccaccatcattggaacaacatattatgggattttccccaatgaatatgaataataaagaatatggtagtatggatacaacacctggaggaactgttctagaaggaaatagttctagtataggagcgcagttcaaaattgaggttgatgagggattctgtagccccaaaccttctgaaattaaagatttttcttatgtctataagcctgaaaattgtcaaattctagtgggatgttccatgtttgcacctctaaaaactctaccaagccaatatctgccccttatcaaattgccagaagagtgtatttaccgtcagagttggactgttggaaaattggaattgctttcttcagggccttcaatgccattcatcaaagagggtgatggaagtaatatggatcaagaatatggcactgcttatacacctcaaactcatacttcttgtgggatgcctcctagcagtgcacctcctagtaacagcggagcaggaattcttccttctccatccacccctcggtttccaactccaaggactccaaggactcctcggactcctcgtggagctggtggacctgctagtgctcaaggttcagtcaaatatgaaaattcagacttgtattcaccagcttctaccccatctacatgcagaccccttaattctgttgaacctgcaactgtcccttccatccctgaagcacacagtctttatgtaaacctcatcctttcagaatcagttatgaatttgtttaaagactgtaactctgatagttgttgcatctgtgtttgcaacatgaacatcaagggtgccgatgttggagtttacattccagatccaacgcaggaagcacaatataggtgtacctgtggcttcagtgctgtcatgaacagaaaatttggaaacaattcaggattatttcttgaagatgaactagatatcataggacgcaatacagactgtggcaaagaagcagaaaaacgttttgaagctctcagggctacctctgctgaacatgttaatggaggactaaaggaatctgaaaaattatctgatgatttgatattattgctacaagatcagtgcactaatttattttcaccctttggagcagcagaccaagatccttttcctaaaagtggtgtaattagcaattgggtacgtgttgaagagcgtgactgttgcaatgactgctaccttgcattagaacatgggcgtcagttcatggataacatgtcaggaggaaaagttgatgaagcacttgtgaaaagttcatgcttacacccctggtccaaaagaaacgatgtgagtatgcagtgctcacaggatatacttcgaatgctcctctctcttcagccagttcttcaggatgccattcagaaaaaaagaacagtaagaccttggggtgttcagggtcctctcacttggcaacaatttcataaaatggctggccgaggctcttatggaactgatgaatccccagaaccactgccaatccccacatttttgttgggttatgattatgattatctggtgctttctccatttgctcttccttattgggagagacttatgctggaaccctatggatctcaaagagatatagcctatgttgtactgtgtccagaaaatgaagccttgttaaatggagcaaaaagcttttttagagatcttactgcaatatatgagtcctgtcgattaggtcaacatagacctgtttctcgactgttaacagatgggatcatgagagttggatctactgcatcaaagaaactatcagaaaagttggtagcagaatggttttctcaggcagctgatggtaacaatgaagcattttctaaactcaagctttatgcacaagtctgcagatatgacctaggtccttatcttgcttccctgccattggacagctctctactttcccagccaaatttagttgcccctacaagtcagtctttgattactccacctcagatgacaaatactggaaatgctaatactccatctgccaccttagcatctgcagcgagcagcactatgacagtgacttcaggtgttgccatatctacttcagttgccacagctaattcaactttgaccacagcttcaacttcatcttcatcatcctccaacttgaatagtggagtatcatcaaataaactaccttcgtttccaccctttggcagtatgaacagtaatgctgcaggatccatgtctacacaagcaaatacagttcagagtggtcagctaggagggcaacagacatcagctctacagacagctgggatttctggagaatcatcttcacttcccactcagccgcatcctgatgtgtctgaaagcacgatggatcgggataaagtgggaatccccacagatggtgattcacatgcagtcacgtatccacctgcaattgttgtttatataattgatccttttacatacgaaaatacagacgagagcactaactcttctagtgtgtggacattggggctacttcgatgctttctagaaatggtccagactcttcctcctcatatcaagagtactgtttctgtacagattattccttgtcagtacctgttgcaacctgtgaagcatgaagatagagaaatctatccccagcatttaaaatccctggctttttcggcctttacccagtgtcggaggccacttccaacatcaaccaatgtgaaaacattgactggctttggtccaggtttagccatggaaactgcccttagaagtcctgatagaccagagtgtattcgactttatgcacctccttttattctggctccagtgaaggacaaacagacagagctaggagaaacatttggagaagctggacagaaatataatgttctttttgtgggatactgtttatcacatgatcaaaggtggattcttgcatcttgcacagatctatatggagaacttttagaaacttgtatcattaacatcgatgttccaaatagggctcgtcggaaaaaaagttctgctagaaaatttggtctacagaaactttgggagtggtgcttaggacttgtacaaatgagttcattgccatggagagttgtaattggtcgtctaggaaggattggtcatggagaattgaaagattggagctgtttgctgagtcgtcgaaacttgcagtctctaagtaaaaggctcaaagacatgtgtagaatgtgtggtatatctgctgcagactcccctagcattctcagtgcttgcttggtggcaatggagccgcaaggctcttttgttattatgccagattctgtgtcaactggttctgtatttggaagaagcacgactctaaatatgcagacatctcagctaaataccccacaggatacatcatgtactcatatacttgtgtttcctacttctgcttctgtgcaagtagcttcagctacttataccactgaaaatttggatttagctttcaatcccaacaatgatggagcagatggaatgggtatctttgatttgttagacacaggagatgatcttgaccctgatatcattaatatccttcctgcttctccaactggttctcctgtacattctccaggatctcattacccccatggaggtgatgcgggcaagggtcagagtactgatcggctactatcaacagaacctcatgaggaagtacctaatattcttcagcaaccattggcccttggttactttgtatcaactgccaaagcaggtccattacctgactggttctggtcagcatgtcctcaagcacaatatcagtgtcccctttttcttaaggcctctttgcacctccacgtgccttcagtgcaatctgacgagctgcttcacagtaaacactcccacccacttgactcaaatcagacttcagatgtcctcaggtttgttttggaacagtacaatgcactctcctggctaacctgtgaccctgcaacccaggacagacgctcatgtctcccaattcattttgtggtgctgaatcagttatataactttattatgaatatgctgtgatcttcatttgatggaactgtgcaagaaaagaacaaggaaaaatggatgtttcgctgcaggattaagttacaattatcttctcagtgaaggtcatttgtgatggggtctaattcttattacttcaacaaatattgttttgacttggggggaggggctataaccctgctatttttcattgactctattgaactctttaggatgatgactgatcatacaaaacgtattataacattttcgtagcaaaattaaccttttttttttccagtcacagtatttgtgaaaagtaatgagccatagtacccagtcatgttaaatgaatattaaaagcatggagaggaaacatgaggaacaatgaatttcaacatatggcttcagaacatgaagatgttcttgtatggattatagtatctagtattcaaaaatgcctgcatctcttctcttatttattgtaagtttttaaatgtataaattgtcttatatttcttaacctcttttataaaaattttcctagaaggtttatactgccttcttgctttaaagcaattggtctaaaatatatgtaatcgtcttaattaaaaagttgcagtagggttgcttttagagtattatttttttgtaagggggtgggtgggacagtaaatttgtattgtctcgatgtacagtttaacggggatagagggggaataatgtccataccattgtgtgtggaggatttacagctaagctgtagttgcagagtacatgtacagtaatgaagttcactgtgtttataaattgaaaaggtaccaggtcttacagcattttatatatcacatctttacagaataacatgatggcaatatacaagtggtattgttaggtggtttaacttagaataaaatgagaattcttcagttatattttgtactatggtttagggctatgactaatatttcaggccatttccggtgaaagaaacttagttttacaagaaaaaccatttgctactgaatgcttaaactaattttagtgtttaatgttacatgcttaaatttttttcagttttaacagtggcatatttaggcatggaaatattattatgaaatttattttcaggatctgctataaggttgaaatttagcccagctctaggcattttacaaattatttttcaagcagtcattcttgattgtttgacttttttttttaaattaaagattgggaatgtatgtgagagtatgcatatgtatgggtgtgtgtgtgtgcgcgcaatcaaactgtggtgtaaatagattctcagtgaattctgggtattcagactctattccactagtgaaagaaccattttttaaacttcccttgccttttttatttatttaattttcttggtttggagatgtcagtcccaaacaccagagtctgtacttttctataacacagctcagattaaggtagggcatatgccaaggaggttctcacctccctaaagaagggacttgaattttagggactttaattcacccctccttcaatacaactttcccccttcttgtttgcacatgccaagataactgcttttatgcaggctgtacccccttgaaaaatcctttctacagtgctgctcacaaaagagcccaagttcgcctcctacctgcattgctgacttgaattcacagtcgccgagtctacctagctttcttggaagcagtctagcaaaatttctatttgtacgttcactaattatctacaaggacaaaatcagttgtatttacaaaactctacttcagtgtttgttttagtttttttttttactgaaacttgtttttgtgaatactctgtgcttagaattaaatatcactttcttatgaacaacataacttcttcagattgtgtatatgaaaacattagcaagtcttgttttttctatgaagcaaacacaattggtgacaaaggttgtcaatcatttcttcaaaattataatgcagttctaatggtcagcatattttgatattaaatttaaagatcacctctctgcatttgtttttaaattatgctaatacaccacacattatgttggtatgttttgttctgtactttctttaaaaaaaaaaaaaaaacttgtctgagatttgaaggaaaatgtgcttatttggaatttccataaaaagagtatcctttttatacacttaatagtgactttacaaaataaaagttatattctcagttgtttaaaatcactaacctatgataaccacacctcaatttgaaagtagatttaaaattattccctgacaggttatttaatatggagccataaggagggaacccagtacacaattattttttatttgggaatcagggaatagttcccaaatatacaggatttattgataagattttttttcttcccttcatatatccattcaaactcaatggaaagttattaaataaccattagaaaagctcagtagacttatttgagaaattaagccttgtgcaggatgatggatttgacttactaatgtactgtcacagacaaatatgggtagttttgtttaaataggtaagcaaaatattatactttatagcagtggattaccaacaccttgacttctttgttacagtgctaacatcttttttttgtgcaggtatccatgattattaagcagggtggaagttcagtattttgtcatttaaaaagattagttatataatgtctgcttccagccagtgagaaacatctagccatacctttcttatgcaagccattgagttatcaggactgtgaattaacactgtatgaataaatttctgtacaccttattgtttggccagaaggccaccaagtgtacttatatgtaatccttaaattttaaagtagctgtaatttttaaatatttctaaacttttcttaaaccactaaaattaagctcttactacttagtcaactatcctcagctgtattcgtactcaattgtcagtatggcacagattactgtattaaaatattctcctttcgtcttcatatttaccttctgaggtaattttttaacttaatgtgttactacaaagatttgcagatctttaatcaagcactatgttaatactgtaatatcagaatactatgttgcattatttaaaatgttcaaattgaatagattaaaaagtttttaaatgctattgcatcatataatttgctattcatccactatggcattgcatatcaatcagttaatacacttaatgttgcatgagtgatattttggtctgggtttcctcttaagattttagtttgtctgaattaaggaaaaatgtttttaatatacattcttattttgtcccacccctccagaaataagctggaaatcttaactttttggggggtcttttttggtgttttaatgggcccagaactgtggtttaaatttttatgtatgtattttcttttttgtggagtataaatttaaaaactggatttgggacctaaaatactcctcaggttgatgtattcatgaagttttaaaacatctttagttttcaaagtaaactggatatgtggaccttaaagttattgagtttaagctacaaattgtaacgtcattactggacatgtcagcatcaaccctctcaaaatagcttggtcactttatgaaggggcgttttaaagttgttgtttagcagtgacatttaatatggtccaattgcttttctttttaacgtgacaaaaagagaataaggaacaaacactattgctgccgaatgccataacactgagttgtacaaattgtgattgaggaaatgaaaaggtttatacttttta

SEQ ID NO: 24997 - DNA, 10459 bp, Homo sapiens
  misc_feature (7058)..(7058): n is a, c, g, or t
  misc_feature (7062)..(7062): n is a, c, g, or t
  misc_feature (7064)..(7064): n is a, c, g, or t
  misc_feature (7067)..(7067): n is a, c, g, or t
  misc_feature (7087)..(7087): n is a, c, g, or t
  misc_feature (7090)..(7090): n is a, c, g, or t
gtttctctctctggtcggaagcggcggtaatggcggatggtgggttgtggcgccggcggcggctgctgtgagggacgatgagtgcctccttcgtgccgaacggggccagcctggaagattgtcactgtaacctcttctgcctggctgacttgacaggaattaagtggaaaaaatatgtatggcaaggcccaacttctgcccctattctgtttcctgtgacagaagaagaccccattttgagcagttttagtcgctgccttaaggcagatgtacttggtgtttggcggcgagatcaaagacctggaagaagagaattgtggatattttggtggggtgaagaccccagttttgctgaccttattcaccatgacttatcagaagaagaagatggagtgtgggagaatggactttcctatgaatgccgtactctgcttttcaaagcagttcacaatctattggaacggtgtttaatgaacaggaattttgtacgtattggcaagtggtttgtaaagccttatgaaaaagatgaaaaacctataaataaaagtgaacacttgtcctgctccttcacctttttcttgcatggagacagcaatgtttgtaccagtgtggaaattaaccaacatcaacctgtataccttctcagtgaagagcatatcacccttgctcaacagtctaatagcccatttcaagttatcttatgcccatttggactaaatggcactctcacaggacaggcattcaagatgtctgattcagctacaaaaaaattaattggtgaatggaaacagttctatcctatctcatgttgcttgaaggagatgtctgaagaaaaacaggaagatatggattgggaagatgattctttagctgcagtagaagttcttgttgctggtgtccgaatgatctacccagcatgctttgttctagtccctcagtcagacattcctactcctagccctgtgggatccactcactgttcatcttcttgcttgggtgtccaccaagtgcctgcttccacaagagatcctgctatgtcttcggttacgcttacaccacctacgtctcctgaggaagtccaaacagttgatcctcagtctgtccagaagtgggtcaaattttcttcagtatctgatggcttcaactccgatagtactagccaccatggtgggaaaatacccagaaaattagcaaatcatgtggtggatagagtttggcaagaatgcaatatgaacagagcacagaacaagaggaagtattctgcttcatcaggtggtctatgcgaagaagcgacagctgctaaagtggcatcctgggattttgttgaagccacacaaagaacaaattgcagttgtttgaggcacaaaaatctcaagtcaagaaatgctggacaacaaggacaggcaccatctttaggtcagcaacaacaaatacttcctaagcacaagaccaatgagaagcaagaaaagagtgaaaagccacagaaacgccccttgactccttttcaccatcgtgtgtctgttagtgatgatgttggcatggacgcagattcagccagccaaagacttgtgatctctgctccagacagtcaagtgagattttcaaatatccgaactaatgatgtagcaaagactcctcagatgcatggcaccgaaatggcaaattcacctcaaccacccccacttagtcctcacccttgtgatgtggttgatgaaggagtgactaaaacaccttcaactcctcagagtcaacatttttatcaaatgccaacaccagatcccttggttccttctaaaccaatggaagataggatagacagtttgtcccagtctttcccacctcaatatcaggaagctgtagaacctacagtatatgttggtacagcagtaaacttggaagaagatgaagccaatatagcctggaagtattacaagttcccaaagaaaaaagatgtagagtttttaccacctcaacttccaagtgataaattcaaggatgatccagttggaccttttggacaggaaagtgtaacatcagttacagagttaatggtgcaatgtaagaaacctttaaaagtttctgatgaattagtgcagcaatatcaaattaaaaaccagtgtctttcagcaatagcatctgatgcagaacaagaacctaaaattgatccatatgcatttgttgaaggagatgaggaattcctttttcctgataaaaaagatagacaaaatagtgagagagaagctggaaaaaaacacaaggtagaagatgggacatctagtgtaacagtgttatcacatgaagaagatgctatgtcattatttagtccctctatcaagcaagatgctccacgccctactagtcatgcccgtcctccatcaacaagtttgatttatgactcagacctggctgtctcttatactgaccttgataatctcttcaattctgatgaagatgaactaacacctggatctaaaagatcagcaaatggatcagatgataaagccagctgcaaggaatcaaagacaggaaatctggacccgttatcttgcataagcactgcagatcttcataaaatgtatcctacaccaccatcattggaacaacatattatgggattttccccaatgaatatgaataataaagaatatggtagtatggatacaacacctggaggaactgttctagaaggaaatagttctagtataggagcgcagttcaaaattgaggttgatgagggattctgtagccccaaaccttctgaaattaaagatttttcttatgtctataagcctgaaaattgtcaaattctagtgggatgttccatgtttgcacctctaaaaactctaccaagccaatatctgccccttatcaaattgccagaagagtgtatttaccgtcagagttggactgttggaaaattggaattgctttcttcagggccttcaatgccattcatcaaagagggtgatggaagtaatatggatcaagaatatggcactgcttatacacctcaaactcatacttcttgtgggatgcctcctagcagtgcacctcctagtaacagcggagcaggaattcttccttctccatccacccctcggtttccaactccaaggactccaaggactcctcggactcctcgtggagctggtggacctgctagtgctcaaggttcagtcaaatatgaaaattcagacttgtattcaccagcttctaccccatctacatgcagaccccttaattctgttgaacctgcaactgtcccttccatccctgaagcacacagtctttatgtaaacctcatcctttcagaatcagttatgaatttgtttaaagactgtaactctgatagttgttgcatctgtgtttgcaacatgaacatcaagggtgccgatgttggagtttacattccagatccaacgcaggaagcacaatataggtgtacctgtggcttcagtgctgtcatgaacagaaaatttggaaacaattcaggattatttcttgaagatgaactagatatcataggacgcaatacagactgtggcaaagaagcagaaaaacgttttgaagctctcagggctacctctgctgaacatgttaatggaggactaaaggaatctgaaaaattatctgatgatttgatattattgctacaagatcagtgcactaatttattttcaccctttggagcagcagaccaagatccttttcctaaaagtggtgtaattagcaattgggtacgtgttgaagagcgtgactgttgcaatgactgctaccttgcattagaacatgggcgtcagttcatggataacatgtcaggaggaaaagttgatgaagcacttgtgaaaagttcatgcttacacccctggtccaaaagaaacgatgtgagtatgcagtgctcacaggatatacttcgaatgctcctctctcttcagccagttcttcaggatgccattcagaaaaaaagaacagtaagaccttggggtgttcagggtcctctcacttggcaacaatttcataaaatggctggccgaggctcttatggaactgatgaatccccagaaccactgccaatccccacatttttgttgggttatgattatgattatctggtgctttctccatttgctcttccttattgggagagacttatgctggaaccctatggatctcaaagagatatagcctatgttgtactgtgtccagaaaatgaagccttgttaaatggagcaaaaagcttttttagagatcttactgcaatatatgagtcctgtcgattaggtcaacatagacctgtttctcgactgttaacagatgggatcatgagagttggatctactgcatcaaagaaactatcagaaaagttggtagcagaatggttttctcaggcagctgatggtaacaatgaagcattttctaaactcaagctttatgcacaagtctgcagatatgacctaggtccttatcttgcttccctgccattggacagctctctactttcccagccaaatttagttgcccctacaagtcagtctttgattactccacctcagatgacaaatactggaaatgctaatactccatctgccaccttagcatctgcagcgagcagcactatgacagtgacttcaggtgttgccatatctacttcagttgccacagctaattcaactttgaccacagcttcaacttcatcttcatcatcctccaacttgaatagtggagtatcatcaaataaactaccttcgtttccaccctttggcagtatgaacagtaatgctgcaggatccatgtctacacaagcaaatacagttcagagtggtcagctaggagggcaacagacatcagctctacagacagctgggatttctggagaatcatcttcacttcccactcagccgcatcctgatgtgtctgaaagcacgatggatcgggataaagtgggaatccccacagatggtgattcacatgcagtcacgtatccacctgcaattgttgtttatataattgatccttttacatacgaaaatacagacgagagcactaactcttctagtgtgtggacattggggctacttcgatgctttctagaaatggtccagactcttcctcctcatatcaagagtactgtttctgtacagattattccttgtcagtacctgttgcaacctgtgaagcatgaagatagagaaatctatccccagcatttaaaatccctggctttttcggcctttacccagtgtcggaggccacttccaacatcaaccaatgtgaaaacattgactggctttggtccaggtttagccatggaaactgcccttagaagtcctgatagaccagagtgtattcgactttatgcacctccttttattctggctccagtgaaggacaaacagacagagctaggagaaacatttggagaagctggacagaaatataatgttctttttgtgggatactgtttatcacatgatcaaaggtggattcttgcatcttgcacagatctatatggagaacttttagaaacttgtatcattaacatcgatgttccaaatagggctcgtcggaaaaaaagttctgctagaaaatttggtctacagaaactttgggagtggtgcttaggacttgtacaaatgagttcattgccatggagagttgtaattggtcgtctaggaaggattggtcatggagaattgaaagattggagctgtttgctgagtcgtcgaaacttgcagtctctaagtaaaaggctcaaagacatgtgtagaatgtgtggtatatctgctgcagactcccctagcattctcagtgcttgcttggtggcaatggagccgcaaggctcttttgttattatgccagattctgtgtcaactggttctgtatttggaagaagcacgactctaaatatgcagacatctcagctaaataccccacaggatacatcatgtactcatatacttgtgtttcctacttctgcttctgtgcaagtagcttcagctacttataccactgaaaatttggatttagctttcaatcccaacaatgatggagcagatggaatgggtatctttgatttgttagacacaggagatgatcttgaccctgatatcattaatatccttcctgcttctccaactggttctcctgtacattctccaggatctcattacccccatggaggtgatgcgggcaagggtcagagtactgatcggctactatcaacagaacctcatgaggaagtacctaatattcttcagcaaccattggcccttggttactttgtatcaactgccaaagcaggtccattacctgactggttctggtcagcatgtcctcaagcacaatatcagtgtcccctttttcttaaggcctctttgcacctccacgtgccttcagtgcaatctgacgagctgcttcacagtaaacactcccacccacttgactcaaatcagacttcagatgtcctcaggtttgttttggaacagtacaatgcactctcctggctaacctgtgaccctgcaacccaggacagacgctcatgtctcccaattcattttgtggtgctgaatcagttatataactttattatgaatatgctgtgatcttcatttgatggaactgtgcaagaaaagaacaaggaaaaatggatgtttcgctgcaggattaagttacaattatcttctcagtgaaggtcatttgtgatggggtctaattcttattacttcaacaaatattgttttgacttggggggaggggctataaccctgctatttttcattgactctattgaactctttaggatgatgactgatcatacaaaacgtattataacattttcgtagcaaaattaaccttttttttttccagtcacagtatttgtgaaaagtaatgagccatagtacccagtcatgttaaatgaatattaaaagcatggagaggaaacatgaggaacaatgaatttcaacatatggcttcagaacatgaagatgttcttgtatggattatagtatctagtattcaaaaatgcctgcatctcttctcttatttataatgtggantaangnttntgtatagagatgtggctatntanagattgtgcgctcttataaattagtctctctgtataaaagcgccgttcgtatgtatatttaaaaaaaatttttccataggaaaggtttatactgccttcttgctttaaagcaattggtctaaaatatatgtaatcgtcttaattaaaaagttgcagtagggttgcttttagagtattatttttttgtaagggggtgggtgggacagtaaatttgtattgtctcgatgtacagtttaacggggatagagggggaataatgtccataccattgtgtgtggaggatttacagctaagctgtagttgcagagtacatgtacagtaatgaagttcactgtgtttataaattgaaaaggtaccaggtcttacagcattttatatatcacatctttacagaataacatgatggcaatatacaagtggtattgttaggtggtttaacttagaataaaatgagaattcttcagttatattttgtactatggtttagggctatgactaatatttcaggccatttccggtgaaagaaacttagttttacaagaaaaaccatttgctactgaatgcttaaactaattttagtgtttaatgttacatgcttaaatttttttcagttttaacagtggcatatttaggcatggaaatattattatgaaatttattttcaggatctgctataaggttgaaatttagcccagctctaggcattttacaaattatttttcaagcagtcattcttgattgtttgacttttttttttaaattaaagattgggaatgtatgtgagagtatgcatatgtatgggtgtgtgtgtgtgcgcgcaatcaaactgtggtgtaaatagattctcagtgaattctgggtattcagactctattccactagtgaaagaaccattttttaaacttcccttgccttttttatttatttaattttcttggtttggagatgtcagtcccaaacaccagagtctgtacttttctataacacagctcagattaaggtagggcatatgccaaggaggttctcacctccctaaagaagggacttgaattttagggactttaattcacccctccttcaatacaactttcccccttcttgtttgcacatgccaagataactgcttttatgcaggctgtacccccttgaaaaatcctttctacagtgctgctcacaaaagagcccaagttcgcctcctacctgcattgctgacttgaattcacagtcgccgagtctacctagctttcttggaagcagtctagcaaaatttctatttgtacgttcactaattatctacaaggacaaaatcagttgtatttacaaaactctacttcagtgtttgttttagtttttttttttactgaaacttgtttttgtgaatactctgtgcttagaattaaatatcactttcttatgaacaacataacttcttcagattgtgtatatgaaaacattagcaagtcttgttttttctatgaagcaaacacaattggtgacaaaggttgtcaatcatttcttcaaaattataatgcagttctaatggtcagcatattttgatattaaatttaaagatcacctctctgcatttgtttttaaattatgctaatacaccacacattatgttggtatgttttgttctgtactttctttaaaaaaaaaaaaaaaacttgtctgagatttgaaggaaaatgtgcttatttggaatttccataaaaagagtatcctttttatacacttaatagtgactttacaaaataaaagttatattctcagttgtttaaaatcactaacctatgataaccacacctcaatttgaaagtagatttaaaattattccctgacaggttatttaatatggagccataaggagggaacccagtacacaattattttttatttgggaatcagggaatagttcccaaatatacaggatttattgataagattttttttcttcccttcatatatccattcaaactcaatggaaagttattaaataaccattagaaaagctcagtagacttatttgagaaattaagccttgtgcaggatgatggatttgacttactaatgtactgtcacagacaaatatgggtagttttgtttaaataggtaagcaaaatattatactttatagcagtggattaccaacaccttgacttctttgttacagtgctaacatcttttttttgtgcaggtatccatgattattaagcagggtggaagttcagtattttgtcatttaaaaagattagttatataatgtctgcttccagccagtgagaaacatctagccatacctttcttatgcaagccattgagttatcaggactgtgaattaacactgtatgaataaatttctgtacaccttattgtttggccagaaggccaccaagtgtacttatatgtaatccttaaattttaaagtagctgtaatttttaaatatttctaaacttttcttaaaccactaaaattaagctcttactacttagtcaactatcctcagctgtattcgtactcaattgtcagtatggcacagattactgtattaaaatattctcctttcgtcttcatatttaccttctgaggtaattttttaacttaatgtgttactacaaagatttgcagatctttaatcaagcactatgttaatactgtaatatcagaatactatgttgcattatttaaaatgttcaaattgaatagattaaaaagtttttaaatgctattgcatcatataatttgctattcatccactatggcattgcatatcaatcagttaatacacttaatgttgcatgagtgatattttggtctgggtttcctcttaagattttagtttgtctgaattaaggaaaaatgtttttaatatacattcttattttgtcccacccctccagaaataagctggaaatcttaactttttggggggtcttttttggtgttttaatgggcccagaactgtggtttaaatttttatgtatgtattttcttttttgtggagtataaatttaaaaactggatttgggacctaaaatactcctcaggttgatgtattcatgaagttttaaaacatctttagttttcaaagtaaactggatatgtggaccttaaagttattgagtttaagctacaaattgtaacgtcattactggacatgtcagcatcaaccctctcaaaatagcttggtcactttatgaaggggcgttttaaagttgttgtttagcagtgacatttaatatggtccaattgcttttctttttaacgtgacaaaaagagaataaggaacaaacactattgctgccgaatgccataacactgagttgtacaaattgtgattgaggaaatgaaaaggtttatacttttta

SEQ ID NO: 24998 - DNA, 6982 bp, Homo sapiens
gtttctctctctggtcggaagcggcggtaatggcggatggtgggttgtggcgccggcggcggctgctgtgagggacgatgagtgcctccttcgtgccgaacggggccagcctggaagattgtcactgtaacctcttctgcctggctgacttgacaggaattaagtggaaaaaatatgtatggcaaggcccaacttctgcccctattctgtttcctgtgacagaagaagaccccattttgagcagttttagtcgctgccttaaggcagatgtacttggtgtttggcggcgagatcaaagacctggaagaagagaattgtggatattttggtggggtgaagaccccagttttgctgaccttattcaccatgacttatcagaagaagaagatggagtgtgggagaatggactttcctatgaatgccgtactctgcttttcaaagcagttcacaatctattggaacggtgtttaatgaacaggaattttgtacgtattggcaagtggtttgtaaagccttatgaaaaagatgaaaaacctataaataaaagtgaacacttgtcctgctccttcacctttttcttgcatggagacagcaatgtttgtaccagtgtggaaattaaccaacatcaacctgtataccttctcagtgaagagcatatcacccttgctcaacagtctaatagcccatttcaagttatcttatgcccatttggactaaatggcactctcacaggacaggcattcaagatgtctgattcagctacaaaaaaattaattggtgaatggaaacagttctatcctatctcatgttgcttgaaggagatgtctgaagaaaaacaggaagatatggattgggaagatgattctttagctgcagtagaagttcttgttgctggtgtccgaatgatctacccagcatgctttgttctagtccctcagtcagacattcctactcctagccctgtgggatccactcactgttcatcttcttgcttgggtgtccaccaagtgcctgcttccacaagagatcctgctatgtcttcggttacgcttacaccacctacgtctcctgaggaagtccaaacagttgatcctcagtctgtccagaagtgggtcaaattttcttcagtatctgatggcttcaactccgatagtactagccaccatggtgggaaaatacccagaaaattagcaaatcatgtggtggatagagtttggcaagaatgcaatatgaacagagcacagaacaagaggaagtattctgcttcatcaggtggtctatgcgaagaagcgacagctgctaaagtggcatcctgggattttgttgaagccacacaaagaacaaattgcagttgtttgaggcacaaaaatctcaagtcaagaaatgctggacaacaaggacaggcaccatctttaggtcagcaacaacaaatacttcctaagcacaagaccaatgagaagcaagaaaagagtgaaaagccacagaaacgccccttgactccttttcaccatcgtgtgtctgttagtgatgatgttggcatggacgcagattcagccagccaaagacttgtgatctctgctccagacagtcaagtgagattttcaaatatccgaactaatgatgtagcaaagactcctcagatgcatggcaccgaaatggcaaattcacctcaaccacccccacttagtcctcacccttgtgatgtggttgatgaaggagtgactaaaacaccttcaactcctcagagtcaacatttttatcaaatgccaacaccagatcccttggttccttctaaaccaatggaagataggatagacagtttgtcccagtctttcccacctcaatatcaggaagctgtagaacctacagtatatgttggtacagcagtaaacttggaagaagatgaagccaatatagcctggaagtattacaagttcccaaagaaaaaagatgtagagtttttaccacctcaacttccaagtgataaattcaaggatgatccagttggaccttttggacaggaaagtgtaacatcagttacagagttaatggtgcaatgtaagaaacctttaaaagtttctgatgaattagtgcagcaatatcaaattaaaaaccagtgtctttcagcaatagcatctgatgcagaacaagaacctaaaattgatccatatgcatttgttgaaggagatgaggaattcctttttcctgataaaaaagatagacaaaatagtgagagagaagctggaaaaaaacacaaggtagaagatgggacatctagtgtaacagtgttatcacatgaagaagatgctatgtcattatttagtccctctatcaagcaagatgctccacgccctactagtcatgcccgtcctccatcaacaagtttgatttatgactcagacctggctgtctcttatactgaccttgataatctcttcaattctgatgaagatgaactaacacctggatctaaaagatcagcaaatggatcagatgataaagccagctgcaaggaatcaaagacaggaaatctggacccgttatcttgcataagcactgcagatcttcataaaatgtatcctacaccaccatcattggaacaacatattatgggattttccccaatgaatatgaataataaagaatatggtagtatggatacaacacctggaggaactgttctagaaggaaatagttctagtataggagcgcagttcaaaattgaggttgatgagggattctgtagccccaaaccttctgaaattaaagatttttcttatgtctataagcctgaaaattgtcaaattctagtgggatgttccatgtttgcacctctaaaaactctaccaagccaatatctgccccttatcaaattgccagaagagtgtatttaccgtcagagttggactgttggaaaattggaattgctttcttcagggccttcaatgccattcatcaaagagggtgatggaagtaatatggatcaagaatatggcactgcttatacacctcaaactcatacttcttgtgggatgcctcctagcagtgcacctcctagtaacagcggagcaggaattcttccttctccatccacccctcggtttccaactccaaggactccaaggactcctcggactcctcgtggagctggtggacctgctagtgctcaaggttcagtcaaatatgaaaattcagacttgtattcaccagcttctaccccatctacatgcagaccccttaattctgttgaacctgcaactgtcccttccatccctgaagcacacagtctttatgtaaacctcatcctttcagaatcagttatgaatttgtttaaagactgtaactctgatagttgttgcatctgtgtttgcaacatgaacatcaagggtgccgatgttggagtttacattccagatccaacgcaggaagcacaatataggtgtacctgtggcttcagtgctgtcatgaacagaaaatttggaaacaattcaggattatttcttgaagatgaactagatatcataggacgcaatacagactgtggcaaagaagcagaaaaacgttttgaagctctcagggctacctctgctgaacatgttaatggaggactaaaggaatctgaaaaattatctgatgatttgatattattgctacaagatcagtgcactaatttattttcaccctttggagcagcagaccaagatccttttcctaaaagtggtgtaattagcaattgggtacgtgttgaagagcgtgactgttgcaatgactgctaccttgcattagaacatgggcgtcagttcatggataacatgtcaggaggaaaagttgatgaagcacttgtgaaaagttcatgcttacacccctggtccaaaagaaacgatgtgagtatgcagtgctcacaggatatacttcgaatgctcctctctcttcagccagttcttcaggatgccattcagaaaaaaagaacagtaagaccttggggtgttcagggtcctctcacttggcaacaatttcataaaatggctggccgaggctcttatggaactgatgaatccccagaaccactgccaatccccacatttttgttgggttatgattatgattatctggtgctttctccatttgctcttccttattgggagagacttatgctggaaccctatggatctcaaagagatatagcctatgttgtactgtgtccagaaaatgaagccttgttaaatggagcaaaaagcttttttagagatcttactgcaatatatgagtcctgtcgattaggtcaacatagacctgtttctcgactgttaacagatgggatcatgagagttggatctactgcatcaaagaaactatcagaaaagttggtagcagaatggttttctcaggcagctgatggtaacaatgaagcattttctaaactcaagctttatgcacaagtctgcagatatgacctaggtccttatcttgcttccctgccattggacagctctctactttcccagccaaatttagttgcccctacaagtcagtctttgattactccacctcagatgacaaatactggaaatgctaatactccatctgccaccttagcatctgcagcgagcagcactatgacagtgacttcaggtgttgccatatctacttcagttgccacagctaattcaactttgaccacagcttcaacttcatcttcatcatcctccaacttgaatagtggagtatcatcaaataaactaccttcgtttccaccctttggcagtatgaacagtaatgctgcaggatccatgtctacacaagcaaatacagttcagagtggtcagctaggagggcaacagacatcagctctacagacagctgggatttctggagaatcatcttcacttcccactcagccgcatcctgatgtgtctgaaagcacgatggatcgggataaagtgggaatccccacagatggtgattcacatgcagtcacgtatccacctgcaattgttgtttatataattgatccttttacatacgaaaatacagacgagagcactaactcttctagtgtgtggacattggggctacttcgatgctttctagaaatggtccagactcttcctcctcatatcaagagtactgtttctgtacagattattccttgtcagtacctgttgcaacctgtgaagcatgaagatagagaaatctatccccagcatttaaaatccctggctttttcggcctttacccagtgtcggaggccacttccaacatcaaccaatgtgaaaacattgactggctttggtccaggtttagccatggaaactgcccttagaagtcctgatagaccagagtgtattcgactttatgcacctccttttattctggctccagtgaaggacaaacagacagagctaggagaaacatttggagaagctggacagaaatataatgttctttttgtgggatactgtttatcacatgatcaaaggtggattcttgcatcttgcacagatctatatggagaacttttagaaacttgtatcattaacatcgatgttccaaataggtatttgtatttccctaaatatatcatatcattccatttgtaacattttgtttcatttttaatgaatagaaaaccagtttgaaggttttatatatattaaaatattaagatgtggggttgtgggtgctttttacttttttctttagtgaatgtttatattgtataactaacataattaaaaataattttgattaatctattatatgaacaaaaaaaaaaaaaaaaaaaaaaaagagtgtgtgtgggtgtgtgctcttccagagaatttgtgtgtggcccatttgagaaaattcttgtgtggcgggaaagaatatctatccgcgcgcccaaggtttttttacacaaaggggggatatatatacctaaaatagggggcttcacaacacggtggtgagacgcccctaaaagtctgaggaggtttaatccaccttataatataaacaccttttgtcaaaagcgccctatgtgagttgtaaacagactctgttgtgaacaaacctgtgttgtttttctccccgagcgggcatcttaacggtgtgaaaccggcggcgctgtggtacaacacaggggaggaaaaaaaacaccgctgcgggaagagacgagcgccgacaaaaattttgccgcgggcagaaaaacacatgtgaccatgtctatagagagagtccttctaaaaaacaaaacgtcgaggcgaggcgataatctctgtgggggccccagacaaacagcgttgtggggagtggcggaccccccacaactgtggtgcttttggtggtgtaaatcattcccgcgacgaagacacatcttgttgtgggggggagaaggagccgtgcctgtgcaaacaaccagaaggggggggcgagatcaatcccacttgttggggagatcattcgcgaggagaagaattcttctgcgaaaggaaaccacacgatagcgcctcgttgtggtgacaccaccaacatgttttggggtggggaaaaaaaaacaccccgcgcgggtatttcttctcactaactacacgaaaagagcgtgtccacaagaaacacagttctagtaaacccgccgtgggggcgacaaacactatagggtggtggggcccccacccaagccagggggctgagcgccaccacacacacgcaggactaatcaacgaccgcggcggggagaagaaacaacctagctggagagggcgccagaaaacaagacggggggccactcacacctctgagttaggagcaaccccccccccgagaggaggagagagcgcctcagagaagaggtacgtagtgcaacaagggaggaagacgcacggctgacgaagattgggtggcgcgcaccccacaagtggtgtgcgctgcaccatttattacaagcaggatggtggggggggagaccacacacccgacgacgtagtcgagaacagaaacc

SEQ ID NO: 24999 - DNA, 6116 bp, Homo sapiens
gtttctctctctggtcggaagcggcggtaatggcggatggtgggttgtggcgccggcggcggctgctgtgagggacgatgagtgcctccttcgtgccgaacggggccagcctggaagattgtcactgtaacctcttctgcctggctgacttgacaggaattaagtggaaaaaatatgtatggcaaggcccaacttctgcccctattctgtttcctgtgacagaagaagaccccattttgagcagttttagtcgctgccttaaggcagatgtacttggtgtttggcggcgagatcaaagacctggaagaagagaattgtggatattttggtggggtgaagaccccagttttgctgaccttattcaccatgacttatcagaagaagaagatggagtgtgggagaatggactttcctatgaatgccgtactctgcttttcaaagcagttcacaatctattggaacggtgtttaatgaacaggaattttgtacgtattggcaagtggtttgtaaagccttatgaaaaagatgaaaaacctataaataaaagtgaacacttgtcctgctccttcacctttttcttgcatggagacagcaatgtttgtaccagtgtggaaattaaccaacatcaacctgtataccttctcagtgaagagcatatcacccttgctcaacagtctaatagcccatttcaagttatcttatgcccatttggactaaatggcactctcacaggacaggcattcaagatgtctgattcagctacaaaaaaattaattggtgaatggaaacagttctatcctatctcatgttgcttgaaggagatgtctgaagaaaaacaggaagatatggattgggaagatgattctttagctgcagtagaagttcttgttgctggtgtccgaatgatctacccagcatgctttgttctagtccctcagtcagacattcctactcctagccctgtgggatccactcactgttcatcttcttgcttgggtgtccaccaagtgcctgcttccacaagagatcctgctatgtcttcggttacgcttacaccacctacgtctcctgaggaagtccaaacagttgatcctcagtctgtccagaagtgggtcaaattttcttcagtatctgatggcttcaactccgatagtactagccaccatggtgggaaaatacccagaaaattagcaaatcatgtggtggatagagtttggcaagaatgcaatatgaacagagcacagaacaagaggaagtattctgcttcatcaggtggtctatgcgaagaagcgacagctgctaaagtggcatcctgggattttgttgaagccacacaaagaacaaattgcagttgtttgaggcacaaaaatctcaagtcaagaaatgctggacaacaaggacaggcaccatctttaggtcagcaacaacaaatacttcctaagcacaagaccaatgagaagcaagaaaagagtgaaaagccacagaaacgccccttgactccttttcaccatcgtgtgtctgttagtgatgatgttggcatggacgcagattcagccagccaaagacttgtgatctctgctccagacagtcaagtgagattttcaaatatccgaactaatgatgtagcaaagactcctcagatgcatggcaccgaaatggcaaattcacctcaaccacccccacttagtcctcacccttgtgatgtggttgatgaaggagtgactaaaacaccttcaactcctcagagtcaacatttttatcaaatgccaacaccagatcccttggttccttctaaaccaatggaagataggatagacagtttgtcccagtctttcccacctcaatatcaggaagctgtagaacctacagtatatgttggtacagcagtaaacttggaagaagatgaagccaatatagcctggaagtattacaagttcccaaagaaaaaagatgtagagtttttaccacctcaacttccaagtgataaattcaaggatgatccagttggaccttttggacaggaaagtgtaacatcagttacagagttaatggtgcaatgtaagaaacctttaaaagtttctgatgaattagtgcagcaatatcaaattaaaaaccagtgtctttcagcaatagcatctgatgcagaacaagaacctaaaattgatccatatgcatttgttgaaggagatgaggaattcctttttcctgataaaaaagatagacaaaatagtgagagagaagctggaaaaaaacacaaggtagaagatgggacatctagtgtaacagtgttatcacatgaagaagatgctatgtcattatttagtccctctatcaagcaagatgctccacgccctactagtcatgcccgtcctccatcaacaagtttgatttatgactcagacctggctgtctcttatactgaccttgataatctcttcaattctgatgaagatgaactaacacctggatctaaaagatcagcaaatggatcagatgataaagccagctgcaaggaatcaaagacaggaaatctggacccgttatcttgcataagcactgcagatcttcataaaatgtatcctacaccaccatcattggaacaacatattatgggattttccccaatgaatatgaataataaagaatatggtagtatggatacaacacctggaggaactgttctagaaggaaatagttctagtataggagcgcagttcaaaattgaggttgatgagggattctgtagccccaaaccttctgaaattaaagatttttcttatgtctataagcctgaaaattgtcaaattctagtgggatgttccatgtttgcacctctaaaaactctaccaagccaatatctgccccttatcaaattgccagaagagtgtatttaccgtcagagttggactgttggaaaattggaattgctttcttcagggccttcaatgccattcatcaaagagggtgatggaagtaatatggatcaagaatatggcactgcttatacacctcaaactcatacttcttgtgggatgcctcctagcagtgcacctcctagtaacagcggagcaggaattcttccttctccatccacccctcggtttccaactccaaggactccaaggactcctcggactcctcgtggagctggtggacctgctagtgctcaaggttcagtcaaatatgaaaattcagacttgtattcaccagcttctaccccatctacatgcagaccccttaattctgttgaacctgcaactgtcccttccatccctgaagcacacagtctttatgtaaacctcatcctttcagaatcagttatgaatttgtttaaagactgtaactctgatagttgttgcatctgtgtttgcaacatgaacatcaagggtgccgatgttggagtttacattccagatccaacgcaggaagcacaatataggtgtacctgtggcttcagtgctgtcatgaacagaaaatttggaaacaattcaggattatttcttgaagatgaactagatatcataggacgcaatacagactgtggcaaagaagcagaaaaacgttttgaagctctcagggctacctctgctgaacatgttaatggaggactaaaggaatctgaaaaattatctgatgatttgatattattgctacaagatcagtgcactaatttattttcaccctttggagcagcagaccaagatccttttcctaaaagtggtgtaattagcaattgggtacgtgttgaagagcgtgactgttgcaatgactgctaccttgcattagaacatgggcgtcagttcatggataacatgtcaggaggaaaagttgatgaagcacttgtgaaaagttcatgcttacacccctggtccaaaagaaacgatgtgagtatgcagtgctcacaggatatacttcgaatgctcctctctcttcagccagttcttcaggatgccattcagaaaaaaagaacagtaagaccttggggtgttcagggtcctctcacttggcaacaatttcataaaatggctggccgaggctcttatggaactgatgaatccccagaaccactgccaatccccacatttttgttgggttatgattatgattatctggtgctttctccatttgctcttccttattgggagagacttatgctggaaccctatggatctcaaagagatatagcctatgttgtactgtgtccagaaaatgaagccttgttaaatggagcaaaaagcttttttagagatcttactgcaatatatgagtcctgtcgattaggtcaacatagacctgtttctcgactgttaacagatgggatcatgagagttggatctactgcatcaaagaaactatcagaaaagttggtagcagaatggttttctcaggcagctgatggtaacaatgaagcattttctaaactcaagctttatgcacaagtctgcagatatgacctaggtccttatcttgcttccctgccattggacagctctctactttcccagccaaatttagttgcccctacaagtcagtctttgattactccacctcagatgacaaatactggaaatgctaatactccatctgccaccttagcatctgcagcgagcagcactatgacagtgacttcaggtgttgccatatctacttcagttgccacagctaattcaactttgaccacagcttcaacttcatcttcatcatcctccaacttgaatagtggagtatcatcaaataaactaccttcgtttccaccctttggcagtatgaacagtaatgctgcaggatccatgtctacacaagcaaatacagttcagagtggtcagctaggagggcaacagacatcagctctacagacagctgggatttctggagaatcatcttcacttcccactcagccgcatcctgatgtgtctgaaagcacgatggatcgggataaagtgggaatccccacagatggtgattcacatgcagtcacgtatccacctgcaattgttgtttatataattgatccttttacatacgaaaatacagacgagagcactaactcttctagtgtgtggacattggggctacttcgatgctttctagaaatggtccagactcttcctcctcatatcaagagtactgtttctgtacagattattccttgtcagtacctgttgcaacctgtgaagcatgaagatagagaaatctatccccagcatttaaaatccctggctttttcggcctttacccagtgtcggaggccacttccaacatcaaccaatgtgaaaacattgactggctttggtccaggtttagccatggaaactgcccttagaagtcctgatagaccagagtgtattcgactttatgcacctccttttattctggctccagtgaaggacaaacagacagagctaggagaaacatttggagaagctggacagaaatataatgttctttttgtgggatactgtttatcacatgatcaaaggtggattcttgcatcttgcacagatctatatggagaacttttagaaacttgtatcattaacatcgatgttccaaatagggctcgtcggaaaaaaagttctgctagaaaatttggtctacagaaactttgggagtggtgcttaggacttgtacaaatgagttcattgccatggagagttgtaattggtcgtctaggaaggattggtcatggagaattgaaagattggagctgtttgctgagtcgtcgaaacttgcagtctctaagtaaaaggctcaaagacatgtgtagaatgtgtggtatatctgctgcagactcccctagcattctcagtgcttgcttggtggcaatggagccgcaaggctcttttgttattatgccagattctgtgtcaactggttctgtatttggaagaagcacgactctaaatatgcagacatctcagctaaataccccacaggatacatcatgtactcatatacttgtgtttcctacttctgcttctgtgcaagtagcttcagctacttataccactgaaaatttggatttagctttcaatcccaacaatggtacgtaatttgttccattttggtagtctgaagaataccccccaaaataaattcatgtccaatacctgaaa

SEQ ID NO: 25000 - DNA, 1429 bp, Homo sapiens
gtttctctctctggtcggaagcggcggtaatggcggatggtgggttgtggcgccggcggcggctgctgtgagggacgatgagtgcctccttcgtgccgaacggggccagcctggaagattgtcactgtaacctcttctgcctggctgacttgacaggaattaagtggaaaaaatatgtatggcaaggcccaacttctgcccctattctgtttcctgtgacagaagaagaccccattttgagcagttttagtcgctgccttaaggcagatgtacttggtgtttggcggcgagatcaaagacctggaagaagagaattgtggatattttggtggggtgaagaccccagttttgctgaccttattcaccatgacttatcagaagaagaagatggagtgtgggagaatggactttcctatgaatgccgtactctgcttttcaaagcagttcacaatctattggaacggtgtttaatgaacaggaattttgtacgtattggcaagtggtttgtaaagccttatgaaaaagatgaaaaacctataaataaaagtgaacacttgtcctgctccttcacctttttcttgcatggagacagcaatgtttgtaccagtgtggaaattaaccaacatcaacctgtataccttctcagtgaagagcatatcacccttgctcaacagtctaatagcccatttcaagttatcttatgcccatttggactaaatggcactctcacaggacaggcattcaagatgtctgattcagctacaaaaaaattaattggtgaatggaaacagttctatcctatctcatgttgcttgaaggagatgtctgaagaaaaacaggaagatatggattgggaagatgattctttagctgcagtagaagttcttgttgctggtgtccgaatgatctacccagcatgctttgttctagtccctcagtcagacattcctactcctagccctgtgggatccactcactgttcatcttcttgcttgggtgtccaccaagtgcctgcttccacaagagatcctgctatgtcttcggttacgcttacaccacctacgtctcctgaggaagtccaaacagttgatcctcagtctgtccagaagtgggtcaaattttcttcagtatctgatggcttcaactccgatagtactagccaccatggtgggaaaatacccagaaaattagcaaatcatgtggtggatagagtttggcaagaatgcaatatgaacagagcacagaacaagaggaagtattctgcttcatcaggtggtctatgcgaagaagcgacagctgctaaagtggcatcctgggattttgttgaagccacacaaagaacaaattgcagttgtttgaggcacaaaactctcaagtcaaaaaatgttgtactgcaaagacaggcttcctcttttagggtccgccgtca

SEQ ID NO: 25001 - DNA, 392 bp, Homo sapiens
ggaattttgccttctattatgcacaggatcccaggttctgttgggttgtcctggggtgatcatcaggtatggaaaaagataaaagagatatgaaagctgggtaagaatcacaacatttacatctaaattgaattttgtgcaagttccattgactaatggcagagagctgtgcttcaaatacagctgtggtctgagcaaacttggctgctctaaatactgaatgccagttcctttgccaattccatgggcaagcattccaggaggcttgagttaaaatgtgcagataaatactcagttctggagttttttggtgccaaagcatacaaaatacttatgttctgctatggaaatactggaagaacagaacttctgtttttaatatctctgaggat

SEQ ID NO: 25002 - DNA, 408 bp, Homo sapiens
ctatggtaagctgtgggctctgtgtttcccattccaacagcatgataaaagatattaattaaaaactgcatttgagaagtaatattgagaaattttaatagttttcttttcctcagggcttctcagcacctttaatttattaatgtaatatagaaaacaccctgtcacatggcaagagtaatgccatcttgaagcagaaccaagatgggtttggctactggatagtagccaatgatgactgatgtttggcgactggattctgtgttcctgcagcaaggtcaagaaacaatgcctatagcatagaaaaatccctcataaaaatgtttatctaacttccccagtggtcacaagttttgcaagacagtctgacacaggactagctgcacatgtttcaccaaaaaaaacaaa

SEQ ID NO: 25003 - DNA, 458 bp, Homo sapiens
ggcttatgatttcttctcgggtttgaaacatgcccccagatgagcaagacggggctgccacattgacggagcagctgcgggacacacccaagaaacctcctggagaacacaggggacattcacggctggaggcttcatctatggccgggggcttcatccatgagctgggggcttcatccatgactgggggcttcatccacgggctgggggcttcatccatgggctgggggcttcatccatgactgggggcttcatccacgggctgggggcttcatccatgactggggacttcatccacgactggagacttcatccataggctgggggcttcatctacagctggagacttcatccacagcaggggcttcatccttggttggtttgcctgatctgtatctgagccacagatacagattattaaacagataataattttattgacttccacttttatcttt

SEQ ID NO: 25004 - DNA, 341 bp, Homo sapiens
agctacttaaaaaatttttttttcatggagatggtgtctcagtatgttgcccaggctggtcttgaatacctggtctcaagcaatcctgccaccccagcctcccagaatgctggaataacaggcatgatatcagcacctggcttcttttttactgattgtttagaaactgtcaaatatgctttattacttactaagattttattttatgatgtatttaaatttttttgtgtttatgtttagccacttctatttattttgagagtttttatattagtttttaatattttttatttgtagttaaagtaatacatttatatgaaaattaagttacagaaatgtaa

SEQ ID NO: 25005 - DNA, 294 bp, Homo sapiens
atcattcattcaacagatgtttactgagcatgtcctttgtgctgagcacaatgtttggtcaaatccttggtaaaggcctggtgcggtggctcacgcctgtaatctcagtactttgggaggccgagaaggatcacctgaggtcaggagttcgagaccagcctggccagcatggcaaaaccctgactctactaaaaatacaaaaattagccaggcgtggtggtgggcacctgtagtcccagctaagtgggaggctgaggcagggagaattgcttgaacctgggaggtggaggttgc

SEQ ID NO: 25006 - DNA, 484 bp, Homo sapiens
tttctcctactttagcagtaaactgaggaggaaccagctacgggcattttgatgtcatttgccagatgctgctgcttagactgctctttggcctaactttgtgatagggatgctacccaattgggtacttgtgagtgcttcatccaaattgacattccgtctgtggccatttacatcctatttaatcaagtatgaagcttattcattcaaccaatatgttctcagttcctatatgcaaagcaaaaggagtcttactgagtgacacaaataaaaacaaaatctagtcttgtgtctctgcattcatggctgagtctctgtcctctagtaggagacagaatgtattcaggtattcactaaattgttgtctctttagaacaccagaggcacatggtggtgttatagagtatttgttgtggggaatgagttccagggtgaaacaaacgggggaaacacgaaattacacttggaaaatcactgggaagtt

SEQ ID NO: 25007 - DNA, 252 bp, Homo sapiens
gtcacagaaaagggacagacatagtgactctaaggttgaggcctgagcaaatggaagaaggcattgtcaccctcccatcattcctcccagtgttcatcagagagccctgaggacagctgagtgtaggcgtgggtgtggctgagtgggacagtgaataatttgttcatctttctatccttagaccctacagagtgggttcatcagaaagacttttgaatgcataaatacttataatttgggataaattaaatg

SEQ ID NO: 25008 - DNA, 278 bp, Homo sapiens
taaaacataactaccaagaataatgagtattgactatacttcattttctctgtattcttaaatattacagcttgaaacaatgctctattaagaatgtgggctgggcgtggtggctcacacctgcagtcccagcattttgggaggccaaggcgggtggatcacttgagcccaggagttcaagaccagcttgggcaccatggtgaaaccctatctctaccaaaaatacaaagattagccaggtatggtggtttgtgcctatagtcctagctgtaagagtt

SEQ ID NO: 25009 - DNA, 754 bp, Homo sapiens
tggaaattgcagtgagccaagatcacaccgctgcactccagcctggtgacagagtgagacttcctctcaaaaaaaaaaaaacaaaaaacaaacaaacaaaaaaaccctcttctatagtaggtgtgttataagtaataaatttattttaaatattagttcgagattatggcttggtaacgtcttgtttgaagtgtgacatttaaaatgaattttcataatttgtgggagtcagtgcctttttaaattcctcagcttacacagtcttcttaaaacactttttgtattgagcttttgagatcatggtttattaaccaacatttatcatttcagaaacagtggggtattgtgtgttgcaataatttttgcccataagttggtgagcatggatttttttgttgatccctcccttctccagatatcatttccatttccattttgctctcatcccctttcttcctaagaagctataaaatggttgaaacatttatttcaggtacaattttttggaaaagatctgcaacttaggtttctattgtataaagtttagaattggttatatgttttcaattttcttttcataaagcctacttcagtaataacttataataaccatattactataagctcgttattttaactcttggctgggcaaggtggctcatgcctgtaatcccagcatttagggaggcagactgaggaggatcactggagcctaggagtttgaggccagcctgggcaacatagggagacccca

SEQ ID NO: 25010 - DNA, 363 bp, Homo sapiens
ggcagatttgagatatgagcccaggctgtctgactctagatcctgtgctctgagatgctaggccagacttcctcctccagatttcctttagcccagcactcttcagccttatcccatggcagcctccctctccacctgcatgctgcctatggatctgcgattccccaaacccatggctttggttcagcctgcctgcctagggttatgaagcttatgtctcctatgaagggtataacaaataggattggtacagacactttcaatgcctctaacagtattgcctccttccaggcttttcataaagaaagggaaaaccccctttgaggatggggaggtggggaccatatcttgtgcttcctggat

SEQ ID NO: 25011 - DNA, 453 bp, Homo sapiens
aaagacacagttgtgcatgtctggcacaacctctggcctgcaactgtgtttagtgataatgatgaactgtgtgtgtgtgactttgaaggattctgtatgtcaagtgaaaaaaaatgatgtctgacctccttacatatgtaaaaaatataccttcagagttcagcagtaagctggaagaagtagatgtcaaagaagttttgaactttgataataatgcttcagttattcattcattgactggtggtaaaatagtcgaaatggttttgaatcagggttatgatagtgatgaagaaggtcaagataacaccacagaaaaggtgcttatagaagaagacatggtgaaaatgtatggtgggcatattgaaggattacggcagcgtgcattaacaacagaatgaaaaaccatgtcagtttttaaaattgaagagagacttctgagctaaaaaccatgtt

SEQ ID NO: 25012 - DNA, 231 bp, Homo sapiens
acagtgttcctggggaatattgtgttgctttgggagctgctgaacatacaggagtttcactgttcttagttctcgaattctctagactctcttgacagcccaattttaaatattgggaatataggtaagacacattcatggttaaaaattcttaagtgaagatgtaggaagaaatttaaagtaatcaatttaggttatgaaaatttagttatggtgaactgtgatgtctgt

SEQ ID NO: 25013 - DNA, 837 bp, Homo sapiens
acttgttagatttttagagacaacttttacaaaacatggaattatctacataccctttctacaaaacagacaaattaaatactcagtagttgaaccaaaaaaagcagttcaaataaaatacttgaaaatgaagaaatcatttgaacagagttaaagttaatcgtaaaataatgtctgtaaaaattattgccaatcaaatataaagttcaaaaatagtgcttgaaaaaggaagaatcatatgaaaagggactactcattttaaaaatgttagatatcaggaaaagccaagaagtgagtatggtaagagtgctgtcaagtgaaaccctgctaatctcactgaacatgtaaaaatctgtagatgcctttattttattcactcacacacatatgtagaaagagaaatatatggtaaacattaaaaaaaccaaattagaatgtaaaattaatactttaaaaaatgggctgtatacttttcttatcaccggagataagaatttattatttttaaaataaagttattttctctgtgactgtttccatgactttgctacttagaagttagagatgccaaagtttatctaagaaaatgtttatggaaatattatttcaataatgaatgtttagaagactgaatttcctgactgggcgcagtggctcatgcctgtaatcccagcactttgagaggctgaagaaggaggatcgcttgagtccgggagttcaagagcatcctgggcaacacagcgagaccctgcagcaaagtaaaaagaaaaaagaattgaaaaaggaagactgaatttcctttgggcaagtcatgtgacattcctgtgcctcagtttc

SEQ ID NO: 25014 - DNA, 409 bp, Homo sapiens
ttttaaatagagacaagatcttggccatgttgcccagactgctcttgaactcctgagaactcctgagctccagctatttgcccacctcagcctcccaaagtgctgggattacaggcttgaaccaccatgcccagccaaaaatgtgttttttaaaaacatgaagagctatgtacaactgaccctggaacaattcaggggttgggactgaggacagcccgcccagtcgaaaagctgaatgtaatttttgactccccataaaattaactggtaatagcctactgttgaccggaagtcttaacaatgacataaagtcaattaacaaatattttgtatgtctattatatactgtattcttacagtaaagtaagctagagaagttattatgagcaagagaaaatacatttacagt

SEQ ID NO: 25015 - DNA, 424 bp, Homo sapiens
gtctctactaaaaatacaaaaaaaaattagccgggcgtggtggcgggtgcctgtagtcccagctactcgggaggctgaggaaggagaatggcatgaacctgggaggcggagcttgcagtgagccgagatcgtgccactgcactccagcctgggcaacagcgtgagactcgtctcaaaaaaaaaaaaaaatccatatttcattccagctttacaagatggggaaatggaggttcagggaagcatgtaagctagattgttgtttaaccagtattgggggttaaaggggtagctgtctggtcgtgtttacaccacttcatgtagacctgttggccctctttccttgccactatccatttctggattcagtcttccccagaacctcaccctttgcctgccctcagctgactgctcattcatttgccaa

SEQ ID NO: 25016 - DNA, 317 bp, Homo sapiens
gttactcaagaaagctttcaaagttcagatattaacactgatgtgcaataccaaattgttagccccacaggacagatggaaacaggaaaagtcagatggttggcactcaaaagcaaaagcaattaagcagttgaaagtgggttggattgtcggtttatttttgttccatttgaacgaatcaagtgagagacatagactcttgcaaggaggaaatcaagtcaaacttgacgcttcctctctctgacagcccaagctggactggttgtctactccccttattcagtttaattgctttatgtgctctgattttcgcagag

SEQ ID NO: 25017 - DNA, 379 bp, Homo sapiens
tgaaattgaggccattttggttgaagttgacagaaaccactatcagggatccccaagactaccccaggcttttctagaaagactctcagctaagatgtgttatggtaaaagcacacaaaacaaaatcagcaaagaaaattagcaagggcagaggcccatggggcgatgtcccgaggacaccaggcttgagcttccagaatcctctcccagcggggtcgtgcaggacgcacttaactccccgcacagtgagccgtgacagcgcgtgtgcagtgtcgtcgccaggaaagcacactagagactcggtgccagggtttttactgggggctgggcacatgggcaccctctgcctgcctcgtgcccagactctggactcccggag

SEQ ID NO: 25018 - DNA, 286 bp, Homo sapiens
  misc_feature (19)..(19): n is a, c, g, or t
aaacagaaggaagcagtanaactttggaggaaagagtgggattataggcgtgagccacaatgcctggccacatttatgtatttttttatattctgtatcagttagcctgtttattcacgtaaaagttttccaccatgtcttattatccatggtccataggtcatctataacacatataataaagtacatcattgctgaaaatgtgtcatcacaccaagagtaggttaactgtgcgttgttgaccaaatgctaactatccagcaggcgactgtctgaaagtaccaat

SEQ ID NO: 25019 - DNA, 547 bp, Homo sapiens
ttgtctgtaagcctaggttaatggctcaaagcccttatgcaaactagaattgtcctatgactatttacttcataatttccctttttaaactgtgtatccattacttttttttcaaaagtacaactcctaacagaataatactagtacagcactttgagatgataacaaaagactacagaacagacaaaatcgaacttaataatgaactccaggtagacttagcctgaaaactactcccttcaaatttcccttgtttctccaaatatgcctaaaaggattttgacactgactcttaggtgccaattaccccctgcctcaatgtgggatgagaacaaaaaccaaaataggtccatcctagcaccaagggccatcaaaaccaaacttaaagatgattgatcagtgatgcttttggaaaaagatctgaagcacaaaagggaaacgtgaaagttgtctgaatcaaaatggagtcactagtaataagaaaactctgacagctcgagctggggaaggacatgaagagagcattctcatgcatgtatgcctgatg

SEQ ID NO: 25020 - DNA, 404 bp, Homo sapiens
aaccttcaaagtgtttgttattttgattagtgtttatacattcagacagattagtgaggcaataaataggagtaaatgctaaaggacagctaatcaagtgagtgagaagcaaatagccacttactatagactacggttataattcaaaagcatgtgaagcattatcattttgatgtagtgtttttagaccaaacgttgtaactagaacaaacaaatagttacacactagcacactggaggatatggtcattaagaaccaaagattttctaataagagacggtaatctttctcagaggccacaggcagttttagtgcccatttattgaaaatgtagtgcaacattttaaaaagtcaagcacaaacattttattgtactgggttcttagggtctgagaacctgaag

SEQ ID NO: 25021 - DNA, 248 bp, Homo sapiens
caaaaataaataaataggatctaattaaattttaaaaattcttcacaacaaaagaaataatcagaagagtaaacagacaacccacagtgtaggagacaatattcacaaatcatcatcttacaaaggactaatatccagaatctacaaggaactcaaatcagcaagaaaaaaacaatctcctccaaaagtgggtaggacatgaatagataattctcaaaagaagatgtacaaacagccaacaaacatat

SEQ ID NO: 25022 - DNA, 553 bp, Homo sapiens
tgaccatacaaaatctaaatctttattgggaaagataagtgacagctttggccagattagtacaggaacatactgctggactgattctcacagacgtatagtattaaaggtgcaccttcaaactgtgagttgagaaaaaaataaaaatatttaaaacatccattataaaagtcctacgcatttaacaaaatcttacgtatttattacaattttacaatctgcctagtattgtgctacagtaccagacaaaatcactttagggttttggggattttgtttttttaaacaaactggtatgtaatataaacttaggaaccaccaccaccatctcgagtatcaatgtttcagaatggaggcatagttcagtgaaaaaaatgccggcattggttttagttttgattcttgtttcaccagaaagcatggtggttgggggagctgtcaaagtactccggatagactcagcgccattaaataagctcaggcatatacggccaggagcaagggaggagaggaaacactgaaacaactcggcagaaagctggcccttgctatt

SEQ ID NO: 25023 - DNA, 358 bp, Homo sapiens
ttcacccaagagtctctttcctggggtcctctgtggtctacaatttccttgggaagtttccatcctgtctttctcatcttgccatcttcaatctgtttctcttctgctgctcccagccctactttcaacaatctaattcacagagtatggaccctcatttcagcacctgcccttggctctgttcaccactttttttaatctcatgcctttcctaccatgttgagcatttttgcctcatctctcctacccctccctagacattggctgggctttttcatcttctactgtgaaagcacctgatctggtcaccaccgtgtggcacctaggcagtagcctctggtttgccctgaaatgtcat

SEQ ID NO: 25024 - DNA, 353 bp, Homo sapiens
ggtaaaaggataaaaataatagcataagtactttgatacttgactcactgtgatgtctgctttggaaatatagactcaaggcacatagatgaaatattttactgggattttaaattttgaaagcaacaagcattatattctttttgtgactatgtagtataatagcactgataactagtgttccacatctcttggcattttgtaactcataaaaaaatatttaaaaatatttgggcctggtgcggtggctcacactgttaatctccgtgctttgggaggccaaggcgggcaaatcacttgaggttaggagtttgataccagcctggccaacatggtggaaccctgcctttact

SEQ ID NO: 25025 - DNA, 946 bp, Homo sapiens
accataatgaaaaggaattgaaccaatgcaaatttatagcataaggatgggaactaattttagaagtcctactttggatagattttcaccttttgtacagttaccacttgaaaattttccttacgtataccagaagagatacactagttattttcttgttatttctatttgcattgtcttgttttataaaaatatttttctgtatatttttctaaaagttgttatttcacagggtttcatctgccccttatgtatgaaaagatgtataactgctattgatttattggagcattaccagaaagtgcacgatgaaaatgaaacaagaggacaggaacttcttaatgactccagtgttactgtgggtcctgtatattttgttttagcagcttggttttgggttgctcaaaatagctggtttttccttgcctcggtgttgcttaactttttatgctacaagggaatatggattgctttaattatgcatgcttaaaggaagtttcaataaggaaaagaggctcttgggaagtctgcgtggtttctcttcctgtttgcagctgtctttttgtgaatttgtaaataaatacagaaatttaagttaatattttgtatcaattttgccatgaaatcaaaatattaagtgaatattattccaacattggtaagttatatttttattattttgttaatgtttcattaatggatgtattaaaatgctttagtataaaatactttgctcttacttagaaaaaggactttgaggctgggcactgtggctcacgcctgtaatcctagcactttgggaggctgaggtgggcagatcacttgaggtcaggagtttgagaccagcctgaccactgaggtcaggagtttgagaccagcctggccaacatggtgaaaccctgtctctactaaaaatacaaaaactagctgggtgtggtggcatgtg

SEQ ID NO: 25026 - DNA, 393 bp, Homo sapiens
tgcctttattagtgcaacatcccagaatgcatgcgtcttacaacccttgtggatatgaaacccagctgggtagacactgcaaagtcttctcatttgattcttccacttggtttctagtgtccctcagggacaaaggaaagccatggtccagtctaagatgaaaaccaattagacctctggcaggcctttgaccaccctgagggccacccccaaggcacggccacactcgcatctgctgccaggaggccctatcttaggctcagctcccaaaccttgaacatcttggaggatccacaaataggaggtacactcagctcaggctcagtcttccttaaaaagcgccttgctaaagctatcaagttcactggaatacttctgcgaaggacacagctt

SEQ ID NO: 25027 - DNA, 428 bp, Homo sapiens
taggcacaaaggttatgagagaaacaaatgaacaattcactggtatggctttcttctttaatgcacacaactcacagcatgaagctgtgcacttcagtacacagggcctctaattcagtgggcctgtgagcgtcacctgggagctcttctaaagcatactttcttgtgtcccaatcctagatatttaatttagtaaaggaggaatgatgcctggaagattaggtaaaatgtcctccaagtgttcacaccaactgaggcctactgctcactctcatccagttgaattacacacattgttatgacggtcaaaatccagttccatattgtctaggtgaagaaggtgaagtcgcggcagcagtgtttctcaagccacagaacatggccacctgtaggtactgatgtaactggggaatcctgggcttgtgtta

SEQ ID NO: 25028 - DNA, 897 bp, Homo sapiens
ggccaggctggtcttgaactcctgacctcagatgatccgcccacctcggcctcccaaactgctgggattacaggcgtgagccaccgcacttggcgaccattatcaatttttaaaaagcctgtttacataccaaataaaatcatcatgttggatgacacactagaagtgtttctttacaattttgaaataatctattttatagactaggtagttttcattagaatttgacattgacctagttgaattcatatgttagcatttcacacataaccatcttggattaatgagatccttgtttctgagctggtgtgtagtcctaccactcagtttatttcagctgtattcatagtttgatgcccgccatcctactttaacttcataatgttctgtttagattattaagtaatcaaagtggtcatattgagaaaactgaatacaattaataggtgtgaccccagtctcataaggggtcattaaaataatgcatgacattatgccttcatttattccattcagtacatttatcaaactactatgtgaagttgtttctcaacccattcagaataagatataaactgtactcacccagaaaatacaaactcaacagtctgtacataatttggccctaacagcctattatctcacctttgctcactacactctggccaagttagtctgttcagtttctcaaacatgccattcttggccttggcttagagcttttacactggttgtttcctttgtttgaaatggtcgccaatccgcggattggcgaccatttcaaccaatttggacatcaggagaactgtcagaatgaggagatcctgaacagtctcacgtatgtccgtcctgggggtggatcccagcccacttcaccttgtccaaaatgtgagggac

SEQ ID NO: 25029 - DNA, 389 bp, Homo sapiens
tcaaacatgccattcttggccttggcttagagcttttacactggttgtttcctttgtttgaaatggtgttttcccagatgttttttagcctggccctttacctttccaatctcagcttaaatatcacctcctgcttcctcaccactcagttaaaaataggtcctccccatcactgttttaatttcttcatgccatttgtgagtccttgaaattatgtgttttttaaaattaatttttatgacagtagggacttcctttgtcttattccttgctgtctacaatgcccgaaacaatactggcaccaaaaggtgttcagtaaaaaaaagtgttgagaggataaagccaggtaccaatttcatctattccccccactttttttttgaaatgga

SEQ ID NO: 25030 - DNA, 703 bp, Homo sapiens
ggacttcaatcttttgaatacatctaccctaacattttcatctctgtacctgcaatatccttgtaggctgcctttcaaggaagtgtatgaagagaaagagaaggcgtgggggagaaaggcagcatgggtgaataaagatgcattctttccagatgctcagttgcactgcctctctttgtgcagtgttcactgaaggatttaaggatgaagcataggaatctgctgtgtgaactaattccctggcttttcctaatggtgtgtaaatttctcattccctaaggcacagtattatttccagagttttctttggttttcataactagtttttctgagttctgtcctcagaatatagtaaatggaagaaatgagatgaatctacaaaaatgctttttaaaacctcctcaaaaaattatttacacataaaataattaaatattttggctcttctgcaacctattggttaaagtacatctttaatgtacaactataactaagttataactaattgtgtccttatatttcaaagacaggtacttgtctgtcttctctcaccccaaaggaatgactacaaagtaaaggaaattggtttaaaacaaaaagcttgagatttcagagaaaggaacatttacataatagcatatctcagcctatttcttgaaatgcattgtttctctgtagctctctttccttttttttttttttt

SEQ ID NO: 25031 - DNA, 427 bp, Homo sapiens
agtaaaggttccatccttctctccatactggagtagagaaatactttgtctatatccctttgctgctgaggcctactggtggctgagatcatttacatggtgaataccttcacagaaagctttctagaaacactattcagggcaccagaatcactccctcccaactgttgatgaatcctgagcacaaaaagacctgccatcacaagtcacaagaattctactagcagagtaaatcatatgggaaaatatatcatatttcactcttaaacaggtaactaaaactcctgaaaacttttagctttatcaacctaaaaaacaggaataaaatgtgaaaaacagccttttaaataaatagggaagcttccaaagggggggaaaatttgtgatggaagaaaggaggtgggagctgttatcagggaggtgagtg

SEQ ID NO: 25032 - DNA, 169 bp, Homo sapiens
gtgcgtggtgcaggcttttcttagcagtgcaccctccttaggcttcacaccacataagtcggcagtcctccaggagtggctatgcctatctcctctgagggcttttgagactaactgttgctgtgcaagatggatgagctgtctgaccaatgatgttctctcctgcctc

SEQ ID NO: 25033 - DNA, 1473 bp, Homo sapiens
ctaattttcaccaccaacatcccctcaataaaaccagcttttaatgtaaatcacatagcatgctgctttagaaaggcttgaaggtagtaattataaactattattaagcatccaaaatgaaggtctccttttgctaatatcattcagattttcttattactacaattattatgaataaattctgtgaagagtgctttaaaataagagagaaatggaagaccaaacttgtacatttaaaatcaggctggaattgaacttgttattgtgtcttaaatccttttttgtgccaaagcaggtatgtatacattaatagtaagatgtacattatttttaaagtacttataacatgtaagattatcaatatgtatagtttttattgagagatcaaagtaggattaaacttcttgttttgaaagcaggcattactttttaagttcaagtattgttgattcttatttacacatatcggataccctctattgctatttcttttagattattgtgataacttgtcagtacattcatctaatgtctctatactcttaataatgtctaggcatttgtcctggtaatacacttggtgaatttatagttcttagattataattacatcttcaaggtggcagtcaacaacataagtttctaaccatcaacatatttggtttgtaagatgatcaatatgcagtttaagaagccatattataattatcttaattaaagtagcaaagttagaaaataccttttacatcttctaaatttaatcctatgaagaataagatctctgtcctgggaatgagcactttgtaattcatagatcttggactgggaacccagttaatgtaaactcttaaaagactgacttgggaagatctttgagggcattgagtgagaacttgcaccagttcagtaacaacccctcctcaacattagaatctatattggttaaaaagtcatttccacaacctagcttgccatatgacaagagagttagaaggttgtgggaaatttattttttaaagcccacatatgttatataataagatattttaagaggtatttcagttcagtgctatttcttttggacatggtggcatatgtaaaagggctatcacagggaacctagaggtgggaatacagatccagcaatgtgaggtagctctcaacggtcatacttcttgctacatctatgtaaacatgtgttttatgtctatttttatgacatatgcagatatcttcatggttaggttatatcgctgtagtcacctttattcaacacttaaatctcaaccacaaagagatgaaataatgttagtataaatttaaattttaaaactcgacatatcttgaaaatcttctggaattaggaagtagtgatgattgcacaactttgtgaatatactaaaatcattacattgcacattttaaaaacatgaattttatggtatgtgaattacatctccaaagaaaaaaaaa

SEQ ID NO: 25034 - DNA, 304 bp, Homo sapiens
acaatggccctgccatcagacaaccccttgaatgtgctcttcttggcccttccataaacctggaacaactgctctccacaacatgcctcggtggctaccttctgaaaatctcggcttgtgttcacactggctccctatccaaacttcttcagacccttttgcagctcctctgatgggagatggaaaatttgaggaaggttatcttggactgaaatgtgtgggattctcaggcaggctagtaattcagcactttcccaacaggtattatctaaatatttggtcaatgctcatctagtgagcgtgt

SEQ ID NO: 25035 - DNA, 457 bp, Homo sapiens
gatgccatctaccacatacaaccatttctttctaatcgtgcatgccgaccccctgaacactcccttcctttggccctgctttctctagtgcctccatctcccagagtcctcacattaaaaaaataggacaggaatggccaagtaaaccttaagccttatctgattaattgtataaatgacccttctacccagaacccactggaaaatctttaaatctgaatttgccactccaaagagaaaaatgatagcatgcatcactgcctgttttagtccgtttaggctactataagaaaataccctaagctgggtaacttataaaaaacagaaactgccgggcgcagtggctcacgcctgtaatcgtaacgctttggaggccaaggcaggcggatcacgaggtcaggagatcgacagcatcctggctaacacggtgaaaccccatctttactaaaaatgcaaa

SEQ ID NO: 25036 - DNA, 286 bp, Homo sapiens
cgttgatactggcctgggaaaattaatttcattgctgaaaaatcctatccaggtgtgtttgtagctttaggttttcaaatactagttatttaagaatctcttttgctttttacttaaagaatgagaagattaggagataatgctatttaatgagttttatttaatggatacttgaatttaatgtccttgactcttatttttttatattttattttatttttgagacagggtcttgctccattgctcaggctagagtgtagtgatgccattatggctcactgcagcc

SEQ ID NO: 25037 - DNA, 454 bp, Homo sapiens
gtggaaattttcctggatataggtatgaggtttatttccttttacaatgttagtgatgggagccatatctttagattcaccaaaaattttattagaaaaccactctgttcgttttttgctcataaatgtgaagctcaagaggatcagagcttcctgattatctgtcctgtgattaatacaggtactccagtcccacagtttattctggggaaggtaaataaacatgtgaatgcaatcatctatcagaagtttctctgtgcccatagccagagctaagaacttttctgctagatacacatattgtacaaagggatagaagggaaatatcggtcattttgtaaaccatgaacagaaagtaattatattagtttgggggaaaattgcattttccatataaagtgatctgttgcctacaagaaacatacctcacctataaagacacacatgtactgaa

SEQ ID NO: 25038 - DNA, 373 bp, Homo sapiens
ggacactctccaatactaataatgttacttaacacagttttaatgttacctttgtaaggaatattaccactcaatttacagtttgtgtttttctaagaaggtaaatgtcattcttggatatgggtccctgtcaatctgtctgaaccttgggctgctgccctggctttacactttgtgaaactccttctcactcagctcactcatcatgctcctagagtcttgggtatggtaatttttgctattgtttccttagtcacactaataacctctgttgtggtgtcctcagtagcactgcacagctctgtttaaacagcccaatatatggaaaattggatgtgcacagccgaccaggcatggatgcttcaaaatcaaa

SEQ ID NO: 25039 - DNA, 432 bp, Homo sapiens
tcccttcttcctcttcttctctgtccatttaatgtctgagtaggttaattcctgtcttgatttgctcactttctcattcactcatttagtgatctactattgccaagcactgtcctgggtttggggaacacggtaacgaacacagtgaagtccctgctctcatggatctcacggggtgaagagaagagaatcaaacacataatgtgtcaaacagataatacaaataaggatagaattacaatctgtgataagggccactaaagagacctacaaggtaatgtgaaagaataaagaggggaacctgctttagatttgaggtgaggaaagttctctttggggaagtaacttttaggctgtaactttctgccttgtgacaggcagagttccaggacggtccccaagattcccagcctctggtatgcagctgctctg

SEQ ID NO: 25040 - DNA, 550 bp, Homo sapiens
tataccctaagttgccaccctcttcccaaaaagtgaaataaaagaactggcaagtgtgaaaaagctagctttaaagttttatggaaaggcatattaacatctagaaattttctcttagtacatagttaagaatatgtgtaaacatttagcttcaaacctagccaccaagcattcttttctagtatcaaaatgatggaaaccacctcactgtgtagcaataggagactgggcaagctgataccaagcaaactctcaaaaagaaattcagttcattgaagggaattcaaagaaataaaatgtagaagtatatcatggaaagatgttcatggtttacaaaagagtatgtggaatacaatctcgtttttacgttaaaacacagaacaataaaagaacttggtgattagaacccagagcattcattggctgtgacccactctgggtagagggatgagattgtagatgatttttttctatttgcttatctaatttttctatgacgaacaaatactacatttaaaattgtttttaagcttttgaaacaaaaagaata

SEQ ID NO: 25041 - DNA, 758 bp, Homo sapiens
  misc_feature (734)..(734): n is a, c, g, or t
  misc_feature (741)..(741): n is a, c, g, or t
taaaactcccgtctctaccaaaaatacaaaaattagccgggtgtggtaacatgctcctgtagtcccagctactagggaggctgagatgggagaatcgcttgaacccgggaggcggaggttgcagtgcgccgagaccacatcattgaactccagcctgggtgacagagtgagactctgtctcaaaaaaaaaaaaaagttgtggtcataaaacttggttcagatgccgtcagcggcatgccttgcctagggtcttgccctccttgtggcctctgcacaccctgcctagtctttccttccctcctgacctttctgaatctgattcatccttttgccccaagcagaatcccaccttctccaggaaggtgttagcctttgtaggacccactctgggacactggtacctgctgcctgtagccgtggcctttccccttccagagggcagggcggtctcagcaccctcttggtccacagctgatcttttttagctgctgaagggtctggggctgtgccctggggaagccatgacgctcccctgcgtagggtcactgggtggctcctgcagccagacttggacaccctccctttgcagatttctgtctcctccccaggaaccagctgccttccttctggggcgaattcattcttatcccacagccccagcataatgggatctggctcaggtaccggctcgaatagcaataggtttgccttccctgtgagcaagcccttactgncctctgncttcccgttgagctgca

SEQ ID NO: 25042 - DNA, 781 bp, Homo sapiens
acatcttgaaagtaaaggtgacttagagaaaagagacattttgacagatacttttaatttgtggttgtctccatcatgaaatagaaacgtgtttggcacttgtgggtggctattttgatttggcatgactacttaattttttaaaaaaattgtggtttgtgaattgcacctttgtccatgtttctgaatctggttttcaaatccagtggagcctttcagtgaaataggtgactattaaaaaagtaatagtattacagaaaaatgagcgattaaatagtaatggatacaattaaggagcaactattttatatgactgttctgtacaaacaaaaagtatgtaatacccattttaaaaaaccatttgaaagtagacaacttattccaaaatagcaaatgcagaatctctgctcagtgagcttggatgagtggcttaacttctctgggcctttgttcctatctgtaaatgagaaagtttgtagatattgccaagatttcccaggctcaatacagtgtaattattttatgttttaaagatatgaaatctgtttactcaaccaattttttaaatgtcatattgtgataatgctctgcttttgcaaattgtgtttgcatgtcattagttatatcaaatagttttgtggcatggggtagtggagcttccctccccacccccatatgtatcagtgaagcctttgaaattacttaaggcagtctttcatggaatgttttgattgagcaatgaaataaacagtcctccattttgtttctgcttgagtggtga

SEQ ID NO: 25043 - DNA, 791 bp, Homo sapiens
aagtaaagaagctgaataaataatttaaattcttcccacagagactatcccggggtcacatttgatgaattcgatcaaatatttaaggaaaaagtaatgttaattatttacaaactcttcttctaaaaaatagaaaaggagggaacactctccaatttattttttcaggtcataagtactgtcctttcaaagtcaggcaaagacatctcaagaaaataaaacaagatgaatatccatcttgaatataaatataaaattattaataaaatatgagcaaaccaaatccagcaataaataagagggattatataccctgagtaagtgggatttgtccaaggaatgcaatgatggtttaacatcagaaaattagttaatggcatgaattatattaatagaataaaggacataaattacataatcacctaagtagagtcagatgaaacatttgacaatattcaacagtcattcatgattaaaaaaaaaaatcaacaaactgggaacagaagaaaactttcttcatctgataaactgcatttatgaaaaacctacagattactcatattaaatgataaaacagaatgcttttctcctaaggaacaaggcaaggatgtccactgtcatcttgtcaccacttttattcattactgtacaggagattctagccagtgcagtcaggcaagaaaacaaaaagacattcggattgtaaaggaagcagtgcaacttcctttattcaccgaagacataatcctatatgtaaaaactcctatggaatgtacaaatatattattata

SEQ ID NO: 25044 - DNA, 373 bp, Homo sapiens
aaatatatatatatatatatactaagcaaatattagttttagtatgattttttcatttcttctttcataactgacagagagtttttaatattttgacaaaacttcttaaaagttgcagaataatcataattcttcccactgagtattaagattgctttgcagtattcacgatagacaagatatggaatcaatctgtaaccatcaacaaatgaataaagacgctgtgatgtatacacaaaatggaatactctacagcagtccattgtgaaagagaaggaattcctgtcatttatcacaacatgggtgaatctataggacacgtaagtgaaataagccaggcacagaaacggaaattctttcaaacgtggaaaaa

SEQ ID NO: 25045 - DNA, 512 bp, Homo sapiens
aacccgagtgtctcctagcacagccactatgtgagcgtcaggcttaccttcctcccaggcttaccttcaaatacctcccaaccatacatctagcatctctagcacagcctctgctggccaggccacctcctgcctgaacatttgtaactggtgccttcctgagctctctgacttcaccctggctgtcacccaatctgttctccacccagtggccataatgaccatctcaaaacccaatctgatcatgctgtcccctggcttaacttcttcaggggcattccagggctgctgggatttggccccaagagctcagcctgtccagcaagcctgcgggacctggggagggcaaggtgggcaccctcagctcctgctgctgctgctgtggtctccccagcatcagacgctgctgggcatcacagaacctgggggctctgcctcaagccaagcagggggtggtttccatgagtcagagccatgggtgatacaggggagagggctcacggaagccaaac

SEQ ID NO: 25046 - DNA, 524 bp, Homo sapiens
gactttgtaatagccatgggctgggctcagtgactcacgcctgtaatcctagcactgggggaggctgaggtgggcggatcacttgaggtcaggagttcgagaccagcctggccaacatggtgaaaccccatctctactaaaaatactaaaattacctgtgcatggtggcaggtgcctgtgatcccagctgctcgggagtctgaggcagtagaatcacttgaacccaggaggtggaggttgcagtgagcggagattgtgccactgcacttggacctggctgacacagcaagactatgtttaaaaaaaaagagagagaaaaaaaaaatagaaggtggaaaaagtatttggtaaactaagaagtaaaccacaacctagtaaagggcatattttaagaattcacaactagaacctggtgccgtggctgtaatcccagcacttggggaagccaaagcaggattacttgaggccagaagtctgagatcagcctaggcaatataaggatactctgtatcttaaaaaaaaaa

SEQ ID NO: 25047 - DNA, 353 bp, Homo sapiens
gcctatatcaaaaaaaagatttcaaataaacaatgtaatgatgtactttaagaaactagaaaagcaagaacaaagccaaaattagaagaagaaaagaaataataaagatcagagtagaactaaacaaaatagagactaaaaaaaaaaatacaaaagatcagagaaatgaaaaactggtgctttgaaaagatcaataaatcgctagctagactaaccaagaaaaaagaagacatacataaaattagacatgaaaaaggagacattacaatttatataacaaatagagaggatcatcagagactatcatgaacaactatatgtgaacaagttgggaaacctagagggaatgtgta

SEQ ID NO: 25048 - DNA, 1041 bp, Homo sapiens
aaagaatacatcttaggacttaagaaatagaatatcataggccagttacattgtaactgtagaactgccagcagccttaccaagaaaatgcattgacaataggagagcataaggttacccctggagagaagcagatatgacaggaagattaatggtacacaagcccagttagtacctgttaggaccagttagtccctgagaatcaaaacatcactgtttactctgtttttgtaatacttcctaatataaagcaagtctgtctttaaactttttttactcaagacactttctgaaagaaaatatttagaatcatctctcttcctgccccttttaaataggatatttgaggattatgactgggtttggtattaaggatcaggaaccctgtagggtggaactgattcaccgaggtggcctgagtcattgggaggccaggtggcaaagccccatgactggggactcaggcttcacctgctgtcccttagcagagggcggcccacaggatacctttccatacaatacatcaccaactggagaccatggtctgtgctctagtcatgtatgctccctctccttgcctggttgatctccttagcaactcatggtcttttactctagcagatggatgcctcatctagagactctggaggagctgattttctgtctgcccacccactaagggccttcaagctaataaagatagaaaacaaggcaggaatttttgtctgttttattcacagtgtatctcaaacacatgaagcagtccctcttcgtattaggcactcagaaatacttgctgaaggtacagttatcaaactgaaatctgagcatttttccttttgatgttccaagttatcttttgggtgattattataaataggtaaaatattgctataagttccctattcacgggtattttataaatttttaaaacttgttcttaatcttcagaagtgtacagaactgttcttcagatctttgtcaaccaaaacatgtattttcaataaattgagattcccagttcaaagttatgtctacaca

SEQ ID NO: 25049 - DNA, 2141 bp, Homo sapiens
agcggggattacaggcacgcaccaccacgcctggctaatttttttgtatttttagtagagacggggtttcaccgtgttagccaggatggtctcaatctcctgaccttgtgatctgcccacttcacctcccaaagtgctgggattacaggccaatgttttcttaatcttagaatgtgaataactgaaaatcatagtctgtggaaaggtgttgaattgagtataatcttcttctgtttatttttgtgttttgttttttaacagatgggtatcttgctatgttgcccaggatggagtgcagtagctattcacaggtatgatcatagcacactgcagcctcaagctcctgggctcaagcgatccccctccctcagcctcccaagtatctggggttactggtgtgcaccaccgtgcttggctccaataattttttttctaattcaaaagttacagtttcactgtgaaaaaggccttgaacacactatttatgacatcttttgaggcagctccagtgccttgacttcaatcccagtttccggttgcagcatccttgttgtcttagcaacacagtgaactattctgaagcatagagtaacacgaaactgggagtccgagaaataatcatctctgcatcacattatgggagacgaagtctgctttatccattttatctttattcagttgtctatgattaattgattacagagtagtagattagaatagtgcatggatatacatttgtgttgaaaaaaggggaagttgatatatatcaatcttagttttcatttatcagtttgatattcatgcatttacactaaacgcttccatttatcccgaaaaagtatatgcaactgtattctgtaggttgatttttggaaaaggggagaagcacactgaattcataaggtcacatgtagtcttaaggtcttacttgcttacagccaattaaatttgaagcaccttatttatacttgttaaaggtaaaacccaaaagaacaagcagaggacattttaaggtcataaaaggtaaataagcttaccttcttaatgttttcattctctttttgtataaatcagaaaatgatctaaactgctgtaacaaagagaccccaaaatatgatggctcatgtaagataatttatttttttctcacatagcaatccagaagtggcttcatttcacaaggtattcaagggatataggagtcatctaccttgttagttctcttaatacccaagggtattgttctttccatggtcaaagctggctcaagacttcctagcctgtgaaaaaagaagaaggtggagcaagccatttcctttttaggaaattacagccatcacttctgcccaccgtccattcatgaatacttactatatagctatacctagcttcaagaaagcctgggacgtgtctctaactagatggacatgtgccctactaaaactccagggaaagggttctattactaaagctaaaaagaggggaatgaatactagagttaaagacaaaaatgatagcagccaatggcccatgccgtgataatctgctgagcaggcatgatggagatcccttgcccagcagaaagtgttccttggtgaaatcatgaatctgctatctaggagaaactcccttgtccattgtcttctgtggccactagtttgacctctaggaaagtcttgctcgtcagcttctgtggccccgtctgaaacttttgagggacatcgcagcttttgcagcccctgcttgctggtgcagacttttagacctagattgccttagagactgaaaaatatacgcttttataggccggggttttagttcatttgactgtaataaagacttcaatgccgtttttaatgtttgactgctgacatctttcaagactcacctttcccttctcccttatgctgcacatctgggcaagctgatggaagcatgggtgcctcctcctttggccccagcaggaagttcaaatcacgcaagccctggcatgcatgcaggaagcttcaccccagcctcacactctaagacggataaaagccaaaccaattaagccgtttctcgaccctcctgggagcctgccctatctccctggaaagtctcagtatgtgagtaataaacctttttatacccatttcttg

SEQ ID NO: 25050 - DNA, 1717 bp, Homo sapiens
agcggggattacaggcacgcaccaccacgcctggctaatttttttgtatttttagtagagacggggtttcaccgtgttagccaggatggtctcaatctcctgaccttgtgatctgcccacttcacctcccaaagtgctgggattacaggccaatgttttcttaatcttagaatgtgaataactgaaaatcatagtctgtggaaaggtgttgaattgagtataatcttcttctgtttatttttgtgttttgttttttaacagatgggtatcttgctatgttgcccaggatggagtgcagtagctattcacaggtatgatcatagcacactgcagcctcaagctcctgggctcaagcgatccccctccctcagcctcccaagtatctggggttactggtgtgcaccaccgtgcttggctccaataattttttttctaattcaaaagttacagtttcactgtgaaaaaggccttgaacacactatttatgacatcttttgaggcagctccagtgccttgacttcaatcccagtttccggttgcagcatccttgttgtcttagcaacacagtgaactattctgaagcatagagtaacacgaaactgggagtccgagaaataatcatctctgcatcacattatgggagacgaagtctgctttatccattttatctttattcagttgtctatgattaattgattacagagtagtagattagaatagtgcatggatatacatttgtgttgaaaaaaggggaagttgatatatatcaatcttagttttcatttatcagtttgatattcatgcatttacactaaacgcttccatttatcccgaaaaagtatatgcaactgtattctgtaggttgatttttggaaaaggggagaagcacactgaattcataaggtcacatgtagtcttaaggtcttacttgcttacagccaattaaatttgaagcaccttatttatacttgttaaaggtaaaacccaaaagaacaagcagaggacattttaaggtcataaaaggtaaataagcttaccttcttaatgttttcattctctttttgtataaatcagaaaatgatctaaactgctgtaacaaagagaccccaaaatatgatggctcatgtaagataatttatttttttctcacatagcaatccagaagtggcttcatttcacaaggtattcaagggatataggagtcatctaccttgttagttctcttaatacccaagggtattgttctttccatggtcaaagctggctcaagacttcctagcctgtgaaaaaagaagaaggtggagcaagccatttcctttttaggaaattacagccatcacttctgcccaccgtccattcatgaatacttactatatagctatacctagcttcaagaaagcctgggacgtgtctctaactagatggacatgtgccctactaaaactccagggaaagggttctattactaaagctaaaaagaggggaatgaatactagagttaaagacaaaaatgatagcagccaatggcccatgccgtgataatctgctgagcaggcatgatggagatcccttgcccagcagaaagtgttccttggtgaaatcatgaatctgctatctaggagaaactcccttgtccattgtcttctgtggccactagtttgacctctaggaaagttctcagtatgtgagtaataaacctttttatacccatttcttg

SEQ ID NO: 25051 - DNA, 443 bp, Homo sapiens
cttcacaatgcctgcaaagacaaactcctatgacagcagaatgtcctgatgtccccatatcacataacaatgtatgcttttatgatggttatagtcaagctttgatgtacttacgcactaaaatgccaaggatagttttctttaaatcagcaacataataaatgtcatgctgtcagtcccccacatgtagacataacttagcttttacatggataagaaacctatataagaaaaccttaggccaggtgtggtggctcatgcctgtaatcccagcactttgggaggccgaggcgggtggatcacttgaggtcagtagtttgagaccagcctggccgacatggcgaaaccccgtctctactaaaaatacaaaaattagcccggcatggtggcacatgcctgtaatcccagctacttgggaggctgaggcaggagaattgcttgaa

SEQ ID NO: 25052 - DNA, 498 bp, Homo sapiens
tattaagtaacagcataccacctcagtcttcaacataccgctcagctcaagagtctgcaccccatcttttacaacctcaatttagtttgttgccttcagcacttgggggatcccagcagactcctcaagcctacagttcaactctctttactagttctactgcttccattgaaagagctcttcttcgagaatgtagtgttattaaacaccatcagcggccttcaggtacccagtcaattcaggcacaactgactggttcacagcactccttacatagttatctatcaaattcaagtgtagttaattttcaggaaacaaccagggcagtcatctttatcctgtagcccaattggagattccactcaggtgaggcaacggaggattacaacagaagacctcccagggtcttcagtgggaacttgctcagtcttactcatctgcgattccatcatcagggtatcctccttctactacaaaaataaaaagctgttctacaga

SEQ ID NO: 25053 - DNA, 577 bp, Homo sapiens
gttcacttagggatacagactttttggtgacagtaactgttactttctgcttattaattcagatacttgcataatgctaacctggtagatattgtcagatgacaagccttcctcctacatgttctctataaaagaactgctagtgacaagcattttattatattaaaaattctacttcatactgttttaagttaaaatgtatttattatgaagccaatattgtgaaatgtttttttctttttccagaatgtggtttttttttcttgtaatggacctaagatgcaggccttattgtgtagaatgaggagctattgccccagatggaccttagtgaaagtaacttaaataagcaagtagattttgcttctgtttgggaaaatgatctaagacggatgctggtattttgggcaggtggagactaatgttttatctcaatgtttgcaacttaagttcagcctacttaagggctgtcccttaagggtgtccaattgtttggcttccctggccacactggaagaattgtgttgggccacatataaaaatacactaacactaacaaatagctgatgagctaaaa

SEQ ID NO: 25054 - DNA, 149 bp, Homo sapiens
agaatataggaggaaaactacaaccaatttaatagatgtgaaagggcatttgacaaaatttgtcacccattcataataagtcagcaaacaagaactaaaagggaatttcctaatctgataaagagtgtctagaaaaacaccacagacat

SEQ ID NO: 25055 - DNA, 837 bp, Homo sapiens
ctaaatctaacccaccaaattagtaacttcccttccccctctgcccatgcaggagtttgtggcttgagtttgtggaagagagactgggagagttttctgtaatacctaatacagtaaccaccctgcctccaccctgccctctactgtgggaaagagaagggaagtctcattctttataatgggagattagtgtaagagtgccccctactttgaaaaagtaaatttcacttatgttcagtgtttttgtaggcccatagaataaatacagtagaagagccctgcagaaatgaaaagccatgctaggaatcaaagtaaatgttggtttaaggaagtaaattgtgtctttatttattttttgagacagggtcgcactctgtcacccaggctgaagtgcagtggtgcgatcactgcagccttgacctcccaggatcaggtgatacccccatctcagattcccgagtggctggcaccacaggcacgcaccaccactcctggctaattttcgtattgttttgtagagatggggttttgccatattcccaggctggtctccaactgtgagggctcaagtgatccgcttgcctcagcctcccaaaatactgggtttacacgcatgagccaccacgccccatcttttaaacttgttaatagaaaaattgatgttggtaaagaaaaagaaccccccaaaaagatagatataggcaataaaaatcacaagtcatctattggcaggaggtgataagagttctgtttgcaaagatatatttaagacacctgcttaaatactagattttttttaaatgaaaatatcagtaaatccaaaacaatagtcttcag

SEQ ID NO: 25056 - DNA, 417 bp, Homo sapiens
gcatgatctcagcttactccaacctccgcctcccgggttcaagcaattcttgtgcctaagcctcccgagtagctgggattacagatgtgcaccaccatgcccagctaatttttgtatttttagaagagttgaggtttcaccatgttggccaagctgatcttgaactcctggcctcaagtgatccgcctgccttggcctcccaaagtgatggaattacgggcatgagtcactgtgcctggcctatttcttaaattattttttctattccctccatcttttgggaaatacaactgtatgtacaataacctgcttgaaattgtcctgtagctcactgatattctggtaattttcttcagtttttcccccgtgcatttcattttggaaagctgctgttgctatgcttttaagttcactaac

SEQ ID NO: 25057 - DNA, 434 bp, Homo sapiens
tccagtgattgatctgttagttaaatccaataattcatatatatgtaattggatttaacatatgtgtgtataacatatatgtataacatatatatacacacacatatatatgtatatatgtgtatatatatatgtatttcttttttgagatggagtctcaccctgtcacccagactgtagtgcagtggcatgatctcagcttactgcagcctctgtctcccgagtttaagcaattctcctgcctcagcctcccgagtagctgggatgacaggtgcccgccaccacacctggccaatttttgtatttttagtagagatggggttttgccatgttggccaggctggtcttgaactcctgacttcaagtgatctgcccacctcggcctcccaaattgttgggattacaggcgtgatccaccacaaccggcccagtaa

SEQ ID NO: 25058 - DNA, 993 bp, Homo sapiens
agattactcaatttaggttggagctgcctatggtaacaaagcatccttttttctttttttactttttttcttttgcggaacaggctatatagaatataaatgcaaacacttgaaaatttcacgtttattcttatttctctctagggaagcaaaaaaagaactgttaacactaattattcttccttgaaataaagatggaaggagggaaggaaaaagggagacagaacagaagaaaggggagaaggattttggtggggaggagggagagagctatttaatgtttttatatgagagaaatggaatgttattcaactggaaacagagaagtgcttccaaaacactgaatttatacagaccaattcctccagatttcaaaaatattaccaacacaggtcagcctgcaaatcaaatacgtgtttttcatttgttccccaattctacccctccagctttccgaagtaacctgcatgtaaatgactgtagatgagccttaagcagctgcttgtctattttcttaacatggcttggccaggagttgtgaacattggcttggaagacctggtttagcagtgaccgtcaaaacacctcacaactttgcactgggcatacactttgctgagtagggcagtaagcaaaattgggctttggctcactgcagaaaaaaagttatcctaaatatctacagtaaaaggaagtggggaggttctgttctcatcaagtaagtgaagttcgctaaaatgtatcatttgctaagcctctcacaatgaaaatagcaactataaatgtgaggatactgaagacattccccgaaagaaacctgtattacttttaatctgctgtagaacttggctttgcatcagtcatcccaacaaattctaagaacttcaaaatgcattaatccttagtgaactggatctgtgtaacatactcattctgagtgttttggcaaagtagccctatgtcactcgcttaattggtggcaggttattttcc

SEQ ID NO: 25059 - DNA, 173 bp, Homo sapiens
tgtgggtcagcatcccacaaaccaagtgtaaattcctcttctctgacacagctggagcctggtgttctgagtcttgcagccctcgggtcacctatggtgtttctgagtagtgtgcaatggacagtaggtgtttatgcacatatattatgtgactgttttataaatttcatggt

SEQ ID NO: 25060 - DNA, 310 bp, Homo sapiens
caccacatagacacacacgtgcacacacacaccacatgcacacacaacatgtgcacacacaccatgcatgcaatgatgggacaggcatgggaaaaccattctggatgatcctgttcaaaaaggtggaaaatggtaccccacaggagtcactggtccatagtattaataattctgagatccaaccaggcatatgtcaccagttccttgttcagggctcagtcctacagcccaggaattgttcaccaagcctctcagctccaccctcttggctctttttgtcctctgaatcttttcttccttttccataaaa

SEQ ID NO: 25061 - DNA, 304 bp, Homo sapiens
cataattaacactcagcatttgttaagggctgaacatgtgcctagagctttatatccagtcctcacagtcatgatcagagtggctggggaagtctccatggaagaggtgctcaggtgtttgaaagttttattgacatcaaatacaaggaaattgtaagcaaaggctttggtttaaatttgcatgtgatcttaccatgtacttcctagcctttttcagtttatataagcataaatccacttacttaccagatgtaataattttattgaatggaaacaacttgatagggtgaacaaaaaaaaaaga

SEQ ID NO: 25062 - DNA, 593 bp, Homo sapiens
gaaagcaattgacttttgtttattaaccttctatcctgcaactttgctatcatcactttttttgagaggggttttggtgtttcttttgaattttctacatagacaatcatgtcatctgcaaacaaagacagttatatttcttccttcccagtctgtataccttgtgttttctttccttgtcttattgcattagctagaacttccaatatgatgttgaaaagtaatgttgagaaggacatctttgtcttgttcctgatgttggccggaaagcttcaagtttccattaaatatgttagctgtaggttttttggagatgttctttatgaaattgtggaagttcctctctaatttaggttttctgagattttttaaaatcagaaatgggtgctggattttgtcaaatgcttttttttttttggcatgtatagatatgatcatgtgatttttcttctttagcttattgatgtgatggattacattaattgatcttcagatgttgaaacagctgtattttattatattttgctataagaataaaaatgccctttcctttcatagctggtaatcacttataaggaaatgatttaattact

SEQ ID NO: 25063 - DNA, 171 bp, Homo sapiens
gaggatcgctaaacttggaaatttgagctctctgtcccctaccagctttgtgcctttcagccagttactgaggttctgagtcaactttctcacctgtaaaatgaggaagatggtcatggtgctgttggtgatggtgattttggatatattggtaatggtggtagtgatggt

SEQ ID NO: 25064 - DNA, 586 bp, Homo sapiens
ccgactaatttaatttctgtatgtttttagtagaggcggggtttcaccatgttggtcaggctggtctcgaactcctgactccaagtgatccatccacctcagcctcccaaagagctggggttacaggtgtgagccaccacgcctggccactattcctgtttcttctacagacttgtttaaagagaaccctacattatgtgtgtttcttccacctcatcattcctctggggcctgggttccgtctccacctgggcactgagaacttggggacagaggttgccagtgacctcccaccgtatctcagtggcatggggttagggacatgggttctggaacagtgagcctcattctttagcggtacataccgaaatgtttgtccttggaatgtctgggatttgctttgacaaaatccacaagtagaaggagtgggtgggggtgaagataaaataagactggccatgaattgatagtttttgaagctggggggtgatggatacatggaggtttgttgtgttttgtctgctttatacttgagagattttctgtttacaaaaagaagagtacatgggttcaaatccagattctg

SEQ ID NO: 25065 - DNA, 503 bp, Homo sapiens
aggtgatccacttgccttggcctcccaaagtgctgggattgcaggcataagccactacccccggctctgtggttggttttgtttaatagctgaaacaggtatcctggtgatgctactatgctgcttagttgtcctgacacattattttttcagtgttaatggtatgtcatatttttactgttaagtacttaatgtatgaataaatgtaagaaaacaattgcctattgttagcatgtagattaagagtcaggaatgatgactcttgttgacatgggtggctgagatagtgacacctttgctttctgatggttcagggtacacaaactttattacaggcacaaaattatcaaaaatacggtataaaattaccttaaggctatgtatataagggatgtgtgtatgtgtgtatacacacaaaaataaattttgtgtttccacttggatcccctccctaagataactcattgtgtacatgcaaatattagaaaatgcaaaaaaaagaa

SEQ ID NO: 25066 - DNA, 191 bp, Homo sapiens
ctgagcatctggaatataacctttggatcttatcctcagcttagatttgttcttcagcagtttttttattctctagaaaaaggctgatatattattggagaaatcaaaatttctgtcataatgtaatataaagaaccaagcatgttttgttgcatgctagaataatttgttaggttttttttttcagctta

SEQ ID NO: 25067 - DNA, 647 bp, Homo sapiens
cttctttctgccatgtgaagaaggcccttactagaactcaaccatggtggcaccctgatcttggacttccaagcctccggaagtgtgagaactaaatgtctgctgtttaaggcacccagctgtatgatactttgttgtgtcagcatgaactaagacaacacgtaagactcaaaaaaacaaaaacaaaaaggactattggagcaacaaaagtttggatatatcctcaaaccatcagacctatagagctacatgtagagtaaacatggattaggtcttgttgataatgcacatctaaaaagagagttttgctacaggtaaaatgataaattatattatttatactaaccactcatttaaattttcagggataatgaggctgtcagaggaattttttttgtctttgtcgtggaaaacaaaagccatggttttaccaaggatgctatttagtaccacaacagacacagacatactaagtcaaaagcctgctgggaactggtatttcttacgattattggtatgagtaagtgaaaatttcagggtaggttaactttggtctcctgtaaagtgtgtttgacactagtaaaatacatttttttaagtatatacatccattttcatttgcaaataattataatcacaagcttgta

SEQ ID NO: 25068 - DNA, 457 bp, Homo sapiens
ctaactactgttatgttacgagttcctcatatgtattcagattgctcccaaataagtgacattgcacatgcattttaaaaaataaatttcagaaactgctacaaaaatgatagaaacattgactaaaaatcagggtaaagagattaaaccaaagagaaaatagtcaatgagtggatattttaggaatacactctagagcatggagactcaagtgtgcaggttgaggagagcacttaggatgtaagctttcgagtcattcattcattcgttcattcagtgaatacctgttgaatgcctgtatgtgtcaggcactgtgctgagctctgggtctgagtctcagctctccccctttctcactgtgtggatgggctaagtgatttcctctcttctcccccagtctcgacctttgcaacctgaggattaatcctgactcacagcgtggttgtgaagattaaat

SEQ ID NO: 25069 - DNA, 321 bp, Homo sapiens
gcctgggcaacagagtgagagacggtctcaaaaaagactagaacggcttttaaaacaaagcattgtagagctatgtgtggtggttcgtgcctgtaatcccaacactttgggaggccaaggccggcagatcactgagatcaggcgttcgagaccagtctggccaacatggtgaaaccccatctcgattaaaaatacaaaaatcagcagggcgtggtggcgggcgcctgttgtctcagctacttgggaggctgaggctggagaattgcttgaacccaggaggtggaggttgtggtgagccgagatcacgccattgcactccag

SEQ ID NO: 25070 - DNA, 465 bp, Homo sapiens
ggagaacctcaggcaggggagtaggctccatcctgcgtggaggaacctgagcagtctaaggcaggctggctctatgatgtgctggcaataaaatcccaatgcttccgctgcagaagtccaagaggacatgactgcggctccatctagtcaagcccagggcaggaattcccttccaggaaaccaagccagagcgctgtggtctctgggctgccaagatgtctcagacaatggtctagcccttcagcccacagaaatctctgggcaaaattatctcccagcattgacagacgaatggataaacaaaatgtgttctatcccacagtggagtattattcagctttaaaaaggaaggaaaaatgctgggcgcggtggctcacaccttgatcccagcacttttgggaggctgaggaaggaggatcatttgtgcccaggagttcgagactagcctggacaacatagagaaac

SEQ ID NO: 25071 - DNA, 389 bp, Homo sapiens
atgtcagcaatagaatctacgtcatggttaagttcaagggaaggtactatgactagacgtgcacataagccagatttatgtttctttccacctaaacatctcagtggagtaaagaataacaaggcagcattgctgcaaatgtgtctcatctcccaccacagggaggtttttctctgatctcagaattgaacaaatgtacaaccgggttttataccgatacattcagttcccaggggcaggcaggagactggccttcctctatctccactgcaagagactttcctcttttactaatctacctcagcacagaccctttatgggtgtcaggccgcgggtcggtcaggtctttctcatcccatgaggccatgtttcaaaacatcacatgggga

SEQ ID NO: 25072 - DNA, 437 bp, Homo sapiens
cccaactctaccgccttatgtgctgtaggccagcgctgtgcagtctaccttagctgttcaatctcatggtcacccccgggactgtgtcaccatcagagggtgaaccatatctggcatgccaggttcacatatcccatttttttcaccaacatctctcttatttctaattcattgcccccaagatgtccgctaccatacatctctgaacttaccgaaattcttctgtccactgaccccgccactttctcgttaaccatcagcctgtttcctagctttcctgctctttttatccaattgagacttctcttattcattattaactctctgatgtaaatacttcccttctcttccagtgtttttctcattatactactctggataaaccgtgctatctgccttcgctggcctacagcacatgccggtaccgagctcgatta

SEQ ID NO: 25073 - DNA, 1193 bp, Homo sapiens
gaatcaaacccaggtttctgtgacactacagcgtactcttcacacctcaccaagctgcccctcacaagagagtaggtgtgatgcctgggctgatgaaatggcagcttaggacgtaaagtgaccatttcaaaggcagcaaaactgcgatttcatctttgacgttaataaaacggcaacaagaagccatctcagtaaatctcgtacaaagaaactctccagaatctaatggcatcaagatcctcgatcaggaatataaccccgattgtcttgtttctatagagaaatcagatttcatttcaggtattttatttcagtttacagttctttctcaaggactgaataacttaccaaatagcagtgtttatactatgaagtacatcagctatctcttgagatattttatttgtatgtagagttaaaattggatttgtagtaatttgaatacattatctgcatttgggagatgctttacggaatgaagtcacaggtattcagaatgtggatggtctatggtgaagaaagcctagtatattctcttgaaattttggtcggatgctacactttttgggtccaggagcccctgaagaagtctttcggtccctatctgcctagccatagttgattccttgtatgaatgtatatatagtcctactgttaaacaaatgaaattaggtaagacagaaggacttatgaaattattaagaataattagtgtataaaggccatatcttgaatcttttcttaccaaatttcttcttgtttggcatgtgcattcttttccttttcctgtttcgaacggagctgaaaataacgtgattgattttgctttaaaggtacatgactgggctgggtgcggtggctcacacctgtaatcccagctctcagggaggcaagaggtgggaggacagcttgagcccaggagttcgagagctgcctgggcaatatagcgagaccccgttctccacaaaaaggaaaaacaaaaacaaaaaaggaacatgactgattgtgtgtgtgtgtgtgtgtgtgtgtgtgtgtgtgttcagcatttcgtttttcagagatgtgtttatctttcaaatggccccagtagtttgggattttggtctccttttcacttaattaggaaaagtgttatttgtggtacaatataagaatttctaatcagagtatttttcaggttagaggaagaaatt

SEQ ID NO: 25074 - DNA, 476 bp, Homo sapiens
tctccagtcaattttctacacagctgccagaataatcttctttaaagacagggctattcatgatactgctcttagttctttttgcctgggagaaaaatgcatgtttcttgaagtttggaatccagggctgtttgtacattttccagcctcatcttctcatgatacactgtgttccatcaactctgaactgttcaccatccccaaacatgctaggccctttcttaactctgaactcttgtgctttcctctgaatactcacttctctccttcttcacatgacaaactactattcttcctttaaaatttagcttaaatatcagcacctaagggaaggttccccatcttctcctaggaataggtcattggtccatcgtttttgctaccagaactctttgtccacaattcagttgaatcactttgccttttctaatatgactatccctttacatgtctttccccactagatcctaaaagtt

SEQ ID NO: 25075 - DNA, 539 bp, Homo sapiens
gtgaaggagccagtgctagtgagccagtgctgggccagccaggtgcccccactttaggaccatccgcagtacagggagaggacaggatgacagggccccagaggtgcgaggggacaggtggctcagcgtgcatctgggaagggagcggcagaatgggccactgcgggcagcagctatcccctgcaccccaagagagcaggaaaagggccaggctgccaggaaggcttccccagccatagatttccctgagacaggcttcccagtgccaagtccctgcagacaggtgcctcgtcaaagaaacgccctgtttggagagggtggccaggacttacctgaggctgaggagggtctggttggtgcagagggcccccatcagtgctgccactcctgcgtcactgatggaattgctctgcaggctgcggaaagaggaggcgccctgggtgtggctgtcccaggacccagagggagctgccctgtcccagtctgggacagcaggcactgggctcaacagggagttgggggctccagggacagtggtg

SEQ ID NO: 25076 - DNA, 430 bp, Homo sapiens
cattttctttatccagtccaccattgatgggcatctaggttgattctatacctttgctattgtgaatagtgctgcgatgaacatacaggtccatgtatcttttttttatagaatgatttattttcatgatttttttttaagtggaaagaaaggttaagtttcagtaggcttgagtgaatgttaaagcatcaacttgtgtattcactgggacagtccctcaattatgactgtacaagttgctgatgtcccatgagcaaaattacctctgtgtccagggactttcctcctgattgcagctgaagctataaatattctcacctctacccctgcatcattgctggcccacccctgctccttttcccttcgtctttctgtcactgctggaaagcccctgcctttgctcagacttctggatgccttccaactcatt

SEQ ID NO: 25077 - DNA, 928 bp, Homo sapiens
tacttttttcctcttactgcattttgggggatttatcattctatgtctaccttttcttgagtacagctttgatatgcacctgttgttacgtggtgatgggaagtcacgggcgtgctctttctggttaatttgatgccacatcttccttgtcttttcagcttgggaaaaaggcggcagtggaggaaggcatggaatgcccacagtggtcagttcaaagaacaaacgtgcaattaaaaaactgtagtcagccaggcacggtggttcacacctgtaatcccagcactttgaaaggccaaggcgggcagattgcttgagctaaggagttcgagaccagcctgagcaacatgatgaaaccccgtctctacaaaaagtacaaaaattagccaggcgtggtggtatgccctggtagtcccagctgctcgggaggctgaggcaggaggatcacctgattctaagaattcgagactgcagtgagccgtgatcttgccactgtagtccaggctgggctacggagagaccctgcctccaaaaaaaaaaaaaaaaaggaaaaaaggggggggggtaaaaattttcccgagtggggggccaagtttggtttacccggttttttgtgtaccagggggtccctaagaggagcggattttaaagcaaggccgggccgccgttacacccgtcggggctgggaaaacctggctcgctgggaccttgggaagggaccctacttctgggcggtgcccttattggcaacctccaatggggtttagggctaaggcacaataaactctacggtattcgcggtaacaccggaatctgcgtggaagttgtcggattgttagaattacggcgccgtacacactctcccaccacacaacaaacacacgccgacacgcattatacacaactactacccgaccaacaccgcactcgt

SEQ ID NO: 25078 - DNA, 2080 bp, Homo sapiens
ctcagctccgcaccgcaactgaagatctgccgccgcggaacagttgcgtctccatctggctaccaacccacccaagctttcttctccaccaccaccaccttccttccttccccctcctccccctcctttccgtcttccctctccacccccgcccccaatctcctcctttttttctcactacgagcggttgctgatgctgaagccgagcgtcacttcggctcccacggcagacatggcgacattgacagtggtccagccgctcaccctggacagagatgttgcaagagcaattgaattactggaaaaactacaggaatctggagaagtaccagtgcacaagctacaatccctcaaaaaagtgcttcagagtgagttttgtacagctattcgagaggtgtatcaatatatgcatgaaacgataactgttaatggctgtcccgaattccgtgcgagggcaacagcaaaggcaacagttgcagcttttgcagctagtgaaggccactcccaccctcgagtagttgaactgccaaagactgatgaaggccttggttttaatgtgatgggaggaaaggagcaaaattcccccatttatatctctcgcataattcctggaggggtggctgaaagacacggaggcctcaaaagaggagaccagctgctatcagtgaacggagtgagtgtggaaggagaacaccatgagaaagctgtggaactactcaaggctgctaaagacagcgtcaagctggtggtgcgatacaccccaaaagttctggaagaaatggaggctcgctttgaaaagctacgaacagccaggcgtcggcagcagcagcaattgctaattcagcagcagcaacagcagcagcagcaacaaacacaacaaaaccacatgtcataggcccttgagggaaagctacttgatcaaacatccgatagtcacaaatttgaaaccgtgcttcagaatcccagcacatagtaaaagacaacactgataattatacctgtcaagaagctgtgaacacatggtgtataaattctttaccaaggcaactcaacaccttctttctctgggcttgaaccgccactgctcacgtgggctttacatacattgaccttccattcactgcagtgggaattctcagtgtgcagagggagaggttttctagtctgcaaactgaaacagtgtaagaagaataaagtctatgacttttaaataaatcaccagggccaagattgagtgaatcttgggtccatagcttttccagatattagcaaacccctcattaggctataattcaaactgcatcagttcaaagtgaaacctacacattgctccttaccctcacctgctccacaatccatagtgctgagttgtctgaattggaattccagttaattgcaagttcaacctgttttcctcttgaaaatcgcaaggtatcatactatatttatattttcttcaggttctagaagcaatcggctttttcttttgtttccatgaattttattatgcattaatagaatggaccaattttagctcaacttttagtttgttagaagcaagtgtaggaactctagcactgtagtttttaattattgcttgtatctattattattaattccaacagagtataatgtatatttattctataaaatatatattatcagagtgcatttgttacaacttaggttcttttcttaccaagtattaagaatctagtaagagaatactagcaaaggacctagccctgtgaacagattctcgtatgttatatacataaacccactctcaatattttttgagttttatactttttgattgataaacactgaagaaatctaaactctactcacactgatgtgctgtcatagaagcctatttcatattttaaagcttagcaaaactaaattatatgtgcatatatattcaaatatttgtgtcacacaaagtttaggtcaatttccccaaatataaaccagatatttttggcactctcagataaacaagtattatttctcttataattgggcaggtggaaaccagtgatatcaatattgtgaatggcagatgctgcttcctcta

SEQ ID NO: 25079 - DNA, 1880 bp, Homo sapiens
tttatattcttatcctaccaggcttcggaataatctcccatatgtaagtggtccagccgctcaccctggacagagatgttgcaagagcaattgaattactggaaaaactacaggaatctggagaagtaccagtgcacaagctacaatccctcaaaaaagtgcttcagagtgagttttgtacagctattcgagaggtgtatcaatatatgcatgaaacgataactgttaatggctgtcccgaattccgtgcgagggcaacagcaaaggcaacagttgcagcttttgcagctagtgaaggccactcccaccctcgagtagttgaactgccaaagactgatgaaggccttggttttaatgtgatgggaggaaaggagcaaaattcccccatttatatctctcgcataattcctggaggggtggctgaaagacacggaggcctcaaaagaggagaccagctgctatcagtgaacggagtgagtgtggaaggagaacaccatgagaaagctgtggaactactcaaggctgctaaagacagcgtcaagctggtggtgcgatacaccccaaaagttctggaagaaatggaggctcgctttgaaaagctacgaacagccaggcgtcggcagcagcagcaattgctaattcagcagcagcaacagcagcagcagcaacaaacacaacaaaaccacatgtcataggcccttgagggaaagctacttgatcaaacatccgatagtcacaaatttgaaaccgtgcttcagaatcccagcacatagtaaaagacaacactgataattatacctgtcaagaagctgtgaacacatggtgtataaattctttaccaaggcaactcaacaccttctttctctgggcttgaaccgccactgctcacgtgggctttacatacattgaccttccattcactgcagtgggaattctcagtgtgcagagggagaggttttctagtctgcaaactgaaacagtgtaagaagaataaagtctatgacttttaaataaatcaccagggccaagattgagtgaatcttgggtccatagcttttccagatattagcaaacccctcattaggctataattcaaactgcatcagttcaaagtgaaacctacacattgctccttaccctcacctgctccacaatccatagtgctgagttgtctgaattggaattccagttaattgcaagttcaacctgttttcctcttgaaaatcgcaaggtatcatactatatttatattttcttcaggttctagaagcaatcggctttttcttttgtttccatgaattttattatgcattaatagaatggaccaattttagctcaacttttagtttgttagaagcaagtgtaggaactctagcactgtagtttttaattattgcttgtatctattattattaattccaacagagtataatgtatatttattctataaaatatatattatcagagtgcatttgttacaacttaggttcttttcttaccaagtattaagaatctagtaagagaatactagcaaaggacctagccctgtgaacagattctcgtatgttatatacataaacccactctcaatattttttgagttttatactttttgattgataaacactgaagaaatctaaactctactcacactgatgtgctgtcatagaagcctatttcatattttaaagcttagcaaaactaaattatatgtgcatatatattcaaatatttgtgtcacacaaagtttaggtcaatttccccaaatataaaccagatatttttggcactctcagataaacaagtattatttctcttataattgggcaggtggaaaccagtgatatcaatattgtgaatggcagatgctgcttcctcta

SEQ ID NO: 25080 - DNA, 1050 bp, Homo sapiens
ctcagctccgcaccgcaactgaagatctgccgccgcggaacagttgcgtctccatctggctaccaacccacccaagctttcttctccaccaccaccaccttccttccttccccctcctccccctcctttccgtcttccctctccacccccgcccccaatctcctcctttttttctcactacgagcggttgctgatgctgaagccgagcgtcacttcggctcccacggcagacatggcgacattgacagtggtccagccgctcaccctggacagagatgttgcaagagcaattgaattactggaaaaactacaggaatctggagaagtaccagtgcacaagctacaatccctcaaaaaagtgcttcagagtgagttttgtacagctattcgagaggtgtatcaatatatgcatgaaacgataactgttaatggctgtcccgaattccgtgcgagggcaacagcaaaggcaacagttgcagcttttgcagctagtgaaggccactcccaccctcgagtagttgaactgccaaagactgatgaaggccttggttttaatgtgatgggaggaaaggagcaaaattcccccatttatatctctcgcataattcctggaggggtggctgaaagacacggaggcctcaaaagaggagaccagctgctatcagtgaacggagtgagtgtggaaggagaacaccatgagaaagctgtggaactactcaaggctgctaaagacagcgtcaagctggtggtgcgatacaccccaaaagttctggaagaaatggaggctcgctttgaaaagctacgaacagccaggcgtcggcagcagcagcaattgctaattcagcagcagcaacagcagcagcagcaacaaacacaacaaaaccacatgtcataggcccttgagggaaagctacttgatcaaacatccgatagtcacaaatttgaaaccgtgcttcagaatcccagcacatagtaaaagacaacactgataattatacctgtcaagaagctgtgaacacatggtgtataaattctttaccaaggcaactc

SEQ ID NO: 25081 - DNA, 1243 bp, Homo sapiens
gcaacatatagccctcacccttcataagccagtacggaatcttatcataaggcgcaaggcccttgagggaaagctacttgatcaaacatccgatagtcacaaatttgaaaccgtgcttcagaatcccagcacatagtaaaagacaacactgataattatacctgtcaagaagctgtgaacacatggtgtataaattctttaccaaggcaactcaacaccttctttctctgggcttgaaccgccactgctcacgtgggctttacatacattgaccttccattcactgcagtgggaattctcagtgtgcagagggagaggttttctagtctgcaaactgaaacagtgtaagaagaataaagtctatgacttttaaataaatcaccagggccaagattgagtgaatcttgggtccatagcttttccagatattagcaaacccctcattaggctataattcaaactgcatcagttcaaagtgaaacctacacattgctccttaccctcacctgctccacaatccatagtgctgagttgtctgaattggaattccagttaattgcaagttcaacctgttttcctcttgaaaatcgcaaggtatcatactatatttatattttcttcaggttctagaagcaatcggctttttcttttgtttccatgaattttattatgcattaatagaatggaccaattttagctcaacttttagtttgttagaagcaagtgtaggaactctagcactgtagtttttaattattgcttgtatctattattattaattccaacagagtataatgtatatttattctataaaatatatattatcagagtgcatttgttacaacttaggttcttttcttaccaagtattaagaatctagtaagagaatactagcaaaggacctagccctgtgaacagattctcgtatgttatatacataaacccactctcaatattttttgagttttatactttttgattgataaacactgaagaaatctaaactctactcacactgatgtgctgtcatagaagcctatttcatattttaaagcttagcaaaactaaattatatgtgcatatatattcaaatatttgtgtcacacaaagtttaggtcaatttccccaaatataaaccagatatttttggcactctcagataaacaagtattatttctcttataattgggcaggtggaaaccagtgatatcaatattgtgaatggcagatgctgcttcctcta

SEQ ID NO: 25082 - DNA, 1213 bp, Homo sapiens
ctcagctccgcaccgcaactgaagatctgccgccgcggaacagttgcgtctccatctggctaccaacccacccaagctttcttctccaccaccaccaccttccttccttccccctcctccccctcctttccgtcttccctctccacccccgcccccaatctcctcctttttttctcactacgagcggttgctgatgctgaagccgagcgtcacttcggctcccacggcagacatggcgacattgacagtggtccagccgctcaccctggacagagatgttgcaagagcaattgaattactggaaaaactacaggaatctggagaagtaccagtgcacaagctacaatccctcaaaaaagtgcttcagagtgagttttgtacagctattcgagaggtgtatcaatatatgcatgaaacgataactgttaatggctgtcccgaattccgtgcgagggcaacagcaaaggcaacagttgcagcttttgcagctagtgaaggccactcccaccctcgagtagttgaactgccaaagactgatgaaggccttggttttaatgtgatgggaggaaaggagcaaaattcccccatttatatctctcgcataattcctggaggggtggctgaaagacacggaggcctcaaaagaggagaccagctgctatcagtgaacggagtgagtgtggaaggagaacaccatgagaaagctgtggaactactcaaggctgctaaagacagcgtcaagctggtggtgcgatacaccccaaaagttctggaagaaatggaggctcgctttgaaaagctacgaacagccaggcgtcggcagcagcagcaattgctaattcagcagcagcaacagcagcagcagcaacaaacacaacaaaaccacatgtcataggcccttgagggaaagctacttgatcaaacatccgatagtcacaaatttgaaaccgtgcttcagaatcccagcacatagtaaaagacaacactgataattatacctgtcaagaagctgtgaacacatggtgtataaattctttaccaaggcaactcaacaccttctttctctgggcttgaaccgccactgctcacgtgggctttacatacattgaccttccattcactgcagtgggaattctcagtgtgcagagggagaggttttctagtctgcaaactgaaacagtgtaagaagaataaagtctatgacttttaaata

SEQ ID NO: 25083 - DNA, 2157 bp, Homo sapiens
ctcagctccgcaccgcaactgaagatctgccgccgcggaacagttgcgtctccatctggctaccaacccacccaagctttcttctccaccaccaccaccttccttccttccccctcctccccctcctttccgtcttccctctccacccccgcccccaatctcctcctttttttctcactacgagcggttgctgatgctgaagccgagcgtcacttcggctcccacggcagacatggcgacattgacagtggtccagccgctcaccctggacagagatgttgcaagagcaattgaattactggaaaaactacaggaatctggagaagtaccagtgcacaagctacaatccctcaaaaaagtgcttcagagtgagttttgtacagctattcgagaggtgtatcaatatatgcatgaaacgataactgttaatggctgtcccgaattccgtgcgagggcaacagcaaaggtattctcgtgtgtacactgtaagagaatttagacatcagtggcagcccagagtctagaaccagtactacttctcaggcaacagttgcagcttttgcagctagtgaaggccactcccaccctcgagtagttgaactgccaaagactgatgaaggccttggttttaatgtgatgggaggaaaggagcaaaattcccccatttatatctctcgcataattcctggaggggtggctgaaagacacggaggcctcaaaagaggagaccagctgctatcagtgaacggagtgagtgtggaaggagaacaccatgagaaagctgtggaactactcaaggctgctaaagacagcgtcaagctggtggtgcgatacaccccaaaagttctggaagaaatggaggctcgctttgaaaagctacgaacagccaggcgtcggcagcagcagcaattgctaattcagcagcagcaacagcagcagcagcaacaaacacaacaaaaccacatgtcataggcccttgagggaaagctacttgatcaaacatccgatagtcacaaatttgaaaccgtgcttcagaatcccagcacatagtaaaagacaacactgataattatacctgtcaagaagctgtgaacacatggtgtataaattctttaccaaggcaactcaacaccttctttctctgggcttgaaccgccactgctcacgtgggctttacatacattgaccttccattcactgcagtgggaattctcagtgtgcagagggagaggttttctagtctgcaaactgaaacagtgtaagaagaataaagtctatgacttttaaataaatcaccagggccaagattgagtgaatcttgggtccatagcttttccagatattagcaaacccctcattaggctataattcaaactgcatcagttcaaagtgaaacctacacattgctccttaccctcacctgctccacaatccatagtgctgagttgtctgaattggaattccagttaattgcaagttcaacctgttttcctcttgaaaatcgcaaggtatcatactatatttatattttcttcaggttctagaagcaatcggctttttcttttgtttccatgaattttattatgcattaatagaatggaccaattttagctcaacttttagtttgttagaagcaagtgtaggaactctagcactgtagtttttaattattgcttgtatctattattattaattccaacagagtataatgtatatttattctataaaatatatattatcagagtgcatttgttacaacttaggttcttttcttaccaagtattaagaatctagtaagagaatactagcaaaggacctagccctgtgaacagattctcgtatgttatatacataaacccactctcaatattttttgagttttatactttttgattgataaacactgaagaaatctaaactctactcacactgatgtgctgtcatagaagcctatttcatattttaaagcttagcaaaactaaattatatgtgcatatatattcaaatatttgtgtcacacaaagtttaggtcaatttccccaaatataaaccagatatttttggcactctcagataaacaagtattatttctcttataattgggcaggtggaaaccagtgatatcaatattgtgaatggcagatgctgcttcctcta

SEQ ID NO: 25084 - DNA, 843 bp, Homo sapiens
ctcagctccgcaccgcaactgaagatctgccgccgcggaacagttgcgtctccatctggctaccaacccacccaagctttcttctccaccaccaccaccttccttccttccccctcctccccctcctttccgtcttccctctccacccccgcccccaatctcctcctttttttctcactacgagcggttgctgatgctgaagccgagcgtcacttcggctcccacggcagacatggcgacattgacagtggtccagccgctcaccctggacagagatgttgcaagagcaattgaattactggaaaaactacaggaatctggagaagtaccagtgcacaagctacaatccctcaaaaaagtgcttcagagtgagttttgtacagctattcgagaggtgtatcaatatatgcatgaaacgataactgttaatggctgtcccgaattccgtgcgagggcaacagcaaaggcaacagttgcagcttttgcagctagtgaaggccactcccaccctcgagtagttgaactgccaaagactgatgaaggccttggttttaatgtgatgggaggaaaggagcaaaattcccccatttatatctctcgcataattcctggaggggtggctgaaagacacggaggcctcaaaagaggagaccagctgctatcagtgaacggagtggtatgtttataaaataaccagagattttctccttaagcacattctttttttttgccccctgctattactgaagtcaacgttgaaaacctagaataaatattcattttatgtctaaccagctttctaagcattgatggatattaaacctataaaagctgcaatctaat

SEQ ID NO: 25085 - DNA, 317 bp, Homo sapiens
gtgagaaacagtacattgatgttctaccttgtttttaataaaataaaagtgataacataattagacctatataattttaatcctgatgataggatttagtaaccgatttataagatttatttatttcctattggttacaatcacattccttgaaataaatgctaacacggccgggcacagtggctcatgcctgtaatcccagcgctttgggaggctgaggcgagcagatcacaaggtcaggagttcgagaccagcccggccaatatggtgaaaccccgtctctactaaaaatacaaaaattagtcaggtgtggtggc

SEQ ID NO: 25086 - DNA, 257 bp, Homo sapiens
gtattagctagaattctcctatgaagatttttcccatttaccctttctcttcctctgtatcctacctttgtttttaaaacactattgcagacccaggattttttttttatgtgttctccattttaattttctttcttttttttttttaaactcatattgtcccagttttgagaagctagagcactctgtgtacatatttgtaacgttttatagaatttcagctttcagaaaacttgcgctgttttagcttgtttagg

SEQ ID NO: 25087 - DNA, 419 bp, Homo sapiens
cttggaaatatacctttgtttatcccattctttcaccaaatgtgtaaatataaaacacagctttccaagatgtgccactttaatttaatctaccagattatgcctgctgtcattctttagcacctcacttcagtgtatctgttgtttgcataacaatatactatcaatttataatgagttattttacaataggtctgtttttcgggaattttgaatgcatttttctaggaagttctgtttgtctatgtagccccaatacttgcatacttggggaagtaaaattgaaaacgaatagtttcatggaggattgttaacattagaggagaagattgtttaatcagaggagaatgaggaagtaaatggagattttagaggaaatgttgaccaggaagaaagccaggacactttcccatgctttt

SEQ ID NO: 25088 - DNA, 669 bp, Homo sapiens
atttacataccactgataaaatgtacaataggcctgaagggtgttaagaacttcttgggggtaaataacaaaaatctctatataaatccacctcttttaacatttgtcttcactggccacagcctatttcatctaccttttctagacagatggggttattggaaaggtactgtttacttaatttccagatcataattgtaaaatagatgaatttagagaacagataataaagggacgttttcaatatgctttgtaacacagctaattcaagtctattcaaaaaggtaaacaaattcattttaactgccactgatatttatagacttcctccaaaatattaaaagctcttaaactgggcagattaagaaatacataaatggccaggtgtggtgcctgtaatcccggcactttgggaggccaaggtgggaggttcacctgagatcaggagttcaagaccagcctgaccaagattgcaaaaccttgtctccactaaaaatacaaaaattagccggtagtggtggcacatgcctgtacttccagctactcaggaggctaaggctggagaattacttgaatccaggaggcagaggttgcagtgaaccaagattgtgccactgcactccagcctaagcaacacagcgagactccatctcaaacaaaaaaaaaaca

SEQ ID NO: 25089 - DNA, 386 bp, Homo sapiens
gaacccagctaaccaggacccattcatctgacccacagaaacagtggcatagtaaatgtgtgttatcataagccactacattgtgataattcactataaagcaagaggtaattattaaccagccttaaggattcagtaacaactctggtataacattgctttgcttcacatatacattgaggttccaagaataatcctgataaagcaagaaactagaactataggctggtgtaaaaacaggccctgggtagatggtggcttcaagggttgggctgtatctcacattaaactggagagggattaagatagtgaaggtccaggaggaagagctagcagaataaaactattcagcttgatgaaatatacacttagggcaaaatgataga

SEQ ID NO: 25090 - DNA, 350 bp, Homo sapiens
agccagccagaagttttgctggcaatggtttggtttctagaacagcatcaaaacttgtctcccatgttttgtaagtggtttaacccacaagatatcacgcatttgaaacttttaagaagaaacttaatttcatctgtgaatgcagaagcaaatatgagggcatgggcatttaaatatgaagtatttcttgaaagccacctactggagagtaagtttggtgcaataatttaagaaaagataaaaaagaaacaggaaaattgggacaacggacagcatgatggagccaccgtgcaagccctcaatagtctgcctccaggttgtgtcaaataaagtaaaaagaacaaaaaaac

SEQ ID NO: 25091 - DNA, 438 bp, Homo sapiens
aacacactcatgaaaaaccagtgggtcaaaaaagaaatcaaaagggaaatttaaaaactcttgagacaaacaaaaatggacatagaacacacccaaactcgcaagatgtagcaaaagcaattctaaaagggaagagcatagcagtaaacacctatgttaagaaaaaaaaaatcccaaataaatagcctaactttatacctcaaacaactagaaaaagaaaaacaaaataaccccaaagttagtagaaaaaagacagaaaggaaggaaggaagggaggaaggaaggaaggaagaaggaaagaaagaaaaagaaggaaagaaagaaagaaaggaaaatcagagcaaaaataaatgaaatagagataagacaaacaagagaaaagatcaaaagttggctttttgaaaagataaaattaacgaaactttagctggcctaact

SEQ ID NO: 25092 - DNA, 248 bp, Homo sapiens
cacagacaggaggaggaggaggaggcagtgtgatcctggaggcacagatcagggtgaagcagtcacaaaccaaggagtgccggcagctcccagaggccggagggtggaggagtggattctccctgagagcctccagagggaacaggccctgcccaacgccctcgttctggcccagtgaaatgaatgtggactgctggccttaataactgtgagaaaaaaacatgtctgtggtttaaagccaccaaatc

SEQ ID NO: 25093 - DNA, 452 bp, Homo sapiens
gaatacttccagacatctttgtttttcaaccatgtttaccaagatttcacccttggggaatagattttcatcttaatttatggaagtctttgagaaacctgggaaatggctaatgaggtagatctttttagtggtagataaaaattaggagatgttagaatctttttaataataactacagttttttaaaacaacatttaaaattatgaaaatagccaggcacggtggctcatgcctgtactcccaatgtgctggtattacaggtgtgagccactgtgcccagccttgctttaataattttttttgtacttgggaaaacctacttagcgtactccacatttttagaatgtttatctgttttattcccggcctagataggcttttagttggtttccatatacagtgtatatagggagaaacagactaagacagacactggcatccacagaagt

SEQ ID NO: 25094 - DNA, 476 bp, Homo sapiens
caggggagcacctgggaagcgctgggggtcgcgtgcccttggccggaggcctggtcacccgcaggccctgccatcctcggcttggccgctgctgcccgcgcgcctgtggcggagcgagcctgcctccagggcagcctcaccgcctggatcctgggcaggagacctcccaggtcccttcctctgtccagctgtctggaatggagccgccatgtctggtgctcaagcggccagctctgacccagaggttaaccagtgttggttcctgttgtttacaaccaagaatcctgagaagttcatatgtagcccacacataagctgaagtattgccttatgacatattctgaatattccaattattttgcaaataattccactaagagattaatacattctagagcatgtagctgtggttcattcattttcataactgtgtaatatttcattgaataaatttgctctttctatattttcaaacc

SEQ ID NO: 25095 - DNA, 410 bp, Homo sapiens
tgagatggagtctcactctgtccccccaggctgcagtgcagtggcacgatctctgctcactgcaacctctgtctccagggttcaagtgattctcctgcctcagcctctcaagtagttgggattagaggtgcctgccagcacgcctggctaattttttgtatttttagtagagacagggtttctcaattttggtcgggctggtctcaaactcccgacctcaggtgatctgcttgccttggcctcccaaagtgttgggattacaggcgtgagccactgcgcccggcccagaatatactttttaaaatgaggtgctataatttatatttgtgtactttagatcaaattaactataagctaaatttttaacatttaacgatacaattcacataaaattggacaaatatgcaact

SEQ ID NO: 25096 - DNA, 1825 bp, Homo sapiens
agcgggccgagcccagctccccgcggcggccgctagcccccggccccgagccaccactccgacctagcggccgccgcccccggtgcgggatgaggagatccgcggccgccactgggccccatggaggagccgcagccgccccgcccaccagcgagcatggccttactgggcagccagcactccggcgccccctccgcggccggcccacctggcgggacttcctcagcggccacggcggccgtgctctccttcagcaccgtggcgaccgcggcgctggggaacctgagcgacgcaagcggaggcggcacagctgccgctcccggtggcggcggccttggcgggtccggggcagcgcgggaggcgggggcggcggtgaggcggccgctaggcccggaggcggcgccgctgctgtcgcacggagctgcagtggcggcccaggcgctcgtcctcctgctcatcttcctgctgtctagccttggcaactgcgcggtgatgggggtgattgtgaagcaccggcagctccgcaccgtcaccaacgccttcatcctgtcgctgtccctatcggatctgctcacggcgctgctctgcctgcccgccgccttcctggacctcttcactccgcccgggggttcggcgcctgcgctgcccgcggggccctggcgcggcttctgccggccaagccgcttcttcagctcgtgcttcggcatcgtgtacgctcagcgtggcgctcatctcgttggaccgttactgcgctatcgtcggccgccgcgggagaagatcggccgccgccgcgcgctgcagctgctggcgggcgcctggctgacggccctgggcttctccttgccctgggagctgctcggggcgccccgggaactcgcggcggcgcagagcttccacggctgcctctaccggacctccccggaccccgcgcagctgggcgcggccttcagcgtggggctggtggtggcctgctacctgctgcccttcctgctcatgtgcttctgccactaccacatctgcaagacggtgcgcctgtcggacgtgcgcgtgcggccggtgaacacctacgcgcgcgtgctgcgcttcttcagcgaggtgcgcacggccaccaccgtcctcatcatgatcgtcttcgtcatctgctgctgggggccctactgcttcctggtgctgctggccgccgcccggcaggcccagaccatgcaggccccctcgctcctcagcgtggtggccgtctggctgacctgggccaatggggccatcaaccctgtcatctacgccatccgcaatcccaacatttcgatgctcctagggcgcaaccgcgaggagggctaccggactaggaatgtggacgctttcctgcccagccagggcccgggtctgcaagccagaagccgcagtcgccttcgaaaccgctatgccaaccggctgggggcctgcaacaggatgtcctcttccaacccggccagcggagtggcaggggacgtggccatgtgggcccgcaaaaatccagttgtacttttctgccgagagggaccaccagagccggtgacggcagtgaccaaacagcctaaatccgaagctggggataccagcctctaagacggttggaatggccagcttatgaaggcaaatttccactcgcattatttaatgatggaagattctgggggagagttgtggatttcataaagccaaacatttaaagctagagacgggggaggcttaccactttccccaaacaacataaaagacaatgtcccttcttcaaaagtgccaaaaggaatgtaaaatgcaaaaattaaaacaatcttaaaccacataa

SEQ ID NO: 25097 - DNA, 163 bp, Homo sapiens
catgggccacactttgagactcaaggtaataagtaaccctcttcaaagtcagggcttttgttttggggaaaattcaagtattcaaatagagctttgttgtcattccaaaaagtcctcaccatccgatgtgttctttcaatggataaatacaaggtaatccatc

SEQ ID NO: 25098 - DNA, 456 bp, Homo sapiens
aaatacgtaaaatcacatatccagttatatagtatgtagtacacatccttccttttgcaacatggctcagcacagcactggctggaactatgacttgcggctaccagcctcaaagattttcaggactctaaatggaaacagaacatctgatcatatctgactcctcacgtctcctgtcacagctcctttgggtagtagcctctcttttcatagaaaaatatcactgtcaggctgacttttagggtcatgttcctaaaggccaataaagacaagctgtgttctcatgacaacaggcagaaatcaacctcacacatctgctgacgctccagaacatctatgtggacttccaagcactaaatatctgagagttactgtcttttaaatacccccaaatgaaggttttgaataacttttctggagcacatatgttcatttaacatttattgaagactacat

SEQ ID NO: 25099 - DNA, 415 bp, Homo sapiens
ggataaattcccaactgattgttttatagcatgctttgtttttacattaaaagggagaatgggcctggtatggtagctcatgcctgtaatcccagcactttgggaggccgaggcagatgaatcatttgaggtcaggagttcgagaccagcttgggcaatatagggaaaccctatctctacaaaaaatacaaaaattagccaggcgttgtggcacgtgcctgtagtccggctactcaagagactgaagtgggagaatggcttgagctggcgaggtagaggttgcagtgagcagagattacaccactgcacatcagcctgggcaacagagccagaccctgtatcaaaaaaaaaaaaaaaaaaaaaagacatgataatacagccagttgtaaaagtcatggggatgtttagtctagag

SEQ ID NO: 25100 - DNA, 165 bp, Homo sapiens
tggtttggggcctggggtcggggaggagtgagtcacccccagtggagagcagtgcactctgggagggcctgacgttccttgccttgctctgcccagtgtttgagaacagcagcaagatcgtgatcgtcatggagtatgccagcacaagaacacacggggtaccga

SEQ ID NO: 25101 - DNA, 970 bp, Homo sapiens
  misc_feature (22)..(22): n is a, c, g, or t
gtctggggcacgaggcagcgancaaccaccagaactggatggtggcacccctaatgtgcatgaggcatcctgggaatggtctggagtaacgcttcgttatttttatttttatttttatttatttatttatttttttgagacggagtttcgctcttggtgcccaggctagagtgcaatggcgcgatctcagctcacctcaacctccgcctcccgggttcaagcgattctcctgcctcagcctccctagtagctgggattacaggcgcccgccaccatgcccggctaattttgtatttttagtagagacagggtttctccatgttggtcaggctggtctcaaactcccgacctcaggtgatccacccacctcggcctcccaaagtgctgggattacaggcgtgagccaccgcgccccacctaacccttccttatttagcctaggagtaagagaacacaatctctgtttcttcaatggttctcttcccttttccatcctccaaacctggcctgagcctcctgaagttgctgctgtgaatctgaaagacttgaaaagcctccgcctgctgtgtggacttcatctcaaggggcccagcctcctctggactccaccttggacctcagtgactcagaacttctgcctctaagctgctctaaagtccagactatggatgtgttctctaggccttcaggactctagaatgtccatatttatttttatgttcttggctttgtgttttaggaaaagtgaatcttgctgttttcaataatgtgaatgctatgttctgggaaaatccactatgacatctaagttttgtgtacagagagatatttttgcaactatttccacctcctcccacaaccccccacactccactccacactcttgagtctctttacctaatggtctctacctaatggacctccgtggccaaaaagtaccattaaaaccagaaaggtgattggaagcagg

SEQ ID NO: 25102 - DNA, 3406 bp, Homo sapiens
gtgctttactgcgcgctctggtactgctgtggctccccgtcctggtgcgggacctgtgccccgcgcttcagccctccccgcacagcctactgattcccctgccgcccttgctcacctcctgctcgccatggagtcgctggttttcgcgcggcgctccggccccactccctcggccgcagagctagcccggccgctggcggaagggctgatcaagtcgcccaagcccctaatgaagaagcaggcggtgaagcggcaccaccacaagcacaacctgcggcaccgctacgagttcctggagaccctgggcaaaggcacctacgggaaggtgaagaaggcgcgggagagctcggggcgcctggtggccatcaagtcaatccggaaggacaaaatcaaagatgagcaagatctgatgcacatacggagggagattgagatcatgtcatcactcaaccaccctcacatcattgccatccatgaagtgtttgagaacagcagcaagatcgtgatcgtcatggagtatgccagccggggcgacctttatgactacatcagcgagcggcagcagctcagtgagcgcgaagctaggcatttcttccggcagatcgtctctgccgtgcactattgccatcagaacagagttgtccaccgagatctcaagctggagaacatcctcttggatgccaatgggaatatcaagattgctgacttcggcctctccaacctctaccatcaaggcaagttcctgcagacattctgtgggagccccctctatgcctcgccagagattgtcaatgggaagccctacacaggcccagaggtggacagctggtccctgggtgttctcctctacatcctggtgcatggcaccatgccctttgatgggcatgaccataagatcctagtgaaacagatcagcaacggggcctaccgggagccacctaaaccctctgatgcctgtggcctgatccggtggctgttgatggtgaaccccacccgccgggccaccctggaggatgtggccagtcactggtgggtcaactggggctacgccacccgagtgggagagcaggaggctccgcatgagggtgggcaccctggcagtgactctgcccgcgcctccatggctgactggctccggcgttcctcccgccccctcctggagaatggggccaaggtgtgcagcttcttcaagcagcatgcacctggtgggggaagcaccacccctggcctggagcgccagcattcgctcaagaagtcccgcaaggagaatgacatggcccagtctctccacagtgacacggctgatgacactgcccatcgccctggcaagagcaacctcaagctgccaaagggcattctcaagaagaaggtgtcagcctctgcagaaggggtacaggaggaccctccggagctcagcccaatccctgcgagcccagggcaggctgccccgctgctccccaagaagggcattctcaagaagccccgacagcgcgagtctggctactactcctctcccgagcccagtgaatctggggagctcttggacgcaggcgacgtgtttgtgagtggggatcccaaggagcagaagcctccgcaagcttcagggctgctcctccatcgcaaaggcatcctcaaactcaatggcaagttctcccagacagccttggagctcgcggcccccaccaccttcggctccctggatgaactcgccccacctcgccccctggcccgggccagccgaccctcaggggctgtgagcgaggacagcatcctgtcctctgagtcctttgaccagctggacttgcctgaacggctcccagagcccccactgcggggctgtgtgtctgtggacaacctcacggggcttgaggagcccccctcagagggccctggaagctgcctgaggcgctggcggcaggatcctttgggggacagctgcttttccctgacagactgccaggaggtgacagcgacctaccgacaggcactgagggtctgctcaaagctcacctgagtggagtaggcattgccccagcccggtcaggctctcagatgcagctggttgcaccccgaggggagatgccttctcccccacctcccaggacctgcatcccagctcagaaggctgagagggtttgcagtggagccctgagcagggctggatatgggaagtaggcaaatgaaatgcgccaagggttcagtgtctgtcttcagccctgctgaacgaagaggatactaaagagaggggaacgggaatgcccgcgacagagtccacattgcctgtttcttgtgtacatgggggggccacagagacctggaaagagaactctcccagggcccatctcctgcatcccatgaatactctgtacacatggtgccttctaaggacagctccttccctactcattccctgcccaagtggggccagacctctttacacacacattcccgttcctaccaaccaccagaactggatggtggcacccctaatgtgcatgaggcatcctgggaatggtctggagtaacgcttcgttatttttatttttatttttatttatttatttatttttttgagacggagtttcgctcttggtgcccaggctagagtgcaatggcgcgatctcagctcacctcaacctccgcctcccgggttcaagcgattctcctgcctcagcctccctagtagctgggattacaggcgcccgccaccatgcccggctaattttgtatttttagtagagacagggtttctccatgttggtcaggctggtctcaaactcccgacctcaggtgatccacccacctcggcctcccaaagtgctgggattacaggcgtgagccaccgcgccccacctaacccttccttatttagcctaggagtaagagaacacaatctctgtttcttcaatggttctcttcccttttccatcctccaaacctggcctgagcctcctgaagttgctgctgtgaatctgaaagacttgaaaagcctccgcctgctgtgtggacttcatctcaaggggcccagcctcctctggactccaccttggacctcagtgactcagaacttctgcctctaagctgctctaaagtccagactatggatgtgttctctaggccttcaggactctagaatgtccatatttatttttatgttcttggctttgtgttttaggaaaagtgaatcttgctgttttcaataatgtgaatgctatgttctgggaaaatccactatgacatctaagttttgtgtacagagagatatttttgcaactatttccacctcctcccacaaccccccacactccactccacactcttgagtctctttacctaatggtctctacctaatggacctccgtggccaaaaagtaccattaaaaccagaaaggtgattggaagcagg

SEQ ID NO: 25103 - DNA, 665 bp, Homo sapiens
gcaagactattatatcctaaattggaataaaagttttaataatactaacttgtcttttttttttttctaaaattgattccattgctactgttaatagtataaatcttaaaagggtgaattttttggatgaaattaatgcttattcttttctttttaaacagggcaataaatgtgttcgtaagtgccaaccgactaattcatcaaaccaacttaatacttcagaccttcaaaactgtggcctgaaagttgtatatgttaagagatgtacttctcagtggcagtattgaactgcctttatctgtaaattttaaagtttgactgtataaattatcagtccctcctgaagggatctaatccaggatgttgaatgggattattgccatcttacaccatatttttgtaaaatgtagcttaatcataatctcacactgaagattttgcatcacttttgctattatcattcttttaagaattataagccaaaagaatttacgccttaatgtgtcattatataacattccttaaaagaattgtaaatattggtgtttgtttctgacattttaacttgaaagcgatatgctgcaagataatgtatttaacaatatttggtggcaaatattcaataaatagtttacatctgttaaacatttctttacttgaaaaaa

SEQ ID NO: 25104 - DNA, 1312 bp, Homo sapiens
tgcacgactccggctgggcaggattccggacaacgcctggttcctcttgggtccttccggcgtcgccggagtgaattgatccgggagttgaagagggctgcaaggtgggaagtgaagtcagtgcctcagttgctgatcagtgtgttttttgtgtccaattcttttatcaccaaaaaagagaagaaatattgcagtgaatgaagattcctctgcattttagcactgctttttcaactgtagttggcttttgaatgaggatgacaatggaagagatgaagaatgaagctgagaccacatccatggtttctatgcccctctatgcagtcatgtatcctgtgtttaatgagctagaacgagtaaatctgtctgcagcccagacactgagagccgctttcatcaaggctgaaaaagaaaatccaggtctcacacaagacatcattatgaaaattttagagaaaaaaagcgtggaagttaacttcacggagtcccttcttcgtatggcagctgatgatgtagaagagtatatgattgaacgaccagagccagaattccaagacctaaacgaaaaggcacgagcacttaaacaaattctcagtaagatcccagatgagatcaatgacagagtgaggtttctgcagacaatcaaggatatagctagtgcaataaaagaacttcttgatacagtgaataatgtcttcaagaaatatcaataccagaaccgcagggcacttgaacaccaaaagaaagaatttgtaaagtactccaaaagtttcagtgatactctgaaaacgtattttaaagatggcaaggcaataaatgtgttcgtaagtgccaaccgactaattcatcaaaccaacttaatacttcagaccttcaaaactgtggcctgaaagttgtatatgttaagagatgtacttctcagtggcagtattgaactgcctttatctgtaaattttaaagtttgactgtataaattatcagtccctcctgaagggatctaatccaggatgttgaatgggattattgccatcttacaccatatttttgtaaaatgtagcttaatcataatctcacactgaagattttgcatcacttttgctattatcattcttttaagaattataagccaaaagaatttacgccttaatgtgtcattatataacattccttaaaagaattgtaaatattggtgtttgtttctgacattttaacttgaaagcgatatgctgcaagataatgtatttaacaatatttggtggcaaatattcaataaatagtttacatctgttaaacatttctttacttgaaaaaa

SEQ ID NO: 25105 - DNA, 879 bp, Homo sapiens
tgcacgactccggctgggcaggattccggacaacgcctggttcctcttgggtccttccggcgtcgccggagtgaattgatccgggagttgaagagggctgcaaggtgggaagtgaagtcagtgcctcagttgctggaagaggagcactggaagaaggaagagacaaatgttggggtctacggattcagttccagtttaatgatgtggccctctaaggagataattttgccttaaacagaaagacttgaccctcttaggtgtcatacctaagatcagtgtgttttttgtgtccaattcttttatcaccaaaaaagagaagaaatattgcagtgaatgaagattcctctgcattttagcactgctttttcaactgtagttggcttttgaatgaggatgacaatggaagagatgaagaatgaagctgagaccacatccatggtttctatgcccctctatgcagtcatgtatcctgtgtttaatgagctagaacgagtaaatctgtctgcagcccagacactgagagccgctttcatcaaggctgaaaaagaaaatccaggtctcacacaagacatcattatgaaaattttagagaaaaaaagcgtggaagttaacttcacggagtcccttcttcgtatggcagctgatgatgtagaagagtatatgattgaacgaccagagccagaattccaagacctaaacgaaaaggcacgagcacttaaacaaattctcagtaagatcccagatgagatcaatgacagagtgaggtttctgcagacaatcaaggatatagctagtgcaataaaagaacttcttgatacagtgaataatgtcttcaagaaatatcaataccagaaccgcaggggtacgtttagtagaagc

SEQ ID NO: 25106 - DNA, 777 bp, Homo sapiens
tgcacgactccggctgggcaggattccggacaacgcctggttcctcttgggtccttccggcgtcgccggagtgaattgatccgggagttgaagagggctgcaaggtgggaagtgaagtcagtgcctcagttgctgctttctcctctaaatcttggtctcttgtttggaagtgactaacagcattttggcatgagaaagccctaaaaagatcagtgtgttttttgtgtccaattcttttatcaccaaaaaagagaagaaatattgcagtgaatgaagattcctctgcattttagcactgctttttcaactgtagttggcttttgaatgaggatgacaatggaagagatgaagaatgaagctgagaccacatccatggtttctatgcccctctatgcagtcatgtatcctgtgtttaatgagctagaacgagtaaatctgtctgcagcccagacactgagagccgctttcatcaaggctgaaaaagaaaatccaggtctcacacaagacatcattatgaaaattttagagaaaaaaagcgtggaagttaacttcacggagtcccttcttcgtatggcagctgatgatgtagaagagtatatgattgaacgaccagagccagaattccaagacctaaacgaaaaggcacgagcacttaaacaaattctcagtaagatcccagatgagatcaatgacagagtgaggtttctgcagacaatcaagatatagctagtgcaatcaggcacctgaacaccaaagaaagaattgtaagtcttcaaa

SEQ ID NO: 25107 - DNA, 679 bp, Homo sapiens
  misc_feature (679)..(679): n is a, c, g, or t
tgcacgactccggctgggcaggattccggacaacgcctggttcctcttgggtccttccggcgtcgccggagtgaattgatccgggagttgaagagggctgcaaggtgggaagtgaagtcagtgcctcagttgctgctttctcctctaaatcttggtctcttgtttggaagtgactaacagcattttggcatgagaaagccctaaaaagatcagtgtgttttttgtgtccaattcttttatcaccaaaaaagagaagaaatattgcagtgaatgaagattcctctgcattttagcactgctttttcaactgtagttggcttttgaatgaggatgacaatggaagagatgaagaatgaagctgagaccacatccatggtttctatgcccctctatgcagtcatgtatcctgtgtttaatgagctagaacgagtaaatctgtctgcagcccagacactgagagccgctttcatcaaggctgaaaaagaaaatccaggtctcacacaagacatcattatgaaaattttagagaaaaaaagcgtggaagttaacttcacggagtcccttcttcgtatggcagctgatgatgtagaagagtatatgattgaacgaccagagccagaattccaaaagtttcagtgttactctgcgtattttaaagatggcgggcattgtgttcgtn

SEQ ID NO: 25108 - DNA, 1385 bp, Homo sapiens
tgcacgactccggctgggcaggattccggacaacgcctggttcctcttgggtccttccggcgtcgccggagtgaattgatccgggagttgaagagggctgcaaggtgggaagtgaagtcagtgcctcagttgctgctttctcctctaaatcttggtctcttgtttggaagtgactaacagcattttggcatgagaaagccctaaaaagatcagtgtgttttttgtgtccaattcttttatcaccaaaaaagagaagaaatattgcagtgaatgaagattcctctgcattttagcactgctttttcaactgtagttggcttttgaatgaggatgacaatggaagagatgaagaatgaagctgagaccacatccatggtttctatgcccctctatgcagtcatgtatcctgtgtttaatgagctagaacgagtaaatctgtctgcagcccagacactgagagccgctttcatcaaggctgaaaaagaaaatccaggtctcacacaagacatcattatgaaaattttagagaaaaaaagcgtggaagttaacttcacggagtcccttcttcgtatggcagctgatgatgtagaagagtatatgattgaacgaccagagccagaattccaagacctaaacgaaaaggcacgagcacttaaacaaattctcagtaagatcccagatgagatcaatgacagagtgaggtttctgcagacaatcaaggatatagctagtgcaataaaagaacttcttgatacagtgaataatgtcttcaagaaatatcaataccagaaccgcagggcacttgaacaccaaaagaaagaatttgtaaagtactccaaaagtttcagtgatactctgaaaacgtattttaaagatggcaaggcaataaatgtgttcgtaagtgccaaccgactaattcatcaaaccaacttaatacttcagaccttcaaaactgtggcctgaaagttgtatatgttaagagatgtacttctcagtggcagtattgaactgcctttatctgtaaattttaaagtttgactgtataaattatcagtccctcctgaagggatctaatccaggatgttgaatgggattattgccatcttacaccatatttttgtaaaatgtagcttaatcataatctcacactgaagattttgcatcacttttgctattatcattcttttaagaattataagccaaaagaatttacgccttaatgtgtcattatataacattccttaaaagaattgtaaatattggtgtttgtttctgacattttaacttgaaagcgatatgctgcaagataatgtatttaacaatatttggtggcaaatattcaataaatagtttacatctgttaaacatttctttacttgaaaaaa

SEQ ID NO: 25109 - DNA, 1592 bp, Homo sapiens
tgcacgactccggctgggcaggattccggacaacgcctggttcctcttgggtccttccggcgtcgccggagtgaattgatccgggagttgaagagggctgcaaggtgggaagtgaagtcagtgcctcagttgctggtaaggtgtagctgttctgtcccagtccccgtagctctgcaccgagcagaagaggtctagggtcacgcaggggccatggctgaggcacttgggcttggttctggcaggcggagcggacggggctgagagcggggccctacgggcgaagaggagcactggaagaaggaagagacaaatgttggggtctacggattcagttccagtttaatgatgtggccctctaaggagataattttgccttaaacagaaagacttgaccctcttaggtgtcatacctaagatcagtgtgttttttgtgtccaattcttttatcaccaaaaaagagaagaaatattgcagtgaatgaagattcctctgcattttagcactgctttttcaactgtagttggcttttgaatgaggatgacaatggaagagatgaagaatgaagctgagaccacatccatggtttctatgcccctctatgcagtcatgtatcctgtgtttaatgagctagaacgagtaaatctgtctgcagcccagacactgagagccgctttcatcaaggctgaaaaagaaaatccaggtctcacacaagacatcattatgaaaattttagagaaaaaaagcgtggaagttaacttcacggagtcccttcttcgtatggcagctgatgatgtagaagagtatatgattgaacgaccagagccagaattccaagacctaaacgaaaaggcacgagcacttaaacaaattctcagtaagatcccagatgagatcaatgacagagtgaggtttctgcagacaatcaaggatatagctagtgcaataaaagaacttcttgatacagtgaataatgtcttcaagaaatatcaataccagaaccgcagggcacttgaacaccaaaagaaagaatttgtaaagtactccaaaagtttcagtgatactctgaaaacgtattttaaagatggcaaggcaataaatgtgttcgtaagtgccaaccgactaattcatcaaaccaacttaatacttcagaccttcaaaactgtggcctgaaagttgtatatgttaagagatgtacttctcagtggcagtattgaactgcctttatctgtaaattttaaagtttgactgtataaattatcagtccctcctgaagggatctaatccaggatgttgaatgggattattgccatcttacaccatatttttgtaaaatgtagcttaatcataatctcacactgaagattttgcatcacttttgctattatcattcttttaagaattataagccaaaagaatttacgccttaatgtgtcattatataacattccttaaaagaattgtaaatattggtgtttgtttctgacattttaacttgaaagcgatatgctgcaagataatgtatttaacaatatttggtggcaaatattcaataaatagtttacatctgttaaacatttctttacttgaaaaaa

SEQ ID NO: 25110 - DNA, 823 bp, Homo sapiens
tgcacgactccggctgggcaggattccggacaacgcctggttcctcttgggtccttccggcgtcgccggagtgaattgatccgggagttgaagagggctgcaaggtgggaagtgaagtcagtgcctcagttgctgctttctcctctaaatcttggtctcttgtttggaagtgactaacagcattttggcatgagaaagccctaaaaagatcagtgtgttttttgtgtccaattcttttatcaccaaaaaagagaagaaatattgcagtgaatgaagattcctctgcattttagcactgctttttcaactgtagttggcttttgaatgaggatgacaatggaagagatgaagaatgaagctgagaccacatccatggtttctatgcccctctatgcagtcatgtatcctgtgtttaatgagctagaacgagtaaatctgtctgcagcccagacactgagagccgctttcatcaaggctgaaaaagaaaatccaggtctcacacaagacatcattatgaaaattttagagaaaaaaagcgtggaagttaacttcacggagtcccttcttcgtatggcagctgatgatgtagaagagtatatgattgaacgaccagagccagaattccaagacctaaacgaaaaggcacgagcacttaaacaaattctcagtaagatcccagatgagatcaatgacagagtgaggtttctgcagacaatcaaggatatagctagtgcaataaaagaacttcttgatacagtgaataatgtcttcaagaaatatcaataccagaaccgcaggttgaaagacgcaggtaccgagctcg

SEQ ID NO: 25111 - DNA, 1686 bp, Homo sapiens
tgcacgactccggctgggcaggattccggacaacgcctggttcctcttgggtccttccggcgtcgccggagtgaattgatccgggagttgaagagggctgcaaggtgggaagtgaagtcagtgcctcagttgctggtaaggtgtagctgttctgtcccagtccccgtagctctgcaccgagcagaagaggtctagggtcacgcaggggccatggctgaggcacttgggcttggttctggcaggcggagcggacggggctgagagcggggccctacgggcgtaagcgaggttaccctacgcgagtggcgtaaagcgggtttgtaaatgccgcctgccggcttgggcccgaacgcctccaggaagtctcctctaggtgggggcgggaggggaagggcgaggttggcccctggtgccccgggagaggggacagggcggatgtgcctggggtggggtcctttgaaggtgtggcttcggaccgagaggtgaggctgctgttttccccctgctttatcagtgtgttttttgtgtccaattcttttatcaccaaaaaagagaagaaatattgcagtgaatgaagattcctctgcattttagcactgctttttcaactgtagttggcttttgaatgaggatgacaatggaagagatgaagaatgaagctgagaccacatccatggtttctatgcccctctatgcagtcatgtatcctgtgtttaatgagctagaacgagtaaatctgtctgcagcccagacactgagagccgctttcatcaaggctgaaaaagaaaatccaggtctcacacaagacatcattatgaaaattttagagaaaaaaagcgtggaagttaacttcacggagtcccttcttcgtatggcagctgatgatgtagaagagtatatgattgaacgaccagagccagaattccaagacctaaacgaaaaggcacgagcacttaaacaaattctcagtaagatcccagatgagatcaatgacagagtgaggtttctgcagacaatcaaggatatagctagtgcaataaaagaacttcttgatacagtgaataatgtcttcaagaaatatcaataccagaaccgcagggcacttgaacaccaaaagaaagaatttgtaaagtactccaaaagtttcagtgatactctgaaaacgtattttaaagatggcaaggcaataaatgtgttcgtaagtgccaaccgactaattcatcaaaccaacttaatacttcagaccttcaaaactgtggcctgaaagttgtatatgttaagagatgtacttctcagtggcagtattgaactgcctttatctgtaaattttaaagtttgactgtataaattatcagtccctcctgaagggatctaatccaggatgttgaatgggattattgccatcttacaccatatttttgtaaaatgtagcttaatcataatctcacactgaagattttgcatcacttttgctattatcattcttttaagaattataagccaaaagaatttacgccttaatgtgtcattatataacattccttaaaagaattgtaaatattggtgtttgtttctgacattttaacttgaaagcgatatgctgcaagataatgtatttaacaatatttggtggcaaatattcaataaatagtttacatctgttaaacatttctttacttgaaaaaa

SEQ ID NO: 25112 - DNA, 1448 bp, Homo sapiens
tgcacgactccggctgggcaggattccggacaacgcctggttcctcttgggtccttccggcgtcgccggagtgaattgatccgggagttgaagagggctgcaaggtgggaagtgaagtcagtgcctcagttgctggaagaggagcactggaagaaggaagagacaaatgttggggtctacggattcagttccagtttaatgatgtggccctctaaggagataattttgccttaaacagaaagacttgaccctcttaggtgtcatacctaagatcagtgtgttttttgtgtccaattcttttatcaccaaaaaagagaagaaatattgcagtgaatgaagattcctctgcattttagcactgctttttcaactgtagttggcttttgaatgaggatgacaatggaagagatgaagaatgaagctgagaccacatccatggtttctatgcccctctatgcagtcatgtatcctgtgtttaatgagctagaacgagtaaatctgtctgcagcccagacactgagagccgctttcatcaaggctgaaaaagaaaatccaggtctcacacaagacatcattatgaaaattttagagaaaaaaagcgtggaagttaacttcacggagtcccttcttcgtatggcagctgatgatgtagaagagtatatgattgaacgaccagagccagaattccaagacctaaacgaaaaggcacgagcacttaaacaaattctcagtaagatcccagatgagatcaatgacagagtgaggtttctgcagacaatcaaggatatagctagtgcaataaaagaacttcttgatacagtgaataatgtcttcaagaaatatcaataccagaaccgcagggcacttgaacaccaaaagaaagaatttgtaaagtactccaaaagtttcagtgatactctgaaaacgtattttaaagatggcaaggcaataaatgtgttcgtaagtgccaaccgactaattcatcaaaccaacttaatacttcagaccttcaaaactgtggcctgaaagttgtatatgttaagagatgtacttctcagtggcagtattgaactgcctttatctgtaaattttaaagtttgactgtataaattatcagtccctcctgaagggatctaatccaggatgttgaatgggattattgccatcttacaccatatttttgtaaaatgtagcttaatcataatctcacactgaagattttgcatcacttttgctattatcattcttttaagaattataagccaaaagaatttacgccttaatgtgtcattatataacattccttaaaagaattgtaaatattggtgtttgtttctgacattttaacttgaaagcgatatgctgcaagataatgtatttaacaatatttggtggcaaatattcaataaatagtttacatctgttaaacatttctttacttgaaaaaa

SEQ ID NO: 25113 - DNA, 1732 bp, Homo sapiens
tgcacgactccggctgggcaggattccggacaacgcctggttcctcttgggtccttccggcgtcgccggagtgaattgatccgggagttgaagagggctgcaaggtgggaagtgaagtcagtgcctcagttgctggtaaggtgtagctgttctgtcccagtccccgtagctctgcaccgagcagaagaggtctagggtcacgcaggggccatggctgaggcacttgggcttggttctggcaggcggagcggacggggctgagagcggggccctacgggcgtaagcgaggttaccctacgcgagtggcgtaaagcgggtttgtaaatgccgcctgccggcttgggcccgaacgcctccaggaagtctcctctaggtgggggcgggaggggaagggcgaggttggcccctggtgccccgggagaggggacagggcggatgtgcctggggtggggtcctttgaaggtgtggcttcggaccgagagctttctcctctaaatcttggtctcttgtttggaagtgactaacagcattttggcatgagaaagccctaaaaagatcagtgtgttttttgtgtccaattcttttatcaccaaaaaagagaagaaatattgcagtgaatgaagattcctctgcattttagcactgctttttcaactgtagttggcttttgaatgaggatgacaatggaagagatgaagaatgaagctgagaccacatccatggtttctatgcccctctatgcagtcatgtatcctgtgtttaatgagctagaacgagtaaatctgtctgcagcccagacactgagagccgctttcatcaaggctgaaaaagaaaatccaggtctcacacaagacatcattatgaaaattttagagaaaaaaagcgtggaagttaacttcacggagtcccttcttcgtatggcagctgatgatgtagaagagtatatgattgaacgaccagagccagaattccaagacctaaacgaaaaggcacgagcacttaaacaaattctcagtaagatcccagatgagatcaatgacagagtgaggtttctgcagacaatcaaggatatagctagtgcaataaaagaacttcttgatacagtgaataatgtcttcaagaaatatcaataccagaaccgcagggcacttgaacaccaaaagaaagaatttgtaaagtactccaaaagtttcagtgatactctgaaaacgtattttaaagatggcaaggcaataaatgtgttcgtaagtgccaaccgactaattcatcaaaccaacttaatacttcagaccttcaaaactgtggcctgaaagttgtatatgttaagagatgtacttctcagtggcagtattgaactgcctttatctgtaaattttaaagtttgactgtataaattatcagtccctcctgaagggatctaatccaggatgttgaatgggattattgccatcttacaccatatttttgtaaaatgtagcttaatcataatctcacactgaagattttgcatcacttttgctattatcattcttttaagaattataagccaaaagaatttacgccttaatgtgtcattatataacattccttaaaagaattgtaaatattggtgtttgtttctgacattttaacttgaaagcgatatgctgcaagataatgtatttaacaatatttggtggcaaatattcaataaatagtttacatctgttaaacatttctttacttgaaaaaa

SEQ ID NO: 25114 - DNA, 1904 bp, Homo sapiens
tgcacgactccggctgggcaggattccggacaacgcctggttcctcttgggtccttccggcgtcgccggagtgaattgatccgggagttgaagagggctgcaaggtgggaagtgaagtcagtgcctcagttgctggtaaggtgtagctgttctgtcccagtccccgtagctctgcaccgagcagaagaggtctagggtcacgcaggggccatggctgaggcacttgggcttggttctggcaggcggagcggacggggctgagagcggggccctacgggcgtaagcgaggttaccctacgcgagtggcgtaaagcgggtttgtaaatgccgcctgccggcttgggcccgaacgcctccaggaagtctcctctaggtgggggcgggaggggaagggcgaggttggcccctggtgccccgggagaggggacagggcggatgtgcctggggtggggtcctttgaaggtgtggcttcggaccgagaggtgaggctgctgttttccccctgctttgtaagtaagagaaaagggaggaggaaggaaagggtgcttgggagtcggctcttgggggtgactcgggttatgccctttgagggaagaggagcactggaagaaggaagagacaaatgttggggtctacggattcagttccagtttaatgatgtggccctctaaggagataattttgccttaaacagaaagacttgaccctcttaggtgtcatacctaagatcagtgtgttttttgtgtccaattcttttatcaccaaaaaagagaagaaatattgcagtgaatgaagattcctctgcattttagcactgctttttcaactgtagttggcttttgaatgaggatgacaatggaagagatgaagaatgaagctgagaccacatccatggtttctatgcccctctatgcagtcatgtatcctgtgtttaatgagctagaacgagtaaatctgtctgcagcccagacactgagagccgctttcatcaaggctgaaaaagaaaatccaggtctcacacaagacatcattatgaaaattttagagaaaaaaagcgtggaagttaacttcacggagtcccttcttcgtatggcagctgatgatgtagaagagtatatgattgaacgaccagagccagaattccaagacctaaacgaaaaggcacgagcacttaaacaaattctcagtaagatcccagatgagatcaatgacagagtgaggtttctgcagacaatcaaggatatagctagtgcaataaaagaacttcttgatacagtgaataatgtcttcaagaaatatcaataccagaaccgcagggcacttgaacaccaaaagaaagaatttgtaaagtactccaaaagtttcagtgatactctgaaaacgtattttaaagatggcaaggcaataaatgtgttcgtaagtgccaaccgactaattcatcaaaccaacttaatacttcagaccttcaaaactgtggcctgaaagttgtatatgttaagagatgtacttctcagtggcagtattgaactgcctttatctgtaaattttaaagtttgactgtataaattatcagtccctcctgaagggatctaatccaggatgttgaatgggattattgccatcttacaccatatttttgtaaaatgtagcttaatcataatctcacactgaagattttgcatcacttttgctattatcattcttttaagaattataagccaaaagaatttacgccttaatgtgtcattatataacattccttaaaagaattgtaaatattggtgtttgtttctgacattttaacttgaaagcgatatgctgcaagataatgtatttaacaatatttggtggcaaatattcaataaatagtttacatctgttaaacatttctttacttgaaaaaa

SEQ ID NO: 25115 - DNA, 1659 bp, Homo sapiens
tgcacgactccggctgggcaggattccggacaacgcctggttcctcttgggtccttccggcgtcgccggagtgaattgatccgggagttgaagagggctgcaaggtgggaagtgaagtcagtgcctcagttgctggtaaggtgtagctgttctgtcccagtccccgtagctctgcaccgagcagaagaggtctagggtcacgcaggggccatggctgaggcacttgggcttggttctggcaggcggagcggacggggctgagagcggggccctacgggcgtaagcgaggttaccctacgcgagtggcgtaaagcgggtttgtaaatgccgcctgccggcttgggcccgaacgcctccaggaagtctcctctaggtgggggcgggaggggaagggcgaggttggcccctggtgccccgggagaggggacagggcggatgtgcctggggtggggtcctttgaaggtgtggcttcggaccgagagatcagtgtgttttttgtgtccaattcttttatcaccaaaaaagagaagaaatattgcagtgaatgaagattcctctgcattttagcactgctttttcaactgtagttggcttttgaatgaggatgacaatggaagagatgaagaatgaagctgagaccacatccatggtttctatgcccctctatgcagtcatgtatcctgtgtttaatgagctagaacgagtaaatctgtctgcagcccagacactgagagccgctttcatcaaggctgaaaaagaaaatccaggtctcacacaagacatcattatgaaaattttagagaaaaaaagcgtggaagttaacttcacggagtcccttcttcgtatggcagctgatgatgtagaagagtatatgattgaacgaccagagccagaattccaagacctaaacgaaaaggcacgagcacttaaacaaattctcagtaagatcccagatgagatcaatgacagagtgaggtttctgcagacaatcaaggatatagctagtgcaataaaagaacttcttgatacagtgaataatgtcttcaagaaatatcaataccagaaccgcagggcacttgaacaccaaaagaaagaatttgtaaagtactccaaaagtttcagtgatactctgaaaacgtattttaaagatggcaaggcaataaatgtgttcgtaagtgccaaccgactaattcatcaaaccaacttaatacttcagaccttcaaaactgtggcctgaaagttgtatatgttaagagatgtacttctcagtggcagtattgaactgcctttatctgtaaattttaaagtttgactgtataaattatcagtccctcctgaagggatctaatccaggatgttgaatgggattattgccatcttacaccatatttttgtaaaatgtagcttaatcataatctcacactgaagattttgcatcacttttgctattatcattcttttaagaattataagccaaaagaatttacgccttaatgtgtcattatataacattccttaaaagaattgtaaatattggtgtttgtttctgacattttaacttgaaagcgatatgctgcaagataatgtatttaacaatatttggtggcaaatattcaataaatagtttacatctgttaaacatttctttacttgaaaaaa

SEQ ID NO: 25116 - DNA, 1281 bp, Homo sapiens
tgcacgactccggctgggcaggattccggacaacgcctggttcctcttgggtccttccggcgtcgccggagtgaattgatccgggagttgaagagggctgcaagatcagtgtgttttttgtgtccaattcttttatcaccaaaaaagagaagaaatattgcagtgaatgaagattcctctgcattttagcactgctttttcaactgtagttggcttttgaatgaggatgacaatggaagagatgaagaatgaagctgagaccacatccatggtttctatgcccctctatgcagtcatgtatcctgtgtttaatgagctagaacgagtaaatctgtctgcagcccagacactgagagccgctttcatcaaggctgaaaaagaaaatccaggtctcacacaagacatcattatgaaaattttagagaaaaaaagcgtggaagttaacttcacggagtcccttcttcgtatggcagctgatgatgtagaagagtatatgattgaacgaccagagccagaattccaagacctaaacgaaaaggcacgagcacttaaacaaattctcagtaagatcccagatgagatcaatgacagagtgaggtttctgcagacaatcaaggatatagctagtgcaataaaagaacttcttgatacagtgaataatgtcttcaagaaatatcaataccagaaccgcagggcacttgaacaccaaaagaaagaatttgtaaagtactccaaaagtttcagtgatactctgaaaacgtattttaaagatggcaaggcaataaatgtgttcgtaagtgccaaccgactaattcatcaaaccaacttaatacttcagaccttcaaaactgtggcctgaaagttgtatatgttaagagatgtacttctcagtggcagtattgaactgcctttatctgtaaattttaaagtttgactgtataaattatcagtccctcctgaagggatctaatccaggatgttgaatgggattattgccatcttacaccatatttttgtaaaatgtagcttaatcataatctcacactgaagattttgcatcacttttgctattatcattcttttaagaattataagccaaaagaatttacgccttaatgtgtcattatataacattccttaaaagaattgtaaatattggtgtttgtttctgacattttaacttgaaagcgatatgctgcaagataatgtatttaacaatatttggtggcaaatattcaataaatagtttacatctgttaaacatttctttacttgaaaaaa

SEQ ID NO: 25117 - DNA, 873 bp, Homo sapiens
  misc_feature (805)..(805): n is a, c, g, or t
  misc_feature (807)..(807): n is a, c, g, or t
  misc_feature (815)..(815): n is a, c, g, or t
  misc_feature (817)..(817): n is a, c, g, or t
  misc_feature (850)..(850): n is a, c, g, or t
tgcacgactccggctgggcaggattccggacaacgcctggttcctcttgggtccttccggcgtcgccggagtgaattgatccgggagttgaagagggctgcaaggtgggaagtgaagtcagtgcctcagttgctgctttctcctctaaatcttggtctcttgtttggaagtgactaacagcattttggcatgagaaagccctaaaaagatcagtgtgttttttgtgtccaattcttttatcaccaaaaaagagaagaaatattgcagtgaatgaagattcctctgcattttagcactgctttttcaactgtagttggcttttgaatgaggatgacaatggaagagatgaagaatgaagctgagaccacatccatggtttctatgcccctctatgcagtcatgtatcctgtgtttaatgagctagaacgagtaaatctgtctgcagcccagacactgagagccgctttcatcaaggctgaaaaagaaaatccaggtctcacacaagacatcattatgaaaattttagagaaaaaaagcgtggaagttaacttcacggagtcccttcttcgtatggcagctgatgatgtagaagagtatatgattgaacgaccagagccagaattccaagacctaaacgaaaaggcacgagcacttaaacaaattctcagtaagatcccagatgagatcaatgacagagtgaggtttctgcagacaatcaaggatatagctagtgcaataaaagaacttcttgatacagtgaataatgtcttcaagaaatatcaataccagaaccgcaggacaccanangaaagaantntgtaaagtactccagttcagtgatactctgccngactattcatcaaacccaactta

SEQ ID NO: 25118 - DNA, 1486 bp, Homo sapiens
ccatcaatctgtaggctgcatcccttctgctaatccagcaaagaccatgcaggtcagtgaggttgtaaatgtcttaaaatccttatgtcaaatcttgatgaagtaaagaaggaaagagagggtctggagaatgacttgaaatctgtgaattttgacatgacaagcaagtttttgacagccctggctcaagatggtgtgataaatgaagaagctctttctgttactgaactagatcgagtctatggaggtcttacaactaaagtccaagaatctctaaagaaacaggagggacttcttaaaaatattcaggtctcacatcaggaattttcgaaaatgaaacaatctaataatgaagctaacttaagagaagaagttttgaagaatttagctactgcatatgacaactttgtgtagttggcttttgaatgaggatgacaatggaagagatgaagaatgaagctgagaccacatccatggtttctatgcccctctatgcagtcatgtatcctgtgtttaatgagctagaacgagtaaatctgtctgcagcccagacactgagagccgctttcatcaaggctgaaaaagaaaatccaggtctcacacaagacatcattatgaaaattttagagaaaaaaagcgtggaagttaacttcacggagtcccttcttcgtatggcagctgatgatgtagaagagtatatgattgaacgaccagagccagaattccaagacctaaacgaaaaggcacgagcacttaaacaaattctcagtaagatcccagatgagatcaatgacagagtgaggtttctgcagacaatcaaggatatagctagtgcaataaaagaacttcttgatacagtgaataatgtcttcaagaaatatcaataccagaaccgcagggcacttgaacaccaaaagaaagaatttgtaaagtactccaaaagtttcagtgatactctgaaaacgtattttaaagatggcaaggcaataaatgtgttcgtaagtgccaaccgactaattcatcaaaccaacttaatacttcagaccttcaaaactgtggcctgaaagttgtatatgttaagagatgtacttctcagtggcagtattgaactgcctttatctgtaaattttaaagtttgactgtataaattatcagtccctcctgaagggatctaatccaggatgttgaatgggattattgccatcttacaccatatttttgtaaaatgtagcttaatcataatctcacactgaagattttgcatcacttttgctattatcattcttttaagaattataagccaaaagaatttacgccttaatgtgtcattatataacattccttaaaagaattgtaaatattggtgtttgtttctgacattttaacttgaaagcgatatgctgcaagataatgtatttaacaatatttggtggcaaatattcaataaatagtttacatctgttaaacatttctttacttgaaaaaa

SEQ ID NO: 25119 - DNA, 1391 bp, Homo sapiens
  misc_feature (1150)..(1150): n is a, c, g, or t
  misc_feature (1156)..(1156): n is a, c, g, or t
  misc_feature (1161)..(1161): n is a, c, g, or t
  misc_feature (1163)..(1163): n is a, c, g, or t
  misc_feature (1389)..(1391): n is a, c, g, or t
tgcacgactccggctgggcaggattccggacaacgcctggttcctcttgggtccttccggcgtcgccggagtgaattgatccgggagttgaagagggctgcaaggtgggaagtgaagtcagtgcctcagttgctggtaaggtgtagctgttctgtcccagtccccgtagctctgcaccgagcagaagaggtctagggtcacgcaggggccatggctgaggcacttgggcttggttctggcaggcggagcggacggggctgagagcggggccctacgggcgtaagcgaggttaccctacgcgagtggcgtaaagcgggtttgtaaatgccgcctgccggcttgggcccgaacgcctccaggaagtctcctctaggtgggggcgggaggggaagggcgaggttggcccctggtgccccgggagaggggacagggcggatgtgcctggggtggggtcctttgaaggtgtggcttcggaccgagagctttctcctctaaatcttggtctcttgtttggaagtgactaacagcattttggcatgagaaagccctaaaaagatcagtgtgttttttgtgtccaattcttttatcaccaaaaaagagaagaaatattgcagtgaatgaagattcctctgcattttagcactgctttttcaactgtagttggcttttgaatgaggatgacaatggaagagatgaagaatgaagctgagaccacatccatggtttctatgcccctctatgcagtcatgtatcctgtgtttaatgagctagaacgagtaaatctgtctgcagcccagacactgagagccgctttcatcaaggctgaaaaagaaaatccaggtctcacacaagacatcattatgaaaattttagagaaaaaaagcgtggaagttaacttcacggagtcccttcttcgtatggcagctgatgatgtagaagagtatatgattgaacgaccagagccagaattccaagacctaaacgaaaaggcacgagcacttaaacaaattctcagtaagatcccagatgagatcaatgacagagtgaggtttctgcagacaatcaaggatatagctagtgcaataaaagaacttcttgatacagtgaataatgtcttcaagaaatatcaataccagaaccgcaggacggnggcatngaacncnaaagaaaaatggagtccccacagttcggaacccgaacggatctaagagcacggcacaagggtccgtggtgcccggaataccaacataacttcgccctaaagggcgaaggtgtttaaaagatccggaaagacacgtagaaaagaggggaaagccccaggacacaggggagcacacaggagggcacacagagaggcgcaacacgccccctaggcgcgtgacaagatannn

SEQ ID NO: 25120 - DNA, 1513 bp, Homo sapiens
tgcacgactccggctgggcaggattccggacaacgcctggttcctcttgggtccttccggcgtcgccggagtgaattgatccgggagttgaagagggctgcaaggtgggaagtgaagtcagtgcctcagttgctgctttctcctctaaatcttggtctcttgtttggaagtgactaacagcattttggcatgagaaagccctaaaaagatcagtgtgttttttgtgtccaattcttttatcaccaaaaaagagaagaaatattgcagtgaatgaagattcctctgcattttagcactgctttttcaactgtagttggcttttgaatgaggatgacaatggaagagatgaagaatgaagctgagaccacatccatggtttctatgcccctctatgcagtcatgtatcctgtgtttaatgagctagaacgagtaaatctgtctgcagcccagacactgagagccgctttcatcaagggcaaaaaggaaagaaaatcatcagcataatgattaaaattggcaggcatcctacaggaaacaaacatcaagtgtgattacagaatttactgggaaaaactgaaatctgaagattaactctggctttggctgaaaaagaaaatccaggtctcacacaagacatcattatgaaaattttagagaaaaaaagcgtggaagttaacttcacggagtcccttcttcgtatggcagctgatgatgtagaagagtatatgattgaacgaccagagccagaattccaagacctaaacgaaaaggcacgagcacttaaacaaattctcagtaagatcccagatgagatcaatgacagagtgaggtttctgcagacaatcaaggatatagctagtgcaataaaagaacttcttgatacagtgaataatgtcttcaagaaatatcaataccagaaccgcagggcacttgaacaccaaaagaaagaatttgtaaagtactccaaaagtttcagtgatactctgaaaacgtattttaaagatggcaaggcaataaatgtgttcgtaagtgccaaccgactaattcatcaaaccaacttaatacttcagaccttcaaaactgtggcctgaaagttgtatatgttaagagatgtacttctcagtggcagtattgaactgcctttatctgtaaattttaaagtttgactgtataaattatcagtccctcctgaagggatctaatccaggatgttgaatgggattattgccatcttacaccatatttttgtaaaatgtagcttaatcataatctcacactgaagattttgcatcacttttgctattatcattcttttaagaattataagccaaaagaatttacgccttaatgtgtcattatataacattccttaaaagaattgtaaatattggtgtttgtttctgacattttaacttgaaagcgatatgctgcaagataatgtatttaacaatatttggtggcaaatattcaataaatagtttacatctgttaaacatttctttacttgaaaaaa

SEQ ID NO: 25121 - DNA, 1765 bp, Homo sapiens
tgcacgactccggctgggcaggattccggacaacgcctggttcctcttgggtccttccggcgtcgccggagtgaattgatccgggagttgaagagggctgcaaggtgggaagtgaagtcagtgcctcagttgctggtaaggtgtagctgttctgtcccagtccccgtagctctgcaccgagcagaagaggtctagggtcacgcaggggccatggctgaggcacttgggcttggttctggcaggcggagcggacggggctgagagcggggccctacgggcgtaagcgaggttaccctacgcgagtggcgtaaagcgggtttgtaaatgccgcctgccggcttgggcccgaacgcctccaggaagtctcctctaggtgggggcgggaggggaagggcgaggttggcccctggtgccccgggagaggggacagggcggatgtgcctggggtggggtcctttgaaggtgtggcttcggaccgagaggtgaggctgctgttttccccctgctttgtaagtaagagaaaagggaggaggaaggaaagggtgcttgggagtcggctcttgggggtgactcgggttatgccctttgagggaagaggagcactggaagaaggaagagacaaatgttggggtctacggattcagttccagtttaatgatgtggccctctaaggagataattttgccttaaacagaaagacttgaccctcttaggtgtcatacctaagctttctcctctaaatcttggtctcttgtttggaagtgactaacagcattttggcatgagaaagccctaaaaagctagaacgagtaaatctgtctgcagcccagacactgagagccgctttcatcaaggctgaaaaagaaaatccaggtctcacacaagacatcattatgaaaattttagagaaaaaaagcgtggaagttaacttcacggagtcccttcttcgtatggcagctgatgatgtagaagagtatatgattgaacgaccagagccagaattccaagacctaaacgaaaaggcacgagcacttaaacaaattctcagtaagatcccagatgagatcaatgacagagtgaggtttctgcagacaatcaaggatatagctagtgcaataaaagaacttcttgatacagtgaataatgtcttcaagaaatatcaataccagaaccgcagggcacttgaacaccaaaagaaagaatttgtaaagtactccaaaagtttcagtgatactctgaaaacgtattttaaagatggcaaggcaataaatgtgttcgtaagtgccaaccgactaattcatcaaaccaacttaatacttcagaccttcaaaactgtggcctgaaagttgtatatgttaagagatgtacttctcagtggcagtattgaactgcctttatctgtaaattttaaagtttgactgtataaattatcagtccctcctgaagggatctaatccaggatgttgaatgggattattgccatcttacaccatatttttgtaaaatgtagcttaatcataatctcacactgaagattttgcatcacttttgctattatcattcttttaagaattataagccaaaagaatttacgccttaatgtgtcattatataacattccttaaaagaattgtaaatattggtgtttgtttctgacattttaacttgaaagcgatatgctgcaagataatgtatttaacaatatttggtggcaaatattcaataaatagtttacatctgttaaacatttctttacttgaaaaaa

SEQ ID NO: 25122 - DNA, 1233 bp, Homo sapiens
tgcacgactccggctgggcaggattccggacaacgcctggttcctcttgggtccttccggcgtcgccggagtgaattgatccgggagttgaagagggctgcaaggtgggaagtgaagtcagtgcctcagttgctgatcagtgtgttttttgtgtccaattcttttatcaccaaaaaagagaagaaatattgcagtgaatgaagattcctctgcattttagcactgctttttcaactgtagttggcttttgaatgaggatgacaatggaagagatgaagaatgaagctgagaccacatccatggtttctatgcccctctatgcagtcatgtatcctgtgtttaatgagctagaacgagtaaatctgtctgcagcccagacactgagagccgctttcatcaaggctgaaaaagaaaatccaggtctcacacaagacatcattatgaaaattttagagaaaaaaagcgtggaagttaacttcacggagtcccttcttcgtatggcagctgatgatgtagaagagtatatgattgaacgaccagagccagaattccaagacctaaacgaaaaggcacgagcacttaaacaaattctcagtaagatcccagatgagatcaatgacagagtgaggtttctgcagacaatcaagcacttgaacaccaaaagaaagaatttgtaaagtactccaaaagtttcagtgatactctgaaaacgtattttaaagatggcaaggcaataaatgtgttcgtaagtgccaaccgactaattcatcaaaccaacttaatacttcagaccttcaaaactgtggcctgaaagttgtatatgttaagagatgtacttctcagtggcagtattgaactgcctttatctgtaaattttaaagtttgactgtataaattatcagtccctcctgaagggatctaatccaggatgttgaatgggattattgccatcttacaccatatttttgtaaaatgtagcttaatcataatctcacactgaagattttgcatcacttttgctattatcattcttttaagaattataagccaaaagaatttacgccttaatgtgtcattatataacattccttaaaagaattgtaaatattggtgtttgtttctgacattttaacttgaaagcgatatgctgcaagataatgtatttaacaatatttggtggcaaatattcaataaatagtttacatctgttaaacatttctttacttgaaaaaa

SEQ ID NO: 25123 - DNA, 821 bp, Homo sapiens
gggcgttctagaggatcccgggcagaagagtatatgattgaacgaccagagccagaattccaagacctaaacgaaaaggcacgagcacttaaacaaattctcagtaagatcccagatgagatcaatgacagagtgaggtttctgcagacaatcaaggatatagctagtgcaataaaagaacttcttgatacagtgaataatgtcttcaagaaatatcaataccagaaccgcagggcacttgaacaccaaaagaaagaatttgtaaagtactccaaaagtttcagtgatactctgaaaacgtattttaaagatggcaaggcaataaatgtgttcgtaagtgccaaccgactaattcatcaaaccaacttaatacttcagaccttcaaaactgtggcctgaaagttgtatatgttaagagatgtacttctcagtggcagtattgaactgcctttatctgtaaattttaaagtttgactgtataaattatcagtccctcctgaagggatctaatccaggatgttgaatgggattattgccatcttacaccatatttttgtaaaatgtagcttaatcataatctcacactgaagattttgcatcacttttgctattatcattcttttaagaattataagccaaaagaatttacgccttaatgtgtcattatataacattccttaaaagaattgtaaatattggtgtttgtttctgacattttaacttgaaagcgatatgctgcaagataatgtatttaacaatatttggtggcaaatattcaataaatagtttacatctgttaaacatttctttacttgaaaaaa

SEQ ID NO: 25124 - DNA, 764 bp, Homo sapiens
tgcacgactccggctgggcaggattccggacaacgcctggttcctcttgggtccttccggcgtcgccggagtgaattgatccgggagttgaagagggctgcaaggtgggaagtgaagtcagtgcctcagttgctgctttctcctctaaatcttggtctcttgtttggaagtgactaacagcattttggcatgagaaagccctaaaaagatcagtgtgttttttgtgtccaattcttttatcaccaaaaaagagaagaaatattgcagtgaatgaagattcctctgcattttagcactgctttttcaactgtagttggcttttgaatgaggatgacaatggaagagatgaagaatgaagctgagaccacatccatggtttctatgcccctctatgcagtcatgtatcctgtgtttaatgagctagaacgagtaaatctgtctgcagcccagacactgagagccgctttcatcaaggctgaaaaagaaaatccaggtctcacacaagacatcattatgaaaattttagagaaaaaaagcgtggaagttaacttcacggagtcccttcttcgtatggcagctgatgatgtagaagagtatatgattgaacgaccagagccagaattccaagacctaaacgaaaaggcacgagcacttaaacaaattctcagtaagatcccagatgagatcaatgacagagtgaggtttctgcagacaatcaaaggggcggaacagcagagaggggcggagcaggggtaccgagctcg

SEQ ID NO: 25125 - DNA, 1205 bp, Homo sapiens
  misc_feature (125)..(125): n is a, c, g, or t
aaccgtgcatagtatcgcaaggtagtaacacccgtatacctgctgcatagatgaaatcagctacacataagtttgtcaggggatccaaagtttacaaccctgtaaatcagccgagactagataangaaatatctgaaagatgagactagaacccagtcctactgtcagtaataatcaatgggtaagatcaattaggtataggctattgaattgagggatgactgtgggatggactagtgtatgtcctgagattgaatacttaacatccatgtttatctttggccctctgatgccgtctatgtatcctgtgtttaatgagctagaacgagtaaatctgtctgcagcccagacactgagagccgctttcatcaaggctgaaaaagaaaatccaggtctcacacaagacatcattatgaaaattttagagaaaaaaagcgtggaagttaacttcacggagtcccttcttcgtatggcagctgatgatgtagaagagtatatgattgaacgaccagagccagaattccaagacctaaacgaaaaggcacgagcacttaaacaaattctcagtaagatcccagatgagatcaatgacagagtgaggtttctgcagacaatcaagcacttgaacaccaaaagaaagaatttgtaaagtactccaaaagtttcagtgatactctgaaaacgtattttaaagatggcaaggcaataaatgtgttcgtaagtgccaaccgactaattcatcaaaccaacttaatacttcagaccttcaaaactgtggcctgaaagttgtatatgttaagagatgtacttctcagtggcagtattgaactgcctttatctgtaaattttaaagtttgactgtataaattatcagtccctcctgaagggatctaatccaggatgttgaatgggattattgccatcttacaccatatttttgtaaaatgtagcttaatcataatctcacactgaagattttgcatcacttttgctattatcattcttttaagaattataagccaaaagaatttacgccttaatgtgtcattatataacattccttaaaagaattgtaaatattggtgtttgtttctgacattttaacttgaaagcgatatgctgcaagataatgtatttaacaatatttggtggcaaatattcaataaatagtttacatctgttaaacatttctttacttgaaaaaa

SEQ ID NO: 25126 - DNA, 1380 bp, Homo sapiens
tgcacgactccggctgggcaggattccggacaacgcctggttcctcttgggtccttccggcgtcgccggagtgaattgatccgggagttgaagagggctgcaaggtgggaagtgaagtcagtgcctcagttgctggtaaggtgtagctgttctgtcccagtccccgtagctctgcaccgagcagaagaggtctagggtcacgcaggggccatggctgaggcacttgggcttggttctggcaggcggagcggacggggctgagagcggggccctacgggcgtaagcgaggttaccctacgcgagtggcgtaaagcgggtttgtaaatgccgcctgccggcttgggcccgaacgcctccaggaagtctcctctaggtgggggcgggaggggaagggcgaggttggcccctggtgccccgggagaggggacagggcggatgtgcctggggtggggtcctttgaaggtgtggcttcggaccgagaggtgaggctgctgttttccccctgctttctttctcctctaaatcttggtctcttgtttggaagtgactaacagcattttggcatgagaaagccctaaaaagatcagtgtgttttttgtgtccaattcttttatcaccaaaaaagagaagaaatattgcagtgaatgaagattcctctgcattttagcactgctttttcaactgtagttggcttttgaatgaggatgacaatggaagagatgaagaatgaagctgagaccacatccatggtttctatgcccctctatgcagtcatgtatcctgtgtttaatgagctagaacgagtaaatctgtctgcagcccagacactgagagccgctttcatcaaggctgaaaaagaaaatccaggtctcacacaagacatcattatgaaaattttagagaaaaaaagcgtggaagttaacttcacggagtcccttcttcgtatggcagctgatgatgtagaagagtatatgattgaacgaccagagccagaattccaagacctaaacgaaaaggcacgagcacttaaacaaattctcagtaagatcccagatgagatcaatgacagagtgaggtttctgcagacaatcaaggatatagctagttgcacataaaaaagaaacttcttgataccaggtggaataagttgtctttcacaggaaaattatcaattacccagaacccggcagggcacttggaacaccgcacaaaggaaaggaatttgggtagacagttacttcccaaacagtttccaggtggatacctcctgggaaacggtaatttttaacagaatgggcagggggcactaactgtgttttcgaaagttgcccaaccgaattaagtttgattcaagagccacgtttaattatcttccggaac

SEQ ID NO: 25127 - DNA, 615 bp, Homo sapiens
ggttggcaacctttggtcagcagtgcaagagaatcaggattacagaggggtataggctaaaatccccactccaaccagctagccgaaaaggctggctgttcttgaagtgattgcgcttaacataattaagagtgtactgtgattagattaagagtgtacttaatttctttcaaatgtagctgatgttcttttctctcacaaatttctttcaaatgtagctgatattctttattcttttcccaacaggatatagctagtgcaataaaagaacttcttgatacagtgaataatgtcttcaagaaatatcaataccagaaccgcaggggtacgtttagtagaagccttgctagttgacaccctagatgttggtttatgcctagttgttttattgacttaaaaataagattgattgttggaaatagttttgtgtcattaaccattgagtttattcttgaatttaaatatgcctttttatttaaaagtgagtactccacaattgcttattagtaatattcatataaagtgcatcccatatcctgtgtaatctcttgtccttgcctttggcttttgtgattatttctcttatttagtactttatttcttattatattttgt

SEQ ID NO: 25128 - DNA, 1521 bp, Homo sapiens
tgcacgactccggctgggcaggattccggacaacgcctggttcctcttgggtccttccggcgtcgccggagtgaattgatccgggagttgaagagggctgcaaggtgggaagtgaagtcagtgcctcagttgctggaagaggagcactggaagaaggaagagacaaatgttggggtctacggattcagttccagtttaatgatgtggccctctaaggagataattttgccttaaacagaaagacttgaccctcttaggtgtcatacctaagctttctcctctaaatcttggtctcttgtttggaagtgactaacagcattttggcatgagaaagccctaaaaagatcagtgtgttttttgtgtccaattcttttatcaccaaaaaagagaagaaatattgcagtgaatgaagattcctctgcattttagcactgctttttcaactgtagttggcttttgaatgaggatgacaatggaagagatgaagaatgaagctgagaccacatccatggtttctatgcccctctatgcagtcatgtatcctgtgtttaatgagctagaacgagtaaatctgtctgcagcccagacactgagagccgctttcatcaaggctgaaaaagaaaatccaggtctcacacaagacatcattatgaaaattttagagaaaaaaagcgtggaagttaacttcacggagtcccttcttcgtatggcagctgatgatgtagaagagtatatgattgaacgaccagagccagaattccaagacctaaacgaaaaggcacgagcacttaaacaaattctcagtaagatcccagatgagatcaatgacagagtgaggtttctgcagacaatcaaggatatagctagtgcaataaaagaacttcttgatacagtgaataatgtcttcaagaaatatcaataccagaaccgcagggcacttgaacaccaaaagaaagaatttgtaaagtactccaaaagtttcagtgatactctgaaaacgtattttaaagatggcaaggcaataaatgtgttcgtaagtgccaaccgactaattcatcaaaccaacttaatacttcagaccttcaaaactgtggcctgaaagttgtatatgttaagagatgtacttctcagtggcagtattgaactgcctttatctgtaaattttaaagtttgactgtataaattatcagtccctcctgaagggatctaatccaggatgttgaatgggattattgccatcttacaccatatttttgtaaaatgtagcttaatcataatctcacactgaagattttgcatcacttttgctattatcattcttttaagaattataagccaaaagaatttacgccttaatgtgtcattatataacattccttaaaagaattgtaaatattggtgtttgtttctgacattttaacttgaaagcgatatgctgcaagataatgtatttaacaatatttggtggcaaatattcaataaatagtttacatctgttaaacatttctttacttgaaaaaa

SEQ ID NO: 25129 - DNA, 1323 bp, Homo sapiens
tgcacgactccggctgggcaggattccggacaacgcctggttcctcttgggtccttccggcgtcgccggagtgaattgatccgggagttgaagagggctgcaaggtgggaagtgaagtcagtgcctcagttgctgctttctcctctaaatcttggtctcttgtttggaagtgactaacagcattttggcatgagaaagccctaaaaagatcagtgtgttttttgtgtccaattcttttatcaccaatgtagttggcttttgaatgaggatgacaatggaagagatgaagaatgaagctgagaccacatccatggtttctatgcccctctatgcagtcatgtatcctgtgtttaatgagctagaacgagtaaatctgtctgcagcccagacactgagagccgctttcatcaaggctgaaaaagaaaatccaggtctcacacaagacatcattatgaaaattttagagaaaaaaagcgtggaagttaacttcacggagtcccttcttcgtatggcagctgatgatgtagaagagtatatgattgaacgaccagagccagaattccaagacctaaacgaaaaggcacgagcacttaaacaaattctcagtaagatcccagatgagatcaatgacagagtgaggtttctgcagacaatcaaggatatagctagtgcaataaaagaacttcttgatacagtgaataatgtcttcaagaaatatcaataccagaaccgcagggcacttgaacaccaaaagaaagaatttgtaaagtactccaaaagtttcagtgatactctgaaaacgtattttaaagatggcaaggcaataaatgtgttcgtaagtgccaaccgactaattcatcaaaccaacttaatacttcagaccttcaaaactgtggcctgaaagttgtatatgttaagagatgtacttctcagtggcagtattgaactgcctttatctgtaaattttaaagtttgactgtataaattatcagtccctcctgaagggatctaatccaggatgttgaatgggattattgccatcttacaccatatttttgtaaaatgtagcttaatcataatctcacactgaagattttgcatcacttttgctattatcattcttttaagaattataagccaaaagaatttacgccttaatgtgtcattatataacattccttaaaagaattgtaaatattggtgtttgtttctgacattttaacttgaaagcgatatgctgcaagataatgtatttaacaatatttggtggcaaatattcaataaatagtttacatctgttaaacatttctttacttgaaaaaa

SEQ ID NO: 25130 - DNA, 866 bp, Homo sapiens
tgcacgactccggctgggcaggattccggacaacgcctggttcctcttgggtccttccggcgtcgccggagtgaattgatccgggagttgaagagggctgcaaggtgggaagtgaagtcagtgcctcagttgctgaaagacttgaccctcttaggtgtcatacctaagatcagtgtgttttttgtgtccaattcttttatcaccaaaaaagagaagaaatattgcagtgaatgaagattcctctgcattttagcactgctttttcaactgtagttggcttttgaatgaggatgacaatggaagagatgaagaatgaagctgagaccacatccatggtttctatgcccctctatgcagtcatgtatcctgtgtttaatgagctagaacgagtaaatctgtctgcagcccagacactgagagccgctttcatcaaggctgaaaaagaaaatccaggtctcacacaagacatcattatgaaaattttagagaaaaaaagcgtggaagttaacttcacggagtcccttcttcgtatggcagctgatgatgtagaagagtatatgattgaacgaccagagccagaattccaagacctaaacgaaaaggcacgagcacttaaacaaattctcagtaagatcccagatgagatcaatgacagagtgaggtttctgcagacaatcaaggatatagctagtgcaataaaagaacttcttgatacagtgaataatgtcttcaagaaatatcaataccagaaccgcagggcacttgaacaccaaaagaaagaatttgtaaagtactccaaaagtttcagtgatactctgaaaacgtattttaaagatggcaagtaagtactgtaatttatcctttac

SEQ ID NO: 25131 - DNA, 1240 bp, Homo sapiens
tgcacgactccggctgggcaggattccggacaacgcctggttcctcttgggtccttccggcgtcgccggagtgaattgatccgggagttgaagagggctgcaaggtgggaagtgaagtcagtgcctcagttgctgtgtagttggcttttgaatgaggatgacaatggaagagatgaagaatgaagctgagaccacatccatggtttctatgcccctctatgcagtcatgtatcctgtgtttaatgagctagaacgagtaaatctgtctgcagcccagacactgagagccgctttcatcaaggctgaaaaagaaaatccaggtctcacacaagacatcattatgaaaattttagagaaaaaaagcgtggaagttaacttcacggagtcccttctcctttcgataactggggccaaggccccttgcactgcactgctacgaaacgcagcagtatatgattgaacgaccagagccagaattccaagacctaaacgaaaaggcacgagcacttaaacaaattctcagtaagatcccagatgagatcaatgacagagtgaggtttctgcagacaatcaaggatatagctagtgcaataaaagaacttcttgatacagtgaataatgtcttcaagaaatatcaataccagaaccgcagggcacttgaacaccaaaagaaagaatttgtaaagtactccaaaagtttcagtgatactctgaaaacgtattttaaagatggcaaggcaataaatgtgttcgtaagtgccaaccgactaattcatcaaaccaacttaatacttcagaccttcaaaactgtggcctgaaagttgtatatgttaagagatgtacttctcagtggcagtattgaactgcctttatctgtaaattttaaagtttgactgtataaattatcagtccctcctgaagggatctaatccaggatgttgaatgggattattgccatcttacaccatatttttgtaaaatgtagcttaatcataatctcacactgaagattttgcatcacttttgctattatcattcttttaagaattataagccaaaagaatttacgccttaatgtgtcattatataacattccttaaaagaattgtaaatattggtgtttgtttctgacattttaacttgaaagcgatatgctgcaagataatgtatttaacaatatttggtggcaaatattcaataaatagtttacatctgttaaacatttctttacttgaaaaaa

SEQ ID NO: 25132 - DNA, 237 bp, Homo sapiens
tttttagtagagacgggatttcaccatgttggccaggctggtctcaaactcctaacctcaagtgatccaccggccttggcctcccaaagtggtacgattacaggcatgatgcacggtgccaggccagcagagttgtttgtttgcttaaaatatcctatttacagctgggcatggtggctcacgcctgcaatcccagtactttgggaggccgaggtgggcgaatcgcgaggtcaggag

SEQ ID NO: 25133 - DNA, 388 bp, Homo sapiens
actctagaggtttactcatttttctgcattatctcccatgtgtacaggaagtatacatgttattaagcttttgtttgctttcccttgttaatctaccttttgttacagggagtcccagctaaaaattcttgaagagtgaaggagaagattatttttttccccctacagaaataagttttatcaggataaactgcagttatagctgcaagccttattaggagagaatcaaaaaagagggagttaattaacatggtcaataaagttggaaaaagatcccagccagattcacaaaggcaaagtggagcagtgctcataactctcaacctgtaggttaaaattacctagtgatcttactaaaatgcagaatctgattcagtaggtctgggtc

SEQ ID NO: 25134 - DNA, 227 bp, Homo sapiens
tggaatggaagggaggttcttctgtttttctaagaattcagagaaaggagaaaaggagaagtgagagtgaagacataataaaaatttcagattgtgaaggggaaaatttatggaaaccattcctctgcgtgagagttttagaattcgctttggggcttaaaaagtggagaaaggtttagagctgcccttatggaaatgagataggaaatgaccttgatgaatgatgg

SEQ ID NO: 25135 - DNA, 209 bp, Homo sapiens
gggctttaggtctcagttttccttttctggaacaggaaaagggagatctgcctgtcaccctcctttccagcctgctttcagtattctcaagctgaagcatttgagcaggaagaacatggaccactgcagcgctgcctccatggggcattgctaccctgacctgcttcatgcacttccccaaaatagctccaaatcatgcttgcttcctg

SEQ ID NO: 25136 - DNA, 287 bp, Homo sapiens
gatccaactgtatggcttctgaggtgtcttctggtaagtctgtgttttgtgacttttagggaaaccacctaatgtttttgaatttgctttttcttaactacactgggaaatacggtggattcattctggtacagtggatctccaccttagctgtactttagaatctcctaggtagattttttttaagtgtgcagtctatgtatatgagtgtgcgtgtgtgcacacacacagccagagttgagacacactagcctagaaatgtccaagagccagtgagtatattaaga

SEQ ID NO: 25137 - DNA, 808 bp, Homo sapiens
tgggagtgggtctctatttcttttctgcaatttacatttaaagcagagtttaccctggaattctgaaggtttcggtgttgaggtatggtttgcattttagaaattcattttggaaatgtgaagatgtcttctatgcggcttgaaagcccgtctgacgttcacaagctgtatggctcaggtcttcagtgcctgaaggttatacagcaaacccaccttgactttgacttcggagtcttttcctcctgaagccaaatctgtttcagcattctggtctcgttaattctcatggtgacagtatattaatatgagccaaagagaaaataaaattcactgaaagaaaataaggctgagcctcattacgcctgtaatcccagcactttgggaggccgaggcgggtggatcatctgaggtcaggagttcaagaccagcctggccaacatggtgaaacccccgtctctacgaaaaatacaaaaattagccaggagtggtggcacacgcctgtaatcccagctactctggtggctgaggcaggaaaatctcttgaacctgggaggctgaggttgcagtgagctgagattgcgccactgcactccagcctgggcgacagagtgagactccatctcaaaaaaaaaaaaaaagagagaaaatgagaataaataagcagccattccacctcttgggtcaaagcttccaaatttgctttttctccaaggagtggcagccacagcaaaacatcttctgcagcgtctggccagggcgttactccagcccagttttgccctggactagattgagtcaggtcgtgcat

SEQ ID NO: 25138 - DNA, 388 bp, Homo sapiens
tacgattttactttttgaatacactgactctaaacatattttaatccacatgttaagccatctcaaataatttcttttaaacttccatagaattttatagaaagttgaagttacactgtgtgatattggaaagacacttgtccatttgttgaacagacattcattatgtgccaggctttgagctggaaagtacaagtcaagtaacaagtcactgtctttgaataacttacatctgttctaggagagaaataaatgatttatttcagtggaccttctgcattctgaattattctgtaaaataaagaataattcatacctacttgaatttttaatagctatttgaatcaaaatattaaaaatggaagggcccttaaagatcatgtaattc

SEQ ID NO: 25139 - DNA, 239 bp, Homo sapiens
cacttatgcccatgcaacgtcatttggtggtaactgaaatacgatacattgatttttaatttctaaagctcttctagataaaggcagcaacatcgatcttcaaaagatgttttaaactagaggttaggccgggcgcggtggctcacgcctgtaatcccagcactttgggaggccgaggcgggcgtatcacaagggctggagatcgagaccatcctggctaacacagtgaaaccccgtct

SEQ ID NO: 25140 - DNA, 408 bp, Homo sapiens
gagcaaaatccttaccaaggtcaccatgggatttgattcctaagtcctcagtcttcactattctaagttattgacttgctcatctaaatccaacctaaattcaaatgcatgttgctggtttgatcagaatcaagaaatttgcttactctgcaattagtcatcggatttgcctctgaacatgtatgtagagatggttcactcttttgtactggtaaaggctgaagacaaaaagaaaatctcaccttttgtcccttgaaagaaaaagcttttcccattccagaagaccatggtatagtttccttaaaaactagctgtgtttcaaactcaaatgactcttgctgtggttgatgaaaagcacaatattccttctctcttcctgtaggaatgcagaaataggaaaacagaaag

SEQ ID NO: 25141 - DNA, 739 bp, Homo sapiens
cttgtgtatggtggtttaggggaatttaaaaggaaagatggcagtttttatataaagcaactgacatactgtctccatacgtgcttcaagttgtttttgcaacaagggtggtgatttacgtagaaccgtcagtggttcagagctgctgtaacaaaggtaactctaaagccagttaacctccatggggatcagtcagacccatcattgttcctgtcttgacctctgtgctctaataaacttccctaaatactactttagctgctgtgtgttatatctacattaatagctaaattagcctgaaggcctaattaatattcagtgtaatttaatacagggaaacaggcccctcttctcaaccctttatagtatgaagaaattttaaattaccctggtcagtgaacaaactccctctgtcaaatatagtcatgatagacctggcacaatgtagggactatggggagtgttagaggatcaaagacagaattggggaaggggtatagttactggatgttacttgttctgtgagagatgtgtggatgttctataagaaaataataatgttttttgtttgtatttaaaactagatagctgtttattggcacccttttagttggataagagaaaatacattgcttggtttctacaagtgagtcttagcaaatttattgtagttattttaggaagagtaattgatagtgcagtaatcttcagtttttaaaaagccctgataaggtttaac

SEQ ID NO: 25142 - DNA, 505 bp, Homo sapiens
cctcccaaagtgctgggattacagatgtgtgccactgcgcctggcctattcttccttgtgagtgattttagtgtattaataatttaaaatgtcaaaagcctatttctcctaacctagaaaagaaactggattattccgataaaagcctgttttagaaaaggatgagaaaatttaggaactgttgtgatgattcttagatcagagtagttaagtggagccagtgttgtgctggaactggttagctgattgtgcctctctctccagctccatgttcagtgacatcatgttagtagcttgaaactggccatggtgggacatttacagcatggcagactgcagaagctacaaatcaggggcccttttctcaaagaggtggtcaaatatttatcagcagaccactggcagtgggaccatatgaaattgttgtttttatagacaaaaaaaatgcttgaatattggcagttcctttcctttcctctcccctcccctcccccctcccctcccc

SEQ ID NO: 25143 - DNA, 153 bp, Homo sapiens
cctggcctcaagtgatctgcctcctttggcctcccaaagtgccgggattacaggtgtgagccactgcgcccgactgagagtcaggcttgtaaaaccggtaagaccaagagcagctaggcaggtcaagggtcacaggtacaggctgatgtggac

SEQ ID NO: 25144 - DNA, 669 bp, Homo sapiens
agtcagcattgcttcagtattgacagtgggccgcaaagcacttaccagtgggaagcaaggaaatgatggctgaagcaaggaatgaatgctgttatttcttaccagcagataggtacacaccacttgctggaatgattcagcaatttaaagttaagagctttgagacttcatgagttacacacggggagcataggaaccaggagggtcagctctgttggaatacttctgggattgctctgttccctcctgctttgaatcacaagctgatgtgcagttgtaggctttttcttctttttctcctcactcctaatcttatccccaaggatccttgactatttataatagagtattctagacagcagcaggtaaaaattctcaggtgctggggggccaggggaggggaagggagggtaaagaaggtgtttcatctatcccttcagtgtttacggtacttccatcttttaaaagtgacattattctattccaccttgtctccctggaaaaaagcaggcctcttgtctggatcttttcgttttaatgatttccatgaaaaggcttttacccaggctctgacatgactgtcagaacacacatttaaatgtgaaactgcttaaaaggccattgatattccctggtggtaaagaaagtgctcttaaaaaaaaaaacaac

SEQ ID NO: 25145 - DNA, 356 bp, Homo sapiens
ggtgctgctgtgatttgaatgtgtcccctccaaaatccagttgttgccggtttgatagtattaagatatggggcctttgagagatggttaggcagtgagggctccaccctcgtgaatgggattaggtgcccttgtaaaggggcttgacagaggggattttatcccccttatgccctccgacttctaccatgtgaggacacattgttcctcccctccagacgatgcaatgttcaaggtgccgcttggaaacagagacccagcctccaccagacgctgaccctgctgatgtcctgatcttggactctcagccaccagaactgtgggaaaataaatttctgttctttataagttaccca

SEQ ID NO: 25146 - DNA, 618 bp, Homo sapiens
cagttctgcctatattttccctggatctgtttttattttgtaactaattttaaaatttttcttttattacattgttcacattctggtgagatgcctcaaatcctttgtgcaagaagactaggtagacaaaattaagctagtcagcagtggccacaaaacattctgaaaaaagagaatattaccatgaaccattctaattgcaggaggctttaatagaaaattgcaatttttatagcctccctccatatggcatgtaagtccttctcttcacacaattcctttagccataagatgctgactgtgagtccccaagacaacaatcttagcaaacttagctgctatagagaggaatgctgctagacttcaggacctctgagatctcttccacctgggtttcccttagactgaggtcacttatgtaatagcttgaggtttattaaatattgaaagtaatattctctaacgacagcacaactgcaagcaacactgaaaatcctgaagagtttaaaaggtttatgtggagatgtatctctagcacaacagagaacttgtggccatttaattatgtgaaaagaagcctctagaaagacaaatttcaattactataaaagcttttcc

SEQ ID NO: 25147 - DNA, 154 bp, Homo sapiens
tatttttttagttttggaattaatcctactctcctgttattttagctatgaatacatgtaacactcctagatcttgggctgatctcctgattgagaagacagcctgactctgcacttcagaactctattcaggccccaagttctttctttcttc

SEQ ID NO: 25148 - DNA, 808 bp, Homo sapiens
gcaatagcatcctttaagaactcattagaaatgtgaattttagggcctgatcccagactacagactacagaaattgaacagtctgttttaataagtcctctagatgattctgctatacaccaacatttgagaacactgtgacttacacaattatgatccttaagggaatagccaagtttctaaaaaagataacttagttctaactcctgctgctgttttacagatcaaatctctggagacagaaactattctcttaaaattatgtagattcatgagtttggttaaggataaatgtacatagctcacatcccctcagtctctccctatagtcccaaagttgttggagcagggaatctgtagagtattgatttaaattgattaaggttacatgtttatgaaactctaagagactagttttagaaatttcactgtaatttctgctgggataaatttgttagcctgggatatcttccaaagataaggcggatgctcaaatatgtgtaaattcatgcaactgttaacagagactgtgctgtaaggagtacttatgtcctatagtaattttattaaacaaatacatgtatgtctccttttgatgtgtacagaaatatactgtttaatctgaagaagctgattgaaacaggaaaaatttaaaaagtaaaaacactcaacccatgtaatactttatttttataacaaggtgttctctttaatacgcctattagattatcctgaagttctctatttactcttactttaaaaaaaatccaatgaaagaaaatttcagtaaagtttgttttgctagaag

SEQ ID NO: 25149 - DNA, 1197 bp, Homo sapiens
tactgtgcgagggtcaacaaggtataaaggtaatgtgggcaagggtctgttggtctgctgaaacagcggccgcttggaaaaaggcaaacatttagactttgtcccaggcctgatcttcccaccaacttagcctcctcctgcctctaccccggctggtgttcacattgacctcgtccaatttttgcctctctaaatctcaagagtcctacacatcttcaccgcagcttcccacacatcattaaaaccagccatctgcacatagactgagaggctgcaaattcaaacacatggaggggccggatccagaaaacacaaatgtgtgaactggactggtgaaagtcaacagaagtagggtttgtaagtaaggcatgacagaatacacatcccaccacaaacaccttcaaattcagctttccaaacactgtcctagccaaacaaacatgtctgccagcagcattcagtcccaaaggcaatagtttgggacctctgatttagagccaacaggatcagattcttgatagtgacttggtgagtgtacacacaaaatacactgagaaccgagaggggggaaaagaaactcgccttattcagagttactcttgttctgaatgatatatgcatgtatatttgttagccacataattctaaacttgaacacagagtctttgtgagagagattcagaagaagagtaccatagcatggtatgaagacttacctgcttcctgtcactactgcgtctgacctgagtttatattgctgctaccgctgtgtaaaaacagtacgtgcagtatactgtactcatagccatttcataatataggacctagactctcatttgtaaacgttctaaccctagtttataatgggggaaattattcagatatcatttttaaatgaattcctacaaatacaatggttttaaaattgggtttgctgaatatatatacatcttttccttctttgtgtatggatagaccacggtatgcatatctatcgacactataaatatatataaatccttagaagaattgttcttttttaaaggtctattattggattcacaatgcactttgagtttgattgtttagatatacaattcagagcagaagttggcagataccacgggaaaaactttctgaaatttctgtaacaaatgttttgcaataaaaaaaaaaactcagtagtttaaaacatga

SEQ ID NO: 25150 - DNA, 1649 bp, Homo sapiens
cttttaattcctctcagaaggtagttgtgttaccttttctctgatgatttccttgcactcatcactgctaatgaaagcaacgtgactgtttctacaggtcatctaagagaggattttggtgaccaggtaatccagatggcaataagaatgaggtgaattttcccttccttaccttacctagtctaccagcctccttaaacctgcaggcccttgtgcgtttgcacaatgtttgtgtgctggaaactgaaaagacatgtgtatggctagaagtccataggctttgtaaagagtgtcagtgccaatcaggacccatgccttcctctggaggagacaggtggctgaggcctatggggcaaagggggaaattcagccttgtgcctggatgtgcggctttctttctcccctcttcttgcttctcttctcttagtctaagactagctgctttttcaccagaccaacagacccttgcccacattacctttataccttgttgaccctcgcacagtaagctgaaacagcggccgcttggaaaaaggcaaacatttagactttgtcccaggcctgatcttcccaccaacttagcctcctcctgcctctaccccggctggtgttcacattgacctcgtccaatttttgcctctctaaatctcaagagtcctacacatcttcaccgcagcttcccacacatcattaaaaccagccatctgcacatagactgagaggctgcaaattcaaacacatggaggggccggatccagaaaacacaaatgtgtgaactggactggtgaaagtcaacagaagtagggtttgtaagtaaggcatgacagaatacacatcccaccacaaacaccttcaaattcagctttccaaacactgtcctagccaaacaaacatgtctgccagcagcattcagtcccaaaggcaatagtttgggacctctgatttagagccaacaggatcagattcttgatagtgacttggtgagtgtacacacaaaatacactgagaaccgagaggggggaaaagaaactcgccttattcagagttactcttgttctgaatgatatatgcatgtatatttgttagccacataattctaaacttgaacacagagtctttgtgagagagattcagaagaagagtaccatagcatggtatgaagacttacctgcttcctgtcactactgcgtctgacctgagtttatattgctgctaccgctgtgtaaaaacagtacgtgcagtatactgtactcatagccatttcataatataggacctagactctcatttgtaaacgttctaaccctagtttataatgggggaaattattcagatatcatttttaaatgaattcctacaaatacaatggttttaaaattgggtttgctgaatatatatacatcttttccttctttgtgtatggatagaccacggtatgcatatctatcgacactataaatatatataaatccttagaagaattgttcttttttaaaggtctattattggattcacaatgcactttgagtttgattgtttagatatacaattcagagcagaagttggcagataccacgggaaaaactttctgaaatttctgtaacaaatgttttgcaataaaaaaaaaaactcagtagtttaaaacatga

SEQ ID NO: 25151 - DNA, 401 bp, Homo sapiens
gaaaaatacacacttgaagtccacagcccatgactgaatctgctagatgatgactcggtggttgctgaggaatttaatcatctggaccatgtccttccctagttaattttcaacccagatgatcatatctcctgttccgggcagacacatttctggcgctaagaccagggcccctattcagccttagtggataattcaacctcctgagaggcactgcagaagcacctgggccaagattgctttcctcttctacgcctatcccaggaatgtggccactgctcaaaatgtgggaattcccttccagaattccccttgaagctgctgcacgcttcttagaccacgtctgagcaatgcctgcatcactagaatatttggcctcagttgggtttgtttctttaaaa

SEQ ID NO: 25152 - DNA, 519 bp, Homo sapiens
agacaggatctcactgtcacccaggctggaatgcagcagcgctatcacagctcactgctgcctggacttcccgggcacaggtgattctcccacctcagcctcccaggtagctgggactacaggtgcataccaccatgcccagttaattttttgtatttttcatagagacagggtttcaccatgttgctcaagttggtctcgaactactgggctcaagtgatctgctcacctctgcctcccaaaatgctgggattattggctctataactgttaacttccatgttattaaactactccacaccatttaaaaagaagagaggctgaggcacgagaattgcttgaacccaggaagtggagcttgcagtgagccaagattgtgccactgcacttcagcctgggtgatggagtgaaacactgtcttaaaataaaataaaataaaataaaaataataaaaagaagaacttccaccaattcattttacaaagtccacacacccctaacacaaagcctgacactacc

SEQ ID NO: 25153 - DNA, 410 bp, Homo sapiens
tatggtttaaggtgactgtcttagtcagcatgggttgccataacaaaataccatagcctgggtggcttcaacaacagaatttacttctcacacttctggaggttgggaagtccaagatccaggactttcgccttgccctcatgtggtgagggggtgaggaagctctgtggggcctcttatatatggatgctaatctcattcatgaggggtctgccctcatgacccagtcacctcccaaaggccccacctcctaataccatcaccctggtaattaagtttcagtgtataaatttgggggactatagacattgaaaccataacaagcacttttctaagatcagggagtgagtaagtagcagagctaggacctcaattccacatgtcagtcatcttgccttcactctgctcca

SEQ ID NO: 25154 - DNA, 466 bp, Homo sapiens
atttcatctgagttgtcgacatttacagcacagagttgttcataatactctgttatcacctgtgaaatctgtagtcatgttacatcactcatctctgttattggtaatttgtgtcttctttataatcccaatcagtctgggtagaggtttgttagttttattgaccttatcaaaaggtgttttctgttgggcatggtggttcacacctgtaatcccagcactttgagaggccgaggcgggcagatcacgtgaggtcaggagttcaagaccagcctggtcaacatagtgaaacgccatctctactaaaaatacaaaaattagccgcctgtggtggcgggcgcctgtggtcccagctcctcgggaggctgaggcaggagaactgcttgaacccaggaaacgtaggttgcagtgagccaggatcgcaccattgcactccagcatgggggacagagcgaaactccatctc

SEQ ID NO: 25155 - DNA, 371 bp, Homo sapiens
ttatattacactatttcaatgtttcctgtgaacctacattaatatagttagtatagtattggcacacataaagatttataggtaaatggaacaaaatttgtgaatctagaaataaacccttatatttgtggtcagtttattttagccaaagaagccaacacaatttaattgaaaaagacagtcttttcaacaattggtgctataataattgaatatttgtatgtacaaaatacccttaagtcctagctctcaccatagagaaaaatcagctttcagtgaatcataatcctaaatgtaacctctaaaattctaaaacttctagaatatattaattagacattcttagatacaatctcaagagtaaaagccct

SEQ ID NO: 25156 - DNA, 398 bp, Homo sapiens
gacaaaaagaaaacttgcttaagaaactataatttaaaaatttaaagtggaaccaatgtaagaatctactgctacgagaatagaagacctagaaaagtgatcctagtgtatataagaactagatatatggtaatagagggattataaattggaaagaagggacagtattaggaaaccatgctagaatgattatcttgtagagcatgtgggactattatattgcgataaattttagataaaccaaaagtcaaatgtttttaaaagaaataagctataggagaagtagaacatgtaggtgaatgtttactttgtcttaagtgggcatggtctttccaagcattaaaacaaaggaaaaaaaccataatggaaatgttaaatactgtatccaaaattaaaaa

SEQ ID NO: 25157 - DNA, 328 bp, Homo sapiens
cttctaccaccaagtactgtactcttaacaagaacagtttggtagggtttttataagactatatagatataagatgatagagaagagagtcatgaatgatgtcagagcactactgaagcctttggagtgattccatagccttctggatggcagctgaatacctatatgtagtatcactgcccaaagacctagactagaaagtgcaaagtagcttagcagctgcagtcattcactcccagcctccaaaattctctttctttcacctcaaatctatttcttgtacttacctactcacagcgacttctgtttgctttcgatcttcacctga

SEQ ID NO: 25158 - DNA, 379 bp, Homo sapiens
ttttgagttgtcttattctctagtgtaataaaataactcccaccagcctgggaatcagccatttctctagtttcttttagtgtgtgtatatctatcaatagatagaactgtaaattatatatatacatacattctctttctcatctgttttgtatccgtttatctaaaaagccatgaattcatcatagtatcttcaattccagtcaaacacagtagggttcgttctagctttccctctttccaagtttgtcttcgacagcaagaaccctggcttttgttatctacaatatatttacttattatttgttcattcctgaaatacatagaaagtagattcagaattgctaaagcatatatctgtaaacaaacctattaatta

SEQ ID NO: 25159 - DNA, 651 bp, Homo sapiens
cgcgaagcggcttggaagtgggcagcctggaagtcactcgggccaccggagctggcggcgtctccagcgagcggcgcggagctggacgccgcgatcgtggggcccgcgaggcgggcagccggggcgtccagatgcacagtctctgacatcagctctcctgggaccctccaagagcactagtgtctagaaggcactaaggcatggcgaggacaacatccttgctgcctccagctggcgggcgaccacagctactgcctgctctgcgctactgagccactcggtctggagcccccaggacagcacctgcttcctgaggttgtcctggctcagctgtgcacagcgatggtggagaactggactccacaggctcacaaccttcctgtcaggtttcagggcccagcatccttcatcctgggcctggctgccctgaacaatggctgagggctgggggaccccatagagtgacaccacagcgtacggggccagcagcactccagtgcccgtggactatgaccacctatcgggccatccccagcgatggtgtggacctggcagccagctgtggcgccagggtgggcgatgtcctccctgggccacacacaggggactacgctcccttgggattctgggcccagaatggcagcatgtccc

SEQ ID NO: 25160 - DNA, 480 bp, Homo sapiens
cttctaaaaaagagtgggtagtgattgttaagacttacccgctcataaatgttttattacatacttaatatgtgaagctatcaagtaaggaggtaaggaagtatgttaatagggaagaagatgataaaatacccaaataggaaaccataatgccaactttctaagcttaagctgactgtaacaaagaactggctttgtaacaaagaacaagtcttactggcttcatgcaatgcaaacatttttttcttacgtatctgacagatcaaggtggtcaggtagctctcctgagcagttttccaccatgtggtgattcagggatccaagcacattctatcacgaggcttagccatattggagtttttcacttcggtgatgaggatgagggagaaagtgggagagagtgaaaagagggagaaaggtggaaaagggagaaagaaggagaaggtggaaaggagagagagagaaattgagaaagtgaga

SEQ ID NO: 25161 - DNA, 343 bp, Homo sapiens
gacaggagtccaagtggctggagtagaaggaagacggaggctgttacaacatgaagtcaagtagggcatcaagttaggtattatggaaggcagggaggcaggatgggggcagggacatagggaaagggctgtgagaagagccgttaaagttgaaaatgagaatggaaagctgaccagacttgtgaaaaagtttattaacagcttgccgactctgctgagatggaaaataataacttttaatagcattaatctacacggtttcaccaacaacttgcagcagcaacagggtgtggaaagcagggagacagatggtttgacctgtaaacagtgaagaatagatttc

SEQ ID NO: 25162 - DNA, 540 bp, Homo sapiens
tgatattattttagaataatattttaaaatgtagatactataaaaggtaaaagaatattttttgaatgtcagatttatttcctttctgagtgtacattgggatggttagactttaaaagtataagtgatttgtgagtccattcagcagttctatagtgtgagatcttttgtattatcaaagtaaccattttaaactattcctaagaaaattcttacaagggtaaccaatgtaatggtcttgagacatggaaattgtttccaagagaagttttaggatttagtgattttttttcaaatatttgagagctatctttttggaattacattgctttgctctttattatactgcataaataccccgaggatcttttttgtttttttgatttgttgtatcaaacctatgtcccttcctccagaaaatggacaaggtgaaggcaaagaagaattattttacctaatgtttgatggtgatagaagcagaacaagtagcatcatgaatctaattccttgggtttctttggtccttcagttttaattgaa

SEQ ID NO: 25163 - DNA, 498 bp, Homo sapiens
gttatggtgtccagtgtgtggcattgttaggttcatccatagctactggtaccagtcagcctagagcccacacagcaagcggcctcaggagatttcttttctcaggtggggcagtgagatgtgacagctgtctcattccagtgcctctctaggcctgatcatttaaagggggctcgccttcctcagataaaaagtttcttttctttgtagtgggtacatttcaacgtgctgggtctgatgcacactggggcttctcaaactctgaatcctgcagcttctgaagtggccaccatgccctccccagaatccacttctctttccttcaattccaccgtgcccagcagccagcaccaccccttgaaaacccaaatcttagctgagcctggtggcttacgcctgtaatcgcagcactttgagacgccaaggcaggcagatcgcctgaggtcaggagttcaagaccagcctggctgacatagcaaaatcctgtctctacttaaa

SEQ ID NO: 25164 - DNA, 505 bp, Homo sapiens
gtataaaaaagagggcctgacaattgccaaacatatcaggtgaggctttgggatccactggtgggaaacactgaatatatttaatatccaagacaataattcaaagactctaaattgggaaattagcttaatagtattttacttgcaaggtcctacatttcaatattaaaaatactgacacattaaaaaatgaaattggtcttttattcctagcctattcatctttgcatctttcccagcacagagcatccccatggcactcagcagacccccatgatgtctggtcaattaatgagttaatggatggtttcaagcccatgagccagattcctgtcaccggcatgtatcagtttattgctgcacacgggaaaccttgcagccacagggctttgtttatacactgccctagaagccactaggattctctagatcagaaagagaaatatattctagttctcatctttcaaactggctcaaaacctgacactttcacatcaggaaagtg

SEQ ID NO: 25165 - DNA, 428 bp, Homo sapiens
gtggtagagttttagcatctttcagctccacagctctactagccaaatgtgcgttccaaaatatttcccacaggtttctgactcttggattttaagtagtatgttatggctggtacctgggatttggtgtatttaaaatttgtttgggccagtcgcagtggctcacgcctgtaatcccagcactttgggaggctgaggcgggtggatcacctgaggttgggagttcgagaccagcctggccaacatgttgaaacgctgtctctactaaaaatacaaaaattagccaggcatggtggtgcacacctgtaattccagctactctggaggccaaggcaggagaatcgcttgaacccaggaggtggaggttgcagtgagcagagatcctctcactgcactccagcctgggtgacagagcgaatctttgtctc

SEQ ID NO: 25166 - DNA, 482 bp, Homo sapiens
ctcttcgtgaaaatcttgtctactatttttaatcgatgtttataataaagatattcaaaaccaagaaatctagtgtaatttagcacatgttgaatagatgctatgaaaccctggttgggtatgacaaaattggaaaagagcttttgaatacccttaggatggagtgagaagctctggtcaggccaaacaatgaatacatctataccattttaataataaaatataattctttggccatgttgaattcattacaggatgcattagatgaaactgaattgatgctgatagctgagacgattattttgtaaatcagttagatattactgtctaaatattggttaaaagagtactgttggatttatttttatacagatatgtttgaaaacgaacacacaaaatctaccaatgataattttaaatcaccaattaaaaacaagaatgtcatcaggttttctcaatgttaaaatatttctcattttaaa

SEQ ID NO: 25167 - DNA, 1929 bp, Homo sapiens
atgaatgtatgagcctaattagagaaacagaaaatcagcatgtcagttttccttcattcaaaataacatagtctttctaagcagtcattctggagttaacatgcctagttcagagccgctgtggatgctcaaatcatttctggaattgccttcaggacacaattatgagaaagtcagacttccaatattttgatcatgccttgtgtcttcctaagtgtccttatcccactggattgtgtctcttactcccaagacttattccaaatgattttttgactcttttcattaatcaaattcaccccaaaccagaaagttttgccattagcgtagatattaaaaatattactggctgggaaagcactcctcaaagcagaggttctaaattaatttatctgttcttttaccatttgctcactcactcactcatggacccattcaatcatagaatatttaagatttatatgcccagaattataatagtgcctaggccttgataattagtgaatttgtacttggggtgaatgtgtaagtgtcaaaaggtaactattatgaaggagaaaataatcgatttaatatgtaaattctggggaggcatttaaaaaatcagtaatcttcaagttatatcttgtgtatcatctgtgttggatactctaatttggggggaaagaggctccagacagtttgctaaatactattttgaaagttatttttgggcattgtaaaataccttgcttcataccccaaagaataagatatgacagtctgacatcgattgtctgaaaggtactaattgcatttaaaattctttaagttaactacaacctcccagactgcaaagcaaatttccaaaccccaggtcatacttttgtatgtatgtaaaagctttagcattttagggaaaaaaatcaatctgtatttcaaaaataaactttgaggtttgaaaataataacaatattaataatggtagtattaacatctattatgtataacttaatctcaacataatttattgaattagaatgaacctggaacactttttgatgaattggtatcctagaggctgtttccttgggccttaactgctggaggattaggtaatcagggattccaagtgttgtgatcttttttctgatgatgccacagtcttcagtgtaaaagttcagaagcctaaaagaacaagtgatcctgaaagtagctgattccagacaagaaaattatattagaactcatgatatggttttttaaagtatttgttattactcagaagggttcatgaatcagtttccactacctctattccttctattgaagctttcctcaaatctacttgtgattcctgatagctcactggcaactgtaccaaggtggccactgtatcatctactgatccttctgcacctagcactcttggctccagataacgcacagaaacctattttctcaccagctgtcatttcttctagggcatgcagttctatgttcacagttcatgtgtaaaaataaaaccaaattcctggattatcaatatcagttctttacctgtgcataaaagaatatcatgaagtaattgaacttatctgttgatataaaaacacagatccaattcgtgtctgtggatgctgcaaggactggctcattggagccaaaccatgtggcggaaactcctgaaattggtggaaaaagtggaatatggcagattgggtaggtaggagaacaattttggagattttgtttcttatgttaaagtgtctgcattttatttgctgtaccctgcctactctggttttaaggattttttgacttcttcgaaaagcactgaataatctcttttccgggtctagattttttgatgagtactgtgtaaaattgtcaatattcaatggattatttaataataaattaagaattacactcataaaaaaaaaaaa

SEQ ID NO: 25168 - DNA, 401 bp, Homo sapiens
  misc_feature (311)..(311): n is a, c, g, or t
  misc_feature (335)..(335): n is a, c, g, or t
  misc_feature (362)..(362): n is a, c, g, or t
agttcttgtgtgctggagatgtggctggggtttgtctcacagtggaggttacctaaccaaactcctgtaaaaccacaccacctatgcctgtgatggggactatctgaatctacagtgccctcggcattctacaataagtgtccaatcggcattttatggacaagattacccaatgtgtagttcccagaagcctgcctgccagagggaagacagcttaacttgtgtggcacccaccaccttccagatagaattaaaaaacaaaaccgtgtgtggaaggacaagggagctggaaactggcacttgccacggantccaagtttccttcaacatcttantctgtggacctatggggcagggagggntccagggggaaggggacatgttgcttccttcccaagggc

SEQ ID NO: 25169 - DNA, 410 bp, Homo sapiens
  misc_feature (377)..(377): n is a, c, g, or t
agttcttgtgtgctggagatgtggctggggtttgtctcacagtggaggttacctaaccaaactcctgtaaaaccacaccacctatgcctgtgatggggactatctgaatctacagtgccctcggcattctacaataagtgtccaatcggcattttatggacaagattacccaatgtgtagttcccagaagcctgcctgccagagggaagacagcttaacttgtgtggcacccaccaccttccagatagaacttcgacccaagcgaatcgaaggttctggaaagatggaatccttgttagtgactctctggcagcctttgcttacattaccagataggtcaatgaatcaaagcttcctagaaagctgcacggatttcntacagtcttgttaataaatgccctgttcaattc

SEQ ID NO: 25170 - DNA, 425 bp, Homo sapiens
caggtcagaatttttatgtacctttagaaatgagatgagctctatcgttgttggtctagcatatttcgtcatatcatgccttgtgcatgaggctaccctgatacagatgtagagagttggcctggttgacagtatgttattttttctttttaaaaaaataaatttaaaaggtacagagatggcattttgttacatggatatattgcatagtggtaaagtctggggttttcctgtatctatcacttgaataatgtacattttacccattaagtgatttctcatcccctgactttatagtttgaaatttaggccaggtggcattgcttatgcctataatcccagtgctttgggaggctgaggcaggaggatcagttcagctcaggagttggagaccagcctgggcaacatagagcttgcctctacta

SEQ ID NO: 25171 - DNA, 507 bp, Homo sapiens
ttttaaattgccaggttttattaagataattggcaaaatttcaacatacaccttacctgaatgaacacttttaataaaatatgaaggatcactcatgactacaactgaactcaaaagtgagatgtagagcagatttgtaaattgataaatttatttggtaagaaattattcacttcattcgcttcactccatagagaattctttgcagagaaatgttatgaacaagagaacaaagcctgtctctcaccaaagagcacctagagtaagagtttacaatgatgtatctggattatctaattcatcaaagtttatttccttttcaaaaacaactgctgtgtcagtctggagttccctatttcatgttttctaattattacaataaatagtcttcaaaatagaagataaaatgctgctttaagaagtaacagttatttttcaacaccataccatttgtctggaaaatcattgtgttgtaatactggtgggtatcttactttgttttgcaag

SEQ ID NO: 25172 - DNA, 357 bp, Homo sapiens
tctcttcttacaatccacattctattcagtatttcatttacttgaggggttatatgctacttatctttatctgttgtggagtgaggacacattccaaatgccttggtattattaaaagcccttcatgatgtggccccatcttttatgacttttccttttcaactgtgccctctagccttatttgatttctctcaaattcttaaacacagcatgcttcactgacctttaagcctttgcacatacagtgttgatgtggagcttcctgaccaactcctaattctccttcaggcctcaatttaaacatcacttcctctgggaagctttctattattcccaaggtactgggatatgttcttg

SEQ ID NO: 25173 - DNA, 225 bp, Homo sapiens
gactcagtgttggtctttgctgctggcagagtatagacttaggtcaggaaagccccagtgagtataatttcatgtttctgagcccatgcatcatctccattcctgacatcatagccaatttgttcagagctcgttagtggctggagtgtctgaagaaagagatgactggcatccagacattttttcctatccacttgattattaaaatcattctctgttgacgta

SEQ ID NO: 25174 - DNA, 309 bp, Homo sapiens
tttttattttttgttttgtcttttattgcttctgtcctttatcacatttaaaaattcctctcattacaaaggtccccaaaaccaccaaatttggttctttccaggagtatcaaatgatttggacatctttagtcatgagagagtagtaaacaacagtactagataacactgactactcatgtcagtttcatcaaggctaataactttatgggtagagaaactgagttattttgccaattttataatgaattttcttaaaccaaaaccctgacatatttgtgcagcagtgtcttgagtttgtatccaata

SEQ ID NO: 25175 - DNA, 459 bp, Homo sapiens
gtttatcctacttgggtttgttgttattggtttttgtttgttttagcttcttggatatataatgttttttataaaatttgagagatttttggacattatttcttagttacatttttctgccctttgctcttctgtgattcgccttatgcatttgttggtacatttcctgttaccctggtctcaggctctgttcatttttttcagtctttttctccctctatttctcaggttgtgtaacgttgatttttcctcaagctcaccgatgcgtctgccatctcaaatctacttgcattgttttgtttcgtaagttgaatttttcagcgcccaggtttccatttggttctttcataactttgtacctctttattgagattctttgttcattggattattataagttttctttaatataataaacagacttccattttgaacatgtttatgaagtctgctaaatcc

SEQ ID NO: 25176 - DNA, 478 bp, Homo sapiens
tgttaagaggctggagaaccgtgcacagattctgtcactgctgtctgcatttaatgctttgcagccatcaaaaatctttctggtgaatttgcacatggttgcagcctggaacttccaagccaagagcagcactcggaattctgtggggtcgacacataggtcattgcaaaagtgctccatgccttcctccaaaattgcatcttcccactcatccttgtagcacctgaacagttcttccaacccctgcaaggaagactcctcggcactggagttggactccctcccaccatctcctgaggatgttggcagctggcagcctcggccttcttggtcccattgacaaggctatctctacttggcatgccacagggtggtacttgctcctcacagtggcctgcaccctgcctgctgtgtgacttcttgctggggtcatggtctgcattcttgctgcccagggtcaatgagggattcttacact

SEQ ID NO: 25177 - DNA, 963 bp, Homo sapiens
aaacaggctggtaccggcctggagattaggatggagaagagcggagcagtggtcggagatgtggcgaccggtgcagctctgtcatttccactctgctctgctgcacagaaggcagaagccctggccgtcccctgctgtgttcttcaggagaaacgtcaggggccttcctccaaggttctccagccccacacccctgtggaggaaggtgctctccaccgcggtagtgggggcgcccctgctcctcggagcccgctatgtcatggcagaggcacgggagaagaggaggatgcggctcgtggtggatggcatggggcgctttggcaggtctctgaaggtcggcctgcagatctccctggactactggtggtgcaccaatgttgtccttcgaggggtggaagagaacagcccaggctacttggaggtgatgtctgcgtgtcaccagcgggcggctgatgccctggtggcaggggccatcagcaacgggggcctctacgtgaagctgggccaggggctgtgctccttcaaccacctgcttccccccgagtatacccggaccctgcgcgtgctagaggacagggccctcaagcggggcttccaggaggtggatgagttgttccttgaggacttccaggccctcccccacgagctcttccaggagtttgactaccagccaattgctgccgccagcctggcacaggtgcacagagccaagctgcacgatggcaccagcgtggctgtgaaggtgcagtacatcgacctgcgggaccgctttgatggggacatccacaccctggaggctcctgctgcggctcgttgaggtcatgcaccccagctttggcttcagctgggtcctccaggacctgaaggggaccctggcccaggagctggacttcgagaatgagggccgcaacgcagagcgctgtgcgcgggagctggcgcacttcccctacgtcgtggtgcccc

SEQ ID NO: 25178 - DNA, 1137 bp, Homo sapiens
tgtggcacccttaggccaagctgactcaggagccctcgtggattccacaaggatggtgttttgtttcatgctcacagtggggtctaggagggcttgcaggcagtaagtgccaggacccgtgttggcgcccgaggatccctggcatgttcggggacggtgaggtgcctgcccggggaatgcgcagtgcgccgagggcgggactggaaccctccgctctcaggaggcgcggtccgggcgccaaaaggtgcagctctgtcatttccactctgctctgctgcacagaaggcagaagccctggccgtcccctgctgtgttcttcaggagaaacgtcaggggccttcctccaaggttctccagccccacacccctgtggaggaaggtgctctccaccgcggtagtgggggcgcccctgctcctcggagcccgctatgtcatggcagaggcacgggagaagaggaggatgcggctcgtggtggatggcatggggcgctttggcaggtctctgaaggtcggcctgcagatctccctggactactggtggtgcaccaatgttgtccttcgaggggtggaagagaacagcccaggctacttggaggtgatgtctgcgtgtcaccagcgggcggctgatgccctggtggcaggggccatcagcaacgggggcctctacgtgaagctgggccaggggctgtgctccttcaaccacctgcttccccccgagtatacccggaccctgcgcgtgctagaggacagggccctcaagcggggcttccaggaggtggatgagttgttccttgaggacttccaggccctcccccacgagctcttccaggagtttgactaccagccaattgctgccgccagcctggcacaggtgcacagagccaagctgcacgatggcaccagcgtggctgtgaaggtgcagtacatcgacctgcgggaccgctttgatggggacatccacaccctggaggctcctgctgcggctcgttgaggtcatgcaccccagctttggcttcagctgggtcctccaggacctgaaggggaccctggcccaggagctggacttcgagaatgagggccgcaacgcagagcgctgtgcgcgggagctggcgcacttcccctacgtcgtggtgcccc

SEQ ID NO: 25179 - DNA, 1127 bp, Homo sapiens
cgagacgctaagcggcgccgggcgggagaagagcggagcagtggtcggagatgtggcgaccggctggagtgcagtgtctcaatcttggctcactgcaatctccgcctaccaagatcaagcgattctcctgtctcagcctcccaactacctgggattacaggtgcagctctgtcatttccactctgctctgctgcacagaaggcagaagccctggccgtcccctgctgtgttcttcaggagaaacgtcaggggccttcctccaaggttctccagccccacacccctgtggaggaaggtgctctccaccgcggtagtgggggcgcccctgctcctcggagcccgctatgtcatggcagaggcacgggagaagaggaggatgcggctcgtggtggatggcatggggcgctttggcagaccttgcctccccaggccttggagacccaccctcctggtgtcctcctctcttcctagtggacctcaggctgcaggtctctgaaggtcggcctgcagatctccctggactactggtggtgcaccaatgttgtccttcgaggggtggaagagaacagcccaggctacttggaggtgatgtctgcgtgtcaccagcgggcggctgatgccctggtggcaggggccatcagcaacgggggcctctacgtgaagctgggccaggggctgtgctccttcaaccacctgcttccccccgagtatacccggaccctgcgcgtgctagaggacagggccctcaagcggggcttccaggaggtggatgagttgttccttgaggacttccaggccctcccccacgagctcttccaggagtttgactaccagccaattgctgccgccagcctggcacaggtgcacagagccaagctgcacgatggcaccagcgtggctgtgaaggtgcagtacatcgacctgcgggaccgctttgatggggacatccacaccctggaggctcctgctgcggctcgttgaggtcatgcaccccagctttggcttcagctgggtcctccaggacctgaaggggaccctggcccaggagctggacttcgagaatgagggccgcaacgcagagcgctgtgcgcgggagctggcgcacttcccctacgtcgtggtgcccc

SEQ ID NO: 25180 - DNA, 955 bp, Homo sapiens
cgagacgctaagcggcgccgggcgggagaagagcggagcagtggtcggagatgtggcgaccggtgcagctctgtcatttccactctgctctgctgcacagaaggcagaagccctggccgtcccctgctgtgttcttcaggagaaacgtcaggggccttcctccaaggttctccagccccacacccctgtggaggaaggtgctctccaccgcggtagtgggggcgcccctgctcctcggagcccgctatgtcatggcagaggcacgggagaagaggaggatgcggctcgtggtggatggcatggggcgctttggcaggtctctgaaggtcggcctgcagatctccctggactactggtggtgcaccaatgttgtccttcgaggggtggaagagaacagcccaggctacttggaggtgatgtctgcgtgtcaccagcgggcggctgatgccctggtggcaggggccatcagcaacgggggcctctacgtgaagctgggccaggggctgtgctccttcaaccacctgcttccccccgagtatacccggaccctgcgcgtgctagaggacagggccctcaagcggggcttccaggaggtggatgagttgttccttgaggacttccaggccctcccccacgagctcttccaggagtttgactaccagccaattgctgccgccagcctggcacaggtgcacagagccaagctgcacgatggcaccagcgtggctgtgaaggtgcagtacatcgacctgcgggaccgctttgatggggacatccacaccctggaggctcctgctgcggctcgttgaggtcatgcaccccagctttggcttcagctgggtcctccaggacctgaaggggaccctggcccaggagctggacttcgagaatgagggccgcaacgcagagcgctgtgcgcgggagctggcgcacttcccctacgtcgtggtgcccc

SEQ ID NO: 25181 - DNA, 1132 bp, Homo sapiens
  misc_feature (1131)..(1131): n is a, c, g, or t
cgagacgctaagcggcgccgggcgggagaagagcggagcagtggtcggagatgtggcgaccggctggagtgcagtgtctcaatcttggctcactgcaatctccgcctaccaagatcaagcgattctcctgtctcagcctcccaactacctgggattacaggtgcagctctgtcatttccactctgctctgctgcacagaaggcagaagccctggccgtcccctgctgtgttcttcaggagaaacgtcaggggccttcctccaaggttctccagccccacacccctgtggaggaaggtgctctccaccgcggtagtgggggcgcccctgctcctcggagcccgctatgtcatggcagaggcacgggagaagaggaggatgcggctcgtggtggatggcatggggcgctttggcaggtctctgaaggtcggcctgcagatctccctggactactggtggtgcaccaatgttgtccttcgaggggtggaagagaacagcccaggctacttggaggtgatgtctgcgtgtcaccagcgggcggctgatgccctggtggcaggggccatcagcaacgggggcctctacgtgaagctgggccaggggctgtgctccttcaaccacctgcttccccccgagtatacccggaccctgcgcgtgctagaggacagggccctcaagcggggcttccaggaggtggatgagttgttccttgaggacttccaggccctcccccacgagctcttccaggagtttgactaccagccaattgctgccgccagcctggcacaggtgcacagagccaagctgcacgatggcaccagcgtggctgtgaaggtgcagacatcgaactgcggcaaccgtttggaggggaaatcacacctggagactctgcttgcgagtcgtgaaggcatgcacccagatggtcagctggtcttccaggactgagggacctggccagaacggatgagagaggcgaagaaaggggcgcgagacgggcacccagaggggccgggcaggaaaccaagcggccgcgatgacggagcaaggagaaggcgggccggaacaaaccacgggaaaggacccgcaagcccgcgaggggggaccaaagcagcaagacgcggccgcggggtcang

SEQ ID NO: 25182 - DNA, 1130 bp, Homo sapiens
tttaggtccaagtagacttgaattaatgtcataattgtcagtattattgaaaattatgtcaactgtactgttattcatctgtcccatagtttagaacatgacctggctatctggcattgttgcaagtgccttaaattcatggcatcctattaaaaaaacaaatttggtgttatgctgcatgacaaagacaaacacacctcaaaatgttgtcctttcttagcttgctgcgttttacagttctttctgctaacaatttataagcctttattatataatattgatgaattacagaaatgatgaagttgttctcttatttctgttaaatgtaccagagctgtgtatctgttaatgagatacagcgtcatttctgtgaaatgtataaatgtatgtgcaggtcaaattaatatatgacattctatcagtctgtatacaggtattcctgttttgctaagctgtgcagattctgtaaaaataaattagtgcagtcaagttctaacatatctcattttatagactccattgacaatggtccaaccgaaaagaaaaattggaaatgactgctaaccagacctcgttatgaaaccaatgatgaaaaagtcacttggtgcacctctcaacaaaacaggatgctttttccgagttcttgtatatgcaaatcatttacgaggcaagttttcaacagacctagaaagcaaaacattgaaagtgtgttgttagccctcctctctgcccctgaatcaacagacagagctctgggaccttggcaatgactcagaggttggggctttctgagtaaagggacatttctttaagcatcatctatcaaatttatttcaatgtatgatgtttttacaactggtcagttcttttgtattcttacagctatggttatttgattgtcctcttacaatttgttctacatgaaagagttctttgttagtcagaatgcaacaaactgtcatcaaatggtcattgaccacttgcactcttttgatgtagattaaaaactttttcataaatttacctgctttgatttgctctgtatttttcctgcagctgtaattgctgagtgcctgttgtatactttatagagttgaaataaaaaaataattacttttaaaaaaaaaaaa

SEQ ID NO: 25183 - DNA, 673 bp, Homo sapiens
tagaataatatatactttaatgttcaagaagaaactagatgagtagtctatttaatgatccattgacaatggtccaaccgaaaagaaaaattggaaatgactgctaaccagacctcgttatgaaaccaatgatgaaaaagtcacttggtgcacctctcaacaaaacaggatgctttttccgagttcttgtatatgcaaatcatttacgaggcaagttttcaacagacctagaaagcaaaacattgaaagtgtgttgttagccctcctctctgcccctgaatcaacagacagagctctgggaccttggcaatgactcagaggttggggctttctgagtaaagggacatttctttaagcatcatctatcaaatttatttcaatgtatgatgtttttacaactggtcagttcttttgtattcttacagctatggttatttgattgtcctcttacaatttgttctacatgaaagagttctttgttagtcagaatgcaacaaactgtcatcaaatggtcattgaccacttgcactcttttgatgtagattaaaaactttttcataaatttacctgctttgatttgctctgtatttttcctgcagctgtaattgctgagtgcctgttgtatactttatagagttgaaataaaaaaataattacttttaaaaaaaaaaaa

SEQ ID NO: 25184 - DNA, 331 bp, Homo sapiens
ttttctagatcttaaataggatgatgatggagagactttggcatgatatagaattggaatggaggcagagttgataattaaactagatctgagggttttttcccagtttataacgtaggtctaccctgagatgatttttgttgtccctgtctggatattagtgtgccttttatttaaaaagaaaaacccaatagtttatcatctttagagagattagatgattgtattttgcatttattaattttccccaactgattatagtatatactgaggaaattcaggaccaatcagagaatgtttaagggcagagctgcctagaaaaccagtttaa

SEQ ID NO: 25185 - DNA, 580 bp, Homo sapiens
tcctcattacacaatattcccacgatctacacaatttaggacaatcagcttttttgattttttagaaaaaaacagagatgtcaacttagttttcattatgattttaaagatttttacatgttcattcttaaataaaatggggatggaaagagtactaagcaattagtgatcatgaagaatgttgctaaaccaagaaagccattaagtagacagcctcataaaacaccaagggtccaatataaaaggtactatctgacccttgtacttatgcagctgctggacccacaacttcagcctctgctccctagaggcagggtaaaggctgtcccatatttgaagggaagtacagggaacctgtacttccagggaaggcccagactacatatcccagctccatctgctggcctggatgcccttgaacatttaagttccccataaagcctagacatggctctggaccagataacccaagcctgacatgctaagaagttgtgccccactcattttcttttctttttcttttttttttttttgagacggagtcccactctctcacccaggctggagtgcagtggtgcga

SEQ ID NO: 25186 - DNA, 419 bp, Homo sapiens
gggaaatttgcttgagaatgccaaaattttaaaactctgtaaaggtaattttacattcacttatgtgtgtttactaatgttgagtaggaacagaagcaaaaatacctaaacctattttttttaaccttcacactctaaccagtattatatatttcagctacctaagataatgcaattaatcatatatccaacctaagcttctgccaataaggatttcagataagcttttaaatttatggaggattttctttgtgtctttggaagttcacttaccataaagtattttatagtctactttaaataacagattttgttacacagggtaagccaaaggctgtacaagatttagtgtcattgggtctcatatttgtgttagaccatgaaatattccattaaaatttatctgtaaatacaaggca

SEQ ID NO: 25187 - DNA, 382 bp, Homo sapiens
cattcggaatggtgcatagtacataatgtgggtgttcaataaattaacagtagtatttttaccactgcagagaataatcttactctcaggcaagtagaatctgttacagttgttgaatatttatgtaatcattgaggatgtttataaatatatttgcttctaaaaattttttccttacatattcttttattaatattaaaccaagtaacatttataatattcttgaatatcttatcacttaagaacatgaggaaaggtggccgggcacagtggctcacacctgtagtcctagcactttgaaaggctgaggtaggtaggattgcttgaactcaggagtttgagaccagcctgggcaacatggtaaaaccccatctctacaaaa

SEQ ID NO: 25188 - DNA, 438 bp, Homo sapiens
gaaaacgttacttaactattggctgaacgtaaatttaggttaaattaaaatgcagcttttttccttataggcatttgttttggttcaagtcatcataaagtaggtattgcattgctatcagtggatacagatgcttagctcttaaaagaattttttttggccagacgcagttgctcacgcctgtaatcccagcactttgggaggttgagggtggatcacgaggtcaggagatcgagaccatcttggttaacatggtgaaaacccatctctactaaaaatacaaaaaattagctaggcgttgtggtgggcacctgtagtcccagctactcgggaggctgaggcaggagaatggcgtgaacccgggaggcggagcttgcagtgagccgagattgtgccactgcactccagcctgggcgacagagcgagactctgtctcaa

SEQ ID NO: 25189 - DNA, 342 bp, Homo sapiens
acctaatgtaaatgacgagttaatgggtgcagcacaccaacatggcacatgtatacatatgtaacaaacctgcacgttgtgcacatgtaccctaaaacttaaagtgtatataaaaaaaaagaacaaaggtattaaaaaaaaagaagaagaaatgataagaaaatgtgaggctgagtccaggagctataaaaaagaaaaaaaaagatgctctcttaagtcactttctgttgctacggctgagtatcacagactgggtagtttataaagaatagaggttatttggacatagtattggaggctggtaaatccacagtcaaggggccacttctgatgagagccttc

SEQ ID NO: 25190 - DNA, 495 bp, Homo sapiens
tatcttttaccaccctctggaattttgacttgctttatgtaaatgacaatggttttgtgactaattcactaagaatatatatacacatatgtgttcacatatatattcttatatatatacagtaagaagtaatgactaagaagtttaatgaatataaaagtgacaaaaaaagacggagatagtgaaaagataaaagacatccagtatttttgactttccatggagactcagttgctatttgacataattctgcaaggtcacacccaacttctaccaccctaagagaatctgctctcaattcacagaagctcacaggagactcctcttttttggcatggcaggtagtatcaatggaaagttattttcattcattaaaactatcacctacacgaggcacacccggctaccaaagtcaatgaaaactaaagaaaaagaactaatgaattcttttaagtctagcctaatctacttcaggaatgattaagtgatgacatg

SEQ ID NO: 25191 - DNA, 441 bp, Homo sapiens
tatcttttaccaccctctggaattttgacttgctttatgtaaatgacaatggttttgtgactaattcactaagaatatatatacacatatgtgttcacatatatattcttatatatatacagtaagaagtaatgactaagaagtttaatgaatatatgactttccatggagactcagttgctatttgacataattctgcaaggtcacacccaacttctaccaccctaagagaatctgctctcaattcacagaagctcacaggagactcctcttttttggcatggcaggtagtatcaatggaaagttattttcattcattaaaactatcacctacacgaggcacacccggctaccaaagtcaatgaaaactaaagaaaaagaactaatgaattcttttaagtctagcctaatctacttcaggaatgattaagtgatgacatg

SEQ ID NO: 25192 - DNA, 390 bp, Homo sapiens
ttccgcacacgcgtagtaggacggtagccggtattcaatcttcaaatcagcgccgcgggaagtgcgggcgggtgttgctcccctgtctctggacgacgctgtgactgatcccaggcttggagccggagctgcgagcgaggcagtgaaagggtggcaggtatggctttgctggactcggaggacgtaagagaaaggcggggactggcttctaggtttaccctaccgaagataaaactttagtctccaagcgcagtgacttcaggtttggatatgtgggtcctgttcaactcgagtagctgagagaaagcaagagttgggctccgactggcactgggtagatgtccagggctctggtgggactgggagaggctcaatttgcattcctgctct

SEQ ID NO: 25193 - DNA, 241 bp, Homo sapiens
tttagtagagacgggctttcaccatgttgaccaggctggtcttgaactcctgacctcaggtgatctgcccgcctcagcctcccaaagtgctaggattacaggcgtgagccaccatgcccagccggcatttcttaacaatgtttttgcaaatgacttccaagattttgctctgctggagcatttcccgggagatgtttggggaaagatccttaagagtcaaccataccacggacaaagccga

SEQ ID NO: 25194 - DNA, 796 bp, Homo sapiens
acacccggcccccatttccttttgaagacatgaaattattcatatttcagagaaaccctataagacatgggaataccttcagttatttacatgtgaatatgaggaagcattcatactggacaggaaaccctgcgaatgtaggcagtgtgggaaaaccttcaatggtcatatgaccttttaaggaccatgagaaggcatatgaagtgtaaagaattttcatatgccctataaatgtaaagaatttataaccttaaaaatgtaaagaatgtggaaaaccctataaatgtaaaaaatgtagaaaaacctttatttgtcttagtttacttggaaaccatgaacaaactcacactggaaagcgacttcttaaatatagacattgtgaaaaagccttcagttggcccacatactaatatgtgagaatgcagactggatagaaatcctataaaagtgagatatagcaatgttttccattttaacaaatgctcatgtgatactcccttatgtgtgaaacttcaatctcatgttgaaactcccactagggaggtactgtataaatgtagataatatgggaaagcctgatgcaaattaattcatgtatattgttctagaaaattcacaacatgtcagaaatgtgataaaacatattatcagttactgattcttaaaatggatctctgaattatggatttctattactttcacaaaagaacactgagatgagataattctgtaagctcttatacagttgtacacaagttgaattgatagtattttttcattaaatcagtttctgaaa

SEQ ID NO: 25195 - DNA, 445 bp, Homo sapiens
atcttttcagaattaaataatgacaatgttggctagggggaagacaaccacttttaaagagtagagctatctgcgcattaacataagagcattttctctcttcagcttgtttgtaaggtctgatggcagatatttctttgtatcctactgcacggtgtttctacatatagtaggtgcatgataaatattggtgatgattgggaatgttaacatttactgttgcacagtgtggaagggaacaagtataaactagagaagtatagatgtctttaacatagcagtggtgactaaggaggagcaaagttgtactagtacttttatgagtaatagaagtagcaattgtctttattattagaggtcagatgtgccttagagaattctcaaaatatgtgaaattgggtaagtttttttaaaaggttgaccttaataaataatttgtttagtg

SEQ ID NO: 25196 - DNA, 928 bp, Homo sapiens
tagccacggacgcgcgctcggtcccccgccgtgcgcccccggtcccgcgcccaggctcccgcccctggcctccttaccagccacttgtcgcccagctgcgaactggagcgggaggcggcggccggagggcccaggacagccccgggagggcggcgaggcggagcaggagcgccccggctccggccacattctcagagtcaggaaaaggggcgagaggccacatgtctccctctcgcccaactgaaaacgaaacggcgctccagcagattgggtggaaagagctgggtctcttttctctgtttttcacgctagaaagggcttgtaaacattgttccttttaaaatgacctaccccaggcatttgtttgggcacacttctgtcctggggtcatcgttcctaggtggcttcggacctgggacttttcctgtatctgcacattgtcgttttatacacaattgccaaggtgggactgctttcaactttactgtgcttgaagctgcaaaggttctgccctgatgtttcctggaataatgctgaggactgcctttcgggtagccgccctattcagttcacttcatctcggaaatacctgacccctgccttggatccagcggccctcctgagagctgaggaaggaggaaatcctatgtgtctgctcccggagctgccacaacccatcttcccacaactcggaacttggaaaaaggaacccaggacacgactttgcttttcttttggacctagttgaagtcacagcttggaggaaaccagtttgcactatttgatgaggaatttggccaccaaaccactgatactttcccaaaggtttggcagaaattgttttttgagtggctcaccagagtacccagaagaatcagtatggaattagaggacagtggcctaccctaaataaagacatgagtgatgt

SEQ ID NO: 25197 - DNA, 1426 bp, Homo sapiens
tagccacggacgcgcgctcggtcccccgccgtgcgcccccggtcccgcgcccaggctcccgcccctggcctccttaccagccacttgtcgcccagctgcgaactggagcgggaggcggcggccggagggcccaggacagccccgggagggcggcgaggcggagcaggagcgccccggctccggccacattctcagagtcaggaaaaggggcgagaggccacatgtctccctctcgcccaactgaaaacgaaacggcgctccagcagattgggtggaaagagctgggtctcttttctctgtttttcacgctagaaagggcttgtaaacattgttccttttaaaatgacctaccccaggcatttgtttgggcacacttctgtcctggggtcatcgttcctaggtggcttcggacctgggacttttcctgtatctgcacattgtcgttttatacacaattgccaaggtgggactgctttcaactttactgtgcttgaagctgcaaagcggatcctgttacagtgcaaagaagaaatggcaaacggataacagctactgtgcctagaagatggttctgccctgatgtttcctggaataatgctgaggactgcctttcgggtagccgccctattcagttcacttcatctcggaaatacctgacccctgccttggatccagcggccctcctgagagctgaggaaggaggaaatcctatgtgtctgctcccggagctgccacaacccatcttcccacaactcggaacttggaaaaaggaacccaggacacgactttgcttttcttttggacctagttggtgattatactctgtctcccatggagaccacgtcttgcatccttccttctatatgggatttaggatagaaattaaaaagaaaacatattattttgagtcttgatttggagaaaggtagtattcaggaggaagtaggctatgatacacatagaaaatttgaggacagtgttacttaacaaggacatttctgtctctgcagaagtcacagcttggaggaaaccagtttgcactatttgatgaggaatttggccaccaaaccactgatactttcccaaaggtttggcagaaattgttttttgagtggctcaccagagtacccagaagaatcagtatggaattagaggacagtggcctaccctaaataaagacatgagtgatgtataaagtctagtgtcaatttattcagaaaatatcaaaattattctgggagctatgggtcaaagttgataggcacaaacaaacaaaaacgaaaggtattttaaattcacagcttggataagtaaaagggagatgttgtcatttctcttcttcaatccaactttagattttcaagccggaaaaagggtaattagaagttagaaattgttattgccagaaaatagctctaaaccctga

SEQ ID NO: 25198 - DNA, 869 bp, Homo sapiens
tagccacggacgcgcgctcggtcccccgccgtgcgcccccggtcccgcgcccaggctcccgcccctggcctccttaccagccacttgtcgcccagctgcgaactggagcgggaggcggcggccggagggcccaggacagccccgggagggcggcgaggcggagcaggagcgccccggctccggccacattctcagagtcaggaaaaggggcgagaggccacatgtctccctctcgcccaactgaaaacgaaacggcgctccagcagattgggtggaaagagctgggtctcttttctctgtttttcacgctagaaagggcttgtaaacattgttccttttaaaatgacctaccccaggcatttgtttgggcacacttctgtcctggggtcatcgttcctaggtggcttcggacctgggacttttcctgtatctgcacattgtcgttttatacacaattgccaaggtgggactgctttcaactttactgtgcttgaagctgcaaaggttctgccctgatgtttcctggaataatgctgaggactgcctttcgggtagccgccctattcagttcacttcatctcggaaatacctgacccctgccttggatccagcggccctcctgagagctgaggaaggaggaaatcctatgtgtctgctcccggagctgccacaacccatcttcccacaactcggaacttggaaaaaggaacccaggacacgactttgcttttcttttggacctagttgatacaagttaacaggatatgcttctggcctgtttctggattctaagggtagaaccagcataaaactagtcagtccaagtatttctaaagatccacagacacagttctcctggatttgggaag

SEQ ID NO: 25199 - DNA, 1127 bp, Homo sapiens
tagccacggacgcgcgctcggtcccccgccgtgcgcccccggtcccgcgcccaggctcccgcccctggcctccttaccagccacttgtcgcccagctgcgaactggagcgggaggcggcggccggagggcccaggacagccccgggagggcggcgaggcggagcaggagcgccccggctccggccacattctcagagtcaggaaaaggggcgagaggccacatgtctccctctcgcccaactgaaaacgaaacggcgctccagcagattgggtggaaagagctgggtctcttttctctgtttttcacgctagaaagggcttgtaaacattgttccttttaaaatgacctaccccaggcatttgtttgggcacacttctgtcctggggtcatcgttcctaggtggcttcggacctgggacttttcctgtatctgcacattgtcgttttatacacaattgccaaggtgggactgctttcaactttactgtgcttgaagctgcaaaggttctgccctgatgtttcctggaataatgctgaggactgcctttcgggtagccgccctattcagttcacttcatctcggaaatacctgacccctgccttggatccagcggccctcctgagagctgaggaaggaggaaatcctatgtgtctgctcccggagctgccacaacccatcttcccacaactcggaacttggaaaaaggaacccaggacacgactttgcttttcttttggacctagttggtgattatactctgtctcccatggagaccacgtcttgcatccttccttctatatgggatttaggatagaaattaaaaagaaaacatattattttgagtcttgatttggagaaaggtagtattcaggaggaagtaggctatgatacacatagaaaatttgaggacagtgttacttaacaaggacatttctgtctctgcagaagtcacagcttggaggaaaccagtttgcactatttgatgaggaatttggccaccaaaccactgatactttcccaaaggtttggcagaaattgttttttgagtggctcaccagagtacccagaagaatcagtatggaattagaggacagtggcctaccctaaataaagacatgagtgatgt

SEQ ID NO: 25200 - DNA, 1362 bp, Homo sapiens
tagccacggacgcgcgctcggtcccccgccgtgcgcccccggtcccgcgcccaggctcccgcccctggcctccttaccagccacttgtcgcccagctgcgaactggagcgggaggcggcggccggagggcccaggacagccccgggagggcggcgaggcggagcaggagcgccccggctccggccacattctcagagtcaggaaaaggggcgagaggccacatgtctccctctcgcccaactgaaaacgaaacggcgctccagcagattgggtggaaagagctgggtctcttttctctgtttttcacgctagaaagggcttgtaaacattgttccttttaaaatgacctaccccaggcatttgtttgggcacacttctgtcctggggtcatcgttcctaggtggcttcggacctgggacttttcctgtatctgcacattgtcgttttatacacaattgccaaggtgggactgctttcaactttactgtgcttgaagctgcaaaggttctgccctgatgtttcctggaataatgctgaggactgcctttcgggtagccgccctattcagttcacttcatctcggaaatacctgacccctgccttggatccagcggccctcctgagagctgaggaaggaggaaatcctatgtgtctgctcccggagctgccacaacccatcttcccacaactcggaacttggaaaaaggaacccaggacacgactttgcttttcttttggacctagttggtgattatactctgtctcccatggagaccacgtcttgcatccttccttctatatgggatttaggatagaaattaaaaagaaaacatattattttgagtcttgatttggagaaaggtagtattcaggaggaagtaggctatgatacacatagaaaatttgaggacagtgttacttaacaaggacatttctgtctctgcagaagtcacagcttggaggaaaccagtttgcactatttgatgaggaatttggccaccaaaccactgatactttcccaaaggtttggcagaaattgttttttgagtggctcaccagagtacccagaagaatcagtatggaattagaggacagtggcctaccctaaataaagacatgagtgatgtataaagtctagtgtcaatttattcagaaaatatcaaaattattctgggagctatgggtcaaagttgataggcacaaacaaacaaaaacgaaaggtattttaaattcacagcttggataagtaaaagggagatgttgtcatttctcttcttcaatccaactttagattttcaagccggaaaaagggtaattagaagttagaaattgttattgccagaaaatagctctaaaccctga

SEQ ID NO: 25201 - DNA, 150 bp, Homo sapiens
tacaggcaagcctgggtctttctggagatcctgggagggaggaggagagggaggaccttgggccacaggtaggacacaccgcctaatgcatctatccagggccaaggcggggtcaggatgagagggacaggcctccaaacaaatcagagt

SEQ ID NO: 25202 - DNA, 2116 bp, Homo sapiens
acttgctttttctcccgctttgtaattgtaggagaaaaccaaagaactagcagagaagcaggcgcaactccaggagcccatctcgctggccagctgcgccatggctgatctggttccagacttgcagcccattcttttctggatgtctaactccatcgagctcctgtactttatccagcagaaatgcccactctacatgcagagcatggaggagcagctggacatcacaggctcgaaggaatcgctgttctcctgcacgctgacggccagcgaggaggccatggcggtgctggaggaggtggtgctgtacgccttccagcagtgcgtctactatgtctccaagtccctgtacatctgcctcccggcactcctggagtgcccgccattccagacggagcgccgtgagagctggtcctcggcccccgaactgcccgaggagctgcgccgcgtggtgtctgtgtaccaggcagccctggacctcctgcggcagctgcaggtgcaccccgaggtggcctcgcagatgctcgcctacctcttcttcttctccgggacactgcttctcaaccagctcctcgacaggggcccctccctgagctgcttccactggcccagaggtgtccaggcctgcgcccgcctgcagcagctcctggagtggatgcggagcgccggcttcggggcggctggagagcacttcttccagaagctctcctgcaccctcaacctgctggccacacccagggcccagctcatccagatgagctggacagccctgcgggctgcgttccccgcactgagcccagcacagctgcaccggctgctgactcactaccagctggcctcggccatgggccccatgagcacctgggagccaggggcccaggacagccccgaggccttcaggtcagaggatgttctggagtcctacgaaaaccccccacccatcgtcctgcccagcgacggcttccaggtggacttggaagccaactgcctggacgacagcatctaccagcacctgctctacgtccgccactttctgtggggtctgcggagcagagccagccccggcagccctggcaggcctggcagtggggcctcccagccagtgtgccccgagggtatgcaccacgtggtccttgacgggcacctggaggccccgagctgccccctggctcccagggaccctggcccagcagcccgggaagtggccccggagcgtactcttcccttgaggggggctccctgggcacaggccccccctggaaggcaacccggccgtgggggctcccaggctggccccccgcacacggactcgtcctgcttgctcacgcctcccagcactccacttggccctgagcctggggaccccgactggccagagtccggcggcccctgtggaaaagcgctcccagagaggcagaggaacggactcagcggcctccggggtgcagctccggaaggagactctgcagcccttgcggaggagtcccctccagccccgtccagccgcagctccagcaccgaggacttctgctacgtcttcacggtggagctggaacgaggcccctccgggctggggatgggcctgatcgacgggatgcacacgcacctgggcgcccccgggctctacatccagaccctgctcccgggcagccccgcagcggccgacgggcgcctgtcgctgggggaccgtatcctggaggtgaatggcagcagcctcctgggccttggctacctgagagctgtggacctgatccgtcatggcgggaagaagatgcggttcctggtcgcgaagtccgacgtggaaacagccaagaagatccatttccgcacgccccctctctaggggggctgcgaggacacccccacaggcccggcacccggtcccacctggtgacactgggcttcctcccgccttcgtccctgttttgtaactgaccaagttgggtcccgggtggggagcctcaccctggggacatgcctgttgataacatgcatctcagtgtaggttctatttatatggcagatgacgtgaaattgtgatgtttgttacagagcttttatgtttaaagacttcaatggagaagtacggttcaataaactatttttcccgttctta

SEQ ID NO: 25203 - DNA, 1367 bp, Homo sapiens
atctgctcgggatttggcgtcggcggctccgggcgcctccagctccggctcgggctccggctccggctccgggcgccgaccaggtccccttggcccccgccgcgcgccctccaacctgctgctgccgccgccgcgccccccaggctctgccagctacccgcgctctgagcccggggccagattcccatggaagcgccgcgatgttcgccccccggctgctggatttccagaagacgaaatacgcgaggttcatgaaccaccgagtccctgcccacaagaggtaccagcccacagagtatgaacatgcggccaactgtgccacccatgctttctggatcatccccagcatcctgggcagctccaacctctacttcctgtcggacgatgactgggagaccatctctgcctggatctacggcctcggcctctgcggcctcttcgtggtgtccactgtgtttcacaccatctcctggaagaagagccacctcaggatggtggaacactgtctacacatgttcgaccggatggtcatctatttcttcatagcggcttcctacgcaccctggctgaaccttcgggagctgggcccctgggcctcccacatgcgctggctggtctggattatggcttccgtgggcaccatctatgtcttcttcttccatgagcggtacaagcttgtggagcttctctgctacgtcgtaatgggcttcttccccgccctggtcatcctctccatgcccaacaccgagggcatctgggagctggtgacccggaggggtcttctactgcctgggcatggtcttcttcaagagtgacgggaggatcccctttgcccacgccatctggcatctctttgtagcatttggtgctggtacccactactatgccatctggaggtacctctatctgcccagcaccctgcagaccaaggtgtccaaatgaggtgacccagacttgagaggtcgtttgggctttaggagtggagcacgtttctgcgaacgttaacccagagcacagcgccaaggcctgtcttccctttattgggtagagttcttgatggctccaaggtgacttctggtgacagccagatcgtccctcgagtccccagcgagaaagaaagcatttagccattcttacagaggagaaattaaccctgtaatgtgtttctattttagatgagtgtttcctaatacaagcaacattaacatcttcagaaaaggaagcaggcatggtcctgggaaaattggggaatgacgggccaatctgtgtttcctaaggtcctgaagaatctggcaaagagtcctgtgggttgttttatacctgggtggccagggcctccctctctgttaccaaagtccaggctggcg

SEQ ID NO: 25204 - DNA, 3674 bp, Homo sapiens
  misc_feature (894)..(894): n is a, c, g, or t
cccgttgcgccgccggcaggaggcgccgcggcacgcgcgggtctgggcgccggccccagccaacggcgagtgggagcagcgcgggaacgtggcggcgcggcgggttgtgccggaggtcacggcctccccacatcctttggctgaagcccacagtcctcatccatgaagcctcacccaccatgttttatgggacgcacttcatcatgtccccgcccaccaagagcaaactgaagcggcagagccagctgttgtccagcatgctgtcccggacgctgagctacaagtaccgggacctggactccaccttctccagcctgggcgccagcgatgaccccgccgagctctccacccagctgtcggcccctggtgtcctgaaggtgtttggggacagtgtctgcacaggaacccactacaagagcgtcctggccaccggcacctccagcgcccgtgagctggtgaaggaggcgctggagcggtacgccctggaccccaggcaggccggccagtacgtgctgtgtgacgtggtgggccaagccggcgatgctgggcagcggtggcaggcccggtgctttcgggtgtttggggacagtgagaagcccctcttgatccaggaattatggaaaccccgagaaggtttatcccggaggtttgagctgaggaagaggtcggacgtggaggagctggcagccaaggaggtggacaccatcacggcagggataaacgcccaggcccggaggctgcagcggagtcgcgcgaagggaaccccgaccccggccctgggggatgcccggagctctcctccaccccggttgcgccgcacagtcagtgagaccagcctgagcccagtgaacgccctgcccgctgccgcccagggccccgaggagcccggccccnacgccatgcggtactcgctgtaccagtccccgcatctgctccttctgcagggctacagccagcagcaccctggtgtatgtgctcaaccgggaccggcacacggtgggccagcggacccctccagcaagcccagcatcagcctctcagcccccgacatcctgcctctacactgcaccatccgccggcaaccgctcccggacagcggccaggccgcggggaggctggtcctggagcccatccccggggcgcacatctccgtcaacttctccgaggtggggcacaggaccgtggtgctgcaccacggggacctgctctccctggggctctactacctgctgctattcaaggaccccgcgcaggcccagcccctgcccgcccgggccttggcgcgcctccgggctgtgccgcagagctgccggctgtgcggggccgcgctcggggcccggggagccgcctcccctactcaggccgccctgccccggcgccagcagctgctcctggagtttgagccccacctggaggacacgctgctgcagaggatcatgacgttgatcgagccggggggcgacgaccacaagctgacccccgccttcctcctgtgcctctgcatccagcactcggccacccacttccagccgggcacattcgggcagctcctgctcaagatagccaggctgatccgcgagactgtctgggagaaaaccaaagaactagcagagaagcaggcgcaactccaggagcccatctcgctggccagctgcgccatggctgatctggttccagacttgcagcccattcttttctggatgtctaactccatcgagctcctgtactttatccagcagaaatgcccactctacatgcagagcatggaggagcagctggacatcacaggctcgaaggaatcgctgttctcctgcacgctgacggccagcgaggaggccatggcggtgctggaggaggtggtgctgtacgccttccagcagtgcgtctactatgtctccaagtccctgtacatctgcctcccggcactcctggagtgcccgccattccagacggagcgccgtgagagctggtcctcggcccccgaactgcccgaggagctgcgccgcgtggtgtctgtgtaccaggcagccctggacctcctgcggcagctgcaggtgcaccccgaggtggcctcgcagatgctcgcctacctcttcttcttctccgggacactgcttctcaaccagctcctcgacaggggcccctccctgagctgcttccactggcccagaggtgtccaggcctgcgcccgcctgcagcagctcctggagtggatgcggagcgccggcttcggggcggctggagagcacttcttccagaagctctcctgcaccctcaacctgctggccacacccagggcccagctcatccagatgagctggacagccctgcgggctgcgttccccgcactgagcccagcacagctgcaccggctgctgactcactaccagctggcctcggccatgggccccatgagcacctgggagccaggggcccaggacagccccgaggccttcaggtcagaggatgttctggagtcctacgaaaaccccccacccatcgtcctgcccagcgacggcttccaggtggacttggaagccaactgcctggacgacagcatctaccagcacctgctctacgtccgccactttctgtggggtctgcggagcagagccagccccggcagccctggcaggcctggcagtggggcctcccagccagtgtgccccgagggtatgcaccacgtggtccttgacgggcacctggaggccccgagctgccccctggctcccagggaccctggcccagcagcccgggaagtggccccggagcgtactcttcccttgaggggggctccctgggcacaggccccccctggaaggcaacccggccgtgggggctcccaggctggccccccgcacacggactcgtcctgcttgctcacgcctcccagcactccacttggccctgagcctggggaccccgactggccagagtccggcggcccctgtggaaaagcgctcccagagaggcagaggaacggactcagcggcctccggggtgcagctccggaaggagactctgcagcccttgcggaggagtcccctccagccccgtccagccgcagctccagcaccgaggacttctgctacgtcttcacggtggagctggaacgaggcccctccgggctggggatgggcctgatcgacgggatgcacacgcacctgggcgcccccgggctctacatccagaccctgctcccgggcagccccgcagcggccgacgggcgcctgtcgctgggggaccgtatcctggaggtgaatggcagcagcctcctgggccttggctacctgagagctgtggacctgatccgtcatggcgggaagaagatgcggttcctggtcgcgaagtccgacgtggaaacagccaagaagatccatttccgcacgccccctctctaggggggctgcgaggacacccccacaggcccggcacccggtcccacctggtgacactgggcttcctcccgccttcgtccctgttttgtaactgaccaagttgggtcccgggtggggagcctcaccctggggacatgcctgttgataacatgcatctcagtgtaggttctatttatatggcagatgacgtgaaattgtgatgtttgttacagagcttttatgtttaaagacttcaatggagaagtacggttcaataaactatttttcccgttctta

SEQ ID NO: 25205 - DNA, 3806 bp, Homo sapiens
  misc_feature (1026)..(1026): n is a, c, g, or t
atctgctcgggatttggcgtcggcggctccgggcgcctccagctccggctcgggctccggctccggctccgggcgccgaccaggtccccttggcccccgccgcgcgccctccaacctgctgctgccgccgccgcgccccccaggctctgccagctacccgcgctctgagcccggggccagattcccatggaagcgccgcgatgttcgccccccggctgctggatttccagaagacgaaatacgcgaggtcacggcctccccacatcctttggctgaagcccacagtcctcatccatgaagcctcacccaccatgttttatgggacgcacttcatcatgtccccgcccaccaagagcaaactgaagcggcagagccagctgttgtccagcatgctgtcccggacgctgagctacaagtaccgggacctggactccaccttctccagcctgggcgccagcgatgaccccgccgagctctccacccagctgtcggcccctggtgtcctgaaggtgtttggggacagtgtctgcacaggaacccactacaagagcgtcctggccaccggcacctccagcgcccgtgagctggtgaaggaggcgctggagcggtacgccctggaccccaggcaggccggccagtacgtgctgtgtgacgtggtgggccaagccggcgatgctgggcagcggtggcaggcccggtgctttcgggtgtttggggacagtgagaagcccctcttgatccaggaattatggaaaccccgagaaggtttatcccggaggtttgagctgaggaagaggtcggacgtggaggagctggcagccaaggaggtggacaccatcacggcagggataaacgcccaggcccggaggctgcagcggagtcgcgcgaagggaaccccgaccccggccctgggggatgcccggagctctcctccaccccggttgcgccgcacagtcagtgagaccagcctgagcccagtgaacgccctgcccgctgccgcccagggccccgaggagcccggccccnacgccatgcggtactcgctgtaccagtccccgcatctgctccttctgcagggctacagccagcagcaccctggtgtatgtgctcaaccgggaccggcacacggtgggccagcggacccctccagcaagcccagcatcagcctctcagcccccgacatcctgcctctacactgcaccatccgccggcaaccgctcccggacagcggccaggccgcggggaggctggtcctggagcccatccccggggcgcacatctccgtcaacttctccgaggtggggcacaggaccgtggtgctgcaccacggggacctgctctccctggggctctactacctgctgctattcaaggaccccgcgcaggcccagcccctgcccgcccgggccttggcgcgcctccgggctgtgccgcagagctgccggctgtgcggggccgcgctcggggcccggggagccgcctcccctactcaggccgccctgccccggcgccagcagctgctcctggagtttgagccccacctggaggacacgctgctgcagaggatcatgacgttgatcgagccggggggcgacgaccacaagctgacccccgccttcctcctgtgcctctgcatccagcactcggccacccacttccagccgggcacattcgggcagctcctgctcaagatagccaggctgatccgcgagactgtctgggagaaaaccaaagaactagcagagaagcaggcgcaactccaggagcccatctcgctggccagctgcgccatggctgatctggttccagacttgcagcccattcttttctggatgtctaactccatcgagctcctgtactttatccagcagaaatgcccactctacatgcagagcatggaggagcagctggacatcacaggctcgaaggaatcgctgttctcctgcacgctgacggccagcgaggaggccatggcggtgctggaggaggtggtgctgtacgccttccagcagtgcgtctactatgtctccaagtccctgtacatctgcctcccggcactcctggagtgcccgccattccagacggagcgccgtgagagctggtcctcggcccccgaactgcccgaggagctgcgccgcgtggtgtctgtgtaccaggcagccctggacctcctgcggcagctgcaggtgcaccccgaggtggcctcgcagatgctcgcctacctcttcttcttctccgggacactgcttctcaaccagctcctcgacaggggcccctccctgagctgcttccactggcccagaggtgtccaggcctgcgcccgcctgcagcagctcctggagtggatgcggagcgccggcttcggggcggctggagagcacttcttccagaagctctcctgcaccctcaacctgctggccacacccagggcccagctcatccagatgagctggacagccctgcgggctgcgttccccgcactgagcccagcacagctgcaccggctgctgactcactaccagctggcctcggccatgggccccatgagcacctgggagccaggggcccaggacagccccgaggccttcaggtcagaggatgttctggagtcctacgaaaaccccccacccatcgtcctgcccagcgacggcttccaggtggacttggaagccaactgcctggacgacagcatctaccagcacctgctctacgtccgccactttctgtggggtctgcggagcagagccagccccggcagccctggcaggcctggcagtggggcctcccagccagtgtgccccgagggtatgcaccacgtggtccttgacgggcacctggaggccccgagctgccccctggctcccagggaccctggcccagcagcccgggaagtggccccggagcgtactcttcccttgaggggggctccctgggcacaggccccccctggaaggcaacccggccgtgggggctcccaggctggccccccgcacacggactcgtcctgcttgctcacgcctcccagcactccacttggccctgagcctggggaccccgactggccagagtccggcggcccctgtggaaaagcgctcccagagaggcagaggaacggactcagcggcctccggggtgcagctccggaaggagactctgcagcccttgcggaggagtcccctccagccccgtccagccgcagctccagcaccgaggacttctgctacgtcttcacggtggagctggaacgaggcccctccgggctggggatgggcctgatcgacgggatgcacacgcacctgggcgcccccgggctctacatccagaccctgctcccgggcagccccgcagcggccgacgggcgcctgtcgctgggggaccgtatcctggaggtgaatggcagcagcctcctgggccttggctacctgagagctgtggacctgatccgtcatggcgggaagaagatgcggttcctggtcgcgaagtccgacgtggaaacagccaagaagatccatttccgcacgccccctctctaggggggctgcgaggacacccccacaggcccggcacccggtcccacctggtgacactgggcttcctcccgccttcgtccctgttttgtaactgaccaagttgggtcccgggtggggagcctcaccctggggacatgcctgttgataacatgcatctcagtgtaggttctatttatatggcagatgacgtgaaattgtgatgtttgttacagagcttttatgtttaaagacttcaatggagaagtacggttcaataaactatttttcccgttctta

SEQ ID NO: 25206 - DNA, 446 bp, Homo sapiens
gctagtgagtatatttagagttatttcttgattacatgctaaacaaggggcggattattcatgagttttctaggaaagggatgaagatttcctggaactgagggtccttcccctttttagactacataggtaacttcctgacgttaccgtggcatttggaaactgtcactgcgctggtgggagtgtcttttagaatgctaatgaattataattagcaactaacgagcagcaaggatgactagagatcactgtcgttgctgtcttggttttggccagcttctctacagcatcctattttatcaggagtgtctttgggacccgcatcttgaacctgtaccttgtgctgacctcctgtctcatcccgtgactaagaatgcctgtcctcctgggaatgcagccccgcaggtctcagcctcgtttttacccagcccctatttaagacgcgg

SEQ ID NO: 25207 - DNA, 6012 bp, Homo sapiens
  misc_feature (894)..(894): n is a, c, g, or t
cccgttgcgccgccggcaggaggcgccgcggcacgcgcgggtctgggcgccggccccagccaacggcgagtgggagcagcgcgggaacgtggcggcgcggcgggttgtgccggaggtcacggcctccccacatcctttggctgaagcccacagtcctcatccatgaagcctcacccaccatgttttatgggacgcacttcatcatgtccccgcccaccaagagcaaactgaagcggcagagccagctgttgtccagcatgctgtcccggacgctgagctacaagtaccgggacctggactccaccttctccagcctgggcgccagcgatgaccccgccgagctctccacccagctgtcggcccctggtgtcctgaaggtgtttggggacagtgtctgcacaggaacccactacaagagcgtcctggccaccggcacctccagcgcccgtgagctggtgaaggaggcgctggagcggtacgccctggaccccaggcaggccggccagtacgtgctgtgtgacgtggtgggccaagccggcgatgctgggcagcggtggcaggcccggtgctttcgggtgtttggggacagtgagaagcccctcttgatccaggaattatggaaaccccgagaaggtttatcccggaggtttgagctgaggaagaggtcggacgtggaggagctggcagccaaggaggtggacaccatcacggcagggataaacgcccaggcccggaggctgcagcggagtcgcgcgaagggaaccccgaccccggccctgggggatgcccggagctctcctccaccccggttgcgccgcacagtcagtgagaccagcctgagcccagtgaacgccctgcccgctgccgcccagggccccgaggagcccggccccnacgccatgcggtactcgctgtaccagtccccgcatctgctccttctgcagggctacagccagcagcaccctggtgtatgtgctcaaccgggaccggcacacggtgggccagcggacccctccagcaagcccagcatcagcctctcagcccccgacatcctgcctctacactgcaccatccgccggcaaccgctcccggacagcggccaggccgcggggaggctggtcctggagcccatccccggggcgcacatctccgtcaacttctccgaggtggggcacaggaccgtggtgctgcaccacggggacctgctctccctggggctctactacctgctgctattcaaggaccccgcgcaggcccagcccctgcccgcccgggccttggcgcgcctccgggctgtgccgcagagctgccggctgtgcggggccgcgctcggggcccggggagccgcctcccctactcaggccgccctgccccggcgccagcagctgctcctggagtttgagccccacctggaggacacgctgctgcagaggatcatgacgttgatcgagccggggggcgacgaccacaagctgacccccgccttcctcctgtgcctctgcatccagcactcggccacccacttccagccgggcacattcgggcagctcctgctcaagatagccaggctgatccgcgagactgtctgggagaaaaccaaagaactagcagagaagcaggcgcaactccaggagcccatctcgctggccagctgcgccatggctgatctggttccagacttgcagcccattcttttctggatgtctaactccatcgagctcctgtactttatccagcagaaatgcccactctacatgcagagcatggaggagcagctggacatcacaggctcgaaggaatcgctgttctcctgcacgctgacggccagcgaggaggccatggcggtgctggaggaggtggtgctgtacgccttccagcagtgcgtctactatgtctccaagtccctgtacatctgcctcccggcactcctggagtgcccgccattccagacggagcgccgtgagagctggtcctcggcccccgaactgcccgaggagctgcgccgcgtggtgtctgtgtaccaggcagccctggacctcctgcggcagctgcaggtgcaccccgaggtggcctcgcagatgctcgcctacctcttcttcttctccgggacactgcttctcaaccagctcctcgacaggggcccctccctgagctgcttccactggcccagaggtgtccaggcctgcgcccgcctgcagcagctcctggagtggatgcggagcgccggcttcggggcggctggagagcacttcttccagaagctctcctgcaccctcaacctgctggccacacccagggcccagctcatccagatgagctggacagccctgcgggctgcgttccccgcactgagcccagcacagctgcaccggctgctgactcactaccagctggcctcggccatgggccccatgagcacctgggagccaggggcccaggacagccccgaggccttcaggtcagaggatgttctggagtcctacgaaaaccccccacccatcgtcctgcccagcgacggcttccaggtggacttggaagccaactgcctggacgacagcatctaccagcacctgctctacgtccgccactttctgtggggtctgcggagcagagccagccccggcagccctggcaggcctggcagtggggcctcccagccagtgtgccccgagggtatgcaccacgtggtccttgacgggcacctggaggccccgagctgccccctggctcccagggaccctggcccagcagcccgggaagtggccccggagcgtactcttcccttgaggggggctccctgggcacaggccccccctggaaggcaacccggccgtgggggctcccaggctggccccccgcacacggactcgtcctgcttgctcacgcctcccagcactccacttggccctgagcctggggaccccgactggccagagtccggcggcccctgtggaaaagcgctcccagagaggcagaggaacggactcagcggcctccggggtgcagctccggaaggagactctgcagcccttgcggaggagtcccctccagccccgtccagccgcagctccagcaccgaggacttctgctacgtcttcacggtggagctggaacgaggcccctccgggctggggatgggcctgatcgacgggatgcacacgcacctgggcgcccccgggctctacatccagaccctgctcccgggcagccccgcagcggccgacgggcgcctgtcgctgggggaccgtatcctggaggtgaatggcagcagcctcctgggccttggctacctgagagctgtggacctgatccgtcatggcgggaagaagatgcggttcctggtcgcgaagtccgacgtggaaacagccaagaagatccatttccgcacgccccctctctaggggggctgcgaggacacccccacaggcccggcacccggtcccacctggtgacactgggcttcctcccgccttcgtccctgttttgtaactgaccaagttgggtcccgggtggggagcctcaccctggggacatgcctgttgataacatgcatctcagtgtaggttctatttatatggcagatgacgtgaaattgtgatgtttgttacagagcttttatgtttaaagacttcaatggagaagtacggttcaataaactatttttcccgttcttagagggtgccctgctggggtctcaactcgggcagcaggcgtgggctgctcggaggggccgcaggggctccccatggcctctgcctgccaccggcacgggagaatgcagtgacagctgtcatcaggggatcatctgaactgactctccctgcccccgtcccacccagacacagggcactgcaggaagcagctccaacagcccctcccagctgaagcagggccagacctggcagaggatgctggacttctgatcccgctgctcagcacaggccccagagaaaggtctagacacccaggcgttggaaagtggaccggcctgatggtctctgaggcgccgagcccaccctgggccctgcttcctctcccaggactcctgctccctcctgagttcctctcccctactaaagccaccagcgtggccctgataccaggctggcggccccaggcccttaatcctcaccagcgtccccctggccaccggccctaacccgggcaggaggccagcgtccctctccaccagctggctgaccatgcgcaggaccagggcagggcacttgctgcctcggggtgacagcgtgggtcgctgggcatcctcagcagctccaccaactgggtgtgggtggcttccgcgccctcctggctgtggtggaactggtggcccagggtcatctttgatagcaacagagaaaccctggggaagagggtcccggcatcagttgcagatgcacctctcactgggacagaggtctgtgcggggtccccagatcggtgtcctgggtctgtcccaggccctgggcctcgtgcagctccacgctgccccctggtgtgcgctacggcgaggtgcagcgcgtccgccccgcgccctctgccgacccgcagttctgtgtgcggctccgcattgcgcctggctcgaaacggcgaccactgccaggttcccaaaatactggataaaatatatatatatatatagtgtttgtatatatatttaagatatgtaaaatatatgaatatatataaatatataattatatatgaatatattacatattcatgtatacgtaatatattcgtatattttataaacattttttatattttattatataaaatataaatatttaatttttttttatgagacggagtctcgctctgtgacccaggctggagtgcagtggtgcaatctcagctcactgcaacctccacctcccaggttcaagcaattctcctcagtctcctgagtagctgggattacaggcgcctgccaccacgcttggctaatttagtacttttagtagagacagggtttcaccacgttggccaggctgatttcaaactgacatcaagtgatctgcccgccttgccctcccaaagtgctgggattacaggcgtgggattaccatgcctggccttgttctgtttcttttcctaggagtcccacaacgtgtgtgttagcactgccgagaatgtctcacagctctggacggtctgcatttctggacctggtgcagatcccaggatcctggactctgatttgatgccttaacggtggaagggggttgagtatattttttatgtgggaggggtgtggactgtggccagaggaaagacagtggcaaggcatttccaaaggtggccaccaacagttcctcccacaaagagaagggggcttatctcttcttccctgcaatattctccggccttctgacttgctccgaacaacaggatgcagcataagtgatattctgggaccttccaagccagactgaagggcctttggtttctattttcatgctcctggaactcagcatccatggaaagaagctcttggcatcaccccaaggaagggaggccccgtggagtcggggaggcccagctagcctctggccgctgaagcacctagctgaggtgcgggactggtgagggctgccactggctgttctggtcttgctgagcttccaggcgaatgcagtcccaccagtgatcccggggacaccacgtggagcagaacgacttcccagccaggccccagacaatctacaacactgtgaaaggagtgtctttgggacccgcatcttgaacctgtaccttgtgctgacctcctgtctcatcccgtgactaagaatgcctgtcctcctgggaatgcagccccgcaggtctcagcctcgtttttacccagcccctatttaagacgcggttgctgtggctcccacgcctctgacctgagtcatgcagtatgtggccttgggtctggattcttttgtgtccggaattggtgggttcttggtctcactgacctcaagaatgaagtcgcggaccctcgcggtgagtgttacagttctt

SEQ ID NO: 25208 - DNA, 1533 bp, Homo sapiens
  misc_feature (2)..(2): n is a, c, g, or t
  misc_feature (6)..(6): n is a, c, g, or t
  misc_feature (8)..(8): n is a, c, g, or t
gncacnancagagaccagtggggcagagacaggcccagtgcagagcggctcagtggggctggagggttcctggctacaaggccttgttctcagtcctgaactgctcggatgtcacaccgggtggtcggcgggaattcagaagggatgagtcctagggtggggccagtcactgtggccaggatcccagcctcctgtgtccacagggcaggggactcagggctcaatctgctggcccctgggttcccacaccgttgggcggggcggcctggcgagggaggcagcttctcctgtggccattacgggcatcctctctcccctgcagaggatgttctggagtcctacgaaaaccccccacccatcgtcctgcccagcgacggcttccaggtggacttggaagccaactgcctggacgacagcatctaccagcacctgctctacgtccgccactttctgtggggtctgcggagcagagccagccccggcagccctggcaggcctggcagtggggcctcccagccagtgtgccccgagggtatgcaccacgtggtccttgacgggcacctggaggccccgagctgccccctggctcccagggaccctggcccagcagcccgggaagtggccccggagcgtactcttcccttgaggggggctccctgggcacaggccccccctggaaggcaacccggccgtgggggctcccaggctggccccccgcacacggactcgtcctgcttgctcacgcctcccagcactccacttggccctgagcctggggaccccgactggccagagtccggcggcccctgtggaaaagcgctcccagagaggcagaggaacggactcagcggcctccggggtgcagctccggaaggagactctgcagcccttgcggaggagtcccctccagccccgtccagccgcagctccagcaccgaggacttctgctacgtcttcacggtggagctggaacgaggcccctccgggctggggatgggcctgatcgacgggatgcacacgcacctgggcgcccccgggctctacatccagaccctgctcccgggcagccccgcagcggccgacgggcgcctgtcgctgggggaccgtatcctggaggtgaatggcagcagcctcctgggccttggctacctgagagctgtggacctgatccgtcatggcgggaagaagatgcggttcctggtcgcgaagtccgacgtggaaacagccaagaagatccatttccgcacgccccctctctaggggggctgcgaggacacccccacaggcccggcacccggtcccacctggtgacactgggcttcctcccgccttcgtccctgttttgtaactgaccaagttgggtcccgggtggggagcctcaccctggggacatgcctgttgataacatgcatctcagtgtaggttctatttatatggcagatgacgtgaaattgtgatgtttgttacagagcttttatgtttaaagacttcaatggagaagtacggttcaataaactatttttcccgttctta

SEQ ID NO: 25209 - DNA, 1439 bp, Homo sapiens
atctgctcgggatttggcgtcggcggctccgggcgcctccagctccggctcgggctccggctccggctccgggcgccgaccaggtccccttggcccccgccgcgcgccctccaacctgctgctgccgccgccgcgccccccaggctctgccagctacccgcgctctgagcccggggccagattcccatggaagcgccgcgatgttcgccccccggctgctggatttccagaagacgaaatacgcgaggttcatgaaccaccgagtccctgcccacaagaggtaccagcccacagagtatgaacatgcggccaactgtgccacccatgctttctggatcatccccagcatcctgggcagctccaacctctacttcctgtcggacgatgactgggagaccatctctgcctggatctacggcctcggcctctgcggcctcttcgtggtgtccactgtgtttcacaccatctcctggaagaagagccacctcaggatggtggaacactgtctacacatgttcgaccggatggtcatctatttcttcatagcggcttcctacgcaccctggctgaaccttcgggagctgggcccctgggcctcccacatgcgctggctggtctggattatggcttccgtgggcaccatctatgtcttcttcttccatgagcgaacagggagctgtgtgcagtttcttcgtggggaggcatgtcctaaggccggcacggcttgtcttcctgccaggtacaagcttgtggagcttctctgctacgtcgtaatgggcttcttccccgccctggtcatcctctccatgcccaacaccgagggcatctgggagctggtgacccggaggggtcttctactgcctgggcatggtcttcttcaagagtgacgggaggatcccctttgcccacgccatctggcatctctttgtagcatttggtgctggtacccactactatgccatctggaggtacctctatctgcccagcaccctgcagaccaaggtgtccaaatgaggtgacccagacttgagaggtcgtttgggctttaggagtggagcacgtttctgcgaacgttaacccagagcacagcgccaaggcctgtcttccctttattgggtagagttcttgatggctccaaggtgacttctggtgacagccagatcgtccctcgagtccccagcgagaaagaaagcatttagccattcttacagaggagaaattaaccctgtaatgtgtttctattttagatgagtgtttcctaatacaagcaacattaacatcttcagaaaaggaagcaggcatggtcctgggaaaattggggaatgacgggccaatctgtgtttcctaaggtcctgaagaatctggcaaagagtcctgtgggttgttttatacctgggtggccagggcctccctctctgttaccaaagtccaggctggcg

SEQ ID NO: 25210 - DNA, 3914 bp, Homo sapiens
  misc_feature (894)..(894): n is a, c, g, or t
  misc_feature (3914)..(3914): n is a, c, g, or t
cccgttgcgccgccggcaggaggcgccgcggcacgcgcgggtctgggcgccggccccagccaacggcgagtgggagcagcgcgggaacgtggcggcgcggcgggttgtgccggaggtcacggcctccccacatcctttggctgaagcccacagtcctcatccatgaagcctcacccaccatgttttatgggacgcacttcatcatgtccccgcccaccaagagcaaactgaagcggcagagccagctgttgtccagcatgctgtcccggacgctgagctacaagtaccgggacctggactccaccttctccagcctgggcgccagcgatgaccccgccgagctctccacccagctgtcggcccctggtgtcctgaaggtgtttggggacagtgtctgcacaggaacccactacaagagcgtcctggccaccggcacctccagcgcccgtgagctggtgaaggaggcgctggagcggtacgccctggaccccaggcaggccggccagtacgtgctgtgtgacgtggtgggccaagccggcgatgctgggcagcggtggcaggcccggtgctttcgggtgtttggggacagtgagaagcccctcttgatccaggaattatggaaaccccgagaaggtttatcccggaggtttgagctgaggaagaggtcggacgtggaggagctggcagccaaggaggtggacaccatcacggcagggataaacgcccaggcccggaggctgcagcggagtcgcgcgaagggaaccccgaccccggccctgggggatgcccggagctctcctccaccccggttgcgccgcacagtcagtgagaccagcctgagcccagtgaacgccctgcccgctgccgcccagggccccgaggagcccggccccnacgccatgcggtactcgctgtaccagtccccgcatctgctccttctgcagggctacagccagcagcaccctggtgtatgtgctcaaccgggaccggcacacggtgggccagcggacccctccagcaagcccagcatcagcctctcagcccccgacatcctgcctctacactgcaccatccgccggcaaccgctcccggacagcggccaggccgcggggaggctggtcctggagcccatccccggggcgcacatctccgtcaacttctccgaggtggggcacaggaccgtggtgctgcaccacggggacctgctctccctggggctctactacctgctgctattcaaggaccccgcgcaggcccagcccctgcccgcccgggccttggcgcgcctccgggctgtgccgcagagctgccggctgtgcggggccgcgctcggggcccggggagccgcctcccctactcaggccgccctgccccggcgccagcagctgctcctggagtttgagccccacctggaggacacgctgctgcagaggatcatgacgttgatcgagccggggggcgacgaccacaagctgacccccgccttcctcctgtgcctctgcatccagcactcggccacccacttccagccgggcacattcgggcagctcctgctcaagatagccaggctgatccgcgagactgtctgggagaaaaccaaagaactagcagagaagcaggcgcaactccaggagcccatctcgctggccagctgcgccatggctgatctggttccagacttgcagcccattcttttctggatgtctaactccatcgagctcctgtactttatccagcagaaatgcccactctacatgcagagcatggaggagcagctggacatcacaggctcgaaggaatcgctgttctcctgcacgctgacggccagcgaggaggccatggcggtgctggaggaggtggtgctgtacgccttccagcagtgcgtctactatgtctccaagtccctgtacatctgcctcccggcactcctggagtgcccgccattccagacggagcgccgtgagagctggtcctcggcccccgaactgcccgaggagctgcgccgcgtggtgtctgtgtaccaggcagccctggacctcctgcggcagctgcaggtgcaccccgaggtggcctcgcagatgctcgcctacctcttcttcttctccgggacactgcttctcaaccagctcctcgacaggggcccctccctgagctgcttccactggcccagaggtgtccaggcctgcgcccgcctgcagcagctcctggagtggatgcggagcgccggcttcggggcggctggagagcacttcttccagaagctctcctgcaccctcaacctgctggccacacccagggcccagctcatccagatgagctggacagccctgcgggctgcgttccccgcactgagcccagcacagctgcaccggctgctgactcactaccagctggcctcggccatgggccccatgagcacctgggagccaggggcccaggacagccccgaggccttcaggtcagaggatgttctggagtcctacgaaaaccccccacccatcgtcctgcccagcgacggcttccaggtggacttggaagccaactgcctggacgacagcatctaccagcacctgctctacgtccgccactttctgtggggtctgcggagcagagccagccccggcagccctggcaggcctggcagtggggcctcccagccagtgtgccccgagggtatgcaccacgtggtccttgacgggcacctggaggccccgagctgccccctggctcccagggaccctggcccagcagcccgggaagtggccccggagcgtactcttcccttgaggggggctccctgggcacaggccccccctggaaggcaacccggccgtgggggctcccaggctggccccccgcacacggactcgtcctgcttgctcacgcctcccagcactccacttggccctgagcctggggaccccgactggccagagtccggcggcccctgtggaaaagcgctcccagagaggcagaggaacggactcagcggcctccggggtgcagctccggaaggagactctgcagcccttgcggaggagtcccctccagccccgtccagccgcagctccagcaccgaggacttctgctacgtcttcacggtggagctggaacgaggcccctccgggctggggatgggcctgatcgacgggatgcacacgcacctgggcgcccccgggctctacatccagaccctgctcccgggcagccccgcagcggccgacgggcgcctgtcgctgggggaccgtatcctggaggtgaatggcagcagcctcctgggccttggctacctgagagctgtggacctgatccgtcatggcgggaagaagatgcggttcctggtcgcgaagtccgacgtggaaacagccaagaagatccatttccgcacgccccctctctaggggggctgcgaggacacccccacaggcccggcacccggtcccacctggtgacactgggcttcctcccgccttcgtccctgttttgtaactgaccaagttgggtcccgggtggggagcctcaccctggggacatgcctgttgataacatgcatctcagtgtaggttctatttatatggcagatgacgtgaaattgtgatgtttgttacagagcttttatgtttaaagacttcaatggagaagtacggttcaataaactatttttcccgttcttaaaaaaaaaaaaaaaaaaaaaaacaaaacaaaaaaaaaactcccggaggggaccaaaatggcgcgggggcggcgagaacacaggggcgttataggacgtgggcccagtggtgcaaaagttgtgtttctgtagacccagtttttttggcacacgggggggagaaccggcgcgggcgcccccaaaggggggcgcggaataaaattccggacaacgcagggttaccctgtagaggcgcgacacn

SEQ ID NO: 25211 - DNA, 418 bp, Homo sapiens
ttttcttggcttctgaaagtcattctcaggcagcacgagaactttaacttttctgtctgtatgtttctcttggtatttttttctctcttcgctaattttgcattttgcttttgtttctggtttatgcatgaaggataagttatgggggcatcaataattagtggaatttgactttatgttcatactatttggtaatttagataagtgaattaaaggaccaaagaggtctattctctattgggcaaaaggatagagaattcagattgttagtctcatttgtttgtccattttgagctcaaatcaattgaaaattttatcctcatcaggagagcatacgggtctacgatatctggccctgtgagtttttgtgttgctgtctttacttttaaactatgaataaaactgtacaactgaagct

SEQ ID NO: 25212 - DNA, 812 bp, Homo sapiens
gtgcactgtagcttcagtcctttgcccacagtcacatagctagcatatgtccaaatgatagtcaaaccttagtgtctgattctctgaatctatgttgtcgtctactttttctgtaacttttaattattaagtagttagggttccttcctgactatggattcatttgggaccatcacccaagattagtgagagatactttttaagacaaagtttatgatggaatatttcttggaattcatagcagctcaaagtaagtgttaactattggtgggttcttaaggaccagcatgtccaagggatagatagattggtaaattactgtatgtacctgtcttttacaaagctataagatatttaagtacccgttttgtaattttccacttaaactgatatgtttgatgaacttggcagtctaactgcattggttaaaaggatgcacatttatatttctaaatgaaatggaatactgaatttaaaaggtgatgttttctctattaagtatgaaaatagatacaaatctggccaggcgcggtgctcacgcctgtagtcccagcgctttgggaggccaaggtggtcagatcacctgaggtcaggagttcgagaccagcctggctaacatggtgaaaccccatttctactaaaaatacaaaaaattagccagacgtgttggcgggcacctgtaatctcagctactcgggaggctgaggcaggagaatcgcttgaacccaggtggcagaggttgcagtgagccaagatcttgccattgcactccagcctgagcaacaagagcaaaacaccatctcaaaaaaaaa

SEQ ID NO: 25213 - DNA, 529 bp, Homo sapiens
tgttaatctcatcctaaaacactctcatagacacacatagaaataatatttggtctgggcacctgttggcccaattaagttgatgcataaaattaaccatcacaccaagaaatacctctcctttccccaaacccttcatagtacgtgctatatttctctttgaatctaagaagattatcttctatgaggaaataatctgctccacacagaaacctgatacagagctctttcaataatgactcattctcaacatcatgaaattatattcgaagttgcagaaaattcactattgtatattgaatgctacattgaaattggaaagaaaaaggtgatataaaataaaagctattacatattttgtgcttctccctaatctgctttattcattggaaattcctacttaagtttagtctgcttaaaacaagctagatacttgattttgcatgcaacaccttggctgttacttttactgtctcctagcactgtgctacagactgcaaaatatttagagaaaattcagacctcgctc

SEQ ID NO: 25214 - DNA, 801 bp, Homo sapiens
ggccaggtgcagtgactcacgcctgaaatcccagcactttggaaggccaaggcgggaggatcacgaggtcaaaagatcgagaccatcctggccaccatggtgaaaccccatctctactaaaagtacaaaaaaaaattagccgggcgtggtgatgcacgcctgtagtcccagctacttgggaggctgaggcaggagactcgcttgaacctgggaggcagaggttgcagtgagccgagatcgtgccactgcactccagcctggcaaaagagcgagactgtctaaaaaaagaaaaataaaaagcaaactacagtataaagtgggttacagaaagtctcaatgatgtattcatatgtaaaaaattaaaggagctgcacacttaaatgtgcactatttattgtaagttatacctcaataaaaggttttctttaatcttcataaaaaaaacaaagaaaggctgctaagtaaaaagcaatacattaaatttctcatgttaacattaaagtactgcatacctaacatcaataggaaaaaataatctaaaaggattactctgttggtttgtgctttgaggacaatttcttttttttacaaagattgctcaatgtggttgtgttctagcatgaagttcagttgtttggccttgcgcagtggttcacacctgtaatcccagcactttgggaggccgaggcgggcggatcacagggtcaggagatcgagaccatcctggctaacgcagtgaaaccgtgtttctactaaaaatacaaaaaaattagccaggcttggtggtgggcgcctatagtc

SEQ ID NO: 25215 - DNA, 392 bp, Homo sapiens
tgctaatgtttcaaattgcctgctggtttattatgttttcccttacttaggcaagtaaagttaagagctattgaagttcacggccatgagggcacatccatggatatcataaagcagcccttttacattttctctctctgcgaatccagccttcagcaggatgattaacagcttcaacctggggaaagaacgcagtctttcctctggggcttcccagacccaagaccctgcccatccccatcacagctctctaagcctgactgcctgtgaggtggggaaagactcaaagaaactgtgccaatcccaatgatacccagggcccgactactgcagggaagcagaaatgatgccttgtaaattggttataaaatggccttgtccaaaggtatgtg

SEQ ID NO: 25216 - DNA, 381 bp, Homo sapiens
tgttcattcagaaaaggtgatatgtataacccagtgtccagttgggtcaactgttttctctctttcacctccttgttagatagtgtctaataattgttccttaaaagcattttgagaaactagtctccatttcagaattttctaatacttgcccagtacccaacacccaataggtgtttgatgcacagttattgaaattgaattaaattgtgaaggatactaataagactcctgcatgtgctgtgttttaggaatattcaccccagcacagtggctcacgcctattcaggagggtaggggtttggggcggtggggaggatcacttgaagccaggagttccagaccagccttggcaacatagcaagacaccatctgtaccaa

SEQ ID NO: 25217 - DNA, 564 bp, Homo sapiens
caattaagacaactctccgtcttaactctttaaaatatctctagcaagtggttacttagcttctgcttgaacacatccactgacaaggagctcactggtctggacagtttattcaatttctagacagctcattcaatttctggacagctctaaacactgcaaatcattccctgtaatcaggtgaagggacctactctaactttaatttagtctttcttttttactcccttaagtcctacagaacatacagttcttctttcacaggaggaatagatatctgctatttgaatactattgccaagctatgcactctctgtcctctttatgttaaattctttaggcccttcaaacattttaaaatgatatggttttatattccagtgacattttagacatgttatctggaatacatgtcatctagttaatgtccctcttaaaatgtggcaccatagcagaacatggttgccaaggaaaaaatatgaaaaaccatgtttccaaatttcattttctattaggagataccttgtaatatgattaaatttccttttaaatcttaaaaaaaaa

SEQ ID NO: 25218 - DNA, 215 bp, Homo sapiens
ttttagagtttcagttgtatttccctatgaggccttgaatttagcaaaccttagttaattaactttttaaaggaaaaatgtgctcttacattagtggcttttaagcatttcttccgactttaccggcctttcccccttaggacaacatttaaaataagtgttttcaacaaacagagcaaataccttgtgaataaacatcaatttcacacaaccag

SEQ ID NO: 25219 - DNA, 455 bp, Homo sapiens
ggaaatgagtgttccacgctctctgggttctacccttcttctttgtagcctcccagccaggggtctggtggaggtctgactcctctgtcctgtgcccttggatgtggtatggaggaggggagaataaggcagcccccaggttctgggcgcaccccactccctacgtgggaagggcaggtggctccctctctagcctgccgtggtggcagggtccacagaccccactggggcccaacaacgtgaggccctgccttgccctgcactgggcgcctgtgtacccagtctcccaaggccttgtcccacctcacagccaagctgctcacctggatgcctgccgctacggcccagctctgctaccctgaggactcagctgcactgtgcagggaaggttctaggaccaggggaagccttgggggatgggcagggctgtctgccagcacctgggccagtgaggc

SEQ ID NO: 25220 - DNA, 373 bp, Homo sapiens
aatggtgaaaagaaaactcccagatatcagctgttagccagccttaaaagctactagtcccgatcagaggaggaggacagggcgctctcaaagctaagtctccaagaacagggaggaatacctagattgcctgagatactagagtacttggggaaaaaaattctggtgggaatctggcacttctgatgagcactggggaaaaagttaaaggctattttttaaaatctatgcaattttttaaaaaggcaatcattaactgcagacaaaacgaatggctgtgtaaggaaagtaagtgtattcatagcacaatacttggcccttcaaagaataaaagttatgtagtcatcattaataccaatactgattattgatt

SEQ ID NO: 25221 - DNA, 548 bp, Homo sapiens
ttttgtattttttgtagagacagggtttcacactgttacccagggtggtctcgaactcctgagctaaagcgatccacccgcctcagcctctcaaagggctaggattacaggcatgaccaagcctgtgccactgcactccagcctgggcgacaaagcaagactgagtctcaaaaataataataataataatacaaaaataacctggagaatacacctatttttatgatgtcctaatctgagtagcaaaactggaatagcaacataaatgaggcaaagactatcaagcagtcagatattatcataggggaagtctaaagatcaacccaaatcgcagagttaatcatacagtggttgtttcattggcacatacaaccagagtccaaatcgccaagataatcactgactcatccttcactctcaatcagcttttacattatggtgtttcagtagagaaatttttattgcttacatgtcctcacttattatgcaggatcagcaaaatgcacactgcatgcattcacacactaaccacacaccttctcaacctc

SEQ ID NO: 25222 - DNA, 448 bp, Homo sapiens
  misc_feature (440)..(440): n is a, c, g, or t
acgaatttcttgcaaagatcttggccgtggtgactgtgagggctggctttggaaaaagaaagatgcgaagagttacttttcacagaaatggaaaaaatattggtttgtcctaaaggatgcatccctttattggtatattaatgaggaggatgaaaaagcagaaggattcattagcctgcctgaatttaaaattgatagagccagtgaatgccgcaaaaaatatgcattcaaagcctgtcatcctaaaatcaaaagcttttattttgctgctgaacatcttgatgatatgaacaggtgggctttaacagaattaatatgctggactgcagggatatggcagaaaggggagagggtttaaggcagggaaccaaggattacttgggagttgaggagttgacccagggaagggaggccaggttacttcccttccaaccaccccnaaaccagg

SEQ ID NO: 25223 - DNA, 423 bp, Homo sapiens
actaatattcgttgagccttttagtagggatctaccttttactagagattgagcactcctcatacattgtctcattaaaccaactctccaaagtagtatctgtcctgttctaccgaaagaacaactcaaaaatgttgcattgccagtaagtggtggagctggaatgtatctgccctcaaagcttcacggacttgctttgaagaagatggtataattcaaagtactttcaaaaggacatagcagtatactgaggttaaaaaaaattagtattcccaaactgagatccttctgtgagctttgtaaccctggcagttagttgcaatactaccaatttggccatcaagaacattctgatatgtttaagctacagtgggaaagccaagatatgaaaacatcacccatgggaattttgagactagagta

SEQ ID NO: 25224 - DNA, 446 bp, Homo sapiens
gaacattctccaagatagatcatatgataggccacaaaacaagtctcaataagtttaagaaaatcaaaattatcttgagtattctctcagacagcagtgcaataatattgtaaatcaattccaaatggaatcctcaaaattatgtaaatatataaaattaaataatccactcctgaaagattgttggtcgataatgaaatcaagatggaaatttaaaaaaatctttgaactgaatgacaatagtaatataacctatcaaaaactctgggatacagcaaaagcagtgctaagagaaaagttcatagcattaatcgcttatgtcaaaaagtctgaaacagcacaaatagacaattaaggtcacatctcaaggaactagagaaacaggaacaaacccaacagaagaaaggaaataacaatgatcagagaaggactaaatgaaatgcaaa

SEQ ID NO: 25225 - DNA, 396 bp, Homo sapiens
tccccaactacagggcaagcagttggattagctcagtggtttgcagttagggacagaagttgtcggtgagcacaggatcattttagatggtagagagatgagatttaagtaacgttaaatcgcacactcagacgctgaaccagcatccagttctcttttaaacctgattttgtcaaggataaagtctcaggatggtgctaatatggttttaacacctccctaatcctcactgagctcacttttcaaagccaggaggacacagaagcctcatcaggccacctaacatttattacactgaaccatctgcaaaagttgttttaggaaggtcaaaaagggtcaagtatcagcaatttcaggtggtccaacccaataaacatattattttcttttcattgt

SEQ ID NO: 25226 - DNA, 2708 bp, Homo sapiens
agtacaaacaaaaagccttaattcccataggagaactgagacttacaagtgggaaagggagtgcaaaacagatacaagttcagaatttatacagcagaaacaatctaacattgtagaggttctttttttttttttctttttctttttgagacggagtctttcattctatcacccaggatggagcacagtggcgcaatctcggctcactgcaatctccgccacctagattcaagcaattctgtctcggcctcctgagtagctgggattacagacaggcaccaccatgcccagctattttttgtacttttagtggagacggggtttcaccatgttgaccggcctcttctcgaacttctggcctcaggtgatcctcccacctcggcctcccaaagtgctgggattacaggcgtgagccactgtgcccaacctaacattgtagaggttctgattccatcatacgtagcttgtgtccctggactcaatgtagcttatctcattctaaatggcctttttcatgctacagtttaaaaacagactagctccgctctggtgacagctagagatcatatcatcagacaaatgagtgacctacttcacaacttgaccttttgcatcaggatccaaagagtaaattctttccttcatcattttagtttctgattaacagttcttccccagatgatgtactagggggacttgattcagtttgttttacatataagcaaatctgtatgaccttggttacaattatctgcaagtttcctgattgtcttacttgctttgttatagttacaacagtgctaactccttcaagtgtaacttccacaactgctcagtacctactagcttggtcttttcttgccaaacctttcttccctacatagaattgtctagagtcccttcacagcaaatggaagtttagcctatataatgtaccctgggacaagtttagaatgtggattatcaccaatcattgacatttaaaaaaaaaacaacaacaacaaaaggtgctccttgtaacttgcagggcatagtacactgccttatgtgaaatttggtcatggaatgtactcataagagataagtgctgacagttaaaaagatgagtatggcccttccctggagatgcttaacagtctagtagaaaataaacataacatttttttcaattcccatgagatactatgttggcatgagaggcatatttttacagaattttgaagacgacttatttaaattagttttgagttttggttctattactacaaacaaaatgagtaattattgtgtcatatggttatttagacatctaagagtgaacaaaaatgataagtgtgcttagagaattaaatatctccactgaggcatggtagcaccacaggaaagatgtgtcccgtagcagatatgagataacttagctattggaaataatctaggactaaagtaattgatcaaaacaaaaactggggggaaataactgaacatgtagcccaactccagagctttgcaaatttataagcttaagtggtggtcacgcctgtagtcccagcactttgggaggctgaggcgggtggatcatgaggtcaggagatcgagaccatcctggctaacacggtgaaaccccgtctctactgaaaatgcaaaaaattggccgggcgcagtggcaggcacctgtggtcccagctactcgggaggctgaggcaggagaatggcgtgaaccctggaagcggtgtttgcagtgggcagagattgcaccactgcactccagcctggggaacaaagcaagactccgtctcaaaaggaaaaaaaaatatatggtcagatttaacgtatgcatttaaaaggacaaaaattctgcattaagaacttgggagaggggttaaaaaaactcaaatttaactgtttaaagagctcctaagaaaagcattgcgatattttgataaaagatcaaaaacattctaatagacaattttttaaaatatggctttacttttgcctaatgttgcattgggttcattcattacaataaaacttattggccggacacggtggttcacgcctgtaatcccagcactttgggagtctgaggcaggtggatcacctgaggtcgtgggttcgagaccagcctaaccaacgtggagaagccccgcctctactagaaatacaaaattagacgggcatggtggcacatgcctgtaatcccagctacttgggaggctaaggcaggagaactgcttgaacccaggaagcagaggttgcactccagcctgggcaacaagagcgaaactccgtctcaaaaaaatacaaaacttactgagagcttaccatgtatcaggcactgtgattgatgctaccatacaacatagtgcttataattaacaatactgtaatatatacttaaaatatatttttattaataataaatacaacagtgcttttaattaacaatactgtaatatatacttaaaatatatttttattaatacttaataaaaatattttttaagtatatgttacagataaatcttacatgtaagtttttaaatcacaaaacaatagaggctgagaggaaattttgggcatgatatgtttatggcattgtgatgggttcatgggtggatacttatctccaaactcctcaagttgtatactttagatatgtacagcttttttgtatgtcaatcatacctcaataaagtgctttttta

SEQ ID NO: 25227 - DNA, 1633 bp, Homo sapiens
agtacaaacaaaaagccttaattcccataggagaactgagacttacaagtgggaaagggagtgcaaaacagatacaagttcagaatttatacagcagaaacaatctaacattgtagaggttctttttttttttttctttttctttttgagacggagtctttcattctatcacccaggatggagcacagtggcgcaatctcggctcactgcaatctccgccacctagattcaagcaattctgtctcggcctcctgagtagctgggattacagacaggcaccaccatgcccagctattttttgtacttttagtggagacggggtttcaccatgttgaccggcctcttctcgaacttctggcctcaggtgatcctcccacctcggcctcccaaagtgctgggattacaggcgtgagccactgtgcccaacctaacattgtagaggttctgattccatcatacgtagcttgtgtccctggactcaatgtagcttatctcattctaaatggcctttttcatgctacagtttaaaaacagactagctccgctctggtgacagctagagatcatatcatcagacaaatgagtgacctacttcacaacttgaccttttgcatcaggatccaaagagtaaattctttccttcatcattttagtttctgattaacagttcttccccagatgatgtactagggggacttgattcagtttgttttacatataagcaaatctgtatgaccttggttacaattatctgcaagtttcctgattgtcttacttgctttgttatagttacaacagtgctaactccttcaagtgtaacttccacaactgctcagtacctactagcttggtcttttcttgccaaacctttcttccctacatagaattgtctagagtcccttcacagcaaatggaagtttagcctatataatgtaccctgggacaagtttagaatgtggattatcaccaatcattgacatttaaaaaaaaaacaacaacaacaaaaggtgctccttgtaacttgcagggcatagtacactgccttatgtgaaatttggtcatggaatgtactcataagagataagtgctgacagttaaaaagatgagtatggcccttccctggagatgcttaacagtctagtagaaaataaacataacatttttttcaattcccatgagatactatgttggcatgagaggcatatttttacagaattttgaagacgacttatttaaattagttttgagttttggttctattactacaaacaaaatgagtaattattgtgtcatatggttatttagacatctaagagtgaacaaaaatgataagtgtgcttagagaattaaatatctccactgaggcatggtagcaccacaggaaagatgtgtcccgtagcagatatgagataacttagctattggaaataatctaggactaaagtaattgatcaaaacaaaaactggggggaaataactgaacatgtagcccaactccagagctttgcaaatttataagcttaagtggtggtcacgcctgtagtcccagcactttgggaggctgaggcggggtttcaccgtgttagccaggatggtctcgatctcctgacctcatgatccacccgccgtcgac

SEQ ID NO: 25228 - DNA, 483 bp, Homo sapiens
agcccaggagttcaaggatgcagtgagctatgactgtaccactgtactcttgcctgggtaatagacggagtctgtctcttaaagcaacaacaacaacaacaacaaaaagcgaaaaaccaaaaaacaagggtcacaaaacccaaacattaaagtgaatggagttcatttatcttttagaccaaattctagaaagattaattagcaagtttatcaacaaattaaaaacaagaagaaaaagcagattgtgtgtggtggcagcaacacaggattgctaaaaggaaaggcactgacaggaagggatatagacaatagtatggtgtgacaatgggagcccaaataaaagggagcgaaaaggggaaaaaaagcaagcattaaaaaaattcacacaagcaagccagaagcgaggattctggccattggttgtacagtgggagaaaacaatgctatttatttcatctacctctcatggtcatgagaacaacc

SEQ ID NO: 25229 - DNA, 405 bp, Homo sapiens
acaccagaggggcctgatgtcaggcaggaactggaaggggtggatgtctaagctacctttgccctgctgaaccctgatgggcagcatttcttttctgaaagcaaaactcaaaagaagaattcaggcgggatgtgaactcacccctgtaatctcagcactttgggaggccaatgcgggcagatcacctgaggtcaggagttcaagaccagcctggccaacatggtgaaaccctgtctctacaaaaatacaaaaattagccaggcatgatggcaggtgcctgtaatcccagctacttggtaggctgtggtgggagaattgctggaacccaggaggcataagtggcagtgagctgagatcgcgccattgccctccagcctgggcaaatagagtgagactccgtctcta

SEQ ID NO: 25230 - DNA, 940 bp, Homo sapiens
caaaaagaaagaaaaaaatttgtcactttgggtaaataatcccacactttttacttctcagatgtgtctttgtgtaggggtgaggacgggtagggactctcaatacttactgataacatgggaaactcaggaatagggactatttttttgaggaatagggatattttaagaggccagccagacaacaggtcaaacaaaaggagagaatccgccattatatagagaacagagtagggaaggaagctcgagttaccgtgtcactggaatagcttcttcaggagaaactgccatctgaaataaagttttgtgaaggaagtaggaatgccaggacttgttcagaggagtgcctctttccccattaagctcatcactagaaattcagctgaggggcattgtgcaggctgcagccatgctctctaacaaacggaacaaccacaacgagatgttcaacacttcagtggaagcatctcttccagctatagtttaaaactcttcttggttcaccaaaaggccggaatgccacagggattaatgatatttgattgagcttcatccactcagcagtttgcttttggagtgggctttatgttctcacgagcaatttcctggtagcaggcacataagattttatttttcttattactattattatttttttgagacggggtctcactctgtctctcaggctggagtgcagtggcacgatctcagctcactgcaacctctgccgcctgggttcaagcgattctcctgcctgcctcagcctcccgaatagctgggattataggcccctgccactgtgcctgcctaatttttatagttttttagtagggatgcggtttcaccctgttggccaggctggtcttgaacacctgacttcatgatccaccaacctcagcctcccagagtgctgggattacaggcgtgagccaccgcgccc

SEQ ID NO: 25231 - DNA, 437 bp, Homo sapiens
tataaaaattatgatagtgagccgcacacagtggctcacgcctgtaatcccagcactttgggaggccgaggcgggcggatcacgaggtcaagagattgggaccatcctggccaacatggtgaaaccttgtctctactaaaaatacaaaagctagttgggcatgatggcgggcgcctgtaatcccagctactcgcgaggttgagacaggagaattgcttgaacccgggtggcggaggttgcagtgagccgagatcacgccactgcactccaccctgggcaacagagtgggactctgtctcaaacaaaaaaataaattatgatagtaacatggggaaaaagtcttgtaatacaatgttatgtgagaagaagttagaaaaagtgtatgtcaaatatatatttattagtccatacatacataaataaatgaccaaataaat

SEQ ID NO: 25232 - DNA, 350 bp, Homo sapiens
tgagacagagtctcgctctgtcgcccaggctggagtgcagtggcatgatctcagctcactgcaagctctgcctcccaggttcacgccattctcctgcctcagcctcttgagtagctgggactgcaggtgcccaccaccatgcctggttaattttttgtatttttaatagagacggggtttcaccgtgttagccaggatggtctccatctcctgacgttgtgatctgcccgcctcagcctcccaaagtgctgggattacaggcatgagccaccatgcccagcaaaatttgccaatttttgcatattctctgagcatgttaaaagtctcaggtggggtgtaaacattttaag

SEQ ID NO: 25233 - DNA, 416 bp, Homo sapiens
taggctgtgctgtttgcagtttgtgccaatttagtacaagccagcagcaaacacctttctggagtctcctgcagcaggcttggggttccctgctggaacctgctggtcacaggatgggtgacctttttagttttcacagccattgtccaatcaattagtccaggcctcaccaatgttatttgctgtgacaaggttcaatgctgccttttctgatgggtccagtggggtcttggggatgggtgtgtcttaaggggatgtgtctgtagtgtgtttgttccagccccatcttcagtcccatcactttcagtccccagccccacggtggccgggcaccggaaacccccaagaggcccgggcgggggcgggggtcggccaagccgcttcccgcggaaggaagggcccggcggttcctgcga

SEQ ID NO: 25234 - DNA, 387 bp, Homo sapiens
gatgtaaaaatgacatggccattggaatttgcctagaatcccggccctaggtccaaaagtatattttgcaagatgatttcaatgctaatttcaaaaaacacgttgatgaagagaaggaaatgtatgaagaaggaagtgggttagctcaggaaatgaataactgcctctataagagtttattctgtgactgtttggtttttcactctgtgggagccttgagaaacgatacccagagaagcccatttgaggtctttcaaacaccctcaactaaattttagtagaagagaatctgtaccactagtgacaacaaagtatgaacacaaattctggcaccaacaaaagagggcattttattcttaaaataaatacgttattaaatttgattta

SEQ ID NO: 25235 - DNA, 387 bp, Homo sapiens
tgcacagggcttgaaatttagtcaatgaaaaattatagacctaaaatattgtcagtgtaaatatatatcacttcatataagtattaaaaaaccaagctgataaggatgaaatgacattaatggtaattaataattacaaaccccaaagagcagttttctgaattccaactatctgtgggtatttgtgggtactcagctttgtatataatattgcaaattggtgcttggtgatcaagatttttacaagattagtcaagtagagtgagtcttcagtaaactctaatagtgcttatttttgatgtgtaaatgaatagtaaactttattaactatcattaacttagtaataataatgagcatttagtctcaagcaaaaaggatattttttt

SEQ ID NO: 25236 - DNA, 547 bp, Homo sapiens
gagcaaatgggccagcgaggtcctggttaggcccgagaccatctcagcagaagggctgtgggtggagcccccagcagagaggtatggggcgtggagcacctcagggccatgtttgctgggtccagatcaggtatggaagacaggtaggcatgcttcctctcccacccccactgctctcctggaaaccagcgtcattgttcccacccggcagtgtgtcctggtgttctgggaaatgccactccagggaggtggtaggtggtgcagtgacctgtgacatcccaacccacatccaccactgtccgttgggggaacacagcccaggtaggtgtctgaaggagagctgagtccatttcaggagccccagaaccctggtagctaaaaacctgtgtgagtcccaggtggcccctcagtacagcaaggcctcacttaaggttgttggtaggttcttggaaaccatgactttgagggaaacagcagaagatgaaaaacaatttccccacaggctaatggatataaacaagacttaagttcctaaggcatatttctg

SEQ ID NO: 25237 - DNA, 383 bp, Homo sapiens
cttcaacctgaactaccacaataatctcctaactgatctccctgcctccagcctcctcttctccaatatgttctctttgttacaacagctcaagacagtacctatttacaaagcatgtaagatgtattcagcactgttctttgggttataaggagggaactattcttcggtatagaatgtacatccacttctcctccctaattgtatgcctggtggctgtgctagagcctttcaaaactaattcaggtatcacctcctatattgcctgcctatgttcacttactactacatttttagaaggcataagtacctactgtcggttcaatactatatatgtacatattatatattttatatatatataatatatatatataaaataa

SEQ ID NO: 25238 - DNA, 458 bp, Homo sapiens
gatcatttatcccaaaacacatacatcagtcctaattttaaattgacagagtttaggcttctgatgtttctctgttgcttgttaataaatctacatttaaaaagcccacagttatcagatcgccatgagcatcttaacagagtttaaaaacgtaaaaattcaaggattgtcacttaggttgaattgtttatgaaaaggaatgtggtatcattagaatgcatttggctacaagtaaccagaaactagattcaaaacggaaaaattagagaatgtattatattacacagcaagaagtttagagttagggtagctctagggcaggctggttgatctagtggctctgtgatgtccttcaacacctaggttctgtcttctgctactatcttagtcctaccctcctcagtatattggctgcattcttggactggatctacttatggtcacagataacctgccag

SEQ ID NO: 25239 - DNA, 463 bp, Homo sapiens
tttcgagcggccgcccgggcaggtacgcgggcagtcctaattttaaattgacagagtttaggcttctgatgtttctctgttgcttgttaataaatctacatttaaaaagcccacagttatcagatcgccatgagcatcttaacagagtttaaaaacgtaaaaattcaaggattgtcacttaggttgaattgtttatgaaaaggaatgtggtatcattagaatgcatttggctacaagtaaccagaaactagattcaaaacggaaaaattagagaatgtattatattacacagcaagaagtttagagttagggtagctctagggcaggctggttgatctagtggctctgtgatgtccttcaacacctaggttctgtcttctgctactatcttagtcctaccctcctcagtatattggctgcattcttggactggatctacttatggtcacagataacctgccag

SEQ ID NO: 25240 - DNA, 585 bp, Homo sapiens
gaagctctgaaggctgctaggagggccacgggagctgtgggagagggtgaggctggagccctgtgggctaacagacagggctctaattcgtgacatcgtggcaacaaactattagaaatgaggctagacctggaagccctgggggcacagtctggaggggagacagacgagagctaagtagaatgcaggcaatgacgccgtaacagagatctgcacagcgaccattgcacagcgtgggggcaggcttctgagaggaggtaacatgctgaaaagacaacgtgtacagctgacattagtacacaacctcatcggagagagaagaagcggagggaatcccaggagcaggggccatcatgctcaaaggttccaaggtacggaatccaaccacagtgcccactgtggtgaagccactgcgctggtccgagaagaaagtgacaaacaaaatgacatggagcccaattcatcctgagagcagaacctcggagccatgtggttaagatggaaattccacttttagtccaagcaaatcttctgatgtatcaagtttgagggtgaggtttcattaaaggaatttaaaataaaaaa

SEQ ID NO: 25241 - DNA, 338 bp, Homo sapiens
tcaatatttagtagagatggggtttcaccatgttggccaggctggtctcgaactcctgacctcaagtgatccacttgcctcagctcccaaagtgctgggattacaggcatgagccaccgtgcccagcctactgaggggtttttatggacatgggacttttaatgctaacactaggacagtctctgtcagactgagatgatggtcactctttggccaaacacctccaccactgccccgcaacatccataatagcaacagtttgagtaaagacacaagtaccatttgcggtccaaatacttgagtgtgtaaacggtgcattgggtgtgcacagcggtacc

SEQ ID NO: 25242 - DNA, 495 bp, Homo sapiens
ggtattctgcaggaggcttcttgcagtggtattgcataactgcccttgacttaggaagattttcatcctgcatatcctaaatggttgacttgctcacagtcaaaaatgtctaagtacatttagatttagctaatgtagattcagattctgaatgtcttttagaatattttgggctttggtatagactcaaagaatttcacatttttggctgggcacagtggttcacgcctgttatttcagcactttgggaggccgaggcgggcggatcacctgaggtcaggagttcgagaccagcctgactaacatggtgaaacctcgtctctactaatattacaaaaattagctgggcatgttggcaggcgcctataatttctttgggaggctgaggcaggagaatcacttgaacccgggaggcggaggttgcagtgagccgagtcgtgccattgcagtccacccagcctaggcgacagagtgaaactccacctcaaaaaaaaa

SEQ ID NO: 25243 - DNA, 415 bp, Homo sapiens
cttgcacaagcctctacatggttttgggccttggtacctatcttggttgattgattaagatgccctacaagttcccttttagttttgatagtgtttcctgtattcacctagggcagggattctaaaccaattttagatattaggggcctctttgagaattgtttgcccttttcttagaaacatgcttggccgggcacagtggctcacacctgtaatcccagcactttgggagggggaggcaggcagatcacttgaggccaggagttcgagaccagcctggccaacatggtgaaagcctgtctctactaaaaatacaaaaagtagctgggtgtggtggcatgtgccaataatcccagctattcagaaggctgaggcaggagagtcacttgaacccgagaggtggaggttgcaatga

SEQ ID NO: 25244 - DNA, 255 bp, Homo sapiens
aagataaaaattagatagtcatttttggttctactgtcttaatgttcacagaggagatagtaaaaaattccccaaatgagaacaaagtgtattaattgacgtcagtaactcatacccctctgctctacccagtgtcatttctgcttttaccgtgtcttctatctctaattatcctaccccccatctactgattaagggcttcccccttcctgttttccctaaaacccaatatattttttatgaaagcacttatta

SEQ ID NO: 25245 - DNA, 4244 bp, Homo sapiens
agcgggctttcggtgcgggccccgccccggctgtggccaccggctgcggaggagtccgagacgcagctgccgcgccggggcctgagctgccgcctcctccgccgcccgaaaacccggagtgccccgcacaggtttagacccagtgtgcctggtgggctgtgcccaggttcagagtcatgccactctgtgggtgaagcttgaggcaaaaatggagccacttcagcagcagcagcagcagcagcagcaacaacagaagcagccacacctggctcctctgcagatggatgccagagagaagcagggccagcagatgagagaagcccagttcttgtatgcccaaaagctggtcacacagccgactctcctttccgccacagctgggagaccttctggcagcactcccttaggtcccttagccagagttccacccaccgcagcagtggcccaagtgtttgaacggggcaacatgaactcagagcctgaggaagaggacggaggtttggaagatgaggatggggatgatgaagttgcagaggtggctgagaaagaaacccaggctgcttcaaaatattttcatgtgcagaaagtagctcgccaagatcccagagtggcacccatgtccaatctacttccagcaccagggctcccaccacatggacaacaagctaaagaagaccataccaaagatgcttccaaggcctcaccttctgtctccacagcaggacagccgaactggaatctggatgagcagctcaagcagaatggtggtttggcctggagtgatgatgcagatggaggccggggaagagagatctctcgagattttgccaagctgtatgaactggacggtgatcctgaaaggaaagagttcctggatgacctcttcgtctttatgcagaagagggggacccccatcaaccgaatccccatcatggccaaacagatcctggacctgtacatgctgtataagctggtgaccgagaagggaggcctggtggagatcatcaacaagaagatctggagggagatcaccaaaggcctaaacctgcccacatccatcaccagcgccgccttcaccctcaggacgcagtacatgaagtatctgtatgcctatgagtgtgagaagaaagccttgagttccccagccgagctccaggcagcaattgatggcaaccgcagggagggccggcggcccagctacagctcctccctctttggctactcacctgctgcggctactgctgctgccgctgccggggcccctgcccttctctccccacccaagatccgctttcccatccttgggcttggctccagcagtggtaccaataccagtagccctcggatatccccagcaaccactctcaggaaaggtgatggagccccagtgacaacagtgcctgtgccaaatcgtctggctgtgcccgtgaccttggcaagccagcaggctggtactcggaccgccgcactggagcagctgcgggagcggctggagtcaggggagcctgctgagaagaaggcatcgaggctgtctgaggaggagcagcgcctggtgcagcaggccttccagcgcaactttttcagcatggcacggcagctccccatgaagatcaggatcaacggcagggaagacagagcagaggcctcggctgcagcactgaacctgaccacgagtagcattgggagcattaacatgtctgtggacatcgatggcaccacctatgcaggtgtgctgtttgcccagaagcctgtggtccacctcatcacggggtctgctccccagagcctcggcagcagcgccagcagcagcagcagctctcactgttcaccaagtcctacctcatcccggggcacccccagcgcagagccctccaccagctggtccctctgatgggcaggacccagcttcccacttgccactctcctgtcgagagtgaaggaagttgatgcacagaatttacctcatctcacagagcccacgtcgacgagcaccatttggccagacattgagagtttggacgtgtccgtctgtccaggctccattcaggtcctgctgtactctgggggcagggagaggctagaggggcaggacagacagcgttgtccaatcagggattgtcctggagaactgggtgggggtctgtgggtgtccagcttcctccagggttccccagccacctcccagctcagggcacagtgtatcgacaatctgtcagccgacgcagggctggaggccctccatttccctccccttttaatttatttccctgaccctgccttctgccatgaccccagggccactagtctcttcccctgtttttaagtcccatgtggggctgccaggagccaagagcatgccttcatgcccttctctgcagagcatgggatggggcccttccagcccactttgcctactgttaggttcctggggtacgggtccctcaaacacaagtcttgaatcagtcctcagggccccagatcccccttctaatagtctgaaggaagaggctgtgagggcagttcagggccagggcccacagggcatctgctgatgggaaggcagagcctcggggctgcccagccctggcacctgcttcacacggaccattctctgaccgcccccgccaaacctcatgctccccacttgcccttattggcctgctttcccaaaaacagcccactcatcctttccccagccctcttcagccctccccagtcctccccagccttcttcagccttcttcagctcagccctcttctatttcttatggggccatcttggcctcaccatccccacacgtgccgatgtcaggttcattgaaatacctcagatttgtaattgttgatgtttgagtcttcaggaagtatttgcatctctgaaatcttttttatatgtgttttgctgacttttgttttttttttattttaaaatttttatcgtagcaccaaagaaatgaaaacagatcacccccaaagccaagcaagtgattgggtaacccggcccctctggcccttccctcaagcccagtgaggaggtgggtggaggcatgcaggggagacgactcagggatcgcgggggcggggaggtggagtggagaggcccgctctcacaccgggtcgggccctgaaaccgtaccagttctgaagaccgttttctgccacacccccacccccagctgaccagggaggcagaggacacctccccatcactcagcattcccagctcagggcacaggcaggctggggtcctcgctggccttgccagaggttgagccgccccagggtatgaggagatgaataactccacagctcctcctggaccctgcgcgggagcaggcagctcctgtgctgtaaagaaaattgattcgcttgcggctcacctcagtcgaggaagccctggaatgttcagcagaacaccaccactgtgacatggggctgtggcagtgggagacaccgcgcgtggcgtgggtgtgtgtggcagcgtggctcgcattcagtcctgtgtaggagaggaaagggaatcaaaagcttgagcacaaacagatacctcagcccggtaagctgcagctctgctcaactgcgtcttctctcagccctccacacacactcacccccactcccacacacatacacacacacacacacataccccatctcccgagggctgacctcctctggcctcagcctgcagggtgtgggcagagaagggcatctgggacgtggtgccagtgaggagcccagttggctggcactgggcccatttgaaggtgtctcagacatttggccagtatgtctttctcaggggtttggtcacaaaggatggactcttcccacccagaggatgcagggaaagcacactgtgtctttccggtcattggatcctctccctttccccaggcagctcgcctggccacaccgttggagtgaaccctcactgccctcaaggacaacagcagggtgtcacccagagcccgatgaggggtgccagcaggtgcccccacgagtggggccttggcccaagcagagcttcccctgaaggtgccatcagccagggcagctctgtcccctcctgctctccatcttatatgtattctaaccaggaaaaatgtgatagcacatgggtagcctaggcagtgagtaaatacctcagatgtcctcctgcagcaagtgtctatatgttgtggttattttctatcttacatgttctcgaatgtttatatttcaataaacctctacctcttcac

SEQ ID NO: 25246 - DNA, 3638 bp, Homo sapiens
taaaaacattttgcagtattttattctttcgtttaagaagctataacttaaaccatcttcagaaacaagatctgtcacccgtagagcttagagtccaaatagacacctatgaggcgagcacaaggggcggtgtgaggcagctgcaggggcctgaccaggggccggggttggctgtgtcctaggcggctgggcagccactggcccccactgccccgtggcccgaagttaaagcaaaatggtggtttggcctgaagggaaagagttccgggatgaccttttcttttttttgcaaaaaagggggacccccatcaaccgaatccccatcatggccaaacagatcctggacctgtacatgctgtataagctggtgaccgagaagggaggcctggtggagatcatcaacaagaagatctggagggagatcaccaaaggcctaaacctgcccacatccatcaccagcgccgccttcaccctcaggacgcagtacatgaagtatctgtatgcctatgagtgtgagaagaaagccttgagttccccagccgagctccaggcagcaattgatggcaaccgcagggagggccggcggcccagctacagctcctccctctttggctactcacctgctgcggctactgctgctgccgctgccggggcccctgcccttctctccccacccaagatccgctttcccatccttgggcttggctccagcagtggtaccaataccagtagccctcggatatccccagcaaccactctcaggaaaggtgatggagccccagtgacaacagtgcctgtgccaaatcgtctggctgtgcccgtgaccttggcaagccagcaggctggtactcggaccgccgcactggagcagctgcgggagcggctggagtcaggggagcctgctgagaagaaggcatcgaggctgtctgaggaggagcagcgcctggtgcagcaggccttccagcgcaactttttcagcatggcacggcagctccccatgaagatcaggatcaacggcagggaagacagagcagaggcctcggctgcagcactgaacctgaccacgagtagcattgggagcattaacatgtctgtggacatcgatggcaccacctatgcaggtgtgctgtttgcccagaagcctgtggtccacctcatcacggggtctgctccccagagcctcggcagcagcgccagcagcagcagcagctctcactgttcaccaagtcctacctcatcccggggcacccccagcgcagagccctccaccagctggtccctctgatgggcaggacccagcttcccacttgccactctcctgtcgagagtgaaggaagttgatgcacagaatttacctcatctcacagagcccacgtcgacgagcaccatttggccagacattgagagtttggacgtgtccgtctgtccaggctccattcaggtcctgctgtactctgggggcagggagaggctagaggggcaggacagacagcgttgtccaatcagggattgtcctggagaactgggtgggggtctgtgggtgtccagcttcctccagggttccccagccacctcccagctcagggcacagtgtatcgacaatctgtcagccgacgcagggctggaggccctccatttccctccccttttaatttatttccctgaccctgccttctgccatgaccccagggccactagtctcttcccctgtttttaagtcccatgtggggctgccaggagccaagagcatgccttcatgcccttctctgcagagcatgggatggggcccttccagcccactttgcctactgttaggttcctggggtacgggtccctcaaacacaagtcttgaatcagtcctcagggccccagatcccccttctaatagtctgaaggaagaggctgtgagggcagttcagggccagggcccacagggcatctgctgatgggaaggcagagcctcggggctgcccagccctggcacctgcttcacacggaccattctctgaccgcccccgccaaacctcatgctccccacttgcccttattggcctgctttcccaaaaacagcccactcatcctttccccagccctcttcagccctccccagtcctccccagccttcttcagccttcttcagctcagccctcttctatttcttatggggccatcttggcctcaccatccccacacgtgccgatgtcaggttcattgaaatacctcagatttgtaattgttgatgtttgagtcttcaggaagtatttgcatctctgaaatcttttttatatgtgttttgctgacttttgttttttttttattttaaaatttttatcgtagcaccaaagaaatgaaaacagatcacccccaaagccaagcaagtgattgggtaacccggcccctctggcccttccctcaagcccagtgaggaggtgggtggaggcatgcaggggagacgactcagggatcgcgggggcggggaggtggagtggagaggcccgctctcacaccgggtcgggccctgaaaccgtaccagttctgaagaccgttttctgccacacccccacccccagctgaccagggaggcagaggacacctccccatcactcagcattcccagctcagggcacaggcaggctggggtcctcgctggccttgccagaggttgagccgccccagggtatgaggagatgaataactccacagctcctcctggaccctgcgcgggagcaggcagctcctgtgctgtaaagaaaattgattcgcttgcggctcacctcagtcgaggaagccctggaatgttcagcagaacaccaccactgtgacatggggctgtggcagtgggagacaccgcgcgtggcgtgggtgtgtgtggcagcgtggctcgcattcagtcctgtgtaggagaggaaagggaatcaaaagcttgagcacaaacagatacctcagcccggtaagctgcagctctgctcaactgcgtcttctctcagccctccacacacactcacccccactcccacacacatacacacacacacacacataccccatctcccgagggctgacctcctctggcctcagcctgcagggtgtgggcagagaagggcatctgggacgtggtgccagtgaggagcccagttggctggcactgggcccatttgaaggtgtctcagacatttggccagtatgtctttctcaggggtttggtcacaaaggatggactcttcccacccagaggatgcagggaaagcacactgtgtctttccggtcattggatcctctccctttccccaggcagctcgcctggccacaccgttggagtgaaccctcactgccctcaaggacaacagcagggtgtcacccagagcccgatgaggggtgccagcaggtgcccccacgagtggggccttggcccaagcagagcttcccctgaaggtgccatcagccagggcagctctgtcccctcctgctctccatcttatatgtattctaaccaggaaaaatgtgatagcacatgggtagcctaggcagtgagtaaatacctcagatgtcctcctgcagcaagtgtctatatgttgtggttattttctatcttacatgttctcgaatgtttatatttcaataaacctctacctcttcac

SEQ ID NO: 25247 - DNA, 3535 bp, Homo sapiens
agcgggctttcggtgcgggccccgccccggctgtggccaccggctgcggaggagtccgagacgcagctgccgcgccggggcctgagctgccgcctcctccgccgcccgaaaacccggagtgccccgcacaggtttagacccagtgtgcctggtgggctgtgcccaggttcagagtcatgccactctgtgggtgaagcttgaggcaaaaatggagccacttcagcagcagcagcagcagcagcagcaacaacagaagcagccacacctggctcctctgcagatggatgccagagagaagcagggccagcagatgagagaagcccagttcttgtatgcccaaaagctggtcacacagccgactctcctttccgccacagctgggagaccttctggcagcactcccttaggtcccttagccagagttccacccaccgcagcagtggcccaagtgtttgaacggggcaacatgaactcagagcctgaggaagaggacggaggtttggaagatgaggatggggatgatgaagttgcagaggtggctgagaaagaaacccaggctgcttcaaaatattttcatgtgcagaaagtagctcgccaagatcccagagtggcacccatgtccaatctacttccagcaccagggctcccaccacatggacaacaagctaaagaagaccataccaaagatgcttccaaggcctcaccttctgtctccacagcaggacagccgaactggaatctggatgagcagctcaagcagaatggtggtttggcctggagtgatgatgcagatggaggccggggaagagagatctctcgagattttgccaagctgtatgaactggacggtgatcctgaaaggaaagagttcctggatgacctcttcgtctttatgcagaagagggggacccccatcaaccgaatccccatcatggccaaacagatcctggacctgtacatgctgtataagctggtgaccgagaagggaggcctggtggagatcatcaacaagaagatctggagggagatcaccaaaggcctaaacctgcccacatccatcaccagcgccgccttcaccctcaggacgcagtacatgaagtatctgtatgcctatgagtgtgagaagaaagccttgagttccccagccgagctccaggcagcaattgatggcaaccgcagggagggccggcggcccagctacagctcctccctctttggctactcacctgctgcggctactgctgctgccgctgccggggcccctgcccttctctccccacccaagatccgctttcccatccttgggcttggctccagcagtggtaccaataccagtagccctcggatatccccagcaaccactctcaggaaaggtgatggagccccagtgacaacagtgcctgtgccaaatcgtctggctgtgcccgtgaccttggcaagccagcaggctggtactcggaccgccgcactggagcagctgcgggagcggctggagtcaggggagcctgctgagaagaaggcatcgaggctgtctgaggaggagcagcgcctggtgcagcaggccttccagcgcaactttttcagcatggcacggcagctccccatgaagatcaggatcaacggcagggaagacagagcagaggcctcggctgcagcactgaacctgaccacgagtagcattgggagcattaacatgtctgtggacatcgatggcaccacctatgcaggtgtgctgtttgcccagaagcctgtggtccacctcatcacggggtctgctccccagagcctcggcagcagcgccagcagcagcagcagctctcactgttcaccaagtcctacctcatcccggggcacccccagcgcagagccctccaccagctggtccctctgatgggcaggacccagcttcccacttgccactctcctgtcgagagtgaaggaagttgatgcacagaatttacctcatctcacagagcccacgtcgacgagcaccatttggccagacattgagagtttggacgtgtccgtctgtccaggctccattcaggtcctgctgtactctgggggcagggagaggctagaggggcaggacagacagcgttgtccaatcagggattgtcctggagaactgggtgggggtctgtgggtgtccagcttcctccagggttccccagccacctcccagctcagggcacagtgtatcgacaatctgtcagccgacgcagggctggaggccctccatttccctccccttttaatttatttccctgaccctgccttctgccatgaccccagggccactagtctcttcccctgtttttaagtcccatgtggggctgccaggagccaagagcatgccttcatgcccttctctgcagagcatgggatggggcccttccagcccactttgcctactgttaggttcctggggtacgggtccctcaaacacaagtcttgaatcagtcctcagggccccagatcccccttctaatagtctgaaggaagaggctgtgagggcagttcagggccagggcccacagggcatctgctgatgggaaggcagagcctcggggctgcccagccctggcacctgcttcacacggaccattctctgaccgcccccgccaaacctcatgctccccacttgcccttattggcctgctttcccaaaaacagcccactcatcctttccccagccctcttcagccctccccagtcctccccagccttcttcagccttcttcagctcagccctcttctatttcttatggggccatcttggcctcaccatccccacacgtgccgatgtcaggttcattgaaatacctcagatttgtaattgttgatgtttgagtcttcaggaagtatttgcatctctgaaatcttttttatatgtgttttgctgacttttgttttttttttattttaaaatttttatcgtagcaccaaagaaatgaaaacagatcacccccaaacctgcagggtgtgggcagagaagggcatctgggacgtggtgccagtgaggagcccagttggctggcactgggcccatttgaaggtgtctcagacatttggccagtatgtctttctcaggggtttggtcacaaaggatggactcttcccacccagaggatgcagggaaagcacactgtgtctttccggtcattggatcctctccctttccccaggcagctcgcctggccacaccgttggagtgaaccctcactgccctcaaggacaacagcagggtgtcacccagagcccgatgaggggtgccagcaggtgcccccacgagtggggccttggcccaagcagagcttcccctgaaggtgccatcagccagggcagctctgtcccctcctgctctccatcttatatgtattctaaccaggaaaaatgtgatagcacatgggtagcctaggcagtgagtaaatacctcagatgtcctcctgcagcaagtgtctatatgttgtggttattttctatcttacatgttctcgaatgtttatatttcaataaacctctacctcttcac

SEQ ID NO: 25248 - DNA, 436 bp, Homo sapiens
tagaggatcccatggccggtcagaggtagaggtttattgaaatataaacattcgagaagatgtagatagaaaataaccacaagatatagacacttgctgcaggaggacatctgaggtatttcctcactgccctcaaggacaacagcagggtgtcacccagagcccgatgaggggtgccagcaggtgcccccacgagtggggccttggcccaagcagagcttcccctgaaggtgccatcagccagggcagctctgtcccctcctgctctccatcttatatgtattctaaccaggaaaaatgtgatagcacatgggtagcctaggcagtgagtaaatacctcagatgtcctcctgcagcaagtgtctatatgttgtggttattttctatcttacatgttctcgaatgtttatatttcaataaacctctacctcttcac

SEQ ID NO: 25249 - DNA, 4519 bp, Homo sapiens
agcgggctttcggtgcgggccccgccccggctgtggccaccggctgcggaggagtccgagacgcagctgccgcgccggggcctgagctgccgcctcctccgccgcccgaaaacccggagtgccccgcacaggtttagacccagtgtgcctggtgggctgtgcccaggttcagagtcatgccactctgtgggtgaagcttgaggcaaaaatggagccacttcagcagcagcagcagcagcagcagcaacaacagaagcagccacacctggctcctctgcagatggatgccagagagaagcagggccagcagatgagagaagcccagttcttgtatgcccaaaagctggtcacacagccgactctcctttccgccacagctgggagaccttctggcagcactcccttaggtcccttagccagagttccacccaccgcagcagtggcccaagtgtttgaacggggcaacatgaactcagagcctgaggaagaggacggaggtttggaagatgaggatggggatgatgaagttgcagaggtggctgagaaagaaacccaggctgcttcaaaatattttcatgtgcagaaagtagctcgccaagatcccagagtggcacccatgtccaatctacttccagcaccagggctcccaccacatggacaacaagctaaagaagaccataccaaagatgcttccaaggcctcaccttctgtctccacagcaggacagccgaactggaatctggatgagcagctcaagcagaatggtggtttggcctggagtgatgatgcagatggaggccggggaagagagatctctcgagattttgccaagctgtatgaactggacggtgatcctgaaaggaaagagttcctggatgacctcttcgtctttatgcagaagagggggacccccatcaaccgaatccccatcatggccaaacagatcctggacctgtacatgctgtataagctggtgaccgagaagggaggcctggtggagatcatcaacaagaagatctggagggagatcaccaaaggcctaaacctgcccacatccatcaccagcgccgccttcaccctcaggacgcagtacatgaagtatctgtatgcctatgagtgtgagaagaaagccttgagttccccagccgagctccaggcagcaattgatggcaaccgcagggagggccggcggcccagctacagctcctccctctttggctactcacctgctgcggctactgctgctgccgctgccggggcccctgcccttctctccccacccaagatccgctttcccatccttgggcttggctccagcagtggtaccaataccagtagccctcggatatccccagcaaccactctcaggaaaggtgatggagccccagtgacaacagtgcctgtgccaaatcgtctggctgtgcccgtgaccttggcaagccagcaggctggtactcggaccgccgcactggagcagctgcgggagcggctggagtcaggggagcctgctgagaagaaggcatcgaggctgtctgaggaggagcagcgcctggtgcagcaggccttccagcgcaactttttcagcatggcacggcagctccccatgaagatcaggatcaacggcagggaagacagagcagaggcctcggctgcagcactgaacctgaccacgagtagcattgggagcattaacatgtctgtggacatcgatggcaccacctatgcaggtgtgctgtttgcccagaagcctgtggtccacctcatcacggggtctgctccccagagcctcggcagcagcgccagcagcagcagcagctctcactgttcaccaagtcctacctcatcccggggcacccccagcgcagagccctccaccagctggtccctctgatgggcaggacccagcttcccacttgccactctcctgtcgagagtgaaggaagttgatgcacagaatttacctcatctcacagagcccacgtcgacgagcaccatttggccagacattgagagtttggacgtgtccgtctgtccaggctccattcaggtcctgctgtactctgggggcagggagaggctagaggggcaggacagacagcgttgtccaatcagggattgtcctggagaactgggtgggggtctgtgggtgtccagcttcctccagggttccccagccacctcccagctcagggcacagtgtatcgacaatctgtcagccgacgcagggctggaggccctccatttccctccccttttaatttatttccctgaccctgccttctgccatgaccccagggccactagtctcttcccctgtttttaagtcccatgtggggctgccaggagccaagagcatgccttcatgcccttctctgcagagcatgggatggggcccttccagcccactttgcctactgttaggttcctggggtacgggtccctcaaacacaagtcttgaatcagtcctcagggccccagatcccccttctaatagtctgaaggaagaggctgtgagggcagttcagggccagggcccacagggcatctgctgatgggaaggcagagcctcggggctgcccagccctggcacctgcttcacacggaccattctctgaccgcccccgccaaacctcatgctccccacttgcccttattggcctgctttcccaaaaacagcccactcatcctttccccagccctcttcagccctccccagtcctccccagccttcttcagccttcttcagctcagccctcttctatttcttatggggccatcttggcctcaccatccccacacgtgccgatgtcaggttcattgaaatacctcagatttgtaattgttgatgtttgagtcttcaggaagtatttgcatctctgaaatcttttttatatgtgttttgctgacttttgttttttttttattttaaaatttttatcgtagcaccaaagaaatgaaaacagatcacccccaaagccaagcaagtgattgggtaacccggcccctctggcccttccctcaagcccagtgaggaggtgggtggaggcatgcaggggagacgactcagggatcgcgggggcggggaggtggagtggagaggcccgctctcacaccgggtcgggccctgaaaccgtaccagttctgaagaccgttttctgccacacccccacccccagctgaccagggaggcagaggacacctccccatcactcagcattcccagctcagggcacaggcaggctggggtcctcgctggccttgccagaggttgagccgccccagggtatgaggagatgaataactccacagctcctcctggaccctgcgcgggagcaggcagctcctgtgctgtaaagaaaattgattcgcttgcggctcacctcagtcgaggaagccctggaatgttcagcagaacaccaccactgtgacatggggctgtggcagtgggagacaccgcgcgtggcgtgggtgtgtgtggcagcgtggctcgcattcagtcctgtgtaggagaggaaagggaatcaaaagcttgagcacaaacagatacctcagcccggtaagctgcagctctgctcaactgcgtcttctctcagccctccacacacactcacccccactcccacacacatacacacacacacacacataccccatctcccgagggctgacctcctctggcctcagcctgcagggtgtgggcagagaagggcatctgggacgtggtgccagtgaggagcccagttggctggcactgggcccatttgaaggtgtctcagacatttggccagtatgtctttctcaggggtttggtcacaaaggatggactcttcccacccagaggatgcagggaaagcacactgtgtctttccggtcattggatcctctccctttccccaggcagctcgcctggccacaccgttggagtgaaccctcactgccctcaaggacaacagcagggtgtcacccagagcccgatgaggggtgccagcaggtgcccccacgagtggggccttggcccaagcagagcttcccctgaaggtgccatcagccagggcagctctgtcccctcctgctctccatcttatatgtattctaaccaggaaaaatgtgatagcacatgggtagcctaggcagtgagtaaatacctcagatgtcctcctgcagcaagtgtctatatgttgtggttattttctatcttacatgttctcgaatgtttatatttcaataaacctctacctcttcacacaaaaaaaatctctctcagttgctttgagtggcctttccactggacagtactggggagaggtgagctccttcagagtgaaaggggactgagtgaactactcctgaccccttgatttctcctgaaccttctccccttcacccacgccttcttcaaagggaaagctcactgagctcactctcagctaaccttgtgtgttagcaggtttctctggcgttaccccagaagctcctagaaaagcctgcccggcagcaagccacaggccccgccacgcca

SEQ ID NO: 25250 - DNA, 958 bp, Homo sapiens
  misc_feature (835)..(835): n is a, c, g, or t
  misc_feature (888)..(888): n is a, c, g, or t
  misc_feature (934)..(934): n is a, c, g, or t
aagcagtggtatcaacgcagagtggccattacggccggggggttggggtgtgagaggttttctcgctctagggagattcttcaagcaatcactatgtcaacagacacaggtgtttcccttccttcatatgaggaagatcagggatcaaaactcattcgaaaagctaaagaggcaccattcgtacccgttggaatagcgggttttgcagcaattgttgcatatggattatataaactgaagagcaggggaaatactaaaatgtccattcatctgatccacatgcgtgtggcagcccaaggctttgttgtaggagcaatgactgttggtatgggctattccatgtatcgggaattctgggcaaaacctaagccttagaagaagagatgctgtcttggtcttgttggaggagcttgctttagttagatgtcttattattaaagttacctattattgttggaaataaactaatttgtatgggtttagatggtaacatggcattttgaatattggcttcctttcttgcaggcttgatttgcttggtgaccgaattactagtgactagtttactaactaggtcattcaaggaagtcaagttaacttaaacatgtcacctaaatgcacttgatggtgttgaaatgtccaccttcttaaatttttaagatgaacttagttctaaagaagataacaggccaatcctgaaggtactccctgtttgctgcagaatgtcagatatttgggatgttgcataagagtcctatttggcccagttaattcaacttttggtctgcggttggggacggtggttgtaaactctgccaagggtggatataatggnggtccccatgcaaatttcgtgtttccccccagtacaggggtgttttaacccgnggaaaagtacgagggaatggggaaaatccataacgcgccgtgtggncgcacgcgtgaagtgcgtatattg

SEQ ID NO: 25251 - DNA, 831 bp, Homo sapiens
  misc_feature (765)..(765): n is a, c, g, or t
  misc_feature (767)..(768): n is a, c, g, or t
  misc_feature (778)..(778): n is a, c, g, or t
  misc_feature (784)..(784): n is a, c, g, or t
  misc_feature (793)..(793): n is a, c, g, or t
aagggagaagccgggaggactgggtgcgcctgcagggatcggaagccggttggggtgtgagaggttttctcgctctagagaacctcatagaaattctttctcggagattcttcaagcaatcactatgtcaacagacacaggtgtttcccttccttcatatgaggaagatcagggatcaaaactcattcgaaaagctaaagaggcaccattcgtacccgttggaatagcgggttttgcagcaattgttgcatatggattatataaactgaagagcaggggaaatactaaaatgtccattcatctgatccacatgcgtgtggcagcccaaggctttgttgtaggagcaatgactgttggtatgggctattccatgtatcgggaattctgggcaaaacctaagccttagaagaagagatgctgtcttggtcttgttggaggagcttgctttagttagatgtcttattattaaagttacctattattgttggaaataaactaatttgtatgggtttagatggtaacatggcattttgaatattggcttcctttcttgcaggcttgatttgcttggtgaccgaattactagtgactagtttactaactaggtcattcaaggaagtcaagttaacttaaacatgtcacctaaatgcacttgatggtgttgaaatgtccaccttcttaaatttttaagatgaacttagttctaaagaagataacaggccaatcctgaaggtactccctgtttgctgcgtcgaaattgggggngnnaaagcctatngcccgnaatcacttngtggccgttgggacggggggccggtaaactgtgcaagg

SEQ ID NO: 25252 - DNA, 1485 bp, Homo sapiens
  misc_feature (1416)..(1416): n is a, c, g, or t
  misc_feature (1422)..(1422): n is a, c, g, or t
aagggagaagccgggaggactgggtgcgcctgcagggatcggaagccggttggggtgtgagaggttttctcgctctagggagattcttcaagcaatcactatgtcaacagacacaggtgtttcccttccttcatatgaggaagatcagggatcaaaactcattcgaaaagctaaagaggcaccattcgtacccgttggaatagcgggttttgcagcaattgttgcatatggattatataaactgaagagcaggggaaatactaaaatgtccattcatctgatccacatgcgtgtggcagcccaaggctttgttgtaggagcaatgactgttggtatgggctattccatgtatcgggaattctgggcaaaacctaagccttagaagaagagatgctgtcttggtcttgttggaggagcttgctttagttagatgtcttattattaaagttacctattattgttggaaataaactaatttgtatgggtttagatggtaacatggcattttgaatattggcttcctttcttgcaggcttgatttgcttggtgaccgaattactagtgactagtttactaactaggtcattcaaggaagtcaagttaacttaaacatgtcacctaaatgcacttgatggtgttgaaatgtccaccttcttaaatttttaagatgaacttagttctaaagaagataacaggccaatcctgaaggtactccctgtttgctgcagaatgtcagatatttgggatgttgcataagagtcctatttggcccagttaattcaacttttgtctgcctgttttgtggactggctggctctgttagaactctgtccaaaaagtgcatggaatataacttgtaaagcttcccacaattgacaatatatatgcatgtgtttaaaccaaatccagaaagcttaaacaatagagctgcataatagtatttattaaagaatcacaactgtaaacatgagaataacttaaggattctagtttagttttttgtaattgcaaattatatttttgctgctgatatattagaataatttttaaatgtcatcttgaaatagaaatatgtattttaagcactcacgcaaaggtaaatgaacacgttttaaatgtgtgtgttgctaattttttccataagaattgtaaacattgaactgaacaaattacctataatggatttggttaatgacttatgagcaagctggtttggccagacagtatacccaaacttttatataatatacagaaggctatcacacttgtgaaattctcttgtctaatctgaatttgcattccatggtgttaacatggtatatgtattgttattaaagtaagtgacccatgtcacgagcaccaccaatacacacacacacacacacacaccctgagagagagaaagagagagagatnactaangagagagaactaggtgcggcaaataatacatgctctaatgaaggttattagtgattatctact

SEQ ID NO: 25253 - DNA, 1752 bp, Homo sapiens
aagggagaagccgggaggactgggtgcgcctgcagggatcggaagccggttggggtgtgagaggttttctcgctctagggagattcttcaagcaatcactatgtcaacagacacaggtgtttcccttccttcatatgaggaagatcagggatcaaaactcattcgaaaagctaaagaggcaccattcgtacccgttggaatagcgggttttgcagcaattgttgcatatggattatataaactgaagagcaggggaaatactaaaatgtccattcatctgatccacatgcgtgtggcagcccaaggctttgttgtaggagcaatgactgttggtatgggctattccatgtatcgggaattctgggcaaaacctaagccttagaagaagagatgctgtcttggtcttgttggaggagcttgctttagttagatgtcttattattaaagttacctattattgttggaaataaactaatttgtatgggtttagatggtaacatggcattttgaatattggcttcctttcttgcaggcttgatttgcttggtgaccgaattactagtgactagtttactaactaggtcattcaaggaagtcaagttaacttaaacatgtcacctaaatgcacttgatggtgttgaaatgtccaccttcttaaatttttaagatgaacttagttctaaagaagataacaggccaatcctgaaggtactccctgtttgctgcagaatgtcagatatttgggatgttgcataagagtcctatttggcccagttaattcaacttttgtctgcctgttttgtggactggctggctctgttagaactctgtccaaaaagtgcatggaatataacttgtaaagcttcccacaattgacaatatatatgcatgtgtttaaaccaaatccagaaagcttaaacaatagagctgcataatagtatttattaaagaatcacaactgtaaacatgagaataacttaaggattctagtttagttttttgtaattgcaaattatatttttgctgctgatatattagaataatttttaaatgtcatcttgaaatagaaatatgtattttaagcactcacgcaaaggtaaatgaacacgttttaaatgtgtgtgttgctaattttttccataagaattgtaaacattgaactgaacaaattacctataatggatttggttaatgacttatgagcaagctggtttggccagacagtatacccaaacttttatataatatacagaaggctatcacacttgtgaaattctcttgtctaatctgaatttgcattccatggtgttaacatggtatatgtattgttattaaagtaagtgacccatgtcacacaaaaaaaaaaaaaaaaaaaaaaaaacaacacaacaaaaaaaagaaaaacaaaaagaaaaacaaaaaaagcacacaaaaaaaaaagaaacacaacgaaaacaaaatgagagaacaaaagaaaaaaagcaggaggaggacagaagaaacacagggagcgagaggaaaagaagaagagaggagaagaagcaggaagaaaagaaaaagagagagggaagagaagaaaaaggagagaagaggcagaaaggaagagaaaagaagaagagaaagcaaaaaaggaggaagaaaaaaagaaacaacaaaagagagagaaagaaaagagaagaaaacaaaaaagaagaaaagaaggcaaaaaaagaaaaggagaaagagaagaaaaaaaagaagaaaaaaaagaaa

SEQ ID NO: 25254 - DNA, 972 bp, Homo sapiens
aagggagaagccgggaggactgggtgcgcctgcagggatcggaagccggttggggtgtgagaggttttctcgctctagggagattcttcaagcaatcactatgtcaacagacacaggtgtttcccttccttcatatgaggaagatcagggatcaaaactcattcgaaaagctaaagaggcaccattcgtacccgttggaatagcgggttttgcagcaattgttgcatatggattatataaactgaagagcaggggaaatactaaaatgtccattcatctgatccacatgcgtgtggcagcccaaggctttgttgtaggagcaatgactgttggtatgggctattccatgtatcgggaattctgggcaaaacctaagccttagaagaagagatgctgtcttggtcttgttggaggagcttgctttagttagatgtcttattattaaagttacctattattgttggaaataaactaatttgtatgggtttagatggtaacatggcattttgaatattggcttcctttcttgcaggcttgatttgcttggtgaccgaattactagtgactagtttactaactaggtcattcaaggaagtcaagttaacttaaacatgtcacctaaatgcacttgatggtgttgaaatgtccaccttcttaaatttttaagatgaacttagttctaaagaagataacaggccaatcctgaaggtactccctgtttgctgcagaatgtcagatatttgggatgttgcataagagtcctatttggcccagttaattcaacttttgtctgcctgttttgtggactggctggctctgttagaactctgtccaaagggtggattaatgggaggttcccatggatatttgctgtgtaccttcgaagtaaaaagcgggagttttttaaacacggcggaaaaaagtgtgggggagaatgcgggataaaaaagttgaaaatttcgagaatatggt

SEQ ID NO: 25255 - DNA, 1346 bp, Homo sapiens
aagcagtggtatcaacgcagagtggccattacggccggggggttggggtgtgagaggttttctcgctctagggagattcttcaagcaatcactatgtcaacagacacaggtgtttcccttccttcatatgaggaagatcagggatcaaaactcattcgaaaagctaaagaggcaccattcgtacccgttggaatagcgggttttgcagcaattgttgcatatggattatataaactgaagagcaggggaaatactaaaatgtccattcatctgatccacatgcgtgtggcagcccaaggctttgttgtaggagcaatgactgttggtatgggctattccatgtatcgggaattctgggcaaaacctaagccttagaagaagagatgctgtcttggtcttgttggaggagcttgctttagttagatgtcttattattaaagttacctattattgttggaaataaactaatttgtatgggtttagatggtaacatggcattttgaatattggcttcctttcttgcaggcttgatttgcttggtgaccgaattactagtgactagtttactaactaggtcattcaaggaagtcaagttaacttaaacatgtcacctaaatgcacttgatggtgttgaaatgtccaccttcttaaatttttaagatgaacttagttctaaagaagataacaggccaatcctgaaggtactccctgtttgctgcagaatgtcagatatttgggatgttgcataagagtcctatttggcccagttaattcaacttttgtctgcctgttttgtggactggctggctctgttagaactctgtccaaaaagtgcatggaatataacttgtaaagcttcccacaattgacaatatatatgcatgtgtttaaaccaaatccagaaagcttaaacaatagagctgcataatagtatttattaaagaatcacaactgtaaacatgagaataacttaaggattctagtttagttttttgtaattgcaaattatatttttgctgctgatatattagaataatttttaaatgtcatcttgaaatagaaatatgtattttaagcactcacgcaaaggtaaatgaacacgttttaaatgtgtgtgttgctaattttttccataagaattgtaaacattgaactgaacaaattacctataatggatttggttaatgacttatgagcaagctggtttggccagacagtatacccaaacttttatataatatacagaaggctatcacacttgtgaaattctcttgtctaatctgaatttgcattccatggtgttaacatggtatatgtattgttattaaagtaagtgacccatgtca

SEQ ID NO: 25256 - DNA, 1377 bp, Homo sapiens
aagggagaagccgggaggactgggtgcgcctgcagggatcggaagccggttggggtgtgagaggttttctcgctctagagaacctcatagaaattctttctcggagattcttcaagcaatcactatgtcaacagacacaggtgtttcccttccttcatatgaggaagatcagggatcaaaactcattcgaaaagctaaagaggcaccattcgtacccgttggaatagcgggttttgcagcaattgttgcatatggattatataaactgaagagcaggggaaatactaaaatgtccattcatctgatccacatgcgtgtggcagcccaaggctttgttgtaggagcaatgactgttggtatgggctattccatgtatcgggaattctgggcaaaacctaagccttagaagaagagatgctgtcttggtcttgttggaggagcttgctttagttagatgtcttattattaaagttacctattattgttggaaataaactaatttgtatgggtttagatggtaacatggcattttgaatattggcttcctttcttgcaggcttgatttgcttggtgaccgaattactagtgactagtttactaactaggtcattcaaggaagtcaagttaacttaaacatgtcacctaaatgcacttgatggtgttgaaatgtccaccttcttaaatttttaagatgaacttagttctaaagaagataacaggccaatcctgaaggtactccctgtttgctgcagaatgtcagatatttgggatgttgcataagagtcctatttggcccagttaattcaacttttgtctgcctgttttgtggactggctggctctgttagaactctgtccaaaaagtgcatggaatataacttgtaaagcttcccacaattgacaatatatatgcatgtgtttaaaccaaatccagaaagcttaaacaatagagctgcataatagtatttattaaagaatcacaactgtaaacatgagaataacttaaggattctagtttagttttttgtaattgcaaattatatttttgctgctgatatattagaataatttttaaatgtcatcttgaaatagaaatatgtattttaagcactcacgcaaaggtaaatgaacacgttttaaatgtgtgtgttgctaattttttccataagaattgtaaacattgaactgaacaaattacctataatggatttggttaatgacttatgagcaagctggtttggccagacagtatacccaaacttttatataatatacagaaggctatcacacttgtgaaattctcttgtctaatctgaatttgcattccatggtgttaacatggtatatgtattgttattaaagtaagtgacccatgtca

SEQ ID NO: 25257 - DNA, 1314 bp, Homo sapiens
agacggagccagcgaggagatggagcagaagcttgtggaggagattcttcaagcaatcactatgtcaacagacacaggtgtttcccttccttcatatgaggaagatcagggatcaaaactcattcgaaaagctaaagaggcaccattcgtacccgttggaatagcgggttttgcagcaattgttgcatatggattatataaactgaagagcaggggaaatactaaaatgtccattcatctgatccacatgcgtgtggcagcccaaggctttgttgtaggagcaatgactgttggtatgggctattccatgtatcgggaattctgggcaaaacctaagccttagaagaagagatgctgtcttggtcttgttggaggagcttgctttagttagatgtcttattattaaagttacctattattgttggaaataaactaatttgtatgggtttagatggtaacatggcattttgaatattggcttcctttcttgcaggcttgatttgcttggtgaccgaattactagtgactagtttactaactaggtcattcaaggaagtcaagttaacttaaacatgtcacctaaatgcacttgatggtgttgaaatgtccaccttcttaaatttttaagatgaacttagttctaaagaagataacaggccaatcctgaaggtactccctgtttgctgcagaatgtcagatatttgggatgttgcataagagtcctatttggcccagttaattcaacttttgtctgcctgttttgtggactggctggctctgttagaactctgtccaaaaagtgcatggaatataacttgtaaagcttcccacaattgacaatatatatgcatgtgtttaaaccaaatccagaaagcttaaacaatagagctgcataatagtatttattaaagaatcacaactgtaaacatgagaataacttaaggattctagtttagttttttgtaattgcaaattatatttttgctgctgatatattagaataatttttaaatgtcatcttgaaatagaaatatgtattttaagcactcacgcaaaggtaaatgaacacgttttaaatgtgtgtgttgctaattttttccataagaattgtaaacattgaactgaacaaattacctataatggatttggttaatgacttatgagcaagctggtttggccagacagtatacccaaacttttatataatatacagaaggctatcacacttgtgaaattctcttgtctaatctgaatttgcattccatggtgttaacatggtatatgtattgttattaaagtaagtgacccatgtca

SEQ ID NO: 25258 - DNA, 1299 bp, Homo sapiens
aagggagaagccgggaggactgggtgcgcctgcagggatcggaagccggttggggtgtgagaggttttctcgctctagggagattcttcaagcaatcactatgtcaacagacacaggtgtttcccttccttcatatgaggaagatcagggatcaaaactcattcgaaaagctaaagaggcaccattcgtacccgttggaatagcgggttttgcagcaattgttgcatatggattatataaactgaagagcaggggaaatactaaaatgtccattcatctgatccacatgcgtgtggcagcccaaggctttgttgtaggagcaatgactgttggtatgggctattccatgtatcgggaattctgggcctttagttagatgtcttattattaaagttacctattattgttggaaataaactaatttgtatgggtttagatggtaacatggcattttgaatattggcttcctttcttgcaggcttgatttgcttggtgaccgaattactagtgactagtttactaactaggtcattcaaggaagtcaagttaacttaaacatgtcacctaaatgcacttgatggtgttgaaatgtccaccttcttaaatttttaagatgaacttagttctaaagaagataacaggccaatcctgaaggtactccctgtttgctgcagaatgtcagatatttgggatgttgcataagagtcctatttggcccagttaattcaacttttgtctgcctgttttgtggactggctggctctgttagaactctgtccaaaaagtgcatggaatataacttgtaaagcttcccacaattgacaatatatatgcatgtgtttaaaccaaatccagaaagcttaaacaatagagctgcataatagtatttattaaagaatcacaactgtaaacatgagaataacttaaggattctagtttagttttttgtaattgcaaattatatttttgctgctgatatattagaataatttttaaatgtcatcttgaaatagaaatatgtattttaagcactcacgcaaaggtaaatgaacacgttttaaatgtgtgtgttgctaattttttccataagaattgtaaacattgaactgaacaaattacctataatggatttggttaatgacttatgagcaagctggtttggccagacagtatacccaaacttttatataatatacagaaggctatcacacttgtgaaattctcttgtctaatctgaatttgcattccatggtgttaacatggtatatgtattgttattaaagtaagtgacccatgtca

SEQ ID NO: 25259 - DNA, 1190 bp, Homo sapiens
ctagttttagaagtttcaatagcactagcaacagacgctaaaccccaggcagcaattgttgcatatggattatataaactgaagagcaggggaaatactaaaatgtccattcatctgatccacatgcgtgtggcagcccaaggctttgttgtaggagcaatgactgttggtatgggctattccatgtatcgggaattctgggcaaaacctaagccttagaagaagagatgctgtcttggtcttgttggaggagcttgctttagttagatgtcttattattaaagttacctattattgttggaaataaactaatttgtatgggtttagatggtaacatggcattttgaatattggcttcctttcttgcaggcttgatttgcttggtgaccgaattactagtgactagtttactaactaggtcattcaaggaagtcaagttaacttaaacatgtcacctaaatgcacttgatggtgttgaaatgtccaccttcttaaatttttaagatgaacttagttctaaagaagataacaggccaatcctgaaggtactccctgtttgctgcagaatgtcagatatttgggatgttgcataagagtcctatttggcccagttaattcaacttttgtctgcctgttttgtggactggctggctctgttagaactctgtccaaaaagtgcatggaatataacttgtaaagcttcccacaattgacaatatatatgcatgtgtttaaaccaaatccagaaagcttaaacaatagagctgcataatagtatttattaaagaatcacaactgtaaacatgagaataacttaaggattctagtttagttttttgtaattgcaaattatatttttgctgctgatatattagaataatttttaaatgtcatcttgaaatagaaatatgtattttaagcactcacgcaaaggtaaatgaacacgttttaaatgtgtgtgttgctaattttttccataagaattgtaaacattgaactgaacaaattacctataatggatttggttaatgacttatgagcaagctggtttggccagacagtatacccaaacttttatataatatacagaaggctatcacacttgtgaaattctcttgtctaatctgaatttgcattccatggtgttaacatggtatatgtattgttattaaagtaagtgacccatgtca

SEQ ID NO: 25260 - DNA, 1242 bp, Homo sapiens
attcggcagataacaagggactgcccggcggataccgagccgttctgaaggaaactcactagcagtggccgctgtctgaggtcatgactgtgagtctgatcaacggggagtcctaggcgagtctcgatctcaagattccgccccgcctactaaaatgtccattcatctgatccacatgcgtgtggcagcccaaggctttgttgtaggagcaatgactgttggtatgggctattccatgtatcgggaattctgggcaaaacctaagccttagaagaagagatgctgtcttggtcttgttggaggagcttgctttagttagatgtcttattattaaagttacctattattgttggaaataaactaatttgtatgggtttagatggtaacatggcattttgaatattggcttcctttcttgcaggcttgatttgcttggtgaccgaattactagtgactagtttactaactaggtcattcaaggaagtcaagttaacttaaacatgtcacctaaatgcacttgatggtgttgaaatgtccaccttcttaaatttttaagatgaacttagttctaaagaagataacaggccaatcctgaaggtactccctgtttgctgcagaatgtcagatatttgggatgttgcataagagtcctatttggcccagttaattcaacttttgtctgcctgttttgtggactggctggctctgttagaactctgtccaaaaagtgcatggaatataacttgtaaagcttcccacaattgacaatatatatgcatgtgtttaaaccaaatccagaaagcttaaacaatagagctgcataatagtatttattaaagaatcacaactgtaaacatgagaataacttaaggattctagtttagttttttgtaattgcaaattatatttttgctgctgatatattagaataatttttaaatgtcatcttgaaatagaaatatgtattttaagcactcacgcaaaggtaaatgaacacgttttaaatgtgtgtgttgctaattttttccataagaattgtaaacattgaactgaacaaattacctataatggatttggttaatgacttatgagcaagctggtttggccagacagtatacccaaacttttatataatatacagaaggctatcacacttgtgaaattctcttgtctaatctgaatttgcattccatggtgttaacatggtatatgtattgttattaaagtaagtgacccatgtca

SEQ ID NO: 25261 - DNA, 541 bp, Homo sapiens
aagggagaagccgggaggactgggtgcgcctgcagggatcggaagccggttggggtgtgagaggttttctcgctctagggagattcttcaagcaatcactatgtcaacagacacaggtgtttcccttccttcatatgaggaagatcagggatcaaaactcattcgaaaagctaaagaggcaccattcgtacccgttgtttttggagacagtcccgctctgtcgcccaggctggagtgcagtggcaggatctcggctcactgcagcctctgcctcctgggttcaagtgattctcctacctcagcttcctgagtagctgggactactcccgccaccacaccaggctgatttttgtgtttttagtagagacggggtttcaccattttggccaggctagtctcgaactcctgttttcaagtgattcacctgcctcggcctcccaaagtgcttggattacaggtgtgagccactgcacccagcctcttatgttatcttaattttgttttggtatcagggatttgttttcttggaaaatatattgga

SEQ ID NO: 25262 - DNA, 1353 bp, Homo sapiens
aagggagaagccgggaggactgggtgcgcctgcagggatcggaagccggttggggtgtgagaggttttctcgctctagggagattcttcaagcaatcactatgtcaacagacacaggtgtttcccttccttcatatgaggaagatcagggatcaaaactcattcgaaaagctaaagaggcaccattcgtacccgttggaatagcgggttttgcagcaattgttgcatatggattatataaactgaagagcaggggaaatactaaaatgtccattcatctgatccacatgcgtgtggcagcccaaggctttgttgtaggagcaatgactgttggtatgggctattccatgtatcgggaattctgggcaaaacctaagccttagaagaagagatgctgtcttggtcttgttggaggagcttgctttagttagatgtcttattattaaagttacctattattgttggaaataaactaatttgtatgggtttagatggtaacatggcattttgaatattggcttcctttcttgcaggcttgatttgcttggtgaccgaattactagtgactagtttactaactaggtcattcaaggaagtcaagttaacttaaacatgtcacctaaatgcacttgatggtgttgaaatgtccaccttcttaaatttttaagatgaacttagttctaaagaagataacaggccaatcctgaaggtactccctgtttgctgcagaatgtcagatatttgggatgttgcataagagtcctatttggcccagttaattcaacttttgtctgcctgttttgtggactggctggctctgttagaactctgtccaaaaagtgcatggaatataacttgtaaagcttcccacaattgacaatatatatgcatgtgtttaaaccaaatccagaaagcttaaacaatagagctgcataatagtatttattaaagaatcacaactgtaaacatgagaataacttaaggattctagtttagttttttgtaattgcaaattatatttttgctgctgatatattagaataatttttaaatgtcatcttgaaatagaaatatgtattttaagcactcacgcaaaggtaaatgaacacgttttaaatgtgtgtgttgctaattttttccataagaattgtaaacattgaactgaacaaattacctataatggatttggttaatgacttatgagcaagctggtttggccagacagtatacccaaacttttatataatatacagaaggctatcacacttgtgaaattctcttgtctaatctgaatttgcattccatggtgttaacatggtatatgtattgttattaaagtaagtgacccatgtca

SEQ ID NO: 25263 - DNA, 904 bp, Homo sapiens
  misc_feature (796)..(796): n is a, c, g, or t
  misc_feature (824)..(824): n is a, c, g, or t
  misc_feature (826)..(826): n is a, c, g, or t
  misc_feature (828)..(829): n is a, c, g, or t
aagggagaagccgggaggactgggtgcgcctgcagggatcggaagccggttggggtgtgagaggttttctcgctctagggagattcttcaagcaatcactatgtcaacagacacaggtgtttcccttccttcatatgaggaagatcagggatcaaaactcattcgaaaagctaaagaggcaccattcgtacccgttggaatagcgggttttgcagcaattgttgcatatggattatataaactgaagagcaggggaaatactaaaatgtccattcatctgatccacatgcgtgtggcagcccaaggctttgttgtaggagcaatgactgttggtatgggctattccatgtatcgggaattctgggcaaaacctaagccttagaagaagagatgctgtcttggtcttgttggaggagcttgctttagttagatgtcttattattaaagttacctattattgttggaaataaactaatttgtatgggtttagatggtaacatggcattttgaatattggcttcctttcttgcaggcttgatttgcttggtgaccgaattactagtgactagtttactaactaggtcattcaaggaagtcaagttaacttaaacatgtcacctaaatgcacttgatggtgttgaaatgtccaccttcttaaatttttaagatgaacttagttctaaagaagataacaggccaatcctgaaggtactccctgtttgctgctggcgaatgtcgatattgggggtggcaagagtctattgggccagttattcactttggttgcggttgggangggggctgtgaccggccaaggggggtantngnngtcccatggattttggtttcccgcacggtaaaagggtgagttttaaccgggggaaagagagtgggggacatggga

SEQ ID NO: 25264 - DNA, 1382 bp, Homo sapiens
aagggagaagccgggaggactgggtgcgcctgcagggatcggaagccggttggggtgtgagaggttttctcgctctagggagattcttcaagcaatcactatgtcaacagacacaggtgtttcccttccttcatatgaggaagatcagggatcaaaactcattcgaaaagctaaagaggcaccattcgtacccgttggaatagcgggttttgcagcaattgttgcatatggattatataaactgaagagcaggggaaatactaaaatgtccattcatctgatccacatgcgtgtggcagcccaaggctttgttgtaggagcaatgactgttggtatgggctattccatgtatcgggaattctgggcaaaacctaagccttagaagaagagatgctgtcttggtcttgttggaggagcttgctttagttagatgtcttattattaaagttacctattattgttggaaataaactaatttgtatgggtttagatggtaacatggcattttgaatattggcttcctttcttgcaggcttgatttgcttggtgaccgaattactagtgactagtttactaactaggtcattcaaggaagtcaagttaacttaaacatgtcacctaaatgcacttgatggtgttgaaatgtccaccttcttaaatttttaagatgaacttagttctaaagaagataacaggccaatcctgaaggtactccctgtttgctgcagaatgtcagatatttgggatgttgcataagagtcctatttggcccagttaattcaacttttgtctgcctgttttgtggactggctggctctgttagaactctgtccaaaaagtgcatggaatataacttgtaaagcttcccacaattgacaatatatatgcatgtgtttaaaccaaatccagaaagcttaaacaatagagctgcataatagtatttattaaagaatcacaactgtaaacatgagaataacttaaggattctagtttagttttttgtaattgcaaattatatttttgctgctgatatattagaataatttttaaatgtcatcttgaaatagaaatatgtattttaagcactcacgcaaaggtaaatgaacacgttttaaatgtgtgtgttgctaattttttccataagaattgtaaacattgaactgaacaaattacctataatggatttggttaatgacttatgagcaagctggtttggccagacagtatacccaaacttttatataatatacagaaggctatcacacttgtgaaattctcttgtctaatctgaatttgcattccatggtgttaacatggtatatgtattgttattaaagtaagtgacccatgtcaaaaaaaaaaaaaaaaaaagctacatacct

SEQ ID NO: 25265 - DNA, 1745 bp, Homo sapiens
aagggagaagccgggaggactgggtgcgcctgcagggatcggaagccggttggggtgtgagaggttttctcgctctagggagattcttcaagcaatcactatgtcaacagacacaggtgtttcccttccttcatatgaggaagatcagggatcaaaactcattcgaaaagctaaagaggcaccattcgtacccgttggaatagcgggttttgcagcaattgttgcatatggattatataaactgaagagcaggggaaatactaaaatgtccattcatctgatccacatgcgtgtggcagcccaaggctttgttgtaggagcaatgactgttggtatgggctattccatgtatcgggaattctgggcaaaacctaagccttagaagaagagatgctgtcttggtcttgttggaggagcttgctttagttagatgtcttattattaaagttacctattattgttggaaataaactaatttgtatgggtttagatggtaacatggcattttgaatattggcttcctttcttgcaggcttgatttgcttggtgaccgaattactagtgactagtttactaactaggtcattcaaggaagtcaagttaacttaaacatgtcacctaaatgcacttgatggtgttgaaatgtccaccttcttaaatttttaagatgaacttagttctaaagaagataacaggccaatcctgaaggtactccctgtttgctgcagaatgtcagatatttgggatgttgcataagagtcctatttggcccagttaattcaacttttgtctgcctgttttgtggactggctggctctgttagaactctgtccaaaaagtgcatggaatataacttgtaaagcttcccacaattgacaatatatatgcatgtgtttaaaccaaatccagaaagcttaaacaatagagctgcataatagtatttattaaagaatcacaactgtaaacatgagaataacttaaggattctagtttagttttttgtaattgcaaattatatttttgctgctgatatattagaataatttttaaatgtcatcttgaaatagaaatatgtattttaagcactcacgcaaaggtaaatgaacacgttttaaatgtgtgtgttgctaattttttccataagaattgtaaacattgaactgaacaaattacctataatggatttggttaatgacttatgagcaagctggtttggccagacagtatacccaaacttttatataatatacagaaggctatcacacttgtgaaattctcttgtctaatctgaatttgcattccatggtgttaacatggtatatgtattgttattaaagtaagtgacccatgtcatgtctttatttatttcatgaggaaaagctttctgtagaggaacaaatttgagaacagttcaggaaatgtctttttgtgttgttctctaatcatgttctcctttctgttcaacgattttaaaatattttactttatggtatggtctcattcttttcctttgggggtaattgggtccatggattatccatataactttctcttttttcgagaagggatattcccggcacacggcgggcggcaaggcacacttgggccagtgagtccacccagaaaggctttgtgtgggaaaacagaggtgcggcccccacaaaaatcacacaacacaaaaaaaaggggcggcaataaagggcacagaacatttaagaggcagagaatataaacgggcaacaaaa

SEQ ID NO: 25266 - DNA, 965 bp, Homo sapiens
  misc_feature (842)..(842): n is a, c, g, or t
  misc_feature (895)..(895): n is a, c, g, or t
  misc_feature (941)..(941): n is a, c, g, or t
aagggagaagccgggaggactgggtgcgcctgcagggatcggaagccggttggggtgtgagaggttttctcgctctagggagattcttcaagcaatcactatgtcaacagacacaggtgtttcccttccttcatatgaggaagatcagggatcaaaactcattcgaaaagctaaagaggcaccattcgtacccgttggaatagcgggttttgcagcaattgttgcatatggattatataaactgaagagcaggggaaatactaaaatgtccattcatctgatccacatgcgtgtggcagcccaaggctttgttgtaggagcaatgactgttggtatgggctattccatgtatcgggaattctgggcaaaacctaagccttagaagaagagatgctgtcttggtcttgttggaggagcttgctttagttagatgtcttattattaaagttacctattattgttggaaataaactaatttgtatgggtttagatggtaacatggcattttgaatattggcttcctttcttgcaggcttgatttgcttggtgaccgaattactagtgactagtttactaactaggtcattcaaggaagtcaagttaacttaaacatgtcacctaaatgcacttgatggtgttgaaatgtccaccttcttaaatttttaagatgaacttagttctaaagaagataacaggccaatcctgaaggtactccctgtttgctgcagaatgtcagatatttgggatgttgcataagagtcctatttggcccagttaattcaacttttggtctgcggttggggacggtggttgtaaactctgccaagggtggatataatggnggtccccatgcaaatttcgtgtttccccccagtacaggggtgttttaacccgnggaaaagtacgagggaatggggaaaatccataacgcgccgtgtggncgcacgcgtgaagtgcgtatattg

SEQ ID NO: 25267 - DNA, 1613 bp, Homo sapiens
aagggagaagccgggaggactgggtgcgcctgcagggatcggaagccggttggggtgtgagaggttttctcgctctagggagattcttcaagcaatcactatgtcaacagacacaggtgtttcccttccttcatatgaggaagatcagggatcaaaactcattcgaaaagctaaagaggcaccattcgtacccgttgtttttggagacagtcccgctctgtcgcccaggctggagtgcagtggcaggatctcggctcactgcagcctctgcctcctgggttcaagtgattctcctacctcagcttcctgagtagctgggactactcccgccaccacaccaggctgatttttgtgtttttagtagagacggggtttcaccattttggccaggctagtctcgaactcctgttttcaagtgattcacctgcctcggcctcccaaagtgcttggattacaggaatagcgggttttgcagcaattgttgcatatggattatataaactgaagagcaggggaaatactaaaatgtccattcatctgatccacatgcgtgtggcagcccaaggctttgttgtaggagcaatgactgttggtatgggctattccatgtatcgggaattctgggcaaaacctaagccttagaagaagagatgctgtcttggtcttgttggaggagcttgctttagttagatgtcttattattaaagttacctattattgttggaaataaactaatttgtatgggtttagatggtaacatggcattttgaatattggcttcctttcttgcaggcttgatttgcttggtgaccgaattactagtgactagtttactaactaggtcattcaaggaagtcaagttaacttaaacatgtcacctaaatgcacttgatggtgttgaaatgtccaccttcttaaatttttaagatgaacttagttctaaagaagataacaggccaatcctgaaggtactccctgtttgctgcagaatgtcagatatttgggatgttgcataagagtcctatttggcccagttaattcaacttttgtctgcctgttttgtggactggctggctctgttagaactctgtccaaaaagtgcatggaatataacttgtaaagcttcccacaattgacaatatatatgcatgtgtttaaaccaaatccagaaagcttaaacaatagagctgcataatagtatttattaaagaatcacaactgtaaacatgagaataacttaaggattctagtttagttttttgtaattgcaaattatatttttgctgctgatatattagaataatttttaaatgtcatcttgaaatagaaatatgtattttaagcactcacgcaaaggtaaatgaacacgttttaaatgtgtgtgttgctaattttttccataagaattgtaaacattgaactgaacaaattacctataatggatttggttaatgacttatgagcaagctggtttggccagacagtatacccaaacttttatataatatacagaaggctatcacacttgtgaaattctcttgtctaatctgaatttgcattccatggtgttaacatggtatatgtattgttattaaagtaagtgacccatgtca

SEQ ID NO: 25268 - DNA, 1398 bp, Homo sapiens
aagggagaagccgggaggactgggtgcgcctgcagggatcggaagccggttggggtgtgagaggttttctcgctctagggagattcttcaagcaatcactatgtcaacagacacaggtgtttcccttccttcatatgaggaagatcagggatcacaaatcagttccggagaaaacgctaataacgaagaggggagccatttctggtaacgccgattgagcaagtagtccggagttctatatcgcgagacgatactcagtgtcgcagtatcggatatataatataaactgaagagcaggggaaatactaaaatgtccattcatctgatccacatgcgtgtggcagcccaaggctttgttgtaggagcaatgactgttggtatgggctattccatgtatcgggaattctgggcaaaacctaagccttagaagaagagatgctgtcttggtcttgttggaggagcttgctttagttagatgtcttattattaaagttacctattattgttggaaataaactaatttgtatgggtttagatggtaacatggcattttgaatattggcttcctttcttgcaggcttgatttgcttggtgaccgaattactagtgactagtttactaactaggtcattcaaggaagtcaagttaacttaaacatgtcacctaaatgcacttgatggtgttgaaatgtccaccttcttaaatttttaagatgaacttagttctaaagaagataacaggccaatcctgaaggtactccctgtttgctgcagaatgtcagatatttgggatgttgcataagagtcctatttggcccagttaattcaacttttgtctgcctgttttgtggactggctggctctgttagaactctgtccaaaaagtgcatggaatataacttgtaaagcttcccacaattgacaatatatatgcatgtgtttaaaccaaatccagaaagcttaaacaatagagctgcataatagtatttattaaagaatcacaactgtaaacatgagaataacttaaggattctagtttagttttttgtaattgcaaattatatttttgctgctgatatattagaataatttttaaatgtcatcttgaaatagaaatatgtattttaagcactcacgcaaaggtaaatgaacacgttttaaatgtgtgtgttgctaattttttccataagaattgtaaacattgaactgaacaaattacctataatggatttggttaatgacttatgagcaagctggtttggccagacagtatacccaaacttttatataatatacagaaggctatcacacttgtgaaattctcttgtctaatctgaatttgcattccatggtgttaacatggtatatgtattgttattaaagtaagtgacccatgtca

SEQ ID NO: 25269 - DNA, 358 bp, Homo sapiens
aagggagaagccgggaggactgggtgcgcctgcagggatcggaagccggttggggtgtgagaggttttctcgctctagggagattcttcaagcaatcactatgtcaacagacacaggtgtttcccttccttcatatgaggaagatcagggatcaaaactcattcgaaaagctaaagaggcaccattcgtacccgttggaatagcgggttttgcagcaattgttgcatatggattatataaactgaagagcaggggaaatactaaaatgtccattcatctgatccacatgcgtgtggcagcccaaggctttgttgtaggagcaatgactgtgacaaagtgtaagcggagcggctcatca

SEQ ID NO: 25270 - DNA, 624 bp, Homo sapiens
  misc_feature (122)..(122): n is a, c, g, or t
ccagttctgtactcaagaagcgcttgatagagtttatgggttcgtaaggacgtcgaaggtcccagaatttgattttccggtcactccccgcagagacaaggaaatggctgttagctttgcancattgaagggtacgcacagcctggtcatgggctaggaaacactggaaggggtagagctttaaggagccatcagagagccgtatccgctgcaggccagaggctattcataagggtaaccatcatgtatgcccacgagggtgatagtaattcgtgagactgaagttgcttagagtacttctttgaccaaggaataccacagacaccctaccgatagaacagtggctcagatcttacttgctcctgcttacgaagtattcccaatcactggtcatctgaccctacttgaacactcctgaacagtcatgttttttaaaatcttcctttatatcaagtcagagagtatacttctataaatttcactcatggatgttaggaaatctagtcatcttccctgtgattgccctgttaagtatttaaccatagctatcatgtgtttcccaaatcttctctagattaaatatcttcagtatcagcaaaagaaatagtaagaagtgtaggcggg

SEQ ID NO: 25271 - DNA, 531 bp, Homo sapiens
ttttgaatggggtagttctgtcagggcttcttatttatcacaggaataatatagatggattttcactgacctttatttaccttggcctcccaaagtgttgagattacaggcatgagccactgcgcccagcccagcacatgattcttgagccagcagctgtaaataagagcaccttcccagtttgataagcacttgttcctaccaactgtttttccctcaaccctcatcgtgatcatttatttatgcaagtgtttttcagcttgagtgtgcgtcagaatcccctgaagagcttgttaaaacacaaggtgctggccccatccagaattgctgattcggtaggtctggggtagaactaggaatttgcattttaacaaatttgcaggtgatactgatgctgcagtttctggggccacactttgtgaacctctgatatgaactgtttaataccgtgtagtgaattcctttctgcttgaactgattggagaggattctgttctatgcaactgagccaatatggggggaaaaaaaaaa

SEQ ID NO: 25272 - DNA, 5098 bp, Homo sapiens
atggaataatggccaaactcagtgacttacacctgtgatcgcagcactatgggaggctgaggcaagaggatcacttcaggtcaggtgttcaagaccagcctggtcaacataacgagaccccatctctagaaaaaattaaaaaattaggccgggcacggtggctcatgcctgtaatcccagcactttgggaggctgaggcaggcgtatcacaaggtcaggagttcgagaccagcctggccaacatagtgaaaccccttctctactaaaaagacaaaaattatccgggcttgctggcgggcgcctgtaatctcagctactcgggaggctgaggcaggacaattgcttgaacccgggaggcggagtttgcagtgagccgagatcgcgccactgcactccagcctggggacagagcaagactccatctcaggaaaaaataaaaataaaaataaaaacggggtctcactatgttgcccaggctggtatcgaattcctgggctcaagtgatcctcccccgccttggcctcccaaagtgctgggatcacagacaggagccaccatacccagccaaagtcatgcttttctactcctactccttcccttccttgtcctctttccaagctctctcgggcccatccctgacttcactactggcagaatcctccagcggccggcggcgaggacttctttgtctcccagactccgccttgggctcggacgccgccagggttgcaggtacagactctctggtctagctggctcttccggccacaggcgcggcagtccggccggaaaggccggattcagggatccagagcgcgagcccggcctgggagtccgcctactcccggctcccgtcgaggccgcgtgggatcccgttggccgcgcaggcgtcgatctcccctttttgacactgcaactcccatgaggccctgcagcgtccctggcgccgctgaagacgccctggaactcggctggcttcggagggctcggtgactctggccgcgctgcattatggaatacagagtctaagagaaaactagcccggcaccgactccggaccaagcacacgtgtttaccttgtgcactggggtgggggcgtcagtgaagagcagctaacaagatttcgtcataagaccgcgaccagacaggcggcgccatcttcgaacttagacttccggaaggactttggcgaggttcagcttgagtgtgcgtcagaatcccctgaagagcttgttaaaacacaaggtgctggccccatccagaattgctgattcggggcagccattttggggggtgctgatggatacctgcggggtcggctatgttgccctgggggaggccggccccgtggggaacatgactgtggtagactctcctggacaagaggtgctaaatcagcttgatgtcaagacctcttcagaaatgaccagtgcagaggcttccgtagagatgtcattacctacccctttgcctggatttgaggattctcctgatcagaggaggctccctccagagcaggaaagcctctccagactggaacagccagatctttcttcagagatgtcaaaggtctcaaagcctagggcctcaaagcctggccggaagagaggtggtaggacacgaaaaggccccaaaaggccccaacagcctaatcctccatcagccccactggttcctggtctcttagatcaatccaaccctctgtccacccccatgcctaagaaacgaggtcgaaagtccaaggcagagctgctgctgctgaagttgtcaaaagacctagatcggccagaatctcaatctccaaagaggccccctgaggactttgagaccccttctggggaacgaccccgccgaagggctgcccaagtggcacttctgtatcttcaggaactggctgaagagctctcaacagccctgcctgcccctgtgtcctgtcctgagggccccaaggtgagcagccccaccaaaccgaagaagatccggcagccagcagcctgtccaggtggagaagaggtggatggtgctccacgggatgaagacttttttctccaggttgaggctgaagatgtggaagaaagtgagggcccaagtgagagctcatctgaacctgagcctgtagtgccccgaagcaccccacgaggatctacttcagggaaacagaaaccacactgccgaggaatggctcccaatggcttaccaaatcatatcatggctcctgtttggaagtgcctccatctcaccaaggacttccgagagcagaaacattcatactgggagtttgctgagtggattcctttagcctggaagtggcacttgttatctgagcttgaggccgctccctacctgccccaggaggagaagtctccattgttttctgtacaacgtgaagggctacctgaagatggcaccctctaccgaataaacagatttagctcgatcacagcacatccagagcgctgggatgtgtccttcttcacggggggaccgctctgggctctggactggtgcccagtgccagagggggcaggagcctcgcaatatgtggctcttttctccagccctgacatgaatgagacacacccactgagccagcttcattcgggtcctgggctgctccagctctggggccttgggaccttgcagcaagaaagctgtcctggcaacagggcccactttgtctatgggattgcttgtgacaacggctgcatctgggacctcaagttctgccccagtggagcatgggaacttccaggcacccctcggaaggctcctctcctgccccggttgggtctcttggctctggcctgctcagacgggaaagtactgctattcagtctaccccatccggaggccctgctggctcagcaacccccagatgcagtgaagcctgccatatataaggtacaatgtgtggcaactctgcaggtggggtctatgcaagctacagacccctctgagtgtggtcagtgccttagcctggcctggatgcctaccaggccccaccaacacctagctgctggatattataatggcatggtggttttctggaaccttcccactaactcacccctgcagcggatacggctctctgatggctccttaaagctctaccccttccagtgtttcctagcccatgaccaggctgtgcgtacccttcaatggtgcaaagctaacagccatttccttgtctctgcggggagtgaccggaaaatcaaattctgggaccttcgacgtccttacgaacccataaactctatcaagcgcttcttgagtacagaactggcctggctgcttccctacaatggtgtcactgtggctcaggacaactgctatgcctcttatggactctgtgggattcattatattgacgctggttaccttggtttcaaggcctacttcactgctcctcgaaaaggcaccgtttggagtctttcaggatccgactggcttgggacaatagctgcaggagatatatccggggagctcattgctgctatattaccagatatggcactgaatccaataaatgtcaagcgacctgtagagcgaagatttcctatatataaagcagatctgataccgtatcaggacagtcctgaaggtccagaccattcttctgcttcatctggggtccccaaccctcccaaggctcgaacttacactgaaactgtcaaccatcactacttgctctttcaagacacagatttgggttcattccatgatctgctccgtagagaaccaatgctgcgcatgcaggagggagaggggcattctcaactctgcctggacaggctgcagctggaggctattcataaggtacgtttcagcccaaacctggactcctatggatggctggtatctggggggcagtcagggctggttcgaatccattttgtccgtggactcgcctccccactgggccaccgtatgcagcttgaaagccgagcccacttcaatgctatgttccaaccatcctcccccactagacggcctggcttctctccaaccagccatcgccttctgcccactccctagccttggcccacaccagatccttggagtgaagtcggtcaagaacaaatggcccctatgcacagagccataggaactgggggccttccctggacagtgatcatgccaggcctggacctttaggcctgcctccccaggactccttagatcccactctttctacagacttctgtgatcacagccccctgcgggcaggggggctctccctccaccaactctcaaggctcctcagcctaagactatggctcatgagaaacactcaggcctgacctaggcttgggagtcaaactgctcatattgagcatattgttaagtgggtaaagccaagtaaaggtactgggtgtttttgtgaccacttgtgaatgggtgtatggagaactgaaaagggtatctgcatgaaggctcctgtctgactattccaggatccaatattactgccttctgaaacttcctctttagggtaaccatcatgtatgcccacgagggtgatagtaattcgtgagactgaagttgcttagagtacttctttgaccaaggaataccacagacaccctaccgatagaacagtggctcagatcttacttgctcctgcttacgaagtattcccaatcactggtcatctgaccctacttgaacactcctgaacagtcatgttttttaaaatcttcctttatatcaagtcagagagtatacttctataaatttcactcatggatgttaggaaatctagtcatcttccctgtgattgccctgttaagtatttaaccatagctatcatgtgtttcccaaatcttctctagattaaatatcttcagttacttcaaccattcttttacacgtcatgatttttgatccttcatgatactgtcacattgttgactcattagaatgtttacctacttcagttctatgtataggaggtgtttagaacccaagtactgtaatgtattgttatatctcatcttgttagagtcctcttgtgggatgctgcagactcacagtgactatgatactgcctcctaagcaaggacacaccccagtgatgagaaataggcaaaccatggtc

SEQ ID NO: 25273 - DNA, 2421 bp, Homo sapiens
ggacgcgtgggtcgcggacgcgtgggtgcatctgggacctcaagttctgccccagtggagcatgggaacttccaggcacccctcggaaggctcctctcctgccccggttgggtctcttggctctggcctgctcagacgggaaagtactgctattcagtctaccccatccggaggccctgctggctcagcaacccccagatgcagtgaagcctgccatatataaggtacaatgtgtggcaactctgcaggtggggtctatgcaagctacagacccctctgagtgtggtcagtgccttagcctggcctggatgcctaccaggccccaccaacacctagctgctggatattataatggcatggtggttttctggaaccttcccactaactcacccctgcagcggatacggctctctgatggctccttaaagctctaccccttccagtgtttcctagcccatgaccaggctgtgcgtacccttcaatggtgcaaagctaacagccatttccttgtctctgcggggagtgaccggaaaatcaaattctgggaccttcgacgtccttacgaacccataaactctatcaagcgcttcttgagtacagaactggcctggctgcttccctacaatggtgtcactgtggctcaggacaactgctatgcctcttatggactctgtgggattcattatattgacgctggttaccttggtttcaaggcctacttcactgctcctcgaaaaggcaccgtttggagtctttcaggatccgactggcttgggacaatagctgcaggagatatatccggggagctcattgctgctatattaccagatatggcactgaatccaataaatgtcaagcgacctgtagagcgaagatttcctatatataaagcagatctgataccgtatcaggacagtcctgaaggtccagaccattcttctgcttcatctggggtccccaaccctcccaaggctcgaacttacactgaaactgtcaaccatcactacttgctctttcaagacacagatttgggttcattccatgatctgctccgtagagaaccaatgctgcgcatgcaggagggagaggggcattctcaactctgcctggacaggctgcagctggaggctattcataaggtacgtttcagcccaaacctggactcctatggatggctggtatctggggggcagtcagggctggttcgaatccattttgtccgtggactcgcctccccactgggccaccgtatgcagcttgaaagccgagcccacttcaatgctatgttccaaccatcctcccccactagacggcctggcttctctccaaccagccatcgccttctgcccactccctagccttggcccacaccagatccttggagtgaagtcggtcaagaacaaatggcccctatgcacagagccataggaactgggggccttccctggacagtgatcatgccaggcctggacctttaggcctgcctccccaggactccttagatcccactctttctacagacttctgtgatcacagccccctgcgggcaggggggctctccctccaccaactctcaaggctcctcagcctaagactatggctcatgagaaacactcaggcctgacctaggcttgggagtcaaactgctcatattgagcatattgttaagtgggtaaagccaagtaaaggtactgggtgtttttgtgaccacttgtgaatgggtgtatggagaactgaaaagggtatctgcatgaaggctcctgtctgactattccaggatccaatattactgccttctgaaacttcctctttagggtaaccatcatgtatgcccacgagggtgatagtaattcgtgagactgaagttgcttagagtacttctttgaccaaggaataccacagacaccctaccgatagaacagtggctcagatcttacttgctcctgcttacgaagtattcccaatcactggtcatctgaccctacttgaacactcctgaacagtcatgttttttaaaatcttcctttatatcaagtcagagagtatacttctataaatttcactcatggatgttaggaaatctagtcatcttccctgtgattgccctgttaagtatttaaccatagctatcatgtgtttcccaaatcttctctagattaaatatcttcagttacttcaaccattcttttacacgtcatgatttttgatccttcatgatactgtcacattgttgactcattagaatgtttacctacttcagttctatgtataggaggtgtttagaacccaagtactgtaatgtattgttatatctcatcttgttagagtcctcttgtgggatgctgcagactcacagtgactatgatactgcctcctaagcaaggacacaccccagtgatgagaaataggcaaaccatggtc

SEQ ID NO: 25274 - DNA, 5294 bp, Homo sapiens
atggaataatggccaaactcagtgacttacacctgtgatcgcagcactatgggaggctgaggcaagaggatcacttcaggtcaggtgttcaagaccagcctggtcaacataacgagaccccatctctagaaaaaattaaaaaattaggccgggcacggtggctcatgcctgtaatcccagcactttgggaggctgaggcaggcgtatcacaaggtcaggagttcgagaccagcctggccaacatagtgaaaccccttctctactaaaaagacaaaaattatccgggcttgctggcgggcgcctgtaatctcagctactcgggaggctgaggcaggacaattgcttgaacccgggaggcggagtttgcagtgagccgagatcgcgccactgcactccagcctggggacagagcaagactccatctcaggaaaaaataaaaataaaaataaaaacggggtctcactatgttgcccaggctggtatcgaattcctgggctcaagtgatcctcccccgccttggcctcccaaagtgctgggatcacagacaggagccaccatacccagccaaagtcatgcttttctactcctactccttcccttccttgtcctctttccaagctctctcgggcccatccctgacttcactactggcagaatcctccagcggccggcggcgaggacttctttgtctcccagactccgccttgggctcggacgccgccagggttgcaggtacagactctctggtctagctggctcttccggccacaggcgcggcagtccggccggaaaggccggattcagggatccagagcgcgagcccggcctgggagtccgcctactcccggctcccgtcgaggccgcgtgggatcccgttggccgcgcaggcgtcgatctcccctttttgacactgcaactcccatgaggccctgcagcgtccctggcgccgctgaagacgccctggaactcggctggcttcggagggctcggtgactctggccgcgctgcattatggaatacagagtctaagagaaaactagcccggcaccgactccggaccaagcacacgtgtttaccttgtgcactggggtgggggcgtcagtgaagagcagctaacaagatttcgtcataagaccgcgaccagacaggcggcgccatcttcgaacttagacttccggaaggactttggcgaggggcagccattttggggggtgctgatggatacctgcggggtcggctatgttgccctgggggaggccggccccgtggggaacatgactgtggtagactctcctggacaagaggtgctaaatcagcttgatgtcaagacctcttcagaaatgaccagtgcagaggcttccgtagagatgtcattacctacccctttgcctggatttgaggattctcctgatcagaggaggctccctccagagcaggaaagcctctccagactggaacagccagatctttcttcagagatgtcaaaggtctcaaagcctagggcctcaaagcctggccggaagagaggtggtaggacacgaaaaggccccaaaaggccccaacagcctaatcctccatcagccccactggttcctggtctcttagatcaatccaaccctctgtccacccccatgcctaagaaacgaggtcgaaagtccaaggcagagctgctgctgctgaagttgtcaaaagacctagatcggccagaatctcaatctccaaagaggccccctgaggactttgagaccccttctggggaacgaccccgccgaagggctgcccaagtggcacttctgtatcttcaggaactggctgaagagctctcaacagccctgcctgcccctgtgtcctgtcctgagggccccaaggtgagcagccccaccaaaccgaagaagatccggcagccagcagcctgtccaggtggagaagaggtggatggtgctccacgggatgaagacttttttctccaggttgaggctgaagatgtggaagaaagtgagggcccaagtgagagctcatctgaacctgagcctgtagtgccccgaagcaccccacgaggatctacttcagggaaacagaaaccacactgccgaggaatggctcccaatggcttaccaaatcatatcatggctcctgtttggaagtgcctccatctcaccaaggacttccgagagcagaaacattcatactgggagtttgctgagtggattcctttagcctggaagtggcacttgttatctgagcttgaggccgctccctacctgccccaggaggagaagtctccattgttttctgtacaacgtgaagggctacctgaagatggcaccctctaccgaataaacagatttagctcgatcacagcacatccagagcgctgggatgtgtccttcttcacggggggaccgctctgggctctggactggtgcccagtgccagagggggcaggagcctcgcaatatgtggctcttttctccagccctgacatgaatgagacacacccactgagccagcttcattcgggtcctgggctgctccagctctggggccttgggaccttgcagcaagaaagctgtcctggcaacagggcccactttgtctatgggattgcttgtgacaacggctgcatctgggacctcaagttctgccccagtggagcatgggaacttccaggcacccctcggaaggctcctctcctgccccggttgggtctcttggctctggcctgctcagacgggaaagtactgctattcagtctaccccatccggaggccctgctggctcagcaacccccagatgcagtgaagcctgccatatataaggtacaatgtgtggcaactctgcaggtggggtctatgcaagctacagacccctctgagtgtggtcagtgccttagcctggcctggatgcctaccaggccccaccaacacctagctgctggatattataatggcatggtggttttctggaaccttcccactaactcacccctgcagcggatacggctctctgatggctccttaaagctctaccccttccagtgtttcctagcccatgaccaggctgtgcgtacccttcaatggtgcaaagctaacagccatttccttgtctctgcggggagtgaccggaaaatcaaattctgggaccttcgacgtccttacgaacccataaactctatcaagcgcttcttgagtacagaactggcctggctgcttccctacaatggtgtcactgtggctcaggacaactgctatgcctcttatggactctgtgggattcattatattgacgctggttaccttggtttcaaggcctacttcactgctcctcgaaaaggcaccgtttggagtctttcaggatccgactggcttgggacaatagctgcaggagatatatccggggagctcattgctgctatattaccagatatggcactgaatccaataaatgtcaagcgacctgtagagcgaagatttgtacgtatacgaacatctaacagcagctgttggatcctaacccacatgccctcccaaattctggtagagtacaaactagtgtcaggtctcccggccctgatatcccagaaaatcttagcacagagttgtatataatcttccctaccgtactgcatctgagcatatatttaaagatactacttttttccatctttaagcctttcctgcccaaaccactttcctctgcttttattctgtcttgagtattatagaacctaatttcatggtctcctttccagcctatatataaagcagatctgataccgtatcaggacagtcctgaaggtccagaccattcttctgcttcatctggggtccccaaccctcccaaggctcgaacttacactgaaactgtcaaccatcactacttgctctttcaagacacagatttgggttcattccatgatctgctccgtagagaaccaatgctgcgcatgcaggagggagaggggcattctcaactctgcctggacaggctgcagctggaggctattcataaggtacgtttcagcccaaacctggactcctatggatggctggtatctggggggcagtcagggctggttcgaatccattttgtccgtggactcgcctccccactgggccaccgtatgcagcttgaaagccgagcccacttcaatgctatgttccaaccatcctcccccactagacggcctggcttctctccaaccagccatcgccttctgcccactccctagccttggcccacaccagatccttggagtgaagtcggtcaagaacaaatggcccctatgcacagagccataggaactgggggccttccctggacagtgatcatgccaggcctggacctttaggcctgcctccccaggactccttagatcccactctttctacagacttctgtgatcacagccccctgcgggcaggggggctctccctccaccaactctcaaggctcctcagcctaagactatggctcatgagaaacactcaggcctgacctaggcttgggagtcaaactgctcatattgagcatattgttaagtgggtaaagccaagtaaaggtactgggtgtttttgtgaccacttgtgaatgggtgtatggagaactgaaaagggtatctgcatgaaggctcctgtctgactattccaggatccaatattactgccttctgaaacttcctctttagggtaaccatcatgtatgcccacgagggtgatagtaattcgtgagactgaagttgcttagagtacttctttgaccaaggaataccacagacaccctaccgatagaacagtggctcagatcttacttgctcctgcttacgaagtattcccaatcactggtcatctgaccctacttgaacactcctgaacagtcatgttttttaaaatcttcctttatatcaagtcagagagtatacttctataaatttcactcatggatgttaggaaatctagtcatcttccctgtgattgccctgttaagtatttaaccatagctatcatgtgtttcccaaatcttctctagattaaatatcttcagttacttcaaccattcttttacacgtcatgatttttgatccttcatgatactgtcacattgttgactcattagaatgtttacctacttcagttctatgtataggaggtgtttagaacccaagtactgtaatgtattgttatatctcatcttgttagagtcctcttgtgggatgctgcagactcacagtgactatgatactgcctcctaagcaaggacacaccccagtgatgagaaataggcaaaccatggtc

SEQ ID NO: 25275 - DNA, 5067 bp, Homo sapiens
atggaataatggccaaactcagtgacttacacctgtgatcgcagcactatgggaggctgaggcaagaggatcacttcaggtcaggtgttcaagaccagcctggtcaacataacgagaccccatctctagaaaaaattaaaaaattaggccgggcacggtggctcatgcctgtaatcccagcactttgggaggctgaggcaggcgtatcacaaggtcaggagttcgagaccagcctggccaacatagtgaaaccccttctctactaaaaagacaaaaattatccgggcttgctggcgggcgcctgtaatctcagctactcgggaggctgaggcaggacaattgcttgaacccgggaggcggagtttgcagtgagccgagatcgcgccactgcactccagcctggggacagagcaagactccatctcaggaaaaaataaaaataaaaataaaaacggggtctcactatgttgcccaggctggtatcgaattcctgggctcaagtgatcctcccccgccttggcctcccaaagtgctgggatcacagacaggagccaccatacccagccaaagtcatgcttttctactcctactccttcccttccttgtcctctttccaagctctctcgggcccatccctgacttcactactggcagaatcctccagcggccggcggcgaggacttctttgtctcccagactccgccttgggctcggacgccgccagggttgcaggtacagactctctggtctagctggctcttccggccacaggcgcggcagtccggccggaaaggccggattcagggatccagagcgcgagcccggcctgggagtccgcctactcccggctcccgtcgaggccgcgtgggatcccgttggccgcgcaggcgtcgatctcccctttttgacactgcaactcccatgaggccctgcagcgtccctggcgccgctgaagacgccctggaactcggctggcttcggagggctcggtgactctggccgcgctgcattatggaatacagagtctaagagaaaactagcccggcaccgactccggaccaagcacacgtgtttaccttgtgcactggggtgggggcgtcagtgaagagcagctaacaagatttcgtcataagaccgcgaccagacaggcggcgccatcttcgaacttagacttccggaaggactttggcgaggggcagccattttggggggtgctgatggatacctgcggggtcggctatgttgccctgggggaggccggccccgtggggaacatgactgtggtagactctcctggacaagaggtgctaaatcagcttgatgtcaagacctcttcagaaatgaccagtgcagaggcttccgtagagatgtcattacctacccctttgcctggatttgaggattctcctgatcagaggaggctccctccagagcaggaaagcctctccagactggaacagccagatctttcttcagagatgtcaaaggtctcaaagcctagggcctcaaagcctggccggaagagaggtggtaggacacgaaaaggccccaaaaggccccaacagcctaatcctccatcagccccactggttcctggtctcttagatcaatccaaccctctgtccacccccatgcctaagaaacgaggtcgaaagtccaaggcagagctgctgctgctgaagttgtcaaaagacctagatcggccagaatctcaatctccaaagaggccccctgaggactttgagaccccttctggggaacgaccccgccgaagggctgcccaagtggcacttctgtatcttcaggaactggctgaagagctctcaacagccctgcctgcccctgtgtcctgtcctgagggccccaaggtgagcagccccaccaaaccgaagaagatccggcagccagcagcctgtccaggtggagaagaggtggatggtgctccacgggatgaagacttttttctccaggttgaggctgaagatgtggaagaaagtgagggcccaagtgagagctcatctgaacctgagcctgtagtgccccgaagcaccccacgaggatctacttcagggaaacagaaaccacactgccgaggaatggctcccaatggcttaccaaatcatatcatggctcctgtttggaagtgcctccatctcaccaaggacttccgagagcagaaacattcatactgggagtttgctgagtggattcctttagcctggaagtggcacttgttatctgagcttgaggccgctccctacctgccccaggaggagaagtctccattgttttctgtacaacgtgaagggctacctgaagatggcaccctctaccgaataaacagatttagctcgatcacagcacatccagagcgctgggatgtgtccttcttcacggggggaccgctctgggctctggactggtgcccagtgccagagggggcaggagcctcgcaatatgtggctcttttctccagccctgacatgaatgagacacacccactgagccagcttcattcgggtcctgggctgctccagctctggggccttgggaccttgcagcaagaaagctgtcctggcaacagggcccactttgtctatgggattgcttgtgacaacggctgcatctgggacctcaagttctgccccagtggagcatgggaacttccaggcacccctcggaaggctcctctcctgccccggttgggtctcttggctctggcctgctcagacgggaaagtactgctattcagtctaccccatccggaggccctgctggctcagcaacccccagatgcagtgaagcctgccatatataaggtacaatgtgtggcaactctgcaggtggggtctatgcaagctacagacccctctgagtgtggtcagtgccttagcctggcctggatgcctaccaggccccaccaacacctagctgctggatattataatggcatggtggttttctggaaccttcccactaactcacccctgcagcggatacggctctctgatggctccttaaagctctaccccttccagtgtttcctagcccatgaccaggctgtgcgtacccttcaatggtgcaaagctaacagccatttccttgtctctgcggggagtgaccggaaaatcaaattctgggaccttcgacgtccttacgaacccataaactctatcaagcgcttcttgagtacagaactggcctggctgcttccctacaatggtgtcactgtggctcaggacaactgctatgcctcttatggactctgtgggattcattatattgacgctggttaccttggtttcaaggcctacttcactgctcctcgaaaaggcaccgtttggcggtgccttttcgaggagcagtgaagtaggccttgaaacggcaccgtttggagtctttcaggatccgactggcttgggacaatagctgcaggagatatatccggggagctcattgctgctatattaccagatatggcactgaatccaataaatgtcaagcgacctgtagagcgaagatttcctatatataaagcagatctgataccgtatcaggacagtcctgaaggtccagaccattcttctgcttcatctggggtccccaaccctcccaaggctcgaacttacactgaaactgtcaaccatcactacttgctctttcaagacacagatttgggttcattccatgatctgctccgtagagaaccaatgctgcgcatgcaggagggagaggggcattctcaactctgcctggacaggctgcagctggaggctattcataaggtacgtttcagcccaaacctggactcctatggatggctggtatctggggggcagtcagggctggttcgaatccattttgtccgtggactcgcctccccactgggccaccgtatgcagcttgaaagccgagcccacttcaatgctatgttccaaccatcctcccccactagacggcctggcttctctccaaccagccatcgccttctgcccactccctagccttggcccacaccagatccttggagtgaagtcggtcaagaacaaatggcccctatgcacagagccataggaactgggggccttccctggacagtgatcatgccaggcctggacctttaggcctgcctccccaggactccttagatcccactctttctacagacttctgtgatcacagccccctgcgggcaggggggctctccctccaccaactctcaaggctcctcagcctaagactatggctcatgagaaacactcaggcctgacctaggcttgggagtcaaactgctcatattgagcatattgttaagtgggtaaagccaagtaaaggtactgggtgtttttgtgaccacttgtgaatgggtgtatggagaactgaaaagggtatctgcatgaaggctcctgtctgactattccaggatccaatattactgccttctgaaacttcctctttagggtaaccatcatgtatgcccacgagggtgatagtaattcgtgagactgaagttgcttagagtacttctttgaccaaggaataccacagacaccctaccgatagaacagtggctcagatcttacttgctcctgcttacgaagtattcccaatcactggtcatctgaccctacttgaacactcctgaacagtcatgttttttaaaatcttcctttatatcaagtcagagagtatacttctataaatttcactcatggatgttaggaaatctagtcatcttccctgtgattgccctgttaagtatttaaccatagctatcatgtgtttcccaaatcttctctagattaaatatcttcagttacttcaaccattcttttacacgtcatgatttttgatccttcatgatactgtcacattgttgactcattagaatgtttacctacttcagttctatgtataggaggtgtttagaacccaagtactgtaatgtattgttatatctcatcttgttagagtcctcttgtgggatgctgcagactcacagtgactatgatactgcctcctaagcaaggacacaccccagtgatgagaaataggcaaaccatggtc

SEQ ID NO: 25276 - DNA, 4302 bp, Homo sapiens
atggaataatggccaaactcagtgacttacacctgtgatcgcagcactatgggaggctgaggcaagaggatcacttcaggtcaggtgttcaagaccagcctggtcaacataacgagaccccatctctagaaaaaattaaaaaattaggccgggcacggtggctcatgcctgtaatcccagcactttgggaggctgaggcaggcgtatcacaaggtcaggagttcgagaccagcctggccaacatagtgaaaccccttctctactaaaaagacaaaaattatccgggcttgctggcgggcgcctgtaatctcagctactcgggaggctgaggcaggacaattgcttgaacccgggaggcggagtttgcagtgagccgagatcgcgccactgcactccagcctggggacagagcaagactccatctcaggaaaaaataaaaataaaaataaaaacggggtctcactatgttgcccaggctggtatcgaattcctgggctcaagtgatcctcccccgccttggcctcccaaagtgctgggatcacagacaggagccaccatacccagccaaagtcatgcttttctactcctactccttcccttccttgtcctctttccaagctctctcgggcccatccctgacttcactactggcagaatcctccagcggccggcggcgaggacttctttgtctcccagactccgccttgggctcggacgccgccagggttgcaggtacagactctctggtctagctggctcttccggccacaggcgcggcagtccggccggaaaggccggattcagggatccagagcgcgagcccggcctgggagtccgcctactcccggctcccgtcgaggccgcgtgggatcccgttggccgcgcaggcgtcgatctcccctttttgacactgcaactcccatgaggccctgcagcgtccctggcgccgctgaagacgccctggaactcggctggcttcggagggctcggtgactctggccgcgctgcattatggaatacagagtctaagagaaaactagcccggcaccgactccggaccaagcacacgtgtttaccttgtgcactggggtgggggcgtcagtgaagagcagctaacaagatttcgtcataagaccgcgaccagacaggcggcgccatcttcgaacttagacttccggaaggactttggcgaggggcagccattttggggggtgctgatggatacctgcggggtcggctatgttgccctgggggaggccggccccgtggggaacatgactgtggtagactctcctggacaagaggtgctaaatcagcttgatgtcaagacctcttcagaaatgaccagtgcagaggcttccgtagagatgtcattacctacccctttgcctggatttgaggattctcctgatcagaggaggctccctccagagcaggaaagcctctccagactggaacagccagatctttcttcagagatgtcaaaggtctcaaagcctagggcctcaaagcctggccggaagagaggtggtaggacacgaaaaggccccaaaaggccccaacagcctaatcctccatcagccccactggttcctggtctcttagatcaatccaaccctctgtccacccccatgcctaagaaacgaggtcgaaagtccaaggcagagctgctgctgctgaagttgtcaaaagacctagatcggccagaatctcaatctccaaagaggccccctgaggactttgagaccccttctggggaacgaccccgccgaagggctgcccaagtggcacttctgtatcttcaggaactggctgaagagctctcaacagccctgcctgcccctgtgtcctgtcctgagggccccaaggtgagcagccccaccaaaccgaagaagatccggcagccagcagcctgtccaggtggagaagaggtggatggtgctccacgggatgaagacttttttctccaggttgaggctgaagatgtggaagaaagtgagggcccaagtgagagctcatctgaacctgagcctgtagtgccccgaagcaccccacgaggatctacttcagggaaacagaaaccacactgccgaggaatggctcccaatggcttaccaaatcatatcatggctcctgtttggaagtgcctccatctcaccaaggacttccgagagcagaaacattcatactgggagtttgctgagtggattcctttagcctggaagtggcacttgttatctgagcttgaggccgctccctacctgccccaggaggagaagtctccattgttttctgtacaacgtgaagggctacctgaagatggcaccctctaccgaataaacagatttagctcgatcacagcacatccagagcgctgggatgtgtccttcttcacggggggaccgctctgggctctggactggtgcccagtgccagagggggcaggagcctcgcaatatgtggctcttttctccagccctgacatgaatgagacacacccactgagccagcttcattcgggtcctgggctgctccagctctggggccttgggaccttgcagcaagaaagctgtcctggcaacagggcccactttgtctatgggattgcttgtgacaacggctgcatctgggacctcaagttctgccccagtggagcatgggaacttccaggcacccctcggaaggctcctctcctgccccggttgggtctcttggctctggcctgctcagacgggaaagtactgctattcagtctaccccatccggaggccctgctggctcagcaacccccagatgcagtgaagcctgccatatataaggtacaatgtgtggcaactctgcaggtggggtctatgcaagctacagacccctctgagtgtggtcagtgccttagcctggcctggatgcctaccaggccccaccaacacctagctgctggatattataatggcatggtggttttctggaaccttcccactaactcacccctgcagcggatacggctctctgatggctccttaaagctctaccccttccagtgtttcctagcccatgaccaggctgtgcgtacccttcaatggtgcaaagctaacagccatttccttgtctctgcggggagtgaccggaaaatcaaattctgggaccttcgacgtccttacgaacccataaactctatcaagcgcttcttgagtacagaactggcctggctgcttccctacaatggtgtcactgtggctcaggacaactgctatgcctcttatggactctgtgggattcattatattgacgctggttaccttggtttcaaggcctacttcactgctcctcgaaaaggcaccgtttggagtctttcaggatccgactggcttgggacaatagctgcaggagatatatccggggagctcattgctgctatattaccagatatggcactgaatccaataaatgtcaagcgacctgtagagcgaagatttcctatatataaagcagatctgataccgtatcaggacagtcctgaaggtccagaccattcttctgcttcatctggggtccccaaccctcccaaggctcgaacttacactgaaactgtcaaccatcactacttgctctttcaagacacagatttgggttcattccatgatctgctccgtagagaaccaatgctgcgcatgcaggagggagaggggcattctcaactctgcctggacaggctgcagctggaggctattcataaggtacgtttcagcccaaacctggactcctatggatggctggtatctggggggcagtcagggctggttcgaatccattttgtccgtggactcgcctccccactgggccaccgtatgcagcttgaaagccgagcccacttcaatgctatgttccaaccatcctcccccactagacggcctggcttctctccaaccagccatcgccttctgcccactccctagccttggcccacaccagatccttggagtgaagtcggtcaagaacaaatggcccctatgcacagagccataggaactgggggccttccctggacagtgatcatgccaggcctggacctttaggcctgcctccccaggactccttagatcccactctttctacagacttctgtgatcacagccccctgcgggcaggggggctctccctccaccaactctcaaggctcctcagcctaagactatggctcatgagaaacactcaggcctgacctaggcttgggagtcaaactgctcatattgagcatattgttaagtgggtaaagccaagtaaaggtactgggtgtttttgtga

SEQ ID NO: 25277 - DNA, 4341 bp, Homo sapiens
atggaataatggccaaactcagtgacttacacctgtgatcgcagcactatgggaggctgaggcaagaggatcacttcaggtcaggtgttcaagaccagcctggtcaacataacgagaccccatctctagaaaaaattaaaaaattaggccgggcacggtggctcatgcctgtaatcccagcactttgggaggctgaggcaggcgtatcacaaggtcaggagttcgagaccagcctggccaacatagtgaaaccccttctctactaaaaagacaaaaattatccgggcttgctggcgggcgcctgtaatctcagctactcgggaggctgaggcaggacaattgcttgaacccgggaggcggagtttgcagtgagccgagatcgcgccactgcactccagcctggggacagagcaagactccatctcaggaaaaaataaaaataaaaataaaaacggggtctcactatgttgcccaggctggtatcgaattcctgggctcaagtgatcctcccccgccttggcctcccaaagtgctgggatcacagacaggagccaccatacccagccaaagtcatgcttttctactcctactccttcccttccttgtcctctttccaagctctctcgggcccatccctgacttcactactggcagaatcctccagcggccggcggcgaggacttctttgtctcccagactccgccttgggctcggacgccgccagggttgcaggtacagactctctggtctagctggctcttccggccacaggcgcggcagtccggccggaaaggccggattcagggatccagagcgcgagcccggcctgggagtccgcctactcccggctcccgtcgaggccgcgtgggatcccgttggccgcgcaggcgtcgatctcccctttttgacactgcaactcccatgaggccctgcagcgtccctggcgccgctgaagacgccctggaactcggctggcttcggagggctcggtgactctggccgcgctgcattatggaatacagagtctaagagaaaactagcccggcaccgactccggaccaagcacacgtgtttaccttgtgcactggggtgggggcgtcagtgaagagcagctaacaagatttcgtcataagaccgcgaccagacaggcggcgccatcttcgaacttagacttccggaaggactttggcgaggggcagccattttggggggtgctgatggatacctgcggggtcggctatgttgccctgggggaggccggccccgtggggaacatgactgtggtagactctcctggacaagaggtgctaaatcagcttgatgtcaagacctcttcagaaatgaccagtgcagaggcttccgtagagatgtcattacctacccctttgcctggatttgaggattctcctgatcagaggaggctccctccagagcaggaaagcctctccagactggaacagccagatctttcttcagagatgtcaaaggtctcaaagcctagggcctcaaagcctggccggaagagaggtggtaggacacgaaaaggccccaaaaggccccaacagcctaatcctccatcagccccactggttcctggtctcttagatcaatccaaccctctgtccacccccatgcctaagaaacgaggtcgaaagtccaaggcagagctgctgctgctgaagttgtcaaaagacctagatcggccagaatctcaatctccaaagaggccccctgaggactttgagaccccttctggggaacgaccccgccgaagggctgcccaagtggcacttctgtatcttcaggaactggctgaagagctctcaacagccctgcctgcccctgtgtcctgtcctgagggccccaaggtgagcagccccaccaaaccgaagaagatccggcagccagcagcctgtccaggtggagaagaggtggatggtgctccacgggatgaagacttttttctccaggttgaggctgaagatgtggaagaaagtgagggcccaagtgagagctcatctgaacctgagcctgtagtgccccgaagcaccccacgaggatctacttcagggaaacagaaaccacactgccgaggaatggctcccaatggcttaccaaatcatatcatggctcctgtttggaagtgcctccatctcaccaaggacttccgagagcagaaacattcatactgggagtttgctgagtggattcctttagcctggaagtggcacttgttatctgagcttgaggccgctccctacctgccccaggaggagaagtctccattgttttctgtacaacgtgaagggctacctgaagatggcaccctctaccgaataaacagatttagctcgatcacagcacatccagagcgctgggatgtgtccttcttcacggggggaccgctctgggctctggactggtgcccagtgccagagggggcaggagcctcgcaatatgtggctcttttctccagccctgacatgaatgagacacacccactgagccagcttcattcgggtcctgggctgctccagctctggggccttgggaccttgcagcaagaaagctgtcctggcaacagggcccactttgtctatgggattgcttgtgacaacggctgcatctgggacctcaagttctgccccagtggagcatgggaacttccaggcacccctcggaaggctcctctcctgccccggttgggtctcttggctctggcctgctcagacgggaaagtactgctattcagtctaccccatccggaggccctgctggctcagcaacccccagatgcagtgaagcctgccatatataaggtacaatgtgtggcaactctgcaggtggggtctatgcaagctacagacccctctgagtgtggtcagtgccttagcctggcctggatgcctaccaggccccaccaacacctagctgctggatattataatggcatggtggttttctggaaccttcccactaactcacccctgcagcggatacggctctctgatggctccttaaagctctaccccttccagtgtttcctagcccatgaccaggctgtgcgtacccttcaatggtgcaaagctaacagccatttccttgtctctgcggggagtgaccggaaaatcaaattctgggaccttcgacgtccttacgaacccataaactctatcaagcgcttcttgagtacagaactggcctggctgcttccctacaatggtgtcactgtggctcaggacaactgctatgcctcttatggactctgtgggattcattatattgacgctggttaccttggtttcaaggcctacttcactgctcctcgaaaaggcaccgtttggagtctttcaggatccgactggcttgggacaatagctgcaggagatatatccggggagctcattgctgctatattaccagatatggcactgaatccaataaatgtcaagcgacctgtagagcgaagatttcctatatataaagcagatctgataccgtatcaggacagtcctgaaggtccagaccattcttctgcttcatctggggtccccaaccctcccaaggctcgaacttacactgaaactgtcaaccatcactacttgctctttcaagacacagatttgggttcattccatgatctgctccgtagagaaccaatgctgcgcatgcaggagggagaggggcattctcaactctgcctggacaggctgcagctggaggctattcataagggtaaccatcatgtatgcccacgagggtgatagtaattcgtgagactgaagttgcttagagtacttctttgaccaaggaataccacagacaccctaccgatagaacagtggctcagatcttacttgctcctgcttacgaagtattcccaatcactggtcatctgaccctacttgaacactcctgaacagtcatgttttttaaaatcttcctttatatcaagtcagagagtatacttctataaatttcactcatggatgttaggaaatctagtcatcttccctgtgattgccctgttaagtatttaaccatagctatcatgtgtttcccaaatcttctctagattaaatatcttcagttacttcaaccattcttttacacgtcatgatttttgatccttcatgatactgtcacattgttgactcattagaatgtttacctacttcagttctatgtataggaggtgtttagaacccaagtactgtaatgtattgttatatctcatcttgttagagtcctcttgtgggatgctgcagactcacagtgactatgatactgcctcctaagcaaggacacaccccagtgatgagaaataggcaaaccatggtc

SEQ ID NO: 25278 - DNA, 3364 bp, Homo sapiens
atggaataatggccaaactcagtgacttacacctgtgatcgcagcactatgggaggctgaggcaagaggatcacttcaggtcaggtgttcaagaccagcctggtcaacataacgagaccccatctctagaaaaaattaaaaaattaggccgggcacggtggctcatgcctgtaatcccagcactttgggaggctgaggcaggcgtatcacaaggtcaggagttcgagaccagcctggccaacatagtgaaaccccttctctactaaaaagacaaaaattatccgggcttgctggcgggcgcctgtaatctcagctactcgggaggctgaggcaggacaattgcttgaacccgggaggcggagtttgcagtgagccgagatcgcgccactgcactccagcctggggacagagcaagactccatctcaggaaaaaataaaaataaaaataaaaacggggtctcactatgttgcccaggctggtatcgaattcctgggctcaagtgatcctcccccgccttggcctcccaaagtgctgggatcacagacaggagccaccatacccagccaaagtcatgcttttctactcctactccttcccttccttgtcctctttccaagctctctcgggcccatccctgacttcactactggcagaatcctccagcggccggcggcgaggacttctttgtctcccagactccgccttgggctcggacgccgccagggttgcaggtacagactctctggtctagctggctcttccggccacaggcgcggcagtccggccggaaaggccggattcagggatccagagcgcgagcccggcctgggagtccgcctactcccggctcccgtcgaggccgcgtgggatcccgttggccgcgcaggcgtcgatctcccctttttgacactgcaactcccatgaggccctgcagcgtccctggcgccgctgaagacgccctggaactcggctggcttcggagggctcggtgactctggccgcgctgcattatggaatacagagtctaagagaaaactagcccggcaccgactccggaccaagcacacgtgtttaccttgtgcactggggtgggggcgtcagtgaagagcagctaacaagatttcgtcataagaccgcgaccagacaggcggcgccatcttcgaacttagacttccggaaggactttggcgaggggcagccattttggggggtgctgatggatacctgcggggtcggctatgttgccctgggggaggccggccccgtggggaacatgactgtggtagactctcctggacaagaggtgctaaatcagcttgatgtcaagacctcttcagaaatgaccagtgcagaggcttccgtagagatgtcattacctacccctttgcctggatttgaggattctcctgatcagaggaggctccctccagagcaggaaagcctctccagactggaacagccagatctttcttcagagatgtcaaaggtctcaaagcctagggcctcaaagcctggccggaagagaggtggtaggacacgaaaaggccccaaaaggccccaacagcctaatcctccatcagccccactggttcctggtctcttagatcaatccaaccctctgtccacccccatgcctaagaaacgaggtcgaaagtccaaggcagagctgctgctgctgaagttgtcaaaagacctagatcggccagaatctcaatctccaaagaggccccctgaggactttgagaccccttctggggaacgaccccgccgaagggctgcccaagtggcacttctgtatcttcaggaactggctgaagagctctcaacagccctgcctgcccctgtgtcctgtcctgagggccccaaggtgagcagccccaccaaaccgaagaagatccggcagccagcagcctgtccaggtggagaagaggtggatggtgctccacgggatgaagacttttttctccaggttgaggctgaagatgtggaagaaagtgagggcccaagtgagagctcatctgaacctgagcctgtagtgccccgaagcaccccacgaggatctacttcagggaaacagaaaccacactgccgaggaatggctcccaatggcttaccaaatcatatcatggctcctgtttggaagtgcctccatctcaccaaggacttccgagagcagaaacattcatactgggagtttgctgagtggattcctttagcctggaagtggcacttgttatctgagcttgaggccgctccctacctgccccaggaggagaagtctccattgttttctgtacaacgtgaagggctacctgaagatggcaccctctaccgaataaacagatttagctcgatcacagcacatccagagcgctgggatgtgtccttcttcacggggggaccgctctgggctctggactggtgcccagtgccagagggggcaggagcctcgcaatatgtggctcttttctccagccctgacatgaatgagacacacccactgagccagcttcattcgggtcctgggctgctccagctctggggccttgggaccttgcagcaagaaagctgtcctggcaacagggcccactttgtctatgggattgcttgtgacaacggctgcatctgggacctcaagttctgccccagtggagcatgggaacttccaggcacccctcggaaggctcctctcctgccccggttgggtctcttggctctggcctgctcagacgggaaagtactgctattcagtctaccccatccggaggccctgctggctcagcaacccccagatgcagtgaagcctgccatatataaggtacaatgtgtggcaactctgcaggtggggtctatgcaagctacagacccctctgagtgtggtcagtgccttagcctggcctggatgcctaccaggccccaccaacacctagctgctggatattataatggcatggtggttttctggaaccttcccactaactcacccctgcagcggatacggctctctgatggctccttaaagctctaccccttccagtgtttcctagcccatgaccaggctgtgcgtacccttcaatggtgcaaagctaacagccatttccttgtctctgcggggagtgaccggcgcttcttgagtacagaactggcctggctgcttccctacaatggtgtcactgtggctcaggacaactgctatgcctcttatggactctgtgggattcattatattgacgctggttaccttggtttcaaggcctacttcactgctcctcgaaaaggcaccgtttggggcaccggttggagtttttcagatccgctggcttggacaatgcttgcagtaatatacgcgaactattgtgtttc

SEQ ID NO: 25279 - DNA, 1641 bp, Homo sapiens
atggaataatggccaaactcagtgacttacacctgtgatcgcagcactatgggaggctgaggcaagaggatcacttcaggtcaggtgttcaagaccagcctggtcaacataacgagaccccatctctagaaaaaattaaaaaattaggccgggcacggtggctcatgcctgtaatcccagcactttgggaggctgaggcaggcgtatcacaaggtcaggagttcgagaccagcctggccaacatagtgaaaccccttctctactaaaaagacaaaaattatccgggcttgctggcgggcgcctgtaatctcagctactcgggaggctgaggcaggacaattgcttgaacccgggaggcggagtttgcagtgagccgagatcgcgccactgcactccagcctggggacagagcaagactccatctcaggaaaaaataaaaataaaaataaaaacggggtctcactatgttgcccaggctggtatcgaattcctgggctcaagtgatcctcccccgccttggcctcccaaagtgctgggatcacagacaggagccaccatacccagccaaagtcatgcttttctactcctactccttcccttccttgtcctctttccaagctctctcgggcccatccctgacttcactactggcagaatcctccagcggccggcggcgaggacttctttgtctcccagactccgccttgggctcggacgccgccagggttgcaggtacagactctctggtctagctggctcttccggccacaggcgcggcagtccggccggaaaggccggattcagggatccagagcgcgagcccggcctgggagtccgcctactcccggctcccgtcgaggccgcgtgggatcccgttggccgcgcaggcgtcgatctcccctttttgacactgcaactcccatgaggccctgcagcgtccctggcgccgctgaagacgccctggaactcggctggcttcggagggctcggtgactctggccgcgctgcattatggaatacagagtctaagagaaaactagcccggcaccgactccggaccaagcacacgtgtttaccttgtgcactggggtgggggcgtcagtgaagagcagctaacaagatttcgtcataagaccgcgaccagacaggcggcgccatcttcgaacttagacttccggaaggactttggcgagggtgagtgtatcgccgcagcgggtgtgtggggggccccacaattactcctcccccttcttttgccatagcactaagatattgggaacaaactcctggctccgctcttctcccagccacagcagcgcgcctttcagcgtctgcgctcctacagagcaccatcatgctccgcaccttccctactgtggccaccgtgcaccccccatctctgcaagcctcgggtcttgccctcctcccccacgcggtgtcggtaacgcggaagcctgtgtccgggcgtaggcgctgcatacgtagcgtccctcgaactcggcgaacctacagtagtccttgttagaaaaccagggctcctctcccgcacaggctaggggagaaatctaccttcacgcccaggactgaagaagggcaggtgatggcccctagagtggttgtgggtcaatctctttcagctgt

SEQ ID NO: 25280 - DNA, 166 bp, Homo sapiens
actgtggctcaggacaactgctatgcctcgtacggcaagatggagataggacctctagggacaggccctaagggttggaatgcaaagcatgccagattgttgtggggagaggagggtagagagttggttcactgaggtggtttaaattctggaagaggttaagaag

SEQ ID NO: 25281 - DNA, 3083 bp, Homo sapiens
atggaataatggccaaactcagtgacttacacctgtgatcgcagcactatgggaggctgaggcaagaggatcacttcaggtcaggtgttcaagaccagcctggtcaacataacgagaccccatctctagaaaaaattaaaaaattaggccgggcacggtggctcatgcctgtaatcccagcactttgggaggctgaggcaggcgtatcacaaggtcaggagttcgagaccagcctggccaacatagtgaaaccccttctctactaaaaagacaaaaattatccgggcttgctggcgggcgcctgtaatctcagctactcgggaggctgaggcaggacaattgcttgaacccgggaggcggagtttgcagtgagccgagatcgcgccactgcactccagcctggggacagagcaagactccatctcaggaaaaaataaaaataaaaataaaaacggggtctcactatgttgcccaggctggtatcgaattcctgggctcaagtgatcctcccccgccttggcctcccaaagtgctgggatcacagacaggagccaccatacccagccaaagtcatgcttttctactcctactccttcccttccttgtcctctttccaagctctctcgggcccatccctgacttcactactggcagaatcctccagcggccggcggcgaggacttctttgtctcccagactccgccttgggctcggacgccgccagggttgcaggtacagactctctggtctagctggctcttccggccacaggcgcggcagtccggccggaaaggccggattcagggatccagagcgcgagcccggcctgggagtccgcctactcccggctcccgtcgaggccgcgtgggatcccgttggccgcgcaggcgtcgatctcccctttttgacactgcaactcccatgaggccctgcagcgtccctggcgccgctgaagacgccctggaactcggctggcttcggagggctcggtgactctggccgcgctgcattatggaatacagagtctaagagaaaactagcccggcaccgactccggaccaagcacacgtgtttaccttgtgcactggggtgggggcgtcagtgaagagcagctaacaagatttcgtcataagaccgcgaccagacaggcggcgccatcttcgaacttagacttccggaaggactttggcgaggttcagcttgagtgtgcgtcagaatcccctgaagagcttgttaaaacacaaggtgctggccccatccagaattgctgattcggggcagccattttggggggtgctgatggatacctgcggggtcggctatgttgccctgggggaggccggccccgtggggaacatgactgtggtagactctcctggacaagaggtgctaaatcagcttgatgtcaagacctcttcagaaatgaccagtgcagaggcttccgtagagatgtcattacctacccctttgcctggatttgaggattctcctgatcagaggaggctccctccagagcaggaaagcctctccagactggaacagccagatctttcttcagagatgtcaaaggtctcaaagcctagggcctcaaagcctggccggaagagaggtggtaggacacgaaaaggccccaaaaggccccaacagcctaatcctccatcagccccactggttcctggtctcttagatcaatccaaccctctgtccacccccatgcctaagaaacgaggtcgaaagtccaaggcagagctgctgctgctgaagttgtcaaaagacctagatcggccagaatctcaatctccaaagaggccccctgaggactttgagaccccttctggggaacgaccccgccgaagggctgcccaagtggcacttctgtatcttcaggaactggctgaagagctctcaacagccctgcctgcccctgtgtcctgtcctgagggccccaaggtgagcagccccaccaaaccgaagaagatccggcagccagcagcctgtccaggtggagaagaggtggatggtgctccacgggatgaagacttttttctccaggttgaggctgaagatgtggaagaaagtgagggcccaagtgagagctcatctgaacctgagcctgtagtgccccgaagcaccccacgaggatctacttcagggaaacagaaaccacactgccgaggaatggctcccaatggcttaccaaatcatatcatggctcctgtttggaagtgcctccatctcaccaaggacttccgagagcagaaacattcatactgggagtttgctgagtggattcctttagcctggaagtggcacttgttatctgagcttgaggccgctccctacctgccccaggaggagaagtctccattgttttctgtacaacgtgaagggctacctgaagatggcaccctctaccgaataaacagatttagctcgatcacagcacatccagagcgctgggatgtgtccttcttcacggggggaccgctctgggctctggactggtgcccagtgccagagggggcaggagcctcgcaatatgtggctcttttctccagccctgacatgaatgagacacacccactgagccagcttcattcgggtcctgggctgctccagctctggggccttgggaccttgcagcaagaaagctgtcctggcaacagggcccactttgtctatgggattgcttgtgacaacggctgcatctgggacctcaagttctgccccagtggagcatgggaacttccaggcacccctcggaaggctcctctcctgccccggttgggtctcttggctctggcctgctcagacgggaaagtactgctattcagtctaccccatccggaggccctgctggctcagcaacccccagatgcagtgaagcctgccatatataaggtacaatgtgtggcaactctgcaggtggggtctatgcaagctacagacccctctgagtgtggtcagtgccttagcctggcctggatgcctaccaggccccaccaacacctagctgctggatattataatggtaaaaaaaccaaaataaaacataaggaactattgctctttaaattttttat

SEQ ID NO: 25282 - DNA, 5336 bp, Homo sapiens
atggaataatggccaaactcagtgacttacacctgtgatcgcagcactatgggaggctgaggcaagaggatcacttcaggtcaggtgttcaagaccagcctggtcaacataacgagaccccatctctagaaaaaattaaaaaattaggccgggcacggtggctcatgcctgtaatcccagcactttgggaggctgaggcaggcgtatcacaaggtcaggagttcgagaccagcctggccaacatagtgaaaccccttctctactaaaaagacaaaaattatccgggcttgctggcgggcgcctgtaatctcagctactcgggaggctgaggcaggacaattgcttgaacccgggaggcggagtttgcagtgagccgagatcgcgccactgcactccagcctggggacagagcaagactccatctcaggaaaaaataaaaataaaaataaaaacggggtctcactatgttgcccaggctggtatcgaattcctgggctcaagtgatcctcccccgccttggcctcccaaagtgctgggatcacagacaggagccaccatacccagccaaagtcatgcttttctactcctactccttcccttccttgtcctctttccaagctctctcgggcccatccctgacttcactactggcagaatcctccagcggccggcggcgaggacttctttgtctcccagactccgccttgggctcggacgccgccagggttgcaggtacagactctctggtctagctggctcttccggccacaggcgcggcagtccggccggaaaggccggattcagggatccagagcgcgagcccggcctgggagtccgcctactcccggctcccgtcgaggccgcgtgggatcccgttggccgcgcaggcgtcgatctcccctttttgacactgcaactcccatgaggccctgcagcgtccctggcgccgctgaagacgccctggaactcggctggcttcggagggctcggtgactctggccgcgctgcattatggaatacagagtctaagagaaaactagcccggcaccgactccggaccaagcacacgtgtttaccttgtgcactggggtgggggcgtcagtgaagagcagctaacaagatttcgtcataagaccgcgaccagacaggcggcgccatcttcgaacttagacttccggaaggactttggcgaggagacaaagtcttgctgtgttgcccaggctgatcttgaactcctggcctcaagcgatcctcccaccttggcctcccaaagtgttgagattacaggcatgagccactgcgcccagcccagcacatgattcttgagccagcagctgtaaataagagcaccttcccagtttgataagcacttgttcctaccaactgtttttccctcaaccctcatcgtgatcatttatttatgcaagtgtttttcagcttgagtgtgcgtcagaatcccctgaagagcttgttaaaacacaaggtgctggccccatccagaattgctgattcggggcagccattttggggggtgctgatggatacctgcggggtcggctatgttgccctgggggaggccggccccgtggggaacatgactgtggtagactctcctggacaagaggtgctaaatcagcttgatgtcaagacctcttcagaaatgaccagtgcagaggcttccgtagagatgtcattacctacccctttgcctggatttgaggattctcctgatcagaggaggctccctccagagcaggaaagcctctccagactggaacagccagatctttcttcagagatgtcaaaggtctcaaagcctagggcctcaaagcctggccggaagagaggtggtaggacacgaaaaggccccaaaaggccccaacagcctaatcctccatcagccccactggttcctggtctcttagatcaatccaaccctctgtccacccccatgcctaagaaacgaggtcgaaagtccaaggcagagctgctgctgctgaagttgtcaaaagacctagatcggccagaatctcaatctccaaagaggccccctgaggactttgagaccccttctggggaacgaccccgccgaagggctgcccaagtggcacttctgtatcttcaggaactggctgaagagctctcaacagccctgcctgcccctgtgtcctgtcctgagggccccaaggtgagcagccccaccaaaccgaagaagatccggcagccagcagcctgtccaggtggagaagaggtggatggtgctccacgggatgaagacttttttctccaggttgaggctgaagatgtggaagaaagtgagggcccaagtgagagctcatctgaacctgagcctgtagtgccccgaagcaccccacgaggatctacttcagggaaacagaaaccacactgccgaggaatggctcccaatggcttaccaaatcatatcatggctcctgtttggaagtgcctccatctcaccaaggacttccgagagcagaaacattcatactgggagtttgctgagtggattcctttagcctggaagtggcacttgttatctgagcttgaggccgctccctacctgccccaggaggagaagtctccattgttttctgtacaacgtgaagggctacctgaagatggcaccctctaccgaataaacagatttagctcgatcacagcacatccagagcgctgggatgtgtccttcttcacggggggaccgctctgggctctggactggtgcccagtgccagagggggcaggagcctcgcaatatgtggctcttttctccagccctgacatgaatgagacacacccactgagccagcttcattcgggtcctgggctgctccagctctggggccttgggaccttgcagcaagaaagctgtcctggcaacagggcccactttgtctatgggattgcttgtgacaacggctgcatctgggacctcaagttctgccccagtggagcatgggaacttccaggcacccctcggaaggctcctctcctgccccggttgggtctcttggctctggcctgctcagacgggaaagtactgctattcagtctaccccatccggaggccctgctggctcagcaacccccagatgcagtgaagcctgccatatataaggtacaatgtgtggcaactctgcaggtggggtctatgcaagctacagacccctctgagtgtggtcagtgccttagcctggcctggatgcctaccaggccccaccaacacctagctgctggatattataatggcatggtggttttctggaaccttcccactaactcacccctgcagcggatacggctctctgatggctccttaaagctctaccccttccagtgtttcctagcccatgaccaggctgtgcgtacccttcaatggtgcaaagctaacagccatttccttgtctctgcggggagtgaccggaaaatcaaattctgggaccttcgacgtccttacgaacccataaactctatcaagcgcttcttgagtacagaactggcctggctgcttccctacaatggtgtcactgtggctcaggacaactgctatgcctcttatggactctgtgggattcattatattgacgctggttaccttggtttcaaggcctacttcactgctcctcgaaaaggcaccgtttggagtctttcaggatccgactggcttgggacaatagctgcaggagatatatccggggagctcattgctgctatattaccagatatggcactgaatccaataaatgtcaagcgacctgtagagcgaagatttcctatatataaagcagatctgataccgtatcaggacagtcctgaaggtccagaccattcttctgcttcatctggggtccccaaccctcccaaggctcgaacttacactgaaactgtcaaccatcactacttgctctttcaagacacagatttgggttcattccatgatctgctccgtagagaaccaatgctgcgcatgcaggagggagaggggcattctcaactctgcctggacaggctgcagctggaggctattcataaggtacgtttcagcccaaacctggactcctatggatggctggtatctggggggcagtcagggctggttcgaatccattttgtccgtggactcgcctccccactgggccaccgtatgcagcttgaaagccgagcccacttcaatgctatgttccaaccatcctcccccactagacggcctggcttctctccaaccagccatcgccttctgcccactccctagccttggcccacaccagatccttggagtgaagtcggtcaagaacaaatggcccctatgcacagagccataggaactgggggccttccctggacagtgatcatgccaggcctggacctttaggcctgcctccccaggactccttagatcccactctttctacagacttctgtgatcacagccccctgcgggcaggggggctctccctccaccaactctcaaggctcctcagcctaagactatggctcatgagaaacactcaggcctgacctaggcttgggagtcaaactgctcatattgagcatattgttaagtgggtaaagccaagtaaaggtactgggtgtttttgtgaccacttgtgaatgggtgtatggagaactgaaaagggtatctgcatgaaggctcctgtctgactattccaggatccaatattactgccttctgaaacttcctctttagggtaaccatcatgtatgcccacgagggtgatagtaattcgtgagactgaagttgcttagagtacttctttgaccaaggaataccacagacaccctaccgatagaacagtggctcagatcttacttgctcctgcttacgaagtattcccaatcactggtcatctgaccctacttgaacactcctgaacagtcatgttttttaaaatcttcctttatatcaagtcagagagtatacttctataaatttcactcatggatgttaggaaatctagtcatcttccctgtgattgccctgttaagtatttaaccatagctatcatgtgtttcccaaatcttctctagattaaatatcttcagttacttcaaccattcttttacacgtcatgatttttgatccttcatgatactgtcacattgttgactcattagaatgtttacctacttcagttctatgtataggaggtgtttagaacccaagtactgtaatgtattgttatatctcatcttgttagagtcctcttgtgggatgctgcagactcacagtgactatgatactgcctcctaagcaaggacacaccccagtgatgagaaataggcaaaccatggtc

SEQ ID NO: 25283 - DNA, 5016 bp, Homo sapiens
atggaataatggccaaactcagtgacttacacctgtgatcgcagcactatgggaggctgaggcaagaggatcacttcaggtcaggtgttcaagaccagcctggtcaacataacgagaccccatctctagaaaaaattaaaaaattaggccgggcacggtggctcatgcctgtaatcccagcactttgggaggctgaggcaggcgtatcacaaggtcaggagttcgagaccagcctggccaacatagtgaaaccccttctctactaaaaagacaaaaattatccgggcttgctggcgggcgcctgtaatctcagctactcgggaggctgaggcaggacaattgcttgaacccgggaggcggagtttgcagtgagccgagatcgcgccactgcactccagcctggggacagagcaagactccatctcaggaaaaaataaaaataaaaataaaaacggggtctcactatgttgcccaggctggtatcgaattcctgggctcaagtgatcctcccccgccttggcctcccaaagtgctgggatcacagacaggagccaccatacccagccaaagtcatgcttttctactcctactccttcccttccttgtcctctttccaagctctctcgggcccatccctgacttcactactggcagaatcctccagcggccggcggcgaggacttctttgtctcccagactccgccttgggctcggacgccgccagggttgcaggtacagactctctggtctagctggctcttccggccacaggcgcggcagtccggccggaaaggccggattcagggatccagagcgcgagcccggcctgggagtccgcctactcccggctcccgtcgaggccgcgtgggatcccgttggccgcgcaggcgtcgatctcccctttttgacactgcaactcccatgaggccctgcagcgtccctggcgccgctgaagacgccctggaactcggctggcttcggagggctcggtgactctggccgcgctgcattatggaatacagagtctaagagaaaactagcccggcaccgactccggaccaagcacacgtgtttaccttgtgcactggggtgggggcgtcagtgaagagcagctaacaagatttcgtcataagaccgcgaccagacaggcggcgccatcttcgaacttagacttccggaaggactttggcgaggggcagccattttggggggtgctgatggatacctgcggggtcggctatgttgccctgggggaggccggccccgtggggaacatgactgtggtagactctcctggacaagaggtgctaaatcagcttgatgtcaagacctcttcagaaatgaccagtgcagaggcttccgtagagatgtcattacctacccctttgcctggatttgaggattctcctgatcagaggaggctccctccagagcaggaaagcctctccagactggaacagccagatctttcttcagagatgtcaaaggtctcaaagcctagggcctcaaagcctggccggaagagaggtggtaggacacgaaaaggccccaaaaggccccaacagcctaatcctccatcagccccactggttcctggtctcttagatcaatccaaccctctgtccacccccatgcctaagaaacgaggtcgaaagtccaaggcagagctgctgctgctgaagttgtcaaaagacctagatcggccagaatctcaatctccaaagaggccccctgaggactttgagaccccttctggggaacgaccccgccgaagggctgcccaagtggcacttctgtatcttcaggaactggctgaagagctctcaacagccctgcctgcccctgtgtcctgtcctgagggccccaaggtgagcagccccaccaaaccgaagaagatccggcagccagcagcctgtccaggtggagaagaggtggatggtgctccacgggatgaagacttttttctccaggttgaggctgaagatgtggaagaaagtgagggcccaagtgagagctcatctgaacctgagcctgtagtgccccgaagcaccccacgaggatctacttcagggaaacagaaaccacactgccgaggaatggctcccaatggcttaccaaatcatatcatggctcctgtttggaagtgcctccatctcaccaaggacttccgagagcagaaacattcatactgggagtttgctgagtggattcctttagcctggaagtggcacttgttatctgagcttgaggccgctccctacctgccccaggaggagaagtctccattgttttctgtacaacgtgaagggctacctgaagatggcaccctctaccgaataaacagatttagctcgatcacagcacatccagagcgctgggatgtgtccttcttcacggggggaccgctctgggctctggactggtgcccagtgccagagggggcaggagcctcgcaatatgtggctcttttctccagccctgacatgaatgagacacacccactgagccagcttcattcgggtcctgggctgctccagctctggggccttgggaccttgcagcaagaaagctgtcctggcaacagggcccactttgtctatgggattgcttgtgacaacggctgcatctgggacctcaagttctgccccagtggagcatgggaacttccaggcacccctcggaaggctcctctcctgccccggttgggtctcttggctctggcctgctcagacgggaaagtactgctattcagtctaccccatccggaggccctgctggctcagcaacccccagatgcagtgaagcctgccatatataaggtacaatgtgtggcaactctgcaggtggggtctatgcaagctacagacccctctgagtgtggtcagtgccttagcctggcctggatgcctaccaggccccaccaacacctagctgctggatattataatggcatggtggttttctggaaccttcccactaactcacccctgcagcggatacggctctctgatggctccttaaagctctaccccttccagtgtttcctagcccatgaccaggctgtgcgtacccttcaatggtgcaaagctaacagccatttccttgtctctgcggggagtgaccggaaaatcaaattctgggaccttcgacgtccttacgaacccataaactctatcaagcgcttcttgagtacagaactggcctggctgcttccctacaatggtgtcactgtggctcaggacaactgctatgcctcttatggactctgtgggattcattatattgacgctggttaccttggtttcaaggcctacttcactgctcctcgaaaaggcaccgtttggagtctttcaggatccgactggcttgggacaatagctgcaggagatatatccggggagctcattgctgctatattaccagatatggcactgaatccaataaatgtcaagcgacctgtagagcgaagatttcctatatataaagcagatctgataccgtatcaggacagtcctgaaggtccagaccattcttctgcttcatctggggtccccaaccctcccaaggctcgaacttacactgaaactgtcaaccatcactacttgctctttcaagacacagatttgggttcattccatgatctgctccgtagagaaccaatgctgcgcatgcaggagggagaggggcattctcaactctgcctggacaggctgcagctggaggctattcataaggtacgtttcagcccaaacctggactcctatggatggctggtatctggggggcagtcagggctggttcgaatccattttgtccgtggactcgcctccccactgggccaccgtatgcagcttgaaagccgagcccacttcaatgctatgttccaaccatcctcccccactagacggcctggcttctctccaaccagccatcgccttctgcccactccctagccttggcccacaccagatccttggagtgaagtcggtcaagaacaaatggcccctatgcacagagccataggaactgggggccttccctggacagtgatcatgccaggcctggacctttaggcctgcctccccaggactccttagatcccactctttctacagacttctgtgatcacagccccctgcgggcaggggggctctccctccaccaactctcaaggctcctcagcctaagactatggctcatgagaaacactcaggcctgacctaggcttgggagtcaaactgctcatattgagcatattgttaagtgggtaaagccaagtaaaggtactgggtgtttttgtgaccacttgtgaatgggtgtatggagaactgaaaagggtatctgcatgaaggctcctgtctgactattccaggatccaatattactgccttctgaaacttcctctttagggtaaccatcatgtatgcccacgagggtgatagtaattcgtgagactgaagttgcttagagtacttctttgaccaaggaataccacagacaccctaccgatagaacagtggctcagatcttacttgctcctgcttacgaagtattcccaatcactggtcatctgaccctacttgaacactcctgaacagtcatgttttttaaaatcttcctttatatcaagtcagagagtatacttctataaatttcactcatggatgttaggaaatctagtcatcttccctgtgattgccctgttaagtatttaaccatagctatcatgtgtttcccaaatcttctctagattaaatatcttcagttacttcaaccattcttttacacgtcatgatttttgatccttcatgatactgtcacattgttgactcattagaatgtttacctacttcagttctatgtataggaggtgtttagaacccaagtactgtaatgtattgttatatctcatcttgttagagtcctcttgtgggatgctgcagactcacagtgactatgatactgcctcctaagcaaggacacaccccagtgatgagaaataggcaaaccatggtc

SEQ ID NO: 25284 - DNA, 2212 bp, Homo sapiens
  misc_feature (122)..(122): n is a, c, g, or t
ccagttctgtactcaagaagcgcttgatagagtttatgggttcgtaaggacgtcgaaggtcccagaatttgattttccggtcactccccgcagagacaaggaaatggctgttagctttgcancattgaagggtacgcacagcctggcatggtggttttctggaaccttcccactaactcacccctgcagcggatacggctctctgatggctccttaaagctctaccccttccagtgtttcctagcccatgaccaggctgtgcgtacccttcaatggtgcaaagctaacagccatttccttgtctctgcggggagtgaccggaaaatcaaattctgggaccttcgacgtccttacgaacccataaactctatcaagcgcttcttgagtacagaactggcctggctgcttccctacaatggtgtcactgtggctcaggacaactgctatgcctcttatggactctgtgggattcattatattgacgctggttaccttggtttcaaggcctacttcactgctcctcgaaaaggcaccgtttggagtctttcaggatccgactggcttgggacaatagctgcaggagatatatccggggagctcattgctgctatattaccagatatggcactgaatccaataaatgtcaagcgacctgtagagcgaagatttcctatatataaagcagatctgataccgtatcaggacagtcctgaaggtccagaccattcttctgcttcatctggggtccccaaccctcccaaggctcgaacttacactgaaactgtcaaccatcactacttgctctttcaagacacagatttgggttcattccatgatctgctccgtagagaaccaatgctgcgcatgcaggagggagaggggcattctcaactctgcctggacaggctgcagctggaggctattcataaggtacgtttcagcccaaacctggactcctatggatggctggtatctggggggcagtcagggctggttcgaatccattttgtccgtggactcgcctccccactgggccaccgtatgcagcttgaaagccgagcccacttcaatgctatgttccaaccatcctcccccactagacggcctggcttctctccaaccagccatcgccttctgcccactccctagccttggcccacaccagatccttggagtgaagtcggtcaagaacaaatggcccctatgcacagagccataggaactgggggccttccctggacagtgatcatgccaggcctggacctttaggcctgcctccccaggactccttagatcccactctttctacagacttctgtgatcacagccccctgcgggcaggggggctctccctccaccaactctcaaggctcctcagcctaagactatggctcatgagaaacactcaggcctgacctaggcttgggagtcaaactgctcatattgagcatattgttaagtgggtaaagccaagtaaaggtactgggtgtttttgtgaccacttgtgaatgggtgtatggagaactgaaaagggtatctgcatgaaggctcctgtctgactattccaggatccaatattactgccttctgaaacttcctctttagggtaaccatcatgtatgcccacgagggtgatagtaattcgtgagactgaagttgcttagagtacttctttgaccaaggaataccacagacaccctaccgatagaacagtggctcagatcttacttgctcctgcttacgaagtattcccaatcactggtcatctgaccctacttgaacactcctgaacagtcatgttttttaaaatcttcctttatatcaagtcagagagtatacttctataaatttcactcatggatgttaggaaatctagtcatcttccctgtgattgccctgttaagtatttaaccatagctatcatgtgtttcccaaatcttctctagattaaatatcttcagttacttcaaccattcttttacacgtcatgatttttgatccttcatgatactgtcacattgttgactcattagaatgtttacctacttcagttctatgtataggaggtgtttagaacccaagtactgtaatgtattgttatatctcatcttgttagagtcctcttgtgggatgctgcagactcacagtgactatgatactgcctcctaagcaaggacacaccccagtgatgagaaataggcaaaccatggtc

SEQ ID NO: 25285 - DNA, 5079 bp, Homo sapiens
atggaataatggccaaactcagtgacttacacctgtgatcgcagcactatgggaggctgaggcaagaggatcacttcaggtcaggtgttcaagaccagcctggtcaacataacgagaccccatctctagaaaaaattaaaaaattaggccgggcacggtggctcatgcctgtaatcccagcactttgggaggctgaggcaggcgtatcacaaggtcaggagttcgagaccagcctggccaacatagtgaaaccccttctctactaaaaagacaaaaattatccgggcttgctggcgggcgcctgtaatctcagctactcgggaggctgaggcaggacaattgcttgaacccgggaggcggagtttgcagtgagccgagatcgcgccactgcactccagcctggggacagagcaagactccatctcaggaaaaaataaaaataaaaataaaaacggggtctcactatgttgcccaggctggtatcgaattcctgggctcaagtgatcctcccccgccttggcctcccaaagtgctgggatcacagacaggagccaccatacccagccaaagtcatgcttttctactcctactccttcccttccttgtcctctttccaagctctctcgggcccatccctgacttcactactggcagaatcctccagcggccggcggcgaggacttctttgtctcccagactccgccttgggctcggacgccgccagggttgcaggtacagactctctggtctagctggctcttccggccacaggcgcggcagtccggccggaaaggccggattcagggatccagagcgcgagcccggcctgggagtccgcctactcccggctcccgtcgaggccgcgtgggatcccgttggccgcgcaggcgtcgatctcccctttttgacactgcaactcccatgaggccctgcagcgtccctggcgccgctgaagacgccctggaactcggctggcttcggagggctcggtgactctggccgcgctgcattatggaatacagagtctaagagaaaactagcccggcaccgactccggaccaagcacacgtgtttaccttgtgcactggggtgggggcgtcagtgaagagcagctaacaagatttcgtcataagaccgcgaccagacaggcggcgccatcttcgaacttagacttccggaaggactttggcgaggggcagccattttggggggtgctgatggatacctgcggggtcggctatgttgccctgggggaggccggccccgtggggaacatgactgtggtagactctcctggacaagaggtgctaaatcagcttgatgtcaagacctcttcagaaatgaccagtgcagaggcttccgtagagatgtcattacctacccctttgcctggatttgaggattctcctgatcagaggaggctccctccagagcaggaaagcctctccagactggaacagccagatctttcttcagagatgtcaaaggtctcaaagcctagggcctcaaagcctggccggaagagaggtggtaggacacgaaaaggccccaaaaggccccaacagcctaatcctccatcagccccactggttcctggtctcttagatcaatccaaccctctgtccacccccatgcctaagaaacgaggtcgaaagtccaaggcagagctgctgctgctgaagttgtcaaaagacctagatcggccagaatctcaatctccaaagaggccccctgaggactttgagaccccttctggggaacgaccccgccgaagggctgcccaagtggcacttctgtatcttcaggaactggctgaagagctctcaacagccctgcctgcccctgtgtcctgtcctgagggccccaaggtgagcagccccaccaaaccgaagaagatccggcagccagcagcctgtccaggtggagaagaggtggatggtgctccacgggatgaagacttttttctccaggttgaggctgaagatgtggaagaaagtgagggcccaagtgagagctcatctgaacctgagcctgtagtgccccgaagcaccccacgaggatctacttcagggaaacagaaaccacactgccgaggaatggctcccaatggcttaccaaatcatatcatggctcctgtttggaagtgcctccatctcaccaaggacttccgagagcagaaacattcatactgggagtttgctgagtggattcctttagcctggaagtggcacttgttatctgagcttgaggccgctccctacctgccccaggaggagaagtctccattgttttctgtacaacgtgaagggctacctgaagatggcaccctctaccgaataaacagatttagctcgatcacagcacatccagagcgctgggatgtgtccttcttcacggggggaccgctctgggctctggactggtgcccagtgccagagggggcaggagcctcgcaatatgtggctcttttctccagccctgacatgaatgagacacacccactgagccagcttcattcgggtcctgggctgctccagctctggggccttgggaccttgcagcaagaaagctgtcctggcaacagggcccactttgtctatgggattgcttgtgacaacggctgcatctgggacctcaagttctgccccagtggagcatgggaacttccaggcacccctcggaaggctcctctcctgccccggttgggtctcttggctctggcctgctcagacgggaaagtactgctattcagtctaccccatccggaggccctgctggctcagcaacccccagatgcagtgaagcctgccatatataaggtacaatgtgtggcaactctgcaggtggggtctatgcaagctacagacccctctgagtgtggtcagtgccttagcctggcctggatgcctaccaggccccaccaacacctagctgctggatattataatggcatggtggttttctggaaccttcccactaactcacccctgcagcggatacggctctctgatggctccttaaagctctaccccttccagtgtttcctagcccatgaccaggctgtgcgtacccttcaatggtgcaaagctaacagccatttccttgtctctgcggggagtgaccggaaaatcaaattctgggaccttcgacgtccttacgaacccataaactctatcaagcgcttcttgagtacagaactggcctggctgcttccctacaatggtgtcactgtggctcaggacaactgctatgcctcttatggactctgtgggattcattatattgacgctggttaccttggtttcaaggcctacttcactgctcctcgaaaaggcaccgtttggagtctttcaggatccgactggcttgggacaatagctgcaggagatatatccggggagctcattgctgctatattaccagatatggcactgaatccaataaatgtcaagcgacctgtagagcgaagatttgtacgtatacgaacatctaacagcagctgttggatcctaacccacatgccctcccaaattctgcctatatataaagcagatctgataccgtatcaggacagtcctgaaggtccagaccattcttctgcttcatctggggtccccaaccctcccaaggctcgaacttacactgaaactgtcaaccatcactacttgctctttcaagacacagatttgggttcattccatgatctgctccgtagagaaccaatgctgcgcatgcaggagggagaggggcattctcaactctgcctggacaggctgcagctggaggctattcataaggtacgtttcagcccaaacctggactcctatggatggctggtatctggggggcagtcagggctggttcgaatccattttgtccgtggactcgcctccccactgggccaccgtatgcagcttgaaagccgagcccacttcaatgctatgttccaaccatcctcccccactagacggcctggcttctctccaaccagccatcgccttctgcccactccctagccttggcccacaccagatccttggagtgaagtcggtcaagaacaaatggcccctatgcacagagccataggaactgggggccttccctggacagtgatcatgccaggcctggacctttaggcctgcctccccaggactccttagatcccactctttctacagacttctgtgatcacagccccctgcgggcaggggggctctccctccaccaactctcaaggctcctcagcctaagactatggctcatgagaaacactcaggcctgacctaggcttgggagtcaaactgctcatattgagcatattgttaagtgggtaaagccaagtaaaggtactgggtgtttttgtgaccacttgtgaatgggtgtatggagaactgaaaagggtatctgcatgaaggctcctgtctgactattccaggatccaatattactgccttctgaaacttcctctttagggtaaccatcatgtatgcccacgagggtgatagtaattcgtgagactgaagttgcttagagtacttctttgaccaaggaataccacagacaccctaccgatagaacagtggctcagatcttacttgctcctgcttacgaagtattcccaatcactggtcatctgaccctacttgaacactcctgaacagtcatgttttttaaaatcttcctttatatcaagtcagagagtatacttctataaatttcactcatggatgttaggaaatctagtcatcttccctgtgattgccctgttaagtatttaaccatagctatcatgtgtttcccaaatcttctctagattaaatatcttcagttacttcaaccattcttttacacgtcatgatttttgatccttcatgatactgtcacattgttgactcattagaatgtttacctacttcagttctatgtataggaggtgtttagaacccaagtactgtaatgtattgttatatctcatcttgttagagtcctcttgtgggatgctgcagactcacagtgactatgatactgcctcctaagcaaggacacaccccagtgatgagaaataggcaaaccatggtc

SEQ ID NO: 25286 - DNA, 4777 bp, Homo sapiens
atggaataatggccaaactcagtgacttacacctgtgatcgcagcactatgggaggctgaggcaagaggatcacttcaggtcaggtgttcaagaccagcctggtcaacataacgagaccccatctctagaaaaaattaaaaaattaggccgggcacggtggctcatgcctgtaatcccagcactttgggaggctgaggcaggcgtatcacaaggtcaggagttcgagaccagcctggccaacatagtgaaaccccttctctactaaaaagacaaaaattatccgggcttgctggcgggcgcctgtaatctcagctactcgggaggctgaggcaggacaattgcttgaacccgggaggcggagtttgcagtgagccgagatcgcgccactgcactccagcctggggacagagcaagactccatctcaggaaaaaataaaaataaaaataaaaacggggtctcactatgttgcccaggctggtatcgaattcctgggctcaagtgatcctcccccgccttggcctcccaaagtgctgggatcacagacaggagccaccatacccagccaaagtcatgcttttctactcctactccttcccttccttgtcctctttccaagctctctcgggcccatccctgacttcactactggcagaatcctccagcggccggcggcgaggacttctttgtctcccagactccgccttgggctcggacgccgccagggttgcaggtacagactctctggtctagctggctcttccggccacaggcgcggcagtccggccggaaaggccggattcagggatccagagcgcgagcccggcctgggagtccgcctactcccggctcccgtcgaggccgcgtgggatcccgttggccgcgcaggcgtcgatctcccctttttgacactgcaactcccatgaggccctgcagcgtccctggcgccgctgaagacgccctggaactcggctggcttcggagggctcggtgactctggccgcgctgcattatggaatacagagtctaagagaaaactagcccggcaccgactccggaccaagcacacgtgtttaccttgtgcactggggtgggggcgtcagtgaagagcagctaacaagatttcgtcataagaccgcgaccagacaggcggcgccatcttcgaacttagacttccggaaggactttggcgaggggcagccattttggggggtgctgatggatacctgcggggtcggctatgttgccctgggggaggccggccccgtggggaacatgactgtggtagactctcctggacaagaggtgctaaatcagcttgatgtcaagacctcttcagaaatgaccagtgcagaggcttccgtagagatgtcattacctacccctttgcctggatttgaggattctcctgatcagaggaggctccctccagagcaggaaagcctctccagactggaacagccagatctttcttcagagatgtcaaaggtctcaaagcctagggcctcaaagcctggccggaagagaggtggtaggacacgaaaaggccccaaaaggccccaacagcctaatcctccatcagccccactggttcctggtctcttagatcaatccaaccctctgtccacccccatgcctaagaaacgaggtcgaaagtccaaggcagagctgctgctgctgaagttgtcaaaagacctagatcggccagaatctcaatctccaaagaggccccctgaggactttgagaccccttctggggaacgaccccgccgaagggctgcccaagtggcacttctgtatcttcaggaactggctgaagagctctcaacagccctgcctgcccctgtgtcctgtcctgagggccccaaggtgagcagccccaccaaaccgaagaagatccggcagccagcagcctgtccaggtggagaagaggtggatggtgctccacgggatgaagacttttttctccaggttgaggctgaagatgtggaagaaagtgagggcccaagtgagagctcatctgaacctgagcctgtagtgccccgaagcaccccacgaggatctacttcagggaaacagaaaccacactgccgaggaatggctcccaatggcttaccaaatcatatcatggctcctgtttggaagtgcctccatctcaccaaggacttccgagagcagaaacattcatactgggagtttgctgagtggattcctttagcctggaagtggcacttgttatctgagcttgaggccgctccctacctgccccaggaggagaagtctccattgttttctgtacaacgtgaagggctacctgaagatggcaccctctaccgaataaacagatttagctcgatcacagcacatccagagcgctgggatgtgtccttcttcacggggggaccgctctgggctctggactggtgcccagtgccagagggggcaggagcctcgcaatatgtggctcttttctccagccctgacatgaatgagacacacccactgagccagcttcattcgggtcctgggctgctccagctctggggccttgggaccttgcagcaagaaagctgtcctggcaacagggcccactttgtctatgggattgcttgtgacaacggctgcatctgggacctcaagttctgccccagtggagcatgggaacttccaggcacccctcggaaggctcctctcctgccccggttgggtctcttggctctggcctgctcagacgggaaagtactgctattcagtctaccccatccggaggccctgctggctcagcaacccccagatgcagtgaagcctgccatatataaggtacaatgtgtggcaactctgcaggtggggtctatgcaagctacagacccctctgagtgtggtcagtgccttagcctggcctggatgcctaccaggccccaccaacacctagctgctggatattataatggcatggtggttttctggaaccttcccactaactcacccctgcagcggatacggctctctgatggctccttaaagctctaccccttccagtgtttcctagcccatgaccaggctgtgcgtacccttcaatggtgcaaagctaacagccatttccttgtctctgcggggagtgaccggaaaatcaaattctgggaccttcgacgtccttacgaacccataaactctatcaagcgcttcttgagtacagaactggcctggctgcttccctacaatggtgtcactgtggctcaggacaactgctatgcctcttatggactctgtgggattcattatattgacgctggttaccttggtttcaaggcctacttcactgctcctcgaaaaggcaccgtttggagtctttcaggatccgactggcttgggacaatagctgcaggagatatatccggggagctcattgctgctatattaccagatatggcactgaatccaataaatgtcaagcgacctgtagagcgaagatttcctatatataaagcagatctgataccgtatcaggacagtcctgaaggtccagaccattcttctgcttcatctggggtccccaaccctcccaaggctcgaacttacactgaaactgtcaaccatcactacttgctctttcaagacacagatttgggttcattccatgatctgctccgtagagaaccaatgctgcgcatgcaggagggagaggggcattctcaactctgcctggacaggctgcagctggaggctattcataaggtacgtttcagcccaaacctggactcctatggatggctggtatctggggggcagtcagggctggttcgaatccattttgtccgtggactcgcctccccactgggccaccgtatgcagcttgaaagccgagcccacttcaatgctatgttccaaccatcctcccccactagacggcctggcttctctccaaccagccatcgccttctgcccactccctagccttggcccacaccagatccttggagtgaagtcggtcaagaacaaatggcccctatgcacagagccataggaactgggggccttccctggacagtgatcatgccaggcctggacctttaggcctgcctccccaggactccttagatcccactctttctacagacttctgtgatcacagccccctgcgggcaggggggctctccctccaccaactctcaaggctcctcagcctaagactatggctcatgagaaacactcaggcctgacctaggcttgggagtcaaactgctcatattgagcatattgttaagtgggtaaagccaagtaaaggtactgggtgtttttgtgaccacttgtgaatgggtgtatggagaactgaaaagggtatctgcatgaaggctcctgtctgactattccaggatccaatattactgccttctgaaacttcctctttagggtaaccatcatgtatgcccacgagggtgatagtaattcgtgagactgaagttgcttagagtacttctttgaccaaggaataccacagacaccctaccgatagaacagtggctcagatcttacttgctcctgcttacgaagtattcccaatcactggtcatctgaccctacttgaacactcctgaacagtcatgttttttaaaatcttcctttatatcaagtcagagagtatacttctataaatttcactcatggatgttaggaaatctagtcatcttcccaagtttccccgggaaaacttggaatttaagggttagacatactttgcagagtggtatccaaatcattggagaggccaacattaaaaa

SEQ ID NO: 25287 - DNA, 374 bp, Homo sapiens
catcccctgagattcttaccatttttagggccgttgtatagggaatccttttttggatgaatattttctaatttgttatttgtgtatctaccaaaaggctattgatttttctgtgttgctcttgcatccaacatcttactgaattttttattaaatagcatatatatagattcttttttatattctatgtggataatcttaacatctgcaaacaaagatggttttctctctgctttcagttcttactcctcttgtttctcttaagaatactttttaagaatgctttattacattagctagaacctacagaaaatattaaatggcagaaataataatgggattattgtgctattcctgactttaatggaaatgtc

SEQ ID NO: 25288 - DNA, 379 bp, Homo sapiens
gtgggctggtcattgaaatcctgctatgcttattttgctatgagaattgtaagctacagatcctttctactctcctgacactataggagctttcagtcttgttgagatgagataaatagtgttgcaaagaatacttatttctaaacactgaaattatattcagggtggtgatgtgtccacactataaaaggcacataagtgatgggactgactgatggaaaagtaggttcctgcctcaagtcacacttacattggtcatgaggaaggagaaggggaaattgtcttgtactatttcaaaattgttattttgcactttccttctcatctcctctcttgtttttctaattctcctccttctcctccttaccttgtcttctcc

SEQ ID NO: 25289 - DNA, 235 bp, Homo sapiens
ctgaggtaggagaatcgcttgaacccgggttgcagaggctgcagtgagccgaaatcgtgccattgaactccagtctgggcaacagagtgagactctgtcttaaaaaaacccgtaaagaacatataatagatatatctaaatgtgcagaaatactttacatgcatagtgactctgtgaaaaatcacttagtatagtgctttcacttatttttatagacatgattttattaacagag

SEQ ID NO: 25290 - DNA, 434 bp, Homo sapiens
gaaacctttccatctctatgcctgtttgtatccactaaagataaacaaatttaaggattctgaaagctcctacagtaatgtctgtgattttctaatttttcattaatgagatcaacactgcttaataaatacgtatactcatctgttcatagagtagaataatatgaaataacctgaattagctgtgaaaatagcagtgcttcggctgggcgtggtggctcacgcctgtaatcccagcactttgggaggctgaggcgggcggatcacgaggtgaggagatcgagaccatcctggataacacggtgaaaccctgtctctactaaaaatacaaaaaaaatagccgggcgtggtggcaggcgcctgtagtcccagctactcgggaggctgaggcaggagaatggcatgaacccgggaggcggagtttgcagtgagcc

SEQ ID NO: 25291 - DNA, 524 bp, Homo sapiens
tgaagaagtcgagctccttcagcaagttcttgagcgcctcgcccatggctccacgtaaaaagacaaagatccgcggtggtctgccagccttctcagaaatctctcgtcgacctactccggggcctttagctggtctagtgcccagtttgcctccaacaacctgaaggtccctggggctaccacctggttgatctatcgtggcctgctcgtcgcagtccaaacccgcccaagactgcagcccaatcaacgcctggagcctcattctgtttccagctttgtccagggcagcctgttttacccagatgggcctgcacctccagcttctttctgaagcatgacccatctccagagatgggatttgagaaatcagtgagagcttcctataaagaactccaggagacaggcctgaactctagagggaacttgaaatccagggtcaaaggttaaggggcagcagcttggtcttggcccctgaaagccttcacctgatgcctctgcagctacacaatcccaagacagagcta

SEQ ID NO: 25292 - DNA, 303 bp, Homo sapiens
cagcactccaggtgcaaaaccatggtcctgggatgcgtagagatgggaggatatgggtagaatcaggaatatgaagatagagggtagaacttggtcacaggttggaagtggcacatacaaggcaatcatggtttgggaaaggcgagctctggtgtggtcaggtaatggggaaaggctcacagagcagcagagtgcatgctgcgtggctggatgggctctgagggcacaggtagtgaggagggagagagagtttaaggtagaaggtgcagaggtatggacctgggaagcattcagggaatagtg

SEQ ID NO: 25293 - DNA, 476 bp, Homo sapiens
agtacctccccttcctcccagccccccgcagctgtccacaaagacgatggtgggggacggaaggtgacagagatggatagccatatagccatgtccatttctcctcctcctcctccccgccccatatacaaatacgcacgtacacacatatccccccaagctatatctgtcccctcctgagatcaaacaaggacaagaaggggaggcaggaggggatcagagctgtaggaaaacagacacaaacggtgaaggttggagatgttctgagatgccaggatagaaggggatgaaggtacacaggtgataggaggacagagaatgatgaacagaaacccaaggaaaacaaagggaggagagagagcaaaaaagataaagtgaaggagaggagagaaaggacaaaggagggctgggggaaaagtgccaaacaagcagtaagaaaggacgataaaagacaggcaagttaagatattggttca

SEQ ID NO: 25294 - DNA, 447 bp, Homo sapiens
taaaagtaggcttagttatttaagcagtcacatctttgcttcctgaaatttatatttgtaccatttagaagcatctcataaactattgaaaaaaaaaatagaaacatctcagtttggtttaaaagggtgaaggagactgggcgtggtggctcaggcctgtaatcccagcactttgggaggctcgaggcaggtggatgatgaggtcaggaatccaagaccagcctggccaacatggtgaaaccctgtctctactaaaaatacaaaaattagctgggcatggtggtgtacacctctattcccagctactcgggaggctgaggcaggagaatcgcttgaacctgggaggtggaggttgcagtaagccacgatcgcaccactgcacaccagcctgggtgacagagtgagactctgttttgcgggggaaaaaaagggtgagggaagttgagt

SEQ ID NO: 25295 - DNA, 354 bp, Homo sapiens
gaaaggatgaagtcaggaaagtaaggtcaaattaaaattttaaacatcttgtgcatttcccccatttaaaatatagaaaggtaagattactctcatagttggttgattacattcaagagatatctaaatttgaaaagatagacttatccacagaggcataggattcttaggagtttaatccttggctaggtgtggtggctcatgcctgtaatcctagcactttggaaggccaaggcaggcagatcacttgaggtcaggagttcgagaccagcctggctaatatggtgaaaccccatctctactaaaaatacaaaaattagctgggcgtgatgtcgggtgcgtgtaatcccagct

SEQ ID NO: 25296 - DNA, 651 bp, Homo sapiens
aagttgccatacttctgcagtataggctggttgcccacaggaaaatattggagacaaagctgaaagcaatgtaaaaaccttgtgaaaaagcagaatgtatctttgaagaactgcacttaatatgttattcagcctaatttgtgcattttaagtaacatgttgatgagttgtacggtagtttcctttatccatagcccataccacaactccaagtagatgcctgcagatggtactgaacccttatatatactatgtttttcctgtgcatacataccaatgataaagtttaatttataaattaggcacagtaagaaattaataactattgataaaatagaacagttataacatcatactgtaataaaaaaaaactatgtaaatgtggtttctctctctgtgtgtctctctgtcatctcaaaatatcttattatactgtactcacctatttttggactgtgggtgaccacaggtaactgaagctgtggaaagcaaaaccatgaataagtggggactgctgtatgtgttgtagagctgtgctgtccagtctgtcagccactacttacatgtggctactgggaaatggaaatgtgtgcccaaagtgatatgtgctgtaagtgaaaaatgaacattaggtttcagaagataagtaca

SEQ ID NO: 25297 - DNA, 199 bp, Homo sapiens
tgtacatcatctgagatttctctctgtcccccaagcctttctcattcaattatcactaaatcatattgacgatacctctcttctgcctccattttgtattcccactgccactgggaacatgaacatttacaaaatggcttttattaaaaaaaaaaactgccaacaattaatgttatttcttacgggaaaaaaattaagc

SEQ ID NO: 25298 - DNA, 642 bp, Homo sapiens
cattctatctgaattctttcttggcattaatcataccttgcttgctctagtgcactccccatcccttaactgtaggttgtcaaagtgttgtctatacaacagaaactcctgagttataaaaccacaatctcagaaggtagggcctggaaatctgatttttgatatagtcttcagtagggtcttatagacactagagattgagaactggcttaacagttgctcttctacagagtcatgactttgcctcagctctgtactaatcattttctgtgtaaccatttattgaatctagatcatttcatctttatgagacaatctacgataataaaaaacaaaacaaaaagaagcaaaccctggggaaagaagagaatctgacttccagggttactatcttatttgattcaaatgttcggttttcaagaaaaaaatcataaggcataaaagaaaaggaaaatatggctcattcaaaggaaaaaagtaaatcaacagaaactgcctctgaaaaagaagtgatggtggatctattagaactttgaaatagctgtccgaaagatactcaaagaactaaagaaagatgtggagagagtcaagaaaatgatatatgaataaaatgtaaatatcaataaggaaaaatcctaaaaa

SEQ ID NO: 25299 - DNA, 394 bp, Homo sapiens
cgtacttctcaacatcatcaagtctccctcaaatgaaaaataaactaaattgtttttaatattttttaatgccattactaaaatacagtgcactaagaaagaaccaactaaaattcctaaattaatgctttataatattacagtgatgtgtactgtttaattaaggccatagaccagttgattatcaaagattttttttttccttttgatctaatgattgtttgatattttttctaatcccattactaacttgtctcatccattaacctacgtaagtggagtgtgaaaaatgcattcataaatttaagttaaattttttttaaattgcagcatgtgaaatctacttaataaattcacaccaactccacaaagcattggggcaatttataaacaa

SEQ ID NO: 25300 - DNA, 453 bp, Homo sapiens
gagaaggaaaatgctttgggaaattgtatctcaggccagcaggaagtcaactttaaatgcttaggaactgtatctcagtgggcttcctcctctcctctttcaagttactataggtattgccttatggtcagctttggaatgagtcctatttacataatgcattttaaaaatagggtgccttttcattgttcaatgacgagttaggtggggcagcgcaccagcatgtcacatgtatacatatgtaaccctgcacattgtgcacatgtaccctaaaacttaaagtataataatttaaaaaaaaaagggtgcttttttattccaaaaatacgggaacatcaatattgcttttttaaaggaaatttactacaataatattttctttcggttcaactgtattaaaagtggaaactcttcgtcaggtgctccgagaacagtgaacaaacacttcaaatg

SEQ ID NO: 25301 - DNA, 584 bp, Homo sapiens
tatgatcctcacaacaaccctgaaagatagatggggcccattttacagatgagaaaactgagccgcgaacaggtgatgcaactcacccagggccacaagtggcagagccaggactagatcccaggtccctggactcctggtcagtatgattctcttgcctcccatcaagcaccaatagagcagcttggctggggtcggagataggaggtttgggccacgttttgcatcgtaacaatatttctggcttggtaacctttttatctctagcacctagcacagtacctggcaattagcagacaccgtaagtcatttgataaatgaatggatgagctagaccaatgctttgtggttaaaataatggcaactttgggcttaaaagaggaaataattctttgcaactgtggctatccatccttgcaacagatgcctcaggaatcacaggtagatgattaggggctcatcgcttagtggctcaaagaggtgttcatgcctgcttgtatggatgttatagaatccaaacacacagggggaagaaatggaaaaatgagaaaaaaactcagtccaaaagtaggcaagaaagtctc

SEQ ID NO: 25302 - DNA, 419 bp, Homo sapiens
gctgaatgaaatccagaagaattagttgaagctgctgaagaggaaggaaaatgggatgcttgttctaggaggtagaagcagaatgtgcaaagccttaaagctctacattggaagaaatccagataggttagtatagctaaggcttgtggtattcccagtgagcattacagagcctaacattagattttcagcaaatactgaataaataaataaataactgatgtaagggaaggagttttttaagagtaggaagtctgggaaagcagacacatagcagtcacatgcagcctaccttgtgtctagagcaccagaattctagtcaagaaggtacagcaaattcaggtctctacagacttgaccagtttgttcatccgggtgtatggtttctttctgaggtacatagataacccacccaggag

SEQ ID NO: 25303 - DNA, 482 bp, Homo sapiens
aatctgtgcattgttacatttctatagtccaaggatggcaattgatttttaaaacacatgctgcaactttatttggtctgtaattacatggactttatttggaggtcagtgaaggaacaactaaataggaaaatgtagtcttcctcccttgtgcaatgaaaccataaaagttggcagacagaaaggaatgctaaactttttcccagagctctgagtttggtttccactggtccatgttccattgggtgattagagaaagcttttttaaacccttacttcagaatgatcttaattggtgcaaggttgagccctttctaggaggggagggaaaaggttgaatagccttttcaagtcacatgaaagtttctaggatgaatgtacgataattagattaataagtagcttaatttatcacagctgaggatttcaacagccacacattagagcaagaaaaaaagattagtgtgattctagtttgtaaa

SEQ ID NO: 25304 - DNA, 586 bp, Homo sapiens
tgcttccccgtcctcagcaggaactcatttaggaggttgaggctgggcccttcccaggagtgctgcctctcagtcctgaacatgggaggggcccagggtatgttcacggggcgatgctgccctcccagctggcccatgggtgaccctgggaacattaactgcctcacaacgtttgtgcctcagttacccgtagatgtagtgagggtaacaatacttactctcgttggtgataaggaacagctaacacaacacacagggtttttctgctcccaaaatgggattcttcagtgcaccaaatcgaagaaagcactggagctcacgctggtttctccattgtttctccttaacagtggaaaccgtaacttttgttctagtagcatctagcatgctcaataattatttgtaaataaaagttatactttccctccaaaggggacaaggtattgttatgacaaggcttttaaataataaagctcctgcgaatagctaacgttcctagagggctggctgtcttgtgggttgtctgatcactgtgtagccttgaatgaattacctgctatgaccaatagtgaggagggggtcgagc

SEQ ID NO: 25305 - DNA, 515 bp, Homo sapiens
ggaaatcatccaatatctgatctcagacgaaaaggaattaaattacaatttgataacagaaagatagccggaaaatcactgaatacttagacattaaataacacatttctttttttttttttttttttttaagacagagtctcactctgtcacccaggctggagtgcagtggcgcgatcttggctcactgcaacctccacctcccaggttcaagctattctcctgcctcagcctcccgagtacctgggactacaggtgcacaccaccacacctggctaatttttgtatttttagtagagacggggtttcaccatgttggccaggctggtcttgaactcctgacctcaggtgatccgcccaccttggcctcccaaagtgctgggattataggtgtgagccacagcacccagcccaaaatgttttcaaaagacatatatggatggaagactgttatccaaaattacacaaagaactctttaaaacttcaacaaaaagagaggtgggtatgggtgctg

SEQ ID NO: 25306 - DNA, 1373 bp, Homo sapiens
ggggaggggggaaacagaaaagaaaagaccagcactttgggaagccaaggcaggcggatcatgaggtcaggagatcaagaccatcctggctaacacggtgaaaccccgtctctactaaaaatacaaaaaaaaattagccaggagtgatggcgggcacctgtagtcccagctactcaggaggctgaggcaggagaatggcatgaaccccggaggtgaagcttgcagtgagctgagattgtgccactgcactccagcctgggcgacagaacgggactccgtctcaaagaaaaaaaaaaaagaaaagaaagtatttggaatttatttgtgaaatttttaaaagaggtaaagcttgtaaagagccctttgtggtgcctggtacagagtaggtgctcaagaaacactggttcacatccttttgcagctggtgtcagtgaggctggtctagctctcctcgcgtgccctgtggtgtctcaggcttgtgcacaggaggcgggagcctgtgtttattatttgctgtttatcctctccctcctccgtctctttcctgacatggtttctatggagacgagggtccctgagcaattcttctgccagagcctcagtcccatcatcaagatctgccgttgccatcctgacaggctgccgaggtggtgctgtcacccggctgggaacaggagcccctggcctgagctgatgtggttgccatggagacagctctccgctagagagaagggaggtggcagaccctggccgagggctgcggtggcactgttgcccagctaccctctcttccagtgtcacacccctccttgtgttttaggcagaaagccaatacgagtgttgacgtgatttattatggtatagctgctgtgtttgagccctcactctgtgccaggcaccacagaagccttgaccacaccagcacattgtttaaccctccaacagccttcccacggacatggtgtggttgtcttattttataggtgccactgtttgttggcaattttaaaatcatgatttaattcccatatcatacaactcaccatttaaaagtgtacagtttgggctgggcacagtggctcacacctgtaatcccagcactttgggaggccaaggcgggtggatcacctgaggtcaggagttcgagaccagcctgaccaacatggtgaaaccccacttctactacaaatacaaaaattagccaagtgtggtggtgggcgcctgtaatcccagctacctgggaggttgaaataggaggagaattgcttgaacccgggagctggaggttgcagtgagccgacatcccatcattgcactccagcctaggcaacaaagcgagactctgtctcaaaaaaaaaaaaaagtgtacaatt

SEQ ID NO: 25307 - DNA, 1427 bp, Homo sapiens
caatgaagacattttctttgcagaaagaaatttcagagcttccaagaccacaaacttaaaataagtaaagaagagagtaaaattcttaaaaaggctcagaaagatggatttttgcatgagacgcttctggacaggtagctatttacttattttcactatttttcagtagccaatagaaatggcatgtagaaaagctatattctcttaaattactgtagttttcacatttttgtctttatttataatttatgagtgtggcaatattacctagagaggacatcatgagtttgggaaaagactgtcaagaaagaatatctaaaaattataaccgattctaagtatatactttaagaaattcaggtttgactgtatctacttcataaatttatcattatctttttataactattagaaccagagttagaaagaagcagtttgactaatataaaaattctgtggattctgttagagtagttcatgttccttaaaataagcatagatcaactaaaaaactaagtataaaagctaaacaagtgaaattgaagcagttttattgtaagatttggaagagtgcaggatgtttatcatagcacattattaatatttattactcttcctatgtagataagtgatgtcctagatttacaacatagaaaaacaggtagagacgtttagctgtgagtgtacaagtataaatcaattaagtgccagattttgataatcaccagctgctcattcaagtcctatgttgcaaagttacttttaccctttatttacattacttgataaaggcaatgtttaattacatatttcctgttaactagctggtagagttcatacctaaagtcagtaaataatgttaagaattttttccagctgagcaaatgaatatgtatctagttgtaagaaatcaagaagaggatataaaatataatcaggatgtggactctaaaacggaataagctctgtgtcctgtaacttttttcacttgtaataatacagcattctcccctgttaaatggaaacttagagcacccttaaattctggaataattaaaattgctatttagattgaaaagcccttaggcaacatttattgaatattaggaaataacttttataagattagaatccactttatagaaacgaaatttaaaagtatacatgttttaatataagtgttgtggtaatacaataaccaaaattgaacacacagttttaaagctttttatatttagtagcagttgaatatatatggcatgttttacatagattaattttactatttttctttgtttaaacaagagaaccaaattgaaagccgacagatactgcagatgactggaatttttgtttctgtcttatctttttgtgttttttttctgaataaaatattcagaggaaatgcttttacagagttaaaaagt

SEQ ID NO: 25308 - DNA, 2450 bp, Homo sapiens
gcagaaacctggaagtggaaatctcgggcattcaccgtttgggtgaagacggaggcgggttctggacagacgtaggctgtcagggagtgtttacttcgcctccacttctgttcctccctgccctggtgctgctccaggtcacatactcgtcctgagccggcttcagcctgtccgcgcagaagtctcccggagccatggcctagtactcttatgtgaagtctagcaagctcgtgctcaagggaaccgaggtgaagagctgggtcctgcagctctggtgggagcctcctcagttcttttcggatgcactccacccccgcgaatccggtggaagccgtggtgcagagagccggctttgtggcctcccaggcttcgctctgaccctgtctgggctggacggaggccggaccgcggttcctggcgcctgtgcagagaggggcagcctcccgtgctgacgaccctggaaacaggatagacgggcgggtgacccgtggccccgtacccacgagtttgggtcccctgaggcatctctccaggcctctgcctgtaagaagaaaaagagcaaagataagaagagaaaaagagaagatgaagaaacccagcttgatacgttggaatctggtgaacagtaacaaactttggtgaaatttcaggaaccatagccattgaaatggatgagggaacctatatacatgcactcgacaatggtctttttaccctgggagctccacacaaagaagaatcgccctgaaatctggctatggaaaatatcttggtataaattcagatgaacttgttgggcattcagatgcaattggaccaagagaacaatgggaaccagtctttcaaaatgggaaaatggctttgttggcctcaaatagctgctttattagatgcaatgaagcaggggacatagaagcaaaaagtaaaacagcaggagaagaagaaatgatcaagattagatcctgtgctgaaaaagaaaccaagaaaaaagatgacattccagaagaagacaaaggaaatgtaaaacaatgtgaaatcaattatgtaaagaaatttcagagcttccaagaccacaaacttaaaataagtaaagaagagagtaaaattcttaaaaaggctcagaaagatggatttttgcatgagacgcttctggacaggtagctatttacttattttcactatttttcagtagccaatagaaatggcatgtagaaaagctatattctcttaaattactgtagttttcacatttttgtctttatttataatttatgagtgtggcaatattacctagagaggacatcatgagtttgggaaaagactgtcaagaaagaatatctaaaaattataaccgattctaagtatatactttaagaaattcaggtttgactgtatctacttcataaatttatcattatctttttataactattagaaccagagttagaaagaagcagtttgactaatataaaaattctgtggattctgttagagtagttcatgttccttaaaataagcatagatcaactaaaaaactaagtataaaagctaaacaagtgaaattgaagcagttttattgtaagatttggaagagtgcaggatgtttatcatagcacattattaatatttattactcttcctatgtagataagtgatgtcctagatttacaacatagaaaaacaggtagagacgtttagctgtgagtgtacaagtataaatcaattaagtgccagattttgataatcaccagctgctcattcaagtcctatgttgcaaagttacttttaccctttatttacattacttgataaaggcaatgtttaattacatatttcctgttaactagctggtagagttcatacctaaagtcagtaaataatgttaagaattttttccagctgagcaaatgaatatgtatctagttgtaagaaatcaagaagaggatataaaatataatcaggatgtggactctaaaacggaataagctctgtgtcctgtaacttttttcacttgtaataatacagcattctcccctgttaaatggaaacttagagcacccttaaattctggaataattaaaattgctatttagattgaaaagcccttaggcaacatttattgaatattaggaaataacttttataagattagaatccactttatagaaacgaaatttaaaagtatacatgttttaatataagtgttgtggtaatacaataaccaaaattgaacacacagttttaaagctttttatatttagtagcagttgaatatatatggcatgttttacatagattaattttactatttttctttgtttaaacaagagaaccaaattgaaagccgacagatactgcagatgactggaatttttgtttctgtcttatctttttgtgttttttttctgaataaaatattcagaggaaatgcttttacagagttaaaaagt

SEQ ID NO: 25309 - DNA, 2374 bp, Homo sapiens
gcagaaacctggaagtggaaatctcgggcattcaccgtttgggtgaagacggaggcgggttctggacagacgtaggctgtcagggagtgtttacttcgcctccacttctgttcctccctgccctggtgctgctccaggtcacatactcgtcctgagccggcttcagcctgtccgcgcagaagtctcccggagccatggcctagtactcttatgtgaagtctagcaagctcgtgctcaagggaaccgaggtgaagagctgggtcctgcagctctggtgggagcctcctcagttcttttcggatgcactccacccccgcgaatccggtggaagccgtggtgcagagagccggctttgtggcctcccaggcttcgctctgacccctggaaacaggatagacgggcgggtgacccgtggccccgtacccacgagtttgggtcccctgaggcatctctccaggcctctgcctgtaagaagaaaaagagcaaagataagaagagaaaaagagaagatgaagaaacccagcttgatacgttggaatctggtgaacagtaacaaactttggtgaaatttcaggaaccatagccattgaaatggatgagggaacctatatacatgcactcgacaatggtctttttaccctgggagctccacacaaagaagaatcgccctgaaatctggctatggaaaatatcttggtataaattcagatgaacttgttgggcattcagatgcaattggaccaagagaacaatgggaaccagtctttcaaaatgggaaaatggctttgttggcctcaaatagctgctttattagatgcaatgaagcaggggacatagaagcaaaaagtaaaacagcaggagaagaagaaatgatcaagattagatcctgtgctgaaaaagaaaccaagaaaaaagatgacattccagaagaagacaaaggaaatgtaaaacaatgtgaaatcaattatgtaaagaaatttcagagcttccaagaccacaaacttaaaataagtaaagaagagagtaaaattcttaaaaaggctcagaaagatggatttttgcatgagacgcttctggacaggtagctatttacttattttcactatttttcagtagccaatagaaatggcatgtagaaaagctatattctcttaaattactgtagttttcacatttttgtctttatttataatttatgagtgtggcaatattacctagagaggacatcatgagtttgggaaaagactgtcaagaaagaatatctaaaaattataaccgattctaagtatatactttaagaaattcaggtttgactgtatctacttcataaatttatcattatctttttataactattagaaccagagttagaaagaagcagtttgactaatataaaaattctgtggattctgttagagtagttcatgttccttaaaataagcatagatcaactaaaaaactaagtataaaagctaaacaagtgaaattgaagcagttttattgtaagatttggaagagtgcaggatgtttatcatagcacattattaatatttattactcttcctatgtagataagtgatgtcctagatttacaacatagaaaaacaggtagagacgtttagctgtgagtgtacaagtataaatcaattaagtgccagattttgataatcaccagctgctcattcaagtcctatgttgcaaagttacttttaccctttatttacattacttgataaaggcaatgtttaattacatatttcctgttaactagctggtagagttcatacctaaagtcagtaaataatgttaagaattttttccagctgagcaaatgaatatgtatctagttgtaagaaatcaagaagaggatataaaatataatcaggatgtggactctaaaacggaataagctctgtgtcctgtaacttttttcacttgtaataatacagcattctcccctgttaaatggaaacttagagcacccttaaattctggaataattaaaattgctatttagattgaaaagcccttaggcaacatttattgaatattaggaaataacttttataagattagaatccactttatagaaacgaaatttaaaagtatacatgttttaatataagtgttgtggtaatacaataaccaaaattgaacacacagttttaaagctttttatatttagtagcagttgaatatatatggcatgttttacatagattaattttactatttttctttgtttaaacaagagaaccaaattgaaagccgacagatactgcagatgactggaatttttgtttctgtcttatctttttgtgttttttttctgaataaaatattcagaggaaatgcttttacagagttaaaaagt

SEQ ID NO: 25310 - DNA, 2158 bp, Homo sapiens
gcagaaacctggaagtggaaatctcgggcattcaccgtttgggtgaagacggaggcgggttctggacagacgtaggctgtcagggagtgtttacttcgcctccacttctgttcctccctgccctggtgctgctccaggtcacatactcgtcctgagccggcttcagcctgtccgcgcagaagtctcccggagccatggcctagtactcttatgtgaagtctagcaagctcgtgctcaagggaaccgaggtgataagaagaaaaagagcaaagataagaagagaaaaagagaagatgaagaaacccagcttgatacgttggaatctggtgaacagtaacaaactttggtgaaatttcaggaaccatagccattgaaatggatgagggaacctatatacatgcactcgacaatggtctttttaccctgggagctccacacaaagaagaatcgccctgaaatctggctatggaaaatatcttggtataaattcagatgaacttgttgggcattcagatgcaattggaccaagagaacaatgggaaccagtctttcaaaatgggaaaatggctttgttggcctcaaatagctgctttattagatgcaatgaagcaggggacatagaagcaaaaagtaaaacagcaggagaagaagaaatgatcaagattagatcctgtgctgaaaaagaaaccaagaaaaaagatgacattccagaagaagacaaaggaaatgtaaaacaatgtgaaatcaattatgtaaagaaatttcagagcttccaagaccacaaacttaaaataagtaaagaagagagtaaaattcttaaaaaggctcagaaagatggatttttgcatgagacgcttctggacaggtagctatttacttattttcactatttttcagtagccaatagaaatggcatgtagaaaagctatattctcttaaattactgtagttttcacatttttgtctttatttataatttatgagtgtggcaatattacctagagaggacatcatgagtttgggaaaagactgtcaagaaagaatatctaaaaattataaccgattctaagtatatactttaagaaattcaggtttgactgtatctacttcataaatttatcattatctttttataactattagaaccagagttagaaagaagcagtttgactaatataaaaattctgtggattctgttagagtagttcatgttccttaaaataagcatagatcaactaaaaaactaagtataaaagctaaacaagtgaaattgaagcagttttattgtaagatttggaagagtgcaggatgtttatcatagcacattattaatatttattactcttcctatgtagataagtgatgtcctagatttacaacatagaaaaacaggtagagacgtttagctgtgagtgtacaagtataaatcaattaagtgccagattttgataatcaccagctgctcattcaagtcctatgttgcaaagttacttttaccctttatttacattacttgataaaggcaatgtttaattacatatttcctgttaactagctggtagagttcatacctaaagtcagtaaataatgttaagaattttttccagctgagcaaatgaatatgtatctagttgtaagaaatcaagaagaggatataaaatataatcaggatgtggactctaaaacggaataagctctgtgtcctgtaacttttttcacttgtaataatacagcattctcccctgttaaatggaaacttagagcacccttaaattctggaataattaaaattgctatttagattgaaaagcccttaggcaacatttattgaatattaggaaataacttttataagattagaatccactttatagaaacgaaatttaaaagtatacatgttttaatataagtgttgtggtaatacaataaccaaaattgaacacacagttttaaagctttttatatttagtagcagttgaatatatatggcatgttttacatagattaattttactatttttctttgtttaaacaagagaaccaaattgaaagccgacagatactgcagatgactggaatttttgtttctgtcttatctttttgtgttttttttctgaataaaatattcagaggaaatgcttttacagagttaaaaagt

SEQ ID NO: 25311 - DNA, 2679 bp, Homo sapiens
gcagaaacctggaagtggaaatctcgggcattcaccgtttgggtgaagacggaggcgggttctggacagacgtaggctgtcagggagtgtttacttcgcctccacttctgttcctccctgccctggtgctgctccaggtcacatactcgtcctgagccggcttcagcctgtccgcgcagaagtctcccggagccatggcctagtactcttatgtgaagtctagcaagctcgtgctcaagggaaccgaggtgaagagctgggtcctgcagctctggtgggagcctcctcagttcttttcggatgcactccacccccgcgaatccggtggaagccgtggtgcagagagccggctttgtggcctcccaggcttcgctctgaccctgtctgggctggacggaggccggaccgcggttcctggcgcctgtgcagagaggggcagcctcccgtgctgacgaccctggaaacaggatagacgggcgggtgacccgtggccccgtacccacgagtttgggtcccctgaggcatctctccaggcctctgcctggcgagatggaaagaaagtatcaaggagtgagctgaagccactgcccttgagaaccctctcgaggagtctgggctcatgaggatgccagaataagtggcagagctaagaagtgacagaatcaggatttaaaatctggaagtgtggctctacaatctgctttgaactttaacataatatgtacaaagcctgaagcaaattctcagcgctgtatttaagagagcatagcaattaagaagaaaaagagcaaagataagaagagaaaaagagaagatgaagaaacccagcttgatacgttggaatctggtgaacagtaacaaactttggtgaaatttcaggaaccatagccattgaaatggatgagggaacctatatacatgcactcgacaatggtctttttaccctgggagctccacacaaagaagaatcgccctgaaatctggctatggaaaatatcttggtataaattcagatgaacttgttgggcattcagatgcaattggaccaagagaacaatgggaaccagtctttcaaaatgggaaaatggctttgttggcctcaaatagctgctttattagatgcaatgaagcaggggacatagaagcaaaaagtaaaacagcaggagaagaagaaatgatcaagattagatcctgtgctgaaaaagaaaccaagaaaaaagatgacattccagaagaagacaaaggaaatgtaaaacaatgtgaaatcaattatgtaaagaaatttcagagcttccaagaccacaaacttaaaataagtaaagaagagagtaaaattcttaaaaaggctcagaaagatggatttttgcatgagacgcttctggacaggtagctatttacttattttcactatttttcagtagccaatagaaatggcatgtagaaaagctatattctcttaaattactgtagttttcacatttttgtctttatttataatttatgagtgtggcaatattacctagagaggacatcatgagtttgggaaaagactgtcaagaaagaatatctaaaaattataaccgattctaagtatatactttaagaaattcaggtttgactgtatctacttcataaatttatcattatctttttataactattagaaccagagttagaaagaagcagtttgactaatataaaaattctgtggattctgttagagtagttcatgttccttaaaataagcatagatcaactaaaaaactaagtataaaagctaaacaagtgaaattgaagcagttttattgtaagatttggaagagtgcaggatgtttatcatagcacattattaatatttattactcttcctatgtagataagtgatgtcctagatttacaacatagaaaaacaggtagagacgtttagctgtgagtgtacaagtataaatcaattaagtgccagattttgataatcaccagctgctcattcaagtcctatgttgcaaagttacttttaccctttatttacattacttgataaaggcaatgtttaattacatatttcctgttaactagctggtagagttcatacctaaagtcagtaaataatgttaagaattttttccagctgagcaaatgaatatgtatctagttgtaagaaatcaagaagaggatataaaatataatcaggatgtggactctaaaacggaataagctctgtgtcctgtaacttttttcacttgtaataatacagcattctcccctgttaaatggaaacttagagcacccttaaattctggaataattaaaattgctatttagattgaaaagcccttaggcaacatttattgaatattaggaaataacttttataagattagaatccactttatagaaacgaaatttaaaagtatacatgttttaatataagtgttgtggtaatacaataaccaaaattgaacacacagttttaaagctttttatatttagtagcagttgaatatatatggcatgttttacatagattaattttactatttttctttgtttaaacaagagaaccaaattgaaagccgacagatactgcagatgactggaatttttgtttctgtcttatctttttgtgttttttttctgaataaaatattcagaggaaatgcttttacagagttaaaaagt

SEQ ID NO: 25312 - DNA, 2492 bp, Homo sapiens
gcagaaacctggaagtggaaatctcgggcattcaccgtttgggtgaagacggaggcgggttctggacagacgtaggctgtcagggagtgtttacttcgcctccacttctgttcctccctgccctggtgctgctccaggtcacatactcgtcctgagccggcttcagcctgtccgcgcagaagtctcccggagccatggcctagtactcttatgtgaagtctagcaagctcgtgctcaagggaaccgaggtgaagagctgggtcctgcagctctgatttgcctgaggttgactgtacatacaaatattgagcatttcctcctggcctccgtgataaacaggggttttgatattgttaggcgagatggaaagaaagtatcaaggagtgagctgaagccactgcccttgagaaccctctcgaggagtctgggctcatgaggatgccagaataagtggcagagctaagaagtgacagaatcaggatttaaaatctggaagtgtggctctacaatctgctttgaactttaacataatatgtacaaagcctgaagcaaattctcagcgctgtatttaagagagcatagcaattaagaagaaaaagagcaaagataagaagagaaaaagagaagatgaagaaacccagcttgatacgttggaatctggtgaacagtaacaaactttggtgaaatttcaggaaccatagccattgaaatggatgagggaacctatatacatgcactcgacaatggtctttttaccctgggagctccacacaaagaagaatcgccctgaaatctggctatggaaaatatcttggtataaattcagatgaacttgttgggcattcagatgcaattggaccaagagaacaatgggaaccagtctttcaaaatgggaaaatggctttgttggcctcaaatagctgctttattagatgcaatgaagcaggggacatagaagcaaaaagtaaaacagcaggagaagaagaaatgatcaagattagatcctgtgctgaaaaagaaaccaagaaaaaagatgacattccagaagaagacaaaggaaatgtaaaacaatgtgaaatcaattatgtaaagaaatttcagagcttccaagaccacaaacttaaaataagtaaagaagagagtaaaattcttaaaaaggctcagaaagatggatttttgcatgagacgcttctggacaggtagctatttacttattttcactatttttcagtagccaatagaaatggcatgtagaaaagctatattctcttaaattactgtagttttcacatttttgtctttatttataatttatgagtgtggcaatattacctagagaggacatcatgagtttgggaaaagactgtcaagaaagaatatctaaaaattataaccgattctaagtatatactttaagaaattcaggtttgactgtatctacttcataaatttatcattatctttttataactattagaaccagagttagaaagaagcagtttgactaatataaaaattctgtggattctgttagagtagttcatgttccttaaaataagcatagatcaactaaaaaactaagtataaaagctaaacaagtgaaattgaagcagttttattgtaagatttggaagagtgcaggatgtttatcatagcacattattaatatttattactcttcctatgtagataagtgatgtcctagatttacaacatagaaaaacaggtagagacgtttagctgtgagtgtacaagtataaatcaattaagtgccagattttgataatcaccagctgctcattcaagtcctatgttgcaaagttacttttaccctttatttacattacttgataaaggcaatgtttaattacatatttcctgttaactagctggtagagttcatacctaaagtcagtaaataatgttaagaattttttccagctgagcaaatgaatatgtatctagttgtaagaaatcaagaagaggatataaaatataatcaggatgtggactctaaaacggaataagctctgtgtcctgtaacttttttcacttgtaataatacagcattctcccctgttaaatggaaacttagagcacccttaaattctggaataattaaaattgctatttagattgaaaagcccttaggcaacatttattgaatattaggaaataacttttataagattagaatccactttatagaaacgaaatttaaaagtatacatgttttaatataagtgttgtggtaatacaataaccaaaattgaacacacagttttaaagctttttatatttagtagcagttgaatatatatggcatgttttacatagattaattttactatttttctttgtttaaacaagagaaccaaattgaaagccgacagatactgcagatgactggaatttttgtttctgtcttatctttttgtgttttttttctgaataaaatattcagaggaaatgcttttacagagttaaaaagt

SEQ ID NO: 25313 - DNA, 2180 bp, Homo sapiens
gcagaaacctggaagtggaaatctcgggcattcaccgtttgggtgaagacggaggcgggttctggacagacgtaggctgtcagggagtgtttacttcgcctccacttctgttcctccctgccctggtgctgctccaggtcacatactcgtcctgagccggcttcagcctgtccgcgcagaagtctcccggagccatggcctagtactcttatgtgaagtctagcaagctcgtgctcaagggaaccgaggtgaagagctgggtcctgcagctctgtaagaagaaaaagagcaaagataagaagagaaaaagagaagatgaagaaacccagcttgatacgttggaatctggtgaacagtaacaaactttggtgaaatttcaggaaccatagccattgaaatggatgagggaacctatatacatgcactcgacaatggtctttttaccctgggagctccacacaaagaagaatcgccctgaaatctggctatggaaaatatcttggtataaattcagatgaacttgttgggcattcagatgcaattggaccaagagaacaatgggaaccagtctttcaaaatgggaaaatggctttgttggcctcaaatagctgctttattagatgcaatgaagcaggggacatagaagcaaaaagtaaaacagcaggagaagaagaaatgatcaagattagatcctgtgctgaaaaagaaaccaagaaaaaagatgacattccagaagaagacaaaggaaatgtaaaacaatgtgaaatcaattatgtaaagaaatttcagagcttccaagaccacaaacttaaaataagtaaagaagagagtaaaattcttaaaaaggctcagaaagatggatttttgcatgagacgcttctggacaggtagctatttacttattttcactatttttcagtagccaatagaaatggcatgtagaaaagctatattctcttaaattactgtagttttcacatttttgtctttatttataatttatgagtgtggcaatattacctagagaggacatcatgagtttgggaaaagactgtcaagaaagaatatctaaaaattataaccgattctaagtatatactttaagaaattcaggtttgactgtatctacttcataaatttatcattatctttttataactattagaaccagagttagaaagaagcagtttgactaatataaaaattctgtggattctgttagagtagttcatgttccttaaaataagcatagatcaactaaaaaactaagtataaaagctaaacaagtgaaattgaagcagttttattgtaagatttggaagagtgcaggatgtttatcatagcacattattaatatttattactcttcctatgtagataagtgatgtcctagatttacaacatagaaaaacaggtagagacgtttagctgtgagtgtacaagtataaatcaattaagtgccagattttgataatcaccagctgctcattcaagtcctatgttgcaaagttacttttaccctttatttacattacttgataaaggcaatgtttaattacatatttcctgttaactagctggtagagttcatacctaaagtcagtaaataatgttaagaattttttccagctgagcaaatgaatatgtatctagttgtaagaaatcaagaagaggatataaaatataatcaggatgtggactctaaaacggaataagctctgtgtcctgtaacttttttcacttgtaataatacagcattctcccctgttaaatggaaacttagagcacccttaaattctggaataattaaaattgctatttagattgaaaagcccttaggcaacatttattgaatattaggaaataacttttataagattagaatccactttatagaaacgaaatttaaaagtatacatgttttaatataagtgttgtggtaatacaataaccaaaattgaacacacagttttaaagctttttatatttagtagcagttgaatatatatggcatgttttacatagattaattttactatttttctttgtttaaacaagagaaccaaattgaaagccgacagatactgcagatgactggaatttttgtttctgtcttatctttttgtgttttttttctgaataaaatattcagaggaaatgcttttacagagttaaaaagt

SEQ ID NO: 25314 - DNA, 2445 bp, Homo sapiens
gcagaaacctggaagtggaaatctcgggcattcaccgtttgggtgaagacggaggcgggttctggacagacgtaggctgtcagggagtgtttacttcgcctccacttctgttcctccctgccctggtgctgctccaggtcacatactcgtcctgagccggcttcagcctgtccgcgcagaagtctcccggagccatggcctagtactcttatgtgaagtctagcaagctcgtgctcaagggaaccgaggtgagcgagatggaaagaaagtatcaaggagtgagctgaagccactgcccttgagaaccctctcgaggagtctgggctcatgaggatgccagaataagtggcagagctaagaagtgacagaatcaggatttaaaatctggaagtgtggctctacaatctgctttgaactttaacataatatgtacaaagcctgaagcaaattctcagcgctgtatttaagagagcatagcaattaagaagaaaaagagcaaagataagaagagaaaaagagaagatgaagaaacccagcttgatacgttggaatctggtgaacagtaacaaactttggtgaaatttcaggaaccatagccattgaaatggatgagggaacctatatacatgcactcgacaatggtctttttaccctgggagctccacacaaagaagttgatgagggccctagtcctccagagcagtttatggctgtcaaattatctgattccagaatcgccctgaaatctggctatggaaaatatcttggtataaattcagatgaacttgttgggcattcagatgcaattggaccaagagaacaatgggaaccagtctttcaaaatgggaaaatggctttgttggcctcaaatagctgctttattagatgcaatgaagcaggggacatagaagcaaaaagtaaaacagcaggagaagaagaaatgatcaagattagatcctgtgctgaaaaagaaaccaagaaaaaagatgacattccagaagaagacaaaggaaatgtaaaacaatgtgaaatcaattatgtaaagaaatttcagagcttccaagaccacaaacttaaaataagtaaagaagagagtaaaattcttaaaaaggctcagaaagatggatttttgcatgagacgcttctggacaggtagctatttacttattttcactatttttcagtagccaatagaaatggcatgtagaaaagctatattctcttaaattactgtagttttcacatttttgtctttatttataatttatgagtgtggcaatattacctagagaggacatcatgagtttgggaaaagactgtcaagaaagaatatctaaaaattataaccgattctaagtatatactttaagaaattcaggtttgactgtatctacttcataaatttatcattatctttttataactattagaaccagagttagaaagaagcagtttgactaatataaaaattctgtggattctgttagagtagttcatgttccttaaaataagcatagatcaactaaaaaactaagtataaaagctaaacaagtgaaattgaagcagttttattgtaagatttggaagagtgcaggatgtttatcatagcacattattaatatttattactcttcctatgtagataagtgatgtcctagatttacaacatagaaaaacaggtagagacgtttagctgtgagtgtacaagtataaatcaattaagtgccagattttgataatcaccagctgctcattcaagtcctatgttgcaaagttacttttaccctttatttacattacttgataaaggcaatgtttaattacatatttcctgttaactagctggtagagttcatacctaaagtcagtaaataatgttaagaattttttccagctgagcaaatgaatatgtatctagttgtaagaaatcaagaagaggatataaaatataatcaggatgtggactctaaaacggaataagctctgtgtcctgtaacttttttcacttgtaataatacagcattctcccctgttaaatggaaacttagagcacccttaaattctggaataattaaaattgctatttagattgaaaagcccttaggcaacatttattgaatattaggaaataacttttataagattagaatccactttatagaaacgaaatttaaaagtatacatgttttaatataagtgttgtggtaatacaataaccaaaattgaacacacagttttaaagctttttatatttagtagcagttgaatatatatggcatgttttacatagattaattttactatttttctttgtttaaacaagagaaccaaattgaaagccgacagatactgcagatgactggaatttttgtttctgtcttatctttttgtgttttttttctgaataaaatattcagaggaaatgcttttacagagttaaaaagt

SEQ ID NO: 25315 - DNA, 1149 bp, Homo sapiens
  misc_feature (1090)..(1090): n is a, c, g, or t
  misc_feature (1095)..(1095): n is a, c, g, or t
  misc_feature (1127)..(1127): n is a, c, g, or t
gcagaaacctggaagtggaaatctcgggcattcaccgtttgggtgaagacggaggcgggttctggacagacgtaggctgtcagggagtgtttacttcgcctccacttctgttcctccctgccctggtgctgctccaggtcacatactcgtcctgagccggcttcagcctgtccgcgcagaagtctcccggagccatggcctagtactcttatgtgaagtctagcaagctcgtgctcaagggaaccgaggtgaagagctgggtcctgcagctctggtgggagcctcctcagttcttttcggatgcactccacccccgcgaatccggtggaagccgtggtgcagagagccggctttgtggcctcccaggcttcgctctgaccctgtctgggctggacggaggccggaccgcggttcctggcgcctgtgcagagaggggcagcctcccgtgctgacgaccctggaaacaggatagacgggcgggtgacccgtggccccgtacccacgagtttgggtcccctgaggcatctctccaggcctctgcctgtaagaagaaaaagagcaaagataagaagagaaaaagagaagatgaagaaacccagcttgatacgttggaatctggtgaacagtaacaaactttggtgaaatttcaggaaccatagccattgaaatggatgagggaacctatatacatgcactcgacaatggtctttttaccctgggagctccacacaaagaagaatcgccctgaaatctggctatggaaaatatcttggtataaattcagatgaacttgttgggcattcagatgcaattggaccaagagaacaatgggaaccagtctttcaaaattttgaccagaccattaatttgattttggatgaaagccatgaacgagtattcagctcttcacagggggtagaacaagtggtactaggattatacattgtaagaggtgacaacgttgcagtcattggagaaatcgatgaagaaacagattctgcgcttgatttggggaatattcgagcagaacctttaaattctgtagcacactgaggaaaaactacatacttggacatctgtaaatctttgnacagnaactgattattctgaggatgatatatggagtntttatgagtgtgtcactggatt

SEQ ID NO: 25316 - DNA, 1355 bp, Homo sapiens
gcagaaacctggaagtggaaatctcgggcattcaccgtttgggtgaagacggaggcgggttctggacagacgtaggctgtcagggagtgtttacttcgcctccacttctgttcctccctgccctggtgctgctccaggtcacatactcgtcctgagccggcttcagcctgtccgcgcagaagtctcccggagccatggcctagtactcttatgtgaagtctagcaagctcgtgctcaagggaaccgaggtgaagagctgggtcctgcagctctggtgggagcctcctcagttcttttcggatgcactccacccccgcgaatccggtggaagccgtggtgcagagagccggctttgtggcctcccaggcttcgctctgaccctgtctgggctggacggaggccggaccgcggttcctggcgcctgtgcagagaggggcagcctcccgtgctgacgaccctggaaacaggatagacgggcgggtgacccgtggccccgtacccacgagtttgggtcccctgaggcatctctccaggcctctgcctgtaagaagaaaaagagcaaagataagaagagaaaaagagaagatgaagaaacccagcttgatacgttggaatctggtgaacagtaacaaactttggtgaaatttcaggaaccatagccattgaaatggatgagggaacctatatacatgcactcgacaatggtctttttaccctgggagctccacacaaagaagaatcgccctgaaatctggctatggaaaatatcttggtataaattcagatgaacttgttgggcattcagatgcaattggaccaagagaacaatgggaaccagtctttcaaaatgggaaaatggctttgttggcctcaaatagctgctttattagatgcaatgaagcaggggacatagaagcaaaaagtaaaacagcaggagaagaagaaatgatcaagctctcctaatctctgtcagcccttcatctttatgaccttgccttgtctaccagaacacacatccctcttactaaagattagatcctgtgctgaaaaagaaaccaagaaaaaagatgacattccagaagaagacaaaggaaatgtaaaacaatgtgaaatcaattatgtaaagaaatttcagagcttccaagaccacaaacttaaaataagtaaagaagagagtaaaattcttaaaaaggctcagaaagatggatttttgcatgagacgcttctggacagagaaccaaattgaaagccgacagatactgcagatgactggaatttttgtttctgtcttatctttttgtgttttttttctgaataaaatattcagaggaaatgcttttacagagttaaaaagt

SEQ ID NO: 25317 - DNA, 758 bp, Homo sapiens
ggacgcgtgggtgacccacgcgtcggaaaaagagaagagtgaagaaatccagcttgatacgttggaatctggtgaacagtaacaaactttggtgaaatttcaggaaccatagccattgaaatggatgagggaacctatatacatgcactcgacaatggtctttttaccctgggagctccacacaaagaagaatcgccctgaaatctggctatggaaaatatcttggtataaattcagatgaacttgttgggcattcagatgcaattggaccaagagaacaatgggaaccagtctttcaaaatgggaaaatggctttgttggcctcaaatagctgctttattagatgcaatgaagcaggggacatagaagcaaaaagtaaaacagcaggagaagaagaaatgatcaagattagatcctgtgctgaaaaagaaaccaagaaaaaagatgacattccagaagaagacaaaggaaatgtaaaacaatgtgaaatcaattatgtaaagaaatttcagagcttccaagaccacaaacttaaaataagtaaagaagagagtaaaattcttaaaaaggctcagaaagatggatttttgcatgagacgcttctggacagacgaagctggaactgtactgatgacatctcgagattcactggaaagcatccatgactgaatactactgccactcagacctgccgagatgactgacaaagaagagaacacgccaaacaagcatgacttggtacagcaatataaaaagga

SEQ ID NO: 25318 - DNA, 1628 bp, Homo sapiens
gcagaaacctggaagtggaaatctcgggcattcaccgtttgggtgaagacggaggcgggttctggacagacgtaggctgtcagggagtgtttacttcgcctccacttctgttcctccctgccctggtgctgctccaggtcacatactcgtcctgagccggcttcagcctgtccgcgcagaagtctcccggagccatggcctagtactcttatgtgaagtctagcaagctcgtgctcaagggaaccgaggtgaagagctgggtcctgcagctctggtgggagcctcctcagttcttttcggatgcactccacccccgcgaatccggtggaagccgtggtgcagagagccggctttgtggcctcccaggcttcgctctgaccctgtctgggctggacggaggccggaccgcggttcctggcgcctgtgcagagaggggcagcctcccgtgctgacgaccctggaaacaggatagacgggcgggtgacccgtggccccgtacccacgagtttgggtcccctgaggcatctctccaggcctctgcctgtaagaagaaaaagagcaaagataagaagagaaaaagagaagatgaagaaacccagcttgatacgttggaatctggtgaacagtaacaaactttggtgaaatttcaggaaccatagccattgaaatggatgagggaacctatatacatgcactcgacaatggtctttttaccctgggagctccacacaaagaagaatcgccctgaaatctggctatggaaaatatcttggtataaattcagatgaacttgttgggcattcagatgcaattggaccaagagaacaatgggaaccagtctttcaaaatgggaaaatggctttgttggcctcaaatagctgctttattagatgcaatgaagcaggggacatagaagcaaaaagtaaaacagcaggagaagaagaaatgatcaagattagatcctgtgctgaaaaagaaaccaagaaaaaagatgacattccagaagaagacaaaggaaatgtaaaacaatgtgaaatcaattatgtaaagaaatttcagagcttccaagaccacaaacttaaaataagtaaagaagagagtaaaattcttaaaaaggctcagaaagatggatttttgcatgagacgcttctggacaggccgaagctggactgtactgctgccatctcggctcactgcaacctccctgcctgattctcctgcctcagcctgccgagtgcctgccattgcaggcacacgccaccacgcctgactggtcttcgtatttttttggtggagacggggttttgctgtgttggccgggctggtctccagctcctaaccgcgagtgatctgccagcctcggcctccggaggtgccgggattgcagacggtgtctggttcactcagtgctcaatggtgcccaggctggagtgcagtggcgtgatcttggctcgctacaacctccacctcccagccacctgccttggcctcccaaagtgctgagagtgcagcctctgcccggccgccaccccgtctgggaagtgaggagcgtctctgcctggccgcccatcgcctgggacgtgaggagtccctctgcctggctgcccagtctggaaagtgaggagcgt

SEQ ID NO: 25319 - DNA, 1279 bp, Homo sapiens
gcagaaacctggaagtggaaatctcgggcattcaccgtttgggtgaagacggaggcgggttctggacagacgtaggctgtcagggagtgtttacttcgcctccacttctgttcctccctgccctggtgctgctccaggtcacatactcgtcctgagccggcttcagcctgtccgcgcagaagtctcccggagccatggcctagtactcttatgtgaagtctagcaagctcgtgctcaagggaaccgaggtgaagagctgggtcctgcagctctggtgggagcctcctcagttcttttcggatgcactccacccccgcgaatccggtggaagccgtggtgcagagagccggctttgtggcctcccaggcttcgctctgaccctgtctgggctggacggaggccggaccgcggttcctggcgcctgtgcagagaggggcagcctcccgtgctgacgaccctggaaacaggatagacgggcgggtgacccgtggccccgtacccacgagtttgggtcccctgaggcatctctccaggcctctgcctgtaagaagaaaaagagcaaagataagaagagaaaaagagaagatgaagaaacccagcttgatacgttggaatctggtgaacagtaacaaactttggtgaaatttcaggaaccatagccattgaaatggatgagggaacctatatacatgcactcgacaatggtctttttaccctgggagctccacacaaagaagaatcgccctgaaatctggctatggaaaatatcttggtataaattcagatgaacttgttgggcattcagatgcaattggaccaagagaacaatgggaaccagtctttcaaaatgggaaaatggctttgttggcctcaaatagctgctttattagatgcaatgaagcaggggacatagaagcaaaaagtaaaacagcaggagaagaagaaatgatcaagattagatcctgtgctgaaaaagaaaccaagaaaaaagatgacattccagaagaagacaaaggaaatgtaaaacaatgtgaaatcaattatgtaaagaaatttcagagcttccaagaccacaaacttaaaataagtaaagaagagagtaaaattcttaaaaaggctcagaaagatggatttttgcatgagacgcttctggacagagaaccaaattgaaagccgacagatactgcagatgactggaatttttgtttctgtcttatctttttgtgttttttttctgaataaaatattcagaggaaatgcttttacagagttaaaaagt

SEQ ID NO: 25320 - DNA, 2115 bp, Homo sapiens
tcccggagccgacttctgagagtcgagtactcctatgtgaagactaccaagctcgtgttcaagggaaccaaggcgaagagagctaagaagtgacagaatcaggatttaaaatctggaagtgtggctctacaatctgctttgaactttaacataatatgtacaaagcctgaagcaaattctcagcgctgtatttaagagagcatagcaattaagaagaaaaagagcaaagataagaagagaaaaagagaagatgaagaaacccagcttgatacgttggaatctggtgaacagtaacaaactttggtgaaatttcaggaaccatagccattgaaatggatgagggaacctatatacatgcactcgacaatggtctttttaccctgggagctccacacaaagaagaatcgccctgaaatctggctatggaaaatatcttggtataaattcagatgaacttgttgggcattcagatgcaattggaccaagagaacaatgggaaccagtctttcaaaatgggaaaatggctttgttggcctcaaatagctgctttattagatgcaatgaagcaggggacatagaagcaaaaagtaaaacagcaggagaagaagaaatgatcaagattagatcctgtgctgaaaaagaaaccaagaaaaaagatgacattccagaagaagacaaaggaaatgtaaaacaatgtgaaatcaattatgtaaagaaatttcagagcttccaagaccacaaacttaaaataagtaaagaagagagtaaaattcttaaaaaggctcagaaagatggatttttgcatgagacgcttctggacaggtagctatttacttattttcactatttttcagtagccaatagaaatggcatgtagaaaagctatattctcttaaattactgtagttttcacatttttgtctttatttataatttatgagtgtggcaatattacctagagaggacatcatgagtttgggaaaagactgtcaagaaagaatatctaaaaattataaccgattctaagtatatactttaagaaattcaggtttgactgtatctacttcataaatttatcattatctttttataactattagaaccagagttagaaagaagcagtttgactaatataaaaattctgtggattctgttagagtagttcatgttccttaaaataagcatagatcaactaaaaaactaagtataaaagctaaacaagtgaaattgaagcagttttattgtaagatttggaagagtgcaggatgtttatcatagcacattattaatatttattactcttcctatgtagataagtgatgtcctagatttacaacatagaaaaacaggtagagacgtttagctgtgagtgtacaagtataaatcaattaagtgccagattttgataatcaccagctgctcattcaagtcctatgttgcaaagttacttttaccctttatttacattacttgataaaggcaatgtttaattacatatttcctgttaactagctggtagagttcatacctaaagtcagtaaataatgttaagaattttttccagctgagcaaatgaatatgtatctagttgtaagaaatcaagaagaggatataaaatataatcaggatgtggactctaaaacggaataagctctgtgtcctgtaacttttttcacttgtaataatacagcattctcccctgttaaatggaaacttagagcacccttaaattctggaataattaaaattgctatttagattgaaaagcccttaggcaacatttattgaatattaggaaataacttttataagattagaatccactttatagaaacgaaatttaaaagtatacatgttttaatataagtgttgtggtaatacaataaccaaaattgaacacacagttttaaagctttttatatttagtagcagttgaatatatatggcatgttttacatagattaattttactatttttctttgtttaaacaagagaaccaaattgaaagccgacagatactgcagatgactggaatttttgtttctgtcttatctttttgtgttttttttctgaataaaatattcagaggaaatgcttttacagagttaaaaagt

SEQ ID NO: 25321 - DNA, 398 bp, Homo sapiens
aaaatcgaaaaacatttttctgaatctttttctttagttcctagagtttgattcactatactgcagaaagggtaatcatctctcctttcaaaaactggagagttgggggtggaaccaagatggcagaataggaacagctccagtctacagctccctgcatgagcgacgcagaagacgaacgatttctgcagttccaactgaggtaccgggtgtatctcactggggattgtcggacagtgggtgcaggacagtgggtccagcgcaccgagcgtgagccgaagcagggcgaggcattgcctcacccaggaagtgcaaggggttggggagttccctttcctagggatgacggatggcacctggaaaatcgggtcactcccaccctaatactgcgcttttct

SEQ ID NO: 25322 - DNA, 294 bp, Homo sapiens
cctccctgctccccctctccccatgcctgggggcaattgtttaaagtcattttgttcccaaccagctgtctcaccctttgccttcttgttcctagaatttgggtttgtttgtttgttttttcgagatagggtctctctctttcacccaggctggaatgcagtggcttgatttcagctcactgcagcctctaccgctgaggcaggagaatggcgtgaacccgggaggcggagcttgcagtgagtggagatcgtgccactgcactccagcctgggcgacgaccgagacgccgtctc

SEQ ID NO: 25323 - DNA, 455 bp, Homo sapiens
aaaagaaaaacaagaagctgagggctgacattccaagactgtaactctaaggaacacaagtccttcataaccagcaaggatcccactccctctataaaaagcctgccaggaggccaagccaggagcgtaagccactgatagggctgtgtctctacccaaatctcattttgaattgtagttcccataatctccatgtgtcatgggagggacctggggggaggtaattgaatcatgggggcagtttccaccatcctgttcttgtgacagtgagttctcacgagatctgatggttttacaaggggcttttccccctttgctctgcacttctccttgctgccaccatgtgaaggatgtgtttgcttccccttccaccatgattgtaagtttcctgaggcctccccagccatgctgaactgtgagtcaattaaacctcttttctttatattaaaaaaaaa

SEQ ID NO: 25324 - DNA, 539 bp, Homo sapiens
ggggtttcaccatgttggccaggctagtctcgaactcctgacctcaggttatcctcccacctcagcctcccaaagtgctgggattacaggtgtaagccactgtacctggcccaaatagattttatttttagaacagtttttgtttcacaacaaaactaaacagaaagtacagaatttccatatccccctcccccgctgtggacatcccccacttgctacagatgacccacctgtgtggacagaccaccatcacccagatgccgtcgtttacattagggttcactcttgctgtggtacactctggattcggacaagtgtgtgttgacaagtatccaccactgtggtgtcatggagtatttaccctgccctaaacatgctctgttctccgcctgttcatccctcgttctccctagcccctgacaccactgatcttttatctttttttttgagatggagtcttgctcttgtcgcccaggctggagtgcaatggcacaatctcagcccactgcaacctctgcctcctggtttcaagtgattct

SEQ ID NO: 25325 - DNA, 129 bp, Homo sapiens
ctggccagagagctgtgtctgaatgtctaagacttggttggatttaaggaactctggcaatgccactggtgatcacttctgttaacctcattctttaaaattgtggtaaaacatacataatataacact

SEQ ID NO: 25326 - DNA, 694 bp, Homo sapiens
  misc_feature (638)..(638): n is a, c, g, or t
  misc_feature (688)..(693): n is a, c, g, or t
gagtggggaaaccccaaggaattctgtaaccttaaaataaactgagattcattagtgcagaaacacagaaagctgtcttctgagtctcggaaactaagattttagatgaagttaattttcttataaaagaatacaatattattgtaaataatttagagattgcatataagacaaagaagaaaataaaatgagctatatccgttcctccagccatcaacaccttccacatttgtggcacatcctttcaggatgtatgtgtgtgtgtgggaggggggtgcttacctgtgtgtagtaacttcatgttatacatatgcctttttccctcaagggtgaccactgttgttgcccaggctggagtgcaatggcgcgatcttggctcaccgcaacctctgcctcctggattcaagcgattctgctgcctcagcctcccaagtagctgggattacaggtgcccactaccacacctggctaatttttttgtatttttaatagaaacagggtttcaccatgttggtcaggctggtctcgaactcctgaactcatgtgatctgcccccccctcacccgccccttggcctcccaaagtgctaggattacaggcgtgggccatgacctgctttttattatcaatctataatnatatgtattgttcctatatcattaaatattctcctttgacatttctaaannnnnna

SEQ ID NO: 25327 - DNA, 451 bp, Homo sapiens
gaactaacaaaaatagactatctccattcccagacttaccatatccgttagctctccctttagcactaggacaggagccatgcatccttcccttccttagtttgtccctcagttagaaatgcagctagaatcttgtggtgaagagcaatcgtcgtcctggttttcagggcctctgctgggatactacatgcgtaataccctcaataagattgcagctatgcaaatttcaaaagacaaaagtggagtttctaagcttcctcactctagtggagtattcagatactttgatcacctgctatttcgagccctccagaacatcaaattgtcttctactaaaggaaggtttccatgaacctgctgagaaaaggtagcatcttctataaaggttatcaaaaacagaaatttctctgcaaaaatcttacctcaatcttatgaagaccaagaaaaaaaa

SEQ ID NO: 25328 - DNA, 848 bp, Homo sapiens
tgatattggtattacagagtaacagcctttgttaattagaaaactggatttgcatatattaaattttaattcctggtgctttgtcttttgtttttgctgttttgggttttagaactactttatatcctgcgaaattgtgttagatttggattattaaattgataaatttttaccatattatgggaagcatttctgatctcattagaaaccatacatattctcagctgcccaggttttactgattttattttctcattaaagacaaacttctgttttaaggaacttgggaaagttgatatgaatttctaatttaatgtattaggtcattaaaataatttttgagttcccttagacacatacaggcttttcatttttttcaaaagtaccctccttaaagtctgtaacagttaacatttttgagtacctttgcccaggtacgttgcaggcaggggtggagtgggggcatgcattggtcgagtcacatatcattactgtatttagtttggggagtatacagaaacttaaggtttttttgtttttgtttttgtttttgtttttgttttaaagaataccgtagcagtaggcaggacagttccaattcaacaaaaacctctttaccctggcactcaaaactgtaatgatgatgaactggtaagcatttttctgttttcagatgttcaacatcaaaatgagaaaagcactaacacttgatttaaaaataattgattgctagtatttctctaattttcatcttgaagttcattactgaactgttgttaagtcttatcagaattatgccagattagactcatagtcaaaatgtcctgttaaaaactgggaaaatcaga

SEQ ID NO: 25329 - DNA, 389 bp, Homo sapiens
gaaaaactttagtaagattggggctcaaaattattgtacacagatcaacagcttttatatatgcaaacagtaacccatcagaagatgtagtaaggaaagaccatatttataagaacaacaaaagttaaattattttgttataaacctaacatatcattaagcctcatgaattaaaataatatagcattagatcatgaaaacatatattaacagaacagattaaaaaaacagaaacagacacaaatgcatacagagatttagaatatttaaaaagtagcatttgaaatcagtgtagaaaagacaagttatttcttacatggcattgatataactgggatatcctctgtaatggagttggatccattcactaagataaaataatatatttc

SEQ ID NO: 25330 - DNA, 433 bp, Homo sapiens
tgtctaccatcgaaggcactgacctctactcacctgcgcttcagagggctgggttcttccctttcccaatgaagttgccaaaccaaggttgaaacattactgggttaataaagaaaagaaaacccaatagaaaagaataagagccaggagtggtctctcacacctgtaatcctaacactttgggaggccgaggtgggcggatcaccacctgaggtcaggagttcaagaccagcctggccaacatggtgaaaccctgtctctattaaaatacaaaaattagccgggcatgatggcaggtgcctgtaatcccagctactcaggaggctgagacgggagaattgcttaaacctggaagacggaggttgcagtgagccaagatcgcaccactacactccagcctgggtggctgagtgagactctgtctcaaaaaaaa

SEQ ID NO: 25331 - DNA, 412 bp, Homo sapiens
aaaaaaaaaaaaaaagccttgagcaccaaaggaccaaagacctgatagaaaaaatggggaaaagacataaatggacaactcacaaacaatgaaaattgggccttaagcacataaaaagttttaagttcatacagagaaataagctcacgcctgtaatcccaacactttgggaggccaaggtgggtggatcacctgaggtttctcaacctcgagaccagcctgaccaacatggagaaaccccgtctttactaaaaatacaaaaattagccaggcgtggtggtgggcgcctgtaatcccagctacttgggaggctgaggcaggagaatcgcttgaactcgggaggcagaggttacgacgagccaagatcgcgccattgcactccagcctgggcaacaagaatgaaacttcatct

SEQ ID NO: 25332 - DNA, 561 bp, Homo sapiens
tggccaggctggtcttgaactcctggcctcaagtgatccacccctctcagcctcccagagtgctgggattacaggcatgagcaccatgcctgacctggaaattttaaattatatttttcctatatttctacctgattctctgacctcagcagaatcttctttattaatacagttatggaaatggaatgaggaggaggtgattgctgtatgaagatcttacaagactaaggctaaaagagattaacatcaaaatacatattaccatggagcacatgaatatagtgaataaaaatttgttcatcaaagcctgctacagtataaaacattgcttgaaatttgaaagaaatgattttagaacaaataaatggtcatgattatacaccatgcacactcaagcacacacaacaatatacatgtagaaatagatgtatctgtatgtgagtttatgtactatatatgtgtgtatttcttaaccttctcttctgaagagcctagaagcaatgacaaccctagggaatactccaagtacccaaatattggtttctgagtctcttcctccac

SEQ ID NO: 25333 - DNA, 491 bp, Homo sapiens
aatgtgtttggggcggcccgctttgcctgctggagggtgttaacacttagcttgcttttcggcgtattctgatttagctttgggagagctaactttattggtcttaggtgttcagtgctacctggcccactgcttgtctgtttgtgacttttaagtcagaaactggagatggtaagatccgataatttccctaacttaatacatcgcggtccctctcactagcaactcctaggtatgtgacaaagttgggatgtttatcaacggtccgcctcctggctagggaaagagctctggggcggagaatgcactttctgttttttgaaaacaacctcattttgtgcccttaaaagccactggggatgacggatccaggattgtgggtggaggtagtgggtttttcatcccctgactatggggccaacttctgccagccattgttttttctaataaagattgtgtggttcctttttaaaaaatttcccctgcgctta

SEQ ID NO: 25334 - DNA, 618 bp, Homo sapiens
gtgaatggacacttaggttgattccaaatcttagctcttgtgaacagtgctgcagtaaacatgggagcagagatatctcattgatgtactgatttcttttcttttgggcatatacctagcagtgggattgctggatcatatgatagctctatttttagttttttcaggaacttccaaactgttctctttcagccatatgaagtgaaaaccatgctctgtaagtgctcacctgacttttagttcctgtgaaactgctgcttttgtgtggatagttgccaatcttagtcttcctgcggggggagtgggtatgatcggtggtgttctctattccaccatcttgctccacccatcctaaaaatgttttcttaggaaactcataacataatgaacaacataggttgataaagtatataaaaagataaactgtacaaacattaatcaaaacagagtgacactattaatatcaaatacagtagactccagagcaaagaaaattattagacaaaaggaacattatataatgataaaaggatcaatccaacaaaaatgcaatgatcctaaatgtgtctctagcaaacctcaaagtacacaaaacaaaactgattgagctgaaaagag

SEQ ID NO: 25335 - DNA, 453 bp, Homo sapiens
tccacccgcctcagcttcccaaagtgctgggattacaggcatgagtcaccatgcctagcctacaatttgacgtattttaagaggagcgttacttttctacatgtgtcccttagaatggaatgaatctgaggtaagcaatagagccaagaggaccagttaggataacatataataatccaagtgaaaattctgaggctctgacttagtaacaggaggaatggaaagaagaggggcatgtggcagccacagaggtgcactcgggtttgccttcaagaaaggacttgttaaatcccaaggagtacagttccccaacctcctctagtggtaatgttctgggcatctgccattgcactggaattgagtttccactcaccccatgtagccctaagccaatggctgcacatggccacaacactaggatttagccgttcttgtccaactttgttctcgtct

SEQ ID NO: 25336 - DNA, 405 bp, Homo sapiens
aaaaaaaaaaaagagagagagagaaatccttatcttttatggtggaagtcaataaaaaaagtctgcaatgaaaaatagatcagagcctttaaatatgaaggtaaattttgaaaatagaggccgggcgcggtggctcacgcctataatcccagcactttgggaggccgaggcaggcggatcttgaggtcaggagatcgagaccatcctggctaacacagtgaaaccccatctctactaaaaaatacaaaaaaatagccacgcgtgttggcgggtgcctgtagtcccagctacttaggaggctgaggcaggagaatggcatgaacccaggaggcggagcttgcagtgagccaagatcatgccactgcactccagcctgggtgacagagcgagactccatctcaaaaa

SEQ ID NO: 25337 - DNA, 2417 bp, Homo sapiens
atctaggctcagttatgtttactaacatgaatcttacttaacagcatgaggcaagatctacgctcaagatggcgctgctcgcgatgcattcttggcgctgggcggccgcggcggctgctttcgaaaagcgccggcactccgcgattctgatccggcctttagtctctgttagcggctcaggtccgcagtggaggccacatcaactcggcgccttgggaaccgctcgagcctaccagattccagagtcattaaaaagtatcacatggcagagattgggaaaaggcaattcaggacagttcttagatgctgcaaaggctctccaggtatggccactgatagaaaagaggacatgttggcatggtcatgcaggaggaggactccacacagacccaaaagaagggttaaaagatgttgatactcggaaaatcataaaagcaatgctttcttatgtgtggcccaaagacaggccagatctacgagctagagttgccatttcgctgggatttttgggtggtgcaaaggccatgaatattgtggttcccttcatgtttaaatatgctgtagacagcctcaaccagatgtcgggaaacatgctgaacctgagtgatgcaccaaatacagttgcaaccatggcaacagcagttctgattggctatggtgtatcaagagctggagctgctttttttaacgaagttcgaaatgcagtatttggcaaggtagcccagaattcaatccgaagaatagccaaaaatgtctttctccatcttcacaacctggatctgggttttcacctgagcagacagacgggagctttatctaaggctattgacagaggaacaaggggtatcagttttgtcctgagtgctttggtatttaatcttcttcccatcatgtttgaagtgatgcttgtcagtggtgttttgtattacaaatgcggtgcccagtttgctttggtaacccttggaacacttggtacatacacagcattcacagttgcagtcacacggtggagaactagatttagaatagaaatgaacaaagcagataatgatgcaggtaatgctgctatagactcactgctgaattatgaaactgtgaagtattttaataatgaaagatatgaagcacagagatatgatggatttttgaagacgtatgagactgcttcattgaaaagtacctctactctggctatgctgaactttggtcaaagtgctattttcagtgtcggtttaacagctataatggtgctcgccagtcagggaattgtggcaggtacccttactgttggagatctagtaatggtgaatggactgctttttcagctttcattacccctgaactttctgggaactgtatatagagagactagacaagcactcatagatatgaacaccttgtttactctactcaaggtagacacccaaattaaagacaaagtgatggcatctccccttcagatcacaccacagacagctaccgtggcctttgataatgtgcattttgaatacattgagggccagaaagtccttagtggaatatcctttgaagtccctgcaggaaagaaagtggccattgtaggaggtagtgggtcagggaaaagcacaatagtgaggctattatttcgcttctatgagcctcaaaagggtagcatttatcttgctggtcaaaatatacaagatgtgagcctggaaagccttcggagggcagtgggagtggtacctcaggatgctgtcctcttccataatactatttattacaacctcttatatggaaacatcagtgcttcacctgaggaagtgtatgcagtggcaaaattagctggacttcatgatgcaattcttcgaatgccacatggatatgacacccaagtaggggaacgaggactcaagctttcaggaggagaaaagcaaagagtagcaattgcaagagccattttgaaggaccccccagtcatactctatgatgaagctacttcatcgttagattcgattactgaagagactattcttggtgccatgaaggatgtggtcaaacacagaacttctattttcattgcacacagattgtcaacagtggttgatgcagatgaaatcattgtcttggatcagggtaaggtagccgaacgtggtacccaccatggtttgcttgctaaccctcatagtatctattcagaaatgtggcatacacagagcagccgtgtgcagaaccatgataaccccaaatgggaagcaaagaaagaaaatatatccaaagaggaggaaagaaagaaactacaagaagaaattgtcaatagtgtgaaaggctgtggaaactgttcgtgctaagtcacataagacattttctttttttgttgttttggactacatatttgcactgaagcagaattgttttattaaaaaaatcatacattccca

SEQ ID NO: 25338 - DNA, 418 bp, Homo sapiens
gatggtgggtccaaaccaccagaacctccctttttccattggccaccaccagattggtccaaccagtgggttgattgccaggatggaaatccattggtccttgggatccaggggtaaggtagccgaacgtggtacccaccatggtttgcttgctaaccctcatagtatctattcagaaatgtggcatacacagagcagccgtgtgcagaaccatgataaccccaaatgggaagcaaagaaagaaaatatatccaaagaggaggaaagaaagaaactacaagaagaaattgtcaatagtgtgaaaggctgtggaaactgttcgtgctaagtcacataagacattttctttttttgttgttttggactacatatttgcactgaagcagaattgttttattaaaaaaatcatacattccca

SEQ ID NO: 25339 - DNA, 2726 bp, Homo sapiens
  misc_feature (2415)..(2415): n is a, c, g, or t
  misc_feature (2418)..(2418): n is a, c, g, or t
  misc_feature (2423)..(2423): n is a, c, g, or t
tgtcccataatcctcttctctcggttcctctttcctcgctcaagatggcgctgctcgcgatgcattcttggcgctgggcggccgcggcggctgctttcgaaaagcgccggcactccgcgattctgatccggcctttagtctctgttagcggctcaggtccgcagtggaggccacatcaactcggcgccttgggaaccgctcgagcctaccagattccagagtcattaaaaagtatcacatggcagagattgggaaaaggcaattcaggacagttcttagatgctgcaaaggctctccaggtatggccactgatagaaaagaggacatgttggcatggtcatgcaggaggaggactccacacagacccaaaagaagggttaaaagatgttgatactcggaaaatcataaaagcaatgctttcttatgtgtggcccaaagacaggccagatctacgagctagagttgccatttcgctgggatttttgggtggtgcaaaggccatgaatattgtggttcccttcatgtttaaatatgctgtagacagcctcaaccagatgtcgggaaacatgctgaacctgagtgatgcaccaaatacagttgcaaccatggcaacagcagttctgattggctatggtgtatcaagagctggagctgctttttttaacgaagttcgaaatgcagtatttggcaaggtagcccagaattcaatccgaagaatagccaaaaatgtctttctccatcttcacaacctggatctgggttttcacctgagcagacagacgggagctttatctaaggctattgacagaggaacaaggggtatcagttttgtcctgagtgctttggtatttaatcttcttcccatcatgtttgaagtgatgcttgtcagtggtgttttgtattacaaatgcggtgcccagtttgctttggtaacccttggaacacttggtacatacacagcattcacagttgcagtcacacggtggagaactagatttagaatagaaatgaacaaagcagataatgatgcaggtaatgctgctatagactcactgctgaattatgaaactgtgaagtattttaataatgaaagatatgaagcacagagatatgatggatttttgaagacgtatgagactgcttcattgaaaagtacctctactctggctatgctgaactttggtcaaagtgctattttcagtgtcggtttaacagctataatggtgctcgccagtcagggaattgtggcaggtacccttactgttggagatctagtaatggtgaatggactgctttttcagctttcattacccctgaactttctgggaactgtatatagagagactagacaagcactcatagatatgaacaccttgtttactctactcaaggtagacacccaaattaaagacaaagtgatggcatctccccttcagatcacaccacagacagctaccgtggcctttgataatgtgcattttgaatacattgagggccagaaagtccttagtggaatatcctttgaagtccctgcaggaaagaaagtggccattgtaggaggtagtgggtcagggaaaagcacaatagtgaggctattatttcgcttctatgagcctcaaaagggtagcatttatcttgctggtcaaaatatacaagatgtgagcctggaaagccttcggagggcagtgggagtggtacctcaggatgctgtcctcttccataatactatttattacaacctcttatatggaaacatcagtgcttcacctgaggaagtgtatgcagtggcaaaattagctggacttcatgatgcaattcttcgaatgccacatggatatgacacccaagtaggggaacgaggactcaagctttcaggaggagaaaagcaaagagtagcaattgcaagagccattttgaaggaccccccagtcatactctatgatgaagctacttcatcgttagattcgattactgaagagactattcttggtgccatgaaggatgtggtcaaacacagaacttctattttcattgcacacagattgtcaacagtggttgatgcagatgaaatcattgtcttggatcagggtaaggtagccgaacgtggtacccaccatggtttgcttgctaaccctcatagtatctattcagaaatgtggcatacacagagcagccgtgtgcagaaccatgataaccccaaatgggaagcaaagaaagaaaatatatccaaagaggaggaaagaaagaaactacaagaagaaattgtcaatagtgtgaaaggctgtggaaactgttcgtgctaagtcacataagacattttctttttttgttgttttggactacatatttgcactgaagcagaattgttttattaaaaaaatcatacattcccaaaaaaaaaaaaaaaaaaaaaanaancaaanacagttttgggggcggcgcccgcgggcacccgcagaaagagacgttcttagaaaccacactttgctggtggggggccgcggggcgacccccaaaagtgaataaagagaacacgcttgcccacagaggggtgtcccgcgaagaaaaaccggggcgcgacgacacaagggcggggggtcctccaccaaaaaaaaaaccggcggggggaacagagggtgttggcgaaaacaccccacgatgggtctggagagcacaaggggactcacagagagagtcaagaggcctaaataaatagccccacggtg

SEQ ID NO: 25340 - DNA, 2113 bp, Homo sapiens
tgtcccataatcctcttctctcggttcctctttcctcgctcaagatggcgctgctcgcgatgcattcttggcgctgggcggccgcggcggctgctttcgaaaagcgccggcactccgcgattctgatccggcctttagtctctgttagcggctcaggtccgcagtggaggccacatcaactcggcgccttgggaaccgctcgagcctaccagattccagagtcattaaaaagtatcacatggcagagattgggaaaaggcaattcaggacagttcttagatgctgcaaaggctctccaggtatggccactgatagaaaagaggacatgttggcatggtcatgcaggaggaggactccacacagacccaaaagaagggttaaaagatgttgatactcggaaaatcataaaagcaatgctttcttatgtgtggcccaaagacaggccagatctacgagctagagttgccatttcgctgggatttttgggtggtgcaaaggccatgaatattgtggttcccttcatgtttaaatatgctgtagacagcctcaaccagatgtcgggaaacatgctgaacctgagtgatgcaccaaatacagttgcaaccatggcaacagcagttctgattggctatggtgtatcaagagctggagctgctttttttaacgaagttcgaaatgcagtatttggcaaggtagcccagaattcaatccgaagaatagccaaaaatgtctttctccatcttcacaacctggatctgggttttcacctgagcagacagacgggagctttatctaaggctattgacagaggaacaaggggtatcagttttgtcctgagtgctttggtatttaatcttcttcccatcatgtttgaagtgatgcttgtcagtggtgttttgtattacaaatgcggtgcccagtttgctttggtaacccttggaacacttggtacatacacagcattcacagttgcagtcacacggtggagaactagatttagaatagaaatgaacaaagcagataatgatgcaggtaatgctgctatagactcactgctgaattatgaaactgtgaagtattttaataatgaaagatatgaagcacagagatatgatggatttttgaagacgtatgagactgcttcattgaaaagtacctctactctggctatgctgaactttggtcaaagtgctattttcagtgtcggtttaacagctataatggtgctcgccagtcagggaattgtggcaggtacccttactgttggagatctagtaatggtgaatggactgctttttcagctttcattacccctgaactttctgggaactgtatatagagagactagacaagcactcatagatatgaacaccttgtttactctactcaaggtagacacccaaattaaagacaaagtgatggcatctccccttcagatcacaccacagacagctaccgtggcctttgataatgtgcattttgaatacattgagggccagaaagtccttagtggaatatcctttgaagtccctgcaggaaagaaagtggccattgtaggaggtagtgggtcagggtgggtaatttagttatttgtaaaattctgtattataggctgatgattcccaatgtaatatttctttctttatcaaaatgattactgtggtttaaaactggggtttcctaacattaataggagctaaataacctttcttcatctccaatttcaggaaaagcacaatagtgaggctattatttcgcttctatgagcctcaaaagggtagcatttatcttgctggtcaaaatatacaagatgtgagcctggaaagccttcggagggcagtgggagtggtacctcaggtatttaaaaacagaaaaaaacaaatttttggaggatttattgggttgatcaatccgtaactagaacagtttgaatcaagggatcaacatatgctactgaagtagtcagtattagaccctaccagtgaaattctggtatcaaaagggattttttaaaaaaggaaaagaaaaaacttgaaggaaaaatctgcatgataggaagccctggaatgatagcataatagaatacaaagaacacagacctggattctaaccc

SEQ ID NO: 25341 - DNA, 1321 bp, Homo sapiens
ggttagcgtgtacttatacattattggttgctggtagggccatatttagaagacatttgggcaataatatcaaaggataaaagtatgcttacctttaaactcatcagtctacttctaggaattcttacagaaacacacagttgtacaaagtcatatacataatgttttattccaacattgtagtagcataaacttggaaatcacattaatgtccatcagtaggagaatgtataaataaattatgacatttccatagtatggaatatacaactgttaaaaagaatgagttagttttctgttattgacatggacaatctctatgatatgttaactgaaaaaagcaattgcaaaataatatgtgtagaatgaccatacttgtgttaggggaaagaaacatatgtttaggtatataaattcacaggaagaagtctggaatgatgcacactaaattgtttatgatgactacccctgggaagggaatgggattttgcagatgagggatgatgaaagggactgtcatgttttaccctttatgcctttgtctctttactatttgaatttttaataatgaacataaatagagagagatatatagatatagatatatattcattcagtatatctgcttcaggatgctgtcctcttccataatactatttattacaacctcttatatggaaacatcagtgcttcacctgaggaagtgtatgcagtggcaaaattagctggacttcatgatgcaattcttcgaatgccacatggatatgacacccaagtaggggaacgaggactcaagctttcaggaggagaaaagcaaagagtagcaattgcaagagccattttgaaggaccccccagtcatactctatgatgaagctacttcatcgttagattcgattactgaagagactattcttggtgccatgaaggatgtggtcaaacacagaacttctattttcattgcacacagattgtcaacagtggttgatgcagatgaaatcattgtcttggatcagggtaaggtagccgaacgtggtacccaccatggtttgcttgctaaccctcatagtatctattcagaaatgtggcatacacagagcagccgtgtgcagaaccatgataaccccaaatgggaagcaaagaaagaaaatatatccaaagaggaggaaagaaagaaactacaagaagaaattgtcaatagtgtgaaaggctgtggaaactgttcgtgctaagtcacataagacattttctttttttgttgttttggactacatatttgcactgaagcagaattgttttattaaaaaaatcatacattccca

SEQ ID NO: 25342 - DNA, 654 bp, Homo sapiens
ctcagtaaaatgaactgtgatcaggagaataaggaaatgttcagtgtattacttggtggttgtaatcaatggaaacactaaaaacataaaatatgcatgcactatgcttccttaaagtaaaattttcctttaccaggaggagaaaagcaaagagtagcaattgcaagagccattttgaaggaccccccagtcatactctatgatgaagctacttcatcgttagattcgattactgaagagactattcttggtgccatgaaggatgtggtcaaacacagaacttctattttcattgcacacagattgtcaacagtggttgatgcagatgaaatcattgtcttggatcagggtaaggtagccgaacgtggtacccaccatggtttgcttgctaaccctcatagtatctattcagaaatgtggcatacacagagcagccgtgtgcagaaccatgataaccccaaatgggaagcaaagaaagaaaatatatccaaagaggaggaaagaaagaaactacaagaagaaattgtcaatagtgtgaaaggctgtggaaactgttcgtgctaagtcacataagacattttctttttttgttgttttggactacatatttgcactgaagcagaattgttttattaaaaaaatcatacattccca

SEQ ID NO: 25343 - DNA, 569 bp, Homo sapiens
atctaggctcagttatgtttactaacatgaatcttacttaacagcatgaggcaagatctacgctcaagatggcgctgctcgcgatgcattcttggcgctgggcggccgcggcggctgctttcgaaaagcgccggcactccgcgattctgatccggcctttagtctctgttagcggctcaggtccgcagtggaggccacatcaactcggcgccttgggaaccgctcgagcctaccaggtgagatgccactgacatggaagaatagggtgaagggcaaggggacctgtagggaaaaggttgccctcctgacctcggggcagagagagcaccaagaagaaagtcatggctaactgggagcagcagtaagtgaaggaaattaacgtcagtaatttgaggaaagggcgaagaagaaaacctttgagttcagcaaagggaaacggggcaggaggttctgggcagaggacacctggagcgctggaggctctcggagtcatagtttttctctcatattaagagttggggtagacaccattcccagcctgcttgcctttctaaagacgaggaagactg

SEQ ID NO: 25344 - DNA, 2393 bp, Homo sapiens
tgtcccataatcctcttctctcggttcctctttcctcgctcaagatggcgctgctcgcgatgcattcttggcgctgggcggccgcggcggctgctttcgaaaagcgccggcactccgcgattctgatccggcctttagtctctgttagcggctcaggtccgcagtggaggccacatcaactcggcgccttgggaaccgctcgagcctaccagattccagagtcattaaaaagtatcacatggcagagattgggaaaaggcaattcaggacagttcttagatgctgcaaaggctctccaggtatggccactgatagaaaagaggacatgttggcatggtcatgcaggaggaggactccacacagacccaaaagaagggttaaaagatgttgatactcggaaaatcataaaagcaatgctttcttatgtgtggcccaaagacaggccagatctacgagctagagttgccatttcgctgggatttttgggtggtgcaaaggccatgaatattgtggttcccttcatgtttaaatatgctgtagacagcctcaaccagatgtcgggaaacatgctgaacctgagtgatgcaccaaatacagttgcaaccatggcaacagcagttctgattggctatggtgtatcaagagctggagctgctttttttaacgaagttcgaaatgcagtatttggcaaggtagcccagaattcaatccgaagaatagccaaaaatgtctttctccatcttcacaacctggatctgggttttcacctgagcagacagacgggagctttatctaaggctattgacagaggaacaaggggtatcagttttgtcctgagtgctttggtatttaatcttcttcccatcatgtttgaagtgatgcttgtcagtggtgttttgtattacaaatgcggtgcccagtttgctttggtaacccttggaacacttggtacatacacagcattcacagttgcagtcacacggtggagaactagatttagaatagaaatgaacaaagcagataatgatgcaggtaatgctgctatagactcactgctgaattatgaaactgtgaagtattttaataatgaaagatatgaagcacagagatatgatggatttttgaagacgtatgagactgcttcattgaaaagtacctctactctggctatgctgaactttggtcaaagtgctattttcagtgtcggtttaacagctataatggtgctcgccagtcagggaattgtggcaggtacccttactgttggagatctagtaatggtgaatggactgctttttcagctttcattacccctgaactttctgggaactgtatatagagagactagacaagcactcatagatatgaacaccttgtttactctactcaaggtagacacccaaattaaagacaaagtgatggcatctccccttcagatcacaccacagacagctaccgtggcctttgataatgtgcattttgaatacattgagggccagaaagtccttagtggaatatcctttgaagtccctgcaggaaagaaagtggccattgtaggaggtagtgggtcagggaaaagcacaatagtgaggctattatttcgcttctatgagcctcaaaagggtagcatttatcttgctggtcaaaatatacaagatgtgagcctggaaagccttcggagggcagtgggagtggtacctcaggatgctgtcctcttccataatactatttattacaacctcttatatggaaacatcagtgcttcacctgaggaagtgtatgcagtggcaaaattagctggacttcatgatgcaattcttcgaatgccacatggatatgacacccaagtaggggaacgaggactcaagctttcaggaggagaaaagcaaagagtagcaattgcaagagccattttgaaggaccccccagtcatactctatgatgaagctacttcatcgttagattcgattactgaagagactattcttggtgccatgaaggatgtggtcaaacacagaacttctattttcattgcacacagattgtcaacagtggttgatgcagatgaaatcattgtcttggatcagggtaaggtagccgaacgtggtacccaccatggtttgcttgctaaccctcatagtatctattcagaaatgtggcatacacagagcagccgtgtgcagaaccatgataaccccaaatgggaagcaaagaaagaaaatatatccaaagaggaggaaagaaagaaactacaagaagaaattgtcaatagtgtgaaaggctgtggaaactgttcgtgctaagtcacataagacattttctttttttgttgttttggactacatatttgcactgaagcagaattgttttattaaaaaaatcatacattccca

SEQ ID NO: 25345 - DNA, 2547 bp, Homo sapiens
tgtcccataatcctcttctctcggttcctctttcctcgctcaagatggcgctgctcgcgatgcattcttggcgctgggcggccgcggcggctgctttcgaaaagcgccggcactccgcgattctgatccggcctttagtctctgttagcggctcaggtccgcagtggaggccacatcaactcggcgccttgggaaccgctcgagcctaccagattccagagtcattaaaaagtatcacatggcagagattgggaaaaggcaattcaggacagttcttagatgctgcaaaggctctccaggtatggccactgatagaaaagaggacatgttggcatggtcatgcaggaggaggactccacacagacccaaaagaagggttaaaagatgttgatactcggaaaatcataaaagcaatgctttcttatgtgtggcccaaagacaggccagatctacgagctagagttgccatttcgctgggatttttgggtggtgcaaaggccatgaatattgtggttcccttcatgtttaaatatgctgtagacagcctcaaccagatgtcgggaaacatgctgaacctgagtgatgcaccaaatacagttgcaaccatggcaacagcagttctgattggctatggtgtatcaagagctggagctgctttttttaacgaagttcgaaatgcagtatttggcaaggtagcccagaattcaatccgaagaatagccaaaaatgtctttctccatcttcacaacctggatctgggttttcacctgagcagacagacgggagctttatctaaggctattgacagaggaacaaggggtatcagttttgtcctgagtgctttggtatttaatcttcttcccatcatgtttgaagtgatgcttgtcagtggtgttttgtattacaaatgcggtgcccagtttgctttggtaacccttggaacacttggtacatacacagcattcacagttgcagtcacacggtggagaactagatttagaatagaaatgaacaaagcagataatgatgcaggtaatgctgctatagactcactgctgaattatgaaactgtgaagtattttaataatgaaagatatgaagcacagagatatgatggatttttgaagacgtatgagactgcttcattgaaaagtacctctactctggctatgctgaactttggtcaaagtgctattttcagtgtcggtttaacagctataatggtgctcgccagtcagggaattgtggcaggtacccttactgttggagatctagtaatggtgaatggactgctttttcagctttcattacccctgaactttctgggaactgtatatagagagactagacaagcactcatagatatgaacaccttgtttactctactcaaggtagacacccaaattaaagacaaagtgatggcatctccccttcagatcacaccacagacagctaccgtggcctttgataatgtgcattttgaatacattgagggccagaaagtccttagtggaatatcctttgaagtccctgcaggaaagaaagtggccattgtaggaggtagtgggtcagggtgggtaatttagttatttgtaaaattctgtattataggctgatgattcccaatgtaatatttctttctttatcaaaatgattactgtggtttaaaactggggtttcctaacattaataggagctaaataacctttcttcatctccaatttcaggaaaagcacaatagtgaggctattatttcgcttctatgagcctcaaaagggtagcatttatcttgctggtcaaaatatacaagatgtgagcctggaaagccttcggagggcagtgggagtggtacctcaggatgctgtcctcttccataatactatttattacaacctcttatatggaaacatcagtgcttcacctgaggaagtgtatgcagtggcaaaattagctggacttcatgatgcaattcttcgaatgccacatggatatgacacccaagtaggggaacgaggactcaagctttcaggaggagaaaagcaaagagtagcaattgcaagagccattttgaaggaccccccagtcatactctatgatgaagctacttcatcgttagattcgattactgaagagactattcttggtgccatgaaggatgtggtcaaacacagaacttctattttcattgcacacagattgtcaacagtggttgatgcagatgaaatcattgtcttggatcagggtaaggtagccgaacgtggtacccaccatggtttgcttgctaaccctcatagtatctattcagaaatgtggcatacacagagcagccgtgtgcagaaccatgataaccccaaatgggaagcaaagaaagaaaatatatccaaagaggaggaaagaaagaaactacaagaagaaattgtcaatagtgtgaaaggctgtggaaactgttcgtgctaagtcacataagacattttctttttttgttgttttggactacatatttgcactgaagcagaattgttttattaaaaaaatcatacattccca

SEQ ID NO: 25346 - DNA, 361 bp, Homo sapiens
ggtggaggtataagctttcgagaatgctttgcctttagagagaaaaacatcctggcctgacccatgtgttaaccaaagatggaatggaactgtccttaccagcctcgtaagtgatgaggttagatgactgagatcatttggcggaggtggatgggaggtgctaatggtcagctcaaggtggcttgttgtgggtaagtggcaataaagagaaaatgttgggtgtgggcactgtacagttagacacagacaaggtccaagtagttgaaaatctagggttagacttgtgctattgcattctttatgacttaataagtggatacatgtccctcactgataaagaaatcctctggaccccaatttt

SEQ ID NO: 25347 - DNA, 726 bp, Homo sapiens
ttttaatttttgtggcttatttttagtacccagccttaatagagttgagcaaaatagagattacgtttccatgacataataaattttggtaatttcagaaagcaaaaaatactggaatcttttcaatccaagtcgattggatacatagcagttcaatttgaacacagcagttcaatttatttgttaacaaattctgcagtgtcttcctgtaagaatctgtaaaaatcctcatcagcatttgaagatgcaccccctcacttttgtaattggttaacagaagcttctatcttttcacatccctttagtgatctcactgtttactcttcaagctgtatagtggcagctgtttatatgcttgcatacacatggtttattggaatgttctcttcaaattgaaattatttatgtttcaaaatttatatacacatactatctatgaaaaatcctgcacaattgtgtattttttttgctgtggatactgcataaataaaatttaaaataagaaagatgtttctcttctttacattattactctatctaagcctactgatattagttaaacattgttattttctggcaacgatgtctttgatgtgtgacacattcttgctggaatccagcctgtggctgattgtattttctagaaagggctgcactaatacatagcccatcccacccacatgctcttcttgcaatgtgacaacaataaatgacattgtctaacct

SEQ ID NO: 25348 - DNA, 397 bp, Homo sapiens
ttgaagtttgggggaagcaaaattaggataacagacataaggtgccggagataaaacatcaaaatggggacaactgctgccttagctaggaagcctttctgtaatttcccctgagtgatagaaatgataggaagtggcatctcagactgaagatatgactgaataaggcttattagaaaaaaggcaagtaggtttatctggatggaatgaagtacagggacttgctgctggcagcagcaccctccaagttatgcctggagatcaagagtgacaatgggccgggtacggtggctcctgcctgtaatcctttgggaggccaaggcaggaagattacctgaggccaggagttcgaggccagcctggtcaacacagtgacacccagtctccacaaattgtt

SEQ ID NO: 25349 - DNA, 208 bp, Homo sapiens
tgactgcggacgaatcggcgtttgccgaggctggcatagatttggctgtctccgctcatagctgcttttggcgcgaaagatgccgggtctggttgactcaaaccctgccccgcctgagtctcaggagaagaagccgctgaagccctgctgcgcttgcccggagaccaagaaggcgcgcgatgcgtgtatcagtgcgcagccggagaga

SEQ ID NO: 25350 - DNA, 476 bp, Homo sapiens
atggttgccaaatcgacttttatttttcatttggattactgctttgctttgcagtgttggaacttatttgttggagaaatgtcttcagagtcagaaaaggataaagagagactgattcaagctgccaaaatgttcttctttcatgtacaagatcttgcttctgtcataaacacactgactgaattgtttagccgcagtatgaatactcaaatccttttgatggctgtgaaaaacaatagttacattaaggatttttttgagcaaatgctcaaaatttttaaggagatgcaatctgtagtggatgcaagacatgacaaaattcaaaaggagtctttatgttccaaggttgcaatggccatgtgctctgtggttcagaagagtaccaatgtagaggagttgcatcagtcagctaaagaagtattcaaaagtgcccatacgccagtcatcatctctgtgctaaacagcagtaacatcct

SEQ ID NO: 25351 - DNA, 1136 bp, Homo sapiens
tccaggaccagagtctcttccggttccatacaatactcaattggttggttgtcggctaagagcccgcctcattgcgctcatctagtacaataggaattagaagaagatagctgctaactgagtggctgacggtcctgtctctcgagttggaggcatcttgacttagttgctgggagcctgtgttggaacttatttgttggagaaatgtcttcagagtcagaaaaggataaagagagactgattcaagctgccaaaatgttcttctttcatgtacaagatcttgcttctgtcataaacacactgactgaattgtttagccgcagtatgaatactcaaatccttttgatggctgtgaaaaacaatagttacattaaggatttttttgagcaaatgctcaaaatttttaaggagatgcaatctgtagtggatgcaagacatgacaaaattcaaaaggagtctttatgttccaaggttgcaatggccatgtgctctgtggttcagaagagtaccaatgtagaggagttgcatcagtcagctaaagaagtattcaaaagtgcccatacgccagtcatcatctctgtgctaaacagcagtaacatccttgggagtctggaatcttctctttcacacttgatgaaattccccatcatgaatcttcaattaagtgacttctatacagaagacaccaaagagcaatcagatgtcaccacatctgagagaaccagaagtcctccaggttcttccaaaaccactatgatagacaccttgaaaaaactgcaggatgtactaaaaactgaggattccaaaaatcccacaaagtcagcagcagatttgttggaacaaattgtcaaggctatgggaccaatcttagagatcctccaaaaagcgataaagactatggaaatgaatatttctgtgtttaagaaagccagtgacaagtagggatgcaacagaaatgttcatttctgtcagaaaactacttaaaatcttatggtttttcatagtagtttctaagatcttttggtgccaaacatgtgctatgttagaacataagtacacaaaagtcatctggcaaaacatttacctgtagttttgctttattaaaataaaaagaaataattaagaaaaaaaaaaaa

SEQ ID NO: 25352 - DNA, 314 bp, Homo sapiens
catctctactaaaaatacaaaaaattagcaacagagcgcgattccgtctcaaaaaaaaagtaactttttaaaactttctatcatgaaaaaatttgaacatatacaaaaatacacagaatcttatattgaactccagcggcctcatcaccagcttcaagaattatcagctcatggccaatcttgctttgtctgtgtacccacttctctcatctctgttatttttgaagtaaataccagatatattatttcatccacagacatttcatacatatctttaaagcacatgacaacattagaaaatattttcactcctt

SEQ ID NO: 25353 - DNA, 866 bp, Homo sapiens
tagcacttttaacatagtccctgtcaagtaattcaacaatagttgaacaattgctaattgaatgaattctgaaagtttcacaaattagacctgaaaggaaagattatttttctcacctgtttttcttgaagtttcaaattattttgaactacaaatggtatttcactagtaagtgtgaaaatttattgtgaatataattaatgtcttgcaatgtgtgatgagaaaggtggctatagtacactagattgttaacattgtacaaagtacaaaagttctttggaaatgttgaatgactgcagtgtggccattattacttttttcctggggtaagaaggaaatgcgataattaaaaaaaaggcaggggattggtagtactttattaaagaaatcttatgttgctaagataatttagtcatgtaattttttaaaaaacaggctatttaaaataatgtttgctttttccttcttcttctccttttttttttttttttgaaaagcatcctcctgccttggccatccagagtgctaggattacaggcatgagccatggcgcccggacttttcctccttttatttcaaccatgacaatgtattttggctctctgctgatttaaattatatttcgtggaaaacagtatgacgtccaaaatgctcatataaccttgaacttgaaattattttcctgagaaaatttgtccttctgactgatgctctttagtgtataaaggtattagttgtaattgattggcttcttaaatgttggaagtatggtgttaaggcagatagatttctttatttcttgaggggtggagattagattttgatactggaccaaaaaatgatttttcctgatataggtttgaatt

SEQ ID NO: 25354 - DNA, 484 bp, Homo sapiens
gtacatatttcagaatgccaacttcaaggaaatccacagaacttataaataccatagttttgctattgatttcagtctaagacaaatttcttttgtcggagcccaataacctaagtgtggttatgtgaaatttattgaatattgctttctgggggtggtcgggagctgcaaccccaagagacatggccagttttctatgttctgggaaaaaagaaaagagaattgccctctgtcagtcccctgaaaacaccagccatcctcttttctgagtcccatggtgtttgaatctgctccggctcctgttttatatcccatccttctccattttggtcagaaatattttctgttaccctgagattagcttgtactctaacagaaagaaagaaaattcctgtttaagattataagtggttcacttttagaattatctttttgctagtgccaaaagtttaatttattgttaagaataatgatttttttaatt

SEQ ID NO: 25355 - DNA, 510 bp, Homo sapiens
tgattgtgagcgccgtttgacagcagagcccactggcatttcttatggtcttggacctggaggtgttgtcaggggaaagggaagaggtgcaatgaccccagtgttggcctgagccactggtagaggagtgtggagaggggaccctgtgctcctggcctccctcccgtggcctccggcatgggtcgaccttggccgagcgtgaggctggtgccacctcagcctcccagaccctgagtagggttaacacctccagacccgaaatggcctccggttgaccgggcccactccccatcagcctgtccagccagccagcacttactgagtgccttctgtgtactaagccctgctctgggtacttccatgagtcaactcacgccctcccggcctcagggtgatccaccgccttcccctacagtattccaaggggccattggacctcagaggcttcatgtcctgcacattctccgtgtcatagagcaggaaaaaataaaaacgggagatcgaattcta

SEQ ID NO: 25356 - DNA, 792 bp, Homo sapiens
tacaagcaattacttgacttgcaaaatctgcttgatatgaagtgtgttgtaatggttttctgctgctactcctctgaagtcctgagtgtttccaccatccagggggaaacagctaatatctatctgcctgttctaaaacattacgtgcaagtacatacacacataatccctttccatcttctgagatttagcaaacgattacatgttgaacaatttagcagtctattgagtgacttttcatttgctattaaagtacgcagatatatggtcctagggaatgcgcatgggctttcgttgtatatcttgggacctacaatttctggcatgttaggcaagttacttaactctgaggttctatattttgaactgtaaagtgaaaatgatgatagtcattgagttgcaaggaaagaattataatgaagtcatgaggggtcaggtttcctgagttcgaatccttctttcaccactgtagtggatgctgtagtgctccactcagattccagaactgagaaactcatgcccatggctgctggaattatgggttgttgatatctcacagccaagtttcttctcaggaaatgtcctctcttggtcaaagagagctgctctgtctaatgctacacccttctcctggggacagtctgaaaggcttcaaagtcttggcattccttcttcaattcagccctccagaaatgcctgggaagtcacctgtaaccagtctgacccagtcttgcttctctgaccccctgacaggtcctggtccagaaaacacccccaataaactttacacaa

SEQ ID NO: 25357 - DNA, 297 bp, Homo sapiens
tctgtacacccatttttgttctaatcttgtcactgaagctggttgcctaaaatcgtcaggctacatagaccaaggctactctgatccccagagatccaagtctttatttttgtcatggggttataaaatttcaaaactggaaaaaaaaaaaggcaaaatggtatgcttctcaagcattaatgtgcatagagtcacctaaagatcttgttaaaatgcaaattccagggccctacccccagagattctgattaggaaagtctggggtgggcactgggaatctgcattgcaatgagctcc

SEQ ID NO: 25358 - DNA, 334 bp, Homo sapiens
ctcccaagaagcaggggagatttcccaccaaaccgatatgatgaagaccagttaattatttcctttctccctcaaaaatgccctgaagcccttgctgggggctgctcctgggctctggcatcaggactaatggttgctgaggcagcctggtcaagtgaaaatggagccgttggcgcgtgtgagatggaagccaggagagaccacagggaacctgccaggcttgagtctagttctgccagccctcagtcaaggcccctattccaccctcctgccaattacaggcagtcattcccccatccccttagggaaaggccaaggggaggcccgagaccca

SEQ ID NO: 25359 - DNA, 247 bp, Homo sapiens
ataaacatagcatttacagaagatagtgagaataccactgatttggtatgttggatgctggttgggagaattttatgggaaaaataccagttgagtgaaattatggatgttcttgagaaatagcagagtttgaattgaatgtggctttttgcataaagtggtaattttggaattttggaataggagaatgaataaagatggcatccccaatagttgtcatggctagtcttaggaagggttggatcag

SEQ ID NO: 25360 - DNA, 518 bp, Homo sapiens
taaaaaacaaaaatcacaagatcctctcaaataacacaggaaatccacttaacaaaatccaacactctttcatgataaaaaacactcgagagactaagaatggaaggaaactccctcaacctgttatagggcatctgcccaaaaatccacagttaatgtcatacttaatggtgaaagacagtatgctttcccctaagatcaggaaccagacaaggatttctgctttcaatacttctattcaacattgtactggagtttttcgccagggcattagatgtaaaagaaatagaaaacattcagaatggaaatgaaaaagtaaagctacctctatgcacagatgacatgatcttgtatacagaaaatcctaaggaattcactaaaaagctattaaaatgaataaatgaattcagcaagttgcaggacataagatcaatacataaaaatcaatttgtgttgcacttgtaaagaacaatttaataaatgacattttaaaaacaattgtattaacaacagcacca

SEQ ID NO: 25361 - DNA, 434 bp, Homo sapiens
catcctccagtgcttctctggtgattcccgggaccccactcaggaggtcccacggcagcgggggaccccgagggcctagccggggaggcaggaggaggctggccagccaccaagccacgattcagagcttgtaagggcacctcccgagcccctcaccttcccactctgaggcgaccccatgtcctcgaccgatgatctggcccgggcgcttccctccacggtctagagtggcggcccagctttgagcttggcgcgccttgagcccttccttcagatgtcccgcagtccgtccaccccgcacgtctcctatcagcctatgcacggcgggctccggtcaggtggaggatcagcaggtgggctttcaaaggttggatccgttgcccacgcgaatgaaagaagaaaaaagaaacctctttgagccttgcctgcggccg

SEQ ID NO: 25362 - DNA, 368 bp, Homo sapiens
cacacaagactgaaggtctagctgtgacaggagaccacaatgaggagtcctgaccgtgccgaagctcccatgggatgccaggatgccagccactgctccacgaccccatgctgcattgtacttcaccctcacgagcataggcaatgtgagcactacctctgcagaggatactgaggctcagagagacaaagacatgggcttaagtccacacgactgactgtaaatgacagaaccaaggtacacattccggctttctaatcccaaagccagagtcttcccaacccaccccaaccccatgttcacaggcctgagacccctctcaccccagtactgtgaaaggccccagtaaagacctgtaaaagaacaaa

SEQ ID NO: 25363 - DNA, 167 bp, Homo sapiens
agcaaaaagatattttgaaacagagaattgtatactgacaaaattcgaaaagctagtggaacaggctatagataaggctttgagaaatgtcttctcaaacattaccaaacaactggcagtaacaggggagtaagaggaaactatagtcattccaggaccccactgtt

SEQ ID NO: 25364 - DNA, 239 bp, Homo sapiens
ggttggcgggggcagtggctacagcttaaaaacacaaacagaggagcgctccttttgagtcccactccttcctggcactgatggggaaaataagccccaggaaagggtaagaatcacccaaggacacaactaagatgttctcaaacagatgaccagaaactaagatgactggcctgctggatgacagatcccttaataattcacaaacggtgggttttatttatttactcataaaacag

SEQ ID NO: 25365 - DNA, 300 bp, Homo sapiens
ataactagagccagtggatggaagctataggggtacggattcagcttagtatggaaaatctttctagtaatcaaaaccacgtgaactcctggtgacgtggccacatcccagtggtagcagtgtttaggcagagcctcatggccaacatggacagaatggacgcgggggctgccttccacctccctcagacgcccacacagtccagtggtccacctccctcaaacgcccacatgggccagggtcctcctctatcagaggaagggccccttccttgttctttcccttcctgccccagatcag

SEQ ID NO: 25366 - DNA, 579 bp, Homo sapiens
gcgcctgtaatcccagatatttgggaggctgaggcagtagaatcgcttgaacccaagaggcggaggtttcagtgagccgagattgcgccattacactccagcctgggcgacagagcaagactccatctcaagggggaaaagaaaaagccgctcaattgttttgtcatggggccgggcgtggtggctcactgtgcctttttacttcagctcacagatttccagttggccgtctctgcagaccctggcctctagcagggaaagagccttttatttggctgttgtgagggcgccttgaagtttaggtatttataaacgcgaactgggctaccactgcttgcctctgagaatcccagggaccatctcacagccaaactaaatttggtccctggactggtgcctgagggctgaggctgagacatggctgtgactctttatgacagagcagcagtttttagtggagattttgggctgtcagagcaagggacctttctggagtggtggtggttatttttctgttacctctgtgtcccctgagtcactgggtggcagagtggaggggcactgtttagataggatgtg

SEQ ID NO: 25367 - DNA, 332 bp, Homo sapiens
catgcatttgttaaaaggatggtgagatgtacgaccgtagtacgttatatgttaatatagtacacggcagatctgggctaccactgcttgcctctgagaatcccagggaccatctcacagccaaactaaatttggtccctggactggtgcctgagggctgaggctgagacatggctgtgactctttatgacagagcagcagtttttagtggagattttgggctgtcagagcaagggacctttctggagtggtggtggttatttttctgttacctctgtgtcccctgagtcactgggtggcagagtggaggggcactgtttagataggatgtg

SEQ ID NO: 25368 - DNA, 439 bp, Homo sapiens
agattcccaccctgcagtggagtgactgctccccccaaacccctaaagctaactagatgtttggttcctggagaggtaacagagggctatggactgcagatcccaagcacagctgagagcagggccaccacagaaaacagcttagtgaactgtactaactgaaggtgcagagacccagccctcttctttttccctccacaggaaacccaactagcctaagaagaaagacctaacagacaatggcatgggcctcccctgctaatccacctagggcagatagcctacagtaaggctcacatctattcacatgcttggagcatccaatggacattttaatctcctatcctgaattatctctgaattttcagcagataaccaagcagcacctgccatctcaagaaagcctgtaacaggaaagccagagaccaaacaaagcagg

SEQ ID NO: 25369 - DNA, 838 bp, Homo sapiens
gtgtgacctgctctcataaactcctccccaaaacaggcttatgcacttagcagtaatagattgaaccatcaactccttaaagcacacctggttgataattagctcaatcacattgtgtttcggtcattacccttggatttcccaaggatgagtttaattcatctcccacattaaagtgagtgcctgcatgaccaaaactcaacagaatagaatttctgtctctattatgtcaatttaatgctgtggtaattttattgcaaaataggtatcggtttacaatttgccacccaaatatctgcacagaaattgttactgtatgctgtaaaaagatctttgatggcaaaaggctcccgtttttcctaaacagtacttcatctgaaggaagacagagggaatgagctgaaactctgatttgaggaatttggggttgataagatctaatattgcttattcagagatgacttactctggttttatagcttataaacgtattgatgatagatacaaccccttgattccaagattttacagagtttattttgtgttttaaccacactccctttgcctctgacctactgctggatgtgaagggataaactggtggtgcatatgctatattaccaaagtgggaagggagagaggcacctttattatatcggattactgccagatgcctagaatgctcaaatctactcactggttgctgtttaaaagggaaaaatacaaatctaaccacttctaggaatggtgccagatgtctgtactaaggcaacccaactccagaaggctataaaaatagcccccaagtagtaggttctgatttcccactgagctgacc

SEQ ID NO: 25370 - DNA, 575 bp, Homo sapiens
gagtgttgttcatgtgtaaaggcaatgggaagacattcttaaatttgtaaaatcttgccatatgcaaagcattcctcaataatatagttgaaggtatattattaaagaatgtgaatgggccgggtgcggtggctcacgcctgtaatcccagcattttgggaggccaaggcgggcagatcacctgaggtcaggaattcaagaccagcctgaccaacatggagaaaccccgtctctactaaaaataaaaaattagccaggtgtggtggcgcatgcctgtaaacccagctactcgagaggctgaggcaggagaatcacttgaacccaggaggcagaggttgtggtgagctgagatcacaccattgcactccagcctgggcaacaagagggaaactccatctcaaaaaataaaaaataaaaaataaagaatgtgaatgaatgatgaataataaagccaatgaatattaaagaagttccaaactgaattcactgtatgagccttcaatccaattaaacacagaattatgtctaaagaattgtcaaaacgagggctatgagaagaaatgtaattgttttaa

SEQ ID NO: 25371 - DNA, 543 bp, Homo sapiens
gacagtctctttttgggcattgctgtatgcatacctcctgaccccttacctccgtggtaggcagatgaccccctgcccactaaagaatagcagggggaggacaagcactaatccctggaacctacaagtatgccatgttacctggcaaaaagcacttcacagatgcaattaggattatggacctaatagggagattagcatggagcatctgggtacacccaatctaatcacatgaactcttaaaagcagataattttctccagctagagtgccagattccaagcaagagaaacactcgatgtccattaccggctttgaagatgaaggggaccagagacctcatggtacaaccacaaggaactgaattctgctcacaaccagattgaacttggaagtggatttttcccttgtcccttcagataccttgactttggccatgcgagtccttacacagaagacctagtcatgtcacgccggactactgacccacagaaactgtgagataataaatgcgtgttgtttgaagctgctaaaaatttgtgt

SEQ ID NO: 25372 - DNA, 486 bp, Homo sapiens
gtaatgcctgtgttattagagttcatgaactaggctgcagtcgggaaattgtagctattctctgtagcagggtatgtatgacacattttcagttggataacattctgtgtgatgattgataatggaataggaaccaacaagagcagaatagcatgtactgcagggaatttgcagatagttgattcaatttttatatccagctaatcaatttgccagatgctggtagatgctgtctcatttggttgactgtgagacttgaatctgctacacatcactctatagattttgaacagttttattagtaatacttcaaagttctaattgacttacaaggtgtgtcaaggaaatacaaaattgctaacaggccctgaaacacaggctaccagaattgaagtgttaagtctatagaacttcttggatccatcacctcagtatctcaagattagctgaaggaggaacaagtcaggccagataaaatacaaaaaa

SEQ ID NO: 25373 - DNA, 209 bp, Homo sapiens
taatctctaactgcttgatgtttaaaataggacagttttatttattttcaagtgtcagattatagaagtgactgatgctgcaaaacattcagaaattatagagaaatagaccgggcgcagtggctcacgcctgtaatcctagcactttgggaggccaaggcgggtggatcacctgaggtcaggagtttgagaccagcctggccaacatg

SEQ ID NO: 25374 - DNA, 203 bp, Homo sapiens
gccttcatatacttctcattactctgattggttattattgtttttaattgtcactgcaatgaaatgcacacataacatttctccttactatggattcaacactaggtatggtcaagttttagaaaaactgtgtcctggggaagcaactatggaggaggagggatgacaaaactactgagcctaattatttttaacaaccaggt

SEQ ID NO: 25375 - DNA, 431 bp, Homo sapiens
acattctgtaaaatggaaatcatgcatacgtagttctcttgggggaccttgagaaaattaatgaggctatgtttgtaaaaagtttttacattatatagagaaaagcattaccttcaggaaagaaactgtcactaatccatattttccttgtacgtaagctcagcatatggattctgacaggaaatccatggctgtttaagtccaactttgaaacttaatatattgattttaaaagtatctggtttcataattaaaacattaaaatatttattacattcttcaattaaaaaaggcaaggcaaacttatcttccaatggcgtgccaatctgtagaccattcattctatgcttaggacactaaaaaaattaaggactttgaagttattaacttgacagccattaaattttgaaagaagaacataaaagattcca

SEQ ID NO: 25376 - DNA, 454 bp, Homo sapiens
ccagatgtctccctctggttcctccaagaaaacacatgacagtaaaatcgctctaagcaaactgaatcttggtgcagggagccagctttctctccatctgaagacactttctcctaaatattaagatcattaacacgtttccagacaggaagaatgtactgttgttagctttagacaaacattatgctaatttcaaatctagagccaaaaacatgctcccaccacaatgtggacgtcttatttgtcttggtttcctcccatgtctgatcagcagatggaaacgcaagtgcttcagctcctaaggggcgctacggactgccagaaggtaatcaaaaccacaggctacagatgatgtggatggggaggaattccgctcttctgggcaaactccgggtttggctcctcctgcctcgatttcctccttcctctgcctgttacctttcctgcctcaggg

SEQ ID NO: 25377 - DNA, 396 bp, Homo sapiens
agttcatgtcttggaattttgcttgcactgtgcaagagacagagcctttcaaaggcaattgggtcatgaggactctgctgtcatgaacagattaatgccattatcatgggagtagttcagttatcataggagtggcttttatataaaagtgagctctgtctcacatgctctcttttgccctactaccctggtaccatgttttgatgcagcaagaaggctttcacccgatgttgagcagatgccagcaccatgctcttagacttcttagtctccagaactatgagccaaacaaacttattttctttataaactaaccagtctgtggtattctgttataccatcagaaggcagactaaaacacggtacacacctgaaatgtaagatgtagctaactga

SEQ ID NO: 25378 - DNA, 433 bp, Homo sapiens
actacaccttgggtacagtgtacactgctcaggtgatgggtatactaaaatctcagaaattaccaccaaagaacttatttatgtaaccaaacaccacctgttccccaaaaacctattgaaagaaaaagaaatagtgatatagaagaagagtaaatcacagtattagtattttagagtggaaagagtaaaaatgatgcaaggaatccattttcaccatttataagctacatggacctgtgctcttgttgcttaatctttgaaccttggttatgagttattgtaaggattacatgaagaccttgctttcaggacagatcctgcctgtggccaggagctagcctcccaatccacctgcttcccattcatcctcattgtgtaccttcactgagggcttgtaccagagcattgtcatgtcctgtgtaacactgggttc

SEQ ID NO: 25379 - DNA, 324 bp, Homo sapiens
gaagttcaactatctttaagagaaagacacatgaacgctactgccacatttggtgaaatttccaagcaacggctgtggcagaactacatttttaccaggcagaacctgctgtgaagggggtgaaacccagtagcccagctgagtttcccagtgtaaagttctgtcgctgcctaccaggacttttcaatggtcaccttcctctgagggggccaaggagaggtccgagggcctagggatgacagacacacagagctctctgcagcagcgggtttaggacacatggtgacttggcagttgtcatccctgttcttgaaggaagagcgt

SEQ ID NO: 25380 - DNA, 237 bp, Homo sapiens
gactccttttcacatgtgctggttatcagcatgggacttttccattcactctttgaattattcatttgggggacacagatagacctctgtgtctttcataaaaagtgtccattggccggttgcagtgtctcatgcctgtaatcccagcactttgggaggctgaggagggcagatcacgaggtcaggagttcaagaccagcctggccaatatggtgaaatcccatctctactaaaaat

SEQ ID NO: 25381 - DNA, 383 bp, Homo sapiens
aatatttgcctaaaagtcctttaatattttgttacatttatggctaggtattttatgttttggttgcttttataagtagtaattttttattttttaaccatcagttactggtgtatagatatgcagctgacttttgtatatcaaatttatgtctagaaaccttactaatctcagatttatttgggttttttctgggaaagacaatcatattatctggaaataatgccaattttgtttttaaatttgtagttcttatactttgtatttctttttcttgtcttattgcacaatgtgggaaccttcagtagaatgttcactataaatggcactggcaaacatttttgctttatttgactttaaaggagttgcttttaatatttgac

SEQ ID NO: 25382 - DNA, 533 bp, Homo sapiens
aaggaagcaaggaaagaaggaaggaaggaaagaagggagggaaggaaggagagagaaagaaagattgtttggtaaggagtaatgacattctcttgcatttaaaagtggcatatttgcttgaaatggaaatagaattctggtcccttttgcaactactgaagaaaaaaaaaagcagtttcagccctgaatgttgtagatttgaaaaaaaaaaaaaattggagctattgagagatctgcctctgtaggagtatggtcccaggcccacaaagttaaagtgcatcagccacaaatatgtgtccatttgagttttggttctgagaatactcctcataaagatatagaatcactccctcctcctaactcgcaaaaggctgaacagtgtatagtatgttacatttaaataaaaacaataaaaatgttgggaaaagaaaattaaaatattgtccttgtttgttttattagtcagaaactctacctggtaataaagagagaagctcaagtgtgtgcatggcaggatgtggttaaatgcccca

SEQ ID NO: 25383 - DNA, 259 bp, Homo sapiens
taacagaatatggagtgcaaacaacataacgacatgatgtcaaagtttcaaatatgtatcacgtttttaaaagccagaaaaatgtgactcattcttaaggaaacagaccgtcaaaatatgacaactcaagatgacccagctggaattcaaaatgaacaaataaataaataaattcaagtattataaatatgctcattgaagcaatgtaaaatattatcgtagtgagtaaaactatatgaaattttagaatagaaataca

SEQ ID NO: 25384 - DNA, 377 bp, Homo sapiens
aacaaggcactcacattcccacacatgggtgccagaggagacctagtgaagattcaggactttcaccattacctagcaagaatgaagccacaccactatggtgttagtggaaaccacatggggagcagtattaagacaccctggtgcctaccagccagggtgatattagcagaggcctagaggggaacctgaactcctgtcccacctagcagtaatgaagagcccctttcctctggtgtcaacaaaggctgagtggggaacctggattttcaatcctgaagcagaagaatcacttgaaccgaggaggcagaggttgcagtgagctgagatcgtgccattgcactccagcctaggcaacaagagtgaaactccatctc

SEQ ID NO: 25385 - DNA, 420 bp, Homo sapiens
tcttgagacagagtcttgctctgtcgcccaggctggagtgcagtggtgcaatctcggctcactgcaagctctgcctcctgggttcacgccattctcccgcctcagcctcctgagtagctgggactgcaggtgcccaccaccacgcccggctaattttttgtttttgtatttttagtagagatgggggtttcacagtgttaatccggatggtctcgatctcctgaccttgtgatcctcccacctcggcctcccaaagttctgggattacaggtgtgagccaccacgcccggccgctgatatctctttaaaaggatctcttagacagttgcatgaagtgaggtggatttctttattttttatttttgagacggaatctcgctctgttgccaggctggagtgcagtggtgtgatctcagttca

SEQ ID NO: 25386 - DNA, 411 bp, Homo sapiens
ccattacaggaagcccaaatatcaatgtggtcaccacagaaagctgccagttaaagccctgtaatgtctctcacttaacaccttttctccccaaggcttctgtcaatgttccaccctaccattgctgacagaagggattagaggtcacacaggttttatagttttcattgatttcttgaatggaaataacagatgctgttaatgaagctccctgtgaatatacacacaaggtaatcccatagcatcttgcttgggggtgacatgtaaactctgctgctctgaaataaagctcctgtgtacctgccagcagcaacagggtgcagcagtttaatgtttaccccggaggaaagtttcatctgactgtcagggaaatacttcccttctaacaacctctgttatctccctcaaacc

SEQ ID NO: 25387 - DNA, 319 bp, Homo sapiens
  misc_feature (287)..(287): n is a, c, g, or t
cataataaacttgtaattttagatattatgcacatattattcaagttttaagcaaatctcatatgattggtcttttgtgataaatagtattttctaaaagacccttcagtaaattataatcacaaatcttccaagtcttcattttgcacatgcacacaaaacaatttctgtctctgtcactgagtctctatgtgtgtatttcagaatctggtgggttgcatcttactaaaacaacaacaaaaaccaacaaacaaaagtaccacattttagttttgtttggaaattgnggcctggaagtgtggggattgtttggatttgg

SEQ ID NO: 25388 - DNA, 467 bp, Homo sapiens
cgcccagcacctcgggcccggatgggcttctcgcgccccagggctgcggccacaccccgccggcccagaccccgcgggtagagaaaggaggtgcaaccctgagagccaagacgttgggcttggctttgctttgcgtttctttccttttttcttttgtttcttttcttcttcttttttttttaaccacatccaggaagaggagaaacctgtctcatgacaggaaacgaagagggaggatgcatccgaactgagggacattgtttcagttgcctcacctgacatactgtctcacctgagagagggaggccgaagaggcagccaatggtggctggagcaagccctgtcctcgttacctgggctgtggctgagccctggggctcaccggctgtatggccctgggcaagtcctcggagccttaggttctctgcaaaatggagatgatgtttaatagaaaatgtttctataac

SEQ ID NO: 25389 - DNA, 278 bp, Homo sapiens
gctcgaccaactgggcaccttttataaagattagtgtttgttgattagcgaaattaccttctctctactgtgaaaacaattcccactatccaacctgatggtaagaaagctgctacataattgtgtgtgaaggccctgaacttcaaacattcctagaacagatttttcctaatggtgacaggacttaaaatctaagaagccatatgaagcatcagaacccatctcaataactttacaaaagcacaagaatagtcaaggagaggttgagaaaggaagac

SEQ ID NO: 25390 - DNA, 457 bp, Homo sapiens
attaaggcacagatagattaatttgtcacaaagcttgcaggtggtgacaccaagcagtgtttctctggaacccatgctcttcttaaccacttgcttatatcacctttttctgaatcagcccatctttattaaattttgacaattgaagtcatgtttttggcaacgacgtgattatcaacattcataaatacgataccaaaatcatatagtaacacccagatggacagcattatgctgatatttcttgtcattgaaatgaaaagaattttttaaattcttggagataatttatcgtttcctaagattagaaacacaaggagatttggaagtcctgaggaagaatttaagataagtattgaaacctaataagtaaagacttaattgtattcattcagtcattcattcaagatctcagataaatgatggcatttattggatcaccaactcctccaaaaag

SEQ ID NO: 25391 - DNA, 650 bp, Homo sapiens
agggttcagaatacatcctggagtggtcatctcagtattctagagaactggaaccttttgtgagtaggaaggaaggtatgattccagttagtaaatatgactagtcctccacttctacctcagtttttctaaagtggggtgataaagcaggatatcataaatcagctttttatatcttgtttcagagaagggagcagggccaaccccaggcaaaaacaaaaaacgaagtggatattggtgacagtctgtactcctttctgcctatgtgccattttctgttatttcccagtcattcttgttcttcttttggtgctcactcccaaatcttcacaggggtactccttgggtaccttttggctcttatttagctactcttccccacctgctcaacacaatgcccattatctctgggagctgaccccatttaggattaggaaaaaacttcccaattctacaagagtgcaggtctttcttgataatagtctttattttccatttctacctccatttaggcagctacatttttccacctgcagcatggttagatgcctcctcagattttcctgaatattttgtgtaaacctccattaggttgcttacttggtactaaattgtaaggtcagtcatataaaaaatatgtatatactaag

SEQ ID NO: 25392 - DNA, 2386 bp, Homo sapiens
cttgcttagattgttgagaagcaaaaacactgatgaacatttggaagcaatgagaatgtaattctaatcatactcttttaataatgttgcaaaactctccaaacactactctgtgtggatgtctttcagaatatgatgaatactagtagtcttattctgcccttttctctctatcacaatatatacattctatattgcatacacatattttccaaatattacatataatttcatgtaatttatagacctattaaggcccaaccattttcttggataggggattctttagaagtccagcttaaataaagcccgtatagaaagtttttttaaaatttatacataatcacctaaagtaaccttatctactgaactcttagtacatgctactggaaccttttatcatgtttcttcctggcttgcattacaacactgttgacatatctcagccttacttctaggcttctttgagagcatgactcatgtttgtattcctcactgaggttgaatgaataagagaaactacagtagtaggaaaaaacagtacatgtagatatcaatgaatatgaaagggtcaaatggatctattatagtaagcacaaaatcaactgacaccagcaaagtaaacccaaaatttttaatggtattttaatagatcaagaggagcaagcagatttttgagacagttgtctcctactttctctatcacagggagtaattttaaaagaaaaatggagggtaagtttctttaagagaaaattgtagtttaaaacaggtcatgggataattagaaataatttaatttctttagaggattttaatctttcaactgcttgcaattagatcctaaggcaataaaagaataaggagatttggaaaaccattgtctgtaatctctgaagaaaagtggacattaggggagtcagttgaaaagcaaagctatcaccattttctaaagaggaaaaaggtgaacctcacaaactatagaccaaaaaaataggacatcgagagaaagaatatgaagctagcataggttcacaaagaatgagtcaaatcaaacaacatgcattttttatttataaagcatgacttgttcattgtcaattcatgttagcttaatcattaggcattaatgccatcactgcaatgcatatgtcagcaataaataatcaaagaccaggcttccatcattctgtttaatatcttcaagtaatgcttaagtttgcaaatgctcttttaacacattctccatatgcagcctgcccagcactgcacacaatagacctgttacttccccctcacgagcactcctaatatttcatgtgctcatccaattgacttctcccactggtgcctcatattgaatttgtagaatcacacctgctcctttttcaaaactcttctgagttttttcttaaataattcactgaccccaaagttgtcagatatttgaagactactcgcacaattttaatattataaatgtataatgtaaatgtaattaagatttgtataatgtacgatgtactttggtaaataaaagtatgctgtgaataaatacgtatgatacaattcaaaattttacataaatatgtgataaaatttagctcatattctttttttttttctttgagacggagtctcactctgttgcacccaggctagagtgcagcagcatgatctcagctcactgcaacctctacctcctgggttcaaacaattctcctgcctcagcctcctgagtagctgggattacaggtgcccgccaccatgcccagctaatttttttctatttttgttgttgttgttgtttttagtagagacggggtttcaccatgttggtcaggctggtcttgaactcctgacctcagataatccacctgcctcggcctcccaaagttctgggattacagacgtgaaccacggtgcccggcctagttcatgttctttaaggacaattatgaatatttttatgcactgttaattttcattaagatattgatcaattaatagctatatatgttctataaattaatcctatctagtttcaatcttaaattgtttgcatataccaatctagtttattgtttgcatatattttatagtgtagagattaggcattttaataaaattttaaaatttccaggacatactgttaatgactatgcttcctaatataggccataattaatttttttctattgtcaacaatattttggtagggatgatcaggaaataaggaaatgtttccttcatttgttaacaataggtgtttggggattttaaaatgaaaattgaagaagtaaaagacaccatatatttagtttgtttgatttcgtggcttcaagagttcaataatttattgaaatattttacagaccaaagaaca

SEQ ID NO: 25393 - DNA, 347 bp, Homo sapiens
tgtctttctgaatatttaagggtaaaatttttctacttttaaagcttaaaaaaatgtttttttactactgtaaaagtaatgcagagaaatgttcacttaccaaacacatacctttgtaaaaatcaccacttaaagtttgtttctaaagattttaggacaccaagatgcaaataatatttttggctgttacctgctctttcactactgctgagtctgcagtggcaagatagctacacagtacctcagccctcctgctcagtttttaacatctattgataatactaattacaagaaaatttaaaatgtctttttgcaaaaaaataccataagcagtcaaaacacaatta

SEQ ID NO: 25394 - DNA, 715 bp, Homo sapiens
agcagccaggagctgcctacgaggagggacgaaggctggccaggcctccactctagacaggaagtctagtctagagtctatatggtcccagccaggactatgtagccatttgggagggagaactctatgttcttcccggcaaaaacgtgtgggcctggccggccacgcttcgctttggaggggtgcagtggggtgccgaggctcaggcagcatgacgacggagacctttgtgaaggatatcaagcctgggctcaagaatctgaaccttatcttcattgtgctggagacaggccgagtgaccaagacaaaggacgggcatgaggttcggacctgcaaagtggcggacaaaacaggcagcatcaatatctctgtctgggacgatgttggcaatctgatccagcctggggacattatccggctcaccaaagggtacgcttcagttttcaaaggttgtctgacactatatactggccgtgggggtgatctgcagaagattggagaattctgtatggtttattctgaggttcctaacttcagtgagccaaacccagagtacagcacccagcaggcacccaacaaggcgtgcagaacgacagcaaccttcaacttcccagctacactggacctctgtgcctctcagctctgagaacgagggatggctgatgccacaggtcgggtgccatcgaataatgcaagccagccgggcaacgggacc

SEQ ID NO: 25395 - DNA, 2271 bp, Homo sapiens
tccgggaatgtccgcactcccgcgttccacggggcagcatccggcggcagcggagcctgtggctccccctgcgggctgctcagcggcgtgcacagtcctgccggctggcttgggtgggtggtgggctgcgggtaggggaggggatggaccgagtcccggcttgtcgggatgagggttccggaagatctggccagtaagattctactccctggctgtgcaccgggttccctacccctgtctacgtcggctccgccacttcgcggcttgagactaaaagagcatcccggcagggggccttccagccccaaagcagcctgtccagagacccccaaattctgatcctgaagttggaggcctccggggatgttcttttttaatcttttagaagggttagaggggttgaggctgcctgaccccagcctaatggggtaggtaggccttgggaagtggagcatgggggcaaaggatccaagcattgagccttcatcctctattccccatccagtggggtgccgaggctcaggcagcatgacgacggagacctttgtgaaggatatcaagcctgggctcaagaatctgaaccttatcttcattgtgctggagacaggccgagtgaccaagacaaaggacgggcatgaggttcggacctgcaaagtggcggacaaaacaggcagcatcaatatctctgtctgggacgatgttggcaatctgatccagcctggggacattatccggctcaccaaagggtacgcttcagttttcaaaggttgtctgacactatatactggccgtgggggtgatctgcagaagattggagaattctgtatggtttattctgaggttcctaacttcagtgagccaaacccagagtacagcacccagcaggcacccaacaaggcggtgcagaacgacagcaacccttcagcttcccagcctaccactggaccctctgctgcctctccagcctctgagaaccagaatgggaatggactgagtgccccaccaggtcccggtggtggcccacatccccctcatactccctcccacccacccagcacccgaatcactcgaagccagcccaaccacacacctgcaggcccgcctggcccttccagcaaccctgttagtaacggcaaagaaacccggaggagcagcaagagatagcatgacattctttcttcctgccaccaaccacatcccaagtgtcccctggagagcaagatagccttccactgattggctggtgtagcagtattttagccactgaacttcagtggagggtggtgagcagtgtccttatccaccctaatctcatactccctcattgtccagctgaactacctgtcccctgggagtcaggaccctctgcctgctctctttcctctttagaaatggcagttactggctgggcgcagtggctcacgcttgtaatcccagcactttgggaagccgaggtgggcggatcacctgaggtcgggagttcaagaccagcctgaccaacatggagaaaccccgtgtctactaaaaatacagaattagccaggcatggtggcgtatgcctgtaatcccagctacttaggaggctgaggcaggagaatctcttgaaaccgggaggcggaggttgaggtgagccgaaattgcaccattgcactccagcctgggcaataagagcgaaactccatctcaaaaaaaaaagaaagaaagaaagaaagaaatggcagttaccatctgtttcttctgtgtgagacatgggagtctaactgaagtctctccttcctaataaatgttaccactctaaaaaaaaaaaaaaaaaaaaaaaaaaaaaaaaaaaaaaaaaaaaaaaaaaaaaaaaaaaaaaaaaaaaaaacaaaaaaacacccatttcaaacgccttgcctggcatatccctggcgccacctgggtaaaccccgtggaggcccatatcaaatccctctgcggacaaactccccttccaggcctggcccatttcccccttgcaacctcctagaaaatcccttattgccaacttgtcaaaccgccaagcgggaatttccccttttaaaccggtggtaaattttggaaaaaccccttaaaaattaaccaaatagccccaatttgcaaaaatgggacaaaacctggaaaaccccttaatttgaaaaaaatttcccccaaaatgggacaaggattccccactttggaaccagggccccctactttagaccctctacccctttgggtatacccccctttttctgccatttccgcctcttc

SEQ ID NO: 25396 - DNA, 1609 bp, Homo sapiens
agcagccaggagctgcctacgaggagggacgaaggctggccaggcctccactctagacaggaagtctagtctagagtctatatggtcccagccaggactatgtagccatttgggagggagaactctatgttcttcccggcaaaaacgtgtgggcctggccggccacgcttcgctttggaggggtgcaggttccatttcttccaagaagggtgagcctgccttttgtctctggtgtaaatgccacttttcccagagaccttgaccaagctgggtagtgcattaaagatgagaaccccaaatcaggaacaaagataacgtggggtgccgaggctcaggcagcatgacgacggagacctttgtgaaggatatcaagcctgggctcaagaatctgaaccttatcttcattgtgctggagacaggccgagtgaccaagacaaaggacgggcatgaggttcggacctgcaaagtggcggacaaaacaggcagcatcaatatctctgtctgggacgatgttggcaatctgatccagcctggggacattatccggctcaccaaagggtacgcttcagttttcaaaggttgtctgacactatatactggccgtgggggtgatctgcagaagattggagaattctgtatggtttattctgaggttcctaacttcagtgagccaaacccagagtacagcacccagcaggcacccaacaaggcggtgcagaacgacagcaacccttcagcttcccagcctaccactggaccctctgctgcctctccagcctctgagaaccagaatgggaatggactgagtgccccaccaggtcccggtggtggcccacatccccctcatactccctcccacccacccagcacccgaatcactcgaagccagcccaaccacacacctgcaggcccgcctggcccttccagcaaccctgttagtaacggcaaagaaacccggaggagcagcaagagatagcatgacattctttcttcctgccaccaaccacatcccaagtgtcccctggagagcaagatagccttccactgattggctggtgtagcagtattttagccactgaacttcagtggagggtggtgagcagtgtccttatccaccctaatctcatactccctcattgtccagctgaactacctgtcccctgggagtcaggaccctctgcctgctctctttcctctttagaaatggcagttactggctgggcgcagtggctcacgcttgtaatcccagcactttgggaagccgaggtgggcggatcacctgaggtcgggagttcaagaccagcctgaccaacatggagaaaccccgtgtctactaaaaatacagaattagccaggcatggtggcgtatgcctgtaatcccagctacttaggaggctgaggcaggagaatctcttgaaaccgggaggcggaggttgaggtgagccgaaattgcaccattgcactccagcctgggcaataagagcgaaactccatctcaaaaaaaaaagaaagaaagaaagaaagaaatggcagttaccatctgtttcttctgtgtgagacatgggagtctaactgaagtctctccttcctaataaatgttaccactcta

SEQ ID NO: 25397 - DNA, 1485 bp, Homo sapiens
tccgggaatgtccgcactcccgcgttccacggggcagcatccggcggcagcggagcctgtggctccccctgcgggctgctcagcggcgtgcacagtcctgccggctggcttgggtgggtggtgggctgcgggtaggggaggggatggaccgagtcccggcttgtcgggatgagggttccggaagatctggccatggggtgccgaggctcaggcagcatgacgacggagacctttgtgaaggatatcaagcctgggctcaagaatctgaaccttatcttcattgtgctggagacaggccgagtgaccaagacaaaggacgggcatgaggttcggacctgcaaagtggcggacaaaacaggcagcatcaatatctctgtctgggacgatgttggcaatctgatccagcctggggacattatccggctcaccaaagggtacgcttcagttttcaaaggttgtctgacactatatactggccgtgggggtgatctgcagaagattggagaattctgtatggtttattctgaggttcctaacttcagtgagccaaacccagagtacagcacccagcaggcacccaacaaggcggtgcagaacgacagcaacccttcagcttcccagcctaccactggaccctctgctgcctctccagcctctgagaaccagaatgggaatggactgagtgccccaccaggtcccggtggtggcccacatccccctcatactccctcccacccacccagcacccgaatcactcgaagccagcccaaccacacacctgcaggcccgcctggcccttccagcaaccctgttagtaacggcaaagaaacccggaggagcagcaagagatagcatgacattctttcttcctgccaccaaccacatcccaagtgtcccctggagagcaagatagccttccactgattggctggtgtagcagtattttagccactgaacttcagtggagggtggtgagcagtgtccttatccaccctaatctcatactccctcattgtccagctgaactacctgtcccctgggagtcaggaccctctgcctgctctctttcctctttagaaatggcagttactggctgggcgcagtggctcacgcttgtaatcccagcactttgggaagccgaggtgggcggatcacctgaggtcgggagttcaagaccagcctgaccaacatggagaaaccccgtgtctactaaaaatacagaattagccaggcatggtggcgtatgcctgtaatcccagctacttaggaggctgaggcaggagaatctcttgaaaccgggaggcggaggttgaggtgagccgaaattgcaccattgcactccagcctgggcaataagagcgaaactccatctcaaaaaaaaaagaaagaaagaaagaaagaaatggcagttaccatctgtttcttctgtgtgagacatgggagtctaactgaagtctctccttcctaataaatgttaccactcta

SEQ ID NO: 25398 - DNA, 857 bp, Homo sapiens
tccgggaatgtccgcactcccgcgttccacggggcagcatccggcggcagcggagcctgtggctccccctgcgggctgctcagcggcgtgcacagtcctgccggctggcttgggtgggtggtgggctgcgggtaggggaggggatggaccgagtcccggcttgtcgggatgagggttccggaagatctggccagtaagattctactccctggctgtgcaccgggttccctacccctgtctacgtcggctccgccacttcgcggcttgagactaaaagagcatcccggcagggggccttccagccccaaagcagcctgtccagagacccccaaattctgatcctgaagttggaggcctccggggatgttcttttttaatcttttagaagggttagaggggttgaggctgcctgaccccagcctaatggggtaggtaggccttgggaagtggagcatgggggcaaaggatccaagcattgagccttcatcctctattccccatccagtggggtgccgaggctcaggcagcatgacgacggagacctttgtgaaggatatcaagcctgggctcaagaatctgaaccttatcttcattgtgctggagacaggccgagtgaccaagacaaaggacgggcatgaggttcggacctgcaaagtggcggacaaaacaggcagcatcaatatctctgtctgggacgatgttggcaatctgatccagcctggggacattatccggctcaccaaagggtacgcttcagttttcaaaggttgtctgacactatatactggccgtgggggtgatctgcagaagattggagaccactgtcgaattcggtaccgagctcgatcgtatcagcc

SEQ ID NO: 25399 - DNA, 210 bp, Homo sapiens
ggaggcggaggttgaggtgagccgaaattgcaccattgcactccagcctgggcaataagagcgaaactccatctcaaaaaaaaaagaaagaaagaaagaaagaaatggcagttaccatctgtttcttctgtgtgagacatgggagtctaactgaagtctctccttcctaataaatgttaccactctactctgtgttggactcctttgctt

SEQ ID NO: 25400 - DNA, 1405 bp, Homo sapiens
tccgggaatgtccgcactcccgcgttccacggggcagcatccggcggcagcggagcctgtggctccccctgcgggctgctcagcggcgtgcacagtcctgccggctggcttggtggggtgccgaggctcaggcagcatgacgacggagacctttgtgaaggatatcaagcctgggctcaagaatctgaaccttatcttcattgtgctggagacaggccgagtgaccaagacaaaggacgggcatgaggttcggacctgcaaagtggcggacaaaacaggcagcatcaatatctctgtctgggacgatgttggcaatctgatccagcctggggacattatccggctcaccaaagggtacgcttcagttttcaaaggttgtctgacactatatactggccgtgggggtgatctgcagaagattggagaattctgtatggtttattctgaggttcctaacttcagtgagccaaacccagagtacagcacccagcaggcacccaacaaggcggtgcagaacgacagcaacccttcagcttcccagcctaccactggaccctctgctgcctctccagcctctgagaaccagaatgggaatggactgagtgccccaccaggtcccggtggtggcccacatccccctcatactccctcccacccacccagcacccgaatcactcgaagccagcccaaccacacacctgcaggcccgcctggcccttccagcaaccctgttagtaacggcaaagaaacccggaggagcagcaagagatagcatgacattctttcttcctgccaccaaccacatcccaagtgtcccctggagagcaagatagccttccactgattggctggtgtagcagtattttagccactgaacttcagtggagggtggtgagcagtgtccttatccaccctaatctcatactccctcattgtccagctgaactacctgtcccctgggagtcaggaccctctgcctgctctctttcctctttagaaatggcagttactggctgggcgcagtggctcacgcttgtaatcccagcactttgggaagccgaggtgggcggatcacctgaggtcgggagttcaagaccagcctgaccaacatggagaaaccccgtgtctactaaaaatacagaattagccaggcatggtggcgtatgcctgtaatcccagctacttaggaggctgaggcaggagaatctcttgaaaccgggaggcggaggttgaggtgagccgaaattgcaccattgcactccagcctgggcaataagagcgaaactccatctcaaaaaaaaaagaaagaaagaaagaaagaaatggcagttaccatctgtttcttctgtgtgagacatgggagtctaactgaagtctctccttcctaataaatgttaccactcta

SEQ ID NO: 25401 - DNA, 1797 bp, Homo sapiens
tccgggaatgtccgcactcccgcgttccacggggcagcatccggcggcagcggagcctgtggctccccctgcgggctgctcagcggcgtgcacagtcctgccggctggcttgggtgggtggtgggctgcgggtaggggaggggatggaccgagtcccggcttgtcgggatgagggttccggaagatctggccagtaagattctactccctggctgtgcaccgggttccctacccctgtctacgtcggctccgccacttcgcggcttgagactaaaagagcatcccggcagggggccttccagccccaaagcagcctgtccagagacccccaaattctgatcctgaagttggaggcctccggggatgttcttttttaatcttttagaagggttagaggggttgaggctgcctgaccccagcctaatggggtaggtaggccttgggaagtggagcatgggggcaaaggatccaagcattgagccttcatcctctattccccatccagtggggtgccgaggctcaggcagcatgacgacggagacctttgtgaaggatatcaagcctgggctcaagaatctgaaccttatcttcattgtgctggagacaggccgagtgaccaagacaaaggacgggcatgaggttcggacctgcaaagtggcggacaaaacaggcagcatcaatatctctgtctgggacgatgttggcaatctgatccagcctggggacattatccggctcaccaaagggtacgcttcagttttcaaaggttgtctgacactatatactggccgtgggggtgatctgcagaagattggagaattctgtatggtttattctgaggttcctaacttcagtgagccaaacccagagtacagcacccagcaggcacccaacaaggcggtgcagaacgacagcaacccttcagcttcccagcctaccactggaccctctgctgcctctccagcctctgagaaccagaatgggaatggactgagtgccccaccaggtcccggtggtggcccacatccccctcatactccctcccacccacccagcacccgaatcactcgaagccagcccaaccacacacctgcaggcccgcctggcccttccagcaaccctgttagtaacggcaaagaaacccggaggagcagcaagagatagcatgacattctttcttcctgccaccaaccacatcccaagtgtcccctggagagcaagatagccttccactgattggctggtgtagcagtattttagccactgaacttcagtggagggtggtgagcagtgtccttatccaccctaatctcatactccctcattgtccagctgaactacctgtcccctgggagtcaggaccctctgcctgctctctttcctctttagaaatggcagttactggctgggcgcagtggctcacgcttgtaatcccagcactttgggaagccgaggtgggcggatcacctgaggtcgggagttcaagaccagcctgaccaacatggagaaaccccgtgtctactaaaaatacagaattagccaggcatggtggcgtatgcctgtaatcccagctacttaggaggctgaggcaggagaatctcttgaaaccgggaggcggaggttgaggtgagccgaaattgcaccattgcactccagcctgggcaataagagcgaaactccatctcaaaaaaaaaagaaagaaagaaagaaagaaatggcagttaccatctgtttcttctgtgtgagacatgggagtctaactgaagtctctccttcctaataaatgttaccactcta

SEQ ID NO: 25402 - DNA, 2217 bp, Homo sapiens
tccgggaatgtccgcactcccgcgttccacggggcagcatccggcggcagcggagcctgtggctccccctgcgggctgctcagcggcgtgcacagtcctgccggctggcttgggtgggtggtgggctgcgggtaggggaggggatggaccgagtcccggcttgtcgggatgagggttccggaagatctggccagtaagattctactccctggctgtgcaccgggttccctacccctgtctacgtcggctccgccacttcgcggcttgagactaaaagagcatcccggcagggggccttccagccccaaagcagcctgtccagagacccccaaattctgatcctgaagttggaggcctccggggatgttcttttttaatcttttagaagggttagaggggttgaggctgcctgaccccagcctaatggggtaggtaggccttgggaagtggagcatgggggcaaaggatccaagcattgagccttcatcctctattccccatccagtggggtgccgaggctcaggcagcatgacgacggagacctttgtgaaggatatcaagcctgggctcaagaatctgaaccttatcttcattgtgctggagacaggccgagtgaccaagacaaaggacgggcatgaggttcggacctgcaaagtggcggacaaaacaggcagcatcaatatctctgtctgggacgatgttggcaatctgatccagcctggggacattatccggctcaccaaagggtacgcttcagttttcaaaggttgtctgacactatatactggccgtgggggtgatctgcagaagattggagaattctgtatggtttattctgaggttcctaacttcagtgagccaaacccagagtacagcacccagcaggcacccaacaaggcggtgcagaacgacagcaacccttcagcttcccagcctaccactggaccctctgctgcctctccagcctctgagaaccagaatgggaatggactgagtgccccaccaggtcccggtggtggcccacatccccctcatactccctcccacccacccagcacccgaatcactcgaagccagcccaaccacacacctgcaggcccgcctggcccttccagcaaccctgttagtaacggcaaagaaacccggaggagcagcaagagatagcatgacattctttcttcctgccaccaaccacatcccaagtgtcccctggagagcaagatagccttccactgattggctggtgtagcagtattttagccactgaacttcagtggagggtggtgagcagtgtccttatccaccctaatctcatactccctcattgtccagctgaactacctgtcccctgggagtcaggaccctctgcctgctctctttcctctttagaaatggcagttactggctgggcgcagtggctcacgcttgtaatcccagcactttgggaagccgaggtgggcggatcacctgaggtcgggagttcaagaccagcctgaccaacatggagaaaccccgtgtctattaggaggctgaggcaggagaatctcttgaaaccgggaggcggaggttgaggtgagccgaaattgcaccattgcactccagcctgggcaataagagcgaaactccatctcaaaaaaaaaagaaagaaagaaagaaagaaatggcagttaccatctgtttcttctgtgtgagacatgggagtctaactgaagtctctccttcctaataaatgttaccactctaaaaaaaaaaaaaaaaaaaaaaaaaaaaaaaaaaaaaaaaaaaaaaaaaaaaaaaaaaaaaaaaaaaaaaacaaaaaaacacccatttcaaacgccttgcctggcatatccctggcgccacctgggtaaaccccgtggaggcccatatcaaatccctctgcggacaaactccccttccaggcctggcccatttcccccttgcaacctcctagaaaatcccttattgccaacttgtcaaaccgccaagcgggaatttccccttttaaaccggtggtaaattttggaaaaaccccttaaaaattaaccaaatagccccaatttgcaaaaatgggacaaaacctggaaaaccccttaatttgaaaaaaatttcccccaaaatgggacaaggattccccactttggaaccagggccccctactttagaccctctacccctttgggtatacccccctttttctgccatttccgcctcttc

SEQ ID NO: 25403 - DNA, 2189 bp, Homo sapiens
tccgggaatgtccgcactcccgcgttccacggggcagcatccggcggcagcggagcctgtggctccccctgcgggctgctcagcggcgtgcacagtcctgccggctggcttgggtgggtggtgggctgcgggtaggggaggggatggaccgagtcccggcttgtcgggatgagggttccggaagatctggccagtaagattctactccctggctgtgcaccgggttccctacccctgtctacgtcggctccgccacttcgcggcttgagactaaaagagcatcccggcagggggccttccagccccaaagcagcctgtccagagacccccaaattctgatcctgaagttggaggcctccggggatgttcttttttaatcttttagaagggttagaggggttgaggctgcctgaccccagcctaatggggtaggtaggccttgggaagtggagcatgggggcaaaggatccaagcattgagccttcatcctctattccccatccagtggggtgccgaggctcaggcagcatgacgacggagacctttgtgaaggatatcaagcctgggctcaagaatctgaaccttatcttcattgtgctggagacaggccgagtgaccaagacaaaggacgggcatgaggttcggacctgcaaagtggcggacaaaacaggcagcatcaatatctctgtctgggacgatgttggcaatctgatccagcctggggacattatccggctcaccaaagggtacgcttcagttttcaaaggttgtctgacactatatactggccgtgggggtgatctgcagaagattggagagtgcagaacgacagcaacccttcagcttcccagcctaccactggaccctctgctgcctctccagcctctgagaaccagaatgggaatggactgagtgccccaccaggtcccggtggtggcccacatccccctcatactccctcccacccacccagcacccgaatcactcgaagccagcccaaccacacacctgcaggcccgcctggcccttccagcaaccctgttagtaacggcaaagaaacccggaggagcagcaagagatagcatgacattctttcttcctgccaccaaccacatcccaagtgtcccctggagagcaagatagccttccactgattggctggtgtagcagtattttagccactgaacttcagtggagggtggtgagcagtgtccttatccaccctaatctcatactccctcattgtccagctgaactacctgtcccctgggagtcaggaccctctgcctgctctctttcctctttagaaatggcagttactggctgggcgcagtggctcacgcttgtaatcccagcactttgggaagccgaggtgggcggatcacctgaggtcgggagttcaagaccagcctgaccaacatggagaaaccccgtgtctactaaaaatacagaattagccaggcatggtggcgtatgcctgtaatcccagctacttaggaggctgaggcaggagaatctcttgaaaccgggaggcggaggttgaggtgagccgaaattgcaccattgcactccagcctgggcaataagagcgaaactccatctcaaaaaaaaaagaaagaaagaaagaaagaaatggcagttaccatctgtttcttctgtgtgagacatgggagtctaactgaagtctctccttcctaataaatgttaccactctaaaaaaaaaaaaaaaaaaaaaaaaaaaaaaaaaaaaaaaaaaaaaaaaaaaaaaaaaaaaaaaaaaaaaaacaaaaaaacacccatttcaaacgccttgcctggcatatccctggcgccacctgggtaaaccccgtggaggcccatatcaaatccctctgcggacaaactccccttccaggcctggcccatttcccccttgcaacctcctagaaaatcccttattgccaacttgtcaaaccgccaagcgggaatttccccttttaaaccggtggtaaattttggaaaaaccccttaaaaattaaccaaatagccccaatttgcaaaaatgggacaaaacctggaaaaccccttaatttgaaaaaaatttcccccaaaatgggacaaggattccccactttggaaccagggccccctactttagaccctctacccctttgggtatacccccctttttctgccatttccgcctcttc

SEQ ID NO: 25404 - DNA, 1077 bp, Homo sapiens
tccgggaatgtccgcactcccgcgttccacggggcagcatccggcggcagcggagcctgtggctccccctgcgggctgctcagcggcgtgcacagtcctgccggctggcttgggtgggtggtgggctgcgggtaggggaggggatggaccgagtcccggcttgtcgggatgagggttccggaagatctggccagtaagattctactccctggctgtgcaccgggttccctacccctgtctacgtcggctccgccacttcgcggcttgagactaaaagagcatcccggcagggggccttccagccccaaagcagcctgtccagagacccccaaattctgatcctgaagttggaggcctccggggatgttcttttttaatcttttagaagggttagaggggttgaggctgcctgaccccagcctaatggggtaggtaggccttgggaagtggagcatgggggcaaaggatccaagcattgagccttcatcctctattccccatccagtggggtgccgaggctcaggcagcatgacgacggagacctttgtgaaggatatcaagcctgggctcaagaatctgaaccttatcttcattgtgctggagacaggccgagtgaccaagacaaaggacgggcatgaggttcggacctgcaaagtggcggacaaaacaggcagcatcaatatctctgtctgggacgatgttggcaatctgatccagcactttgggaagccgaggtgggcggatcacctgaggtcgggagttcaagaccagcctgaccaacatggagaaaccccgtgtctactaaaaatacagaattagccaggcatggtggcgtatgcctgtaatcccagctacttaggaggctgaggcaggagaatctcttgaaaccgggaggcggaggttgaggtgagccgaaattgcaccattgcactccagcctgggcaataagagcgaaactccatctcaaaaaaaaaagaaagaaagaaagaaagaaatggcagttaccatctgtttcttctgtgtgagacatgggagtctaactgaagtctctccttcctaataaatgttaccactcta

SEQ ID NO: 25405 - DNA, 2880 bp, Homo sapiens
aaagtagatccggccaggcagacaaaagtttgggagagaagttcggtctgtggctagcgtgagagctaggggggcgggggccggggagagtggggcagtcgggcgagtcgacgcgtgaacagatagacctgcggactggacagccgcggccagagaccctgctagccccgctcagccccagatgcgcggggggacgcagcccctcccgctgggggatgctgtgggattcctggcgcagggcatccaggccgcccgctaagcccctgtgcctcccctgtgcccctggggaaccagagtccggctgcagggaaagagaaccggccgccgagacgccgcagggtgccaggcggggagggggcgagaggccccaggcccgagggcatggagcggttaggagagaaagccagtcgcctgctggagaagttcggccgcagaaagggtgaatctagccggtctgggtctgacgggacccccgggccgggcaaggggcgcctaagtgggttggggggacctaggaagtcagggccccgaggagctactgggggacctggggatgagccgttggagccggcccgggagcaaggttccctggacgctgagcgaaatcagcgcggctcctttgaggcgccgcgctacgaaggctcttttcccgcggggccgccgcccacccgggccttgcctctacctcagtcgttgccccccgattttcggctggagcccacggccccggccctcagcccccgctctagcttcgccagtagctcggccagcgacgcgagcaagccgtccagcccccggggcagcctgctgctggacggggcgggggctggcggagctggaggtagccggccctgcagcaatcgcaccagcggcatcagcatgggctacgaccagcgccacgggagccccttgccagcggggccgtgcctgtttggcccacccctggccggagcaccggcaggctattctcccggaggggtcccgtccgcctacccggagctccacgccgccctggaccgattgtacgctcagcggcccgcggggttcggctgccaggaaagccgccactcgtatcccccggccctgggcagccctggagctctagccggggccggagtgggagcggcggggcccttggagagacggggggcgcaacccggacgacactctgtgaccggctacggggactgcgccgtgggcgcccggtaccaggacgagctaacagctttgcttcgcctgacggtgggcaccggtgggcgagaagccggagcccgcggagaaccctcggggattgagccgtcgggtctggaggagccaccaggtcctttcgttccggaggccgcccgggcccggatgcgggagccagaggccagggaggactacttcggcacctgtatcaagtgcaacaaaggcatctatgggcagagcaatgcctgccaggccctggacagcctctaccacacccagtgctttgtttgctgctcttgtgggcgaactttgcgttgcaaggctttctacagtgtcaatggctctgtgtactgtgaggaagattatctgttttcagggtttcaggaggcagctgagaaatgctgtgtctgtggtcacttgattttggagaagatcctacaagcaatggggaagtcctatcatccaggctgtttccgatgcattgtttgcaacaagtgcctggatggcatccccttcacagtggacttctccaaccaagtatactgtgtcaccgactaccacaaaaattatgctcctaagtgtgcagcctgtggccaacccatcctcccctctgagggctgtgaggacatcgtgagggtgatatccatggaccgggattatcactttgagtgctaccactgtgaggactgccggatgcagctgagtgatgaggaaggctgctgctgtttccctctggatgggcacttgctctgccatggttgccacatgcagcggctcaatgcccgacaaccccctgccaactatatctgagctgcaatcactgctgctgctgtcaccctgcagacaaactgctgtggccagtgggcccctctgaggccagccaaggcaaagaatgcactctgcaggcctggcagaagagtcctctggggaggaccccaagggccggagacccaaagatcatgatattccaaatggattgtggaagagaaaccttatatttaccagggtgggggcgactggcctttttcccatgtgtgcagtctgagcttaggcacacacaggagggttccaggactttctgaacatctgattctgtatcttcagtatatatattttgtttgttttagagatgggatctcaccatgttgcccaggctagtcttgaactcctgggctcgaatgatcctcccaccttggcctcccaaagtgctgggattataggcgtaagccactgtgtctggcctagtgtatgattatgcatgagtcacgcaatgttctggtcctggattccaggagtagaggacctagctttaaatcaattagtttcatttgcttgaaactagttcacctaaagctagatctcttaaaaccaatttactgaaaacttgtttgcttaaagttaatgacttaatgactaatttgccaaaagctcaattcctattttggtgtgtttatatccatttaggtgtcctattcttttttgtcatgctttggatatttcaaggatttatatctattcatccaagagtacttctgagctattatcagcaacataaatttatcaaatttgcagcactttgtaaatgatgagattgcttcctacctttatggatgtctttttctatgttatctaccattcaaaaacttttttaaaaagtttaaagtttctagcaataaatacaattggtacaga

SEQ ID NO: 25406 - DNA, 4263 bp, Homo sapiens
aaagtagatccggccaggcagacaaaagtttgggagagaagttcggtctgtggctagcgtgagagctaggggggcgggggccggggagagtggggcagtcgggcgagtcgacgcgtgaacagatagacctgcggactggacagccgcggccagagaccctgctagccccgctcagccccagatgcgcggggggacgcagcccctcccgctgggggatgctgtgggattcctggcgcagggcatccaggccgcccgctaagcccctgtgcctcccctgtgcccctggggaaccagagtccggctgcagggaaagagaaccggccgccgagacgccgcagggtgccaggcggggagggggcgagaggccccaggcccgagggcatggagcggttaggagagaaagccagtcgcctgctggagaagttcggccgcagaaagggtgaatctagccggtctgggtctgacgggacccccgggccgggcaaggggcgcctaagtgggttggggggacctaggaagtcagggccccgaggagctactgggggacctggggatgagccgttggagccggcccgggagcaaggttccctggacgctgagcgaaatcagcgcggctcctttgaggcgccgcgctacgaaggctcttttcccgcggggccgccgcccacccgggccttgcctctacctcagtcgttgccccccgattttcggctggagcccacggccccggccctcagcccccgctctagcttcgccagtagctcggccagcgacgcgagcaagccgtccagcccccggggcagcctgctgctggacggggcgggggctggcggagctggaggtagccggccctgcagcaatcgcaccagcggcatcagcatgggctacgaccagcgccacgggagccccttgccagcggggccgtgcctgtttggcccacccctggccggagcaccggcaggctattctcccggaggggtcccgtccgcctacccggagctccacgccgccctggaccgattgtacgctcagcggcccgcggggttcggctgccaggaaagccgccactcgtatcccccggccctgggcagccctggagctctagccggggccggagtgggagcggcggggcccttggagagacggggggcgcaacccggacgacactctgtgaccggctacggggactgcgccgtgggcgcccggtaccaggacgagctaacagctttgcttcgcctgacggtgggcaccggtgggcgagaagccggagcccgcggagaaccctcggggattgagccgtcgggtctggaggagccaccaggtcctttcgttccggaggccgcccgggcccggatgcgggagccagaggccagggaggactacttcggcacctgtatcaagtgcaacaaaggcatctatgggcagagcaatgcctgccaggccctggacagcctctaccacacccagtgctttgtttgctgctcttgtgggcgaactttgcgttgcaaggctttctacagtgtcaatggctctgtgtactgtgaggaagattatctgttttcagggtttcaggaggcagctgagaaatgctgtgtctgtggtcacttgattttggagaagatcctacaagcaatggggaagtcctatcatccaggctgtttccgatgcattgtttgcaacaagtgcctggatggcatccccttcacagtggacttctccaaccaagtatactgtgtcaccgactaccacaaaaattatgctcctaagtgtgcagcctgtggccaacccatcctcccctctgagggctgtgaggacatcgtgagggtgatatccatggaccgggattatcactttgagtgctaccactgtgaggactgccggatgcagctgagtgatgaggaaggctgctgctgtttccctctggatgggcacttgctctgccatggttgccacatgcagcggctcaatgcccgacaaccccctgccaactatatctgagctgcaatcactgctgctgctgtcaccctgcagacaaactgctgtggccagtgggcccctctgaggccagccaaggcaaagaatgcactctgcaggcctggcagaagagtcctctggggaggaccccaagggccggagacccaaagatcatgatattccaaatggattgtggaagagaaaccttatatttaccagggtgggggcgactggcctttttcccatgtgtgcagtctgagcttaggcacacacaggagggttccaggactttctgaacatctgattctgtatcttcagtatatatattttgtttgttttagagatgggatctcaccatgttgcccaggctagtcttgaactcctgggctcgaatgatcctcccaccttggcctcccaaagtgctgggattataggcgtaagccactgtgtctggcctagtgtatgattatgcatgagtcacgcaatgttctggtcctggattccaggagtagaggacctagctttaaatcaattagtttcagctaaactgactagaaccaggtcaaagtgtaattctccctccagctcccccaaaccccagagttttggggttgtggttgatgcagtgtgggatgtccctgagaggtagcaagtctagggtggtgagttcctgctaggcaaccaaatttaagctcctcactttttgtgacacatggtgtcagatatggggtcccgcacctatatctggatgaagaggtagaaactctggacctcattaatgagttatttcttggccttcttctaaggactaggagagctccttatctgtctgagaatggggaccagctctgagtggggttgctgcctgtattccctgtttctcaggaacttacatgggtctggggaggctaggtaggtgattgtacgtggttgctcttctccttggctgggggaggtaatgagcagatctctgtgggtgtggagcttgttggggggatgtctaggaagcttcagcttagccacattcccaagtttaggtgcactgagccatatagcccagtgtatgcatgtgtgggtgtgttcatgcacacacacactctctctcttgtctctctgtctctctctcactctttcttactctcttctcaggtcacttgtacacttggtttcctagtagaagctcacttgccacctctcaggggggtcccggattgcatccatcacaatcccaaaactagagttggggggaactggagggagcaaaacactgatttgatactagtcagtttgcttgaaactagttcacctaaagctagatctcttaaaaccaatttactgaaaacttgtttgcttaaagttaatgacttaatgactaatttgccaaaagctcaattcctattttggtgtgtttatatccatttaggtgtcctattcttttttgtcatgctttggatatttcaaggatttatatctattcatccaagagtacttctgagctattatcagcaacataaatttatcaaatttgcagcactttgtaaatgatgagattgcttcctacctttatggatgtctttttctatgttatctaccattcaaaaacttttttaaaaagtttaaagtttctagcaataaatacaattggtacagacattttgtgtatcatttttttgtttcttaatccaatattcctttacaaattaaatgccttgaaaaatataatggagttcaatgtgattttgatgctttggtctaacttctacattcctactgttaaaaaggccagtatatcttaaacaaatgaataggcatgaggcatattcagttgacttacaatgaaaagttatacagacaacagtaataactaaaagggtgaatctgctaaatccttttgaaatgctgcagatttgataaatatttattttagactaattggttttaggtgaattggttttaggcaaattaatttagtaatctttgatctttagtcttcattttctgtcactcagtgagtttcttactggaaatgatgactcctgacaacagaatttccacatttgggggctattctaaggtgactatgccagccaacctgggaaatacataaaagagatctctgagtgagagggaaagaggtcagatttatacaactgagcgccagaggggaaaatgcaccttgttggagtgagaaatgttctgaaactgaattacttcttgtacagctgagatagcttcttctgaactattattaaataagtgaatacaaaggccctatgatgggaaatccag

SEQ ID NO: 25407 - DNA, 4474 bp, Homo sapiens
aaagtagatccggccaggcagacaaaagtttgggagagaagttcggtctgtggctagcgtgagagctaggggggcgggggccggggagagtggggcagtcgggcgagtcgacgcgtgaacagatagacctgcggactggacagccgcggccagagaccctgctagccccgctcagccccagatgcgcggggggacgcagcccctcccgctgggggatgctgtgggattcctggcgcagggcatccaggccgcccgctaagcccctgtgcctcccctgtgcccctggggaaccagagtccggctgcagggaaagagaaccggccgccgagacgccgcagggtgccaggcggggagggggcgagaggccccaggcccgagggcatggagcggttaggagagaaagccagtcgcctgctggagaagttcggccgcagaaagggtgaatctagccggtctgggtctgacgggacccccgggccgggcaaggggcgcctaagtgggttggggggacctaggaagtcagggccccgaggagctactgggggacctggggatgagccgttggagccggcccgggagcaaggttccctggacgctgagcgaaatcagcgcggctcctttgaggcgccgcgctacgaaggctcttttcccgcggggccgccgcccacccgggccttgcctctacctcagtcgttgccccccgattttcggctggagcccacggccccggccctcagcccccgctctagcttcgccagtagctcggccagcgacgcgagcaagccgtccagcccccggggcagcctgctgctggacggggcgggggctggcggagctggaggtagccggccctgcagcaatcgcaccagcggcatcagcatgggctacgaccagcgccacgggagccccttgccagcggggccgtgcctgtttggcccacccctggccggagcaccggcaggctattctcccggaggggtcccgtccgcctacccggagctccacgccgccctggaccgattgtacgctcagcggcccgcggggttcggctgccaggaaagccgccactcgtatcccccggccctgggcagccctggagctctagccggggccggagtgggagcggcggggcccttggagagacggggggcgcaacccggacgacactctgtgaccggctacggggactgcgccgtgggcgcccggtaccaggacgagctaacagctttgcttcgcctgacggtgggcaccggtgggcgagaagccggagcccgcggagaaccctcggggattgagccgtcgggtctggaggagccaccaggtcctttcgttccggaggccgcccgggcccggatgcgggagccagaggccagggaggactacttcggcacctgtatcaagtgcaacaaaggcatctatgggcagagcaatgcctgccaggccctggacagcctctaccacacccagtgctttgtttgctgctcttgtgggcgaactttgcgttgcaaggctttctacagtgtcaatggctctgtgtactgtgaggaagattatctgttttcagggtttcaggaggcagctgagaaatgctgtgtctgtggtcacttgattttggagaagatcctacaagcaatggggaagtcctatcatccaggctgtttccgatgcattgtttgcaacaagtgcctggatggcatccccttcacagtggacttctccaaccaagtatactgtgtcaccgactaccacaaaaattatgctcctaagtgtgcagcctgtggccaacccatcctcccctctgagggctgtgaggacatcgtgagggtgatatccatggaccgggattatcactttgagtgctaccactgtgaggactgccggatgcagctgagtgatgaggaaggctgctgctgtttccctctggatgggcacttgctctgccatggttgccacatgcagcggctcaatgcccgacaaccccctgccaactatatctgagctgcaatcactgctgctgctgtcaccctgcagacaaactgctgtggccagtgggcccctctgaggccagccaaggcaaagaatgcactctgcaggcctggcagaagagtcctctggggaggaccccaagggccggagacccaaagatcatgatattccaaatggattgtggaagagaaaccttatatttaccagggtgggggcgactggcctttttcccatgtgtgcagtctgagcttaggcacacacaggagggttccaggactttctgaacatctgattctgtatcttcagtatatatattttgtttgttttagagatgggatctcaccatgttgcccaggctagtcttgaactcctgggctcgaatgatcctcccaccttggcctcccaaagtgctgggattataggcgtaagccactgtgtctggcctagtgtatgattatgcatgagtcacgcaatgttctggtcctggattccaggagtagaggacctagctttaaatcaattagtttcagctaaactgactagaaccaggtcaaagtgtaattctccctccagctcccccaaaccccagagttttggggttgtggttgatgcagtgtgggatgtccctgagaggtagcaagtctagggtggtgagttcctgctaggcaaccaaatttaagctcctcactttttgtgacacatggtgtcagatatggggtcccgcacctatatctggatgaagaggtagaaactctggacctcattaatgagttatttcttggccttcttctaaggactaggagagctccttatctgtctgagaatggggaccagctctgagtggggttgctgcctgtattccctgtttctcaggaacttacatgggtctggggaggctaggtaggtgattgtacgtggttgctcttctccttggctgggggaggtaatgagcagatctctgtgggtgtggagcttgttggggggatgtctaggaagcttcagcttagccacattcccaagtttaggtgcactgagccatatagcccagtgtatgcatgtgtgggtgtgttcatgcacacacacactctctctcttgtctctctgtctctctctcactctttcttactctcttctcaggtcacttgtacacttggtttcctagtagaagctcacttgccacctctcaggggggtcccggattgcatccatcacaatcccaaaactagagttggggggaactggagggagcaaaacactgatttgatactagtcagtttgcttgaaactagttcacctaaagctagatctcttaaaaccaatttactgaaaacttgtttgcttaaagttaatgacttaatgactaatttgccaaaagctcaattcctattttggtgtgtttatatccatttaggtgtcctattcttttttgtcatgctttggatatttcaaggatttatatctattcatccaagagtacttctgagctattatcagcaacataaatttatcaaatttgcagcactttgtaaatgatgagattgcttcctacctttatggatgtctttttctatgttatctaccattcaaaaacttttttaaaaagtttaaagtttctagcaataaatacaattggtacagacattttgtgtatcatttttttgtttcttaatccaatattcctttacaaattaaatgccttgaaaaatataatggagttcaatgtgattttgatgctttggtctaacttctacattcctactgttaaaaaggccagtatatcttaaacaaatgaataggcatgaggcatattcagttgacttacaatgaaaagttatacagacaacagtaataactaaaagggtgaatctgctaaatccttttgaaatgctgcagatttgataaatatttattttagactaattggttttaggtgaattggttttaggcaaattaatttagtaatctttgatctttagtcttcattttctgtcactcagtgagtttcttactggaaatgatgactcctgacaacagaatttccacatttgggggctattctaaggtgactatgccagccaacctgggaaatacataaaagagatctctgagtgagagggaaagaggtcagatttatacaactgagcgccagaggggaaaatgcaccttgttggagtgagaaatgttctgaaactgaattacttcttgtacagctgagatagcttcttctgaactattattaaataagtgaatacaaaggccctatgatgggaaatccagacaagcttgtgtaactttacatccatcccctcagggatatttttttttttttttttgagactccatctcaaaaaaaaggaaaaggatggccaggcacagtggctcatgcctgtaatcccagcactttggaaggctgaggtgggaggatcgcttgagtccaggagttcaacaccagcctgggccacatagtgggaccctgactctacaaaaa

SEQ ID NO: 25408 - DNA, 4250 bp, Homo sapiens
aaagtagatccggccaggcagacaaaagtttgggagagaagttcggtctgtggctagcgtgagagctaggggggcgggggccggggagagtggggcagtcgggcgagtcgacgcgtgaacagatagacctgcggactggacagccgcggccagagaccctgctagccccgctcagccccagatgcgcggggggacgcagcccctcccgctgggggatgctgtgggattcctggcgcagggcatccaggccgcccgctaagcccctgtgcctcccctgtgcccctggggaaccagagtccggctgcagggaaagagaaccggccgccgagacgccgcagggtgccaggcggggagggggcgagaggccccaggcccgagggcatggagcggttaggagagaaagccagtcgcctgctggagaagttcggccgcagaaagggtgaatctagccggtctgggtctgacgggacccccgggccgggcaaggggcgcctaagtgggttggggggacctaggaagtcagggccccgaggagctactgggggacctggggatgagccgttggagccggcccgggagcaaggttccctggacgctgagcgaaatcagcgcggctcctttgaggcgccgcgctacgaaggctcttttcccgcggggccgccgcccacccgggccttgcctctacctcagtcgttgccccccgattttcggctggagcccacggccccggccctcagcccccgctctagcttcgccagtagctcggccagcgacgcgagcaagccgtccagcccccggggcagcctgctgctggacggggcgggggctggcggagctggaggtagccggccctgcagcaatcgcaccagcggcatcagcatgggctacgaccagcgccacgggagccccttgccagcggggccgtgcctgtttggcccacccctggccggagcaccggcaggctattctcccggaggggtcccgtccgcctacccggagctccacgccgccctggaccgattgtacgctcagcggcccgcggggttcggctgccaggaaagccgccactcgtatcccccggccctgggcagccctggagctctagccggggccggagtgggagcggcggggcccttggagagacggggggcgcaacccggacgacactctgtgaccggctacggggactgcgccgtgggcgcccggtaccaggacgagctaacagctttgcttcgcctgacggtgggcaccggtgggcgagaagccggagcccgcggagaaccctcggggattgagccgtcgggtctggaggagccaccaggtcctttcgttccggaggccgcccgggcccggatgcgggagccagaggccagggaggactacttcggcacctgtatcaagtgcaacaaaggcatctatgggcagagcaatgcctgccaggccctggacagcctctaccacacccagtgctttgtttgctgctcttgtgggcgaactttgcgttgcaaggctttctacagtgtcaatggctctgtgtactgtgaggaagattatctgttttcagggtttcaggaggcagctgagaaatgctgtgtctgtggtcacttgattttggagaagatcctacaagcaatggggaagtcctatcatccaggctgtttccgatgcattgtttgcaacaagtgcctggatggcatccccttcacagtggacttctccaaccaagtatactgtgtcaccgactaccacaaaaattatgctcctaagtgtgcagcctgtggccaacccatcctcccctctgagggctgtgaggacatcgtgagggtgatatccatggaccgggattatcactttgagtgctaccactgtgaggactgccggatgcagctgagtgatgaggaaggctgctgctgtttccctctggatgggcacttgctctgccatggttgccacatgcagcggctcaatgcccgacaaccccctgccaactatatctgagctgcaatcactgctgctgctgtcaccctgcagacaaactgctgtggccagtgggcccctctgaggccagccaaggcaaagaatgcactctgcaggcctggcagaagagtcctctggggaggaccccaagggccggagacccaaagatcatgatattccaaatggattgtggaagagaaaccttatatttaccagggtgggggcgactggcctttttcccatgtgtgcagtctgagcttaggcacacacaggagggttccaggactttctgaacatctgattctgtatcttcagtatatatattttgtttgttttagagatgggatctcaccatgttgcccaggctagtcttgaactcctgggctcgaatgatcctcccaccttggcctcccaaagtgctgggattataggcgtaagccactgtgtctggcctagtgtatgattatgcatgagtcacgcaatgttctggtcctggattccaggagtagaggacctagctttaaatcaattagtttcagctaaactgactagaaccaggtcaaagtgtaattctccctccagctcccccaaaccccagagttttggggttgtggttgatgcagtgtgggatgtccctgagaggtagcaagtctagggtggtgagttcctgctaggcaaccaaatttaagctcctcactttttgtgacacatggtgtcagatatggggtcccgcacctatatctggatgaagaggtagaaactctggacctcattaatgagttatttcttggccttcttctaaggactaggagagctccttatctgtctgagaatggggaccagctctgagtggggttgctgcctgtattccctgtttctcaggaacttacatgggtctggggaggctaggtaggtgattgtacgtggttgctcttctccttggctgggggaggtaatgagcagatctctgtgggtgtggagcttgttggggggatgtctaggaagcttcagcttagccacattcccaagtttaggtgcactgagccatatagcccagtgtatgcatgtgtgggtgtgttcatgcacacacacactctctctcttgtctctctgtctctctctcactctttcttactctcttctcaggtcacttgtacacttggtttcctagtagaagctcacttgccacctctcaggggggtcccggattgcatccatcacaatcccaaaactagagttggggggaactggagggagcaaaacactgatttgatactagtcagtttgcttgaaactagttcacctaaagctagatctcttaaaaccaatttactgaaaacttgtttgcttaaagttaatgacttaatgactaatttgccaaaagctcaattcctattttggtgtgtttatatccatttaggtgtcctattcttttttgtcatgctttggatatttcaaggatttatatctattcatccaagagtacttctgagctattatcagcaacataaatttatcaaatttgcagcactttgtaaatgatgagattgcttcctacctttatggatgtctttttctatgttatctaccattcaaaaacttttttaaaaagtttaaagtttctagcaataaatacaattggtacagaaaaaaaaaaaaaaaaaaaaaaaaaaaaaaaaaaaaaaaagaaaaaaaaaaaaaaaacaacaacaacaacaaagagagagagagagcgacagcgcccacagaaaaaaaatccaacatgaggggcgcaccacacgaagcacaagagagacgcacacagcaatagaggaaaaccaaagagggaccccactaaagagaggatcaacattaaaaaggaggaagcagggcgagaaagcgaggaccccctaataaagcaaacagcgagactagagggaaaaacaacaagagcaaacaacgcggcgaccacctaacaacaagagacaccacacataaaacaagaggaaggacaaagtaagacacaaatagaggaaacagaaacaagcacgaagaacaggagacaagaacccgaccacgaaagaaggaaaaaacagcaaaagaagaaaagaggaggagagaagagcgaaaaaacagcgggagcaacacaacacacaaagaagaagagaaaaaagacacggaggcccgccaccaaaaaaacacatcggagaaaaagaaaaaggggagagatgcggcgactaagcccgaagaacaacggaacgacacaccacagcgggggaagacacaaaagaaaa

SEQ ID NO: 25409 - DNA, 1988 bp, Homo sapiens
  misc_feature (1)..(1): n is a, c, g, or t
  misc_feature (5)..(5): n is a, c, g, or t
ncttnacaggcatacgccaccacgcccggctgacttctgtatttttagtagagatgttttttcagtatgctggtctcaaactcttgaccttgtgatgtgcctgccttggcctcccaaagtgctgggattataggcgtaagccactgtgtctggcctagtgtatgattatgcatgagtcacgcaatgttctggtcctggattccaggagtagaggacctagctttaaatcaattagtttcagctaaactgactagaaccaggtcaaagtgtaattctccctccagctcccccaaaccccagagttttggggttgtggttgatgcagtgtgggatgtccctgagaggtagcaagtctagggtggtgagttcctgctaggcaaccaaatttaagctcctcactttttgtgacacatggtgtcagatatggggtcccgcacctatatctggatgaagaggtagaaactctggacctcattaatgagttatttcttggccttcttctaaggactaggagagctccttatctgtctgagaatggggaccagctctgagtggggttgctgcctgtattccctgtttctcaggaacttacatgggtctggggaggctaggtaggtgattgtacgtggttgctcttctccttggctgggggaggtaatgagcagatctctgtgggtgtggagcttgttggggggatgtctaggaagcttcagcttagccacattcccaagtttaggtgcactgagccatatagcccagtgtatgcatgtgtgggtgtgttcatgcacacacacactctctctcttgtctctctgtctctctctcactctttcttactctcttctcaggtcacttgtacacttggtttcctagtagaagctcacttgccacctctcaggggggtcccggattgcatccatcacaatcccaaaactagagttggggggaactggagggagcaaaacactgatttgatactagtcagtttgcttgaaactagttcacctaaagctagatctcttaaaaccaatttactgaaaacttgtttgcttaaagttaatgacttaatgactaatttgccaaaagctcaattcctattttggtgtgtttatatccatttaggtgtcctattcttttttgtcatgctttggatatttcaaggatttatatctattcatccaagagtacttctgagctattatcagcaacataaatttatcaaatttgcagcactttgtaaatgatgagattgcttcctacctttatggatgtctttttctatgttatctaccattcaaaaacttttttaaaaagtttaaagtttctagcaataaatacaattggtacagacattttgtgtatcatttttttgtttcttaatccaatattcctttacaaattaaatgccttgaaaaatataatggagttcaatgtgattttgatgctttggtctaacttctacattcctactgttaaaaaggccagtatatcttaaacaaatgaataggcatgaggcatattcagttgacttacaatgaaaagttatacagacaacagtaataactaaaagggtgaatctgctaaatccttttgaaatgctgcagatttgataaatatttattttagactaattggttttaggtgaattggttttaggcaaattaatttagtaatctttgatctttagtcttcattttctgtcactcagtgagtttcttactggaaatgatgactcctgacaacagaatttccacatttgggggctattctaaggtgactatgccagccaacctgggaaatacataaaagagatctctgagtgagagggaaagaggtcagatttatacaactgagcgccagaggggaaaatgcaccttgttggagtgagaaatgttctgaaactgaattacttcttgtacagctgagatagcttcttctgaactattattaaataagtgaatacaaaggccctatgatgggaaatccag

SEQ ID NO: 25410 - DNA, 2006 bp, Homo sapiens
aaagtagatccggccaggcagacaaaagtttgggagagaagttcggtctgtggctagcgtgagagctaggggggcgggggccggggagagtggggcagtcgggcgagtcgacgcgtgaacagatagacctgcggactggacagccgcggccagagaccctgctagccccgctcagccccagatgcgcggggggacgcagcccctcccgctgggggatgctgtgggattcctggcgcagggcatccaggccgcccgctaagcccctgtgcctcccctgtgcccctggggaaccagagtccggctgcagggaaagagaaccggccgccgagacgccgcagggtgccaggcggggagggggcgagaggccccaggcccgagggcatggagcggttaggagagaaagccagtcgcctgctggagaagttcggccgcagaaagggtgaatctagccggtctgggtctgacgggacccccgggccgggcaaggggcgcctaagtgggttggggggacctaggaagtcagggccccgaggagctactgggggacctggggatgagccgttggagccggcccgggagcaaggttccctggacgctgagcgaaatcagcgcggctcctttgaggcgccgcgctacgaaggctcttttcccgcggggccgccgcccacccgggccttgcctctacctcagtcgttgccccccgattttcggctggagcccacggccccggccctcagcccccgctctagcttcgccagtagctcggccagcgacgcgagcaagccgtccagcccccggggcagcctgctgctggacggggcgggggctggcggagctggaggtagccggccctgcagcaatcgcaccagcggcatcagcatgggctacgaccagcgccacgggagccccttgccagcggggccgtgcctgtttggcccacccctggccggagcaccggcaggctattctcccggaggggtcccgtccgcctacccggagctccacgccgccctggaccgattgtacgctcagcggcccgcggggttcggctgccaggaaagccgccactcgtatcccccggccctgggcagccctggagctctagccggggccggagtgggagcggcggggcccttggagagacggggggcgcaacccggacgacactctgtgaccggctacggggactgcgccgtgggcgcccggtaccaggacgagctaacagctttgcttcgcctgacggtgggcaccggtgggcgagaagccggagcccgcggagaaccctcggggattgagccgtcgggtctggaggagccaccaggtcctttcgttccggaggccgcccgggcccggatgcgggagccagaggccagggaggactacttcggcacctgtatcaagtgcaacaaaggcatctatgggcagagcaatgcctgccaggccctggacagcctctaccacacccagtgctttgtttgctgctcttgtgggcgaactttgcgttgcaaggctttctacagtgtcaatggctctgtgtactgtgaggaagattatctgttttcagggtttcaggaggcagctgagaaatgctgtgtctgtggtcacttgattttggagaagatcctacaagcaatggggaagtcctatcatccaggctgtttccgatgcattgtttgcaacaagtgcctggatggcatccccttcacagtggacttctccaaccaagtatactgtgtcaccgactaccacaaatgctaggcctctgttgcatggctgtacaaagaacataagagtccatatttctagtggatttgtaaaataagtgtgtgtgagacacttgcgtttgaagaaagatctagggtcctgggtctcttgcatttatatgtcagaaaaggggcgatatgctgctgaggggtgagtgcatatgagtgtggccctgaggaccagggctggcagatgttgtctacctgctgaagaataaagatttcttttggtaaaaaaaaaaa

SEQ ID NO: 25411 - DNA, 538 bp, Homo sapiens
ctcagttttcttttctgtaaaaacaaaagataggattaaatcagtgattctcaatcatggtagcctagcagatcagctgggaagaactaaaaaacaaaacaaaacaaaaaacagtgtttggatcccatcaccacagattgtgataataggcctggaggagggccaaagcattgatgttttttaaaagctgcctaggtgatcctgatatgcagccagagtgaaacactgctggcctgaatgctctctcaggcacttttcagggtctccgcctccattttacgacttcttcaccgacattacatagcattgttctgggagtatagcagcgggttggatgaggttaatgggagtaataaggagcataatgggcagctggagagctgggactggagggagactgattctcttgctaccccatgagccagatcctacaagcaatggggaagtcctatcatccaggctgtttccgatgcattgtttgcaacaagtgcctggatggcatccccttcacagtggacttctccaaccaagtatactg

SEQ ID NO: 25412 - DNA, 1821 bp, Homo sapiens
aaagtagatccggccaggcagacaaaagtttgggagagaagttcggtctgtggctagcgtgagagctaggggggcgggggccggggagagtggggcagtcgggcgagtcgacgcgtgaacagatagacctgcggactggacagccgcggccagagaccctgctagccccgctcagccccagatgcgcggggggacgcagcccctcccgctgggggatgctgtgggattcctggcgcagggcatccaggccgcccgctaagcccctgtgcctcccctgtgcccctggggaaccagagtccggctgcagggaaagagaaccggccgccgagacgccgcagggtgccaggcggggagggggcgagaggccccaggcccgagggcatggagcggttaggagagaaagccagtcgcctgctggagaagttcggccgcagaaagggtgaatctagccggtctgggtctgacgggacccccgggccgggcaaggggcgcctaagtgggttggggggacctaggaagtcagggccccgaggagctactgggggacctggggatgagccgttggagccggcccgggagcaaggttccctggacgctgagcgaaatcagcgcggctcctttgaggcgccgcgctacgaaggctcttttcccgcggggccgccgcccacccgggccttgcctctacctcagtcgttgccccccgattttcggctggagcccacggccccggccctcagcccccgctctagcttcgccagtagctcggccagcgacgcgagcaagccgtccagcccccggggcagcctgctgctggacggggcgggggctggcggagctggaggtagccggccctgcagcaatcgcaccagcggcatcagcatgggctacgaccagcgccacgggagccccttgccagcggggccgtgcctgtttggcccacccctggccggagcaccggcaggctattctcccggaggggtcccgtccgcctacccggagctccacgccgccctggaccgattgtacgctcagcggcccgcggggttcggctgccaggaaagccgccactcgtatcccccggccctgggcagccctggagctctagccggggccggagtgggagcggcggggcccttggagagacggggggcgcaacccggacgacactctgtgaccggctacggggactgcgccgtgggcgcccggtaccaggacgagctaacagctttgcttcgcctgacggtgggcaccggtgggcgagaagccggagcccgcggagaaccctcggggattgagccgtcgggtctggaggagccaccaggtcctttcgttccggaggccgcccgggcccggatgcgggagccagaggccagggaggactacttcggaatcatgctcacatggtcccctctgcacggagccctctgccaagccagatccttttctccatccttggaagtctgcagtggagagaaatcattctataactgaacagctcgtttgactgatgggaaactgaagtcccagagacgatttctgggcctagcctgctttctctagaaagtattttcaagtctgctgctgagcacctgtggactggcatctttgaccgttcatcctacacactgcaacagagatcataccttgcctgtgtagtcttttctccccaacagaaactaagcatctgaatgccagggaccatatcttcgactttctccaggtttccttaggtagtggtgctgtgttaagcacaaaacagatgctcagaaaatatctgttgagtaattaaataaacaagaatggatctgctcaaacaagatc

SEQ ID NO: 25413 - DNA, 3625 bp, Homo sapiens
aaagtagatccggccaggcagacaaaagtttgggagagaagttcggtctgtggctagcgtgagagctaggggggcgggggccggggagagtggggcagtcgggcgagtcgacgcgtgaacagatagacctgcggactggacagccgcggccagagaccctgctagccccgctcagccccagatgcgcggggggacgcagcccctcccgctgggggatgctgtgggattcctggcgcagggcatccaggccgcccgctaagcccctgtgcctcccctgtgcccctggggaaccagagtccggctgcagggaaagagaaccggccgccgagacgccgcagggtgccaggcggggagggggcgagaggccccaggcccgagggcatggagcggttaggagagaaagccagtcgcctgctggagaagttcggccgcagaaagggtgaatctagccggtctgggtctgacgggacccccgggccgggcaaggggcgcctaagtgggttggggggacctaggaagtcagggccccgaggagctactgggggacctggggatgagccgttggagccggcccgggagcaaggttccctggacgctgagcgaaatcagcgcggctcctttgaggcgccgcgctacgaaggctcttttcccgcggggccgccgcccacccgggccttgcctctacctcagtcgttgccccccgattttcggctggagcccacggccccggccctcagcccccgctctagcttcgccagtagctcggccagcgacgcgagcaagccgtccagcccccggggcagcctgctgctggacggggcgggggctggcggagctggaggtagccggccctgcagcaatcgcaccagcggcatcagcatgggctacgaccagcgccacgggagccccttgccagcggggccgtgcctgtttggcccacccctggccggagcaccggcaggctattctcccggaggggtcccgtccgcctacccggagctccacgccgccctggaccgattgtacgctcagcggcccgcggggttcggctgccaggaaagccgccactcgtatcccccggccctgggcagccctggagctctagccggggccggagtgggagcggcggggcccttggagagacggggggcgcaacccggacgacactctgtgaccggctacggggactgcgccgtgggcgcccggtaccaggacgagctaacagctttgcttcgcctgacggtgggcaccggtgggcgagaagccggagcccgcggagaaccctcggggattgagccgtcgggtctggaggagccaccaggtcctttcgttccggaggccgcccgggcccggatgcgggagccagaggccagggaggactacttcggcacctgtatcaagtgcaacaaaggcatctatgggcagagcaatgcctgccaggccctggacagcctctaccacacccagtgctttgtttgctgctcttgtgggcgaactttgcgttgcaaggctttctacagtgtcaatggctctgtgtactgtgaggaagattatctgttttcagggtttcaggaggcagctgagaaatgctgtgtctgtggtcacttgattttggagaagatcctacaagcaatggggaagtcctatcatccaggctgtttccgatgcattgtttgcaacaagtgcctggatggcatccccttcacagtggacttctccaaccaagtatactgtgtcaccgactaccacaaaaattatgctcctaagtgtgcagcctgtggccaacccatcctcccctctgagggctgtgaggacatcgtgagggtgatatccatggaccgggattatcactttgagtgctaccactgtgaggactgccggatgcagctgagtgatgaggaaggctgctgctgtttccctctggatgggcacttgctctgccatggttgccacatgcagcggctcaatgcccgacaaccccctgccaactatatctgagctgcaatcactgctgctgctgtcaccctgcagacaaactgctgtggccagtgggcccctctgaggccagccaaggcaaagaatgcactctgcaggcctggcagaagagtcctctggggaggaccccaagggccggagacccaaagatcatgatattccaaatggattgtggaagagaaaccttatatttaccagggtgggggcgactggcctttttcccatgtgtgcagtctgagcttaggcacacacaggagggttccaggactttctgaacatctgattctgtatcttcagtatatatattttgtttgttttagagatgggatctcaccatgttgcccaggctagtcttgaactcctgggctcgaatgatcctcccaccttggcctcccaaagtgctgggattataggcgtaagccactgtgtctggcctagtgtatgattatgcatgagtcacgcaatgttctggtcctggattccaggagtagaggacctagctttaaatcaattagtttcagctaaactgactagaaccaggtcaaagtgtaattctccctccagctcccccaaaccccagagttttggggttgtggttgatgcagtgtgggatgtccctgagaggtagcaagtctagggtggtgagttcctgctaggcaaccaaatttaagctcctcactttttgtgacacatggtgtcagatatggggtcccgcacctatatctggatgaagaggtagaaactctggacctcattaatgagttatttcttggccttcttctaaggactaggagagctccttatctgtctgagaatggggaccagctctgagtggggttgctgcctgtattccctgtttctcaggaacttacatgggtctggggaggctaggtaggtgattgtacgtggttgctcttctccttggctgggggaggtaatgagcagatctctgtgggtgtggagcttgttggggggatgtctaggaagcttcagcttagccacattcccaagtttaggtgcactgagccatatagcccagtgtatgcatgtgtgggtgtgttcatgcacacacacactctctctcttgtctctctgtctctctctcactctttcttactctcttctcaggtcacttgtacacttggtttcctagtagaagctcacttgccacctctcaggggggtcccggattgcatccatcacaatcccaaaactagagttggggggaactggagggagcaaaacactgatttgatactagtcagtttgcttgaaactagttcacctaaagctagatctcttaaaaccaatttactgaaaacttgtttgcttaaagttaatgacttaatgactaatttgccaaaagctcaattcctattttggtgtgtttatatccatttaggtgtcctattcttttttgtcatgctttggatatttcaaggatttatatctattcatccaagagtacttctgagctattatcagcaacataaatttatcaaatttgcagcactttgtaaatgatgagattgcttcctacctttatggatgtctttttctatgttatctaccattcaaaaacttttttaaaaagtttaaagtttctagcaataaatacaattggtacaga

SEQ ID NO: 25414 - DNA, 3324 bp, Homo sapiens
aaagtagatccggccaggcagacaaaagtttgggagagaagttcggtctgtggctagcgtgagagctaggggggcgggggccggggagagtggggcagtcgggcgagtcgacgcgtgaacagatagacctgcggactggacagccgcggccagagaccctgctagccccgctcagccccagatgcgcggggggacgcagcccctcccgctgggggatgctgtgggattcctggcgcagggcatccaggccgcccgctaagcccctgtgcctcccctgtgcccctggggaaccagagtccggctgcagggaaagagaaccggccgccgagacgccgcagggtgccaggcggggagggggcgagaggccccaggcccgagggcatggagcggttaggagagaaagccagtcgcctgctggagaagttcggccgcagaaagggtgaatctagccggtctgggtctgacgggacccccgggccgggcaaggggcgcctaagtgggttggggggacctaggaagtcagggccccgaggagctactgggggacctggggatgagccgttggagccggcccgggagcaaggttccctggacgctgagcgaaatcagcgcggctcctttgaggcgccgcgctacgaaggctcttttcccgcggggccgccgcccacccgggccttgcctctacctcagtcgttgccccccgattttcggctggagcccacggccccggccctcagcccccgctctagcttcgccagtagctcggccagcgacgcgagcaagccgtccagcccccggggcagcctgctgctggacggggcgggggctggcggagctggaggtagccggccctgcagcaatcgcaccagcggcatcagcatgggctacgaccagcgccacgggagccccttgccagcggggccgtgcctgtttggcccacccctggccggagcaccggcaggctattctcccggaggggtcccgtccgcctacccggagctccacgccgccctggaccgattgtacgctcagcggcccgcggggttcggctgccaggaaagccgccactcgtatcccccggccctgggcagccctggagctctagccggggccggagtgggagcggcggggcccttggagagacggggggcgcaacccggacgacactctgtgaccggctacggggactgcgccgtgggcgcccggtaccaggacgagctaacagctttgcttcgcctgacggtgggcaccggtgggcgagaagccggagcccgcggagaaccctcggggattgagccgtcgggtctggaggagccaccaggtcctttcgttccggaggccgcccgggcccggatgcgggagccagaggccagggaggactacttcggcacctgtatcaagtgcaacaaaggcatctatgggcagagcaatgcctgccaggccctggacagcctctaccacacccagtgctttgtttgctgctcttgtgggcgaactttgcgttgcaaggctttctacagtgtcaatggctctgtgtactgtgaggaagattatctgttttcagggtttcaggaggcagctgagaaatgctgtgtctgtggtcacttgattttggagaagatcctacaagcaatggggaagtcctatcatccaggctgtttccgatgcattgtttgcaacaagtgcctggatggcatccccttcacagtggacttctccaaccaagtatactgtgtcaccgactaccacaaaaattatgctcctaagtgtgcagcctgtggccaacccatcctcccctctgagggctgtgaggacatcgtgagggtgatatccatggaccgggattatcactttgagtgctaccactgtgaggactgccggatgcagctgagtgatgaggaaggctgctgctgtttccctctggatgggcacttgctctgccatggttgccacatgcagcggctcaatgcccgacaaccccctgccaactatatctgagctgcaatcactgctgctgctgtcaccctgcagacaaactgctgtggccagtgggcccctctgaggccagccaaggcaaagaatgcactctgcaggcctggcagaagagtcctctggggaggaccccaagggccggagacccaaagatcatgatattccaaatggattgtggaagagaaaccttatatttaccagggtgggggcgactggcctttttcccatgtgtgcagtctgagcttaggcacacacaggagggttccaggactttctgaacatctgattctgtatcttcagtatatatattttgtttgttttagagatgggatctcaccatgttgcccaggctagtcttgaactcctgggctcgaatgatcctcccaccttggcctcccaaagtgctgggattataggcgtaagccactgtgtctggcctagtgtatgattatgcatgagtcacgcaatgttctggtcctggattccaggagtagaggacctagctttaaatcaattagtttcagctaaactgactagaaccaggtcaaagtgtaattctccctccagctcccccaaaccccagagttttggggttgtggttgatgcagtgtgggatgtccctgagaggtagcaagtctagggtggtgagttcctgctaggcaaccaaatttaagctcctcactttttgtgacacatggtgtcagatatggggtcccgcacctatatctggatgaagaggtagaaactctggacctcattaatgagttatttcttggccttcttctaaggactaggagagctccttatctgtctgagaatggggaccagctctgagtggggttgctgcctgtattccctgtttctcaggaacttacatgggtctggggaggctaggtaggtgattgtacgtggttgctcttctccttggctgggggaggtaatgagcagatctctgtgggtgtggagcttgttggggggatgtctaggaagcttcagcttagccacattcccaagtttaggtgcactgagccatatagcccagtgtatgcatgtgtgggtgtgttcatgcacacacacactctctctcttgtctctctgtctctctctcactctttcttactctcttctcaggtcacttgtacacttggtttcctagtagaagctcacttgccacctctcaggggggtcccggattgcatccatcacaatcccaaaccccagagttttggggcttgtggttgatagcagtgtgggatgtccctgagaggtagcaagtctagggtggtgagttcctgctaggcaaccaaatttaaactcctcactataatcaag

SEQ ID NO: 25415 - DNA, 468 bp, Homo sapiens
tccctctccctaccacccagttactctgaagggatgataacagccattggggggttaaaaagaggcagtgaaccccccagttaatgagtaggaattcagcaggcagtgtaagataaatggagctctctctgcttctgctagagtcagcatgaactgccgccctgcggcttgtttgtggcaaatggagtgcgcgaaatatcaaagggcagtgatccagaagaagaccgactttgacaaattttaaattggccagaaagaaaaccagcaaaaagaaaaaaaaaagggaaaagaaaaaggaagaaaaaaaggaaaaaggaaaatgatgcaatttgctgtgtcctgcaatttgcgcattgctgcctttgtatggaattagtggtaaacacagcggcaacaattgggggatgctgggagcaattatgagccatctaagtgagatgcttatcagtggtgaagcttttagagctc

SEQ ID NO: 25416 - DNA, 461 bp, Homo sapiens
ctgcattttaggcaatgtggaccccacctcagtttagaatctggctagatatcttttctatacatggtctaacctgaatgtataaagcagttatttccaacaagtggcaacctgtcatgacactaactgtacaagcagttaatgcacagaatgagccttacctgccagagatcacagagatctatggaggtcacagcacaggtgtgacttgaaggacgagaaggaatggggaaggcagaccaggaagaagggggacatcggcaaagaccccaaagtgggaaaactcaaggtcaattcagggctcaagatgtgctgcctgcttatctgaagtagcgtctctgcgatgagctcagactaaagagggtctttggttacctttttaaactttgggcccataatgaggactcaagaaatacttgctgggttgttaattaatccagtgtagcagagatttgtttttt

SEQ ID NO: 25417 - DNA, 231 bp, Homo sapiens
gttaaataaaaaagatgccacaaatataacagaaaaagaaaagggcaatacaaatatagttttgtcatactgctattctatgacaaaataaatcaattgtatcagcatagtctaattgccctttctactgatagatactcctcctcctgcatcttagcagcttctaaccccagtgcattctcaaacttgactgcaatggaatcatctagaaagcttaaaaaaaaaaaaaaa

SEQ ID NO: 25418 - DNA, 428 bp, Homo sapiens
tttcacaatgttgggcaggatggtttcgatctcttgacctcatgatctgcctgcctcggccttccaaagtgctgggattacaggtgtgagccactgcgcccgggcttatttgcttttttgtttgttcatttattgctctttgtgggcaaggactcatccctgttgttcgttgttgtatttgtattccaagaacataaattactgcctggcacataaagagtgttccataatttcatgtgcgtccgtgtgaagagaccaccaaacaggctttgtgtgagcaataaagctgtttatttcacctgggtgcaggcgggctgagtctgaaaagagagtcagtgaagggagatagaggtggggcattttataggatttgggtaggtaaaggaaaaaggatggttgttctgtggtgggcaggagtgggggtcaca

SEQ ID NO: 25419 - DNA, 492 bp, Homo sapiens
cctgctccatacttaaggtttgtgatgccaacatttggattctctcttggtgccaatcagtggctgttagaggctactcaggtgtaccccaaacagaaggcacatggatctggggcgactgttccaggtcctcccaacctctgaagtgctcagtagcccaacaacaaggctgctgggggcctgttcttcagcccccgtcagggcggggccagcctctctgtccaatgctgcctggacatttactggggaggtgagtagcaggcccagctccaggatctgaattggaatctcagattctctggataaagaatctgtctcaagtcaggaggtcctcattctgcgactcccaaccagggtggagtgggcacagacaggatgccttatgcttatctctagcacattccagggggttccagggttcctgcacctggaatccagtgtgtccaagccagtattaaattatctcaacacattccacagaccagactgcct

SEQ ID NO: 25420 - DNA, 705 bp, Homo sapiens
tttctgtatacccaaaatatgtacatttaatatatgtgatataacatctttccgtgttccagtagatttcccattctttttcacaggtacccagtgttctgtataatttattaaccatttatctacgcataaacacctgagttaatagtttttaaatattacaaatggtgctgcagtaaatattgctaggcatatttatgtatctttgctacttttgtgaatatatataatagggataaattcctggaagtgaaattgctggttatagggaaatatttgactaaaattttattgtttcgggaggtccacatctgaaattttgataactattgtcaaactgttcaaaaatcctgaaccagtgtacatctctgttaacagttgatccctcctgactctcccacattctcacaaatataaactgatttcttctttctcccctccttccttccctcccttctctccttctctcccaccctccttccttcttcttccttttttaaacagtttaattttctaatttctgatcacagcccctatgtttgcattatctacaaaaatcttcttgcctggcacagtagctcaagtctttaatcccagctctttgggaggccaaggagggcagattgcttgagcccaggagttcaaaccagcctgggcaacgtggtgaaaacctgtctctaccaaaaaaaaaaaaaaaaaaaaaat

SEQ ID NO: 25421 - DNA, 459 bp, Homo sapiens
gcaatgcccagccctaaaagccatgttttaactttcctaaaaatttctcatcataaaatttgtgaccattaatggatactattgctgacctgcaaaaaaagctagactgaggcggggtgcagtggctcacgccagtaatcccaacactttgggaggctgaggcaggcagatcatctgaggtcaggagttcaagaccagcctggcaaacatggtgaaacctgtctctaggttgggcgcggtggctcacgcctgtaatcccagcactttgggaggccgagatgggcggatcatgaggtcaggagattgagaccatcctggctaacacggtgaaaccccgtttctactaaaaatacaaaaaaaattagccaggtgtggtggcaggcgcccgtagtcccaactattcgggaggctgaggcaggagaattgcgggaacccaggaggcagaggttgcagtgagcc

SEQ ID NO: 25422 - DNA, 262 bp, Homo sapiens
taaaatacatctggatggccgggcgcggtggctcacgcctgtaatcccagcactttgggaggccgaggtgggcagatcacgaggtcgggtgatcgagaccatcctggctaacacggtgaaaccccgtctctactaaaaatacaaaaaaaaatagccatccaaatgtggagagtccagcaaggtcctagcatggtggcaggcgcctatagtcccagctaatcgggaggctgaggtaggagaatggcgtgaaccctggaggcgg

SEQ ID NO: 25423 - DNA, 463 bp, Homo sapiens
tcattccaactgcttcctcccattgtggccatacatttactatgctcaacaatcattatagtactaaatcactcatcagatgatacataatctcaaatgtatggaatataagttgtataaggaaaaaggcccctgaacagtcaaaatagagcctatgcatgcattccaaggtgagcttctcagaacattattcaagtttctgcccttgaacacagttctgatgagcttaattacctatgcctagaaggcaaataaaatggcaaagaagaaagagggatagcttctattatgaggctgtgggacggtacaaacaggaatacaggataaatagatgtgggagaaaacaaaaaatataaaaagcaagtataagactccaaagggcatttctgaattaaggttttcttcacatttaatgaaagcagagaagagtgaatatcactgtagaatatcctgcctgtaacat

SEQ ID NO: 25424 - DNA, 286 bp, Homo sapiens
ccagaagatctcaatctgcaaatacttaacaaggtcaggcatcatgggagatatttaaaaaacatgtgtgtgcctttgagccgtttactaagttgagaccaaacatatacaaatgggaagttgactctcagtaccaggcagtacaggccaactgcttatagacagtaactgctgtggacttcagggatggccagcttcctaggatcttaggtagtccggaaatcttttcaggttcttgagctggcctaagcaggatttaggtgggctcaacataatgccagatctg

SEQ ID NO: 25425 - DNA, 420 bp, Homo sapiens
attcaacaatgccactttcgactcctagaaaaataaaataaccctaaccctattcatgcctgggaatagaatgtacttcaagaggcaaatacaagaatgtcatatgatataaatagactccaccagttcaaggagagggtgttaaaactgaaacattgacaggtaattatcaaaagtaccttagaaaagcaagtttctgtggacgatagctgcaatttattattattattgttgctagcctccctgatgttctccatttatgattcgagtaatcttgtctcttttgatgaatctaccttttgtttttcattaagatgtcaacgctctagacaaaagccctgctgagtacaacaaaaccgaaaacctgacagaggaaaaacctttatatctgtcgacgcggccgcgaatttagtagtagta

SEQ ID NO: 25426 - DNA, 739 bp, Homo sapiens
ggaaagcagagcagccttgtgtttgctccaaatcccagcttctcatccatgatgtcgttaaccccagaatccacatgtacccccagtgctctttcctctcagcaggctccggctatggacgtgtgtctgagctccgcgcagcagcctgggcgccggcgggaaggactcagctccccgggtggctggttagaggctgagaagaagggggctccgcagaaagacagcaccgggggagtcctagaaggtaacctccttcttcatcacttcaacagttttcctcagttgttttcctggcgatgacatcttcaagtaaatttcagtgacaagaatttccatttccttttaacattagattttttgctataatgaagcttagcagaaaaatgttttgcaagtataaacataattcctgttttttcattatttacttattaaaagtaattcctggtttttcattacttatcaaagtttgcacatttgttttttttctatgtatagatctaagcttgctgtatttttgtaacaagaacttaaaagaagaacaaaaaatctaggttcatttctgcttttcaccaaaatacattcttggtagctttgtcatacagtgaatctttataaatcaaactgtatttccccgttaggacaatgtaacagtttagggttacatttctgggcatggattcagttgtaaataaataatagacataacaaatgatctaataaaagccaagatgcagca

SEQ ID NO: 25427 - DNA, 1370 bp, Homo sapiens
  misc_feature (1369)..(1369): n is a, c, g, or t
agcggggaacaactggtttcctcttggagtctgggaggaggaaagcggagccggcagggagcgaaccaggactggggtgacggcagggcagggggcgcctggccggggagaagcgcgggggctggagcaccaccaactggagggtccggagtagcgagcgccccgaaggaggccatcggggagccgggaggggggactgcgagaggaccccggcgtccgggctcccggtgccagcgctatgaggccactcctcgtcctgctgctcctgggcctggcggccggctcgcccccactggacgacaacaagatccccagcctctgcccggggcaccccggccttccaggcacgccgggccaccatggcagccagggcttgccgggccgcgatggccgcgacggccgcgacggcgcgcccggggctccgggagagaaaggcgagggcgggaggccgggactgccgggacctcgaggggaccccgggccgcgaggagaggcgggacccgcggggcccaccgggcctgccggggagtgctcggtgcctccgcgatccgccttcagcgccaagcgctccgagagccgggtgcctccgccgtctgacgcacccttgcccttcgaccgcgtgctggtgaacgagcagggacattacgacgccgtcaccggcaagttcacctgccaggtgcctggggtctactacttcgccgtccatgccaccgtctaccgggccagcctgcagtttgatctggtgaagaatggcgaatccattgcctctttcttccagtttttcggggggtggcccaagccagcctcgctctcggggggggccatggtgaggctggagcctgaggaccaagtgtgggtgcaggtgggtgtgggtgactacattggcatctatgccagcatcaagacagacagcaccttctccggatttctggtgtactccgactggcacagctccccagtctttgcttagtgcccactgcaaagtgagctcatgctctcactcctagaaggagggtgtgaggctgacaaccaggtcatccaggagggctggcccccctggaatattgtgaatgactagggaggtggggtagagcactctccgtcctgctgctggcaaggaatgggaacagtggctgtctgcgatcaggtctggcagcatggggcagtggctggatttctgcccaagaccagaggagtgtgctgtgctggcaagtgtaagtcccccagttgctctggtccaggagcccacggtggggtgctctcttcctggtcctctgcttctctggatcctccccaccccctcctgctcctggggccggcccttttctcagagatcactcaataaacctaagaaccctcaaaaaaaaanc

SEQ ID NO: 25428 - DNA, 425 bp, Homo sapiens
  misc_feature (424)..(424): n is a, c, g, or t
gctgacaacctggtcatcctcacaccctccttctaggagtgagctcatgctctcactcctagaaggagggtgtgaggctgacaaccaggtcatccaggagggctggcccccctggaatattgtgaatgactagggaggtggggtagagcactctccgtcctgctgctggcaaggaatgggaacagtggctgtctgcgatcaggtctggcagcatggggcagtggctggatttctgcccaagaccagaggagtgtgctgtgctggcaagtgtaagtcccccagttgctctggtccaggagcccacggtggggtgctctcttcctggtcctctgcttctctggatcctccccaccccctcctgctcctggggccggcccttttctcagagatcactcaataaacctaagaaccctcaaaaaaaaanc

SEQ ID NO: 25429 - DNA, 1208 bp, Homo sapiens
  misc_feature (2)..(2): n is a, c, g, or t
  misc_feature (4)..(5): n is a, c, g, or t
  misc_feature (7)..(7): n is a, c, g, or t
  misc_feature (13)..(13): n is a, c, g, or t
  misc_feature (1207)..(1207): n is a, c, g, or t
gngnncngagctnccagctcccggtgtccgggactcgggtctcccgccagggggcgccactccccgcgctttgcagccctgagcgggggaggggcccaggcggcgggagcccccttggccagccccccagatctgccctgcgggaaggggtggaggaggtacccgtgcgggaggaggcgctggccgaagctcaggcaggggcggggaggggtacggtgaccttagagtcgccgccccgctgcgggctgagccgccgctactctcaccctgccgccccgcttaccccgcaggactgccgggacctcgaggggaccccgggccgcgaggagaggcgggacccgcggggcccaccgggcctgccggggagtgctcggtgcctccgcgatccgccttcagcgccaagcgctccgagagccgggtgcctccgccgtctgacgcacccttgcccttcgaccgcgtgctggtgaacgagcagggacattacgacgccgtcaccggcaagttcacctgccaggtgcctggggtctactacttcgccgtccatgccaccgtctaccgggccagcctgcagtttgatctggtgaagaatggcgaatccattgcctctttcttccagtttttcggggggtggcccaagccagcctcgctctcggggggggccatggtgaggctggagcctgaggaccaagtgtgggtgcaggtgggtgtgggtgactacattggcatctatgccagcatcaagacagacagcaccttctccggatttctggtgtactccgactggcacagctccccagtctttgcttagtgcccactgcaaagtgagctcatgctctcactcctagaaggagggtgtgaggctgacaaccaggtcatccaggagggctggcccccctggaatattgtgaatgactagggaggtggggtagagcactctccgtcctgctgctggcaaggaatgggaacagtggctgtctgcgatcaggtctggcagcatggggcagtggctggatttctgcccaagaccagaggagtgtgctgtgctggcaagtgtaagtcccccagttgctctggtccaggagcccacggtggggtgctctcttcctggtcctctgcttctctggatcctccccaccccctcctgctcctggggccggcccttttctcagagatcactcaataaacctaagaaccctcaaaaaaaaanc

SEQ ID NO: 25430 - DNA, 1271 bp, Homo sapiens
  misc_feature (2)..(2): n is a, c, g, or t
  misc_feature (4)..(5): n is a, c, g, or t
  misc_feature (7)..(7): n is a, c, g, or t
  misc_feature (13)..(13): n is a, c, g, or t
gngnncngagctnccagctcccggtgtccgggactcgggtctcccgccagggggcgccactccccgcgctttgcagccctgagcgggggaggggcccaggcggcgggagcccccttggccagccccccagatctgccctgcgggaaggggtggaggaggtacccgtgcgggaggaggcgctggccgaagctcaggcaggggcggggaggggtacggtgaccttagagtcgccgccccgctgcgggctgagccgccgctactctcaccctgccgccccgcttaccccgcaggactgccgggacctcgaggggaccccgggccgcgaggagaggcgggacccgcggggcccaccgggcctgccggggagtgctcggtgcctccgcgatccgccttcagcgccaagcgctccgagagccgggtgcctccgccgtctgacgcacccttgcccttcgaccgcgtgctggtgaacgagcagggacattacgacgccgtcaccggcaagttcacctgccaggtgcctggggtctactacttcgccgtccatgccaccgtctaccgggccagcctgcagtttgatctggtgaagaatggcgaatccattgcctctttcttccagtttttcggggggtggcccaagccagcctcgctctcggggggggccatggtgaggctggagcctgaggaccaagtgtgggtgcaggtgggtgtgggtgactacattggcatctatgccagcatcaagacagacagcaccttctccggatttctggtgtactccgactggcacagctccccagtctttgcttagtgcccactgcaaagtgagctcatgctctcactcctagaaggagggtgtgaggctgacaaccaggtcatccaggagggctggcccccctggaatattgtgaatgactagggaggtggggtagagcactctccgtcctgctgctggcaaggaatgggaacagtggctgtctgcgatcaggtctggcagcatggggcagtggctggatttctgcccaagaccagaggagtgtgctgtgctggcaagtgtaagtcccccagttgctctggtccaggagcccacggtggggtgctctcttcctggtcctctgcttctctggatcctccccaccccctcctgctcctggggccggcccttttctcagagatcacgagctggctcaatcactagtgaattcgcgccgcctgcagtcgacaatatggagagctcccaacgcgtgagcatagctgatattctatagtcaccg

SEQ ID NO: 25431 - DNA, 1122 bp, Homo sapiens
  misc_feature (1121)..(1121): n is a, c, g, or t
agcggggaacaactggtttcctcttggagtctgggaggaggaaagcggagccggcagggagcgaaccaggactggggtgacggcagggcagggggcgcctggccggggagaagcgcgggggctggagcaccaccaactggagggtccggagtagcgagcgccccgaaggaggccatcggggagccgggaggggggactgcgagaggaccccggcgtccgggctcccggtgccagcgctatgaggccactcctcgtcctgctgctcctgggcctggcggccggctcgcccccactggacgacaacaagatccccagcctctgcccggggcaccccggccttccaggcacgccgggccaccatggcagccagggcttgccgggccgcgatggccgcgacggccgcgacggcgcgcccggggctccgggagagaaaggcgagggcgggaggccgggactgccgggacctcgaggggaccccgggccgcgaggagaggcgggacccgcggggcccaccgggcctgccggggagtgctcggtgcctccgcgatccgccttcagcgccaagcgctccgagagccgggtgcctccgccgtctgacgcacccttgcccttcgaccgcgtgctggtgaacgagcagggacattacgacgccgtcaccggcaagttcacctgccaggtgcctggggtctactacttcgccgtccatgccaccgtctaccgggccagcctgcagtttgatctggtgaagaatggcgaatccattgcctctttcttccagtttttcggggggtggcccaagccagcctcgctctcggggggggccatggtgaggctggagcctgaggaccaagtgtgggtgcaggtgggtgtgggtgactacattggcatctatgccagcatcaagacagacagcaccttctccggattttctgcccaagaccagaggagtgtgctgtgctggcaagtgtaagtcccccagttgctctggtccaggagcccacggtggggtgctctcttcctggtcctctgcttctctggatcctccccaccccctcctgctcctggggccggcccttttctcagagatcactcaataaacctaagaaccctcaaaaaaaaanc

SEQ ID NO: 25432 - DNA, 1053 bp, Homo sapiens
  misc_feature (1052)..(1052): n is a, c, g, or t
cggcctgcgagcgctcagcctcaggtgcacggcagtggggtggggaccgactgggccgcgccggggtggggagagaggcaggtcccaggattctgggtcccgactccagtcctgcctggtccacagactgcgagaggaccccggcgtccgggctcccggtgccagcgctatgaggccactcctcgtcctgctgctcctgggcctggcggccggctcgcccccactggacgacaacaagatccccagcctctgcccggggcaccccggccttccaggcacgccgggccaccatggcagccagggcttgccgggccgcgatggccgcgacggccgcgacggcgcgcccggggctccgggagagaaaggcgagggcgggaggccgggactgccgggacctcgaggggaccccgggccgcgaggagaggcgggacccgcggggcccaccgggcctgccggggagtgctcggtgcctccgcgatccgccttcagcgccaagcgctccgagagccgggtgcctccgccgtctgacgcacccttgcccttcgaccgcgtgctggtgaacgagcagggacattacgacgccgtcaccggcaagttcacctgccaggtgcctggggtctactacttcgccgtccatgccaccgtctaccgggccagcctgcagtttgatctggtgaagaatggcgaatccattgcctctttcttccagtttttcggggggtggcccaagccagcctcgctctcggggggggccatggtgaggctggagcctgaggaccaagtgtgggtgcaggtgggtgtgggtgactacattggcatctatgccagcatcaagacagacagcaccttctccggattttctgcccaagaccagaggagtgtgctgtgctggcaagtgtaagtcccccagttgctctggtccaggagcccacggtggggtgctctcttcctggtcctctgcttctctggatcctccccaccccctcctgctcctggggccggcccttttctcagagatcactcaataaacctaagaaccctcaaaaaaaaanc

SEQ ID NO: 25433 - DNA, 211 bp, Homo sapiens
  misc_feature (210)..(210): n is a, c, g, or t
gatagggacgtgatgctgaggtcgctctagagatcccgtgcacattgtgggcagtgtaagtcccccagttgctctggtccaggagcccacggtggggtgctctcttcctggtcctctgcttctctggatcctccccaccccctcctgctcctggggccggcccttttctcagagatcactcaataaacctaagaaccctcaaaaaaaaanc

SEQ ID NO: 25434 - DNA, 1244 bp, Homo sapiens
  misc_feature (1243)..(1243): n is a, c, g, or t
agcggggaacaactggtttcctcttggagtctgggaggaggaaagcggagccggcagggagcgaaccaggactggggtgacggcagggcagggggcgcctggccggggagaagcgcgggggctggagcaccaccaactggagggtccggagtagcgagcgccccgaaggaggccatcggggagccgggaggggggactgcgagaggaccccggcgtccgggctcccggtgccagcgctatgaggccactcctcgtcctgctgctcctgggcctggcggccggctcgcccccactggacgacaacaagatccccagcctctgcccgggactgccgggacctcgaggggaccccgggccgcgaggagaggcgggacccgcggggcccaccgggcctgccggggagtgctcggtgcctccgcgatccgccttcagcgccaagcgctccgagagccgggtgcctccgccgtctgacgcacccttgcccttcgaccgcgtgctggtgaacgagcagggacattacgacgccgtcaccggcaagttcacctgccaggtgcctggggtctactacttcgccgtccatgccaccgtctaccgggccagcctgcagtttgatctggtgaagaatggcgaatccattgcctctttcttccagtttttcggggggtggcccaagccagcctcgctctcggggggggccatggtgaggctggagcctgaggaccaagtgtgggtgcaggtgggtgtgggtgactacattggcatctatgccagcatcaagacagacagcaccttctccggatttctggtgtactccgactggcacagctccccagtctttgcttagtgcccactgcaaagtgagctcatgctctcactcctagaaggagggtgtgaggctgacaaccaggtcatccaggagggctggcccccctggaatattgtgaatgactagggaggtggggtagagcactctccgtcctgctgctggcaaggaatgggaacagtggctgtctgcgatcaggtctggcagcatggggcagtggctggatttctgcccaagaccagaggagtgtgctgtgctggcaagtgtaagtcccccagttgctctggtccaggagcccacggtggggtgctctcttcctggtcctctgcttctctggatcctccccaccccctcctgctcctggggccggcccttttctcagagatcactcaataaacctaagaaccctcaaaaaaaaanc

SEQ ID NO: 25435 - DNA, 823 bp, Homo sapiens
caaggcctcccccttcacctgtgcctcagatgctacccaatcccgccttctctgtccctccagaaggcaccctttgcttaggcctccctctcttcctgaaccacctctggaagtttcttattggcctatgaatgcattcttatttcttcttatcaaataaagccttccctttaatttatggcacatttatgctttggaatccactctcaggaataatcagtatgtagcatattacacgtcaggcggcaacattctttttttttttttttttttttgaggcagggtcccgctctgtcatccaggctagagtacggtggtgcaatcatagttcactgcagcctcaacttcctggggtcaagccatcttcccacctcagtctcccaagtagctggaaccacatgtgtgcactaccacacccagctagtttttttttgtagagacagggccttgccttgttgcccaggctggtctccaagtcctgggctcaagtgatgctcctgccttggccttccaaagtgctaggattacaggtgtgagctaccatgcctggtccaacattcttcatttggtaaatggctaaacttagtgcagagtatgagcctgattttgtttaaaaaaaaaatgtgtgtgggtgtgtatatgtatctttgagtgtatataaaaagactgaaagagggctgggcacggtggctcatgcctgtaatcccagcactttgggaggctgagggaggcggatcacttaagtcaggagtttgagaccagactgggtgaaaccccatctctactaaaaaatgcaaaaattagctgggcatggtggcgggca

SEQ ID NO: 25436 - DNA, 420 bp, Homo sapiens
aaatcattagatcccgtgagacttactcactgccatgaaaacagtataggggcaactgcccccatgattgaattatctcccaccggctccctcccacaacacatgggaattatgggagctacaattcaagatgagatttgggtggggacacagccaaattgtaccagtatccatgtgtgcattgaccaaatcattcagcatctcttgtgtgctccttatctgtctagagcagagatggggcagaaatgaagttcctagaagtgggcattttatctgaaattctcaggattaaaatagcactgtccaaaataattgtaattcaagctacaaatataatttaaaattttctagtagtcaaattttaaaagtgtagactagtatgcaaggtcaaatattttaaatactttagtagtcacatta

SEQ ID NO: 25437 - DNA, 417 bp, Homo sapiens
gatcagatctcactatgtttctcaggctggtctcaaactcctgggctcaaactatctgcctgccttggcctcccgaagtgctaggattacaggcatgagccaccacacttggctgttgttaattaatatggaatttcaacttccatcactcctggacaagtcttagctcttaaagtcttaatgccagatctctctggccacagagctaacaattcagacttgatgcctctgagcactgctgtgaatattcaagcctgctgtgaaacactatatgatctctgaccgtgtctccattatctcacatggttgatatcatttgccattcttaacatagaaaaaaactaaagtgggggaagggatatgcaaggaccccagagttttcccatcagtgaatcccatagcctgtgatttccatgc

SEQ ID NO: 25438 - DNA, 408 bp, Homo sapiens
cgtatcacacacatgtggctgggacatcagaatcttagccaaaatttggtaaatacctaagtgaaagactagttaaattctatgttcacaataacaagcattggcaaagatagggagaaactggaaccctcatacattgtgacagaaatataaatagtgtggccactttgaaaacatttcagtagctcatcaaaagattaaacatagggttaccatttaacctagcaatttcactcctagatatctgcccgagagacttgaaaacacatatccacacaaaaacatgtacatgggctgggtgcagtggctcacgcctgtaaccctagcactttgggaggctgaggcaggtggatcacttgagtccaggagtttaagaccagcctgggcaacatggcaaaaccccttctc

SEQ ID NO: 25439 - DNA, 176 bp, Homo sapiens
gtgccccaagtgtaaaatacatatcagatcaaagatgcagcacagaaatgtaaaatatctcatgaatagtgtttttttactgattacatattgaagtaatatattgggttcactaaaatatattattaaaatatttcacccacccactttttttttactttttaaatgtgactact

SEQ ID NO: 25440 - DNA, 3516 bp, Homo sapiens
agggggcggggaaggggcgttttccagccccgaaggagtcctttggggttggaggaggggcgcgagcgcgcggcaaatcgggcgggaagaggtaaaaaaggaactgggagcgcgccgcggcggttcctgtccttacagttgcgctgcccagggaccgatgttgcgcgaggaaaatgcgggacgcccaggtcggtgctcggcccagacttatgcccgtgttttcacagcccacactcgtgcccgaagccccttaccccgccccgggctgtggtctgtgggctgtgggacgagctgcggcgcgggccatttctgagcagtggaggtttcaagtaatccactaacaaccagttccaaattctgtcatcaaatcctgtgctgctgttcctcgtggtaatagatgcatattatttcttttatttaaaagaaatgaatgtgactagtattgcattaagagctgaaacttggcttttagctgcatggcatgttaaagtacctccgatgtggctggaagcttgtattaactggattcaagaagaaaataataatgttaacttgagtcaggcccaaatgaataaacaagtgtttgagcagtggctccttactgatctgagggatttggagcatcctcttttacccgatggcattttagaaattccaaaaggagaattaaatggattttatgctctgcagattaattccttggttgatgtaagtcagcctgcatactcccagatacagaagttgagaggaaagaatacaacaaatgatctagttacagctgaagcacaagtaaccccaaaaccttgggaagcaaagccttcacgaatgttgatgctgcagctaactgatggaatcgtacaaatacagggaatggaatatcagcctattccaattcttcatagtgatcttcctccaggtacaaaaattttgatttatggaaatatatctttccgtcttggtgttctcttattgaaaccagaaaacgtgaaagtgttaggaggtgaagtagatgctcttttagaagaatatgcccaagaaaaagtacttgcaagattaataggggaacctgatcttgtagtttcagtcataccaaacaattctaacgaaaacattcccagagttacagatgttctagatcctgcattaggtccttctgatgaagaactcttggcaagtcttgatgaaaatgatgagcttacagcaaataatgacacttcctcagaacgatgtttcaccacaggtagttcctcaaataccattcccacaagacagtcaagttttgagccagaatttgttatttctccaagaccaaaagaggaaccatcaaacctatctatacatgtaatggatggagaattagatgacttttcactggaggaggccttgcttttagaagaaactgtccagaaagaacagatggaaactaaggaattgcaaccattgacttttaacagaaatgccgatcgaagtatagagagattttcacataatcctaatactacgaataacttttctttgacttgcaaaaatggaaacaataattggagtgaaaaaaatgtatctgaacaaatgactaatgaagacaaatcatttggttgtccatctgttagagaccaaaacaggagtattttttcagttcattgtaatgtacccttagcccatgattttacaaataaagaaaagaacttagagacagataataaaataaaacaaaccagcagttcagatagccattccttaaataataaaatattaaatagagaggtggtcaactatgtacagaaaaggagttcacaaatttctaatgaaaatgattgtaatttacagagttgttctttaagatcatcagagaatagcattaatctttctattgccatggatttgtattctccaccctttgtctatttgtctgttctaatggccagcaaaccaaaggaagttacaacagtgaaagtgaaagcatttattgtaaccttaactggaaatctctcaagttctggtggtatttggagtataactgcaaaggtgtctgatggtactgcatatctagatgtagactttgtggatgaaatacttactagcttgatagggttctcagtaccagaaatgaaacagtcaaaaaaggatcctcttcaataccaaaagttcctggaagggttgcagaaatgtcaaagagatctaatagatttgtgctgtctaatgactatttcatttaatccttccttgtctaaagcaatggtactggcattacaagatgttaatatggaacaccttgagaatctaaagaagcggttaaataaataattaaactaaaatagtattaggaacaattaaaaacaacaaggaaatatttagaatttgttcacaattttacttatgatactttgtgtaaaaaggaaaaatgaaatttcatagcttatttcagtttaattttaaagtgtttaatcatgtttgttatatgtggagcttttgaaaataagttaatctttttttttttttttaatgtcagggtattgctctgttgcccaggctagagtgcagtggcatgatcataggttattgcatcaacctcttgagctcaagcgatcctcctgccttagcctcttgagttgctgggactataggcatgtaccaccatgcccagctaatttataattactattattgttttgtagggacagagttttgctatgttgcccagattggtctcaaactcctggcctctcactcctgccgtcatggcctccaaagtttaatttttttaaaagtaactgttagatggaggaatatggtgacccactattgttgagaaatttgttttccacttgtcacgtcacataagatgattgctaaaatattgtactggtgttcggtggtgagtcatatttttgaaagttaataattataaataggtaatttccttctaatatgttggtactgtctatggccataccaccctgaacatgcctgagcttgtcataatatgttgagtacccaaaagatttgtttatattgttaatcttagggaaaaaaaattaaaatccagtagatcagaacatcaggctttcagatacaaattgatttactggtttttattttgctgattataatatttggtatatttaaggtaatctagttaactagatgctatttcatagattatattgaatgatttaaaactttattttcaaggatagtttattttaaatggcatattgaaaacatcattattaagatccagtaggtaggacatttattggattaaaatgaagcatttatctatgtctttaggtgtcattgttccctttctgaattagctgtacatataagccttcctttggttttaagtactgatttttttttaaaaaaaagagggactgtttaccattcttccactgtgctgttataaagttgtatttgaaaggtaatgttgtttttattaatcttttgtcttaaaataatttaaagtgctttgaattttaaaacattaaacaaatccttaaataacaaaataca

SEQ ID NO: 25441 - DNA, 363 bp, Homo sapiens
  misc_feature (1)..(1): n is a, c, g, or t
nacccaagaccaaaagcactggaggaggccgcagaagaaactgtccagaaagaacagatggaaactaaggaattgcaaccattgacttttaacagaaatgccgatcgaagtatagagagattttcacataatcctaatactacgaataacttttctttgacttgcaaaaatggaaacaataattggagtgaaaaaaatgtatctgaacaaatgactaatgaagacaaatcatttggttgtccatctgttagagaccaaaacaggagtattttttcagttcattgtaatgtacccttagcccatgattttacaaataaagaaaaaaaactcgagacagttctcctcgtaccgaattcctcagcc

SEQ ID NO: 25442 - DNA, 3403 bp, Homo sapiens
agggggcggggaaggggcgttttccagccccgaaggagtcctttggggttggaggaggggcgcgagcgcgcggcaaatcgggcgggaagaggtaaaaaaggaactgggagcgcgccgcggcggttcctgtccttacagttgcgctgcccagggaccgatgttgcgcgaggaaaatgcgggacgcccagggccatttctgagcagtggaggtttcaagtaatccactaacaaccagttccaaattctgtcatcaaatcctgtgctgctgttcctcgtggtaatagatgcatattatttcttttatttaaaagaaatgaatgtgactagtattgcattaagagctgaaacttggcttttagctgcatggcatgttaaagtacctccgatgtggctggaagcttgtattaactggattcaagaagaaaataataatgttaacttgagtcaggcccaaatgaataaacaagtgtttgagcagtggctccttactgatctgagggatttggagcatcctcttttacccgatggcattttagaaattccaaaaggagaattaaatggattttatgctctgcagattaattccttggttgatgtaagtcagcctgcatactcccagatacagaagttgagaggaaagaatacaacaaatgatctagttacagctgaagcacaagtaaccccaaaaccttgggaagcaaagccttcacgaatgttgatgctgcagctaactgatggaatcgtacaaatacagggaatggaatatcagcctattccaattcttcatagtgatcttcctccaggtacaaaaattttgatttatggaaatatatctttccgtcttggtgttctcttattgaaaccagaaaacgtgaaagtgttaggaggtgaagtagatgctcttttagaagaatatgcccaagaaaaagtacttgcaagattaataggggaacctgatcttgtagtttcagtcataccaaacaattctaacgaaaacattcccagagttacagatgttctagatcctgcattaggtccttctgatgaagaactcttggcaagtcttgatgaaaatgatgagcttacagcaaataatgacacttcctcagaacgatgtttcaccacaggtagttcctcaaataccattcccacaagacagtcaagttttgagccagaatttgttatttctccaagaccaaaagaggaaccatcaaacctatctatacatgtaatggatggagaattagatgacttttcactggaggaggccttgcttttagaagaaactgtccagaaagaacagatggaaactaaggaattgcaaccattgacttttaacagaaatgccgatcgaagtatagagagattttcacataatcctaatactacgaataacttttctttgacttgcaaaaatggaaacaataattggagtgaaaaaaatgtatctgaacaaatgactaatgaagacaaatcatttggttgtccatctgttagagaccaaaacaggagtattttttcagttcattgtaatgtacccttagcccatgattttacaaataaagaaaagaacttagagacagataataaaataaaacaaaccagcagttcagatagccattccttaaataataaaatattaaatagagaggtggtcaactatgtacagaaaaggagttcacaaatttctaatgaaaatgattgtaatttacagagttgttctttaagatcatcagagaatagcattaatctttctattgccatggatttgtattctccaccctttgtctatttgtctgttctaatggccagcaaaccaaaggaagttacaacagtgaaagtgaaagcatttattgtaaccttaactggaaatctctcaagttctggtggtatttggagtataactgcaaaggtgtctgatggtactgcatatctagatgtagactttgtggatgaaatacttactagcttgatagggttctcagtaccagaaatgaaacagtcaaaaaaggatcctcttcaataccaaaagttcctggaagggttgcagaaatgtcaaagagatctaatagatttgtgctgtctaatgactatttcatttaatccttccttgtctaaagcaatggtactggcattacaagatgttaatatggaacaccttgagaatctaaagaagcggttaaataaataattaaactaaaatagtattaggaacaattaaaaacaacaaggaaatatttagaatttgttcacaattttacttatgatactttgtgtaaaaaggaaaaatgaaatttcatagcttatttcagtttaattttaaagtgtttaatcatgtttgttatatgtggagcttttgaaaataagttaatctttttttttttttttaatgtcagggtattgctctgttgcccaggctagagtgcagtggcatgatcataggttattgcatcaacctcttgagctcaagcgatcctcctgccttagcctcttgagttgctgggactataggcatgtaccaccatgcccagctaatttataattactattattgttttgtagggacagagttttgctatgttgcccagattggtctcaaactcctggcctctcactcctgccgtcatggcctccaaagtttaatttttttaaaagtaactgttagatggaggaatatggtgacccactattgttgagaaatttgttttccacttgtcacgtcacataagatgattgctaaaatattgtactggtgttcggtggtgagtcatatttttgaaagttaataattataaataggtaatttccttctaatatgttggtactgtctatggccataccaccctgaacatgcctgagcttgtcataatatgttgagtacccaaaagatttgtttatattgttaatcttagggaaaaaaaattaaaatccagtagatcagaacatcaggctttcagatacaaattgatttactggtttttattttgctgattataatatttggtatatttaaggtaatctagttaactagatgctatttcatagattatattgaatgatttaaaactttattttcaaggatagtttattttaaatggcatattgaaaacatcattattaagatccagtaggtaggacatttattggattaaaatgaagcatttatctatgtctttaggtgtcattgttccctttctgaattagctgtacatataagccttcctttggttttaagtactgatttttttttaaaaaaaagagggactgtttaccattcttccactgtgctgttataaagttgtatttgaaaggtaatgttgtttttattaatcttttgtcttaaaataatttaaagtgctttgaattttaaaacattaaacaaatccttaaataacaaaataca

SEQ ID NO: 25443 - DNA, 3592 bp, Homo sapiens
agggggcggggaaggggcgttttccagccccgaaggagtcctttggggttggaggaggggcgcgagcgcgcggcaaatcgggcgggaagaggtaaaaaaggaactgggagcgcgccgcggcggttcctgtccttacagttgcgctgcccagggaccgatgttgcgcgaggaaaatgcgggacgcccaggtcggtgctcggcccagacttatgcccgtgttttcacagcccacactcgtgcccgaagccccttaccccgccccgggctgtggtctgtgggctgtgggacgagctgcggcgcgggtcttgctctatcgcccaagctggagagcagaggcatgatcacatctcactgcagccttgtcctcctaggctcagggccatttctgagcagtggaggtttcaagtaatccactaacaaccagttccaaattctgtcatcaaatcctgtgctgctgttcctcgtggtaatagatgcatattatttcttttatttaaaagaaatgaatgtgactagtattgcattaagagctgaaacttggcttttagctgcatggcatgttaaagtacctccgatgtggctggaagcttgtattaactggattcaagaagaaaataataatgttaacttgagtcaggcccaaatgaataaacaagtgtttgagcagtggctccttactgatctgagggatttggagcatcctcttttacccgatggcattttagaaattccaaaaggagaattaaatggattttatgctctgcagattaattccttggttgatgtaagtcagcctgcatactcccagatacagaagttgagaggaaagaatacaacaaatgatctagttacagctgaagcacaagtaaccccaaaaccttgggaagcaaagccttcacgaatgttgatgctgcagctaactgatggaatcgtacaaatacagggaatggaatatcagcctattccaattcttcatagtgatcttcctccaggtacaaaaattttgatttatggaaatatatctttccgtcttggtgttctcttattgaaaccagaaaacgtgaaagtgttaggaggtgaagtagatgctcttttagaagaatatgcccaagaaaaagtacttgcaagattaataggggaacctgatcttgtagtttcagtcataccaaacaattctaacgaaaacattcccagagttacagatgttctagatcctgcattaggtccttctgatgaagaactcttggcaagtcttgatgaaaatgatgagcttacagcaaataatgacacttcctcagaacgatgtttcaccacaggtagttcctcaaataccattcccacaagacagtcaagttttgagccagaatttgttatttctccaagaccaaaagaggaaccatcaaacctatctatacatgtaatggatggagaattagatgacttttcactggaggaggccttgcttttagaagaaactgtccagaaagaacagatggaaactaaggaattgcaaccattgacttttaacagaaatgccgatcgaagtatagagagattttcacataatcctaatactacgaataacttttctttgacttgcaaaaatggaaacaataattggagtgaaaaaaatgtatctgaacaaatgactaatgaagacaaatcatttggttgtccatctgttagagaccaaaacaggagtattttttcagttcattgtaatgtacccttagcccatgattttacaaataaagaaaagaacttagagacagataataaaataaaacaaaccagcagttcagatagccattccttaaataataaaatattaaatagagaggtggtcaactatgtacagaaaaggagttcacaaatttctaatgaaaatgattgtaatttacagagttgttctttaagatcatcagagaatagcattaatctttctattgccatggatttgtattctccaccctttgtctatttgtctgttctaatggccagcaaaccaaaggaagttacaacagtgaaagtgaaagcatttattgtaaccttaactggaaatctctcaagttctggtggtatttggagtataactgcaaaggtgtctgatggtactgcatatctagatgtagactttgtggatgaaatacttactagcttgatagggttctcagtaccagaaatgaaacagtcaaaaaaggatcctcttcaataccaaaagttcctggaagggttgcagaaatgtcaaagagatctaatagatttgtgctgtctaatgactatttcatttaatccttccttgtctaaagcaatggtactggcattacaagatgttaatatggaacaccttgagaatctaaagaagcggttaaataaataattaaactaaaatagtattaggaacaattaaaaacaacaaggaaatatttagaatttgttcacaattttacttatgatactttgtgtaaaaaggaaaaatgaaatttcatagcttatttcagtttaattttaaagtgtttaatcatgtttgttatatgtggagcttttgaaaataagttaatctttttttttttttttaatgtcagggtattgctctgttgcccaggctagagtgcagtggcatgatcataggttattgcatcaacctcttgagctcaagcgatcctcctgccttagcctcttgagttgctgggactataggcatgtaccaccatgcccagctaatttataattactattattgttttgtagggacagagttttgctatgttgcccagattggtctcaaactcctggcctctcactcctgccgtcatggcctccaaagtttaatttttttaaaagtaactgttagatggaggaatatggtgacccactattgttgagaaatttgttttccacttgtcacgtcacataagatgattgctaaaatattgtactggtgttcggtggtgagtcatatttttgaaagttaataattataaataggtaatttccttctaatatgttggtactgtctatggccataccaccctgaacatgcctgagcttgtcataatatgttgagtacccaaaagatttgtttatattgttaatcttagggaaaaaaaattaaaatccagtagatcagaacatcaggctttcagatacaaattgatttactggtttttattttgctgattataatatttggtatatttaaggtaatctagttaactagatgctatttcatagattatattgaatgatttaaaactttattttcaaggatagtttattttaaatggcatattgaaaacatcattattaagatccagtaggtaggacatttattggattaaaatgaagcatttatctatgtctttaggtgtcattgttccctttctgaattagctgtacatataagccttcctttggttttaagtactgatttttttttaaaaaaaagagggactgtttaccattcttccactgtgctgttataaagttgtatttgaaaggtaatgttgtttttattaatcttttgtcttaaaataatttaaagtgctttgaattttaaaacattaaacaaatccttaaataacaaaataca

SEQ ID NO: 25444 - DNA, 448 bp, Homo sapiens
cttccttctttcttccagaaccagcagtcatcggcggctccaacctcacaggagagaagcagcaacccagccccccgcaggcagcaggcgtttgtggcccctctctcccaagccccctacaccttccagcatggcagcccgctacactcgacagggcacccacaccttgccccggcccctgctcacctgccaagccaggctcatctgtatacgtatgctgccccgacttctgctgctgcactgggctcaaccagctccattgctcatcttttctccccacagggttcctcaaggcatgctgcagcctataccactcaccctagcactttggtgcaccaggtccctgtcagtgttgggcccagcctcctcacttctgccagcgtggcccctgctcagtactaccaacagcttcagagtacccccttttaagggaaccatgcacctaaca

SEQ ID NO: 25445 - DNA, 5938 bp, Homo sapiens
caatagctggactacaagcaacaacaaagcattctggattccctgtgaggatggataatgctgtaccgattgtaccccaggcaccagctgctcagccactacagattcagtcaggagttctcacgcagggaagctgtacaccactaatggtagcaactctccaccctcaagtagccaccatcacaccgcagtatgcggtgccctttactctgagctgcgcagccggccggccggcgctggttgaacagactgccgctgtactggcgtggcctggagggactcagcaaattctcctgccttcaacttggcaacagttgcctggggtagctctacacaactctgtccagcccacagcaatgattccagaggccatggggagtggacagcagctagctgactggaggaatgcccactctcatggcaaccagtacagcactatcatgcagcagccatccttgctgactaaccatgtgacattggccactgctcagcctctgaatgttggtgttgcccatgttgtcagacaacaacaatccagttccctcccttcgaagaagaataagcagtcagctccagtctcttccaagtcctctctagatgttctgccttcccaagtctattctctggttgggagcagtcccctccgcaccacatcttcttataattccttggtccctgtccaagatcagcatcagcccatcatcattccagatactcccagccctcctgtgagtgtcatcactatccgaagtgacactgatgaggaagaggacaacaaatacaagcccagtagctctggactgaagccaaggtctaatgtcatcagttatgtcactgtcaatgattctccagactctgactcttctttgagcagcccttattccactgataccctgagtgctctccgaggcaatagtggatccgttttggaggggcctggcagagttgtggcagatggcactggcacccgcactatcattgtgcctccactgaaaactcagcttggtgactgcactgtagcaacccaggcctcaggtctcctgagcaataagactaagccagtcgcttcagtgagtgggcagtcatctggatgctgtatcacccccacagggtatcgagctcaacgcggggggaccagtgcagcacaaccactcaatcttagccagaaccagcagtcatcggcggctccaacctcacaggagagaagcagcaacccagccccccgcaggcagcaggcgtttgtggcccctctctcccaagccccctacaccttccagcatggcagcccgctacactcgacagggcacccacaccttgccccggcccctgctcacctgccaagccaggctcatctgtatacgtatgctgccccgacttctgctgctgcactgggctcaaccagctccattgctcatcttttctccccacagggttcctcaaggcatgctgcagcctataccactcaccctagcactttggtgcaccaggtccctgtcagtgttgggcccagcctcctcacttctgccagcgtggcccctgctcagtaccaacaccagtttgccacccaatcctacattgggtcttcccgaggctcaacaatttacactggatacccgctgagtcctaccaagatcagccagtattcctacttatagttggtgagcatgagggaggaggaatcatggctaccttctcctggccctgcgttcttaatattgggctatggagagatcctcctttaccctcttgaaatttcttagccagcaacttgttctgcaggggcccactgaagcagaaggtttttctctgggggaacctgtctcagtgttgactgcattgttgtagtcttcccaaagtttgccctatttttaaattcattatttttgtgacagtaattttggtacttggaagagttcagatgcccatcttctgcagttaccaaggaagagagattgttctgaagttaccctctgaaaaatattttgtctctctgacttgatttctataaatgcttttaaaaacaagtgaagcccctctttatttcattttgtgttattgtgattgctggtcaggaaaaatgctgatagaaggagttgaaatctgatgacaaaaaaagaaaaattactttttgtttgtttataaactcagacttgcctattttattttaaaagcggcttacacaatctcccttttgtttattggacatttaaacttacagagtttcagttttgttttaatgtcatattatacttaatgggcaattgttatttttgcaaaactggttacgtattactctgtgttactattgagattctctcaattgctcctgtgtttgttataaagtagtgtttaaaaggcagctcaccatttgctggtaacttaatgtgagagaatccatatctgcgtgaaaacaccaagtattctttttaaatgaagcaccatgaattcttttttaaattattttttaaaagtctttctctctctgattcagcttaaatttttttatcgaaaaagccattaaggtggttattattacatggtggtggtggttttattatatgcaaaatctctgtctattatgagatactggcattgatgagctttgcctaaagattagtatgaattttcagtaatacacctctgttttgctcatctctcccttctgttttatgtgatttgtttggggagaaagctaaaaaaacctgaaaccagataagaacatttcttgtgtatagcttttatacttcaaagtagcttcctttgtatgccagcagcaaattgaatgctctcttattaagacttatataataagtgcatgtaggaattgcaaaaaatattttaaaaatttattactgaatttaaaaatattttagaagttttgtaatggtggtgttttaatattttacataattaaatatgtacatattgattagaaaaatataacaagcaatttttcctgctaacccaaaatgttatttgtaatcaaatgtgtagtgattacacttgaattgtgtacttagtgtgtatgtgatcctccagtgttatcccggagatggattgatgtctccattgtatttaaaccaaaatgaactgatacttgttggaatgtatgtgaactaattgcaattatattagagcatattactgtagtgctgaatgagcaggggcattgcctgcaaggagaggagacccttggaattgttttgcacaggtgtgtctggtgaggagtttttcagtgtgtgtctcttccttccctttcttcctccttcccttattgtagtgccttatatgataatgtagtggttaatagagtttacagtgagcttgccttaggatggaccagcaagcccccgtggaccctaagttgttcaccgggatttatcagaacaggattagtagctgtattgtgtaatgcattgttctcagtttccctgccaacattgaaaaataaaaacagcagcttttctcctttaccaccacctctacccctttccattttggattctcggctgagttctcacagaagcattttccccatgtggctctctcactgtgcgttgctaccttgcttctgtgagaattcaggaagcaggtgagaggagtcaagccaatattaaatatgcattcttttaaagtatgtgcaatcacttttagaatgaatttttttttccttttcccatgtggcagtccttcctgcacatagttgacattcctagtaaaatatttgcttgttgaaaaaaacatgttaacagatgtgtttataccaaagagcctgttgtattgcttaccatgtccccatactatgaggagaagttttgtggtgccgctggtgacaaggaactcacagaaaggtttcttagctggtgaagaatatagagaaggaaccaaagcctgttgagtcattgaggcttttgaggtttcttttttaacagcttgtatagtcttggggcccttcaagctgtgaaattgtccttgtactctcagctcctgcatggatctgggtcaagtagaaggtactggggatggggacattcctgcccataaaggatttggggaaagaagattaatcctaaaatacaggtgtgttccatctgaattgaaaatgatatatttgagatataattttaggactggttctgtgtagatagagatggtgtcaaggaggtgcaggatggagatgggagatttcatggagcctggtcagccagctctgtaccaggttgaacaccgaggagctgtcaaagtatttggagtttcttcattgtaaggagtaagggcttccaagatggggcaggtagtccgtacagcctaccaggaacatgttgtgttttctttattttttaaaatcattatattgagttgtgttttcagcactatattggtcaagatagccaagcagtttgtataatttctgtcactagtgtcatacagttttctggtcaacatgtgtgatctttgtgtctcctttttgccaagcacattctgattttcttgttggaacacaggtctagtttctaaaggacaaattttttgttccttgtcttttttctgtaagggacaagatttgttgttttgtaagaaatgagatgcaggaaagaaaaccaaatcccattcctgcaccccagtccaataagcagataccacttaagataggagtctaaactccacagaaaaggataataccaagagcttgtattgttaccttagtcacttgcctagcagtgtgtggctttaaaaactagagatttttcagtcttagtctgcaaactggcatttccgattttccagcataaaaatccacctgtgtctgctgaatgtgtatgtatgtgctcactgtggctttagattctgtccctggggttaggcctgttggccctgacaggaagggaggaagcctggtgaatttagtgagcagctggcctgggtcacagtgacctgacctcaaaccagcttaaggctttaagtcctctctcagaacttggcatttccaacttcttcctttccgggtgagagaagaagcggagaagggttcagtgtagccactctgggctcatagggacacttggtcactccagagtttttaatagctcccaggaggtgatattattttcagtgctcagctgaaataccaaccccaggaataagaactccatttcaaacagttctggccattctgagcctgcttttgtgattgctcatccattgtcctccactagaggggctaagcttgactgcccttagccaggcaagcacagtaatgtgtgttttgttcagcattattatgcaaaaattcactagttgagatggtttgttttaggataggaaatgaaattgcctctcagtgacaggagtggcccgagcctgcttcctattttgattttttttttttttaactgatagatggtgcagcatgtctacatggttgtttgttgctaaactttatataatgtgtggtttcaattcagcttgaaaaataatctcactacatgtagcagtacattatatgtacattatatgtaatgttagtatttctgctttgaatccttgatattgcaatggaattcctactttattaaatgtatttgatatgctagttattgtgtgcgatttaaactttttttgctttctccctttttttggttgtgcgctttcttttacaacaagcctctagaaacagatagtttctgagaattactgagctatgtttgtaatgcagatgtacttagggagtatgtaaaataatcattttaacaaaagaaatagatatttaaaatttaatactaactatgggaaaagggtccattgtgtaaaacatagtttatctttggattcaatgtttgtctttggttttacaaagtagcttgtattttcagtattttctacataatatggtaaaatgtagagcaattgcaatgcatcaataaaatgggtaaatttt

SEQ ID NO: 25446 - DNA, 4840 bp, Homo sapiens
  misc_feature (20)..(20): n is a, c, g, or t
gctaacccaaaatgttattngtaatcaaatgtgtagtgattacacttgaattgtgtacttagtgtgtatgtgatcctccagtgttatcccggagatggattgatgtctccattgtatttaaaccaaaatgaactgatacttgttggaatgtatgtgaactaattgcaattatcttccagcatggcagcccgctacactcgacagggcacccacaccttgccccggcccctgctcacctgccaagccaggctcatctgtatacgtatgctgccccgacttctgctgctgcactgggctcaaccagctccattgctcatcttttctccccacagggttcctcaaggcatgctgcagcctataccactcaccctagcactttggtgcaccaggtccctgtcagtgttgggcccagcctcctcacttctgccagcgtggcccctgctcagtaccaacaccagtttgccacccaatcctacattgggtcttcccgaggctcaacaatttacactggatacccgctgagtcctaccaagatcagccagtattcctacttatagttggtgagcatgagggaggaggaatcatggctaccttctcctggccctgcgttcttaatattgggctatggagagatcctcctttaccctcttgaaatttcttagccagcaacttgttctgcaggggcccactgaagcagaaggtttttctctgggggaacctgtctcagtgttgactgcattgttgtagtcttcccaaagtttgccctatttttaaattcattatttttgtgacagtaattttggtacttggaagagttcagatgcccatcttctgcagttaccaaggaagagagattgttctgaagttaccctctgaaaaatattttgtctctctgacttgatttctataaatgcttttaaaaacaagtgaagcccctctttatttcattttgtgttattgtgattgctggtcaggaaaaatgctgatagaaggagttgaaatctgatgacaaaaaaagaaaaattactttttgtttgtttataaactcagacttgcctattttattttaaaagcggcttacacaatctcccttttgtttattggacatttaaacttacagagtttcagttttgttttaatgtcatattatacttaatgggcaattgttatttttgcaaaactggttacgtattactctgtgttactattgagattctctcaattgctcctgtgtttgttataaagtagtgtttaaaaggcagctcaccatttgctggtaacttaatgtgagagaatccatatctgcgtgaaaacaccaagtattctttttaaatgaagcaccatgaattcttttttaaattattttttaaaagtctttctctctctgattcagcttaaatttttttatcgaaaaagccattaaggtggttattattacatggtggtggtggttttattatatgcaaaatctctgtctattatgagatactggcattgatgagctttgcctaaagattagtatgaattttcagtaatacacctctgttttgctcatctctcccttctgttttatgtgatttgtttggggagaaagctaaaaaaacctgaaaccagataagaacatttcttgtgtatagcttttatacttcaaagtagcttcctttgtatgccagcagcaaattgaatgctctcttattaagacttatataataagtgcatgtaggaattgcaaaaaatattttaaaaatttattactgaatttaaaaatattttagaagttttgtaatggtggtgttttaatattttacataattaaatatgtacatattgattagaaaaatataacaagcaatttttcctgctaacccaaaatgttatttgtaatcaaatgtgtagtgattacacttgaattgtgtacttagtgtgtatgtgatcctccagtgttatcccggagatggattgatgtctccattgtatttaaaccaaaatgaactgatacttgttggaatgtatgtgaactaattgcaattatattagagcatattactgtagtgctgaatgagcaggggcattgcctgcaaggagaggagacccttggaattgttttgcacaggtgtgtctggtgaggagtttttcagtgtgtgtctcttccttccctttcttcctccttcccttattgtagtgccttatatgataatgtagtggttaatagagtttacagtgagcttgccttaggatggaccagcaagcccccgtggaccctaagttgttcaccgggatttatcagaacaggattagtagctgtattgtgtaatgcattgttctcagtttccctgccaacattgaaaaataaaaacagcagcttttctcctttaccaccacctctacccctttccattttggattctcggctgagttctcacagaagcattttccccatgtggctctctcactgtgcgttgctaccttgcttctgtgagaattcaggaagcaggtgagaggagtcaagccaatattaaatatgcattcttttaaagtatgtgcaatcacttttagaatgaatttttttttccttttcccatgtggcagtccttcctgcacatagttgacattcctagtaaaatatttgcttgttgaaaaaaacatgttaacagatgtgtttataccaaagagcctgttgtattgcttaccatgtccccatactatgaggagaagttttgtggtgccgctggtgacaaggaactcacagaaaggtttcttagctggtgaagaatatagagaaggaaccaaagcctgttgagtcattgaggcttttgaggtttcttttttaacagcttgtatagtcttggggcccttcaagctgtgaaattgtccttgtactctcagctcctgcatggatctgggtcaagtagaaggtactggggatggggacattcctgcccataaaggatttggggaaagaagattaatcctaaaatacaggtgtgttccatctgaattgaaaatgatatatttgagatataattttaggactggttctgtgtagatagagatggtgtcaaggaggtgcaggatggagatgggagatttcatggagcctggtcagccagctctgtaccaggttgaacaccgaggagctgtcaaagtatttggagtttcttcattgtaaggagtaagggcttccaagatggggcaggtagtccgtacagcctaccaggaacatgttgtgttttctttattttttaaaatcattatattgagttgtgttttcagcactatattggtcaagatagccaagcagtttgtataatttctgtcactagtgtcatacagttttctggtcaacatgtgtgatctttgtgtctcctttttgccaagcacattctgattttcttgttggaacacaggtctagtttctaaaggacaaattttttgttccttgtcttttttctgtaagggacaagatttgttgttttgtaagaaatgagatgcaggaaagaaaaccaaatcccattcctgcaccccagtccaataagcagataccacttaagataggagtctaaactccacagaaaaggataataccaagagcttgtattgttaccttagtcacttgcctagcagtgtgtggctttaaaaactagagatttttcagtcttagtctgcaaactggcatttccgattttccagcataaaaatccacctgtgtctgctgaatgtgtatgtatgtgctcactgtggctttagattctgtccctggggttaggcctgttggccctgacaggaagggaggaagcctggtgaatttagtgagcagctggcctgggtcacagtgacctgacctcaaaccagcttaaggctttaagtcctctctcagaacttggcatttccaacttcttcctttccgggtgagagaagaagcggagaagggttcagtgtagccactctgggctcatagggacacttggtcactccagagtttttaatagctcccaggaggtgatattattttcagtgctcagctgaaataccaaccccaggaataagaactccatttcaaacagttctggccattctgagcctgcttttgtgattgctcatccattgtcctccactagaggggctaagcttgactgcccttagccaggcaagcacagtaatgtgtgttttgttcagcattattatgcaaaaattcactagttgagatggtttgttttaggataggaaatgaaattgcctctcagtgacaggagtggcccgagcctgcttcctattttgattttttttttttttaactgatagatggtgcagcatgtctacatggttgtttgttgctaaactttatataatgtgtggtttcaattcagcttgaaaaataatctcactacatgtagcagtacattatatgtacattatatgtaatgttagtatttctgctttgaatccttgatattgcaatggaattcctactttattaaatgtatttgatatgctagttattgtgtgcgatttaaactttttttgctttctccctttttttggttgtgcgctttcttttacaacaagcctctagaaacagatagtttctgagaattactgagctatgtttgtaatgcagatgtacttagggagtatgtaaaataatcattttaacaaaagaaatagatatttaaaatttaatactaactatgggaaaagggtccattgtgtaaaacatagtttatctttggattcaatgtttgtctttggttttacaaagtagcttgtattttcagtattttctacataatatggtaaaatgtagagcaattgcaatgcatcaataaaatgggtaaatttt

SEQ ID NO: 25447 - DNA, 4762 bp, Homo sapiens
tcatagctgattcctgaggataaacagcgggcaggtgacccccacccgtggcaagagctatttccggacccaaatactcccaggccccctacaccttccagcatggcagcccgctacactcgacagggcacccacaccttgccccggcccctgctcacctgccaagccaggctcatctgtatacgtatgctgccccgacttctgctgctgcactgggctcaaccagctccattgctcatcttttctccccacagggttcctcaaggcatgctgcagcctataccactcaccctagcactttggtgcaccaggtccctgtcagtgttgggcccagcctcctcacttctgccagcgtggcccctgctcagtaccaacaccagtttgccacccaatcctacattgggtcttcccgaggctcaacaatttacactggatacccgctgagtcctaccaagatcagccagtattcctacttatagttggtgagcatgagggaggaggaatcatggctaccttctcctggccctgcgttcttaatattgggctatggagagatcctcctttaccctcttgaaatttcttagccagcaacttgttctgcaggggcccactgaagcagaaggtttttctctgggggaacctgtctcagtgttgactgcattgttgtagtcttcccaaagtttgccctatttttaaattcattatttttgtgacagtaattttggtacttggaagagttcagatgcccatcttctgcagttaccaaggaagagagattgttctgaagttaccctctgaaaaatattttgtctctctgacttgatttctataaatgcttttaaaaacaagtgaagcccctctttatttcattttgtgttattgtgattgctggtcaggaaaaatgctgatagaaggagttgaaatctgatgacaaaaaaagaaaaattactttttgtttgtttataaactcagacttgcctattttattttaaaagcggcttacacaatctcccttttgtttattggacatttaaacttacagagtttcagttttgttttaatgtcatattatacttaatgggcaattgttatttttgcaaaactggttacgtattactctgtgttactattgagattctctcaattgctcctgtgtttgttataaagtagtgtttaaaaggcagctcaccatttgctggtaacttaatgtgagagaatccatatctgcgtgaaaacaccaagtattctttttaaatgaagcaccatgaattcttttttaaattattttttaaaagtctttctctctctgattcagcttaaatttttttatcgaaaaagccattaaggtggttattattacatggtggtggtggttttattatatgcaaaatctctgtctattatgagatactggcattgatgagctttgcctaaagattagtatgaattttcagtaatacacctctgttttgctcatctctcccttctgttttatgtgatttgtttggggagaaagctaaaaaaacctgaaaccagataagaacatttcttgtgtatagcttttatacttcaaagtagcttcctttgtatgccagcagcaaattgaatgctctcttattaagacttatataataagtgcatgtaggaattgcaaaaaatattttaaaaatttattactgaatttaaaaatattttagaagttttgtaatggtggtgttttaatattttacataattaaatatgtacatattgattagaaaaatataacaagcaatttttcctgctaacccaaaatgttatttgtaatcaaatgtgtagtgattacacttgaattgtgtacttagtgtgtatgtgatcctccagtgttatcccggagatggattgatgtctccattgtatttaaaccaaaatgaactgatacttgttggaatgtatgtgaactaattgcaattatattagagcatattactgtagtgctgaatgagcaggggcattgcctgcaaggagaggagacccttggaattgttttgcacaggtgtgtctggtgaggagtttttcagtgtgtgtctcttccttccctttcttcctccttcccttattgtagtgccttatatgataatgtagtggttaatagagtttacagtgagcttgccttaggatggaccagcaagcccccgtggaccctaagttgttcaccgggatttatcagaacaggattagtagctgtattgtgtaatgcattgttctcagtttccctgccaacattgaaaaataaaaacagcagcttttctcctttaccaccacctctacccctttccattttggattctcggctgagttctcacagaagcattttccccatgtggctctctcactgtgcgttgctaccttgcttctgtgagaattcaggaagcaggtgagaggagtcaagccaatattaaatatgcattcttttaaagtatgtgcaatcacttttagaatgaatttttttttccttttcccatgtggcagtccttcctgcacatagttgacattcctagtaaaatatttgcttgttgaaaaaaacatgttaacagatgtgtttataccaaagagcctgttgtattgcttaccatgtccccatactatgaggagaagttttgtggtgccgctggtgacaaggaactcacagaaaggtttcttagctggtgaagaatatagagaaggaaccaaagcctgttgagtcattgaggcttttgaggtttcttttttaacagcttgtatagtcttggggcccttcaagctgtgaaattgtccttgtactctcagctcctgcatggatctgggtcaagtagaaggtactggggatggggacattcctgcccataaaggatttggggaaagaagattaatcctaaaatacaggtgtgttccatctgaattgaaaatgatatatttgagatataattttaggactggttctgtgtagatagagatggtgtcaaggaggtgcaggatggagatgggagatttcatggagcctggtcagccagctctgtaccaggttgaacaccgaggagctgtcaaagtatttggagtttcttcattgtaaggagtaagggcttccaagatggggcaggtagtccgtacagcctaccaggaacatgttgtgttttctttattttttaaaatcattatattgagttgtgttttcagcactatattggtcaagatagccaagcagtttgtataatttctgtcactagtgtcatacagttttctggtcaacatgtgtgatctttgtgtctcctttttgccaagcacattctgattttcttgttggaacacaggtctagtttctaaaggacaaattttttgttccttgtcttttttctgtaagggacaagatttgttgttttgtaagaaatgagatgcaggaaagaaaaccaaatcccattcctgcaccccagtccaataagcagataccacttaagataggagtctaaactccacagaaaaggataataccaagagcttgtattgttaccttagtcacttgcctagcagtgtgtggctttaaaaactagagatttttcagtcttagtctgcaaactggcatttccgattttccagcataaaaatccacctgtgtctgctgaatgtgtatgtatgtgctcactgtggctttagattctgtccctggggttaggcctgttggccctgacaggaagggaggaagcctggtgaatttagtgagcagctggcctgggtcacagtgacctgacctcaaaccagcttaaggctttaagtcctctctcagaacttggcatttccaacttcttcctttccgggtgagagaagaagcggagaagggttcagtgtagccactctgggctcatagggacacttggtcactccagagtttttaatagctcccaggaggtgatattattttcagtgctcagctgaaataccaaccccaggaataagaactccatttcaaacagttctggccattctgagcctgcttttgtgattgctcatccattgtcctccactagaggggctaagcttgactgcccttagccaggcaagcacagtaatgtgtgttttgttcagcattattatgcaaaaattcactagttgagatggtttgttttaggataggaaatgaaattgcctctcagtgacaggagtggcccgagcctgcttcctattttgattttttttttttttaactgatagatggtgcagcatgtctacatggttgtttgttgctaaactttatataatgtgtggtttcaattcagcttgaaaaataatctcactacatgtagcagtacattatatgtacattatatgtaatgttagtatttctgctttgaatccttgatattgcaatggaattcctactttattaaatgtatttgatatgctagttattgtgtgcgatttaaactttttttgctttctccctttttttggttgtgcgctttcttttacaacaagcctctagaaacagatagtttctgagaattactgagctatgtttgtaatgcagatgtacttagggagtatgtaaaataatcattttaacaaaagaaatagatatttaaaatttaatactaactatgggaaaagggtccattgtgtaaaacatagtttatctttggattcaatgtttgtctttggttttacaaagtagcttgtattttcagtattttctacataatatggtaaaatgtagagcaattgcaatgcatcaataaaatgggtaaatttt

SEQ ID NO: 25448 - DNA, 5661 bp, Homo sapiens
caatagctggactacaagcaacaacaaagcattctggattccctgtgaggatggataatgctgtaccgattgtaccccaggcaccagctgctcagccactacagattcagtcaggagttctcacgcagggaagctgtacaccactaatggtagcaactctccaccctcaagtagccaccatcacaccgcagtatgcggtgccctttactctgagctgcgcagccggccggccggcgctggttgaacagactgccgctgtactggcgtggcctggagggactcagcaaattctcctgccttcaacttggcaacagttgcctggggtagctctacacaactctgtccagcccacagcaatgattccagaggccatggggagtggacagcagctagctgactggaggaatgcccactctcatggcaaccagtacagcactatcatgcagcagccatccttgctgactaaccatgtgacattggccactgctcagcctctgaatgttggtgttgcccatgttgtcagacaacaacaatccagttccctcccttcgaagaagaataagcagtcagctccagtctcttccaagtcctctctagatgttctgccttcccaagtctattctctggttgggagcagtcccctccgcaccacatcttcttataattccttggtccctgtccaagatcagcatcagcccatcatcattccagatactcccagccctcctgtgagtgtcatcactatccgaagtgacactgatgaggaagaggacaacaaatacaagcccagtagctctggactgaagccaaggtctaatgtcatcagttatgtcactgtcaatgattctccagactctgactcttctttgagcagcccttattccactgataccctgagtgctctccgaggcaatagtggatccgttttggaggggcctggcagagttgtggcagatggcactggcacccgcactatcattgtgcctccactgaaaactcagcttggtgactgcactgtagcaacccaggcctcaggtctcctgagcaataagactaagccagtcgcttcagtgagtgggcagtcatctggatgctgtatcacccccacagggtatcgagctcaacgcggggggaccagtgcagcacaaccactcaatcttagccagaaccagcagtcatcggcggctccaacctcacaggagagaagcagcaacccagccccccgcaggcagcaggcgtttgtggcccctctctcccaagccccctacaccaacaccagtttgccacccaatcctacattgggtcttcccgaggctcaacaatttacactggatacccgctgagtcctaccaagatcagccagtattcctacttatagttggtgagcatgagggaggaggaatcatggctaccttctcctggccctgcgttcttaatattgggctatggagagatcctcctttaccctcttgaaatttcttagccagcaacttgttctgcaggggcccactgaagcagaaggtttttctctgggggaacctgtctcagtgttgactgcattgttgtagtcttcccaaagtttgccctatttttaaattcattatttttgtgacagtaattttggtacttggaagagttcagatgcccatcttctgcagttaccaaggaagagagattgttctgaagttaccctctgaaaaatattttgtctctctgacttgatttctataaatgcttttaaaaacaagtgaagcccctctttatttcattttgtgttattgtgattgctggtcaggaaaaatgctgatagaaggagttgaaatctgatgacaaaaaaagaaaaattactttttgtttgtttataaactcagacttgcctattttattttaaaagcggcttacacaatctcccttttgtttattggacatttaaacttacagagtttcagttttgttttaatgtcatattatacttaatgggcaattgttatttttgcaaaactggttacgtattactctgtgttactattgagattctctcaattgctcctgtgtttgttataaagtagtgtttaaaaggcagctcaccatttgctggtaacttaatgtgagagaatccatatctgcgtgaaaacaccaagtattctttttaaatgaagcaccatgaattcttttttaaattattttttaaaagtctttctctctctgattcagcttaaatttttttatcgaaaaagccattaaggtggttattattacatggtggtggtggttttattatatgcaaaatctctgtctattatgagatactggcattgatgagctttgcctaaagattagtatgaattttcagtaatacacctctgttttgctcatctctcccttctgttttatgtgatttgtttggggagaaagctaaaaaaacctgaaaccagataagaacatttcttgtgtatagcttttatacttcaaagtagcttcctttgtatgccagcagcaaattgaatgctctcttattaagacttatataataagtgcatgtaggaattgcaaaaaatattttaaaaatttattactgaatttaaaaatattttagaagttttgtaatggtggtgttttaatattttacataattaaatatgtacatattgattagaaaaatataacaagcaatttttcctgctaacccaaaatgttatttgtaatcaaatgtgtagtgattacacttgaattgtgtacttagtgtgtatgtgatcctccagtgttatcccggagatggattgatgtctccattgtatttaaaccaaaatgaactgatacttgttggaatgtatgtgaactaattgcaattatattagagcatattactgtagtgctgaatgagcaggggcattgcctgcaaggagaggagacccttggaattgttttgcacaggtgtgtctggtgaggagtttttcagtgtgtgtctcttccttccctttcttcctccttcccttattgtagtgccttatatgataatgtagtggttaatagagtttacagtgagcttgccttaggatggaccagcaagcccccgtggaccctaagttgttcaccgggatttatcagaacaggattagtagctgtattgtgtaatgcattgttctcagtttccctgccaacattgaaaaataaaaacagcagcttttctcctttaccaccacctctacccctttccattttggattctcggctgagttctcacagaagcattttccccatgtggctctctcactgtgcgttgctaccttgcttctgtgagaattcaggaagcaggtgagaggagtcaagccaatattaaatatgcattcttttaaagtatgtgcaatcacttttagaatgaatttttttttccttttcccatgtggcagtccttcctgcacatagttgacattcctagtaaaatatttgcttgttgaaaaaaacatgttaacagatgtgtttataccaaagagcctgttgtattgcttaccatgtccccatactatgaggagaagttttgtggtgccgctggtgacaaggaactcacagaaaggtttcttagctggtgaagaatatagagaaggaaccaaagcctgttgagtcattgaggcttttgaggtttcttttttaacagcttgtatagtcttggggcccttcaagctgtgaaattgtccttgtactctcagctcctgcatggatctgggtcaagtagaaggtactggggatggggacattcctgcccataaaggatttggggaaagaagattaatcctaaaatacaggtgtgttccatctgaattgaaaatgatatatttgagatataattttaggactggttctgtgtagatagagatggtgtcaaggaggtgcaggatggagatgggagatttcatggagcctggtcagccagctctgtaccaggttgaacaccgaggagctgtcaaagtatttggagtttcttcattgtaaggagtaagggcttccaagatggggcaggtagtccgtacagcctaccaggaacatgttgtgttttctttattttttaaaatcattatattgagttgtgttttcagcactatattggtcaagatagccaagcagtttgtataatttctgtcactagtgtcatacagttttctggtcaacatgtgtgatctttgtgtctcctttttgccaagcacattctgattttcttgttggaacacaggtctagtttctaaaggacaaattttttgttccttgtcttttttctgtaagggacaagatttgttgttttgtaagaaatgagatgcaggaaagaaaaccaaatcccattcctgcaccccagtccaataagcagataccacttaagataggagtctaaactccacagaaaaggataataccaagagcttgtattgttaccttagtcacttgcctagcagtgtgtggctttaaaaactagagatttttcagtcttagtctgcaaactggcatttccgattttccagcataaaaatccacctgtgtctgctgaatgtgtatgtatgtgctcactgtggctttagattctgtccctggggttaggcctgttggccctgacaggaagggaggaagcctggtgaatttagtgagcagctggcctgggtcacagtgacctgacctcaaaccagcttaaggctttaagtcctctctcagaacttggcatttccaacttcttcctttccgggtgagagaagaagcggagaagggttcagtgtagccactctgggctcatagggacacttggtcactccagagtttttaatagctcccaggaggtgatattattttcagtgctcagctgaaataccaaccccaggaataagaactccatttcaaacagttctggccattctgagcctgcttttgtgattgctcatccattgtcctccactagaggggctaagcttgactgcccttagccaggcaagcacagtaatgtgtgttttgttcagcattattatgcaaaaattcactagttgagatggtttgttttaggataggaaatgaaattgcctctcagtgacaggagtggcccgagcctgcttcctattttgattttttttttttttaactgatagatggtgcagcatgtctacatggttgtttgttgctaaactttatataatgtgtggtttcaattcagcttgaaaaataatctcactacatgtagcagtacattatatgtacattatatgtaatgttagtatttctgctttgaatccttgatattgcaatggaattcctactttattaaatgtatttgatatgctagttattgtgtgcgatttaaactttttttgctttctccctttttttggttgtgcgctttcttttacaacaagcctctagaaacagatagtttctgagaattactgagctatgtttgtaatgcagatgtacttagggagtatgtaaaataatcattttaacaaaagaaatagatatttaaaatttaatactaactatgggaaaagggtccattgtgtaaaacatagtttatctttggattcaatgtttgtctttggttttacaaagtagcttgtattttcagtattttctacataatatggtaaaatgtagagcaattgcaatgcatcaataaaatgggtaaatttt

SEQ ID NO: 25449 - DNA, 6016 bp, Homo sapiens
caatagctggactacaagcaacaacaaagcattctggattccctgtgaggatggataatgctgtaccgattgtaccccaggcaccagctgctcagccactacagattcagtcaggagttctcacgcagggaagctgtacaccactaatggtagcaactctccaccctcaagtagccaccatcacaccgcagtatgcggtgccctttactctgagctgcgcagccggccggccggcgctggttgaacagactgccgctgtactggcgtggcctggagggactcagcaaattctcctgccttcaacttggcaacagttgcctggggtagctctacacaactctgtccagcccacagcaatgattccagaggccatggggagtggacagcagctagctgactggaggaatgcccactctcatggcaaccagtacagcactatcatgcagcagccatccttgctgactaaccatgtgacattggccactgctcagcctctgaatgttggtgttgcccatgttgtcagacaacaacaatccagttccctcccttcgaagaagaataagcagtcagctccagtctcttccaagtcctctctagatgttctgccttcccaagtctattctctggttgggagcagtcccctccgcaccacatcttcttataattccttggtccctgtccaagatcagcatcagcccatcatcattccagatactcccagccctcctgtgagtgtcatcactatccgaagtgacactgatgaggaagaggacaacaaatacaagcccagtagctctggactgaagccaaggtctaatgtcatcagttatgtcactgtcaatgattctccagactctgactcttctttgagcagcccttattccactgataccctgagtgctctccgaggcaatagtggatccgttttggaggggcctggcagagttgtggcagatggcactggcacccgcactatcattgtgcctccactgaaaactcagcttggtgactgcactgtagcaacccaggcctcaggtctcctgagcaataagactaagccagtcgcttcagtgagtgggcagtcatctggatgctgtatcacccccacagggtatcgagctcaacgcggggggaccagtgcagcacaaccactcaatcttagccagaaccagcagtcatcggcggctccaacctcacaggagagaagcagcaacccagccccccgcaggcagcaggcgtttgtggcccctctctcccaagccccctacaccttccagcatggcagcccgctacactcgacagggcacccacaccttgccccggcccctgctcacctgccaagccaggctcatctgtatacgtatgctgccccgacttctgctgctgcactgggctcaaccagctccattgctcatcttttctccccacagggttcctcaaggcatgctgcagcctataccactcaccctagcactttggtgcaccaggtccctgtcagtgttgggcccagcctcctcacttctgccagcgtggcccctgctcagtaccaacaccagtttgccacccaatcctacattgggtcttcccgaggctcaacaatttacactggatacccgctgagtcctaccaagatcagccagtattcctacttatagttggtgagcatgagggaggaggaatcatggctaccttctcctggccctgcgttcttaatattgggctatggagagatcctcctttaccctcttgaaatttcttagccagcaacttgttctgcaggggcccactgaagcagaaggtttttctctgggggaacctgtctcagtgttgactgcattgttgtagtcttcccaaagtttgccctatttttaaattcattatttttgtgacagtaattttggtacttggaagagttcagatgcccatcttctgcagttaccaaggaagagagattgttctgaagttaccctctgaaaaatattttgtctctctgacttgatttctataaatgcttttaaaaacaagtgaagcccctctttatttcattttgtgttattgtgattgctggtcaggaaaaatgctgatagaaggagttgaaatctgatgacaaaaaaagaaaaattactttttgtttgtttataaactcagacttgcctattttattttaaaagcggcttacacaatctcccttttgtttattggacatttaaacttacagagtttcagttttgttttaatgtcatattatacttaatgggcaattgttatttttgcaaaactggttacgtattactctgtgttactattgagattctctcaattgctcctgtgtttgttataaagtagtgtttaaaaggcagctcaccatttgctggtaacttaatgtgagagaatccatatctgcgtgaaaacaccaagtattctttttaaatgaagcaccatgaattcttttttaaattattttttaaaagtctttctctctctgattcagcttaaatttttttatcgaaaaagccattaaggtggttattattacatggtggtggtggttttattatatgcaaaatctctgtctattatgagatactggcattgatgagctttgcctaaagattagtatgaattttcagtaatacacctctgttttgctcatctctcccttctgttttatgtgatttgtttggggagaaagctaaaaaaacctgaaaccagataagaacatttcttgtgtatagcttttatacttcaaagtagcttcctttgtatgccagcagcaaattgaatgctctcttattaagacttatataataagtgcatgtaggaattgcaaaaaatattttaaaaatttattactgaatttaaaaatattttagaagttttgtaatggtggtgttttaatattttacataattaaatatgtacatattgattagaaaaatataacaagcaatttttcctgctaacccaaaatgttatttgtaatcaaatgtgtagtgattacacttgaattgtgtacttagtgtgtatgtgatcctccagtgttatcccggagatggattgatgtctccattgtatttaaaccaaaatgaactgatacttgttggaatgtatgtgaactaattgcaattatattagagcatattactgtagtgctgaatgagcaggggcattgcctgcaaggagaggagacccttggaattgttttgcacaggtgtgtctggtgaggagtttttcagtgtgtgtctcttccttccctttcttcctccttcccttattgtagtgccttatatgataatgtagtggttaatagagtttacagtgagcttgccttaggatggaccagcaagcccccgtggaccctaagttgttcaccgggatttatcagaacaggattagtagctgtattgtgtaatgcattgttctcagtttccctgccaacattgaaaaataaaaacagcagcttttctcctttaccaccacctctacccctttccattttggattctcggctgagttctcacagaagcattttccccatgtggctctctcactgtgcgttgctaccttgcttctgtgagaattcaggaagcaggtgagaggagtcaagccaatattaaatatgcattcttttaaagtatgtgcaatcacttttagaatgaatttttttttccttttcccatgtggcagtccttcctgcacatagttgacattcctagtaaaatatttgcttgttgaaaaaaacatgttaacagatgtgtttataccaaagagcctgttgtattgcttaccatgtccccatactatgaggagaagttttgtggtgccgctggtgacaaggaactcacagaaaggtttcttagctggtgaagaatatagagaaggaaccaaagcctgttgagtcattgaggcttttgaggtttcttttttaacagcttgtatagtcttggggcccttcaagctgtgaaattgtccttgtactctcagctcctgcatggatctgggtcaagtagaaggtactggggatggggacattcctgcccataaaggatttggggaaagaagattaatcctaaaatacaggtgtgttccatctgaattgaaaatgatatatttgagatataattttaggactggttctgtgtagatagagatggtgtcaaggaggtgcaggatggagatgggagatttcatggagcctggtcagccagctctgtaccaggttgaacaccgaggagctgtcaaagtatttggagtttcttcattgtaaggagtaagggcttccaagatggggcaggtagtccgtacagcctaccaggaacatgttgtgttttctttattttttaaaatcattatattgagttgtgttttcagcactatattggtcaagatagccaagcagtttgtataatttctgtcactagtgtcatacagttttctggtcaacatgtgtgatctttgtgtctcctttttgccaagcacattctgattttcttgttggaacacaggtctagtttctaaaggacaaattttttgttccttgtcttttttctgtaagggacaagatttgttgttttgtaagaaatgagatgcaggaaagaaaaccaaatcccattcctgcaccccagtccaataagcagataccacttaagataggagtctaaactccacagaaaaggataataccaagagcttgtattgttaccttagtcacttgcctagcagtgtgtggctttaaaaactagagatttttcagtcttagtctgcaaactggcatttccgattttccagcataaaaatccacctgtgtctgctgaatgtgtatgtatgtgctcactgtggctttagattctgtccctggggttaggcctgttggccctgacaggaagggaggaagcctggtgaatttagtgagcagctggcctgggtcacagtgacctgacctcaaaccagcttaaggctttaagtcctctctcagaacttggcatttccaacttcttcctttccgggtgagagaagaagcggagaagggttcagtgtagccactctgggctcatagggacacttggtcactccagagtttttaatagctcccaggaggtgatattattttcagtgctcagctgaaataccaaccccaggaataagaactccatttcaaacagttctggccattctgagcctgcttttgtgattgctcatccattgtcctccactagaggggctaagcttgactgcccttagccaggcaagcacagtaatgtgtgttttgttcagcattattatgcaaaaattcactagttgagatggtttgttttaggataggaaatgaaattgcctctcagtgacaggagtggcccgagcctgcttcctattttgattttttttttttttaactgatagatggtgcagcatgtctacatggttgtttgttgctaaactttatataatgtgtggtttcaattcagcttgaaaaataatctcactacatgtagcagtacattatatgtacattatatgtaatgttagtatttctgctttgaatccttgatattgcaatggaattcctactttattaaatgtatttgatatgctagttattgtgtgcgatttaaactttttttgctttctccctttttttggttgtgcgctttcttttacaacaagcctctagaaacagatagtttctgagaattactgagctatgtttgtaatgcagatgtacttagggagtatgtaaaataatcattttaacaaaagaaatagatatttaaaatttaatactaactatgggaaaagggtccattgtgtaaaacatagtttatctttggattcaatgtttgtctttggttttacaaagtagcttgtattttcagtattttctacataatatggtaaaatgtagagcaattgcaatgcatcaataaaatgggtaaattttctgacttatgtggctgtttttgacttctgttataggatataaaggggatcaataaatgacatctttgaaagtggctaa

SEQ ID NO: 25450 - DNA, 4052 bp, Homo sapiens
caatagctggactacaagcaacaacaaagcattctggattccctgtgaggatggataatgctgtaccgattgtaccccaggcaccagctgctcagccactacagattcagtcaggagttctcacgcagggaagctgtacaccactaatggtagcaactctccaccctcaagtagccaccatcacaccgcagtatgcggtgccctttactctgagctgcgcagccggccggccggcgctggttgaacagactgccgctgtactggcgtggcctggagggactcagcaaattctcctgccttcaacttggcaacagttgcctggggtagctctacacaactctgtccagcccacagcaatgattccagaggccatggggagtggacagcagctagctgactggaggaatgcccactctcatggcaaccagtacagcactatcatgcagcagccatccttgctgactaaccatgtgacattggccactgctcagcctctgaatgttggtgttgcccatgttgtcagacaacaacaatccagttccctcccttcgaagaagaataagcagtcagctccagtctcttccaagtcctctctagatgttctgccttcccaagtctattctctggttgggagcagtcccctccgcaccacatcttcttataattccttggtccctgtccaagatcagcatcagcccatcatcattccagatactcccagccctcctgtgagtgtcatcactatccgaagtgacactgatgaggaagaggacaacaaatacaagcccagtagctctggactgaagccaaggtctaatgtcatcagttatgtcactgtcaatgattctccagactctgactcttctttgagcagcccttattccactgataccctgagtgctctccgaggcaatagtggatccgttttggaggggcctggcagagttgtggcagatggcactggcacccgcactatcattgtgcctccactgaaaactcagcttggtgactgcactgtagcaacccaggcctcaggtctcctgagcaataagactaagccagtcgcttcagtgagtgggcagtcatctggatgctgtatcacccccacagggtatcgagctcaacgcggggggaccagtgcagcacaaccactcaatcttagccagaaccagcagtcatcggcggctccaacctcacaggagagaagcagcaacccagccccccgcaggcagcaggcgtttgtggcccctctctcccaagccccctacaccttccagcatggcagcccgctacactcgacagggcacccacaccttgccccggcccctgctcacctgccaagccaggctcatctgtatacgtatgctgccccgacttctgctgctgcactgggctcaaccagctccattgctcatcttttctccccacagggttcctcaaggcatgctgcagcctataccactcaccctagcactttggtgcaccaggtccctgtcagtgttgggcccagcctcctcacttctgccagcgtggcccctgctcagtaccaacaccagtttgccacccaatcctacattgggtcttcccgaggctcaacaatttacactggatacccgctgagtcctaccaagatcagccagtattcctacttatagttggtgagcatgagggaggaggaatcatggctaccttctcctggccctgcgttcttaatattgggctatggagagatcctcctttaccctcttgaaatttcttagccagcaacttgttctgcaggggcccactgaagcagaaggtttttctctgggggaacctgtctcagtgttgactgcattgttgtagtcttcccaaagtttgccctatttttaaattcattatttttgtgacagtaattttggtacttggaagagttcagatgcccatcttctgcagttaccaaggaagagagattgttctgaagttaccctctgaaaaatattttgtctctctgacttgatttctataaatgcttttaaaaacaagtgaagcccctctttatttcattttgtgttattgtgattgctggtcaggaaaaatgctgatagaaggagttgaaatctgatgacaaaaaaagaaaaattactttttgtttgtttataaactcagacttgcctattttattttaaaagcggcttacacaatctcccttttgtttattggacatttaaacttacagagtttcagttttgttttaatgtcatattatacttaatgggcaattgttatttttgcaaaactggttacgtattactctgtgttactattgagattctctcaattgctcctgtgtttgttataaagtagtgtttaaaaggcagctcaccatttgctggtaacttaatgtgagagaatccatatctgcgtgaaaacaccaagtattctttttaaatgaagcaccatgaattcttttttaaattattttttaaaagtctttctctctctgattcagcttaaatttttttatcgaaaaagccattaaggtggttattattacatggtggtggtggttttattatatgcaaaatctctgtctattatgagatactggcattgatgagctttgcctaaagattagtatgaattttcagtaatacacctctgttttgctcatctctcccttctgttttatgtgatttgtttggggagaaagctaaaaaaacctgaaaccagataagaacatttcttgtgtatagcttttatacttcaaagtagcttcctttgtatgccagcagcaaattgaatgctctcttattaagacttatataataagtgcatgtaggaattgcaaaaaatattttaaaaatttattactgaatttaaaaatattttagaagttttgtaatggtggtgttttaatattttacataattaaatatgtacatattgattagaaaaatataacaagcaatttttcctgctaacccaaaatgttatttgtaatcaaatgtgtagtgattacacttgaattgtgtacttagtgtgtatgtgatcctccagtgttatcccggagatggattgatgtctccattgtatttaaaccaaaatgaactgatacttgttggaatgtatgtgaactaattgcaattatattagagcatattactgtagtgctgaatgagcaggggcattgcctgcaaggagaggagacccttggaattgttttgcacaggtgtgtctggtgaggagtttttcagtgtgtgtctcttccttccctttcttcctccttcccttattgtagtgccttatatgataatgtagtggttaatagagtttacagtgagcttgccttaggatggaccagcaagcccccgtggaccctaagttgttcaccgggatttatcagaacaggattagtagctgtattgtgtaatgcattgttctcagtttccctgccaacattgaaaaataaaaacagcagcttttctcctttaccaccacctctacccctttccattttggattctcggctgagttctcacagaagcattttccccatgtggctctctcactgtgcgttgctaccttgcttctgtgagaattcaggaagcaggtgagaggagtcaagccaatattaaatatgcattcttttaaagtatgtgcaatcacttttagaatgaatttttttttccttttcccatgtggcagtccttcctgcacatagttgacattcctagtaaaatatttgcttgttgaaaaaaacatgttaacagatgtgtttataccaaagagcctgttgtattgcttaccatgtccccatactatgaggagaagttttgtggtgccgctggtgacaaggaactcacagaaaggtttcttagctggtgaagaatatagagaaggaaccaaagcctgttgagtcattgaggcttttgaggtttcttttttaacagcttgtatagtcttggggcccttcaagctgtgaaattgtccttgtactctcagctcctgcatggatctgggtcaagtagaaggttgtaggggtaaggaaggttgtaacgaagttagctagg

SEQ ID NO: 25451 - DNA, 3998 bp, Homo sapiens
caatagctggactacaagcaacaacaaagcattctggattccctgtgaggatggataatgctgtaccgattgtaccccaggcaccagctgctcagccactacagattcagtcaggagttctcacgcagggaagctgtacaccactaatggtagcaactctccaccctcaagtagccaccatcacaccgcagtatgcggtgccctttactctgagctgcgcagccggccggccggcgctggttgaacagactgccgctgtactggcgtggcctggagggactcagcaaattctcctgccttcaacttggcaacagttgcctggggtagctctacacaactctgtccagcccacagcaatgattccagaggccatggggagtggacagcagctagctgactggaggaatgcccactctcatggcaaccagtacagcactatcatgcagcagccatccttgctgactaaccatgtgacattggccactgctcagcctctgaatgttggtgttgcccatgttgtcagacaacaacaatccagttccctcccttcgaagaagaataagcagtcagctccagtctcttccaagtcctctctagatgttctgccttcccaagtctattctctggttgggagcagtcccctccgcaccacatcttcttataattccttggtccctgtccaagatcagcatcagcccatcatcattccagatactcccagccctcctgtgagtgtcatcactatccgaagtgacactgatgaggaagaggacaacaaatacaagcccagtagctctggactgaagccaaggtctaatgtcatcagttatgtcactgtcaatgattctccagactctgactcttctttgagcagcccttattccactgataccctgagtgctctccgaggcaatagtggatccgttttggaggggcctggcagagttgtggcagatggcactggcacccgcactatcattgtgcctccactgaaaactcagcttggtgactgcactgtagcaacccaggcctcaggtctcctgagcaataagactaagccagtcgcttcagtgagtgggcagtcatctggatgctgtatcacccccacagggtatcgagctcaacgcggggggaccagtgcagcacaaccactcaatcttagccagaaccagcagtcatcggcggctccaacctcacaggagagaagcagcaacccagccccccgcaggcagcaggcgtttgtggcccctctctcccaagccccctacaccttccagcatggcagcccgctacactcgacagggcacccacaccttgccccggcccctgctcacctgccaagccaggctcatctgtatacgtatgctgccccgacttctgctgctgcactgggctcaaccagctccattgctcatcttttctccccacagggttcctcaaggcatgctgcagcctataccactcaccctagcactttggtgcaccaggtccctgtcagtgttgggcccagcctcctcacttctgccagcgtggcccctgctcagtaccaacaccagtttgccacccaatcctacattgggtcttcccgaggctcaacaatttacactggatacccgctgagtcctaccaagatcagccagtattcctacttatagttggtgagcatgagggaggaggaatcatggctaccttctcctggccctgcgttcttaatattgggctatggagagatcctcctttaccctcttgaaatttcttagccagcaacttgttctgcaggggcccactgaagcagaaggtttttctctgggggaacctgtctcagtgttgactgcattgttgtagtcttcccaaagtttgccctatttttaaattcattatttttgtgacagtaattttggtacttggaagagttcagatgcccatcttctgcagttaccaaggaagagagattgttctgaagttaccctctgaaaaatattttgtctctctgacttgatttctataaatgcttttaaaaacaagtgaagcccctctttatttcattttgtgttattgtgattgctggtcaggaaaaatgctgatagaaggagttgaaatctgatgacaaaaaaagaaaaattactttttgtttgtttataaactcagacttgcctattttattttaaaagcggcttacacaatctcccttttgtttattggacatttaaacttacagagtttcagttttgttttaatgtcatattatacttaatgggcaattgttatttttgcaaaactggttacgtattactctgtgttactattgagattctctcaattgctcctgtgtttgttataaagtagtgtttaaaaggcagctcaccatttgctggtaacttaatgtgagagaatccatatctgcgtgaaaacaccaagtattctttttaaatgaagcaccatgaattcttttttaaattattttttaaaagtctttctctctctgattcagcttaaatttttttatcgaaaaagccattaaggtggttattattacatggtggtggtggttttattatatgcaaaatctctgtctattatgagatactggcattgatgagctttgcctaaagattagtatgaattttcagtaatacacctctgttttgctcatctctcccttctgttttatgtgatttgtttggggagaaagctaaaaaaacctgaaaccagataagaacatttcttgtgtatagcttttatacttcaaagtagcttcctttgtatgccagcagcaaattgaatgctctcttattaagacttatataataagtgcatgtaggaattgcaaaaaatattttaaaaatttattactgaatttaaaaatattttagaagttttgtaatggtggtgttttaatattttacataattaaatatgtacatattgattagaaaaatataacaagcaatttttcctgctaacccaaaatgttatttgtaatcaaatgtgtagtgattacacttgaattgtgtacttagtgtgtatgtgatcctccagtgttatcccggagatggattgatgtctccattgtatttaaaccaaaatgaactgatacttgttggaatgtatgtgaactaattgcaattatattagagcatattactgtagtgctgaatgagcaggggcattgcctgcaaggagaggagacccttggaattgttttgcacaggtgtgtctggtgaggagtttttcagtgtgtgtctcttccttccctttcttcctccttcccttattgtagtgccttatatgataatgtagtggttaatagagtttacagtgagcttgccttaggatggaccagcaagcccccgtggaccctaagttgttcaccgggatttatcagaacaggattagtagctgtattgtgtaatgcattgttctcagtttccctgccaacattgaaaaataaaaacagcagcttttctcctttaccaccacctctacccctttccattttggattctcggctgagttctcacagaagcattttccccatgtggctctctcactgtgcgttgctaccttgcttctgtgagaattcaggaagcaggtgagaggagtcaagccaatattaaatatgcattcttttaaagtatgtgcaatcacttttagaatgaatttttttttccttttcccatgtggcagtccttcctgcacatagttgacattcctagtaaaatatttgcttgttgaaaaaaacatgttaacagatgtgtttataccaaagagcctgttgtattgcttaccatgtccccatactatgaggagaagttttgtggtgccgctggtgacaaggaactcacagaaaggtttcttagctggtgaagaatatagagaaggaaccaaagcctgttgagtcattgaggggtgggcaggtgttgtcaatataatcaggtatgtgttcttaaccattgtattggcatatcatgctgagtaacagattaccccatacatag

SEQ ID NO: 25452 - DNA, 1282 bp, Homo sapiens
caatagctggactacaagcaacaacaaagcattctggattccctgtgaggatggataatgctgtaccgattgtaccccaggcaccagctgctcagccactacagattcagtcaggagttctcacgcagggaagctgtacaccactaatggtagcaactctccaccctcaagtagccaccatcacaccgcagtatgcggtgccctttactctgagctgcgcagccggccggccggcgctggttgaacagactgccgctgtactggcgtggcctggagggactcagcaaattctcctgccttcaacttggcaacagttgcctggggtagctctacacaactctgtccagcccacagcaatgattccagaggccatggggagtggacagcagctagctgactggaggaatgcccactctcatggcaaccagtacagcactatcatgcagcagccatccttgctgactaaccatgtgacattggccactgctcagcctctgaatgttggtgttgcccatgttgtcagacaacaacaatccagttccctcccttcgaagaagaataagcagtcagctccagtctcttccaagtcctctctagatgttctgccttcccaagtctattctctggttgggagcagtcccctccgcaccacatcttcttataattccttggtccctgtccaagatcagcatcagcccatcatcattccagatactcccagccctcctgtgagtgtcatcactatccgaagtgacactgatgaggaagaggacaacaaatacaagcccagtagctctggactgaagccaaggtctaatgtcatcagttatgtcactgtcaatgattctccagactctgactcttctttgagcagcccttattccactgataccctgagtgctctccgaggcaatagtggatccgttttggaggggcctggcagagttgtggcagatggcactggcacccgcactatcattgtgcctccactgaaaactcagcttggtgactgcactgtagcaacccaggcctcaggtctcctgagcaataagactaagccagtcgcttcagtgagtgggcagtcatctggatgctgtatcacccccacagggtatcgagctcaacgcggggggaccagtgcagcacaaccactcaatcttagccaggtaagtgctatgggctactgccttctgtttgggccctgcactgttgttactttctggagaaccctgcttctggctggatgctgaataaagccaaatgaagccccttttgtgtcaaa

SEQ ID NO: 25453 - DNA, 673 bp, Homo sapiens
  misc_feature (1)..(1): n is a, c, g, or t
nttttttctcatttcgttgatttcagagcaataaaatttcccatggtgggggaagttttacttaaaaccaattactagttcaatctaccaggaagaaagcctaaggcctttcaatgctgcactatattttttttaattaaaaatatcttctctctcattggtataagcaaaattttcaagtgctagcgccacagttatagctatgaaatctttaatcttcattttatcaaaattatattgcctctgaggaattttcagcccttgtgtgatttcaggtttccccagatgtgtttataaagataatgattatatttaacaactacagctattaagatacagtaacacagcaaaaagttgcccattttaaatggagaaaaagaaattaaggcagtatttctttttcactgctttgaacaacttcattctgctcaggatcccagctcagaaccaacgtagaataatcgtagttaacatttttcaagttcattttcagaaacatcagttgttctatattgtcaaagtccaggctcatgatctgttttggatgaaagtggctatttttagtaaagatacattcagattgccaactacacatggggcaacttagatactggatggcaacctgggtcaaagccggccatatgcttatcttcctctgccagtaaattaaagg

SEQ ID NO: 25454 - DNA, 702 bp, Homo sapiens
aacaaggaaagaggacacattacagatgacgttcagggactggggaagaagggaaaaaagcaagaaatgttgagttcaagatgtctgtgaagatccaaatggctatgtctacctgccagatgggatgtataaattagtcagggctagagacatagatttgaataatcagatttgaaacacccttgtaagggtagttcagactcaaaagtatataagatgccctaggaaaatatgtagagaaagaacaataggacaaggatgaaatcctggagaataccaattatcacagaggtggaaagagaaggaatatagagacatttgtgaaagagcaattataaatatatgatagagactgccagtgtccattaatattggtgtgcctctcttcttccataaaagtactgctaaactacatatctcagcctttgcagttaggtaaagccatttgaaaatattttgtccaaagatctatgggcagaagtaatatatgcacttctaggcctggtttctgaaacttcttccatgatcctctgtgctgtctcatttttcatggaagacttggaagccacaaactgaggaagccaagtctctgaatgtctctaaggagctgcacttaggacagacactgtagtaaatatcaatattttgtgtcagaggtctaaaccctgaaaaacctacatggtttgcaccacaaaaaaaaaa

SEQ ID NO: 25455 - DNA, 2237 bp, Homo sapiens
gcagcgagcgcggctccacattgttgcggatcgccggcacccggcagagcggcggcggctgggacgcgcggcgcctccgacccgttctcctcgcgcccggccgcgcagccagagccacccgggccgccgaccgccgagccccgcgcccgccgcctgggccccgagccttctgcgccgcccgggtgcgtcccgccaccctcggaggacggccggccatggacgcctgcaagttggagccgagcgggagggtgtgagcgggccggggccaggagcccgcgccgcgcaaccgggcagccgggcgcgccgggggtgggtccctctccccagccccgctctgcgtggaagaagagggcggggaccggcgccgggaggagagcggaggaggcgaaggggcatgactcgtgcaacttgcggcgggcatctgccgagcctctgagccggcggcggcccggggcccggactgcggccgcgcggatcccacccagcccaccccgccccggccgacggctgcagctgacctggatccttcgagcgcccgccgaccgccagcgatcttccctcatcttccgggctggtttctgctgcgcgaggagcgctgccctcgccgcccctctcgccggacccccggcccccgatggctcggatggggcttgcgggcgccgctggacgctggtggggactcgctctcggcttgaccgcattcttcctcccaggcgtccactcccaggtggtccaggtgaacgactccatgtatggcttcatcggcacagacgtggttctgcactgcagctttgccaacccgcttcccagcgtgaagatcacccaggtcacatggcagaagtccaccaatggctccaagcagaacgtggccatctacaacccatccatgggcgtgtccgtgctggctccctaccgcgagcgtgtggaattcctgcggccctccttcaccgatggcactatccgcctctcccgcctggagctggaggatgagggtgtctacatctgcgagtttgctaccttccctacgggcaatcgagaaagccagctcaatctcacggtgatggccaaacccaccaattggatagagggtacccaggcagtgcttcgagccaagaaggggcaggatgacaaggtcctggtggccacctgcacctcagccaatgggaagcctcccagtgtggtatcctgggaaactcggttaaaaggtgaggcagagtaccaggagatccggaaccccaatggcacagtgacggtcatcagccgctaccgcctggtgcccagcagggaagcccaccagcagtccttggcctgcatcgtcaactaccacatggaccgcttcaaggaaagcctcactctcaacgtgcagtatgagcctgaggtaaccattgaggggtttgatggcaactggtacctgcagcggatggacgtgaagctcacctgcaaagctgatgctaaccccccagccactgagtaccactggaccacgctaaatggctctctccccaagggtgtggaggcccagaacagaaccctcttcttcaagggacccatcaactacagcctggcagggacctacatctgtgaggccaccaaccccatcggtacacgctcaggccaggtggaggtcaatatcacagaattcccctacaccccgtctcctcccgaacatgggcggcgcgccgggccggtgcccacggccatcattgggggcgtggcggggagcatcctgctggtgttgattgtggtcggcgggatcgtggtcgccctgcgtcggcgccggcacaccttcaagggtgactacagcaccaagaagcacgtgtatggcaacggctacagcaaggcaggcatcccccagcaccacccaccaatggcacagaacctgcagtaccccgacgactcagacgacgagaagaaggccggcccactgggtggaagcagctatgaggaggaggaggaggaggaggagggcggtggagggggcgagcgcaaggtgggcggcccccaccccaaatatgacgaggacgccaagcggccctacttcaccgtggatgaggccgaggcccgtcaggacggctacggggaccggactctgggctaccagtacgaccctgagcagctggacttggctgagaacatggtttctcagaacgacgggtctttcatttccaagaaggagtggtacgtgtagccccccttccagagcctctgtctgtgaccgctcctccccagcccctccc

SEQ ID NO: 25456 - DNA, 455 bp, Homo sapiens
  misc_feature (37)..(37): n is a, c, g, or t
ccccccccaagcccattgaagtacccctttggccccncgctaaatggctctctccccaagggtgtggaggcccagaacagaaccctcttcttcaagggacccatcaactacagcctggcagggacctacatctgtgaggccaccaaccccatcggtacacgctcaggccaggtggaggtcaatatcacagctttctgtcaacttatctatccgggcaaagggaggacaagagctaggatgttctgaggagagacttcacctgggacgtgaaaggagcatgggcttgatgtcagacagctgtgaccctggacagggccccccccaccatctgtaaaacggggacagtatgatgtaccttgaagggctgttgtcagaattctacgtgatgtaagtcaagcacctagcacagatcagtctgtcaataaatggccaatgttccgtgattattaaactga

SEQ ID NO: 25457 - DNA, 731 bp, Homo sapiens
aagctgcatcctccccagcctctccgcacccacgggttccttcgccacctgcatccctcacctttgagcaatgccactgcaggaagattatctccttttcctgcttctctagttctcccttgagctctggccattggttttgctttgcttttctctttctttcattaaagggtgcaaatgagacagtcagggtgacccccaatcagagaggggcaggaggaaggctctgagagggaagaaggaagtgctgtttacagcaatgctgttttgggggccaatagaacctgcccgtagatctgccagcagaacacgctgtgggatgctggcatggtggggataggtttgcaggtggagctcatctcctccaagctctgcacctgtggtcaaggacctcttcatgggccagaaagtgaggcttacctcaagcagggagactggagagaaagcgaagatgtagcccaaagccatagtgctttgtgtgccctgcaactgagctttccctgcagctttctgtcaacttatctatccgggcaaagggaggacaagagctaggatgttctgaggagagacttcacctgggacgtgaaaggagcatgggcttgatgtcagacagctgtgacctatgatgtaccttgaagggctgttgtcagaattctacgtgatgtaagtcaagcacctagcacagatcagtctgtcaataaatggccaatgttccgtgattattaaactga

SEQ ID NO: 25458 - DNA, 1902 bp, Homo sapiens
gcagcgagcgcggctccacattgttgcggatcgccggcacccggcagagcggcggcggctgggacgcgcggcgcctccgacccgttctcctcgcgcccggccgcgcagccagagccacccgggccgccgaccgccgagccccgcgcccgccgcctgggccccgagccttctgcgccgcccgggtgcgtcccgccaccctcggaggacggccggccatggacgcctgcaagttggagccgagcgggagggtgtgagcgggccggggccaggagcccgcgccgcgcaaccgggcagccgggcgcgccgggggtgggtccctctccccagccccgctctgcgtggaagaagagggcggggaccggcgccgggaggagagcggaggaggcgaaggggcatgactcgtgcaacttgcggcgggcatctgccgagcctctgagccggcggcggcccggggcccggactgcggccgcgcggatcccacccagcccaccccgccccggccgacggctgcagctgacctggatccttcgagcgcccgccgaccgccagcgatcttccctcatcttccgggctggtttctgctgcgcgaggagcgctgccctcgccgcccctctcgccggacccccggcccccgatggctcggatggggcttgcgggcgccgctggacgctggtggggactcgctctcggcttgaccgcattcttcctcccaggcgtccactcccaggtggtccaggtgaacgactccatgtatggcttcatcggcacagacgtggttctgcactgcagctttgccaacccgcttcccagcgtgaagatcacccaggtcacatggcagaagtccaccaatggctccaagcagaacgtggccatctacaacccatccatgggcgtgtccgtgctggctccctaccgcgagcgtgtggaattcctgcggccctccttcaccgatggcactatccgcctctcccgcctggagctggaggatgagggtgtctacatctgcgagtttgctaccttccctacgggcaatcgagaaagccagctcaatctcacggtgatggccaaacccaccaattggatagagggtacccaggcagtgcttcgagccaagaaggggcaggatgacaaggtcctggtggccacctgcacctcagccaatgggaagcctcccagtgtggtatcctgggaaactcggttaaaaggtgaggcagagtaccaggagatccggaaccccaatggcacagtgacggtcatcagccgctaccgcctggtgcccagcagggaagcccaccagcagtccttggcctgcatcgtcaactaccacatggaccgcttcaaggaaagcctcactctcaacgtgcagtatgagcctgaggtaaccattgaggggtttgatggcaactggtacctgcagcggatggacgtgaagctcacctgcaaagctgatgctaaccccccagccactgagtaccactggaccacgctaaatggctctctccccaagggtgtggaggcccagaacagaaccctcttcttcaagggacccatcaactacagcctggcagggacctacatctgtgaggccaccaaccccatcggtacacgctcaggccaggtggaggtcaatatcacagctttctgtcaacttatctatccgggcaaagggaggacaagagctaggatgttctgaggagagacttcacctgggacgtgaaaggagcatgggcttgatgtcagacagctgtgaccctggacagggccccccccaccatctgtaaaacggggacagtatgatgtaccttgaagggctgttgtcagaattctacgtgatgtaagtcaagcacctagcacagatcagtctgtcaataaatggccaatgttccgtgattattaaactga

SEQ ID NO: 25459 - DNA, 1072 bp, Homo sapiens
aataggcagtcacggtatccgtgagttttgctcaagaggatccccgacaggcgcacgatggcgtgtccgtgctggctccctaccgcgagcgtgtggaattcctgcggccctccttcaccgatggcactatccgcctctcccgcctggagctggaggatgagggtgtctacatctgcgagtttgctaccttccctacgggcaatcgagaaagccagctcaatctcacggtgatggccaaacccaccaattggatagagggtacccaggcagtgcttcgagccaagaaggggcaggatgacaaggtcctggtggccacctgcacctcagccaatgggaagcctcccagtgtggtatcctgggaaactcggttaaaaggtgaggcagagtaccaggagatccggaaccccaatggcacagtgacggtcatcagccgctaccgcctggtgcccagcagggaagcccaccagcagtccttggcctgcatcgtcaactaccacatggaccgcttcaaggaaagcctcactctcaacgtgcagtatgagcctgaggtaaccattgaggggtttgatggcaactggtacctgcagcggatggacgtgaagctcacctgcaaagctgatgctaaccccccagccactgagtaccactggaccacgctaaatggctctctccccaagggtgtggaggcccagaacagaaccctcttcttcaagggacccatcaactacagcctggcagggacctacatctgtgaggccaccaaccccatcggtacacgctcaggccaggtggaggtcaatatcacagctttctgtcaacttatctatccgggcaaagggaggacaagagctaggatgttctgaggagagacttcacctgggacgtgaaaggagcatgggcttgatgtcagacagctgtgaccctggacagggccccccccaccatctgtaaaacggggacagtatgatgtaccttgaagggctgttgtcagaattctacgtgatgtaagtcaagcacctagcacagatcagtctgtcaataaatggccaatgttccgtgattattaaactga

SEQ ID NO: 25460 - DNA, 1635 bp, Homo sapiens
gcagcgagcgcggctccacattgttgcggatcgccggcacccggcagagcggcggcggctgggacgcgcggcgcctccgacccgttctcctcgcgcccggccgcgcagccagagccacccgggccgccgaccgccgagccccgcgcccgccgcctgggccccgagccttctgcgccgcccgggtgcgtcccgccaccctcggaggacggccggccatggacgcctgcaagttggagccgagcgggagggtgtgagcgggccggggccaggagcccgcgccgcgcaaccgggcagccgggcgcgccgggggtgggtccctctccccagccccgctctgcgtggaagaagagggcggggaccggcgccgggaggagagcggaggaggcgaaggggcatgactcgtgcaacttgcggcgggcatctgccgagcctctgagccggcggcggcccggggcccggactgcggccgcgcggatcccacccagcccaccccgccccggccgacggctgcagctgacctggatccttcgagcgcccgccgaccgccagcgatcttccctcatcttccgggctggtttctgctgcgcgaggagcgctgccctcgccgcccctctcgccggacccccggcccccgatggctcggatggggcttgcgggcgccgctggacgctggtggggactcgctctcggcttgaccgcattcttcctcccaggcgtccactcccaggtggtccaggtgaacgactccatgtatggcttcatcggcacagacgtggttctgcactgcagctttgccaacccgcttcccagcgtgaagatcacccaggtcacatggcagaagtccaccaatggctccaagcagaacgtggccatctacaacccatccatgggcgtgtccgtgctggctccctaccgcgagcgtgtggaattcctgcggccctccttcaccgatggcactatccgcctctcccgcctggagctggaggatgagggtgtctacatctgcgagtttgctaccttccctacgggcaatcgagaaagccagctcaatctcacggtgatggccaaacccaccaattggatagagggtacccaggcagtgcttcgagccaagaaggggcaggatgacaaggtcctggtggccacctgcacctcagccaatgggaagcctcccagtgtggtatcctgggaaactcggttaaaaggtgaggcagagtaccaggagatccggaaccccaatggcacagtgacggtcatcagccgctaccgcctggtgcccagcagggaagcccaccagcagtccttggcctgcatcgtcaactaccacatggaccgcttcaaggaaagcctcactctcaacgtgcagtatgagcctgaggtaaccattgaggggtttgatggcaactggtacctgcagcggatggacgtgaagctcacctgcaaagctgatgctaaccccccagccactgagtaccactggaccacctggacagggccccccccaccatctgtaaaacggggacagtatgatgtaccttgaagggctgttgtcagaattctacgtgatgtaagtcaagcacctagcacagatcagtctgtcaataaatggccaatgttccgtgattattaaactga

SEQ ID NO: 25461 - DNA, 906 bp, Homo sapiens
gtagtcggtaccggacatgctgatctcacgtgcagtatgagcctgaggtaaccattgaggggtttgatggcaactggtacctgcagcggatggacgtgaagctcacctgcaaagctgatgctaaccccccagccactgagtaccactggaccacgctaaatggctctctccccaagggtgtggaggcccagaacagaaccctcttcttcaagggacccatcaactacagcctggcagggacctacatctgtgaggccaccaaccccatcggtacacgctcaggccaggtggaggtcaatatcacagaattcccctacaccccgtctcctcccgaacatgggcggcgcgccgggccggtgcccacggccatcattgggggcgtggcggggagcatcctgctggtgttgattgtggtcggcgggatcgtggtcgccctgcgtcggcgccggcacaccttcaagggtgactacagcaccaagaagcacgtgtatggcaacggctacagcaaggcaggcatcccccagcaccacccaccaatggcacagaacctgcagtaccccgacgactcagacgacgagaagaaggccggcccactgggtggaagcagctatgaggaggaggaggaggaggaggagggcggtggagggggcgagcgcaaggtgggcggcccccaccccaaatatgacgaggacgccaagcggccctacttcaccgtggatgaggccgaggcccgtcaggacggctacggggaccggactctgggctaccagtacgaccctgagcagctggacttggctgagaacatggtttctcagaacgacgggtctttcatttccaagaaggagtggtacgtgtagccccccttccagagcctctgtctgtgaccgctcctccccagcccctccc

SEQ ID NO: 25462 - DNA, 274 bp, Homo sapiens
caggatgacaaggtcctggtggccacctgcacctcagccaatgggaagcctcccagtgtggtatcctgggaaactcggttaaaaggtgaggcagagtaccaggagatccggaaccccaatggcacagtgacggtcatcagccgctaccgcctggtgcccagcagggaagcccaccagcagtccttggcctgcatcgtcaactaccacatggaccgcttcaaggaaagcctcactctcaacgtgcagtgtgagcagggctggctgccaggggcct

SEQ ID NO: 25463 - DNA, 2011 bp, Homo sapiens
gcagcgagcgcggctccacattgttgcggatcgccggcacccggcagagcggcggcggctgggacgcgcggcgcctccgacccgttctcctcgcgcccggccgcgcagccagagccacccgggccgccgaccgccgagccccgcgcccgccgcctgggccccgagccttctgcgccgcccgggtgcgtcccgccaccctcggaggacggccggccatggacgcctgcaagttggagccgagcgggagggtgtgagcgggccggggccaggagcccgcgccgcgcaaccgggcagccgggcgcgccgggggtgggtccctctccccagccccgctctgcgtggaagaagagggcggggaccggcgccgggaggagagcggaggaggcgaaggggcatgactcgtgcaacttgcggcgggcatctgccgagcctctgagccggcggcggcccggggcccggactgcggccgcgcggatcccacccagcccaccccgccccggccgacggctgcagctgacctggatccttcgagcgcccgccgaccgccagcgatcttccctcatcttccgggctggtttctgctgcgcgaggagcgctgccctcgccgcccctctcgccggacccccggcccccgatggctcggatggggcttgcgggcgccgctggacgctggtggggactcgctctcggcttgaccgcattcttcctcccaggcgtccactcccaggtggtccaggtgaacgactccatgtatggcttcatcggcacagacgtggttctgcactgcagctttgccaacccgcttcccagcgtgaagatcacccaggtcacatggcagaagtccaccaatggctccaagcagaacgtggccatctacaacccatccatgggcgtgtccgtgctggctccctaccgcgagcgtgtggaattcctgcggccctccttcaccgatggcactatccgcctctcccgcctggagctggaggatgagggtgtctacatctgcgagtttgctaccttccctacgggcaatcgagaaagccagctcaatctcacggtgatggccaaacccaccaattggatagagggtacccaggcagtgcttcgagccaagaaggggcaggatgacaaggtcctggtggccacctgcacctcagccaatgggaagcctcccagtgtggtatcctgggaaactcggttaaaaggtgaggcagagtaccaggagatccggaaccccaatggcacagtgacggtcatcagccgctaccgcctggtgcccagcagggaagcccaccagcagtccttggcctgcatcgtcaactaccacatggaccgcttcaaggaaagcctcactctcaacgtgcagtatgagcctgaggtaaccattgaggggtttgatggcaactggtacctgcagcggatggacgtgaagctcacctgcaaagctgatgctaaccccccagccactgagtaccactggaccacgctaaatggctctctccccaagggtgtggaggcccagaacagaaccctcttcttcaagggacccatcaactacagcctggcagggacctacatctgtgaggccaccaaccccatcggtacacgctcaggccaggtggaggtcaatatcacagaaaagccccgcccccagaggggtctgggaagtgcagccaggctcctggcgggcaccgtggccgtgttcctcatcctagttgctgtgctcactgtcttcttcctgtacaaccggcagcagaagagcccaccggagacggatggggccgggaccgaccagcccctctcccagaagccggagccttctcccagcaggcaaagctcccttgtgcctgaggatatccaggttgtccacctggacccagggaggcagcagcagcaagaagaggaggacttgcagaagctgtccctgcagcccccctactatgatctgggggtctccccctcctaccacccctcggtaaggacaaccgaacctcgaggagagtgcccctag

SEQ ID NO: 25464 - DNA, 530 bp, Homo sapiens
tcctggccactttttcaaacttgggtttcgaggacgccggaccaaccaaggatacagatttccatgtggccttggagaacgtggacaccactatgaaggtgcacatcaagaggcccccgagattgacctcgtccatcagtgtgtagcctgcggggccaccttcaccaccccctaccgccctgccccggactcagacgacgagaagaaggccggcccactgggtggaagcagctatgaggaggaggaggaggaggaggagggcggtggagggggcgagcgcaaggtgggcggcccccaccccaaatatgacgaggacgccaagcggccctacttcaccgtggatgaggccgaggcccgtcaggacggctacggggaccggactctgggctaccagtacgaccctgagcagctggacttggctgagaacatggtttctcagaacgacgggtctttcatttccaagaaggagtggtacgtgtagccccccttccagagcctctgtctgtgaccgctcctccccagcccctccc

SEQ ID NO: 25465 - DNA, 1686 bp, Homo sapiens
gcagcgagcgcggctccacattgttgcggatcgccggcacccggcagagcggcggcggctgggacgcgcggcgcctccgacccgttctcctcgcgcccggccgcgcagccagagccacccgggccgccgaccgccgagccccgcgcccgccgcctgggccccgagccttctgcgccgcccgggtgcgtcccgccaccctcggaggacggccggccatggacgcctgcaagttggagccgagcgggagggtgtgagcgggccggggccaggagcccgcgccgcgcaaccgggcagccgggcgcgccgggggtgggtccctctccccagccccgctctgcgtggaagaagagggcggggaccggcgccgggaggagagcggaggaggcgaaggggcatgactcgtgcaacttgcggcgggcatctgccgagcctctgagccggcggcggcccggggcccggactgcggccgcgcggatcccacccagcccaccccgccccggccgacggctgcagctgacctggatccttcgagcgcccgccgaccgccagcgatcttccctcatcttccgggctggtttctgctgcgcgaggagcgctgccctcgccgcccctctcgccggacccccggcccccgatggctcggatggggcttgcgggcgccgctggacgctggtggggactcgctctcggcttgaccgcattcttcctcccaggcgtccactcccaggtggtccaggtgaacgactccatgtatggcttcatcggcacagacgtggttctgcactgcagctttgccaacccgcttcccagcgtgaagatcacccaggtcacatggcagaagtccaccaatggctccaagcagaacgtggccatctacaacccatccatgggcgtgtccgtgctggctccctaccgcgagcgtgtggaattcctgcggccctccttcaccgatggcactatccgcctctcccgcctggagctggaggatgagggtgtctacatctgcgagtttgctaccttccctacgggcaatcgagaaagccagctcaatctcacggtgatggccaaacccaccaattggatagagggtacccaggcagtgcttcgagccaagaaggggcaggatgacaaggtcctggtggccacctgcacctcagccaatgggaagcctcccagtgtggtatcctgggaaactcggttaaaaggtgaggcagagtaccaggagatccggaaccccaatggcacagtgacggtcatcagccgctaccgcctggtgcccagcagggaagcccaccagcagtccttggcctgcatcgtcaactaccacatggaccgcttcaaggaaagcctcactctcaacgtgcagtatgagcctgaggtaaccattgaggggtttgatggcaactggtacctgcagcggatggacgtgaagctcacctgcaaagctgatgctaaccccccagccactgagtaccactggaccacgctaaatggctctctccccaagggtgtggaggcccagaacagaaccctcttcttcaagggacccatcaactacagcctggcagggacctacatctgtgaggccaccaaccccatcggtacacgctcaggccaggtggaggtcaatatcacaggagggtcaacagtctgcccatcagtcaatggagtttcttcagatccaga

SEQ ID NO: 25466 - DNA, 458 bp, Homo sapiens
ctctagacgatcccttaccggatctgggtacactggaccacgctaaatggctctctccccaagggtgtggaggcccagaacagaaccctcttcttcaagggacccatcaactacagcctggcagggacctacatctgtgaggccaccaaccccatcggtacacgctcaggccaggtggaggtcaatatcacagctttctgtcaacttatctatccgggcaaagggaggacaagagctaggatgttctgaggagagacttcacctgggacgtgaaaggagcatgggcttgatgtcagacagctgtgaccctggacagggccccccccaccatctgtaaaacggggacagtatgatgtaccttgaagggctgttgtcagaattctacgtgatgtaagtcaagcacctagcacagatcagtctgtcaataaatggccaatgttccgtgattattaaactga

SEQ ID NO: 25467 - DNA, 489 bp, Homo sapiens
ccaagcagaacgtggccatctacaacccatccatgggcgtgtccgtgctggctccctaccgcgagcgtgtggaattcctgcggccctccttcaccgatggcactatccgcctctcccgcctggagctggaggatgagggtgtctacatctgcgagtttgctaccttccctacgggcaatcgagaaagccagctcaatctcacggtgatgggtaagctgccctgggccccctccctgttcatccagaggcctgtgacctcggggcgtggccatcctcaggatgcctcaatgaccccagacatcccccttgggtgggcatgctgccatcattctaggcatgaggcttccagtcccttctagccaggccaccccacaattcactagggattaggggcaggggcttatctctagacagtggggaacgtgattcttcaggttgaagcccacaaggcactgtgctggcagcagcatcagacaccacggtaaggaa

SEQ ID NO: 25468 - DNA, 509 bp, Homo sapiens
agccatggacaagaagctttaagcatcagagtcaaggtttctaatattgcaaagactaaataattccaaggggggtgggatggaaagaaagagagagagagtgtgtgtgtctgtatgtgggttgtagagatgggacacagagatgaagacaggacagacttggaactatccctgcaattaatacctggcttcccagatccctttccaagccaaaaagatgtttttagacaaaacttgccaagcctcacaacagtcctgtgaggtaggtaagtattattacacccatttggtagatggaaagagctgagctgagagaagctgcatgatccatctagaaatcagcagtagaccctggggaggaaagagaggatggtgcccttcttctccctactctacgtgccttggctttctcttaagacagaaggaggagccccaaggtgctctgcctcttcaaatgtcaccattgagaaggaagaagaaaacagttttgcatgaaggtagctataaga

SEQ ID NO: 25469 - DNA, 536 bp, Homo sapiens
atttcatagacgaggaagctgaggctcagaggagcaaactaacttgcctaagttcacacagctagtaaaaggtgcttgtcattgaacacttatctattactttctgtgtgtcagggactcttctgggtgctttactcatttaactcattttaccctaacaggtagggtatctgttagcaccattttataaatgaggctactaaggcacagagatgttaagcaacttttccaaggtcacacagctagtaagtgattggactagtgtgcaaacccaggtgtgaagggcctagcacagacctggttcagagtagacatttggaggctccctgatctttgatcctcgctcggatatggcctgggatctacttggatagccaggttccccggccccccgatgattttccaggatgttcttggatcacactcgaggaaagctccagctgggcccagatttggggcttctgtcctgaaagcgctgctcctggtgtgaatgggaggcccaggctgtcttgtttaccaccttctgtaagtcctca

SEQ ID NO: 25470 - DNA, 630 bp, Homo sapiens
tttatatgtatgtcctggatcatgattgcaaaatggaattctgactggggttacagtaaaaaaaaaaaaaaaaaatcttgaaaaccactaccataaatacccaatgtctctttttatatattggccagtgttcaaatgcaagcatttgatgatgtttgtccacatgattgagataatgagatcattttcttcagttgagattcctgaatgagatgtccaaatagcaaataggaacgttaaaattgtctcaaatgcaaggcaataacaataagaattttaatttttttcttaattttagaaaaccatactctatcagataatttctcaaaatcccaaaaaccatacctttaatgaaacactcatcttaattcaagagaaaaacaacaaatgtaggctgcccaaaggacattcattaacttgaagggaataatacctttgaatccaaaagaaattcgccaggttatgggagacacaggatgttcccaaattggtagtgcggttccgtaaatgatacaaacttgcaactaattttttggaattttaatcatttacatttcttcaacactcatttagctttgcagatttaaaaagtaaatttttcattttaatttttttgtttcagttcctctg

SEQ ID NO: 25471 - DNA, 181 bp, Homo sapiens
gggtgtcctgtgccaggaaggtgtcctgccgggtggccccttctccccagggcgggagctgacgaggctggtttcaggccttccttccaccctgcggactgtgagaaagttctctgcttcctccgtcttggaggctgggcttggaatttgtgaagcctggaattgctcactccgggggctg

SEQ ID NO: 25472 - DNA, 459 bp, Homo sapiens
tttggtctgtagttgtaatgcctttgtctggttttggtgtcaggatactactagctatatgggatgggttgagaatttctaatatatcaaattaaggatactgttaggtgtgtttaataagagacactgtctgggcatggtgtaatcctagcctgtaatcctgtaatcacacttgtaatcccagcactttgggaggccaaggcaggagggtcacctgaggtcagcagttcgagatcagcctggccaacatggtgaaaccccgtctctactaaaaatacaaaaattagcccggtgtggtagtgggtgcctgtaatcccagccgttcaggaggctgaggcaagagaattgcttgaacccgggaggtggaggttgcagtgagccgagatggcttcattgcactcaagcttgggtgacaagagtgaaattccatctcaaaaaaaaaaaaaaaaagagacactg

SEQ ID NO: 25473 - DNA, 2010 bp, Homo sapiens
agacctgagttgtgtctttaaaagatccctccagcaagaatgaaagctggaatatttgttgggaagctgctgcaatagctctggcaggaaataatgatggcttaggctaggattatggcatgggatatctaagagttggtcagatttgctataaaattttgaggtaaaggcagcaggatttgccggtggattctatttaaggaccataatgggggagagaaagagaaaaatccaggatgactcttagaattagagtttgagcaaacaagcccaagcaaacaagcacaatgtggcagtgccatagtctgtgatagcagagcttagagaagcccatgcatgtttgggggcattgtggaagggagttctttcttgagcatacgaagtgtgagatgcctgttacaaatgtatatcctaccacactcctgacctcccagcttggggtcaggccctatacccaattgcccatccaaccacatggcagatcaccagggatgtgagggagcccagtgtacagactccccactgactgaggggcatcaggatgctcttcactggggacttagcataactcagtgtgaccctgggaagccctctgagccacccacaaaggattcttgtcctcatggtgactgtggtcacccaagcctgtgaccaacactggtctcattaagatgggtatcaacagggaaaacccattgcccccaagaaagcccgagagagacattcgataaggagcagccacatgtgtgtctgatggagccagaatgatccccatatggacacggggctcaatggggctacatactttatcctagaggttggtctctcaggaccatgttttcacttcatccctgtcagagtaggtctgcagtggcaaccctcatctcgtggactgtttaaatattaaatatcgttccttcctagaaggaggaaactcttgagatggttctggagtccttggggataagaggagaaacactgccctttgttaaggagagaaaatgtcccttgaatggggaatgggcaaccacctggaagaaactgatgcagccagatctatttccagctataactgactcactttcatctgtcaaaacagcattaagcaccagtaataagccctttaaacaaacaggctgttcatcctgagactgcaacatcttcagctgcaggaccaccccaggaggaaatactgcaggagattagcctcttcttttagcagggggagaagaaggggaaaaggaggcttggaatggaattctgccaatgatcctctccctccgtggggccattggactctgcagggtgctgggtctaataggacaccaatgaaaagttagggagcatgttcattagcccttgccttggtgggaccttacctggtgttcactgcaagtggaggaatgggctggggagggatgcagtacaaagtcacacgagaaaagaccaagggattgtagagaggaaggctgaggaggaatccggccaagaggcactgtggcctagcatcaaaaccatgggctttggcagtagcgacacctccaaagggtccagaccccagctccgtgactggcttggttgtatcacctgccttcccccagagccccgcagaagacacatgtaattaatcaatcgtgcctactgtgattgtggcagctgccacctgccacttggagagctacaatgtgggaaagacataagacttgtcctatggactcaagagttccagaggctggagccacaaggaggagagtgcaataggctgaatttaagacaggactctgtagtagtcagagcagtggactaagttaaaccagtcactcatgagttcttcaccttgaagtcccaataatggactgcagtttgcaaaataatcttgtttccttatgttaagatgtgttacccaataaaccccctgtttatagggtatgtgggggggggtgtgaatgaacttttattgtgataaaatatacataacataaaatttatgattttaatgatttttttctt

SEQ ID NO: 25474 - DNA, 613 bp, Homo sapiens
agacctgagttgtgtctttaaaagatccctccagcaagaatgaaagctggaatatttgttgggaagctgctgcaatagctctggcaggaaataatgatggcttaggctaggattatggcatgggatatctaagagttggtcagatttgctataaaattttgaggtaaaggcagcaggatttgccggtggattctatttaaggaccataatgggggagagaaagagaaaaatccaggatgactcttagaattagagtttgagcaaacaagcccaagcaaacaagcacaatgtggcagtgccatagtctgtggttgcataccaggtaccaggagatgtgttaatttgctcaagcaatgaaaccatgtctggtacagcaactgcaattgcagtcaccacttgattaatcttacagtaacccactgtcattctccaagatccatctgtcttctgcacaggccaaatgggaaagttgaatgggaatgtggtgggaatctccaagccggtgtccttcaagtccatgatggtggcactaatctccgcagttcctccagggatgcgatatgggtttggatttactatttttctaagtagatgcagctctaatggcttccat

SEQ ID NO: 25475 - DNA, 429 bp, Homo sapiens
ggttgcagtgagccgagattgtgtcactgcactccagcctgggtgacagagccagactccatctcaaaaaaaaaaaacccttgggcctagaaactaggtcatctacatacattagcagctctcaaacttttaaaaaaatataacacagaaatatattttatattctgatgcagtagtcacatacatatgtaatgaagcaagagtaatgcaaaatagtacttatcactactttgaaacatatactttgttttctattctgcttcattaaaaaccaaaatactagttgtgaccttctagattgatttcacattctattcatggattgtcacctcctattgaaaaacactggccttggatgtctaacctaaaactttgggtccttatgtgcaaggtattatgataagtactatgaggcatttagaaaactct

SEQ ID NO: 25476 - DNA, 375 bp, Homo sapiens
ctggcaaggggctcagcataggcaatggtgtgggtcgggggagggggagctggctggaatgtgagagatctccggtggcaggggccagacagatgatgcgggctttgctctggggtagtggggagccatagaagggtttagagggagggagtggacacccaccaggcctgggagtcagaactttctggagcacagaaaggaggtgacacattgtcaagaggctctcaggggagcatgggttagggggaaggcgaggtccccaaactgggcatccagggagcacaggtctggggaggaccccattgctgctgccctgactggactaagagcacctgggttgaggccgggcgccgccacctccctgcagaccccgga

SEQ ID NO: 25477 - DNA, 431 bp, Homo sapiens
tgaaaataaaatgtcagtagttaaaaaaccgtgataaaatttaaaaccatgggggtaattgattataaaagaccattatgccacagataaaataagttgcctgagagcctgcctggagccattagttaaaacattgccaatctaataatgatagaactgggcagccatggtggctgatgcctgtaatcccatatctttgggaggctaaagtgggaggatcgtttgaggccaggagtttgaaaccagtctgggcaacatagcaagaccctatctctataaaaactttagaagataactgggcatggtggtacatgcctattgtgctagctaggcgggaggaatgcttgagcccaggaatttgaggttacagtaagctatgatcatgcttctgctctccagcctaggcaacaaagtgagaccctatctcaaaa

SEQ ID NO: 25478 - DNA, 548 bp, Homo sapiens
gctattttaattcaagcattcagactctgcatcttggatctttacaactcacatttactcgtcagtctttcaagctccagacaaagggccaagcacatagtgagtttttaatgaacacttgttgcctgtttgatttattgatgaaagtggaaagtaaaaaagctgaggacatgagggcatagtttttcatccatacattgaatggaggtgggcatagctgatgaactggaagatccattttatacacatgcccattctgatctgctccactgtataagtcctgatcatagaggaagaacttagagatactgaaaaatatagccttccttccactgccctgaccaagataaccagcagccttcttgggacacagtaagggaagaagagtcttttgagttgacaatgttagtcctgccataagctgaccaaataggtgtgctattggttacaccacagtatgcttgggtgctagaagcttgtttaaaggtcaataagcagagatacttctagccaccttgagagtttaaataaataaacctatgcacatg

SEQ ID NO: 25479 - DNA, 1501 bp, Homo sapiens
tgcaaagcatgcatcagccacatccatgctatctcctaaagcagtcattctgaaacccaatctggggacagtgcagactaaataaaatttcattttgatttggcctcccgctgcgaatgggactgctttgtctcagccgacagaaccagcaagccagaaagggaatgaagacatttggagaagaagcgtttactgaaaggagattcctgggctggaggaaaaccatgatctacagttcatgttgacagatattgtatttttggtcctagatctgacttttgaaatgacttatcacaaattcaaatttagcaatcatgagtgaagtacccacgatgtgctaagcatctacctctgcagatagaagaacacttactgttcctgagcatgggagggaatagaagttcctgggtcctggcctcacctcatcaggcactgccaaatttgacacctccttcctgttcacggcagtcctttgcgatagggtattagatgccaccaagtagctgcataactcacccatttggtcagagcctgggtctaagccaggtctgacagactccaaagcaagccctgtttacagcatgactgggatccagtggacgagggaactgagctgtcaaaactaagtgacttgattgaggccatgcagctggcgaggggaggaccaggatctgaacccaactgggtctcccaagcctgggccactgaaccatttcacctcttggaaaaacttaatggtcagagtggcccacccagtccatggacagcatggaggataaactgcttccctagaaatcctctccagcattcttgccaccacgactttgggacacattgaccatgaggaggagctggtcaatgatggacaggagtccagattagcagagatgtggtaataaggacaccgatgcctaaatacttgaaatatccaataggaagcattccacctttgtgcaaatgcgaaccacatctcaccaagttcaggccaaggctgccaccggtgacgttttggaaaagaaaaaaaaaagcggggggagaggagagaaacagagaagcaaggaatgcagaagagagcagaggccacaaaaacagcagcaacgtgtcctgtgtattctgtttccttgtaaaactatgaagcatgttaaggagatacttcattttttgaggattcatactcttgtttatattataataaaaacaacccatgttctttctaaaaatttaggcaatgccttcgtgcacataaaagtaaaacaaaatcacctgtaatcctaccacacgcagatcagcacttgctaatcttttcacagggatcctaagaatatcctattctctatagaatatagttgatttatgttacctaataactaactgttaaccattttaaaattcttcagttttacattatgctagaaaaaaggagccgtcactctacgtgacatttctgtatattggtttattcattcaataaacattttttaagtacctacaaaaaaaaaaa

SEQ ID NO: 25480 - DNA, 471 bp, Homo sapiens
tattttctacttccaccaacagtatataagggtttcgattcctctatgtccttgccaacacttgctattttgtgttttttttttaatagtagctatcctaatgggtgtgggataatatctcattgtacttttgagttgcatttccctagtgattagtgatgttgagcatttttcatgtgcttattggccattcatctatcttctttgaagaaattattgcagtataatttacatgaaataaaatgcacccatatttaaagatacagtttgaagagtcttgacaaatgtctctattcatgtaactattaacactacttcaatcaagatttagagcgtctctgtcactccagaatgtcaccttgtgccctttggccaccagttctctcacactcctggccttgtgcaactatcgatgtgctttctgtcactgtagattcattttgcctctcttagcactgcacttacatggaa

SEQ ID NO: 25481 - DNA, 350 bp, Homo sapiens
agctgggattcacgtgcttagcaaataaccaataaaattgttacattttggcccggcacgatggctcatgcctgtaatcccagcactttaagaggccaaggcaggcagataacctgaggtcaggagtttgagaccagcctggtcaacatggcaataccccgtctctactaaaaatacaaaattagccgaatgtagaggcccatgcctataatcccagctacttgggaggctgaggcaggagaatcacttgaacccaggaggcagaggttgcagtgagccgagatcatgccattgcactccagtctcatgccattgcactccagggcgacaagagcgaaactctgtctcaa

SEQ ID NO: 25482 - DNA, 480 bp, Homo sapiens
tacaccaccaccctggagagttattctttgaatatttttgaatagtggtcagattctcagatatggaactctaggatacagagtgccaactgtacctcattttgtacctcattttgcttattaatttattagttgatggacatttgggctgttttcactttctggctactatggataatgctgctatgaacattcttgtgtatgtttttgtgtggacatatgattataattctgttgggtctgtacctaggagtaaaatcctggattatatggaaaatctatgcttcaccctttaaggaactagcagactgttttccaaactggttccaccattttacattctgaagagcaatgtatgaagattccagtttctccactttcttgccaacatttgttactgtctgtctcgttaatgatagctactatagtgtgtatgtagtggtatctcattgtggcttttatttgtatttccctgatgac

SEQ ID NO: 25483 - DNA, 195 bp, Homo sapiens
gggggccagctttgatttatgcctgctgccctggcataattactaatattgcctcctttttcagaagtgccctgctttgggccgggcgtggtggctcaccccggtaatcccagcactttgggaggccgacgcaggtggaccacctgaggtcaggaattcaagaccagcctggccaacacggcgaaaccccgtctc

SEQ ID NO: 25484 - DNA, 663 bp, Homo sapiens
ttacctttctcaacattccacaggttacttcctccttcctttgttctcctctgcctttgcctccttaaaaaagttctaagttgctagccaatcgggccaaataaaaaatgtgaagtcccgttccagccaatggaaactggacacggcagtagggtggacgcgtcaggttataaatgaccctgcctcctttgttctgtgggtgtagtctcatagcaaaactgctggcaagtgtaccctttctgcagaaagtataaaaatggccttgctaaggaatttaaatttacattcaagtgctatttctttacagcaccggaaaacaagcatttcaaacaagacctactatacaatgacagtaattaagataatgtgatactggtggaggaataagcacgtagacaaatcgaacataatagagaacccagaaataaacccctacaaatatatacgcaactattttttaacaaagattcaaaagcaattcagtggagaaaaaatgaccttttcaacaaataatggtggagcagttgaacatctacagcaaaaacaaagctcaacttcaacctcacacctgatataaaacatgaataaaaaactatgaaacttttagaaaaataaataaataaaccttagggatctagggccaggcaacatgtttttatactt

SEQ ID NO: 25485 - DNA, 392 bp, Homo sapiens
aggatggaaggcggtgaatcccgcctccagcatggagctcgggagaggccctgactgcagatggagaggctgccctggccgcagcgcacggggctcctgacccacaaaaatcgcgagataatgagttcatgttgtttgaaagtccgtcatttctggtaatttgctatataaaactattgctatacgattaaaaactaatacagaagaatatttctttaacattatgttaaaaaggaaaaaagctaacattttctttgtagcaaaacactgccatgatttacattaaaattaggaacaaattaggatgtctagtatcattactaatattttacaatatcttttctaattaatgtggtaatgtaggaaaataaacacaaatatataactatcaa

SEQ ID NO: 25486 - DNA, 407 bp, Homo sapiens
atcatgagatcctggcaagagtttttctccacagacattctgttggtggaatagaaatatgtgagatggtgaatggaacagatctaaataagcatgggactaacaaagtacaatgtatgaaagattttacttagaaaaaacaattacaaattgactatacaatcaataagactaaccgaagggaaatgcagtaaaacactttcaaagaaaaatactgtggagcccagaagaaaataagccaattgacagaggtagatttcacgagctcataaaaatgaaaaagtaaatgctgctggacaaaaagtggtccttacttttgctctcaatgtttctagtatgctatgtagaacaattattttgcttttactgaaaaataactattgcatttggtataaaacgattcatag

SEQ ID NO: 25487 - DNA, 474 bp, Homo sapiens
aggatagtcttttcaacaaattgtactggaacaactggacatcccccatgtaaaaaaaatgaaccctcacccatacttctttctaaatttttgtttacttactgatttattatgtttttgagacagggtcttgctctgtcaccaaggcaggagcacactggtgtgatcatggcttactgcagccttgatttcccaggctcaagcgattttcccacctcagcctcccgagtagctgggatcataggcatgtggtcccagcccggctgattttttttattttttgtaaagatggggtctcactatgttgcccaggctgttcttgaactcctgagctcaagtgattcttccaatttggcctcccaaagtagcgggattacaggggtgagccattgcacctgaccttgacccatacttcacatcatatatgaaaactagttcaaaatgaatcatagacctgaaggtagaacctaaaac

SEQ ID NO: 25488 - DNA, 379 bp, Homo sapiens
aaagctaacacagaccttgaggtggagagaaggcaagtggagagaacagtgttggaggatacagaggtacaagcagagactgaaatcaacccacttacaagttgggaatccttgtcagaaaaagcaacagaagtttacagatgcatggatctttgcagatgttgctgttgagtgtaagagctgctatcagtcctctacattgtgtattctgaatgagctacagttccagctgctggctgagtagttgctaagacacaacctcttggttcttacttcccttccatatctttagacctacaccaactaagataacttgaaaatgtcatgtttttctcaaacccaaataggattgactgctaaggacatttatacattgcaa

SEQ ID NO: 25489 - DNA, 408 bp, Homo sapiens
  misc_feature (48)..(48): n is a, c, g, or t
  misc_feature (320)..(320): n is a, c, g, or t
  misc_feature (329)..(329): n is a, c, g, or t
agcctttttttaaaccactgttaattctccatcaacatttaacatagnggattatcacccatttgtgagtagaaaaactgaggcccatagaggttaagtaagctgtgaggaactggcacagccaggattcaaagtgaatctgtgtaattcccaggcctgggtcccttctgctccactggcccctgtagaaggccccacaaaataataggtattcatttaaataatagaataaatttgttgtctgaaagtcaccaccaagtttatttagaaggttgggaattgtgaataacgagatttctggctctttcctaaccttaganacctttganaaacactgtggtttgaatgtcaataattaatggatcattttagctgagagacactagatttggtgtttgatctgaaaaa

SEQ ID NO: 25490 - DNA, 435 bp, Homo sapiens
ggtgtgtgtgtgtgtgtgggggggtgtgtgtgttcttttgggatatctgctttgaaatttcatcatcaaactaggcttttccctgatgaaagttccatactatagagaaaacatccacatttgcttgcagtttgtgcagcttaaactgaagacagatgtcttgtgcagcaaccacaatattttcatttatctcttaatagatttccatctaggaatcaaaagtctgattttatttttcaactctgatgatgaatactaagaattattttaattatagatctatttcattctgcaggaaataaggagaggcattttgaagtttttttctttaaagacctcaataatatttatcttctaaatgggattttcatacataccatgacaatcttatggattactacatattgggagatacctactatggaatccctggca

SEQ ID NO: 25491 - DNA, 441 bp, Homo sapiens
aaaaatattttcccacttcctccttgcttctgttgttgcttttgagtgttacctctgagtctgcctgtgctccctggaaacggcccgggtttcccaccccctgcccaggtttgctccttccctggtttttctgtcattatcacgctcacgtgtttccctcggtcaccccctctgcaattttcacacgtcttttccctctctctttgcttcattacctttggcccgcctgccagctgctgattctctctgaagatgtctctaaatgacttttaactgtgatttgtggaattcttattgtggagttttgcgtcttttcaggtgtaggttttttgtctcgcgtgtttccacgtctgcttgtagcgctttccgcttcgccgttccctgcggcccttccttccgtgcccggtgttcatcctcttgaatgctcttttcctgcctgtt

SEQ ID NO: 25492 - DNA, 601 bp, Homo sapiens
agtgaggccagcttctgttctctttgtttgaaacagggaatggggaggccatctgagctgttttatctgatgataggattgtgctgtgttgctttctcaggcgagatgctcttaaagatgcctctcagagcagatctcacacctctcccccaagcatccaaagatggtctgggcactggggcatccaggctgaaagcagcccagctgggagcctggcctgtcttcaccttcatggaaatgcctctctgccctgaaggggtggaaattcttgctcactcaggaggctccatccaggattgacctgtcagtctcaagtgacacctctagttcctccatgggcttctgtggccctgggcaggaagtctgatgggtgggcttgagtgtgcacatcagggagaaaggaacatcagagaccacggggcctggtggggacgggctgggctctggagcctcacagccctgggttgaaatcttggctctagagacatatgtgtcttggcaagtcacttaatgtctctgcacccctcaccccatatctgcaacctttggataatagtgtcaacctcacaggcttgctgtgaataagtagtagataaaaaaa

SEQ ID NO: 25493 - DNA, 381 bp, Homo sapiens
cctgatgatctgtcactgtctcccgtcacccccagatggggctgtctagttgcaggaaaacaagctcagggctcccactgagtctctgtgatggtgagttgtagaattatttaattatatgttacaatgtaataatagtagaaataaagtgcacaataaatgcaatgcacttgaatcgtcctgaaaccatccctccccgaccccaatccatggaaaaattgtgttccgcgaaaccggtctctggtgccaaaaaggttggggaccgcttctggaaaagctggaaaaggcaagaaaacgcattctctccctcagcctctggaaggaaccagcactgtgggactaatttacatactgtagggtaataaatttgtgttgcttcga

SEQ ID NO: 25494 - DNA, 313 bp, Homo sapiens
ttcctgtaaggttgtgccttggattattttctggccagaacacagaacaaagcattccagagaaaccttggtttgtttatctactttcttcaatgcgctcatttttgcagccccgtcagtatggttatcaggaagagaaattggttataagaagactattttctgcatctactttctcttcaatatgttttgttttcaacagcgttattatagattcacataaactggaaatctttttctgttttatttcctttttcagagattcatagtgttttaaatatctaggtatcttcagatgacttgagctaccaaa

SEQ ID NO: 25495 - DNA, 396 bp, Homo sapiens
tttgagatggagtctcgctctgtcgcccaggctggagtgcagtggcatgatctccgctcactgcaagctctgcctcctgggttcacgccattctccggcctcagcctcccgagtagctgggactacaggcggccgccaccacgcccggctaattttttgtatttttagtagagacggggtttcactgtgttagccaggatggtctcgatctcctgacctcatgatccacccacctcggcctcccaaagtcctgggattacaggcgtgaggtaccgcgcctggcctaaaatctgaattcttaaaaggtatttccctcatcttgtagatgagaaactgcagcctggagatgccagttacttttatcaggtcacacagagtaaggagtagagttgggat

SEQ ID NO: 25496 - DNA, 437 bp, Homo sapiens
ttatattgattgattttgagatgccatctcagctcactgcaacctccgcctcctgggttcataccattctcctgcctcagcctcctgagtagagtagctgggactacaggcacccgccaccacgcccggctaatgtttttgtatttttagtagagacggggtttcaccgtgttagccaggatggtctcgatctcctaacctcgtgacccgcccaccttggcctcccaaagtgctgggattacaggtgtgagccaccacgcctggccttacttcttttttaaatgtttggaaggattggagaattcaccagcaaagccatttgggccttgggttttctttgtgggaaagtttaaagtttggtttttgtttttgtttttgttttccttatctgaaatgtctttactagctatagggatattcatattacctatgtcttc

SEQ ID NO: 25497 - DNA, 339 bp, Homo sapiens
ctgtgaagaagctttttagtttgagataatagtttgtctgtttttgcttttgttgcctgtgcttttgagatcttcttcataaaatcttaacctagaccaatgccctgaagtgtttcctctaaggtttcttctattcattgttggtgtatagaaatgctactaatttctgtgtgttgattttgtattctgcacctttactgaatttatcagttctaacagctttttggtgaagcttttagggttttctatatatgaatttgtgtcatctgctatacatagaacttttaaattactggaatagaatgtagaaggaggaatataaagaaatgtaattcaaca

SEQ ID NO: 25498 - DNA, 308 bp, Homo sapiens
cacagctgaaattttaagttggaatgaatattcactgggcccaaaatgacagttcatatttgaataaaagtgacaaaagcctttttataagtaatcacttttaagtgaaatgttttaactgatttcatgtgatttagaatatgatttaatcaaattattttaatgatagatggaatggcagacaaaaacatgcctgtccttctagactgattttactttaccctctaatattcatctcagtagcagtgttttaaatattctctgggctgcaaaactctttgggaatctgataaaagctatgaacactc

SEQ ID NO: 25499 - DNA, 417 bp, Homo sapiens
ctggctctaaagtgagcactcttaagaattaattatatttctcaaggttgtatccgtttaacttctgtgtagcagtatcttacccagcataatgtatgtttaattttataggtgaaaaaatagtactttaatgctttaatttgcatttctttgactacttaggagaataaaactatgaatagtctgtagagaattttcatttacttttgcactggagtattcaacatatgaatatagggatgtgactaaaaagtaaagagactgaaagcatagtagttaagagtgtgggcttgaataccagctccatgtctttctagctgcatcacctttttttttttttttgagacagagtctccgctctgtcacccaggctggagtgcagtggcgtgatctcagctcagtgcaagctccacctcc

SEQ ID NO: 25500 - DNA, 396 bp, Homo sapiens
taggaagctgcttttataagtaaaaggggaaaaatagcttgataatttttgaggacaggcagcgacggggaaagggcacgttgttcagtttagaagctaaactaggggataggaagaggatgactggccagcttagactgttagaacttgggtttcctcactggcaggcagatattagatttgcttagaatcaagactgctgtgaagatctttcctctcttgctctcgggaataaatcctactttggtgttttaagctgtttctcttctgttagccactccccagattttcactcaaatcctgcatcagtgtcctttgtacctttcctctcactctgtctctgttgtaaaatcaattataatttgcttacatctccagttatgggggtacattttc

SEQ ID NO: 25501 - DNA, 620 bp, Homo sapiens
ccttatcattaaggggtggtgatgatatatctcaattctagaaaaacaccagggggctaatttatcacagtgtcagaactgagcaaataacattccctcctatccactctgagaattgttcctggaaatggaattggagttgggtagcacatgttaccactgcttggtggtacatcctattagcattgtgtgacactgaactcaccaagctgccctttaaatataattttataatttagattcccacataacattttctccagaggaaagaatgatctggtcatgcccaagagccactctgagcctttgggagttatatttatcactgtaaattaataaattggggccatgcgcggtggcttatgcccgtaatcccaatactttgggaggccgaggtggatggatcacgagatcagatcgagaccatcctggctaacacagtgaaaccccatctctactgaaaatacaaaaaattagccgggtgtggtggcgggcgcctgtagtcccaactactcgagaggctgaggcaggagaatggcgtgaacccgggaggcggagcttgcagtgagccgagatcgcgccactgcactccagcctgggcaacagcgagactccgtctc

SEQ ID NO: 25502 - DNA, 614 bp, Homo sapiens
tctgcttttatctttattttatttcattccttctacttactttgggcttactctgttttcaacttcttgagttgaaagattaactcatttattttcactttttctaattttttaaccttaaacatgtatttaaggttatagttttctctctttagctactttacaagatctaatgtggagtaatttcattgtcgttcagctctaaatattttgtaattctcattataattacctccttacccatgcagtatctacaaggaagtttatcagaagtattcttttcttcttcagctaactttttgttgccattacaaaaaaactataacccctccataatctcaattctgtatctccacatcctatttttccagcttattctttctactagggtgatcctgaactactgtgcattgttcaacctcatggaatctccactgactctcatgctcttgatgtcccttcactctcctctttatcgagattacattccatgatttatcattattatcatcactctcccctctctccctttatagtgcttggcaaaactacaaccttgtttaaatccaattttctgcctactccacacctgcacctgtgcaactaaatgtggc

SEQ ID NO: 25503 - DNA, 1276 bp, Homo sapiens
ctcaaatcagtgatctgtcaaaataggccttgtaactgaaataccttacaaagcagttctaactaatgcaatgtgttttttaaaaatttttaatgaaccttacattgtgaacataattgcaacatgttttaagacaaacagtatttaatccttgaagacctgtcttgtatgtctctcaattttgtcagaatttttattattgtttttcacatatgtgaaataagcagttttttcagggtacatagggtatctttgttttacagatttttaaagatgaggttttgaaaagccctcagaggtttttgttaaaagactatcttgcttaataaatgacaacttgttaacagattcacacattacaagtaggacagtataacaggagattggtgtgtgaatgctacaaaacagtcagcaaaaggaatcatgtttgcttgtgaaacttcagaggtaccctgaaagtcatttcctaaagctagtgcatgtgaatcttttccttgaattgtgcagaataattggattgaggcacatattttgaggagtagcaagtggaatggtataatgactacagagaaaattatcttgaaatatagcaaggaagagaaacaagttttctttctccactttattgttggactaattgggtcaatttgctgtgacatatcaaagatctctttgtgccaggccaagactggctactgagttctcaaagcgttttaatatatagattacgtatgagtgcctattttttcctcctcctttcattttttatcttaatacccattttacttctgaaataattcatctgttttgctttatgaccagctttaatttcaattgaggaataataacaaccctagagattcataggaaagagcattgaaatacattttttgcataaagatacctaaaaccatctacccagcttagggttgaactgaatttctgtgaaataaatttgttttaaatactaattattttaaaactacttaattcttaaaaacaatgtcatcagtttcaaaagtttcactttgggaggatattccttaaaaggcatacatagatggtaaagtataaaatatttctgacagaattattcagtattattcaacatttactttcatgtttgttattgtaccacaaagatagtgtcattgttgggttaaaatgttggctgtttttgttaatatacttaaaactgtaaccagtgaataacacctgtagtattttttattatagattatattttatttcaataaactttgatatttagaccaaa

SEQ ID NO: 25504 - DNA, 889 bp, Homo sapiens
  misc_feature (831)..(831): n is a, c, g, or t
ctcaaatcagtgatctgtcaaaataggccttgtaactgaaataccttacaaagcagttctaactaatgcaatgtgttttttaaaaatttttaatgaaccttacattgtgaacataattgcaacatgttttaagacaaacagtatttaatccttgaagacctgtcttgtatgtctctcaattttgtcagaatttttattattgtttttcacatatgtgaaataagcagttttttcagggtacatagggtatctttgttttacagatttttaaagatgaggttttgaaaagccctcagaggtttttgttaaaagactatcttgcttaataaatgacaacttgttaacagattcacacattacaagtaggacagtataacaggagattggtgtgtgaatgctacaaaacagtcagcaaaaggaatcatgtttgcttgtgaaacttcagaggtaccctgaaagtcatttcctaaagctagtgcatgtgaatcttttccttgaattgtgcagaataattggattgaggcacatattttgaggagtagcaagtggaatggtataatgactacagagaaaattatcttgaaatatagcaaggaagagaaacaagttttctttctccactttattgttggactaattgggtcaatttgctgtgacatatcaaagatctctttgtgccaggccaagactggctactgagttctcaaagcgttttaatatatagattacgtatgagtgcctattttttcctcctcctttcattttttatcttaatacccattttacttctgaaataattcatctgttttgctttatttaagcttctatacntgtaattaataataatatactaagataagccagttgacctgtggggatcctcagatca

SEQ ID NO: 25505 - DNA, 1588 bp, Homo sapiens
ctcaaatcagtgatctgtcaaaataggccttgtaactgaaataccttacaaagcagttctaactaatgcaatgtgttttttaaaaatttttaatgaaccttacattgtgaacataattgcaacatgttttaagacaaacagtatttaatccttgaagacctgtcttgtatgtctctcaattttgtcagaatttttattattgtttttcacatatgtgaaataagcagttttttcagggtacatagggtatctttgttttacagatttttaaagatgaggttttgaaaagccctcagaggtttttgttaaaagactatcttgcttaataaatgacaacttgttaacagattcacacattacaagtaggacagtataacaggagattggtgtgtgaatgctacaaaacagtcagcaaaaggaatcatgtttgcttgtgaaacttcagaggtaccctgaaagtcatttcctaaagctagtgcatgtgaatcttttccttgaattgtgcagaataattggattgaggcacatattttgaggagtagcaagtggaatggtataatgactacagagaaaattatcttgaaatatagcaaggaagagaaacaagttttctttctccactttattgttggactaattgggtcaatttgctgtgacatatcaaagatctctttgtgccaggccaagactggctactgagttctcaaagcgttttaatatatagattacgtatgagtgcctattttttcctcctcctttcattttttatcttaatacccattttacttctgaaataattcatctgttttgctttatgaccagctttaatttcaattgaggaataataacaaccctagagattcataggaaagagcattgaaatacattttttgcataaagatacctaaaaccatctacccagcttagggttgaactgaatttctgtgaaataaatttgttttaaatactaattattttaaaactacttaattcttaaaaacaatgtcatcagtttcaaaagtttcactttgggaggatattccttaaaaggcatacatagatggtaaagtataaaatatttctgacagaattattcagtattattcaacatttactttcatgtttgttattgtaccacaaagatagtgtcattgttgggttaaaatgttggctgtttttgttaatatacttaaaactgtaaccagtgaataacacctgtagtattttttattatagattatattttatttcaataaactttgatatttagaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaataaaaagaaaaaacatacagaaaaaattaaaaaaaaaagaataaaataaaaattattaataaaaaaaaaatgttttccccccttagaccaaaactttttttactattgaatatttttctcgtcgcgccttattcgatcttttgtgcatattcccccaattgggagctgtctaaacaatccgggcgccgttatttcaaaattcgccgtcgtt

SEQ ID NO: 25506 - DNA, 1141 bp, Homo sapiens
ctcaaatcagtgatctgtcaaaataggccttgtaactgaaataccttacaaagcagttctaactaatgcaatgtgttttttaaaaatttttaatgaaccttacattgtgaacataattgcaacatgttttaagacaaacagtatttaatccttgaagacctgtcttgtatgtctctcaattttgtcagaatttttattattgtttttcacatatgtgaaataagcagttttttcagggtacatagggtatctttgttttacagatttttaaagatgaggttttgaaaagccctcagaggtttttgttaaaagactatcttgcttaataaatgacaacttgttaacagattcacacattacaagtaggacagtataacaggagattggtgtgtgaatgctacaaaacagtcagcaaaaggaatcatgtttgcttgtgaaacttcagaggtaccctgaaagtcatttcctaaagctagtgcatgtgaatcttttccttgaattgtgcagaataattggattgaggcacatattttgaggagtagcaagtggaatggtataatgactacagagaaaattatcttgaaatatagcaaggaagagaaacaagttttctttctccactttattgttggactaattgggtcaatttgctgtgacatatcaaagatctctttgtgccaggccaagactggctactgagttctcaaagcgttttaatatatagattacgtatgagtgcctattttttcctcctcctttcattttttatcttaatacccattttacttctgaaataattcatctgttttgctttatgaccagctttaatttcaattgaggaataataacaaccctagagattcataggaaagagcattgaaatacattttttgcataaagatacctaaaaccatctacccagcttagggttgaactgaatttctgtgaaataaatttgttttaaatactaattattttaaaactacttaattcttaaaaacaatgtcatcagtttcaaaagtttcactttgggaggatattccttaaaaggcatacatagatggtaaagtataaaatattgaaactgatgacattgtttttaagaattaagcagttttaaaataattgtcgacgcggccgc

SEQ ID NO: 25507 - DNA, 398 bp, Homo sapiens
ttacaggcacccgccatcatgtccagctaatttttgtatatttgtagagacggggtttcaccatgttggccagactggtcttgaactcctgacctcaggtgatctgcccgcctcagcctcccaaagtgctaggattacaagtgtgagccaccacgcccggccccaatattctttcttactagacactgtgtaagctaattattcagcaagtattttgcactgaactctaaataggtaagtattttgtgtccattttacagacaagagaaataaaataggtaaagtatttccccaaagctatgataaatgaatcccatagctagaaatggcagaaaacccatggaaacttctatggggagtggatgtctgccttaccttggcacaatgcttggttctca

SEQ ID NO: 25508 - DNA, 401 bp, Homo sapiens
gagagattttgctggattcttcaaacgctgggtattttctcattgaaacagaggccagagtccagtgactgcaagctaaggacaatgagaagcctacaaagagaggttattgaaagctcacgtcaggcggtgactcacacctgtaatcccagcactttgggaagctgagtcgggcagatcatctgaggtcgggagttcgagaccaacctggccaacacagcaaaacccatctctactaaaaacaccaaaattagccaggtatagtggctcatgcctgcagttcccagccattcaggaggctgaggcacgataatcgcttaaactctggaggcagaggttacagtgcaccaagatcgtgccactgcacttcagcctaggtgacagagcgagactctgtctcc

SEQ ID NO: 25509 - DNA, 152 bp, Homo sapiens
actcctaaaaataatgtgttttaggacacacagtgaaactgatcatgtgtctccattcatggcctgctttcatcattggtttgtgcatgaagacacttctaaaattatttattcatattatcgatatatagatgtattagccattgcttctc

SEQ ID NO: 25510 - DNA, 378 bp, Homo sapiens
ttatataactgatgtcactacttcaaattcctggtctgaaatctcacctggaccctcagtactgcacatcaatccttttaccaatctctactccacttcctctctcattaccttccttcttgataaacttaagtccagttactatgatcttttttcctaaagtcccactcaaaggatgaggctgtcccttctcacatttaaggtcaacctttctacctgccctatatatttcccctgcaattcctacaagctaaaaacctataagtcatacttgactgtactccccatatataatcaacagtcgagctagttctgcatattgtttcctaaataattctttaaattgcaaattatttttatccctatttccacactgtg

SEQ ID NO: 25511 - DNA, 297 bp, Homo sapiens
ttcttttcttactgtatcttgtaacttctgtggtgctttatcgagatttaccagacacaggaagaagatggccatctaaaagtcaaaagaagaagcctggaacagatttttccctcacagttctcagaaggagccagtggtgccgacaacttgatctagtctccagagctataccacaaccaattccacttatttaagccacctaggttgtggtacctcgctacagcatcacctagaaaattaatgcaccttcattacccagagataacctcagtaaacacttactatacatttaaa

SEQ ID NO: 25512 - DNA, 237 bp, Homo sapiens
aagagtgtcacctctcagatgccctttcagaaaccttagagcagttattattgcaatgattaagcaacaattaataataacaagccaaagatcttccttgattttaacttcacgaatttaaaatttattcttatgtatacatagcactgaattgtatttgtttaaaagctcaaaatcactttttaatgtttatgatatattaatatacaatgtaggactaagaaaaattatactttt

SEQ ID NO: 25513 - DNA, 370 bp, Homo sapiens
tgtattttcccaagcagacattcgacttgtacagttttccagcattactctcttctttagcagtttataaattccaagcttgtttgatgaactggaagccttgccaaggatgagagagatagatacatgtgctgcgtcctcatttattatacttactaaacagatgctttttgacttgaccatgtcttcctggcttttcttttagcccttatttgactcccaagacaactggacattttagctgtgtatctaactgggcagaatagtggcacatcctttctcaccttttaaaaccaagatgtggtgcagctgaaacagctaagaagtttgcagcaggctctgacccctactatcagttactgaagtgtat

SEQ ID NO: 25514 - DNA, 394 bp, Homo sapiens
tttttttttaatgagatgctcaaaaagatctgcgtgtaattccagatgacattgccaccttatttatccaaggatgcctgtctcactagtaactgattttgaattccagataatactattatgtccaatcctggatattaggtcaaatggctaaactattgcttattcacttatgtcccagacgtgaggtatcactagatccagaaatgaattatccccggtgggctctctttgacacatggctccaggaactcatcatttagacgtcaatcattttctcctcctagctctgatgtctcacaggtttcctgacaacaattagggggaataaaatcactgataatcacaatcacacctgccttccttattggctcgcaggcaatttacttcactc

SEQ ID NO: 25515 - DNA, 262 bp, Homo sapiens
gctgtgaacagcagagtcaggctttgaaacctgatctgtcaactgcaaagccagagcggctggccatatgactacaggggcttctgctgtttccggtgggtgacttgggagcattgagaagcgctggtggtgggagctgagcttccagctcccacttcatgtcgggtcatggtttagcctgctgaggtgggcttttggcatctttatgcatcttagatttccacctaggagatgtcacagccagctcctctcataagccacc

SEQ ID NO: 25516 - DNA, 310 bp, Homo sapiens
aacatgggtttgaactgcaagaattgcctgtaaaccatttgtttctaactaaacacggattgaaaatacagtatttgtgggatacgaaacctgtttacatggaggtctaacttgttgaatatgcagattactcagagacagctgtagtacttgagtatgcatggattttgctatatgtgagcagtccgagaagcaatcccctgtgtataccaagtggcaagttgtgtgtgtatgtgtatctgtttgataatttattttaatggaacttaaacattttaaccaaaagaataaaatgttcttttgaaatagg

SEQ ID NO: 25517 - DNA, 691 bp, Homo sapiens
ttcattctggattctttggacgttacattgtattggctctgggttctgcctcctgtctatatactgtctgacactgtctatatactgtattccccttgcccctgtggttttccacgtatgaattgagtttacattgcttggactataattgctcatccctaccacagttactttattagtttagctatactattgggaagatgatttttcatcatggttatacaaatttgtttataagcctatttaactcaaatttaaattatgctgctgtgggtaaaaatagtaacaagtactttttcatggatttcttcagagactaactaaaatgatcaatcagcgtgtccaagaaaatatgagaaaatttatctttcagaaatgttttgtatgaaattctcaaatgcttcaaaggcttacaactttacatgaaatgattaaagacagatttaaaaacaagaacaaaatccacaattattatccacattacttttgagtactgttaatacagccattacagagacctccagatagaaggaatgatagtatctaaataatagaaataggatgattaagttgcatttatttaaaaacaagtctttttggttggaaataggatgtataaaaaagctcaataccaaaatttagatgagatgtacatttattggagagaataaaattgttgagatagttttta

SEQ ID NO: 25518 - DNA, 729 bp, Homo sapiens
aggtcacgtggctggagctgagtaagcaaggggaataatggtgggagaaattacgtggaggaggtagtcaggggctagatcatgtatatattgccatgcaggccatggtaaggactttggattttattctgagtaccatgggaagccactgaaaaaccttgcctaagataatgggtttctgttttgcctaaggcaaattaactttttactgaagtatactatacattacggaaaaagtacacaaatcgtaagcttgatgaattttcatgatgtaatcgcatccatatcactagcacccaggtcaataaacagatcattaccagaaccccagaaccctcccttatgcccctttccagtaacgcccatcccccaacccacgggtaactaccatcctgacttctatcaccaaagattagttttgcctgtttatataaaactttatataattgcaatcacaatatgtattcattttgtgtctggcttctttcatttaatattatgtttaggagtttcatcattgcttagcaatagtttattggtgctatatggaagttgagtgcgtgatcacaccacagtttatccattctactgttgatggacatatgagtaatttccggtttggaactactacaaacagtgctgttatgaacattctattacatgtcttttggtgaacaaatatattcactcctgtttgaaataaacttaagaatggaacttatggatcat

SEQ ID NO: 25519 - DNA, 1850 bp, Homo sapiens
agctgagagcccaatcgcatcaggggagcacggcccagcagcaggagctccaggctggctggacacctgggtccccacgcagactgtgagtagagggagctggaccacagtgggacaaggacacctccagacaggttgccagggccccacatggaggaggcaggtgggcccatggcccgggccaaggcccaagtggtaagtgccacattgacatggcggcagtggccccccacccaggaagagatcaaacatggttttcacaaggtgtccctggtgtcaggggcccagatggaagccccgcagaaggagatgtttgagttcagccgtcgagaggaagtggaagtcaatggctttgcaacacaggaagaagagactgtgaattgccagggccctcgggatacagctggctccaagaacttccagagccatggacccatcttttccaagaagtacataccacctcccaaggagaaaaggcctgaggggaggctgaaggaggctgtggaccagagtgatggcagccgccaagctcccaggactgagcccccatgtgtgggagctatggccaggactgagcttttggttcccctgcctgggccccgagagccaagtccccacccaggtgtaggtctcaccagtggtagctcccggagcctcgaggaataccgagtgacacgcactgtgcggaccaccacagtggtgggaggtcatgtggaccggcggatgagcagctctgtgactgtgaggccagtgtcctcaggcgaggccctgccacggggccgtcaggtctcccgcatggtgccgccagtggtggtgggctccccaccaggctcgcccagccgcagccaggccgtgaaagtgctaagtaacctcgtgcctgctgggcacagcccccctgccagtcacctgcccaggcccacggctggcgggccaaggagcacaggtctgggcagcacagtgggggcagccttgaggcagctgcctgagaccgggacagcagagcttaaagacagctctgccctggcctctacaggcatcccagccagtgctcacctgcctaagaatcaggatgcccctgcagcctgtccggacagagaccagggcagagccccggatgccagggcctgtgagctctggcaggtgctgggagcccccagttccactgagctccctctccagacttctcagggtcaagcatcagtcccctcctctcccagactcgagacccatgtcccctctcctggcctaactcaccctgcaaagcagcctgtggtgcccactcaccccggggcccggctcactccccttgttctgccccctaaaaaaaggacgggcccgtggacccccctgctgccaccgtcctgcccatggtgaggagcgagcatgtgacagtccctggacaacctcctgctccatccactacaagaaggaaggatgtccccagcccaggaggtctttctgctccatcgtccccaaggaataagtttgttcagaactctgaaaatgtccctgtcctcccctttacccagagggaggtcgtgaagggccccggtgtgtgggccgagagccgcctgccgcgccagacgtggagcatcagtgaatcgggccacatctgcagccagatgttcgaaggccagatcctggacgtgaagggaggccggggctacgaccgggaccacgtggtgctatgggagccggatgaggacagggcatcccagatctggactatccacgtgctttgaaacttttcccctcaccctccagccctggaggcttttgctgggatgaatgtttttatagggtttttgttgtaacataagctattttctaatatgctgccaggtaccctt

SEQ ID NO: 25520 - DNA, 499 bp, Homo sapiens
attttacagatggggaaataaaggcccagagaagtggacacggatttgctctgcaatcttggcgccgggtttatttccgcctctggaatgcagcactggggggattcctggcagtgccggaccatgtggaggacatgaaagcaggccgtgtggtggtcgccgacccccaagctggaggtagctgcatctggtactacgaggatgggctgctgaagaaccagatggcccccaccatgagcctacaggtgattggaccccctagcccaggctccaaggtggtgctgtgggccgagagccgcctgccgcgccagacgtggagcatcagtgaatcgggccacatctgcagccagatgttcgaaggccagatcctggacgtgaagggaggccggggctacgaccgggaccacgtggtgctatgggagccggatgaggacagggcatcccagatctggactatccacgtgctttgaacttctaaaaggtatcagctcggttcgtt

SEQ ID NO: 25521 - DNA, 1369 bp, Homo sapiens
  misc_feature (58)..(58): n is a, c, g, or t
  misc_feature (150)..(151): n is a, c, g, or t
gggaggctatgacgagttgctgacctccctccgggtcatccggacggacttcgggganccggccgtcgtgctatttgaggccatggacttcgaggggcacggcgtggaggtgagcaaggcattgccggatgtggagctggtgcaacacgnncccagcacacaggccatccacgtgctcagcggcgtgtgggtggcctaccaggaggtgggcttctccggggaacagtacgtgctggagaagggcgtgtatcgtaactgcgaggactggggcgctggcaacagcaccctcgcctcgctgcagccggtcctacaggtcggggagcacgatctgcacttcgtctcaaagattcagcttttctcccgccccgactttctgggcgaccacttctctttcgaagatgaccaggccgctctgcccgcctccttccgacctcagtcctgccgggtccacggcggcagctggatcctgtttgatgagacgaacttcgagggtgaccagcacattctctctgagggcgagttccccactctcacggccatgggctgcctcgcctccacagtcctgggctctctccagaaggtatccctgcacttttcagagccttccattttcctgtatggactcgagtgcttcgaggggaaggagatcgagctcagcagggaggtgcggagcctgcaagccgagggcttcaacaaccatgtgctgtctgtgcggatcaaggggggcatttgggtgctatgtgaacacagtgacttccggggccgccagtggctggtgggaagctgcgagatcaccaactggctgacctacagcggcacccagagggtgggctccctctaccccatcaagcagcgccgggtttatttccgcctctggaatgcagcactggggggattcctggcagtgccggaccatgtggaggacatgaaagcaggccgtgtggtggtcgccgacccccaagctggaggtagctgcatctggtactacgaggatgggctgctgaagaaccagatggcccccaccatgagcctacaggtgattggaccccctagcccaggctccaaggtggtgctgtgggccgagagccgcctgccgcgccagacgtggagcatcagtgaatcgggccacatctgcagccagatgttcgaaggccagatcctggacgtgaagggaggccggggctacgaccgggaccacgtggtgctatgggagccggatgaggacagggcatcccagatctggactatccacgtgctttgaaacttttcccctcaccctccagccctggaggcttttgctgggatgaatgtttttatagggtttttgttgtaacataagctattttctaatatgctgccaggtaccctt

SEQ ID NO: 25522 - DNA, 709 bp, Homo sapiens
gaagataatgtaggtaaaacattattagaacagtgcttgagtgagtcagctctcaacaaacgttagctgtgattattgttattactattattacttttgctaccatctaagagctccagctgatttatggcagagccatgtctgatgtctgacagtccagtgtccatcccgtcaggaaccctcttcaacacagcgccgggtttatttccgcctctggaatgcagcactggggggattcctggcagtgccggaccatgtggaggacatgaaagcaggccgtgtggtggtcgccgacccccaagctggaggtagctgcatctggtactacgaggatgggctgctgaagaaccagatggcccccaccatgagcctacaggtgattggaccccctagcccaggctccaaggtggtgctgtgggccgagagccgcctgccgcgccagacgtggagcatcagtgaatcgggccacatctgcagccagatgttcgaaggccagatcctggacgtgaagggaggccggggctacgaccgggaccacgtggtgctatgggagccggatgaggacagggcatcccagatctggactatccacgtgctttgaaacttttcccctcaccctccagccctggaggcttttgctgggatgaatgtttttatagggtttttgttgtaacataagctattttctaatatgctgccaggtaccctt

SEQ ID NO: 25523 - DNA, 743 bp, Homo sapiens
cacgtgtcatgggtcagttttgaggactgaagataatgtaggtaaaacattattagaacagtgcttgagtgagtcagctctcaacaaacgttagctgtgattattgttattactattattacttttgctaccatctaagagctccagctgatttatggcagagccatgtctgatgtctgacagtccagtgtccatcccgtcaggaaccctcttcaacacaggtgtgtgtgcatttctttctgtaagtgtgtgtgcacatctgtatgcccacacacatccacgcttttagcaagcagaactgcctggtatggagtagactgcatggatctatggttagaacatgtgagttggatggctgcatgtatccatgtgtttgtgtcttctgtgaacttctgtgccatcatgtgtaccagaggtgtatctgtcagtttgtccctctgcacacatctgtgggtacctctatgaccatggaactgtgtgtgtgtgtgtgtgtgtgtgtgtgtgtgagagagagagagatacatgtgctctccgtatgtgtgtgtaaagaagcagtgacttagaaatagagtcaaggaaggtttggggacaggagggagggcttgggagcctgatactggagagtccagagttgagggtactgggggcccaggtcatccctccccggcacccctgactctcagcctctttctgccaccagcgccgggtttatttccgcctctggaatgcagcactggggggat

SEQ ID NO: 25524 - DNA, 835 bp, Homo sapiens
tgattccatttttaaatcaattactgaataaaacacactccatcgtgtggatgaaatgctaccttaatttgtcaaagctatcattttctaaacttttctttttaattcaaatcattaatattttgtggccagatcaatactgattcattgttttaagcttcaaatgcattatacagttgggcagaacacatttcctctcatcaatcttcttttccaggatttgtcagatattcctgacattaattcactactaatatgcacagtttctctaatcatggtcaacaaagatctgacagtgcattgtccctaaacgacccatacttgcctcactgacaccatgtggcccacttcccatctataatctatgtctgggtgtgaagcccttcccatatgatcccccgaatggaacttcacaagttcgaattcactgggtcacagtgtgatagcgtgaagatgggaggacgttaagggaaggctatgggtgagttgggaaatgtgttaggcagggtcagagattaccacatcctaaaaacaacacttaaggcgggagatgacaaaacaatcaatgaataacatgactttttccagtgaaagtgccatatctaatccttttccatttttgttctctgagcttctttcttagggaagatccttcttgagaagcccctgctgagtattaggaaaatgcatttcaggacctctcatcaacacaccctctttctttaccacaaccacatatatgggggcataactcaacatgtgtaaaagacaatcttctgcttttcactgaacctccaggaattcaggacaataaacctctacatgcagaccaaaa

SEQ ID NO: 25525 - DNA, 455 bp, Homo sapiens
tcccagaagtgtccacttaaactaagttttcaagcttattgtcataaagttgctcaaaataatcttatattttaaatatgtttatcttaattttgtccctatttctcttcctaatactatttgtttacacctatagtttttctctagatcagcttttcaaaggtttactgcattttaccctccctgatggggctcagtgtgcgcagctggaaaaagtagatgccctggttatgcatgcagctcatttgttgtacatgttgctttaagggaccttgaagactcttccctctccctattgttgccaaaataactgcctctgatctgtttttgtttgcatcccaggccccagactagcatgtaagatgcctttgagaagtcctagaacactgcagtcaaggtggacgttggaaaataaaaaggcttattgaattttctatcttttcaaagaatcagct

SEQ ID NO: 25526 - DNA, 597 bp, Homo sapiens
tacaacccacatcaaaacaactctgctcactttgccttctaattatctctagaatctgtctagttttctccataattgctgctcttactccagttcaggcttcctggattactgcaacaatcctttctcctggactattgcaacactttcctaactggtcttctttgttagtccattccaccgcttctcaaccttgtagccacagtgggttgggtcttccaaaagggcatttcactttccccacttaaaacgctgcaatagatgttgcccttaggatagcgccctacatcctgaggctgatgctttatgatctagcccctgttccctctcaattcttgccacttccctagttatactaagcttcctgtggctcccccaggagccatgttttccctgggttcatggcctttgaacataatatgttctctggctacagtgctctttctttcccactccttcctcccttttggtctggctacctcctactactggtccttcgggctccagctttctctaaaaactcctcagggctccaaagtaggttggatgctcttcctatgtgctcctgtggcacccgctatttaatacccagaattc

SEQ ID NO: 25527 - DNA, 440 bp, Homo sapiens
ccacagcagcagggatttacatttgctctttgagaacttattggctgtgaatgtggatgaacttaagccagctcttcttccttgcaggggagtccattagttaaggtgacttattgaagccctggccagctctaggagttctcggttttataattgaattactttagtaatattaaataatttggggagggggttaattttgggtcatttatatttcacttgtcaatgtagagggagctacttttattgtcattaagagtgacattcatcctggtgccatggtgagcacctgtggtcttagctacttgggaagctgaggtgggaggatcacttgagcccaggagtttgaggccagcctggcaacaaacaaaatccacatctctaagtaataatgatgatgatgataataaaatcctagaaatgaagaacaggtttggaaa

SEQ ID NO: 25528 - DNA, 9181 bp, Homo sapiens
  misc_feature (7541)..(7541): n is a, c, g, or t
ctggtggtccagtacctccaaagatatggaatacactcctgaaatatcctgaaaacttttttttttcagaatcctttaataagcagttatgtcaatctgaaagttgcttacttgtactttatattaatagctattcttgtttttcttatccaaagaaaaatcctctaatccccttttcacatgatagttgttaccatgtttaggcattagtcacatcaacccctctcctctcccaaacttctcttcttcaaatcaaactttattagtccctcctttataatgattccttgcctcgttttatccagatcaattttttttcactttgatgcccagagctgaagaaatggactactgtataaattattcattgccaagagaataattgcattttaaacccatattataacaaagaataatgattatattttgtgatttgtaacaaataccctttattttcccttaactattgaattaaatattttaattatttgtattctctttaactatcttggtatattaaagtattatcttttatatatttatcaatggtggacacttttataggtactctgtgtcatttttgatactgtaggtatcttatttcatttatctttattcttaatgtacgaattcataatatttgattcagaacaaatttatcactaattaacagagtgtcaattatgctaacatctcatttactgattttaatttaaaacagtttttgttaacatgcatgtttagggttggcttcttaataatttcttcttcctcttctctctctcctcttcttttggtcagtgttgtgcgggttaatacaacaaactgtaacaagtgtacctggtatggacttgttgtccgggacgtacattttcgcggtcctgctagcatgcgtggtgttccactctggcgcccaggagaaaaactacaccatccgagaagaaatgccagaaaacgtcctgataggcgacttgttgaaagaccttaacttgtcgctgattccaaacaagtccttgacaactgctatgcagttcaagctagtgtacaagaccggagatgtgccactgattcgaattgaagaggatactggtgagatcttcactactggcgctcgcattgatcgtgagaaattatgtgctggtatcccaagggatgagcattgcttttatgaagtggaggttgccattttgccggatgaaatatttagactggttaagatacgttttctgatagaagatataaatgataatgcaccattgttcccagcaacagttatcaacatatcaattccagagaactcggctataaactctaaatatactctcccagcggctgttgatcctgacgtaggaataaacggagttcaaaactacgaactaattaagagtcaaaacatttttggcctcgatgtcattgaaacaccagaaggagacaagatgccacaactgattgttcaaaaggagttagatagggaagagaaggatacctacgtgatgaaagtaaaggttgaagatggtggctttcctcaaagatccagtactgctattttgcaagtgagtgttactgatacaaatgacaaccacccagtctttaaggagacagagattgaagtcagtataccagaaaatgctcctgtaggcacttcagtgacacagctccatgccacagatgctgacataggtgaaaatgccaagatccacttctctttcagcaatctagtctccaacattgccaggagattatttcacctcaatgccaccactggacttatcacaatcaaagaaccactggatagggaagaaacaccaaaccacaagttactggttttggcaagtgatggtggattgatgccagcaagagcaatggtgctggtaaatgttacagatgtcaatgataatgtcccatccattgacataagatacatcgtcaatcctgtcaatgacacagttgttctttcagaaaatattccactcaacaccaaaattgctctcataactgtgacggataaggatgcggaccataatggcagggtgacatgcttcacagatcatgaaatccctttcagattaaggccagtattcagtaatcagttcctcctggagactgcagcatatcttgactatgagtccacaaaagaatatgccattaaattactggctgcagatgctggcaaacctcctttgaatcagtcagcaatgctcttcatcaaagtgaaagatgaaaatgacaatgctccagttttcacccagtctttcgtaactgtttctattcctgagaataactctcctggcatccagttgacgaaagtaagtgcaatggatgcagacagtgggcctaatgctaagatcaattacctgctaggccctgatgctccacctgaattcagcctggattgtcgtacaggcatgctgactgtagtgaagaaactagatagagaaaaagaggataaatatttattcacaattctggcaaaagataacggggtaccacccttaaccagcaatgtcacagtctttgtaagcattattgatcagaatgacaatagcccagttttcactcacaatgaatacaacttctatgtcccagaaaaccttccaaggcatggtacagtaggactaatcactgtaactgatcctgattatggagacaattctgcagttacgctctccattttagatgagaatgatgacttcaccattgattcacaaactggtgtcatccgaccaaatatttcatttgatagagaaaaacaagaatcttacactttctatgtaaaggctgaggatggtggtagagtatcacgttcttcaagtgccaaagtaaccataaatgtggttgatgtcaatgacaacaaaccagttttcattgtccctccttccaactgttcttatgaattggttctaccgtccactaatccaggcacagtggtctttcaggtaattgctgttgacaatgacactggcatgaatgcagaggttcgttacagcattgtaggaggaaacacaagagatctgtttgcaatcgaccaagaaacaggcaacataacattgatggagaaatgtgatgttacagaccttggtttacacagagtgttggtcaaagctaatgacttaggacagcctgattctctcttcagtgttgtaattgtcaatctgttcgtgaatgagtcggtgaccaatgctacactgattaatgaactggtgcgcaaaagcactgaagcaccagtgaccccaaatactgagatagctgatgtatcctcaccaactagtgactatgtcaagatcctggttgcagctgttgctggcaccataactgtcgttgtagttattttcatcactgctgtagtaagatgtcgccaggcaccacaccttaaggctgctcagaaaaacaagcagaattctgaatgggctaccccaaacccagaaaacaggcagatgataatgatgaagaaaaagaaaaagaagaagaagcattcccctaagaacttgctgcttaattttgtcactattgaagaaactaaggcagatgatgttgacagtgatggaaacagagtcacactagaccttcctattgatctagaagagcaaacaatgggaaagtacaattgggtaactacacctactactttcaagcccgacagccctgatttggcccgacactacaaatctgcctctccacagcctgccttccaaattcagcctgaaactcccctgaattcgaagcaccacatcatccaagaactgcctctcgataacacctttgtggcctgtgactctatctccaagtgttcctcaagcagttcagatccctacagcgtttctgactgtggctatccagtgacgaccttcgaggtacctgtgtccgtacacaccagaccgccaatgaaggaggttgtgcgatcttgcacccccatgaaagagtctacaactatggagatctggattcatccccaaccacagcggaaatctgaagggaaagtggcaggaaagtcccagcggcgtgtcacatttcacctgccagaaggctctcaggaaagcagcagtgatggtggactgggagaccatgatgcaggcagccttaccagcacatctcatggcctgccccttggctatcctcaggaggagtactttgatcgtgctacacccagcaatcgcactgaaggggatggcaactccgatcctgaatctactttcatacctggactaaagaaagctgcagaaataactgttcaaccaactgtggaagaggcctctgacaactgcactcaagaatgtctcatctatggccattctgatgcctgctggatgccggcatctctggatcattccagctcttcgcaagcacaggcctctgctctatgccacagcccaccactgtcacaggcctctactcagcaccacagcccacgagtgacacagaccattgctctctgccacagccctccagtgacacagaccatcgcattgtgccacagcccaccaccgatacaggtgtctgctctccaccacagtcctcctctagtgcaggctactgcacttcaccacagcccaccatcagcacaggcctcagccctctgctacagccctcctttagcacaggctgctgcaatcagccacagctctcctctgccacaggttattgccctccatcgtagtcaggcccaatcatcagtcagtttgcagcaaggttgggtgcaaggtgctgatgggctatgctctgttgatcagggagtgcaaggtagtgcaacatctcagttttacaccatgtctgaaagacttcatcccagtgatgattcaattaaagtcattcctttgacaaccttcactccacgccaacaggccagaccgtccagaggtgattcccccattatggaagaacatcccttgtaaagctaaaatagttacttcaaattttcagaaaagatgtatatagtcaaaatttaagatacaattccaatgagtattctgattatcagatttgtaaataactatgtaaatagaaacagataccagaataaatctacagctagacccttagtcaatagttaaccaaaaaattgcaatttgtttaattcagaatgtgtatttaaaaagaaaaggaatttaacaatttgcatccccttgtacagtaaggcttatcatgacagagcgcactatttctgatgtacagtattttttgttgtttttatcatcatgtgcaatattactgatttgtttccatgctgattgtgtggaaccagtatgtagcaaatggaaagcctagaaatatcttattttctaagtttacctttagtttacctaaacttttgttcagataacgttaaaaggtatacgtactctagcctttttttgggctttctttttgatttttgtttgttgttttcagtttttttgttgttgttagtgagtctcccttcaaaatacgcagtaggtagtgtaaatactgcttgtttgtgtctctctgctgtcatgttttctaccttattccaatactatattgttgataaaatttgtatatacattttcaataaagaatatgtataaactgtacagatctagatctacaacctatttctctactctttagtagagttcgagacacagaagtgcaataactgccctaattaagcaactatttgttaaaaagggcctctttttactttaatagtttagtgtaaagtacatcagaaataaagctgtatctgccattttaagcctgtagtccattattacttgggtctttacttctgggaatttgtatgtaacagcctagaaaattaaaaggaggtggatgcatccaaagcacgagtcacttaaaatatcgacggtaaactactattttgtagagaaactcaggaagatttaaatgttgatttgacagctcaataggctgttaccaaagggtgttcagtaaaaataacaaatacatgtaactgtagataaaaccatatactaaatctataagactaagggatttttgttattctagctcaacttactgaagaaaaccactaataacaacaagaatatcaggaaggaacttttcaagaaatgtaattataaatctacatcaaacagaattttaaggaaaaatgcagagggagaaataaggcacatgactgcttcttgcagtcaacaagaaataccaataacacacacagaacaaaaaccatcaaaatctcatatatgaaataaaatatattcttctaagcaaagaaacagtactattcatagaaaacattagttttcttctgttgtctgttatttccttcttgtatcctcttaactggccattatcttgtatgtgcacattttataaatgtacagaaacatcaccaacttaattttcttccatagcaaaactgagaaaataccttgtttcagtataacactaaaccaagagacaattgatgtttaatgggggcggttggggtgggggggggagtcaatatctcctattgattaacttagacatagattttgtaatgtataacttgatatttaatttatgattaaactgtgtgtaaattttgtaacataaactgtggtaattgcataatttcattggtgaggatttccactgaatattgagaaagtttcttttcatgtgcccagcaggttaagtagcgttttcagaatatacattattcccatccattgtaaagttccttaagtcatatttgactgggcgtgcagaataacttcttaacttttaactatcagagtttgattaataaaattaattaatgttttttctccttcgtgttgttaatgttccaagggatttggagcatactggttttccaggtgcatgtgaatcccgaaggactgatgatatttgaatgtttattaaattattatcatacaaatgtgttgatattgtggctattgttgatgttgaaaattttaaacttggggaagattaagaaaagaaccaatagtgacaaaaatcagtgcttccagtagattttagaacattctttgcctcaaaaaacctgcaaagatgatgtgagattttttcttgtgttttaattattttcacattttctctctgcaaaactttagttttctgatgatctacacacacacacacacacacacgtgcacacacacacacatttaaatgatataaaaagaagaggttgaaagattattaaataacttatcaggcatctcaatggttactatctatgttagtgaaaatcaaataggactcaaagttggatatttgggatttttcttctgacagtataatttattgagttactagggaggttcttaaatcctcatatctggaaacttgtgacgttttgacacctttcctatagatgatataggaatgaaccaatacgcttttattaccctttctaactctgattttataatcagacttagattgtgtttagaatattaaatgactgggcaccctcttcttggtttttaccagagaggctttgaatggaagcaggctgagagtagccaaagaggcaaggggtattagcccagttattctcccctatgccttccttctctttctaagcntccactaggtctggccttggaaacctgttacttctagggcttcagatctgatgatatctttttcatcacattacaagttatttctctgactgaatagacagtggtataggttgacacagcacacaagtggctattgtgatgtatgatgtatgtagtcctacaactgcaaaacgtcttactgaaccaacaatcaaaaaatggttctgttttaaaaaggattttgtttgatttgaaattaaaacttcaagctgaatgacttatatgagaataatacgttcaatcaaagtagttattctattttgtgtccatattccattagattgtgattattaattttctagctatggtattactatatcacacttgtgagtatgtattcaaatactaagtatcttatatgctacgtgcatacacattcttttcttaaactttacctgtgttttaactaatattgtgtcagtgtattaaaaattagcttttacatatgatatctacaatgtaataaatttagagagtaattttgtgtattcttatttacttaacattttacttttaattatgtaaatttggttagaaaataataataaatggttagtgctattgtgtaatggtagcagttacaaagagcctctgccttcccaaactaatatttatcacacatggtcattaaatgggaaaaaaatagactaaacaaatcacaaattgttcagttcttaaaatgtaattatgtcacacacacaaaaaatccttttcaatcctgagaaaattaaaggcgttttactcacatggctatttcaacattagttttttttgtttgtttctttttcatggtattactgaaggtgtgtatactccctaatacacatttatgaaaatctacttgtttaggcttttatttatactcttctgatttatattttttattataattattatttcttatctttcttcttttatattttttggaaaccaaatttatagttagtttaggtaaactttttattatgaccattagaaactattttgaatgcttccaactggctcaattggccgggaaaacatgggagcaagagaagctgaaatatatttctgcaagaacctttctatattatgtgccaattaccacaccagatcaattttatgcagaggccttaaaatattctttcacagtagctttcttacactaaccgtcatgtgcttttagtaaatatgatttttaaaagcagttcaagttgacaacagcagaaacagtaacaaaaaaatctgctcagaaaaatgtatgtgcacaaataaaaaaaattaatggcaattgtttagtgattgtaagtgatactttttaaagagtaaactgtgtgaaatttatactatccctgcttaaaatattaagatttttatgaaatatgtatttatgtttgtattgtgggaagattcctcctctgtgatatcatacagcatctgaaagtgaacagtatcccaaagcagttccaaccatgctttggaagtaagaaggttgactattgtatggccaaggatggcagtatgtaatccagaagcaaacttgtattaattgttctatttcaggttctgtattgcatgttttcttattaatatatattaataaaagttatgagaaataaaca

SEQ ID NO: 25529 - DNA, 4723 bp, Homo sapiens
cccctttctccccctcggttaagtccctccccctcgccattcaaaagggctggctcggcactggctccttgcagtcggcgaactgtcggggcgggaggagccgtgagcagtagctgcactcagctgcccgcgcggcaaagaggaaggcaagccaaacagagtgcgcagagtggcagtgccagcggcgacacaggcagcacaggcagcccgggctgcctgaatagcctcagaaacaacctcagcgactccggctgctctgcggactgcgagctgtggcggtagagcccgctacagcagtcgcagtctccgtggagcgggcggaagccttttttctccctttcgtttacctcttcattctactctaaaggcatcgttattaggaaaatcctgttgcgaataagaaggattccacagatcacataccggagaggttttgcctcagctgctctcaactttgtaatcttgtgaagaagctgacaagcttggctgattgcagagcactatgaggactgaacgacagtgggttttaattcagatatttcaagtgttgtgcgggttaatacaacaaactgtaacaagtgtacctggtatggacttgttgtccgggacgtacattttcgcggtcctgctagcatgcgtggtgttccactctggcgcccaggagaaaaactacaccatccgagaagaaatgccagaaaacgtcctgataggcgacttgttgaaagaccttaacttgtcgctgattccaaacaagtccttgacaactgctatgcagttcaagctagtgtacaagaccggagatgtgccactgattcgaattgaagaggatactggtgagatcttcactactggcgctcgcattgatcgtgagaaattatgtgctggtatcccaagggatgagcattgcttttatgaagtggaggttgccattttgccggatgaaatatttagactggttaagatacgttttctgatagaagatataaatgataatgcaccattgttcccagcaacagttatcaacatatcaattccagagaactcggctataaactctaaatatactctcccagcggctgttgatcctgacgtaggaataaacggagttcaaaactacgaactaattaagagtcaaaacatttttggcctcgatgtcattgaaacaccagaaggagacaagatgccacaactgattgttcaaaaggagttagatagggaagagaaggatacctacgtgatgaaagtaaaggttgaagatggtggctttcctcaaagatccagtactgctattttgcaagtgagtgttactgatacaaatgacaaccacccagtctttaaggagacagagattgaagtcagtataccagaaaatgctcctgtaggcacttcagtgacacagctccatgccacagatgctgacataggtgaaaatgccaagatccacttctctttcagcaatctagtctccaacattgccaggagattatttcacctcaatgccaccactggacttatcacaatcaaagaaccactggatagggaagaaacaccaaaccacaagttactggttttggcaagtgatggtggattgatgccagcaagagcaatggtgctggtaaatgttacagatgtcaatgataatgtcccatccattgacataagatacatcgtcaatcctgtcaatgacacagttgttctttcagaaaatattccactcaacaccaaaattgctctcataactgtgacggataaggatgcggaccataatggcagggtgacatgcttcacagatcatgaaatccctttcagattaaggccagtattcagtaatcagttcctcctggagactgcagcatatcttgactatgagtccacaaaagaatatgccattaaattactggctgcagatgctggcaaacctcctttgaatcagtcagcaatgctcttcatcaaagtgaaagatgaaaatgacaatgctccagttttcacccagtctttcgtaactgtttctattcctgagaataactctcctggcatccagttgacgaaagtaagtgcaatggatgcagacagtgggcctaatgctaagatcaattacctgctaggccctgatgctccacctgaattcagcctggattgtcgtacaggcatgctgactgtagtgaagaaactagatagagaaaaagaggataaatatttattcacaattctggcaaaagataacggggtaccacccttaaccagcaatgtcacagtctttgtaagcattattgatcagaatgacaatagcccagttttcactcacaatgaatacaacttctatgtcccagaaaaccttccaaggcatggtacagtaggactaatcactgtaactgatcctgattatggagacaattctgcagttacgctctccattttagatgagaatgatgacttcaccattgattcacaaactggtgtcatccgaccaaatatttcatttgatagagaaaaacaagaatcttacactttctatgtaaaggctgaggatggtggtagagtatcacgttcttcaagtgccaaagtaaccataaatgtggttgatgtcaatgacaacaaaccagttttcattgtccctccttccaactgttcttatgaattggttctaccgtccactaatccaggcacagtggtctttcaggtaattgctgttgacaatgacactggcatgaatgcagaggttcgttacagcattgtaggaggaaacacaagagatctgtttgcaatcgaccaagaaacaggcaacataacattgatggagaaatgtgatgttacagaccttggtttacacagagtgttggtcaaagctaatgacttaggacagcctgattctctcttcagtgttgtaattgtcaatctgttcgtgaatgagtcggtgaccaatgctacactgattaatgaactggtgcgcaaaagcactgaagcaccagtgaccccaaatactgagatagctgatgtatcctcaccaactagtgactatgtcaagatcctggttgcagctgttgctggcaccataactgtcgttgtagttattttcatcactgctgtagtaagatgtcgccaggcaccacaccttaaggctgctcagaaaaacaagcagaattctgaatgggctaccccaaacccagaaaacaggcagatgataatgatgaagaaaaagaaaaagaagaagaagcattcccctaagaacttgctgcttaattttgtcactattgaagaaactaaggcagatgatgttgacagtgatggaaacagagtcacactagaccttcctattgatctagaagagcaaacaatgggaaagtacaattgggtaactacacctactactttcaagcccgacagccctgatttggcccgacactacaaatctgcctctccacagcctgccttccaaattcagcctgaaactcccctgaattcgaagcaccacatcatccaagaactgcctctcgataacacctttgtggcctgtgactctatctccaagtgttcctcaagcagttcagatccctacagcgtttctgactgtggctatccagtgacgaccttcgaggtacctgtgtccgtacacaccagaccgactgattccaggacatcaactattgaaatctgcagtgagatataactttctaggaacaacaaaattccattccccttccaaaaaatttcaatgattgtgatttcaaaattaggctaagatcattaattttgtaatctagatttcccattataaaagcaagcaaaaatcatcttaaaaatgatgtcctagtgaaccttgtgctttctttagctgtaatctggcaatggaaatttaaaatttatggaagagacagtgcagcacaataacagagtactctcatgctgtttctctgtttgctctgaatcaacagccatgatgtaatataaggctgtcttggtgtatacacttatggttaatatatcagtcatgaaacatgcaattacttgccctgtctgattgttgaataattaaaacattatctccaggagtttggaagtgagctgaactagccaaactactctctgaaaggtatccagggcaagagacatttttaagaccccaaacaaacaaaaaacaaaaccaaaacactctggttcagtgttttgaaaatattcactaacataatattgctgagaaaatcatttttattacccaccactctgcttaaaagttgagtgggccgggcgcggtggctcacgcctgtaatcccagcactttgggaggccgaggcgggtggatcacgaggtcaggagattgagaccatcctggctaacacggtgaaaccccatctccactaaaaatacaaaaaattagcctggcgtggtggcgggcgcctgtagtcccagctactcgggaggctgaggcaggagaatagcgtgaacccgggaggcggagcttgcagtgagccgagatggcgccactgcactccagcctgggtgacagagcaagactctgtctcaaaaagaaaaaaatgttcaatgatagaaaataattttactaggtttttatgttgattgtactcatgctgttccactccttttaattattaaaaagttatttttggctgggtgtggtggctcacacctgtaatcccagcactttgggaggccgaggtgggtggatcacctgaggtcaggagttcaagaccagtctggccaacat

SEQ ID NO: 25530 - DNA, 8814 bp, Homo sapiens
  misc_feature (7174)..(7174): n is a, c, g, or t
cccctttctccccctcggttaagtccctccccctcgccattcaaaagggctggctcggcactggctccttgcagtcggcgaactgtcggggcgggaggagccgtgagcagtagctgcactcagctgcccgcgcggcaaagaggaaggcaagccaaacagagtgcgcagagtggcagtgccagcggcgacacaggcagcacaggcagcccgggctgcctgaatagcctcagaaacaacctcagcgactccggctgctctgcggactgcgagctgtggcggtagagcccgctacagcagtcgcagtctccgtggagcgggcggaagccttttttctccctttcgtttacctcttcattctactctaaaggcatcgttattaggaaaatcctgttgcgaataagaaggattccacagatcacataccggagaggttttgcctcagctgctctcaactttgtaatcttgtgaagaagctgacaagcttggctgattgcagagcactatgaggactgaacgacagtgggttttaattcagatatttcaagtgttgtgcgggttaatacaacaaactgtaacaagtgtacctggtatggacttgttgtccgggacgtacattttcgcggtcctgctagcatgcgtggtgttccactctggcgcccaggagaaaaactacaccatccgagaagaaatgccagaaaacgtcctgataggcgacttgttgaaagaccttaacttgtcgctgattccaaacaagtccttgacaactgctatgcagttcaagctagtgtacaagaccggagatgtgccactgattcgaattgaagaggatactggtgagatcttcactactggcgctcgcattgatcgtgagaaattatgtgctggtatcccaagggatgagcattgcttttatgaagtggaggttgccattttgccggatgaaatatttagactggttaagatacgttttctgatagaagatataaatgataatgcaccattgttcccagcaacagttatcaacatatcaattccagagaactcggctataaactctaaatatactctcccagcggctgttgatcctgacgtaggaataaacggagttcaaaactacgaactaattaagagtcaaaacatttttggcctcgatgtcattgaaacaccagaaggagacaagatgccacaactgattgttcaaaaggagttagatagggaagagaaggatacctacgtgatgaaagtaaaggttgaagatggtggctttcctcaaagatccagtactgctattttgcaagtgagtgttactgatacaaatgacaaccacccagtctttaaggagacagagattgaagtcagtataccagaaaatgctcctgtaggcacttcagtgacacagctccatgccacagatgctgacataggtgaaaatgccaagatccacttctctttcagcaatctagtctccaacattgccaggagattatttcacctcaatgccaccactggacttatcacaatcaaagaaccactggatagggaagaaacaccaaaccacaagttactggttttggcaagtgatggtggattgatgccagcaagagcaatggtgctggtaaatgttacagatgtcaatgataatgtcccatccattgacataagatacatcgtcaatcctgtcaatgacacagttgttctttcagaaaatattccactcaacaccaaaattgctctcataactgtgacggataaggatgcggaccataatggcagggtgacatgcttcacagatcatgaaatccctttcagattaaggccagtattcagtaatcagttcctcctggagactgcagcatatcttgactatgagtccacaaaagaatatgccattaaattactggctgcagatgctggcaaacctcctttgaatcagtcagcaatgctcttcatcaaagtgaaagatgaaaatgacaatgctccagttttcacccagtctttcgtaactgtttctattcctgagaataactctcctggcatccagttgacgaaagtaagtgcaatggatgcagacagtgggcctaatgctaagatcaattacctgctaggccctgatgctccacctgaattcagcctggattgtcgtacaggcatgctgactgtagtgaagaaactagatagagaaaaagaggataaatatttattcacaattctggcaaaagataacggggtaccacccttaaccagcaatgtcacagtctttgtaagcattattgatcagaatgacaatagcccagttttcactcacaatgaatacaacttctatgtcccagaaaaccttccaaggcatggtacagtaggactaatcactgtaactgatcctgattatggagacaattctgcagttacgctctccattttagatgagaatgatgacttcaccattgattcacaaactggtgtcatccgaccaaatatttcatttgatagagaaaaacaagaatcttacactttctatgtaaaggctgaggatggtggtagagtatcacgttcttcaagtgccaaagtaaccataaatgtggttgatgtcaatgacaacaaaccagttttcattgtccctccttccaactgttcttatgaattggttctaccgtccactaatccaggcacagtggtctttcaggtaattgctgttgacaatgacactggcatgaatgcagaggttcgttacagcattgtaggaggaaacacaagagatctgtttgcaatcgaccaagaaacaggcaacataacattgatggagaaatgtgatgttacagaccttggtttacacagagtgttggtcaaagctaatgacttaggacagcctgattctctcttcagtgttgtaattgtcaatctgttcgtgaatgagtcggtgaccaatgctacactgattaatgaactggtgcgcaaaagcactgaagcaccagtgaccccaaatactgagatagctgatgtatcctcaccaactagtgactatgtcaagatcctggttgcagctgttgctggcaccataactgtcgttgtagttattttcatcactgctgtagtaagatgtcgccaggcaccacaccttaaggctgctcagaaaaacaagcagaattctgaatgggctaccccaaacccagaaaacaggcagatgataatgatgaagaaaaagaaaaagaagaagaagcattcccctaagaacttgctgcttaattttgtcactattgaagaaactaaggcagatgatgttgacagtgatggaaacagagtcacactagaccttcctattgatctagaagagcaaacaatgggaaagtacaattgggtaactacacctactactttcaagcccgacagccctgatttggcccgacactacaaatctgcctctccacagcctgccttccaaattcagcctgaaactcccctgaattcgaagcaccacatcatccaagaactgcctctcgataacacctttgtggcctgtgactctatctccaagtgttcctcaagcagttcagatccctacagcgtttctgactgtggctatccagtgacgaccttcgaggtacctgtgtccgtacacaccagaccgtcccagcggcgtgtcacatttcacctgccagaaggctctcaggaaagcagcagtgatggtggactgggagaccatgatgcaggcagccttaccagcacatctcatggcctgccccttggctatcctcaggaggagtactttgatcgtgctacacccagcaatcgcactgaaggggatggcaactccgatcctgaatctactttcatacctggactaaagaaagctgcagaaataactgttcaaccaactgtggaagaggcctctgacaactgcactcaagaatgtctcatctatggccattctgatgcctgctggatgccggcatctctggatcattccagctcttcgcaagcacaggcctctgctctatgccacagcccaccactgtcacaggcctctactcagcaccacagcccacgagtgacacagaccattgctctctgccacagccctccagtgacacagaccatcgcattgtgccacagcccaccaccgatacaggtgtctgctctccaccacagtcctcctctagtgcaggctactgcacttcaccacagcccaccatcagcacaggcctcagccctctgctacagccctcctttagcacaggctgctgcaatcagccacagctctcctctgccacaggttattgccctccatcgtagtcaggcccaatcatcagtcagtttgcagcaaggttgggtgcaaggtgctgatgggctatgctctgttgatcagggagtgcaaggtagtgcaacatctcagttttacaccatgtctgaaagacttcatcccagtgatgattcaattaaagtcattcctttgacaaccttcactccacgccaacaggccagaccgtccagaggtgattcccccattatggaagaacatcccttgtaaagctaaaatagttacttcaaattttcagaaaagatgtatatagtcaaaatttaagatacaattccaatgagtattctgattatcagatttgtaaataactatgtaaatagaaacagataccagaataaatctacagctagacccttagtcaatagttaaccaaaaaattgcaatttgtttaattcagaatgtgtatttaaaaagaaaaggaatttaacaatttgcatccccttgtacagtaaggcttatcatgacagagcgcactatttctgatgtacagtattttttgttgtttttatcatcatgtgcaatattactgatttgtttccatgctgattgtgtggaaccagtatgtagcaaatggaaagcctagaaatatcttattttctaagtttacctttagtttacctaaacttttgttcagataacgttaaaaggtatacgtactctagcctttttttgggctttctttttgatttttgtttgttgttttcagtttttttgttgttgttagtgagtctcccttcaaaatacgcagtaggtagtgtaaatactgcttgtttgtgtctctctgctgtcatgttttctaccttattccaatactatattgttgataaaatttgtatatacattttcaataaagaatatgtataaactgtacagatctagatctacaacctatttctctactctttagtagagttcgagacacagaagtgcaataactgccctaattaagcaactatttgttaaaaagggcctctttttactttaatagtttagtgtaaagtacatcagaaataaagctgtatctgccattttaagcctgtagtccattattacttgggtctttacttctgggaatttgtatgtaacagcctagaaaattaaaaggaggtggatgcatccaaagcacgagtcacttaaaatatcgacggtaaactactattttgtagagaaactcaggaagatttaaatgttgatttgacagctcaataggctgttaccaaagggtgttcagtaaaaataacaaatacatgtaactgtagataaaaccatatactaaatctataagactaagggatttttgttattctagctcaacttactgaagaaaaccactaataacaacaagaatatcaggaaggaacttttcaagaaatgtaattataaatctacatcaaacagaattttaaggaaaaatgcagagggagaaataaggcacatgactgcttcttgcagtcaacaagaaataccaataacacacacagaacaaaaaccatcaaaatctcatatatgaaataaaatatattcttctaagcaaagaaacagtactattcatagaaaacattagttttcttctgttgtctgttatttccttcttgtatcctcttaactggccattatcttgtatgtgcacattttataaatgtacagaaacatcaccaacttaattttcttccatagcaaaactgagaaaataccttgtttcagtataacactaaaccaagagacaattgatgtttaatgggggcggttggggtgggggggggagtcaatatctcctattgattaacttagacatagattttgtaatgtataacttgatatttaatttatgattaaactgtgtgtaaattttgtaacataaactgtggtaattgcataatttcattggtgaggatttccactgaatattgagaaagtttcttttcatgtgcccagcaggttaagtagcgttttcagaatatacattattcccatccattgtaaagttccttaagtcatatttgactgggcgtgcagaataacttcttaacttttaactatcagagtttgattaataaaattaattaatgttttttctccttcgtgttgttaatgttccaagggatttggagcatactggttttccaggtgcatgtgaatcccgaaggactgatgatatttgaatgtttattaaattattatcatacaaatgtgttgatattgtggctattgttgatgttgaaaattttaaacttggggaagattaagaaaagaaccaatagtgacaaaaatcagtgcttccagtagattttagaacattctttgcctcaaaaaacctgcaaagatgatgtgagattttttcttgtgttttaattattttcacattttctctctgcaaaactttagttttctgatgatctacacacacacacacacacacacgtgcacacacacacacatttaaatgatataaaaagaagaggttgaaagattattaaataacttatcaggcatctcaatggttactatctatgttagtgaaaatcaaataggactcaaagttggatatttgggatttttcttctgacagtataatttattgagttactagggaggttcttaaatcctcatatctggaaacttgtgacgttttgacacctttcctatagatgatataggaatgaaccaatacgcttttattaccctttctaactctgattttataatcagacttagattgtgtttagaatattaaatgactgggcaccctcttcttggtttttaccagagaggctttgaatggaagcaggctgagagtagccaaagaggcaaggggtattagcccagttattctcccctatgccttccttctctttctaagcntccactaggtctggccttggaaacctgttacttctagggcttcagatctgatgatatctttttcatcacattacaagttatttctctgactgaatagacagtggtataggttgacacagcacacaagtggctattgtgatgtatgatgtatgtagtcctacaactgcaaaacgtcttactgaaccaacaatcaaaaaatggttctgttttaaaaaggattttgtttgatttgaaattaaaacttcaagctgaatgacttatatgagaataatacgttcaatcaaagtagttattctattttgtgtccatattccattagattgtgattattaattttctagctatggtattactatatcacacttgtgagtatgtattcaaatactaagtatcttatatgctacgtgcatacacattcttttcttaaactttacctgtgttttaactaatattgtgtcagtgtattaaaaattagcttttacatatgatatctacaatgtaataaatttagagagtaattttgtgtattcttatttacttaacattttacttttaattatgtaaatttggttagaaaataataataaatggttagtgctattgtgtaatggtagcagttacaaagagcctctgccttcccaaactaatatttatcacacatggtcattaaatgggaaaaaaatagactaaacaaatcacaaattgttcagttcttaaaatgtaattatgtcacacacacaaaaaatccttttcaatcctgagaaaattaaaggcgttttactcacatggctatttcaacattagttttttttgtttgtttctttttcatggtattactgaaggtgtgtatactccctaatacacatttatgaaaatctacttgtttaggcttttatttatactcttctgatttatattttttattataattattatttcttatctttcttcttttatattttttggaaaccaaatttatagttagtttaggtaaactttttattatgaccattagaaactattttgaatgcttccaactggctcaattggccgggaaaacatgggagcaagagaagctgaaatatatttctgcaagaacctttctatattatgtgccaattaccacaccagatcaattttatgcagaggccttaaaatattctttcacagtagctttcttacactaaccgtcatgtgcttttagtaaatatgatttttaaaagcagttcaagttgacaacagcagaaacagtaacaaaaaaatctgctcagaaaaatgtatgtgcacaaataaaaaaaattaatggcaattgtttagtgattgtaagtgatactttttaaagagtaaactgtgtgaaatttatactatccctgcttaaaatattaagatttttatgaaatatgtatttatgtttgtattgtgggaagattcctcctctgtgatatcatacagcatctgaaagtgaacagtatcccaaagcagttccaaccatgctttggaagtaagaaggttgactattgtatggccaaggatggcagtatgtaatccagaagcaaacttgtattaattgttctatttcaggttctgtattgcatgttttcttattaatatatattaataaaagttatgagaaataaaca

SEQ ID NO: 25531 - DNA, 9151 bp, Homo sapiens
  misc_feature (7511)..(7511): n is a, c, g, or t
ctggtggtccagtacctccaaagatatggaatacactcctgaaatatcctgaaaacttttttttttcagaatcctttaataagcagttatgtcaatctgaaagttgcttacttgtactttatattaatagctattcttgtttttcttatccaaagaaaaatcctctaatccccttttcacatgatagttgttaccatgtttaggcattagtcacatcaacccctctcctctcccaaacttctcttcttcaaatcaaactttattagtccctcctttataatgattccttgcctcgttttatccagatcaattttttttcactttgatgcccagagctgaagaaatggactactgtataaattattcattgccaagagaataattgcattttaaacccatattataacaaagaataatgattatattttgtgatttgtaacaaataccctttattttcccttaactattgaattaaatattttaattatttgtattctctttaactatcttggtatattaaagtattatcttttatatatttatcaatggtggacacttttataggtactctgtgtcatttttgatactgtaggtatcttatttcatttatctttattcttaatgtacgaattcataatatttgattcagaacaaatttatcactaattaacagagtgtcaattatgctaacatctcatttactgattttaatttaaaacagtttttgttaacatgcatgtttagggttggcttcttaataatttcttcttcctcttctctctctcctcttcttttggtcagtgttgtgcgggttaatacaacaaactgtaacaagtgtacctggtatggacttgttgtccgggacgtacattttcgcggtcctgctagcatgcgtggtgttccactctggcgcccaggagaaaaactacaccatccgagaagaaatgccagaaaacgtcctgataggcgacttgttgaaagaccttaacttgtcgctgattccaaacaagtccttgacaactgctatgcagttcaagctagtgtacaagaccggagatgtgccactgattcgaattgaagaggatactggtgagatcttcactactggcgctcgcattgatcgtgagaaattatgtgctggtatcccaagggatgagcattgcttttatgaagtggaggttgccattttgccggatgaaatatttagactggttaagatacgttttctgatagaagatataaatgataatgcaccattgttcccagcaacagttatcaacatatcaattccagagaactcggctataaactctaaatatactctcccagcggctgttgatcctgacgtaggaataaacggagttcaaaactacgaactaattaagagtcaaaacatttttggcctcgatgtcattgaaacaccagaaggagacaagatgccacaactgattgttcaaaaggagttagatagggaagagaaggatacctacgtgatgaaagtaaaggttgaagatggtggctttcctcaaagatccagtactgctattttgcaagtgagtgttactgatacaaatgacaaccacccagtctttaaggagacagagattgaagtcagtataccagaaaatgctcctgtaggcacttcagtgacacagctccatgccacagatgctgacataggtgaaaatgccaagatccacttctctttcagcaatctagtctccaacattgccaggagattatttcacctcaatgccaccactggacttatcacaatcaaagaaccactggatagggaagaaacaccaaaccacaagttactggttttggcaagtgatggtggattgatgccagcaagagcaatggtgctggtaaatgttacagatgtcaatgataatgtcccatccattgacataagatacatcgtcaatcctgtcaatgacacagttgttctttcagaaaatattccactcaacaccaaaattgctctcataactgtgacggataaggatgcggaccataatggcagggtgacatgcttcacagatcatgaaatccctttcagattaaggccagtattcagtaatcagttcctcctggagactgcagcatatcttgactatgagtccacaaaagaatatgccattaaattactggctgcagatgctggcaaacctcctttgaatcagtcagcaatgctcttcatcaaagtgaaagatgaaaatgacaatgctccagttttcacccagtctttcgtaactgtttctattcctgagaataactctcctggcatccagttgacgaaagtaagtgcaatggatgcagacagtgggcctaatgctaagatcaattacctgctaggccctgatgctccacctgaattcagcctggattgtcgtacaggcatgctgactgtagtgaagaaactagatagagaaaaagaggataaatatttattcacaattctggcaaaagataacggggtaccacccttaaccagcaatgtcacagtctttgtaagcattattgatcagaatgacaatagcccagttttcactcacaatgaatacaacttctatgtcccagaaaaccttccaaggcatggtacagtaggactaatcactgtaactgatcctgattatggagacaattctgcagttacgctctccattttagatgagaatgatgacttcaccattgattcacaaactggtgtcatccgaccaaatatttcatttgatagagaaaaacaagaatcttacactttctatgtaaaggctgaggatggtggtagagtatcacgttcttcaagtgccaaagtaaccataaatgtggttgatgtcaatgacaacaaaccagttttcattgtccctccttccaactgttcttatgaattggttctaccgtccactaatccaggcacagtggtctttcaggtaattgctgttgacaatgacactggcatgaatgcagaggttcgttacagcattgtaggaggaaacacaagagatctgtttgcaatcgaccaagaaacaggcaacataacattgatggagaaatgtgatgttacagaccttggtttacacagagtgttggtcaaagctaatgacttaggacagcctgattctctcttcagtgttgtaattgtcaatctgttcgtgaatgagtcggtgaccaatgctacactgattaatgaactggtgcgcaaaagcactgaagcaccagtgaccccaaatactgagatagctgatgtatcctcaccaactagtgactatgtcaagatcctggttgcagctgttgctggcaccataactgtcgttgtagttattttcatcactgctgtagtaagatgtcgccaggcaccacaccttaaggctgctcagaaaaacaagcagaattctgaatgggctaccccaaacccagaaaacaggcagatgataatgatgaagaaaaagaaaaagaagaagaagcattcccctaagaacttgctgcttaattttgtcactattgaagaaactaaggcagatgatgttgacagtgatggaaacagagtcacactagaccttcctattgatctagaagagcaaacaatgggaaagtacaattgggtaactacacctactactttcaagcccgacagccctgatttggcccgacactacaaatctgcctctccacagcctgccttccaaattcagcctgaaactcccctgaattcgaagcaccacatcatccaagaactgcctctcgataacacctttgtggcctgtgactctatctccaagtgttcctcaagcagttcagatccctacagcgtttctgactgtggctatccagtgacgaccttcgaggtacctgtgtccgtacacaccagaccgccaatgaaggaggttgtgcgatcttgcacccccatgaaagagtctacaactatggagatctggattcatccccaaccacagtcccagcggcgtgtcacatttcacctgccagaaggctctcaggaaagcagcagtgatggtggactgggagaccatgatgcaggcagccttaccagcacatctcatggcctgccccttggctatcctcaggaggagtactttgatcgtgctacacccagcaatcgcactgaaggggatggcaactccgatcctgaatctactttcatacctggactaaagaaagctgcagaaataactgttcaaccaactgtggaagaggcctctgacaactgcactcaagaatgtctcatctatggccattctgatgcctgctggatgccggcatctctggatcattccagctcttcgcaagcacaggcctctgctctatgccacagcccaccactgtcacaggcctctactcagcaccacagcccacgagtgacacagaccattgctctctgccacagccctccagtgacacagaccatcgcattgtgccacagcccaccaccgatacaggtgtctgctctccaccacagtcctcctctagtgcaggctactgcacttcaccacagcccaccatcagcacaggcctcagccctctgctacagccctcctttagcacaggctgctgcaatcagccacagctctcctctgccacaggttattgccctccatcgtagtcaggcccaatcatcagtcagtttgcagcaaggttgggtgcaaggtgctgatgggctatgctctgttgatcagggagtgcaaggtagtgcaacatctcagttttacaccatgtctgaaagacttcatcccagtgatgattcaattaaagtcattcctttgacaaccttcactccacgccaacaggccagaccgtccagaggtgattcccccattatggaagaacatcccttgtaaagctaaaatagttacttcaaattttcagaaaagatgtatatagtcaaaatttaagatacaattccaatgagtattctgattatcagatttgtaaataactatgtaaatagaaacagataccagaataaatctacagctagacccttagtcaatagttaaccaaaaaattgcaatttgtttaattcagaatgtgtatttaaaaagaaaaggaatttaacaatttgcatccccttgtacagtaaggcttatcatgacagagcgcactatttctgatgtacagtattttttgttgtttttatcatcatgtgcaatattactgatttgtttccatgctgattgtgtggaaccagtatgtagcaaatggaaagcctagaaatatcttattttctaagtttacctttagtttacctaaacttttgttcagataacgttaaaaggtatacgtactctagcctttttttgggctttctttttgatttttgtttgttgttttcagtttttttgttgttgttagtgagtctcccttcaaaatacgcagtaggtagtgtaaatactgcttgtttgtgtctctctgctgtcatgttttctaccttattccaatactatattgttgataaaatttgtatatacattttcaataaagaatatgtataaactgtacagatctagatctacaacctatttctctactctttagtagagttcgagacacagaagtgcaataactgccctaattaagcaactatttgttaaaaagggcctctttttactttaatagtttagtgtaaagtacatcagaaataaagctgtatctgccattttaagcctgtagtccattattacttgggtctttacttctgggaatttgtatgtaacagcctagaaaattaaaaggaggtggatgcatccaaagcacgagtcacttaaaatatcgacggtaaactactattttgtagagaaactcaggaagatttaaatgttgatttgacagctcaataggctgttaccaaagggtgttcagtaaaaataacaaatacatgtaactgtagataaaaccatatactaaatctataagactaagggatttttgttattctagctcaacttactgaagaaaaccactaataacaacaagaatatcaggaaggaacttttcaagaaatgtaattataaatctacatcaaacagaattttaaggaaaaatgcagagggagaaataaggcacatgactgcttcttgcagtcaacaagaaataccaataacacacacagaacaaaaaccatcaaaatctcatatatgaaataaaatatattcttctaagcaaagaaacagtactattcatagaaaacattagttttcttctgttgtctgttatttccttcttgtatcctcttaactggccattatcttgtatgtgcacattttataaatgtacagaaacatcaccaacttaattttcttccatagcaaaactgagaaaataccttgtttcagtataacactaaaccaagagacaattgatgtttaatgggggcggttggggtgggggggggagtcaatatctcctattgattaacttagacatagattttgtaatgtataacttgatatttaatttatgattaaactgtgtgtaaattttgtaacataaactgtggtaattgcataatttcattggtgaggatttccactgaatattgagaaagtttcttttcatgtgcccagcaggttaagtagcgttttcagaatatacattattcccatccattgtaaagttccttaagtcatatttgactgggcgtgcagaataacttcttaacttttaactatcagagtttgattaataaaattaattaatgttttttctccttcgtgttgttaatgttccaagggatttggagcatactggttttccaggtgcatgtgaatcccgaaggactgatgatatttgaatgtttattaaattattatcatacaaatgtgttgatattgtggctattgttgatgttgaaaattttaaacttggggaagattaagaaaagaaccaatagtgacaaaaatcagtgcttccagtagattttagaacattctttgcctcaaaaaacctgcaaagatgatgtgagattttttcttgtgttttaattattttcacattttctctctgcaaaactttagttttctgatgatctacacacacacacacacacacacgtgcacacacacacacatttaaatgatataaaaagaagaggttgaaagattattaaataacttatcaggcatctcaatggttactatctatgttagtgaaaatcaaataggactcaaagttggatatttgggatttttcttctgacagtataatttattgagttactagggaggttcttaaatcctcatatctggaaacttgtgacgttttgacacctttcctatagatgatataggaatgaaccaatacgcttttattaccctttctaactctgattttataatcagacttagattgtgtttagaatattaaatgactgggcaccctcttcttggtttttaccagagaggctttgaatggaagcaggctgagagtagccaaagaggcaaggggtattagcccagttattctcccctatgccttccttctctttctaagcntccactaggtctggccttggaaacctgttacttctagggcttcagatctgatgatatctttttcatcacattacaagttatttctctgactgaatagacagtggtataggttgacacagcacacaagtggctattgtgatgtatgatgtatgtagtcctacaactgcaaaacgtcttactgaaccaacaatcaaaaaatggttctgttttaaaaaggattttgtttgatttgaaattaaaacttcaagctgaatgacttatatgagaataatacgttcaatcaaagtagttattctattttgtgtccatattccattagattgtgattattaattttctagctatggtattactatatcacacttgtgagtatgtattcaaatactaagtatcttatatgctacgtgcatacacattcttttcttaaactttacctgtgttttaactaatattgtgtcagtgtattaaaaattagcttttacatatgatatctacaatgtaataaatttagagagtaattttgtgtattcttatttacttaacattttacttttaattatgtaaatttggttagaaaataataataaatggttagtgctattgtgtaatggtagcagttacaaagagcctctgccttcccaaactaatatttatcacacatggtcattaaatgggaaaaaaatagactaaacaaatcacaaattgttcagttcttaaaatgtaattatgtcacacacacaaaaaatccttttcaatcctgagaaaattaaaggcgttttactcacatggctatttcaacattagttttttttgtttgtttctttttcatggtattactgaaggtgtgtatactccctaatacacatttatgaaaatctacttgtttaggcttttatttatactcttctgatttatattttttattataattattatttcttatctttcttcttttatattttttggaaaccaaatttatagttagtttaggtaaactttttattatgaccattagaaactattttgaatgcttccaactggctcaattggccgggaaaacatgggagcaagagaagctgaaatatatttctgcaagaacctttctatattatgtgccaattaccacaccagatcaattttatgcagaggccttaaaatattctttcacagtagctttcttacactaaccgtcatgtgcttttagtaaatatgatttttaaaagcagttcaagttgacaacagcagaaacagtaacaaaaaaatctgctcagaaaaatgtatgtgcacaaataaaaaaaattaatggcaattgtttagtgattgtaagtgatactttttaaagagtaaactgtgtgaaatttatactatccctgcttaaaatattaagatttttatgaaatatgtatttatgtttgtattgtgggaagattcctcctctgtgatatcatacagcatctgaaagtgaacagtatcccaaagcagttccaaccatgctttggaagtaagaaggttgactattgtatggccaaggatggcagtatgtaatccagaagcaaacttgtattaattgttctatttcaggttctgtattgcatgttttcttattaatatatattaataaaagttatgagaaataaaca

SEQ ID NO: 25532 - DNA, 4603 bp, Homo sapiens
ctggtggtccagtacctccaaagatatggaatacactcctgaaatatcctgaaaacttttttttttcagaatcctttaataagcagttatgtcaatctgaaagttgcttacttgtactttatattaatagctattcttgtttttcttatccaaagaaaaatcctctaatccccttttcacatgatagttgttaccatgtttaggcattagtcacatcaacccctctcctctcccaaacttctcttcttcaaatcaaactttattagtccctcctttataatgattccttgcctcgttttatccagatcaattttttttcactttgatgcccagagctgaagaaatggactactgtataaattattcattgccaagagaataattgcattttaaacccatattataacaaagaataatgattatattttgtgatttgtaacaaataccctttattttcccttaactattgaattaaatattttaattatttgtattctctttaactatcttggtatattaaagtattatcttttatatatttatcaatggtggacacttttataggtactctgtgtcatttttgatactgtaggtatcttatttcatttatctttattcttaatgtacgaattcataatatttgattcagaacaaatttatcactaattaacagagtgtcaattatgctaacatctcatttactgattttaatttaaaacagtttttgttaacatgcatgtttagggttggcttcttaataatttcttcttcctcttctctctctcctcttcttttggtcagtgttgtgcgggttaatacaacaaactgtaacaagtgtacctggtatggacttgttgtccgggacgtacattttcgcggtcctgctagcatgcgtggtgttccactctggcgcccaggagaaaaactacaccatccgagaagaaatgccagaaaacgtcctgataggcgacttgttgaaagaccttaacttgtcgctgattccaaacaagtccttgacaactgctatgcagttcaagctagtgtacaagaccggagatgtgccactgattcgaattgaagaggatactggtgagatcttcactactggcgctcgcattgatcgtgagaaattatgtgctggtatcccaagggatgagcattgcttttatgaagtggaggttgccattttgccggatgaaatatttagactggttaagatacgttttctgatagaagatataaatgataatgcaccattgttcccagcaacagttatcaacatatcaattccagagaactcggctataaactctaaatatactctcccagcggctgttgatcctgacgtaggaataaacggagttcaaaactacgaactaattaagagtcaaaacatttttggcctcgatgtcattgaaacaccagaaggagacaagatgccacaactgattgttcaaaaggagttagatagggaagagaaggatacctacgtgatgaaagtaaaggttgaagatggtggctttcctcaaagatccagtactgctattttgcaagtgagtgttactgatacaaatgacaaccacccagtctttaaggagacagagattgaagtcagtataccagaaaatgctcctgtaggcacttcagtgacacagctccatgccacagatgctgacataggtgaaaatgccaagatccacttctctttcagcaatctagtctccaacattgccaggagattatttcacctcaatgccaccactggacttatcacaatcaaagaaccactggatagggaagaaacaccaaaccacaagttactggttttggcaagtgatggtggattgatgccagcaagagcaatggtgctggtaaatgttacagatgtcaatgataatgtcccatccattgacataagatacatcgtcaatcctgtcaatgacacagttgttctttcagaaaatattccactcaacaccaaaattgctctcataactgtgacggataaggatgcggaccataatggcagggtgacatgcttcacagatcatgaaatccctttcagattaaggccagtattcagtaatcagttcctcctggagactgcagcatatcttgactatgagtccacaaaagaatatgccattaaattactggctgcagatgctggcaaacctcctttgaatcagtcagcaatgctcttcatcaaagtgaaagatgaaaatgacaatgctccagttttcacccagtctttcgtaactgtttctattcctgagaataactctcctggcatccagttgacgaaagtaagtgcaatggatgcagacagtgggcctaatgctaagatcaattacctgctaggccctgatgctccacctgaattcagcctggattgtcgtacaggcatgctgactgtagtgaagaaactagatagagaaaaagaggataaatatttattcacaattctggcaaaagataacggggtaccacccttaaccagcaatgtcacagtctttgtaagcattattgatcagaatgacaatagcccagttttcactcacaatgaatacaacttctatgtcccagaaaaccttccaaggcatggtacagtaggactaatcactgtaactgatcctgattatggagacaattctgcagttacgctctccattttagatgagaatgatgacttcaccattgattcacaaactggtgtcatccgaccaaatatttcatttgatagagaaaaacaagaatcttacactttctatgtaaaggctgaggatggtggtagagtatcacgttcttcaagtgccaaagtaaccataaatgtggttgatgtcaatgacaacaaaccagttttcattgtccctccttccaactgttcttatgaattggttctaccgtccactaatccaggcacagtggtctttcaggtaattgctgttgacaatgacactggcatgaatgcagaggttcgttacagcattgtaggaggaaacacaagagatctgtttgcaatcgaccaagaaacaggcaacataacattgatggagaaatgtgatgttacagaccttggtttacacagagtgttggtcaaagctaatgacttaggacagcctgattctctcttcagtgttgtaattgtcaatctgttcgtgaatgagtcggtgaccaatgctacactgattaatgaactggtgcgcaaaagcactgaagcaccagtgaccccaaatactgagatagctgatgtatcctcaccaactagtgactatgtcaagatcctggttgcagctgttgctggcaccataactgtcgttgtagttattttcatcactgctgtagtaagatgtcgccaggcaccacaccttaaggctgctcagaaaaacaagcagaattctgaatgggctaccccaaacccagaaaacaggcagatgataatgatgaagaaaaagaaaaagaagaagaagcattcccctaagaacttgctgcttaattttgtcactattgaagaaactaaggcagatgatgttgacagtgatggaaacagagtcacactagaccttcctattgatctagaagagcaaacaatgggaaagtacaattgggtaactacacctactactttcaagcccgacagccctgatttggcccgacactacaaatctgcctctccacagcctgccttccaaattcagcctgaaactcccctgaattcgaagcaccacatcatccaagaactgcctctcgataacacctttgtggcctgtgactctatctccaagtgttcctcaagcagttcagatccctacagcgtttctgactgtggctatccagtgacgaccttcgaggtacctgtgtccgtacacaccagaccggtaggtatccaagtttctaacacaactttctaactatttttttattattattttcagttgatgtagaactttacaaaatctattgacttcaaagagggatcaaaacaatcatattctacagatgtacccaatagatatatggattcaattaagtttggtagaagatgagaacaaaataactactgatttaggaaaattggatgcagaataataattatagtaggggcaattttgtctgtagatggcagtatgacaattcttgctagagaatatattgaaaaaaacttcaacacaaagggttgtagcactgtcctcagtaccattgtgtgcatgaggatcagaatagtctgggctagatacatcacattaaagcttttcagaatctgataaatagctctaaatactaatgatattgagaagcctagcttcacttgggaaaatctgtggctgttcacagaaattcagcaccaagttattccccccatactctaccaggccttcaggtcctcataaagaaaagtgtcgttttcagattaggaactcaaaattattttggtgcatcaaatctacagtcacacaatataacaagaatgggattagaaaaatgaaagcctactcattctcatctttaagccagagaatgaaatatatatgaggtctctggatagctatttaaatatttgcatatttatgcaaggtattttgagcccttcagaagacattct

SEQ ID NO: 25533 - DNA, 527 bp, Homo sapiens
caaaattgaaaaacttgtttgttgctccccgaaacgagtatccacccatcttgttgaaacctgtactcctcacgtttatggcatatcactgaattggaaacaattttccttctggtatatatcattcagcttaactctgtatcaatcctttgacgtgttaataaactatccagagccacctaatttatgaagaatattgaagatccacataatcatgttaaaccttgttatgagcagtactgtagtgggaagttgggcttgcagtcagagcgaatacacctgaatttagttccagcaataaatcttaacctctttgagcttcgggtttttttttttcagctgtaaaatagggttaaaggatggttttatattatgtatgggaaagatgtcagagcagaagggtattattaaagagatcccagtaaataatacatggaaatttaattctccaaatagttcttgaggtgaaatatttaacatttggttactatttgctttttctcttaaaatgccattttaattctcta

SEQ ID NO: 25534 - DNA, 747 bp, Homo sapiens
  misc_feature (747)..(747): n is a, c, g, or t
tacactgttcttttgtgcttgcaagatactacctaaactagccatttaattatatttaatcacaagaattattagctgctggattttacagctattttaatgctcttaattctgatctcttttttttttcattctacccttttttctttatttgggaactcacaaaaaaaacaggtctaaaagaatgacttaagaatataaggttggtttttaaaattctcttttaaggttattaaaaatttcgtctaaggctactgagaactattgagttccttggagataggtgccaaatctaaatccagttaatatattcattgatttcttaatgactgtagcaagtaggatgtcagtcaaaactgaaaggtattagaaaattatttgaaaggttatggttaattttaatttgagaggggtaaggggggaaaggagctgtcatatcaaaaaaaaaaaaaaaagcaaaaaaaaaaattgtggggggctggcccaaaaattttaaaaccaattccggtgtgggcgcgcgggggccccaagtatcggtacctgtgaacggtcgccatgagggggtgcccaaagaaaaccggggccaaggacacacgcgctgggggttcctccaccaaataaaaaacggccgggggggaacccggcgcggtctgtgcacaaaactacagaagggagctcgagggcacacggggactcttatcaagagggagccaaaggacacgagaataaattaccccgggcagtgan

SEQ ID NO: 25535 - DNA, 497 bp, Homo sapiens
tgctataataaaataccctacaggttctgtaaggcatttctaaactgtaaatgcttgaaacgcaagttggacattttctatactatgtgtaaaatgccaggttatacctctattttctttcttcctaatggtcattgaaatgagcttgtttctctacattgagcaagctacattttattttaaatgagtcaggtgcatgttcagatgtctgtattcccaatacattgcatgcagcctgagcacaagtatgccttcaccctctggctcttttcctgacaccaaacagagaagtccacagctacaagcacaaggggcttgacaggtaggccttgttttattatgaacaaattcaccagaaaaccattcttgaggaaccagccactcccatagcatttttagtcttagggaagaaaattggcagggaagaaaaattggcagacaatgggaaagaggtttggtcaacctgcataagtggaataaagtcattgaagtacttg

SEQ ID NO: 25536 - DNA, 477 bp, Homo sapiens
tgaagacagggtcttgctctgttgcctggtctggagtgcagtgacacaatcagggtttgctgcagcctcagcctcccaggctcaagcatccttctgcctcaggctcccaagtagctgggactacaggcacatgacaccatgcccagctaatatttttactttttgtagagatggggtcttactatgttgtccaagctagcttcaaactcccaggctcaagcaatcctcctcccttggcctcccaaagcactgggattatagatatgtgccaccatgccaggcctaagaatgtattcttaaaataggtatggtctcatttgtacaactaaaacttattaaaacatatgcagtagtataattttatcataggaagtataatgtagagtataacaacacaggtttcttgcactggaatcccagttcaatatttatgattgctgtgacaagttacctaaactcacaagttacctaaactct

SEQ ID NO: 25537 - DNA, 484 bp, Homo sapiens
gtgacagagcaagactccatctcaaaaaaaaaaaaaaaaaaaaaaaaactgtgatcttgtaggtctaaggttgagtctgaggagctgtatttattataataagccccacctgttgaggatggatgctgctggtctgaagaccatactttgagtagcaaggggccagtatagacaataacagccatcggagttcaaaggagagaaatgaatatggtctggccttgagacctctctcaaacctaaccatgtcttctagtaatacgaatcctgtcttaatctgcttaggatacaccttaaacaaattaagtcatgatttcatacacaggtatatatcggatggagggtttggtttcagaccactgcaataaagcgagtcacacaaatattttggtttcctagtgcatataaagtcatgtttatattgtagtctactaagtgtgcaatagcattatgcctaacaacatgtagaaaacttctttattgt

SEQ ID NO: 25538 - DNA, 282 bp, Homo sapiens
gaacagctcgtctgcaggaggtggcaggaaggccagcctggcttggactgagatccggagagagcactcaagatgaccaaaggaacttaagaattaggagaatgtgagttctttgagggcagcagggattgttcgctgctgcgtcaccagctttccatctgtctgtgaagtgaagctcttctagaagttttctagagattgattccaggcagtctgtgatttctaaatctagcctctctctaccaccacatcggggcctttgccctcaacagccctttttgg

SEQ ID NO: 25539 - DNA, 211 bp, Homo sapiens
gttcttcatttctcatttactactttttgtgtttaattgcttttttgtgtagacatgctttgactcccttcttttatttacttcttttgtttgtttgtttatgatggagtctcactctgtcgccaaggctacagttcagtggtacgatcttggctcaccgcagccagctccgcctctcgggttcaaatgtttcttgtgccccagtggctca

SEQ ID NO: 25540 - DNA, 755 bp, Homo sapiens
agacctaaccccacactcattttatattgtgtttggttgtgagttacatgattgctgcaggcaccatatttatttctgtgctccaggtctctaaaggtcctaatccagtcctgaccaaacagactagtgatggaccatcgtgagcttctctcaggagaaatatcaagagggaggccaacctgtaatcataagaacttctgctattttaatgccattcatcagactacagtcaatcaccatgcttctggctttttgtctatctctgctgtcttgtacatcctgagatagtccattctgagaactgtaccctagatcttgtattgcctgatgcctgtcaaagatgtaatccatgctgcttaagtgaggttgtgcacacaaatcaccatatctcctgcaagtttggattttgattcagtagttcgatggtggggtttgagattctgcatttctaataagctcccagatgtggctggtgctgctggtccatgaaacacactttgagtagcaagaggtgatctgtagctcagtattggtcctttaagttccctcaaacatatatagagaaaaggtcctaaatattgcaaattctctcaaagtttgtcaagctatattggaattctctcaaagtctgtcaagctctattgtagaaaatcaaatttttattgggaaaaagcctaccccatatttacttacagataaagtacttttaggatcattcaaggcacacacccataacactgagtatgtaagacaga

SEQ ID NO: 25541 - DNA, 468 bp, Homo sapiens
cataaaagaatatgttaactatattaactcatcaaaaataattggtattgtaagaattaaagaaagaggaaacatgaaagtttctttcgaaagggggtgaagattggcagttaacaaagagactttccccccacctccctctgtgccttagctgtcttatctgtgttttactgtctgctctttctggctgcttgtagttagaagagaagtgatttccttgaaatgcatgaggctagaatgggagctggaactgaaagtggcagtgtttgtctgagatgatggtgctcctgctctgtcattctaggccctatagttataaaaggatgaggggcgatgtgttctttctggttacttcctgctgatgggggtgtggagagtttcttggtctcagattgcctgcaggagcaacactgtgtgtagatgttttgaggcagttgtctgcgaaatggccatgattctgtcagttaa

SEQ ID NO: 25542 - DNA, 766 bp, Homo sapiens
  misc_feature (52)..(52): n is a, c, g, or t
ggaggggagggaggggaggggagaggtgggaatggaggatggaaggccgtanggaagtgacgcgccccattgtgttggcacccgcgaattcggccattatggccgggcaggcatactttggagatagttttggttttagaccaccaccataaagcaaatattgccataaagcaagtcacacaaattttgtggttactgagtgcatataaaagctttgttggctgggcgtggtggctcacgctatatcccagcactttgggaggccaaggcaggcagatcaccagaggttgggagttcgagatcagcctggctaacatggtgaaaccccatctctactaaatatacaaaattagctgggtgtggtggctcccacctgtaatcccagctactcgggtggctgaggcaggagaatcgcttgaagccaggaggtggaggttgcagtgagctgggattgcatcactgcactccagtctgggcgacagagtgagatttggtctccaaaaaaaaaaaaggtaggggtaaagcatgggggcgtgatttgaggctcacttgggaaattggccctagagggagagtcggatgacaaattaagtggcgcgtaggttggcaacgtggtggactgagagaaccctaggtgttaccgatgttaataggggaggagaggagaggcccgcttttggccagaggggctatataaagcaaagaggcccctgacagaataggccgttgcgaaagagtgggggaggccgagatgggtggaatggaa

SEQ ID NO: 25543 - DNA, 820 bp, Homo sapiens
gaagggcgaagcgatgtcagaaataatagaaaaggctttttcctttgaaatatctaaacgttcaaagatgggaacagccgcaggggggagaatactgtgctatgcaagttgatctgattttgtggaccatccatttccaattgggaagctcacttactttcaacttgaagcatcagaaaaccagacttacagcagcttcagcctataggggtttatttttctcatgtaacaagaagaacagaagtggacagaggccgagttctcaaggactcagtttctttctgtcccaccaaccttaccatgttggattgtcatctttgtgcttgttgcctcatgatggcaagatggctgcagcacctctgggactcacgactgatttttaagactacagagcctaagtcaaagcttgttcttggacccaggaaatatgtcaaatccttccagtgaatggtgcctttcaggattggagactactcccccagttgctgatggtgtggtcagccctcagttttcagtcctctttgggaattgccttggatgaagaaagtcacctcacccaagatcactccaactcctgggacccacatccaatgattggccaatatggggactcaaaggcctggtcccccttccccaacttgagactactctgaaggatcacccagcttcagagcttcccatggttgagacttttagacttcactgtggtccaaccaatctcttcctatacacggtcctgactccttcacttccctcccagcacttcttctgtgttaatatcaaacttctgtgctaataacaaacttcttccgtgctaata

SEQ ID NO: 25544 - DNA, 477 bp, Homo sapiens
atctaaatcagctcatactttattttctctcacatttacagactacagagcctaagtcaaagcttgttcttggacccaggaaatatgtcaaatccttccagtgaatggtgcctttcaggattggagactactcccccagttgctgatggtgtggtcagccctcagttttcagtcctctttgggaattgccttggatgaagaaagtcacctcacccaagatcactccaactcctgggacccacatccaatgattggccaatatggggactcaaaggcctggtcccccttccccaacttgagactactctgaaggatcacccagcttcagagcttcccatggttgagacttttagacttcactgtggtccaaccaatctcttcctatacacggtcctgactccttcacttccctcccagcacttcttctgtgttaatatcaaacttctgtgctaataacaaacttcttccgtgctaata

SEQ ID NO: 25545 - DNA, 769 bp, Homo sapiens
gaagggcgaagcgatgtcagaaataatagaaaaggctttttcctttgaaatatctaaacgttcaaagatgggaacagccgcaggggggagaatactgtgctatgcaagttgatctgattttgtggaccatccatttccaattgggaagctcacttactttcaacttgaagcatcagaaaaccagacttacagcagcttcagcctataggggtttatttttctcatgtaacaagaagaacagaagtggacagaggccgagttctcaaggactcagtttctttctgtcccaccaaccttaccatgttggattgtcatctttgtgcttgttgcctcatgatggcaagatggctgcagcacctctgggactcacgactgatttttaagactacagagcctaagtcaaagcttgttcttggacccaggaaatatgtcaaatccttccagtgaatggtatgtcttcctaaatgacgcacttgtgagaacagctggacctaactgtctaaaggacagctagcttccagcccgattttcagagctgatatatcaaaatctaattccttttacagaatagccaaataaatattttcactgtcaattccaaaaaaaaaaaaaaaaaaaaaaatttttggggcgcctgggccgagaagtttttaaaccctttgttggggcggccctgtaggcactggccgttccagaaaccggccggccggtggtttcccataaagcgggggcgggtttgacatccagggtcgggctgggtcacggcccg

SEQ ID NO: 25546 - DNA, 754 bp, Homo sapiens
gaagggcgaagcgatgtcagaaataatagaaaaggctttttcctttgaaatatctaaacgttcaaagatgggaacagccgcaggggggagaatactgtgctatgcaagttgatctgattttgtggaccatccatttccaattgggaagctcacttactttcaacttgaagcatcagaaaaccagacttacagcagcttcagcctataggggtttatttttctcatgtaacaagaagaacagaagtggacagaggccgagttctcaaggactcagtttctttctgtcccaccaaccttaccatgttggattgtcatctttgtgcttgttgcctcatgatggcaagatggctgcagcacctctgggactcacgactgatttttaaggtgcctttcaggattggagactactcccccagttgctgatggtgtggtcagccctcagttttcagtcctctttgggaattgccttggatgaagaaagtcacctcacccaagatcactccaactcctgggacccacatccaatgattggccaatatggggactcaaaggcctggtcccccttccccaacttgagactactctgaaggatcacccagcttcagagcttcccatggttgagacttttagacttcactgtggtccaaccaatctcttcctatacacggtcctgactccttcacttccctcccagcacttcttctgtgttaatatcaaacttctgtgctaataacaaacttcttccgtgctaata

SEQ ID NO: 25547 - DNA, 533 bp, Homo sapiens
gaagggcgaagcgatgtcagaaataatagaaaaggctttttcctttgaaatatctaaacgttcaaagatgggaacagccgcaggggggagaatactgtgctatgcaagttgatctgattttgtggaccatccatttccaattgggaagctcacttactttcaacttgaagcatcagaaaaccagacttacagcagcttcagcctataggggtttatttttctcatgtaacaagaagaacagaagtggacagaggccgagttctcaaggactcagtttctttctgtcccaccaaccttaccatgttggattgtcatctttgtgcttgttgcctcatgatggcaagatggctgcagcacctctgggactcacgactgatttttaaggtaggaagaaggggacaggactgtactagccagatggcttcctttcatctggaaagcaaaaggtttccctgaatcctcagcagatttctgctgtcttcccattggccagaactgtgtcacatggtcacttttaataggtttaaaaatga

SEQ ID NO: 25548 - DNA, 354 bp, Homo sapiens
catgccaatgtgcaataaatactaattttgtttactaatgttttctctgttttccaagtctcattttagccattggttttaatattttgcatgagcaaatctttaattagaaatttcagttgcatcatttgattctttttattgtttcgcttttgtaatggtagtaatgggatggacaagtgataatttccagacaaaaggaagatgattgagagtttttaaaatttcacttgaggggctgggcatcctggctcacgcgtataatctcagcactttgggaggctgaggcagaaggattgcttgaggccaggagtttggaccaacctgggtagcatggcaagatcctatatttac

SEQ ID NO: 25549 - DNA, 446 bp, Homo sapiens
aatgtctacaatattttactaaaattaaatttaacattaatagcacattaatataaaggtaaaatttaacttatttagtataaaattatacaaaaaatagtcaaatataaaatggtgtttatttttttttaagtcccgagggtggccaggtaagtcacaatgcccctcatccccaaggccatagcacgcgggggtggtgaaggccacaagaaggccaagacttcaagaggggccagggccacagcatcccttgggcggcgctgagcaggaatggagcgggaggcgtcaccatggggcttcaagccccaggatatgcaacaaaaattatatgcttattttccactttcttttccctcagaactaaaagtcttttagcacaggtaccacccctagaatttccagtacaccagcaccagcctgaaaaccatgttcttattaaaagatga

SEQ ID NO: 25550 - DNA, 469 bp, Homo sapiens
attaagaatgtaacttggctccaagttctggatattccccacattatgtgagaactagagtagtcaagagggcaaatcatgccttgcaatcataattctcaattagagtcttgattctacaacttgctaacttagggagactaacttggggaaatttctctgagtcatattggaaaaatgagtgttaaaagcactcttgaccctatctacatcacaagatttttgtgaagattcacggaggtgatgtagacaaagcccttataaaacactggttgcatatttggaagctaataggcctccaagtgactgaagttgatgtgatgttagtacttgaggaatggtaggcagttggcaatcttgaggtcacatgcctgtcagcttcagcagatcattgccatgtgcaaagtggtcagacgtagagtgccagaaccttggtttttaaagaaaacctgggtatctaaaattttat

SEQ ID NO: 25551 - DNA, 3355 bp, Homo sapiens
ccccaggcaggctgaggagcctaggggcggggtgggaaggaggaccggccgaaccttgggtgtgggacagagtgcgtgcgtgtggtgtgtccccaagggcaggaaggtggcgaagggaggcgaatccgagtgggtggagggaggggaagggcgggaggagaaaaaggtgggaggaggaccaggtgggagggtggcggctcactcaggacccagcgggggcagcgcgatgaggcgggtgaccctgttcctgaacggcagccccaagaacggaaaggtggttgctgtatatggaactttatctgatttgctttctgtggccagcagtaaactcggcataaaagccaccagtgtgtataatgggaaaggtggactgattgatgatattgctttgatcagggatgatgatgttttgtttgtttgtgaaggagagccatttattgatcctcagacagattctaagcctcctgagggattgttaggattccacacagactggctgacattaaatgttggagggcggtactttacaactacacgcgttactcctaccaggttgtagcatgcatctttttgagagagcagctgggatcgagtatactcttgacttaaatatgtttgtttataaagacaaatggagaaatcaatttttttccctgaattcttaggagcactttagtgaataaagaacctgacagtatgctggcccacatgtttaaggacaaaggtgtctggggaaataagcaagatcatagaggagctttcttaattgaccgaagtcctgagtacttcgaacccattttgaactacttgcgtcatggacagctcattgtaaatgatggcattaatttattgggtgtgttagaagaagcaagattttttggtattgactcattgattgaacacctagaagtggcaataaagaattctcaaccaccggaggatcattcaccaatatcccgaaaggaatttgtccgatttttgctagcaactccaaccaagtcagaactgcgatgccagggtttgaacttcagtggtgctgatctttctcgtttggaccttcgatacattaacttcaaaatggccaatttaagccgctgtaatcttgcacatgcaaatctttgctgtgcaaatcttgaacgagctgatctctctggatcagtgcttgactgtgcgaatctccagggagtcaagatgctctgttctaatgcagaaggagcatccctgaaactgtgtaattttgaggatccttctggtcttaaagccaatttagaaggtgctaatctgaaaggtgtggatatggaaggaagtcagatgacaggaattaacctgagagtggctaccttaaaaaatgcaaagttgaagaactgtaacctcagaggagcaactctggcaggaactgatttagagaattgtgatctgtctgggtgtgatcttcaagaagccaacctgagagggtccaacgtgaagggagctatatttgaagagatgctgacaccactacacatgtcacaaagtgtcagatgagaattttaggggctggaggaagatgtaaaagatgaaaatgttttccttatcacttttctttctccacccactcagttgtctagaagaaataacactgtaaggaaatttaaaaaaaaaacatttagaggattatgcttgttttgagtggtgcataagggaaaaaactgactttttttccatattctgatttttaacagaaaagcactcatttaatagatgtagggaaactagatattgctgccttttgaatggggtaggggggtttacctggttttatgaccaggcatagtatctattatatttgcttttaaataggcatgatgtggaaataccatcttggtttgagatgcatttgaggattttaatttatggaaagcacaacatatgcaattatatttattgaattcctagatgcagtatggatatttaaattgttaaaactttatgaaaacttggaaaaggttgttcaggtttataaatagctttagtgatgcctcccctctttaaatacctgtcacaccgtatgaatatggtgagatcagactccctaagactcttttcaggttcatttttataatgtttactttttaggacagaacagtagctaaattaaagtaatatccagttcttactgattgagacagagtggaaagaaagacatcattgtacatcactgtcattccaaaggtacagtgtaactctggatggaggaataacttacctatcactacaacacttacaaatgagaatttctcagaatttcattctaggcaagttccactcaacaccagatcaagcaattctatctatttacactattagcctagttttctcatacagtcatcacaagcataggaagatacttcaaaaccaaaaaaaccaaggtgcatcattaatattcatttaattcaaataccaaatagtttacatagggccagcttagaaatagatactaaatccagagctactgcaatcaaagcttatatgagtgaatatggtagagttgcctgctaaaaggcaatgtaatataattgcagctagaaccctacagtggggaatgaggaattttaaacacacatttgattacagccaccaaaaaaatagacgtaaaaataaaggcatttggctggtccaagatgtaattatcaatcagtcagcacctgtgattcttttacttatttttttgtggttttttttttttaaacaaattttagcccaattttcttgagtcattctctctctgcagcagcagaggaagggcctgtacctccctaccaatgacttggtgtccttattttctaccccaagagcagggatattagctgtgtccaaatgggttctgaattctacagactcatcaacatgaggcaaggaatcattgaaaaccacctgtgtctcctttgggagaatgacatatctttagtatttacgtagcttattcttctatatctacatatgcaaagctttccttaacagtaaagggtacatatgcatagtgggaggagatcagacctttacaagtgaaggaaagcaacttcagaaatgaattattttctttgctttattatttttaccaagacagagaagtattgtattgagagataatctattttcataatcaatatgtgcctaaattatatttaaatcatttcactctgtactatattttcaggaattacagaatgtggtattcattcacttaaaggtacctctgtagaaataacctaaaactgcagaaggatctgaaagatctaaacatggtgtgcttagaaactgcagattttagatctaatgtatactgcattaataaatgatataaagtgtttgttga

SEQ ID NO: 25552 - DNA, 3313 bp, Homo sapiens
gaactcctgacctcaggtgatccacccaccttggcctcccaaaaagtgccggcattacaggcttgagccaccatgcccagactgctttagaattgcatttatactgtgtatttttttaccctaatgacagtgtaagagacttaaatgaatatgactgtcacacaaaaaaggtgtgtcctacttcaacactcaacattcaagaaatatttgtcaaagacctgctgtaagccaggtggttgctgtatatggaactttatctgatttgctttctgtggccagcagtaaactcggcataaaagccaccagtgtgtataatgggaaaggtggactgattgatgatattgctttgatcagggatgatgatgttttgtttgtttgtgaaggagagccatttattgatcctcagacagattctaagcctcctgagggattgttaggattccacacagactggctgacattaaatgttggagggcggtactttacaactacacgcgttactcctaccaggttgtagcatgcatctttttgagagagcagctgggatcgagtatactcttgacttaaatatgtttgtttataaagacaaatggagaaatcaatttttttccctgaattcttaggagcactttagtgaataaagaacctgacagtatgctggcccacatgtttaaggacaaaggtgtctggggaaataagcaagatcatagaggagctttcttaattgaccgaagtcctgagtacttcgaacccattttgaactacttgcgtcatggacagctcattgtaaatgatggcattaatttattgggtgtgttagaagaagcaagattttttggtattgactcattgattgaacacctagaagtggcaataaagaattctcaaccaccggaggatcattcaccaatatcccgaaaggaatttgtccgatttttgctagcaactccaaccaagtcagaactgcgatgccagggtttgaacttcagtggtgctgatctttctcgtttggaccttcgatacattaacttcaaaatggccaatttaagccgctgtaatcttgcacatgcaaatctttgctgtgcaaatcttgaacgagctgatctctctggatcagtgcttgactgtgcgaatctccagggagtcaagatgctctgttctaatgcagaaggagcatccctgaaactgtgtaattttgaggatccttctggtcttaaagccaatttagaaggtgctaatctgaaaggtgtggatatggaaggaagtcagatgacaggaattaacctgagagtggctaccttaaaaaatgcaaagttgaagaactgtaacctcagaggagcaactctggcaggaactgatttagagaattgtgatctgtctgggtgtgatcttcaagaagccaacctgagagggtccaacgtgaagggagctatatttgaagagatgctgacaccactacacatgtcacaaagtgtcagatgagaattttaggggctggaggaagatgtaaaagatgaaaatgttttccttatcacttttctttctccacccactcagttgtctagaagaaataacactgtaaggaaatttaaaaaaaaaacatttagaggattatgcttgttttgagtggtgcataagggaaaaaactgactttttttccatattctgatttttaacagaaaagcactcatttaatagatgtagggaaactagatattgctgccttttgaatggggtaggggggtttacctggttttatgaccaggcatagtatctattatatttgcttttaaataggcatgatgtggaaataccatcttggtttgagatgcatttgaggattttaatttatggaaagcacaacatatgcaattatatttattgaattcctagatgcagtatggatatttaaattgttaaaactttatgaaaacttggaaaaggttgttcaggtttataaatagctttagtgatgcctcccctctttaaatacctgtcacaccgtatgaatatggtgagatcagactccctaagactcttttcaggttcatttttataatgtttactttttaggacagaacagtagctaaattaaagtaatatccagttcttactgattgagacagagtggaaagaaagacatcattgtacatcactgtcattccaaaggtacagtgtaactctggatggaggaataacttacctatcactacaacacttacaaatgagaatttctcagaatttcattctaggcaagttccactcaacaccagatcaagcaattctatctatttacactattagcctagttttctcatacagtcatcacaagcataggaagatacttcaaaaccaaaaaaaccaaggtgcatcattaatattcatttaattcaaataccaaatagtttacatagggccagcttagaaatagatactaaatccagagctactgcaatcaaagcttatatgagtgaatatggtagagttgcctgctaaaaggcaatgtaatataattgcagctagaaccctacagtggggaatgaggaattttaaacacacatttgattacagccaccaaaaaaatagacgtaaaaataaaggcatttggctggtccaagatgtaattatcaatcagtcagcacctgtgattcttttacttatttttttgtggttttttttttttaaacaaattttagcccaattttcttgagtcattctctctctgcagcagcagaggaagggcctgtacctccctaccaatgacttggtgtccttattttctaccccaagagcagggatattagctgtgtccaaatgggttctgaattctacagactcatcaacatgaggcaaggaatcattgaaaaccacctgtgtctcctttgggagaatgacatatctttagtatttacgtagcttattcttctatatctacatatgcaaagctttccttaacagtaaagggtacatatgcatagtgggaggagatcagacctttacaagtgaaggaaagcaacttcagaaatgaattattttctttgctttattatttttaccaagacagagaagtattgtattgagagataatctattttcataatcaatatgtgcctaaattatatttaaatcatttcactctgtactatattttcaggaattacagaatgtggtattcattcacttaaaggtacctctgtagaaataacctaaaactgcagaaggatctgaaagatctaaacatggtgtgcttagaaactgcagattttagatctaatgtatactgcattaataaatgatataaagtgtttgttga

SEQ ID NO: 25553 - DNA, 3675 bp, Homo sapiens
ccccaggcaggctgaggagcctaggggcggggtgggaaggaggaccggccgaaccttgggtgtgggacagagtgcgtgcgtgtggtgtgtccccaagggcaggaaggtggcgaagggaggcgaatccgagtgggtggagggaggggaagggcgggaggagaaaaaggtgggaggaggaccaggtgggagggtggcggctcactcaggacccagcgggggcagcgcgatgaggcgggtgaccctgttcctgaacggcagccccaagaacggaaaggtggttgctgtatatggaactttatctgatttgctttctgtggccagcagtaaactcggcataaaagccaccagtgtgtataatgggaaaggtggactgattgatgatattgctttgatcagggatgatgatgttttgtttgtttgtgaaggagagccatttattgatcctcagacagattctaagcctcctgagggattgttaggattccacacagactggctgacattaaatgttggagggcggtactttacaactacacggagcactttagtgaataaagaacctgacagtatgctggcccacatgtttaaggacaaaggtgtctggggaaataagcaagatcatagaggagctttcttaattgaccgaagtcctgagtacttcgaacccattttgaactacttgcgtcatggacagctcattgtaaatgatggcattaatttattgggtgtgttagaagaagcaagattttttggtattgactcattgattgaacacctagaagtggcaataaagaattctcaaccaccggaggatcattcaccaatatcccgaaaggaatttgtccgatttttgctagcaactccaaccaagtcagaactgcgatgccagggtttgaacttcagtggtgctgatctttctcgtttggaccttcgatacattaacttcaaaatggccaatttaagccgctgtaatcttgcacatgcaaatctttgctgtgcaaatcttgaacgagctgatctctctggatcagtgcttgactgtgcgaatctccagggagtcaagatgctctgttctaatgcagaaggagcatccctgaaactgtgtaattttgaggatccttctggtcttaaagccaatttagaaggtgctaatctgaaaggtgtggatatggaaggaagtcagatgacaggaattaacctgagagtggctaccttaaaaaatgcaaagttgaagaactgtaacctcagaggagcaactctggcaggaactgatttagagaattgtgatctgtctgggtgtgatcttcaagaagccaacctgagagggtccaacgtgaagggagctatatttgaagagatgctgacaccactacacatgtcacaaagtgtcagatgagaattttaggggctggaggaagatgtaaaagatgaaaatgttttccttatcacttttctttctccacccactcagttgtctagaagaaataacactgtaaggaaatttaaaaaaaaaacatttagaggattatgcttgttttgagtggtgcataagggaaaaaactgactttttttccatattctgatttttaacagaaaagcactcatttaatagatgtagggaaactagatattgctgccttttgaatggggtaggggggtttacctggttttatgaccaggcatagtatctattatatttgcttttaaataggcatgatgtggaaataccatcttggtttgagatgcatttgaggattttaatttatggaaagcacaacatatgcaattatatttattgaattcctagatgcagtatggatatttaaattgttaaaactttatgaaaacttggaaaaggttgttcaggtttataaatagctttagtgatgcctcccctctttaaatacctgtcacaccgtatgaatatggtgagatcagactccctaagactcttttcaggttcatttttataatgtttactttttaggacagaacagtagctaaattaaagtaatatccagttcttactgattgagacagagtggaaagaaagacatcattgtacatcactgtcattccaaaggtacagtgtaactctggatggaggaataacttacctatcactacaacacttacaaatgagaatttctcagaatttcattctaggcaagttccactcaacaccagatcaagcaattctatctatttacactattagcctagttttctcatacagtcatcacaagcataggaagatacttcaaaaccaaaaaaaccaaggtgcatcattaatattcatttaattcaaataccaaatagtttacatagggccagcttagaaatagatactaaatccagagctactgcaatcaaagcttatatgagtgaatatggtagagttgcctgctaaaaggcaatgtaatataattgcagctagaaccctacagtggggaatgaggaattttaaacacacatttgattacagccaccaaaaaaatagacgtaaaaataaaggcatttggctggtccaagatgtaattatcaatcagtcagcacctgtgattcttttacttatttttttgtggttttttttttttaaacaaattttagcccaattttcttgagtcattctctctctgcagcagcagaggaagggcctgtacctccctaccaatgacttggtgtccttattttctaccccaagagcagggatattagctgtgtccaaatgggttctgaattctacagactcatcaacatgaggcaaggaatcattgaaaaccacctgtgtctcctttgggagaatgacatatctttagtatttacgtagcttattcttctatatctacatatgcaaagctttccttaacagtaaagggtacatatgcatagtgggaggagatcagacctttacaagtgaaggaaagcaacttcagaaatgaattattttctttgctttattatttttaccaagacagagaagtattgtattgagagataatctattttcataatcaatatgtgcctaaattatatttaaatcatttcactctgtactatattttcaggaattacagaatgtggtattcattcacttaaaggtacctctgtagaaataacctaaaactgcagaaggatctgaaagatctaaacatggtgtgcttagaaactgcagattttagatctaatgtatactgcattaataaatgatataaagtgtttgttgaaaaggagtttcttctcttccttttgaaaatcatcactttctgtattttgcttacatttcttcaatatgtgttgacaaccagccctgtggttctgggtagcaaaggaaatacagtataacttaatttgttatggattagtctttttgaaagtaccattaaagtaaatttatttctttaaacatgattatttttatcattcttttaaaaatacaccatgctaacaacacaaaccttatgaattctgaacaaaagaaaagactgcctccccaataattcgtttaatttgtttgtgttaaattcatcactctttaggtgatgaatattaccagttagctttattagactggataaatagcatgccccaaaacattttttgcctgataactaggatagagaattttaaggagggaagaaaccgttaaaatagtaaaacttccattaaccctag

SEQ ID NO: 25554 - DNA, 3134 bp, Homo sapiens
ccccaggcaggctgaggagcctaggggcggggtgggaaggaggaccggccgaaccttgggtgtgggacagagtgcgtgcgtgtggtgtgtccccaagggcaggaaggtggcgaagggaggcgaatccgagtgggtggagggaggggaagggcgggaggagaaaaaggtgggaggaggaccaggtgggagggtggcggctcactcaggacccagcgggggcagcgcgatgaggcgggtgaccctgttcctgaacggcagccccaagaacggaaaggtggttgctgtatatggaactttatctgatttgctttctgtggccagcagtaaactcggcataaaagccaccagtgtgtataatgggaaaggtggactgattgatgatattgctttgatcagggatgatgatgttttgtttgtttgtgaaggagagccatttattgatcctcagacagattctaagcctcctgagggattgttaggattccacacagactggctgacattaaatgttggagggcggtactttacaactacacggagcactttagtgaataaagaacctgacagtatgctggcccacatgtttaaggacaaaggtgtctggggaaataagcaagatcatagaggagctttcttaattgaccgaagtcctgagtacttcgaacccattttgaactacttgcgtcatggacagctcattgtaaatgatggcattaatttattgggtgtgttagaagaagcaagattttttggtattgactcattgattgaacacctagaagtggcaataaagaattctcaaccaccggaggatcattcaccaatatcccgaaaggaatttgtccgatttttgctagcaactccaaccaagtcagaactgcgatgccagggtttgaacttcagtggtgctgatctttctcgtttggaccttcgatacattaacttcaaaatggccaatttaagccgctgtaatcttgcacatgcaaatctttgctgtgcaaatcttgaacgagctgatctctctggatcagtgcttgactgtgcgaatctccagggagtcaagatgctctgttctaatgcagaaggagcatccctgaaactgtgtaattttgaggatccttctggtcttaaagccaatttagaaggtgctaatctgaaaggtgtggatatggaaggaagtcagatgacaggaattaacctgagagtggctaccttaaaaaatgcaaagttgaagaactgtaacctcagaggagcaactctggcaggaactgatttagagaattgtgatctgtctgggtgtgatcttcaagaagccaacctgagagggtccaacgtgaagggagctatatttgaagagatgctgacaccactacacatgtcacaaagtgtcagatgagaattttaggggctggaggaagatgtaaaagatgaaaatgttttccttatcacttttctttctccacccactcagttgtctagaagaaataacactgtaaggaaatttaaaaaaaaaacatttagaggattatgcttgttttgagtggtgcataagggaaaaaactgactttttttccatattctgatttttaacagaaaagcactcatttaatagatgtagggaaactagatattgctgccttttgaatggggtaggggggtttacctggttttatgaccaggcatagtatctattatatttgcttttaaataggcatgatgtggaaataccatcttggtttgagatgcatttgaggattttaatttatggaaagcacaacatatgcaattatatttattgaattcctagatgcagtatggatatttaaattgttaaaactttatgaaaacttggaaaaggttgttcaggtttataaatagctttagtgatgcctcccctctttaaatacctgtcacaccgtatgaatatggtgagatcagactccctaagactcttttcaggttcatttttataatgtttactttttaggacagaacagtagctaaattaaagtaatatccagttcttactgattgagacagagtggaaagaaagacatcattgtacatcactgtcattccaaaggtacagtgtaactctggatggaggaataacttacctatcactacaacacttacaaatgagaatttctcagaatttcattctaggcaagttccactcaacaccagatcaagcaattctatctatttacactattagcctagttttctcatacagtcatcacaagcataggaagatacttcaaaaccaaaaaaaccaaggtgcatcattaatattcatttaattcaaataccaaatagtttacatagggccagcttagaaatagatactaaatccagagctactgcaatcaaagcttatatgagtgaatatggtagagttgcctgctaaaaggcaatgtaatataattgcagctagaaccctacagtggggaatgaggaattttaaacacacatttgattacagccaccaaaaaaatagacgtaaaaataaaggcatttggctggtccaagatgtaattatcaatcagtcagcacctgtgattcttttacttatttttttgtggttttttttttttaaacaaattttagcccaattttcttgagtcattctctctctgcagcagcagaggaagggcctgtacctccctaccaatgacttggtgtccttattttctaccccaagagcagggatattagctgtgtccaaatgggttctgaattctacagactcatcaacatgaggcaaggaatcattgaaaaccacctgtgtctcctttgggagaatgacatatctttagtatttacgtagcttattcttctatatctacatatgcaaagctttccttaacagtaaagggtacatatgcatagtgggaggagatcagacctttacaagtgaaggaaagcaacttcagaaatgaattattttctttgctttattatttttaccaagacagagaagtattgtattgagaaaatcattaaaacaacagtgttagctaaagatcaagcaagtgctggagacttgacgcatgtgccacaaaggagatgctcaataaatgttggcttctcataagcccaacgatggaaagcttactaatcattaagcaaat

SEQ ID NO: 25555 - DNA, 446 bp, Homo sapiens
gatgatttaggggtaaaaaatgtaaagaaaaaaagaatagttggctgtgactttaatctatcctttcagcataattattcattctcaattgataagaaagctgaactcaacatcgtttgtgtaaggagatttttttccccacatttcaaaagtactttcatgtgcaagatcttatttttgaatttaaattcaaagacagttaagttcaaggggttaaacaaagcattggaaacttagcttctttgcagtctagattgatagcaaaacctattgtctatataattgtaaggaatagttcctataagcaacagataattaatgtgatttttagattttgatggtagctttttaaattttgatttccccagggatgatgatgttttgtttgtttgtgaaggagagccatttattggtaagtgactttaaaagccaattttatctgccaa

SEQ ID NO: 25556 - DNA, 831 bp, Homo sapiens
aaatcaatttttttccctgaattcttaggagcactttagtgaataaagaacctgacagtatgctggcccacatgtttaaggacaaaggtgagtgtaacacgttgttttcacatttcatcttacctgttttatatctgtgctgactttataactcctgaccttctgtacttactaattatgtcagtttttaagagtaaaaacttatatttagcaattttttcctcatacatttctgactttattttttgtttatgggggactttctttattataatggtgacacaggtgtctggggaaataagcaagatcatagaggagctttcttaattgaccgaagtcctgagtacttcgaacccattttgaactacttgcgtcatggacagctcattgtaaatgatggcattaatttattgggtgagtttatttagactttcaatataattatgtaactactcacatttttgtaagtttaagattttaactttgtttcactcagtaacagtatatttccataaagtaaaagtatatattttttctattttttaaactagatgttttcacatgtatatgagtgatataggtgtagaaatagatttaggcacgggcaggtggtccttcaggtagatagtctttgtacatatagctaaatatgtaagccatacgcatcaactttatattctaaattgatttacgttctatcacaagtgactttaaaggattttgttgtttccttttttaaaaattgaattaagaatgtaacttggctccaagttctggatattccccacattatgtgagaactagagtagtcaagagggcaaatcatgcctt

SEQ ID NO: 25557 - DNA, 3227 bp, Homo sapiens
ccccaggcaggctgaggagcctaggggcggggtgggaaggaggaccggccgaaccttgggtgtgggacagagtgcgtgcgtgtggtgtgtccccaagggcaggaaggtggcgaagggaggcgaatccgagtgggtggagggaggggaagggcgggaggagaaaaaggtgggaggaggaccaggtgggagggtggcggctcactcaggacccagcgggggcagcgcgatgaggcgggtgaccctgttcctgaacggcagccccaagaacggaaaggtggttgctgtatatggaactttatctgatttgctttctgtggccagcagtaaactcggcataaaagccaccagtgtgtataatgggaaaggtggactgattgatgatattgctttgatcagggatgatgatgttttgtttgtttgtgaaggagagccatttattgatcctcagacagattctaagcctcctgagggattgttaggattccacacagactggctgacattaaatgttggagggcggtactttacaactacacggagcactttagtgaataaagaacctgacagtatgctggcccacatgtttaaggacaaaggtgtctggggaaataagcaagatcatagaggagctttcttaattgaccgaagtcctgagtacttcgaacccattttgaactacttgcgtcatggacagctcattgtaaatgatggcattaatttattgggtgtgttagaagaagcaagattttttggtattgactcattgattgaacacctagaagtggcaataaagaattctcaaccaccggaggatcattcaccaatatcccgaaaggaatttgtccgatttttgctagcaactccaaccaagtcagaactgcgatgccagggtttgaacttcagtggtgctgatctttctcgtttggaccttcgatacattaacttcaaaatggccaatttaagccgctgtaatcttgcacatgcaaatctttgctgtgcaaatcttgaacgagctgatctctctggatcagtgcttgactgtgcgaatctccagggagtcaagatgctctgttctaatgcagaaggagcatccctgaaactgtgtaattttgaggatccttctggtcttaaagccaatttagaaggtgctaatctgaaaggtgtggatatggaaggaagtcagatgacaggaattaacctgagagtggctaccttaaaaaatgcaaagttgaagaactgtaacctcagaggagcaactctggcaggaactgatttagagaattgtgatctgtctgggtgtgatcttcaagaagccaacctgagagggtccaacgtgaagggagctatatttgaagagatgctgacaccactacacatgtcacaaagtgtcagatgagaattttaggggctggaggaagatgtaaaagatgaaaatgttttccttatcacttttctttctccacccactcagttgtctagaagaaataacactgtaaggaaatttaaaaaaaaaacatttagaggattatgcttgttttgagtggtgcataagggaaaaaactgactttttttccatattctgatttttaacagaaaagcactcatttaatagatgtagggaaactagatattgctgccttttgaatggggtaggggggtttacctggttttatgaccaggcatagtatctattatatttgcttttaaataggcatgatgtggaaataccatcttggtttgagatgcatttgaggattttaatttatggaaagcacaacatatgcaattatatttattgaattcctagatgcagtatggatatttaaattgttaaaactttatgaaaacttggaaaaggttgttcaggtttataaatagctttagtgatgcctcccctctttaaatacctgtcacaccgtatgaatatggtgagatcagactccctaagactcttttcaggttcatttttataatgtttactttttaggacagaacagtagctaaattaaagtaatatccagttcttactgattgagacagagtggaaagaaagacatcattgtacatcactgtcattccaaaggtacagtgtaactctggatggaggaataacttacctatcactacaacacttacaaatgagaatttctcagaatttcattctaggcaagttccactcaacaccagatcaagcaattctatctatttacactattagcctagttttctcatacagtcatcacaagcataggaagatacttcaaaaccaaaaaaaccaaggtgcatcattaatattcatttaattcaaataccaaatagtttacatagggccagcttagaaatagatactaaatccagagctactgcaatcaaagcttatatgagtgaatatggtagagttgcctgctaaaaggcaatgtaatataattgcagctagaaccctacagtggggaatgaggaattttaaacacacatttgattacagccaccaaaaaaatagacgtaaaaataaaggcatttggctggtccaagatgtaattatcaatcagtcagcacctgtgattcttttacttatttttttgtggttttttttttttaaacaaattttagcccaattttcttgagtcattctctctctgcagcagcagaggaagggcctgtacctccctaccaatgacttggtgtccttattttctaccccaagagcagggatattagctgtgtccaaatgggttctgaattctacagactcatcaacatgaggcaaggaatcattgaaaaccacctgtgtctcctttgggagaatgacatatctttagtatttacgtagcttattcttctatatctacatatgcaaagctttccttaacagtaaagggtacatatgcatagtgggaggagatcagacctttacaagtgaaggaaagcaacttcagaaatgaattattttctttgctttattatttttaccaagacagagaagtattgtattgagagataatctattttcataatcaatatgtgcctaaattatatttaaatcatttcactctgtactatattttcaggaattacagaatgtggtattcattcacttaaaggtacctctgtagaaataacctaaaactgcagaaggatctgaaagatctaaacatggtgtgcttagaaactgcagattttagatctaatgtatactgcattaataaatgatataaagtgtttgttga

SEQ ID NO: 25558 - DNA, 3497 bp, Homo sapiens
ggaagaggatgtgcactgattgtccagaactgtgggttatgtgcagccatttacatttgggtgtatggtggatgtgtagtgggtaaacactgacagtagagttacttccagctatatttttcctagatttaatatgacagtttatttcatctccaaagcacacaacagctgatgatttaggggtaaaaaatgtaaagaaaaaaagaatagttggctgtgactttaatctatcctttcagcataattattcattctcaattgataagaaagctgaactcaacatcgtttgtgtaaggagatttttttccccacatttcaaaagtactttcatgtgcaagatcttatttttgaatttaaattcaaagacagttaagttcaaggggttaaacaaagcattggaaacttagcttctttgcagtctagattgatagcaaaacctattgtctatataattgtaaggaatagttcctataagcaacagataattaatgtgatttttagattttgatggtagctttttaaattttgatttccccagggatgatgatgttttgtttgtttgtgaaggagagccatttattgatcctcagacagattctaagcctcctgagggattgttaggattccacacagactggctgacattaaatgttggagggcggtactttacaactacacgcgttactcctaccaggttgtagcatgcatctttttgagagagcagctgggatcgagtatactcttgacttaaatatgtttgtttataaagacaaatggagaaatcaatttttttccctgaattcttaggagcactttagtgaataaagaacctgacagtatgctggcccacatgtttaaggacaaaggtgtctggggaaataagcaagatcatagaggagctttcttaattgaccgaagtcctgagtacttcgaacccattttgaactacttgcgtcatggacagctcattgtaaatgatggcattaatttattgggtgtgttagaagaagcaagattttttggtattgactcattgattgaacacctagaagtggcaataaagaattctcaaccaccggaggatcattcaccaatatcccgaaaggaatttgtccgatttttgctagcaactccaaccaagtcagaactgcgatgccagggtttgaacttcagtggtgctgatctttctcgtttggaccttcgatacattaacttcaaaatggccaatttaagccgctgtaatcttgcacatgcaaatctttgctgtgcaaatcttgaacgagctgatctctctggatcagtgcttgactgtgcgaatctccagggagtcaagatgctctgttctaatgcagaaggagcatccctgaaactgtgtaattttgaggatccttctggtcttaaagccaatttagaaggtgctaatctgaaaggtgtggatatggaaggaagtcagatgacaggaattaacctgagagtggctaccttaaaaaatgcaaagttgaagaactgtaacctcagaggagcaactctggcaggaactgatttagagaattgtgatctgtctgggtgtgatcttcaagaagccaacctgagagggtccaacgtgaagggagctatatttgaagagatgctgacaccactacacatgtcacaaagtgtcagatgagaattttaggggctggaggaagatgtaaaagatgaaaatgttttccttatcacttttctttctccacccactcagttgtctagaagaaataacactgtaaggaaatttaaaaaaaaaacatttagaggattatgcttgttttgagtggtgcataagggaaaaaactgactttttttccatattctgatttttaacagaaaagcactcatttaatagatgtagggaaactagatattgctgccttttgaatggggtaggggggtttacctggttttatgaccaggcatagtatctattatatttgcttttaaataggcatgatgtggaaataccatcttggtttgagatgcatttgaggattttaatttatggaaagcacaacatatgcaattatatttattgaattcctagatgcagtatggatatttaaattgttaaaactttatgaaaacttggaaaaggttgttcaggtttataaatagctttagtgatgcctcccctctttaaatacctgtcacaccgtatgaatatggtgagatcagactccctaagactcttttcaggttcatttttataatgtttactttttaggacagaacagtagctaaattaaagtaatatccagttcttactgattgagacagagtggaaagaaagacatcattgtacatcactgtcattccaaaggtacagtgtaactctggatggaggaataacttacctatcactacaacacttacaaatgagaatttctcagaatttcattctaggcaagttccactcaacaccagatcaagcaattctatctatttacactattagcctagttttctcatacagtcatcacaagcataggaagatacttcaaaaccaaaaaaaccaaggtgcatcattaatattcatttaattcaaataccaaatagtttacatagggccagcttagaaatagatactaaatccagagctactgcaatcaaagcttatatgagtgaatatggtagagttgcctgctaaaaggcaatgtaatataattgcagctagaaccctacagtggggaatgaggaattttaaacacacatttgattacagccaccaaaaaaatagacgtaaaaataaaggcatttggctggtccaagatgtaattatcaatcagtcagcacctgtgattcttttacttatttttttgtggttttttttttttaaacaaattttagcccaattttcttgagtcattctctctctgcagcagcagaggaagggcctgtacctccctaccaatgacttggtgtccttattttctaccccaagagcagggatattagctgtgtccaaatgggttctgaattctacagactcatcaacatgaggcaaggaatcattgaaaaccacctgtgtctcctttgggagaatgacatatctttagtatttacgtagcttattcttctatatctacatatgcaaagctttccttaacagtaaagggtacatatgcatagtgggaggagatcagacctttacaagtgaaggaaagcaacttcagaaatgaattattttctttgctttattatttttaccaagacagagaagtattgtattgagagataatctattttcataatcaatatgtgcctaaattatatttaaatcatttcactctgtactatattttcaggaattacagaatgtggtattcattcacttaaaggtacctctgtagaaataacctaaaactgcagaaggatctgaaagatctaaacatggtgtgcttagaaactgcagattttagatctaatgtatactgcattaataaatgatataaagtgtttgttga

SEQ ID NO: 25559 - DNA, 3457 bp, Homo sapiens
ccccaggcaggctgaggagcctaggggcggggtgggaaggaggaccggccgaaccttgggtgtgggacagagtgcgtgcgtgtggtgtgtccccaagggcaggaaggtggcgaagggaggcgaatccgagtgggtggagggaggggaagggcgggaggagaaaaaggtgggaggaggaccaggtgggagggtggcggctcactcaggacccagcgggggcagcgcgatgaggcgggtgaccctgttcctgaacggcagccccaagaacggaaagtgtaagagacttaaatgaatatgactgtcacacaaaaaaggtgtgtcctacttcaacactcaacattcaagaaatatttgtcaaagacctgctgtaagccaggtggttgctgtatatggaactttatctgatttgctttctgtggccagcagtaaactcggcataaaagccaccagtgtgtataatgggaaaggtggactgattgatgatattgctttgatcagggatgatgatgttttgtttgtttgtgaaggagagccatttattgatcctcagacagattctaagcctcctgagggattgttaggattccacacagactggctgacattaaatgttggagggcggtactttacaactacacgcgttactcctaccaggttgtagcatgcatctttttgagagagcagctgggatcgagtatactcttgacttaaatatgtttgtttataaagacaaatggagaaatcaatttttttccctgaattcttaggagcactttagtgaataaagaacctgacagtatgctggcccacatgtttaaggacaaaggtgtctggggaaataagcaagatcatagaggagctttcttaattgaccgaagtcctgagtacttcgaacccattttgaactacttgcgtcatggacagctcattgtaaatgatggcattaatttattgggtgtgttagaagaagcaagattttttggtattgactcattgattgaacacctagaagtggcaataaagaattctcaaccaccggaggatcattcaccaatatcccgaaaggaatttgtccgatttttgctagcaactccaaccaagtcagaactgcgatgccagggtttgaacttcagtggtgctgatctttctcgtttggaccttcgatacattaacttcaaaatggccaatttaagccgctgtaatcttgcacatgcaaatctttgctgtgcaaatcttgaacgagctgatctctctggatcagtgcttgactgtgcgaatctccagggagtcaagatgctctgttctaatgcagaaggagcatccctgaaactgtgtaattttgaggatccttctggtcttaaagccaatttagaaggtgctaatctgaaaggtgtggatatggaaggaagtcagatgacaggaattaacctgagagtggctaccttaaaaaatgcaaagttgaagaactgtaacctcagaggagcaactctggcaggaactgatttagagaattgtgatctgtctgggtgtgatcttcaagaagccaacctgagagggtccaacgtgaagggagctatatttgaagagatgctgacaccactacacatgtcacaaagtgtcagatgagaattttaggggctggaggaagatgtaaaagatgaaaatgttttccttatcacttttctttctccacccactcagttgtctagaagaaataacactgtaaggaaatttaaaaaaaaaacatttagaggattatgcttgttttgagtggtgcataagggaaaaaactgactttttttccatattctgatttttaacagaaaagcactcatttaatagatgtagggaaactagatattgctgccttttgaatggggtaggggggtttacctggttttatgaccaggcatagtatctattatatttgcttttaaataggcatgatgtggaaataccatcttggtttgagatgcatttgaggattttaatttatggaaagcacaacatatgcaattatatttattgaattcctagatgcagtatggatatttaaattgttaaaactttatgaaaacttggaaaaggttgttcaggtttataaatagctttagtgatgcctcccctctttaaatacctgtcacaccgtatgaatatggtgagatcagactccctaagactcttttcaggttcatttttataatgtttactttttaggacagaacagtagctaaattaaagtaatatccagttcttactgattgagacagagtggaaagaaagacatcattgtacatcactgtcattccaaaggtacagtgtaactctggatggaggaataacttacctatcactacaacacttacaaatgagaatttctcagaatttcattctaggcaagttccactcaacaccagatcaagcaattctatctatttacactattagcctagttttctcatacagtcatcacaagcataggaagatacttcaaaaccaaaaaaaccaaggtgcatcattaatattcatttaattcaaataccaaatagtttacatagggccagcttagaaatagatactaaatccagagctactgcaatcaaagcttatatgagtgaatatggtagagttgcctgctaaaaggcaatgtaatataattgcagctagaaccctacagtggggaatgaggaattttaaacacacatttgattacagccaccaaaaaaatagacgtaaaaataaaggcatttggctggtccaagatgtaattatcaatcagtcagcacctgtgattcttttacttatttttttgtggttttttttttttaaacaaattttagcccaattttcttgagtcattctctctctgcagcagcagaggaagggcctgtacctccctaccaatgacttggtgtccttattttctaccccaagagcagggatattagctgtgtccaaatgggttctgaattctacagactcatcaacatgaggcaaggaatcattgaaaaccacctgtgtctcctttgggagaatgacatatctttagtatttacgtagcttattcttctatatctacatatgcaaagctttccttaacagtaaagggtacatatgcatagtgggaggagatcagacctttacaagtgaaggaaagcaacttcagaaatgaattattttctttgctttattatttttaccaagacagagaagtattgtattgagagataatctattttcataatcaatatgtgcctaaattatatttaaatcatttcactctgtactatattttcaggaattacagaatgtggtattcattcacttaaaggtacctctgtagaaataacctaaaactgcagaaggatctgaaagatctaaacatggtgtgcttagaaactgcagattttagatctaatgtatactgcattaataaatgatataaagtgtttgttga

SEQ ID NO: 25560 - DNA, 3329 bp, Homo sapiens
ccccaggcaggctgaggagcctaggggcggggtgggaaggaggaccggccgaaccttgggtgtgggacagagtgcgtgcgtgtggtgtgtccccaagggcaggaaggtggcgaagggaggcgaatccgagtgggtggagggaggggaagggcgggaggagaaaaaggtgggaggaggaccaggtgggagggtggcggctcactcaggacccagcgggggcagcgcgatgaggcgggtgaccctgttcctgaacggcagccccaagaacggaaagtgtaagagacttaaatgaatatgactgtcacacaaaaaaggtgtgtcctacttcaacactcaacattcaagaaatatttgtcaaagacctgctgtaagccaggtggttgctgtatatggaactttatctgatttgctttctgtggccagcagtaaactcggcataaaagccaccagtgtgtataatgggaaaggtggactgattgatgatattgctttgatcagggatgatgatgttttgtttgtttgtgaaggagagccatttattgatcctcagacagattctaagcctcctgagggattgttaggattccacacagactggctgacattaaatgttggagggcggtactttacaactacacggagcactttagtgaataaagaacctgacagtatgctggcccacatgtttaaggacaaaggtgtctggggaaataagcaagatcatagaggagctttcttaattgaccgaagtcctgagtacttcgaacccattttgaactacttgcgtcatggacagctcattgtaaatgatggcattaatttattgggtgtgttagaagaagcaagattttttggtattgactcattgattgaacacctagaagtggcaataaagaattctcaaccaccggaggatcattcaccaatatcccgaaaggaatttgtccgatttttgctagcaactccaaccaagtcagaactgcgatgccagggtttgaacttcagtggtgctgatctttctcgtttggaccttcgatacattaacttcaaaatggccaatttaagccgctgtaatcttgcacatgcaaatctttgctgtgcaaatcttgaacgagctgatctctctggatcagtgcttgactgtgcgaatctccagggagtcaagatgctctgttctaatgcagaaggagcatccctgaaactgtgtaattttgaggatccttctggtcttaaagccaatttagaaggtgctaatctgaaaggtgtggatatggaaggaagtcagatgacaggaattaacctgagagtggctaccttaaaaaatgcaaagttgaagaactgtaacctcagaggagcaactctggcaggaactgatttagagaattgtgatctgtctgggtgtgatcttcaagaagccaacctgagagggtccaacgtgaagggagctatatttgaagagatgctgacaccactacacatgtcacaaagtgtcagatgagaattttaggggctggaggaagatgtaaaagatgaaaatgttttccttatcacttttctttctccacccactcagttgtctagaagaaataacactgtaaggaaatttaaaaaaaaaacatttagaggattatgcttgttttgagtggtgcataagggaaaaaactgactttttttccatattctgatttttaacagaaaagcactcatttaatagatgtagggaaactagatattgctgccttttgaatggggtaggggggtttacctggttttatgaccaggcatagtatctattatatttgcttttaaataggcatgatgtggaaataccatcttggtttgagatgcatttgaggattttaatttatggaaagcacaacatatgcaattatatttattgaattcctagatgcagtatggatatttaaattgttaaaactttatgaaaacttggaaaaggttgttcaggtttataaatagctttagtgatgcctcccctctttaaatacctgtcacaccgtatgaatatggtgagatcagactccctaagactcttttcaggttcatttttataatgtttactttttaggacagaacagtagctaaattaaagtaatatccagttcttactgattgagacagagtggaaagaaagacatcattgtacatcactgtcattccaaaggtacagtgtaactctggatggaggaataacttacctatcactacaacacttacaaatgagaatttctcagaatttcattctaggcaagttccactcaacaccagatcaagcaattctatctatttacactattagcctagttttctcatacagtcatcacaagcataggaagatacttcaaaaccaaaaaaaccaaggtgcatcattaatattcatttaattcaaataccaaatagtttacatagggccagcttagaaatagatactaaatccagagctactgcaatcaaagcttatatgagtgaatatggtagagttgcctgctaaaaggcaatgtaatataattgcagctagaaccctacagtggggaatgaggaattttaaacacacatttgattacagccaccaaaaaaatagacgtaaaaataaaggcatttggctggtccaagatgtaattatcaatcagtcagcacctgtgattcttttacttatttttttgtggttttttttttttaaacaaattttagcccaattttcttgagtcattctctctctgcagcagcagaggaagggcctgtacctccctaccaatgacttggtgtccttattttctaccccaagagcagggatattagctgtgtccaaatgggttctgaattctacagactcatcaacatgaggcaaggaatcattgaaaaccacctgtgtctcctttgggagaatgacatatctttagtatttacgtagcttattcttctatatctacatatgcaaagctttccttaacagtaaagggtacatatgcatagtgggaggagatcagacctttacaagtgaaggaaagcaacttcagaaatgaattattttctttgctttattatttttaccaagacagagaagtattgtattgagagataatctattttcataatcaatatgtgcctaaattatatttaaatcatttcactctgtactatattttcaggaattacagaatgtggtattcattcacttaaaggtacctctgtagaaataacctaaaactgcagaaggatctgaaagatctaaacatggtgtgcttagaaactgcagattttagatctaatgtatactgcattaataaatgatataaagtgtttgttga

SEQ ID NO: 25561 - DNA, 3061 bp, Homo sapiens
ccccaggcaggctgaggagcctaggggcggggtgggaaggaggaccggccgaaccttgggtgtgggacagagtgcgtgcgtgtggtgtgtccccaagggcaggaaggtggcgaagggaggcgaatccgagtgggtggagggaggggaagggcgggaggagaaaaaggtgggaggaggaccaggtgggagggtggcggctcactcaggacccagcgggggcagcgcgatgaggcgggtgaccctgttcctgaacggcagccccaagaacggaaagatcctcagacagattctaagcctcctgagggattgttaggattccacacagactggctgacattaaatgttggagggcggtactttacaactacacggagcactttagtgaataaagaacctgacagtatgctggcccacatgtttaaggacaaaggtgtctggggaaataagcaagatcatagaggagctttcttaattgaccgaagtcctgagtacttcgaacccattttgaactacttgcgtcatggacagctcattgtaaatgatggcattaatttattgggtgtgttagaagaagcaagattttttggtattgactcattgattgaacacctagaagtggcaataaagaattctcaaccaccggaggatcattcaccaatatcccgaaaggaatttgtccgatttttgctagcaactccaaccaagtcagaactgcgatgccagggtttgaacttcagtggtgctgatctttctcgtttggaccttcgatacattaacttcaaaatggccaatttaagccgctgtaatcttgcacatgcaaatctttgctgtgcaaatcttgaacgagctgatctctctggatcagtgcttgactgtgcgaatctccagggagtcaagatgctctgttctaatgcagaaggagcatccctgaaactgtgtaattttgaggatccttctggtcttaaagccaatttagaaggtgctaatctgaaaggtgtggatatggaaggaagtcagatgacaggaattaacctgagagtggctaccttaaaaaatgcaaagttgaagaactgtaacctcagaggagcaactctggcaggaactgatttagagaattgtgatctgtctgggtgtgatcttcaagaagccaacctgagagggtccaacgtgaagggagctatatttgaagagatgctgacaccactacacatgtcacaaagtgtcagatgagaattttaggggctggaggaagatgtaaaagatgaaaatgttttccttatcacttttctttctccacccactcagttgtctagaagaaataacactgtaaggaaatttaaaaaaaaaacatttagaggattatgcttgttttgagtggtgcataagggaaaaaactgactttttttccatattctgatttttaacagaaaagcactcatttaatagatgtagggaaactagatattgctgccttttgaatggggtaggggggtttacctggttttatgaccaggcatagtatctattatatttgcttttaaataggcatgatgtggaaataccatcttggtttgagatgcatttgaggattttaatttatggaaagcacaacatatgcaattatatttattgaattcctagatgcagtatggatatttaaattgttaaaactttatgaaaacttggaaaaggttgttcaggtttataaatagctttagtgatgcctcccctctttaaatacctgtcacaccgtatgaatatggtgagatcagactccctaagactcttttcaggttcatttttataatgtttactttttaggacagaacagtagctaaattaaagtaatatccagttcttactgattgagacagagtggaaagaaagacatcattgtacatcactgtcattccaaaggtacagtgtaactctggatggaggaataacttacctatcactacaacacttacaaatgagaatttctcagaatttcattctaggcaagttccactcaacaccagatcaagcaattctatctatttacactattagcctagttttctcatacagtcatcacaagcataggaagatacttcaaaaccaaaaaaaccaaggtgcatcattaatattcatttaattcaaataccaaatagtttacatagggccagcttagaaatagatactaaatccagagctactgcaatcaaagcttatatgagtgaatatggtagagttgcctgctaaaaggcaatgtaatataattgcagctagaaccctacagtggggaatgaggaattttaaacacacatttgattacagccaccaaaaaaatagacgtaaaaataaaggcatttggctggtccaagatgtaattatcaatcagtcagcacctgtgattcttttacttatttttttgtggttttttttttttaaacaaattttagcccaattttcttgagtcattctctctctgcagcagcagaggaagggcctgtacctccctaccaatgacttggtgtccttattttctaccccaagagcagggatattagctgtgtccaaatgggttctgaattctacagactcatcaacatgaggcaaggaatcattgaaaaccacctgtgtctcctttgggagaatgacatatctttagtatttacgtagcttattcttctatatctacatatgcaaagctttccttaacagtaaagggtacatatgcatagtgggaggagatcagacctttacaagtgaaggaaagcaacttcagaaatgaattattttctttgctttattatttttaccaagacagagaagtattgtattgagagataatctattttcataatcaatatgtgcctaaattatatttaaatcatttcactctgtactatattttcaggaattacagaatgtggtattcattcacttaaaggtacctctgtagaaataacctaaaactgcagaaggatctgaaagatctaaacatggtgtgcttagaaactgcagattttagatctaatgtatactgcattaataaatgatataaagtgtttgttga

SEQ ID NO: 25562 - DNA, 5927 bp, Homo sapiens
ccccaggcaggctgaggagcctaggggcggggtgggaaggaggaccggccgaaccttgggtgtgggacagagtgcgtgcgtgtggtgtgtccccaagggcaggaaggtggcgaagggaggcgaatccgagtgggtggagggaggggaagggcgggaggagaaaaaggtgggaggaggaccaggtgggagggtggcggctcactcaggacccagcgggggcagcgcgatgaggcgggtgaccctgttcctgaacggcagccccaagaacggaaaggtggttgctgtatatggaactttatctgatttgctttctgtggccagcagtaaactcggcataaaagccaccagtgtgtataatgggaaaggtggactgattgatgatattgctttgatcagggatgatgatgttttgtttgtttgtgaaggagagccatttattgatcctcagacagattctaagcctcctgagggattgttaggattccacacagactggctgacattaaatgttggagggcggtactttacaactacacggagcactttagtgaataaagaacctgacagtatgctggcccacatgtttaaggacaaaggtgtctggggaaataagcaagatcatagaggagctttcttaattgaccgaagtcctgagtacttcgaacccattttgaactacttgcgtcatggacagctcattgtaaatgatggcattaatttattgggtgtgttagaagaagcaagattttttggtattgactcattgattgaacacctagaagtggcaataaagaattctcaaccaccggaggatcattcaccaatatcccgaaaggaatttgtccgatttttgctagcaactccaaccaagtcagaactgcgatgccagggtttgaacttcagtggtgctgatctttctcgtttggaccttcgatacattaacttcaaaatggccaatttaagccgctgtaatcttgcacatgcaaatctttgctgtgcaaatcttgaacgagctgatctctctggatcagtgcttgactgtgcgaatctccagggagtcaagatgctctgttctaatgcagaaggagcatccctgaaactgtgtaattttgaggatccttctggtcttaaagccaatttagaaggtgctaatctgaaaggtgtggatatggaaggaagtcagatgacaggaattaacctgagagtggctaccttaaaaaatgcaaagttgaagaactgtaacctcagaggagcaactctggcaggaactgatttagaggtgagttcaccaacactttaagaatttttattactctagacttactaagcatctcatgcaaaatttattgaaatcaaaacaaagtagttggctggtaaaactggattggaagactcatctgacattcagtctaagttgatttcatttctctccttttccttgagtttttctcaagtaaataagtttgatagatgtgttatctaatgtattgcattttccataaaatttaattccgaatagaattaaatgggctagattacttcttaaactacttgagaaatttaaatgatatccaggtttgaaatcaggttcaggaaaagtctatttgaaattggaaccatatgttttttggttttcagcttgagattataattttgcctggtcatctttttcaaagaattatatttgtatgtcttcttaatttgccagtttagctagcagacttgatagctgttgataggtctatatcagcactatccaatagcactttgtgcaggagggacatgttctatatctgtgctgttcagtatagtagctaccacccatatatagctattgagcgcttgagatttggctagtgcaaatgagaaattgatttttaaattttatttaattttaattcatttaaatttaagtagccacatgtgctggtagctatgaaatctggtataaattggatagcagagaacggtatgtcaaaatttagcttgctgttaatgttttttcataatatttttgcctagatatcttgatagctctcggtagcagagtagcaggcccctttcaacttcaaggcaaaaagaattggcctaagtataatcctatcacgagcacaattatttattgtttgttacattactttcacctaagattatatttttttccttggttttagtactgtgtactcagtgtggcctagcagcaaaagcctccctctctctgattgcaaagactgatcaggttgactattgaggggagagctgctgacatttgttctcctaacaggttacgtttagtcacccttctctctaaccattgtcccctatcatatccagggacttaagtggaatctctatcttattgctccgtgatctcaagacaaattaagaaatagcttcaaattgcggtggttacactgttgtgtacatctgtcaaactcactgtattatatacgtacctttggggctttaaaaagaagggcagttccttgctataaaaatactagggctagggaatggaaaaatctattacacaatttgattaagtaaaatcttttcagattaaaaaaaaagtcttccccccatctcattccttttgttgttgttgttcttggatcatagtaaaattgttttgataatatttattactttggggccaggcgcagtgctcatgcctgtaaccccagcattttgggaggccaaggtgggcgaatcacttgaggttaggagtttgagaccagcctggccaacatggtgaaaccccgtctctactaaaaatagaaaaaattagccaggcgtggtggtgagtgcctgtaaccccagctactctggaagctgaggcaggagaatagctcgaatcctggaggtggaggttgcagtgagccgagattgcactccagcctgggcaacaagagcaaaactccgtttcaaaaaaaaaattgtgtgtgtgtgtgtgtgtgtgtgtgtgtgtatttattatgttggaatccattctgtattttaaatcagtggtccccaacctttttggcaccagggactggttttgtggaagaaaatattttcacagatcagagtcgggggctggttttgggatgattcaagcgcgttacatttattgtgcactttatttctactagtattacattgtaatacataatgaaataattatataactcaccataatgtagaatcagtgggagccctgagtttgttttcttgcaactagacagtcccatctgggggtgttggagacagtgacagatcatcagggattagattctcatgaggagtaccccacctagatccctcacatgtgcagttcacaatagggttcacgctcctgtgcgaatctaatgcccctgctgatctgacaggaggtggagctcaggctgtaacttgagccatacagggactggctgtaaatacagatgaagcttcatctactggtgacctcctgctgtgtggcctgattcttaacaggccatggaccagtatcagtctgtggcccaggggttggggacccctgttttcaatgtctccttataaaatatgcaagaacaagggacatgcttcctctttaacctttgtttatacatatttatggtgatcagcctgaactagaggtaacaaataaagatagaagaacatcttaatttagggtggtgtatcatcagttttccggaaattaactgagttttattgtataagaacattttcctaatctgccccagaaatcattctgagcagaaatagataaggcctgaaatttccacatgaattacatgaatattgttttcatcttgcagaattgtgatctgtctgggtgtgatcttcaagaagccaacctgagagggtccaacgtgaagggagctatatttgaagagatgctgacaccactacacatgtcacaaagtgtcagatgagaattttaggggctggaggaagatgtaaaagatgaaaatgttttccttatcacttttctttctccacccactcagttgtctagaagaaataacactgtaaggaaatttaaaaaaaaaacatttagaggattatgcttgttttgagtggtgcataagggaaaaaactgactttttttccatattctgatttttaacagaaaagcactcatttaatagatgtagggaaactagatattgctgccttttgaatggggtaggggggtttacctggttttatgaccaggcatagtatctattatatttgcttttaaataggcatgatgtggaaataccatcttggtttgagatgcatttgaggattttaatttatggaaagcacaacatatgcaattatatttattgaattcctagatgcagtatggatatttaaattgttaaaactttatgaaaacttggaaaaggttgttcaggtttataaatagctttagtgatgcctcccctctttaaatacctgtcacaccgtatgaatatggtgagatcagactccctaagactcttttcaggttcatttttataatgtttactttttaggacagaacagtagctaaattaaagtaatatccagttcttactgattgagacagagtggaaagaaagacatcattgtacatcactgtcattccaaaggtacagtgtaactctggatggaggaataacttacctatcactacaacacttacaaatgagaatttctcagaatttcattctaggcaagttccactcaacaccagatcaagcaattctatctatttacactattagcctagttttctcatacagtcatcacaagcataggaagatacttcaaaaccaaaaaaaccaaggtgcatcattaatattcatttaattcaaataccaaatagtttacatagggccagcttagaaatagatactaaatccagagctactgcaatcaaagcttatatgagtgaatatggtagagttgcctgctaaaaggcaatgtaatataattgcagctagaaccctacagtggggaatgaggaattttaaacacacatttgattacagccaccaaaaaaatagacgtaaaaataaaggcatttggctggtccaagatgtaattatcaatcagtcagcacctgtgattcttttacttatttttttgtggttttttttttttaaacaaattttagcccaattttcttgagtcattctctctctgcagcagcagaggaagggcctgtacctccctaccaatgacttggtgtccttattttctaccccaagagcagggatattagctgtgtccaaatgggttctgaattctacagactcatcaacatgaggcaaggaatcattgaaaaccacctgtgtctcctttgggagaatgacatatctttagtatttacgtagcttattcttctatatctacatatgcaaagctttccttaacagtaaagggtacatatgcatagtgggaggagatcagacctttacaagtgaaggaaagcaacttcagaaatgaattattttctttgctttattatttttaccaagacagagaagtattgtattgagagataatctattttcataatcaatatgtgcctaaattatatttaaatcatttcactctgtactatattttcaggaattacagaatgtggtattcattcacttaaaggtacctctgtagaaataacctaaaactgcagaaggatctgaaagatctaaacatggtgtgcttagaaactgcagattttagatctaatgtatactgcattaataaatgatataaagtgtttgttgaaaaggagtttcttctcttccttttgaaaatcatcactttctgtattttgcttacatttcttcaatatgtgttgacaaccagccctgtggttctgggtagcaaaggaaatacagtataacttaatttgttatggattagtctttttgaaagtaccattaaagtaaatttatttcttt

SEQ ID NO: 25563 - DNA, 2404 bp, Homo sapiens
ccccaggcaggctgaggagcctaggggcggggtgggaaggaggaccggccgaaccttgggtgtgggacagagtgcgtgcgtgtggtgtgtccccaagggcaggaaggtggcgaagggaggcgaatccgagtgggtggagggaggggaagggcgggaggagaaaaaggtgggaggaggaccaggtgggagggtggcggctcactcaggacccagcgggggcagcgcgatgaggcgggtgaccctgttcctgaacggcagccccaagaacggaaaggtggttgctgtatatggaactttatctgatttgctttctgtggccagcagtaaactcggcataaaagccaccagtgtgtataatgggaaaggtggactgattgatgatattgctttgatcagggatgatgatgttttgtttgtttgtgaaggagagccatttattgatcctcagacagattctaagcctcctgagggattgttaggattccacacagactggctgacattaaatgttggagggcggtactttacaactacacggagcactttagtgaataaagaacctgacagtatgctggcccacatgtttaaggacaaaggtgtctggggaaataagcaagatcatagaggagctttcttaattgaccgaagtcctgagtacttcgaacccattttgaactacttgcgtcatggacagctcattgtaaatgatggcattaatttattgggtgtgttagaagaagcaagattttttggtattgactcattgattgaacacctagaagtggcaataaagaattctcaaccaccggaggatcattcaccaatatcccgaaaggaatttgtccgatttttgctagcaactccaaccaagtcagaactgcgatgccagggtttgaacttcagtggtgctgatctttctcgtttggaccttcgatacattaacttcaaaatggccaatttaagccgctgtaatcttgcacatgcaaatctttgctgtgcaaatcttgaacgagctgatctctctggatcagtgcttgactgtgcgaatctccagggagtcaagatgctctgttctaatgcagaaggagcatccctgaaactgtgtaattttgaggatccttctggtcttaaagccaatttagaaggtgctaatctgaaaggtgtggatatggaaggaagtcagatgacaggaattaacctgagagtggctaccttaaaaaatgcaaagttgaagaactgtaacctcagaggagcaactctggcaggaactgatttagagaattgtgatctgtctgggtgtgatcttcaagaagccaacctgagagggtccaacgtgaagggagctatatttgaagagatgctgacaccactacacatgtcacaaagtgtcagatgagaattttaggggctggaggaagatgtaaaagatgaaaatgttttccttatcacttttctttctccacccactcagttgtctagaagaaataacactgtaaggaaatttaaaaaaaaaacatttagaggattatgcttgttttgagtggtgcataagggaaaaaactgactttttttccatattctgatttttaacagaaaagcactcatttaatagatgtagggaaactagatattgctgccttttgaatggggtaggggggtttacctggttttatgaccaggcatagtatctattatatttgcttttaaataggcatgatgtggaaataccatcttggtttgagatgcatttgaggattttaatttatggaaagcacaacatatgcaattatatttattgaattcctagatgcagtatggatatttaaattgttaaaactttatgaaaacttggaaaaggttgttcaggtttataaatagctttagtgatgcctcccctctttaaatacctgtcacaccgtatgaatatggtgagatcagactccctaagactcttttcaggttcatttttataatgtttactttttaggacagaacagtagctaaattaaagtaatatccagttcttactgattgagacagagtggaaagaaagacatcattgtacatcactgtcattccaaaggtacagtgtaactctggatggaggaataacttacctatcactacaacacttacaaatgagaatttctcagaatttcattctaggcaagttccactcccgtaccagctggtacgggagtggaacaaggaaaacatggaacccaaagggaactgcagcgagagcacaaagattctaggatactgcgagcaaatggggtggaggggtgctctcctgagctacagaaggaatgatctggtggttaagataaaacacaagtcaaacttattcgagttgtccacagtcagcaatgtgatcttcttgatggtctgccattcccgtaca

SEQ ID NO: 25564 - DNA, 2569 bp, Homo sapiens
aacttttccctattctctttattgtcatagcgttgttaatatcttaagatttggaggtaaacggaaatggagaatcagcaactatacttcaaccttattgtaaacagacaaaacactaacaataaaaagttttgaagttaaaaggacgtaagttccaccttctatcctttgtagagatataaaaacaaaacaaaacaaactctgactagacaggctacccgctacacactcaaatcgacctccgcgaccggagggggaagcgcaactggttatggcaacccccctgccaccccggcccataacgcttcaccacgttctgtgccacggccggaagtgacgcataacctgcgacgccagtgcctgccgcccacggccgcaggagtcgggcttcggtcgcaccagagacagcggactttcctccgatggttgcagcagagggatcatgacggggaaaaagtcctcccgggagaaacggcgcaaacgtagcagtcaggaggcggccgcagcgctcgcggccccggacatcgtacccgcgttggccagcggcagcagtggaagcactagcggctgcgggagcgccgggggctgcgggagcgtcagctgctgtgggaacgccaattttagtggaagtgtcaccggcggtgggagcggcggcagctgttggggcgggagcagcgtggagcgcagcgagcgccggaagcggaggagtaccgactcttccagcgtctcgggctccttgcagcaggaaactaaatatattttgccaactttggaaaaagaattattcttggcagagcacagtgaccttgaagaaggtggactggacctgactgtgtcattgaaaccagttagtttctatatatcagacaaaaaagaaatgcttcagcagtgcttctgtattataggagagaaaaagttacagaagatgcttcctgatgtgttaaagaactgttcaatagaagaaattaaaaaactatgccaggaacagttagagctcctgtctgaaaaaaaaattttgaagattcttgagggtgacaatggaatggactctgatatggaagaggaagcagatgatggttctaagatgggatctgatttagtcagtcagcaagacatctgtatagattctgcttcatccgtgagagagaataagcaacctgaaggtttggaattaaaacaaggaaaaggggaagatagtgatgtactcagtataaatgcagatgcttatgacagcgacatagaaggcccatgcaacgaagaagcagctgctcccgaggcaccagaaaatacagtccaaagtgaagctggtcagatagatgacctggagaaagacattgagaaaagtgtgaatgagattctaggactggcagagtctagcccaaacgaacccaaagcagccaccctggctgttcctccaccagaagatgttcaaccttctgcacagcaactggagctgctagaacttgagatgagggcaagagcgattaaagccctaatgaaagctggtgatataaaaaagccagcctaggtatttaacttgattttgaattttaggtatgtttgaacaaagccacatcatttaattttgtatctaaaatttatttggggtcttatatgttatttctcatgtaacccttattaggactcattttagccctaaattacctgtggctgtttctttttatttttttgactacttttatattataaatgtgtgttactgtcttatgaattcatggcaatatagttggatagcctggatactttgttagatgagtatttagctgtgtctgcaaatcttaaaagccattagcaaagagtcgtggtatttttttctttatttttaaatgtttgggcaccaaacctaaaagcaaaagattgacgaagcatgtttctcttaaggctacttgtattttacaatacaatattaaattatttaatttgagaaatttagttttgcttatatgcactttttaaatatatactattttgaagattccttatgtaaatgcaaatttcctagttaaaaccgaataacagagatctgaaatgactgagaaaaacttttttattaaaggaaggaattaatttaaggcaatttttaactatgtagaactaattgcccatgtttaattatagcagacacgccattctaacaggtatttgataccattggatgcattattctaggttttttctttaataaaaatggaacaagttttcatttacattccaagctgtcaggaaatgaagaatattttattatctaggattttatctgatgtagttgcttaaagatctgatgtgctataattccatgaatcagaaataataaaatgctatcattctggatctgaagacttttgatactttttcaaaagcaaaattaatttcaggaacctttgataagttgttgttataattaatctaattttgtatagtttttgtaaataaattaccatccttccacaattagggatgcttttatccccccatcactaattgcagttgtttgataccaaaataaatttacgtagagatccttaacttaaaataaattaattttttc

SEQ ID NO: 25565 - DNA, 3152 bp, Homo sapiens
aacttttccctattctctttattgtcatagcgttgttaatatcttaagatttggaggtaaacggaaatggagaatcagcaactatacttcaaccttattgtaaacagacaaaacactaacaataaaaagttttgaagttaaaaggacgtaagttccaccttctatcctttgtagagatataaaaacaaaacaaaacaaactctgactagacaggctacccgctacacactcaaatcgacctccgcgaccggagggggaagcgcaactggttatggcaacccccctgccaccccggcccataacgcttcaccacgttctgtgccacggccggaagtgacgcataacctgcgacgccagtgcctgccgcccacggccgcaggagtcgggcttcggtcgcaccagagacagcggactttcctccgatggttgcagcagagggatcatgacggggaaaaagtcctcccgggagaaacggcgcaaacgtagcagtcaggaggcggccgcagcgctcgcggccccggacatcgtacccgcgttggccagcggcagcagtggaagcactagcggctgcgggagcgccgggggctgcgggagcgtcagctgctgtgggaacgccaattttagtggaagtgtcaccggcggtgggagcggcggcagctgttggggcgggagcagcgtggagcgcagcgagcgccggaagcggaggagtaccgactcttccagcgtctcgggctccttgcagcaggaaactaaatatattttgccaactttggaaaaagaattattcttggcagagcacagtgaccttgaagaaggtggactggacctgactgtgtcattgaaaccagttagtttctatatatcagacaaaaaagaaatgcttcagcagtgcttctgtattataggagagaaaaagttacagaagatgcttcctgatgtgttaaagaactgttcaatagaagaaattaaaaaactatgccaggaacagttagagctcctgtctgaaaaaaaaattttgaagattcttgagggtgacaatggaatggactctgatatggaagaggaagcagatgatggttctaagatgggatctgatttagtcagtcagcaagacatctgtatagattctgcttcatccgtgagagagaataagcaacctgaaggtttggaattaaaacaaggaaaaggggaagatagtgatgtactcagtataaatgcagatgcttatgacagcgacatagaaggcccatgcaacgaagaagcagctgctcccgaggcaccagaaaatacagtccaaagtgaagctggtcagatagatgacctggagaaagacattgagaaaagtgtgaatgagattctaggactggcagagtctagcccaaacgaacccaaagcagccaccctggctgttcctccaccagaagatgttcaaccttctgcacagcaactggagctgctagaacttgagatgagggcaagagcgattaaagccctaatgaaagctggtgatataaaaaagccagcctaggtatttaacttgattttgaattttaggtatgtttgaacaaagccacatcatttaattttgtatctaaaatttatttggggtcttatatgttatttctcatgtaacccttattaggactcattttagccctaaattacctgtggctgtttctttttatttttttgactacttttatattataaatgtgtgttactgtcttatgaattcatggcaatatagttggatagcctggatactttgttagatgagtatttagctgtgtctgcaaatcttaaaagccattagcaaagagtcgtggtatttttttctttatttttaaatgtttgggcaccaaacctaaaagcaaaagattgacgaagcatgtttctcttaaggctacttgtattttacaatacaatattaaattatttaatttgagaaatttagttttgcttatatgcactttttaaatatatactattttgaagattccttatgtaaatgcaaatttcctagttaaaaccgaataacagagatctgaaatgactgagaaaaacttttttattaaaggaaggaattaatttaaggcaatttttaactatgtagaactaattgcccatgtttaattatagcagacacgccattctaacaggtatttgataccattggatgcattattctaggttttttctttaataaaaatggaacaagttttcatttacattccaagctgtcaggaaatgaagaatattttattatctaggattttatctgatgtagttgcttaaagatctgatgtgctataattccatgaatcagaaataataaaatgctatcattctggatctgaagacttttgatactttttcaaaagcaaaattaatttcaggaacctttgataagttgttgttataattaatctaattttgtatagtttttgtaaataaattaccatccttccacaattagggatgcttttatccccccatcactaattgcagttgtttgataccaaaataaatttacgtagagatccttaacttaaaataaattaattttttcaaaaaacataaatctggaactgttgtttctatatttgataacaaatacagtatattttatttataagccatggtctactgatactgtatgaggactttccttatatataaaagttgcagggattgtgttttattagctgctttaattatgttaattttagagagtttttaaatggaaatagaggacatttatgaaacgctggaattgcagttacaaattctttttgttgttgttgttcctgaacatgccttggaataattctaccattttttccccctccataaatctttctaataaagcatagaaaaagcctatatgattttaaatgcttctcttaagctggtaaacagatttgagttatgagttcattgttattgcttcaagatgaaaagacagtgatataatttttctatttcaacttaaaagtaatagttaatatgctaaagtagtacagaataaactttattgctgcttactaactacaaaatactgtagatggcatctgtatgattaaacatataaagtaaaacaggtctgagggctttgtagatgattaaagtctccaccttcatgaaaaaaaaaa

SEQ ID NO: 25566 - DNA, 3306 bp, Homo sapiens
aacttttccctattctctttattgtcatagcgttgttaatatcttaagatttggaggtaaacggaaatggagaatcagcaactatacttcaaccttattgtaaacagacaaaacactaacaataaaaagttttgaagttaaaaggacgtaagttccaccttctatcctttgtagagatataaaaacaaaacaaaacaaactctgactagacaggctacccgctacacactcaaatcgacctccgcgaccggagggggaagcgcaactggttatggcaacccccctgccaccccggcccataacgcttcaccacgttctgtgccacggccggaagtgacgcataacctgcgacgccagtgcctgccgcccacggccgcaggagtcgggcttcggtcgcaccagagacagcggactttcctccgatggttgcagcagagggatcatgacggggaaaaagtcctcccgggagaaacggcgcaaacgtagcagtcaggaggcggccgcagcgctcgcggccccggacatcgtacccgcgttggccagcggcagcagtggaagcactagcggctgcgggagcgccgggggctgcgggagcgtcagctgctgtgggaacgccaattttagtggaagtgtcaccggcggtgggagcggcggcagctgttggggcgggagcagcgtggagcgcagcgagcgccggaagcggaggagtaccgactcttccagcgtctcgggctccttgcagcaggtgcgtgcgcgcccctctggccgcttcctggagctgctgctttttcggaagaagtcgggcttccagagggatggggcgcaggctggagctcactgctagcgcggcaatctcaaggtcgtccgtccttgaggttcatgttcctacctaagtcctggaaactaaatatattttgccaactttggaaaaagaattattcttggcagagcacagtgaccttgaagaaggtggactggacctgactgtgtcattgaaaccagttagtttctatatatcagacaaaaaagaaatgcttcagcagtgcttctgtattataggagagaaaaagttacagaagatgcttcctgatgtgttaaagaactgttcaatagaagaaattaaaaaactatgccaggaacagttagagctcctgtctgaaaaaaaaattttgaagattcttgagggtgacaatggaatggactctgatatggaagaggaagcagatgatggttctaagatgggatctgatttagtcagtcagcaagacatctgtatagattctgcttcatccgtgagagagaataagcaacctgaaggtttggaattaaaacaaggaaaaggggaagatagtgatgtactcagtataaatgcagatgcttatgacagcgacatagaaggcccatgcaacgaagaagcagctgctcccgaggcaccagaaaatacagtccaaagtgaagctggtcagatagatgacctggagaaagacattgagaaaagtgtgaatgagattctaggactggcagagtctagcccaaacgaacccaaagcagccaccctggctgttcctccaccagaagatgttcaaccttctgcacagcaactggagctgctagaacttgagatgagggcaagagcgattaaagccctaatgaaagctggtgatataaaaaagccagcctaggtatttaacttgattttgaattttaggtatgtttgaacaaagccacatcatttaattttgtatctaaaatttatttggggtcttatatgttatttctcatgtaacccttattaggactcattttagccctaaattacctgtggctgtttctttttatttttttgactacttttatattataaatgtgtgttactgtcttatgaattcatggcaatatagttggatagcctggatactttgttagatgagtatttagctgtgtctgcaaatcttaaaagccattagcaaagagtcgtggtatttttttctttatttttaaatgtttgggcaccaaacctaaaagcaaaagattgacgaagcatgtttctcttaaggctacttgtattttacaatacaatattaaattatttaatttgagaaatttagttttgcttatatgcactttttaaatatatactattttgaagattccttatgtaaatgcaaatttcctagttaaaaccgaataacagagatctgaaatgactgagaaaaacttttttattaaaggaaggaattaatttaaggcaatttttaactatgtagaactaattgcccatgtttaattatagcagacacgccattctaacaggtatttgataccattggatgcattattctaggttttttctttaataaaaatggaacaagttttcatttacattccaagctgtcaggaaatgaagaatattttattatctaggattttatctgatgtagttgcttaaagatctgatgtgctataattccatgaatcagaaataataaaatgctatcattctggatctgaagacttttgatactttttcaaaagcaaaattaatttcaggaacctttgataagttgttgttataattaatctaattttgtatagtttttgtaaataaattaccatccttccacaattagggatgcttttatccccccatcactaattgcagttgtttgataccaaaataaatttacgtagagatccttaacttaaaataaattaattttttcaaaaaacataaatctggaactgttgtttctatatttgataacaaatacagtatattttatttataagccatggtctactgatactgtatgaggactttccttatatataaaagttgcagggattgtgttttattagctgctttaattatgttaattttagagagtttttaaatggaaatagaggacatttatgaaacgctggaattgcagttacaaattctttttgttgttgttgttcctgaacatgccttggaataattctaccattttttccccctccataaatctttctaataaagcatagaaaaagcctatatgattttaaatgcttctcttaagctggtaaacagatttgagttatgagttcattgttattgcttcaagatgaaaagacagtgatataatttttctatttcaacttaaaagtaatagttaatatgctaaagtagtacagaataaactttattgctgcttactaactacaaaatactgtagatggcatctgtatgattaaacatataaagtaaaacaggtctgagggctttgtagatgattaaagtctccaccttcatgaaaaaaaaaa

SEQ ID NO: 25567 - DNA, 3067 bp, Homo sapiens
aacttttccctattctctttattgtcatagcgttgttaatatcttaagatttggaggtaaacggaaatggagaatcagcaactatacttcaaccttattgtaaacagacaaaacactaacaataaaaagttttgaagttaaaaggacgtaagttccaccttctatcctttgtagagatataaaaacaaaacaaaacaaactctgactagacaggctacccgctacacactcaaatcgacctccgcgaccggagggggaagcgcaactggttatggcaacccccctgccaccccggcccataacgcttcaccacgttctgtgccacggccggaagtgacgcataacctgcgacgccagtgcctgccgcccacggccgcaggagtcgggcttcggtcgcaccagagacagcggactttcctccgatggttgcagcagagggatcatgacggggaaaaagtcctcccgggagaaacggcgcaaacgtagcagtcaggaggcggccgcagcgctcgcggccccggacatcgtacccgcgttggccagcggcagcagtggaagcactagcggctgcgggagcgccgggggctgcgggagcgtcagctgctgtgggaacgccaattttagtggaagtgtcaccggcggtgggagcggcggcagctgttggggcgggagcagcgtggagcgcagcgagcgccggaagcggaggagtaccgactcttccagcgtctcgggctccttgcagcaggaaactaaatatattttgccaactttggaaaaagaattattcttggcagagcacagtgaccttgaagaaggtggactggacctgactgtgtcattgaaaccagttagtttctatatatcagacaaaaaagaaatgcttcagcagtgcttctgtattataggagagaaaaagttacagaagatgcttcctgatgtgttaaaggtgacaatggaatggactctgatatggaagaggaagcagatgatggttctaagatgggatctgatttagtcagtcagcaagacatctgtatagattctgcttcatccgtgagagagaataagcaacctgaaggtttggaattaaaacaaggaaaaggggaagatagtgatgtactcagtataaatgcagatgcttatgacagcgacatagaaggcccatgcaacgaagaagcagctgctcccgaggcaccagaaaatacagtccaaagtgaagctggtcagatagatgacctggagaaagacattgagaaaagtgtgaatgagattctaggactggcagagtctagcccaaacgaacccaaagcagccaccctggctgttcctccaccagaagatgttcaaccttctgcacagcaactggagctgctagaacttgagatgagggcaagagcgattaaagccctaatgaaagctggtgatataaaaaagccagcctaggtatttaacttgattttgaattttaggtatgtttgaacaaagccacatcatttaattttgtatctaaaatttatttggggtcttatatgttatttctcatgtaacccttattaggactcattttagccctaaattacctgtggctgtttctttttatttttttgactacttttatattataaatgtgtgttactgtcttatgaattcatggcaatatagttggatagcctggatactttgttagatgagtatttagctgtgtctgcaaatcttaaaagccattagcaaagagtcgtggtatttttttctttatttttaaatgtttgggcaccaaacctaaaagcaaaagattgacgaagcatgtttctcttaaggctacttgtattttacaatacaatattaaattatttaatttgagaaatttagttttgcttatatgcactttttaaatatatactattttgaagattccttatgtaaatgcaaatttcctagttaaaaccgaataacagagatctgaaatgactgagaaaaacttttttattaaaggaaggaattaatttaaggcaatttttaactatgtagaactaattgcccatgtttaattatagcagacacgccattctaacaggtatttgataccattggatgcattattctaggttttttctttaataaaaatggaacaagttttcatttacattccaagctgtcaggaaatgaagaatattttattatctaggattttatctgatgtagttgcttaaagatctgatgtgctataattccatgaatcagaaataataaaatgctatcattctggatctgaagacttttgatactttttcaaaagcaaaattaatttcaggaacctttgataagttgttgttataattaatctaattttgtatagtttttgtaaataaattaccatccttccacaattagggatgcttttatccccccatcactaattgcagttgtttgataccaaaataaatttacgtagagatccttaacttaaaataaattaattttttcaaaaaacataaatctggaactgttgtttctatatttgataacaaatacagtatattttatttataagccatggtctactgatactgtatgaggactttccttatatataaaagttgcagggattgtgttttattagctgctttaattatgttaattttagagagtttttaaatggaaatagaggacatttatgaaacgctggaattgcagttacaaattctttttgttgttgttgttcctgaacatgccttggaataattctaccattttttccccctccataaatctttctaataaagcatagaaaaagcctatatgattttaaatgcttctcttaagctggtaaacagatttgagttatgagttcattgttattgcttcaagatgaaaagacagtgatataatttttctatttcaacttaaaagtaatagttaatatgctaaagtagtacagaataaactttattgctgcttactaactacaaaatactgtagatggcatctgtatgattaaacatataaagtaaaacaggtctgagggctttgtagatgattaaagtctccaccttcatgaaaaaaaaaa

SEQ ID NO: 25568 - DNA, 3232 bp, Homo sapiens
aacttttccctattctctttattgtcatagcgttgttaatatcttaagatttggaggtaaacggaaatggagaatcagcaactatacttcaaccttattgtaaacagacaaaacactaacaataaaaagttttgaagttaaaaggacgtaagttccaccttctatcctttgtagagatataaaaacaaaacaaaacaaactctgactagacaggctacccgctacacactcaaatcgacctccgcgaccggagggggaagcgcaactggttatggcaacccccctgccaccccggcccataacgcttcaccacgttctgtgccacggccggaagtgacgcataacctgcgacgccagtgcctgccgcccacggccgcaggagtcgggcttcggtcgcaccagagacagcggactttcctccgatggttgcagcagagggatcatgacggggaaaaagtcctcccgggagaaacggcgcaaacgtagcagtcaggaggcggccgcagcgctcgcggccccggacatcgtacccgcgttggccagcggcagcagtggaagcactagcggctgcgggagcgccgggggctgcgggagcgtcagctgctgtgggaacgccaattttagtggaagtgtcaccggcggtgggagcggcggcagctgttggggcgggagcagcgtggagcgcagcgagcgccggaagcggaggagtaccgactcttccagcgtctcgggctccttgcagcaggtgcgtgcgcgcccctctggccgcttcctggagctgctgctttttcggaagaagtcgggcttccagagggatggggcgcaggctggagctcactgctagcgcggcaatctcaaggtcgtccgtccttgaggttcatgttcctacctaagtcctggaaactaaatatattttgccaactttggaaaaagaattattcttggcagagcacagtgaccttgaagaaggtggactggacctgactgtgtcattgaaaccagttagtttctatatatcagacaaaaaagaaatgcttcagcagtgcttctgtattataggagagaaaaagttacagaagatgcttcctgatgtgttaaagaactgttcaatagaagaaattaaaaaactatgccaggaacagttagagctcctgtctgaaaaaaaaattttgaagattcttgagggtgacaatggaatggactctgatatggaagaggaagcagatgatggttctaagatgggatctgatttagtcagtcagaaaaggggaagatagtgatgtactcagtataaatgcagatgcttatgacagcgacatagaaggcccatgcaacgaagaagcagctgctcccgaggcaccagaaaatacagtccaaagtgaagctggtcagatagatgacctggagaaagacattgagaaaagtgtgaatgagattctaggactggcagagtctagcccaaacgaacccaaagcagccaccctggctgttcctccaccagaagatgttcaaccttctgcacagcaactggagctgctagaacttgagatgagggcaagagcgattaaagccctaatgaaagctggtgatataaaaaagccagcctaggtatttaacttgattttgaattttaggtatgtttgaacaaagccacatcatttaattttgtatctaaaatttatttggggtcttatatgttatttctcatgtaacccttattaggactcattttagccctaaattacctgtggctgtttctttttatttttttgactacttttatattataaatgtgtgttactgtcttatgaattcatggcaatatagttggatagcctggatactttgttagatgagtatttagctgtgtctgcaaatcttaaaagccattagcaaagagtcgtggtatttttttctttatttttaaatgtttgggcaccaaacctaaaagcaaaagattgacgaagcatgtttctcttaaggctacttgtattttacaatacaatattaaattatttaatttgagaaatttagttttgcttatatgcactttttaaatatatactattttgaagattccttatgtaaatgcaaatttcctagttaaaaccgaataacagagatctgaaatgactgagaaaaacttttttattaaaggaaggaattaatttaaggcaatttttaactatgtagaactaattgcccatgtttaattatagcagacacgccattctaacaggtatttgataccattggatgcattattctaggttttttctttaataaaaatggaacaagttttcatttacattccaagctgtcaggaaatgaagaatattttattatctaggattttatctgatgtagttgcttaaagatctgatgtgctataattccatgaatcagaaataataaaatgctatcattctggatctgaagacttttgatactttttcaaaagcaaaattaatttcaggaacctttgataagttgttgttataattaatctaattttgtatagtttttgtaaataaattaccatccttccacaattagggatgcttttatccccccatcactaattgcagttgtttgataccaaaataaatttacgtagagatccttaacttaaaataaattaattttttcaaaaaacataaatctggaactgttgtttctatatttgataacaaatacagtatattttatttataagccatggtctactgatactgtatgaggactttccttatatataaaagttgcagggattgtgttttattagctgctttaattatgttaattttagagagtttttaaatggaaatagaggacatttatgaaacgctggaattgcagttacaaattctttttgttgttgttgttcctgaacatgccttggaataattctaccattttttccccctccataaatctttctaataaagcatagaaaaagcctatatgattttaaatgcttctcttaagctggtaaacagatttgagttatgagttcattgttattgcttcaagatgaaaagacagtgatataatttttctatttcaacttaaaagtaatagttaatatgctaaagtagtacagaataaactttattgctgcttactaactacaaaatactgtagatggcatctgtatgattaaacatataaagtaaaacaggtctgagggctttgtagatgattaaagtctccaccttcatgaaaaaaaaaa

SEQ ID NO: 25569 - DNA, 2914 bp, Homo sapiens
agaaatatcttaaattactgaaattacttggttactttgattatgattataaagttttaaaaatgatgatagctcctggtacgtatgttacttttctgtataatatttgtgatttgtaacatctttacttcaatttatttatatgaatttaagtacagtgataatgcatacatagagcttttgggtgaatggccttttaggggaaaatcctaattcttcaaaagtctaaaattttaagaaattattcaatatttactatacttttgtttgtgtatcctaaatatctcttcccttatagctactccttgagttaattgcagtgtggagagaaaaatcaagtaatattaaacagatattctctcctatggttttgataaataattatgcaaagaatttgggaatttttgatgaagaagaatttattaaatgaaaacgtatgatgtcatgtacgtattctttatattttaagtagtattgtttaatggttctttattcttttaactttaggaaactaaatatattttgccaactttggaaaaagaattattcttggcagagcacagtgaccttgaagaaggtggactggacctgactgtgtcattgaaaccagttagtttctatatatcagacaaaaaagaaatgcttcagcagtgcttctgtattataggagagaaaaagttacagaagatgcttcctgatgtgttaaagaactgttcaatagaagaaattaaaaaactatgccaggaacagttagagctcctgtctgaaaaaaaaattttgaagattcttgagggtgacaatggaatggactctgatatggaagaggaagcagatgatggttctaagatgggatctgatttagtcagtcagcaagacatctgtatagattctgcttcatccgtgagagagaataagcaacctgaaggtttggaattaaaacaaggaaaaggggaagatagtgatgtactcagtataaatgcagatgcttatgacagcgacatagaaggcccatgcaacgaagaagcagctgctcccgaggcaccagaaaatacagtccaaagtgaagctggtcagatagatgacctggagaaagacattgagaaaagtgtgaatgagattctaggactggcagagtctagcccaaacgaacccaaagcagccaccctggctgttcctccaccagaagatgttcaaccttctgcacagcaactggagctgctagaacttgagatgagggcaagagcgattaaagccctaatgaaagctggtgatataaaaaagccagcctaggtatttaacttgattttgaattttaggtatgtttgaacaaagccacatcatttaattttgtatctaaaatttatttggggtcttatatgttatttctcatgtaacccttattaggactcattttagccctaaattacctgtggctgtttctttttatttttttgactacttttatattataaatgtgtgttactgtcttatgaattcatggcaatatagttggatagcctggatactttgttagatgagtatttagctgtgtctgcaaatcttaaaagccattagcaaagagtcgtggtatttttttctttatttttaaatgtttgggcaccaaacctaaaagcaaaagattgacgaagcatgtttctcttaaggctacttgtattttacaatacaatattaaattatttaatttgagaaatttagttttgcttatatgcactttttaaatatatactattttgaagattccttatgtaaatgcaaatttcctagttaaaaccgaataacagagatctgaaatgactgagaaaaacttttttattaaaggaaggaattaatttaaggcaatttttaactatgtagaactaattgcccatgtttaattatagcagacacgccattctaacaggtatttgataccattggatgcattattctaggttttttctttaataaaaatggaacaagttttcatttacattccaagctgtcaggaaatgaagaatattttattatctaggattttatctgatgtagttgcttaaagatctgatgtgctataattccatgaatcagaaataataaaatgctatcattctggatctgaagacttttgatactttttcaaaagcaaaattaatttcaggaacctttgataagttgttgttataattaatctaattttgtatagtttttgtaaataaattaccatccttccacaattagggatgcttttatccccccatcactaattgcagttgtttgataccaaaataaatttacgtagagatccttaacttaaaataaattaattttttcaaaaaacataaatctggaactgttgtttctatatttgataacaaatacagtatattttatttataagccatggtctactgatactgtatgaggactttccttatatataaaagttgcagggattgtgttttattagctgctttaattatgttaattttagagagtttttaaatggaaatagaggacatttatgaaacgctggaattgcagttacaaattctttttgttgttgttgttcctgaacatgccttggaataattctaccattttttccccctccataaatctttctaataaagcatagaaaaagcctatatgattttaaatgcttctcttaagctggtaaacagatttgagttatgagttcattgttattgcttcaagatgaaaagacagtgatataatttttctatttcaacttaaaagtaatagttaatatgctaaagtagtacagaataaactttattgctgcttactaactacaaaatactgtagatggcatctgtatgattaaacatataaagtaaaacaggtctgagggctttgtagatgattaaagtctccaccttcatgaaaaaaaaaa

SEQ ID NO: 25570 - DNA, 1434 bp, Homo sapiens
aacttttccctattctctttattgtcatagcgttgttaatatcttaagatttggaggtaaacggaaatggagaatcagcaactatacttcaaccttattgtaaacagacaaaacactaacaataaaaagttttgaagttaaaaggacgtaagttccaccttctatcctttgtagagatataaaaacaaaacaaaacaaactctgactagacaggctacccgctacacactcaaatcgacctccgcgaccggagggggaagcgcaactggttatggcaacccccctgccaccccggcccataacgcttcaccacgttctgtgccacggccggaagtgacgcataacctgcgacgccagtgcctgccgcccacggccgcaggagtcgggcttcggtcgcaccagagacagcggactttcctccgatggttgcagcagagggatcatgacggggaaaaagtcctcccgggagaaacggcgcaaacgtagcagtcaggaggcggccgcagcgctcgcggccccggacatcgtacccgcgttggccagcggcagcagtggaagcactagcggctgcgggagcgccgggggctgcgggagcgtcagctgctgtgggaacgccaattttagtggaagtgtcaccggcggtgggagcggcggcagctgttggggcgggagcagcgtggagcgcagcgagcgccggaagcggaggagtaccgactcttccagcgtctcgggctccttgcagcaggtgcgtgcgcgcccctctggccgcttcctggagctgctgctttttcggaagaagtcgggcttccagagggatggggcgcaggctggagctcactgctagcgcggcaatctcaaggtcgtccgtccttgaggttcatgttcctacctaagtcctggtgagccccacactcccatccgtgtcttgaatcttgaacttcaagtttctggatttcctgatcactttttttttaatttattttttaaactcttggctccttccactcctatggtttcagtctgccggaagaatacgagttggaagctagccttcatttcccttgcgagccaaacacttctcccttcgtcttcaccttttcgtagatatggttaactccgcattagagataagaaaattgaggcccaaagaagttaaactttacccacggtcacagagtttgttaatagctcctaggtttgaatccaaatatctgactacaaaagccatgttctttatacgccaccagtctgccaagagaacgccgttttaaaaaagttcataatttgtttgaaaacaaatgaatgaataggtactttaaattcattcaatgaggaaataaagggaaagcgtcaagtcccttttcttgcccctccattagtattttgatacgcggcctcttttaatcactcctcgtgagatacgtgtttttaagt

SEQ ID NO: 25571 - DNA, 176 bp, Homo sapiens
ccactgctaccataggtcccagaatcaaggtgttttctcctctgtttccaagggcagggctgtgtctctggtttcagccaggacaatcccatccagtgcctcaggagtgggctgctctctgaagaaagctgtgtgaacagggcagcttgaaagagccgtggaggtgatgctgccac

SEQ ID NO: 25572 - DNA, 556 bp, Homo sapiens
gtcatttgcaccgtactatgaataagcaccagagtcttttttttggaaagcagattttgatatgaggagtggggtcagaggaagacagaaggaaataagaaccgtgacagcaatgagcagggaagagaggggaaaggggcccctcccacgtgggtgaaaggaactgagtgggcagatggtgaaactgacccacaaatgatgccttcacggctttgtgtcttgattccttttgtccttctcacagtcctgtcacggtggtctgcatgttgtgggagcacacaataactgttagagcttgatggccataaataaaatttgaaagaaggatttggctatatgagacaatttcccacttggcatgatttggcctggagcctgcagactatccacggggtgactaaccatcacttctttactgggcaaggagttttcctgtgtgtttttttcctccttatctattttcatggcatgttgagatggggttggagccaggacttcatgcagaagtgaagagcctggtgctcagcagagggagtggcctgctttcggtcacaca

SEQ ID NO: 25573 - DNA, 394 bp, Homo sapiens
aaatataacccatgatgagaagaaaaaccagtgcgagcaacaaacccagaaaatgaaagatgatagaattagtaaacaacattaaaaatgaaatttatattaagccaaatgcggtggctcactcctgtaaccccagcactttgggaggccaaggtaggaggagaaaaatacttgaggccaagagttcaagaccagtctgggaaacacagggaggccccacctctatgaaaaatttttaaaatgaaagttttgttttttggtttttttttgagacaaggtctcactctgccacccaggctggagtgcagtggcacgacctcgatcactgcaacctctgcctcctgggctcaagcaatcctcccacctcagcaaatttttaacaaagctaaaaaaa

SEQ ID NO: 25574 - DNA, 397 bp, Homo sapiens
tccctctaaaggccaagcccagaagctgcgtgcaacacctctgctcccatcccatcgtcataacgtagtcacggggcagcatgtcgccatcagggagcctgggatgtgtagtctttaactgggcagccgcgtgctctgataaaacatgggaattttaatactaaaggaagaaagggagagtgaatattctgggacaacaagcagactctgccacaggcaatgaccgccctaaccctggggaagatgcagatgccttccctatcatctaattaattcaccatttattgagcatggactctgtgccagatattgtgcacaacacacaggttcttcctttaggcctcctccttacagtctagaaggggcagacagactgatgaacacccagggtgctcag

SEQ ID NO: 25575 - DNA, 955 bp, Homo sapiens
gtgggtggtggggtgggtgggatggctgggggtgggagtgtaagtcccttttcctactttcatgtaaagtgccacaggtgtcttggtttgcatattcaaatattatataggaaaaacagtctgttatgtatttcttcacctagcttcttgtaatatttatggacgtttccagtttttgtaccttcttagctaaagcagttgcctttttgtaatggcaattaatttatatgataaaactttgtatccactgtagttgacagtattggttgctaattaactgccatattgccctgtctttctattaaaaaaatactgtacctgtacttagaggctaacagattcatgtggacatttaccaggcaagaccaacttgtattgtccatgatttctacgatttccactatcttcaaatgaaaaataaacgctgagtagaactgatgttttcagactaactcctttcaactttagcatttgggagtcccagatttctgtttacgtttgtgtcgcctgtttgtctccaaaataagttctgctgctcttgggtcaaaacaaatgattaattcgcatttcctttgaagccattgtgaaaaccttaaaagaaaaaaaaaaaaaaaaaagcaagtatcttttccagttggtttgtcttcagcagcaatttactcttattgaagctgttccttcggagtgtgtgaacagactcaagatattattataaagcatcatccttcaatcaaaggattattttataatatgtgctgtgaaattaacttgagtggcaaagtttggtgcaatgagttatttcattcaatggtgattgatgctgttaagtaatatttttaagtgactcgaggaaatactgtgcatttacagatccatccttaaggatgcaggtctaaaaaaagagtaagaaagaaaaatcaagtggtagatagatagaagaagagagaaaaagaaa

SEQ ID NO: 25576 - DNA, 433 bp, Homo sapiens
gtgggtggtggggtgggtgggatggctgggggtgggagtgtaagtcccttttcctactttcatgtaaagtgccacaggtgtcttggtttgcatattcaaatattatataggaaaaacagtctgttatgtatttcttcacctagcttcttgtaatatttatggacgtttccagtttttgtaccttcttagctaaagcagttgcctttttgtaatggcaattaatttatatgataaaactttgtatccactgtagttgacagtattggttgctaattaactgccatattgccctgtctttctattaaaaaaatactgtacctgtacttagaggctaacagattcatgtggacatttaccaggcaagaccaacttgtattgtccatgatttctacgatttccactatcttcaaatgaaaaataaacgctgagtaga

SEQ ID NO: 25577 - DNA, 400 bp, Homo sapiens
  misc_feature (24)..(24): n is a, c, g, or t
  misc_feature (28)..(28): n is a, c, g, or t
tactactactaaattcgcggccgngtcnacgtaaagtgccacaggtgtcttggtttgcatattcaaatattatataggaaaaacagtctgttatgtatttcttcacctagcttcttgtaatatttatggacgtttccagtttttgtaccttcttagctaaagcagttgcctttttgtaatggcaattaatttatatgataaaactttgtatccactgtagttgacagtattggttgctaattaactgccatattgccctgtctttctattaaaaaaatactgtacctgtacttagaggctaacagattcatgtggacatttaccaggcaagaccaacttgtattgtccatgatttctacgatttccactatcttcaaatgaaaaataaacgctgagtaga

SEQ ID NO: 25578 - DNA, 543 bp, Homo sapiens
attgactaaggagaagtaagggaataatctgtaaaactcaacccaaaatgaagtcttttttcttgctagaggcatattatttatttggatagattaagattttcctctacatgtttaagaagttaatctcaatttggatgtgattagtaataatttcaaatctatatttcacttgagtttcttgcagtgtaattatgtttgttgtctgtttgggaatactaaaacaatcattttattgtagtatatttaatacttttaccatatttcttcttacttaaacgaatacatataaataacaaccatgagaatctcaagcatatttgaaatattttaatatcattatgaaagtagaaagataaaattagagtgctccaaaaatatttaaaaattctagtccaatatcctcatttagagaaagaaaccgaggcccagaaatgtaaaagcaagtgaataaaattagtggtatggccagaattaggtactttgttcatgaaaatatttagacatttttgaggtgagttaggactggcagggcacggaggg

SEQ ID NO: 25579 - DNA, 378 bp, Homo sapiens
cggattacaggcatgagccaccgcgcctggccatggccctggtttctaatgagccaagctgacctccacactctcacaagacgaccgtgcctccaggtttgtgcacatggtgtctcgcaaccaagcgcacacacactaccacttgtctgggcctgcgagctcctttcagctttactcaagcaccatggtctctggaaggtcttaggccccccaggtgtgtgttcccatagcccaactccccagatcttgttaagatcttgttaataccaaatgccatccttttggcttttgttttttctagagacacggtctcaccctgttgcccaggctggagtgcagtggtgcaatcttggctcacagcagcctccacctcgtggt

SEQ ID NO: 25580 - DNA, 410 bp, Homo sapiens
ttttttgagacggagtcttgttctgtcgcctaggctggagtcccgtggcgccatctcggctcactgcaacctctgcctcctgggttcaagcgattctcctgcctcagcctcccaagtagctaagactacaggcatccaccaccatgcccagctaatttttgtatttttagtagagacagggtttcaccatgttggccaggctggccttgaactcctgacctcgtgacctgccagcctcagcagttaccaccaagaaaataatactggatacctaccgcacatgttaaagcaggataaatctaaatgtatcaaatataaagtttaaaagaaaatgtgatatagtttataaccctggagtgcaggagactttctaactataacttaaaacccatacactataaaaggttatt

SEQ ID NO: 25581 - DNA, 375 bp, Homo sapiens
taatgatgagtgacgttgagcatcttttcacattcgtgttggccgtctgtacatctttggagaaatgtctattcaagttctttcctaatgagaccactctctttgaccacagaaaatgagaccaggcaggccataaataatatccagtgatgtgcaggagccagcttatatataatgtgaaaacaaataattcaaaatcaaagctgttggaaactggaattattttgagtcttaaaggaatgtgcttatgggacctttaatccctctcgcctggggcgataggtgtgagtcactccgcctggccttgaataaactcctttaaactggattctgatcctttcaattatttcaggttgccaataacctcatcaaaat

SEQ ID NO: 25582 - DNA, 413 bp, Homo sapiens
ctcaaattcctcagagaccagcagcgggagccaaagcctgggatgctcttacaacctgcaagcgaccagagaggtaggaagacctcccgcccctcatctctccttgcagctccctctgccctaccaggaggggatgtcttagagccagccatcccttctctccaggctcagctccagacccaagctccttgtccagtttgcaatgggaaaggagaagagctttgcattggagaagagactggagtcttagctggactggtccaagtttcaataaccaaatgtgtgaggagaaacatggactcagataagaaatcattcagagataggaaagagaggttcgatgagcgtattttaaagcagtgacggtaaagacggaacatttatgagcacatttccgtgaattaaggctcttg

SEQ ID NO: 25583 - DNA, 558 bp, Homo sapiens
actgcactccagcctggttaacagagtgagactccatctcaaaaaaaaaaaaaaaatgttatcgtgaaagcagaagagaataatacctggcttatacttgagaaaggtattagccttacagaagaagaaagaaaccccttacaatgtgacagaagaagatacacatatggatgcagacaaagatgtaagtttgtttgcagaaagaaagtgaggtctttctcactattgtaagggagaaaggaaaggagtaggaagttgaagcgactggtaaaggtttaaatcactgctatgatgaatatgaaagaactgagtagagatgcataggggagttataggcactggagaatcagttgagattaaagaatctggatgtatgtggcatcagactacatgattatgagatatctccagcagtgatcatgtggtcaacaaacaagatttagaaaaaaagacttttctgttttatttcaactatttggcatgtcagctttacttagaataacagaagtattggacatatttaaatgaaatacaataaaactaatgtgtatcaagtgt

SEQ ID NO: 25584 - DNA, 276 bp, Homo sapiens
ataatatatatattatatatatatatatatatacacatatgtatatataacttaaagttccattgtacgtagccggacaataaaatctggaaaccagcatgaaaccctgttattcacatgttaaaatgttgaaactatgaccaaaatgtgaaaactgctagagctatcagaaagagacaagacaaaaaccttctttcatatgtataaactaaatgtgataatctcaaaaaacttttcaaaattatgattaccttccagtttaaaaactttaatcct

SEQ ID NO: 25585 - DNA, 356 bp, Homo sapiens
gatctgctgctctgattgctgcttttaaccaaaaggtacagataaagaggtggatggccactgttgttacacctccccttattattgcaagcctctccccatccagctgaagtgacttcctggggatttaaacggccactgcccttctctcctctcatttttctgttttgatgttgttgttgttgtttgtttgtttgttgtttttgtttttgttttgagagccgcacattaaagaccagggcattcaaaaccaattgcttatacgggaaaaattaggaagtgacaagtcatgcccagggaaatgtgtaggctcagaagagacctgagaagactttaagttagcgtgtcagaatact

SEQ ID NO: 25586 - DNA, 501 bp, Homo sapiens
agaaaggctgggctgggctaagctgggtgtgagtcaggggaaacatcgttcctgctgagaggcccggggcacccagagtcccacccaggcacccagagtccagtcactctggaaagaagtttgccccagccatgcagactccccaagggctttgtgctgagggtggggctcaacgtcaggacgcacccttgcatccctggacctggcagccctgtccccctcgggattgagctcaggggaacagagcctggggaacccgtgcccctccccctctccaaaagaagccaggagacctgcggaagggagggcttgaaggcagatggctgagccattttctgcctccgtgagggctgattgaagggcaatgaggcagctaatgcgaagaaagatagaaatttacttgctttaacttcatacggtccacagtgaaagagttcattcagtcgccggcccgccatagctgatggatgaataaaccatttgcggcatcgatcatgcctc

SEQ ID NO: 25587 - DNA, 304 bp, Homo sapiens
tagagacgagatctcactttgttgcccagtctagacttgaactcctggcctcaagtgatccttctgtctcagcctccgaaagtgttggaattacaggtgttgagccactgcacctagccctaattttcctatttcttttctctttttttccaattttttaaaatagcaacaaggtctcactatgttgcccaggctggtcttaaactcttgaactcaagtgatcctcctgcctcagcctctcaaattgctttctatttctgtttttgactcctggatcatttagaagtgtattgtttagttttta

SEQ ID NO: 25588 - DNA, 5936 bp, Homo sapiens
gtgatggcatctcacactgcaaccgcacgtgcttggaggactgtggccatggtgtgtgcagtggccccccggactttacctgcgtgtgtgacctaggctggacatcagacctgccccctcccacacccgccccgggtccgccagccccccgctgctcccgggactgtggctgcagcttccacagccactgccgcaagcggggccctggcttctgcgacgagtgccaggactggacatggggggagcactgcgaacgatgccggcccggcagcttcggcaacgccacaggctctaggggctgccggccctgccagtgcaacgggcacggggacccacgccgtggccactgcgacaacctcagtgggctctgcttctgccaggaccacaccgagggtgcccactgccagctctgctccccaggctattatggggatccccgggccggtggttcctgctttcgggagtgtgggggtcgcgccctcctcaccaacgtgtcctcagtggcactgggctcacgccgggtcggggggctgctgcctccaggtggcggggctgcaagagccgggcctggcctgtcctactgtgtgtgggttgtctcggccactgaggagctacagccctgtgctcccgggaccctctgtcccccactcaccctcaccttctcccccgacagcagcaccccctgcacgctgagctacgtcctggcgtttgatggattcccacgcttcctggacactggtgttgtccagtcggaccgcagcctcatagctgccttctgcggccagcgacgggacaggcccctcactgttcaggccctgtctgggctgctcgtgctgcactgggaggccaatggctcctcatcctggggcttcaatgcttcggtgggctctgcccgctgtgggtcagggggccccgggagctgtcccgtcccccaggaatgcgtgccccaggacggtgctgcaggtgcggggctctgccgatgtcctcagggctgggctggcccacactgccgcatggctctgtgtcctgagaactgcaatgcccacactggggcaggaacttgtaaccagagcctgggtgtgtgcatctgtgccgagggcttcgggggccccgactgcgccaccaagctggatggcgggcagctggtctgggagaccctcatggacagccgcctctcagccgacactgccagccgcttcctgcaccgcctgggccacaccatggtggatggacccgatgccaccttgtggatgtttgggggcctgggcctgccccaggggctgctgggaaacctgtacaggtactcagtgagtgagcggcggtggacacagatgctggcgggagccgaggacgggggcccaggcccatcgccccgctccttccatgcagccgcatatgtgcccgctggccgtggtgccatgtatctgctggggggacttaccgctggaggcgtcacccgtgatttctgggtcctcaacctcaccaccctgcaatggcggcaggagaaggccccccagaccgtggagctgccagccgttgctggtcacacccttactgcccgccgaggcctgtctctgctcctggtgggcggttactccccggaaaatggcttcaaccagcagctgctggagtaccagctggcaaccggcacctgggtgtcaggagcccagagtgggacaccccccacaggtctctatggtcactctgctgtctaccacgaggccaccgactccctctacgtgtttggggggttccgattccatgtggagctggcggccccatcccccgagctctactccctgcactgtcctgaccgcacctggagtctgctggccccttctcagggggcaaagccccgcccccggcttttccacgcctcagccctgttaggggacaccatggtggttcttggggggcgctcggaccctgacgagttcagcagcgacgttctgctctaccaggtcaactgcaatgcctggcttctgcccgacctcacccgctcggcctctgtggggcccccaatggaggagtctgtggcccatgctgtggcagcagtcgggagccgcctgtatatctctgggggtttcgggggagtggccctgggccgcctgctggcactgaccctgccccctgacccctgccgcctgctgtcctcacctgaagcttgtaaccagtctggggcctgcacctggtgccatggggcctgcttgtccggggatcaggcccacaggctgggctgcgggggctccccctgctccccaatgcctcgctccccggaggaatgtcgacgtctccggacctgcagtgagtgcctggcccgccatcctcggaccctgcaacctggagatggagaggcgtccaccccccgctgtaagtggtgtaccaactgccccgaaggtgcttgcattggacgcaatgggtcctgcacctctgagaatgactgtcggatcaaccagcgagaggtcttctgggcagggaactgctccgaggctgcgtgcggggctgctgactgcgagcagtgcacgcgggagggcaagtgcatgtggacgcggcagttcaagaggacaggggagacccgccgcatcctctccgtgcagcccacctatgactggacgtgcttcagccactctctgctgaatgtgtcccccatgccggtggaatcatcacccccactgccctgccccaccccttgtcacctcctacccaactgtacctcctgcctggactctaagggagcagatgggggctggcagcactgtgtttggagcagcagcctgcagcagtgtctgagcccttcctacctgcccctgcgatgtatggccggaggctgtgggcggctgctccggggacctgagagctgctccctgggctgtgctcaggcaactcagtgcgccttgtgcctgcggcgcccccattgcggctggtgtgcctgggggggccaggatgggggtggccgctgcatggagggtggactcagcggcccccgtgatgggctgacatgtgggcgtccgggggcctcctgggccttcctgtcctgcccccctgaggacgagtgtgcaaacgggcaccacgactgcaacgagacgcagaattgccacgaccagccccacggctatgagtgcagctgcaagaccggctataccatggacaacatgacagggctgtgccgccctgtgtgcgcccagggctgcgtgaacggctcatgtgtggagcccgaccactgccgctgccactttggctttgtgggccgcaactgctccacggaatgccgctgcaaccgccacagtgaatgcgctggtgttggggcgcgtgaccactgcttgctctgccgcaaccacaccaagggcagccactgtgagcagtgcctcccgctgtttgtgggttcagctgtcggaggcgggacctgccggccctgccacgccttttgtcgtggaaatagccacatctgcatctccaggaaggagttacaaatgtccaagggagagccaaagaagtactcactggacccagaggagattgaaaactgggtgacagagggtcctagtgaagacgaggccgtgtgcgtgaactgccagaataacagctatggggagaaatgcgagagctgcctgcagggctacttcctcctggacgggaagtgcaccaatgcgccaagtgccgggaatcatttcacgggagtccgctgggcggccagcagtgctaccgcctcatctcggtggagcaggagtgctgcctggaccccacgtcccagaccaactgcttccatgagcccaaacgccgggcgctaggccccggccgcactgtcctctttggcgtgcagcccaaattcaccaacgtggacatccgcctgacgctggacgtgaccttcggggccgtggacctctatgtctccacctcctatgacaccttcgtggtccgtgtggcccctgacactggcgtccatactgtacacatccagccacccccagccccaccacctccaccaccccctgcagatggtgggccccggggggctggggatccaggaggagcaggggccagcagtgggccgggcgccccagcagagccacgggtacgggaggtatggccgcggggcctgattacctacgtgacggtgacggagccgtcggcagtgctggtggtccgcggcgtgcgggaccggctggtcatcacctacccacacgagcaccatgccctcaagtcgagccgcttctacctgctgctgctgggcgtgggagacccaagtgggcccggcgccaacggctcagccgactcgcagggcctgctcttcttccggcaggaccaggcccacattgacctgtttgtcttcttctccgtcttcttctcctgcttcttcctcttcctctcactctgtgtgctcctctggaaggccaagcaggctctggaccagcggcaggagcagcgccggcacttgcaggagatgaccaagatggccagccgccccttcgccaaggtcaccgtctgcttcccacctgaccctactgccccggcctccgcctggaagccggctgggctcccacctcccgccttccgccgctctgagcccttcctggcacccctgctgctgacaggggccggtgggccctggggacccatgggagggggctgctgcccaccagccatccccgccaccactgctgggctgcgagctgggcccatcactctcgagcccacagaagatggcatggctggcgtggccacactgctgctccagctgcctggcgggccccatgcacccaacggcgcctgcctggggtcagccctcgtcacactgcggcacaggctgcacgagtactgtgggggtggtgggggtgctgggggcagtgggcatgggactggtgcgggccggaagggactgttgagccaggacaacctcaccagcatgtccctctgacatgcccagggttctcatccacagcagctgggtcacctgatagggccgccctggacttggggtccctccacctgggggcccctggacactgtctacttggagaccactggcccccttcccccagggttgcccagatggggcctcctttgttctgcattcagcagctatttatcgagtacctactctgtcaggcactgtcataggcgtggggcaaagcaggaaccaagagacgaggttccctgatctcatgggacttaggttctggtgaagggagacaatcagtgcacatgcacacaccccacacgcatacacacatgaacacatgcacatgtgcacacacaagtaagatggcttcagagagggagaagcactgtgaggcctccagaggatgtggcagtgagggacgatggggtgaagtcagctgggcattcaaagaagctagactgagaacgcctgagaagaaccagctacgggaagagctttgggaagcaaaggcagaggccctggggtgggagcaggcttgttttattggaaggaccagaaaactggtaagtgtgacccagatcaagtgtgaggagatgaggctggggatagtcaggggctggatcacccagggccttgtgggccccacatagggttttgggttttattctcagggcaatgggaagctgttggatggtttgatgaaggggagtgacaggatccgatgtacctatttaagaatttaagagggtcgggtgcggtggctcatgcctataatcctagcactttgagaggccaaggtgggctgatcacaaggtcaagagttcgtgaccagcctggccaatatggtgaaaccccatgtctactaaaaatacaaaaattagctgggcatggtggcacacacttgtagtccgagctactcgggaggctgaggcagaagaatcgcttgaacccaggaggcggaggttgcagtgagctcagattgcgtcactgcactccaacctgggtgacagagcgagactccacctcaaaaaaaaaa

SEQ ID NO: 25589 - DNA, 5192 bp, Homo sapiens
gtgatggcatctcacactgcaaccgcacgtgcttggaggactgtggccatggtgtgtgcagtggccccccggactttacctgcgtgtgtgacctaggctggacatcagacctgccccctcccacacccgccccgggtccgccagccccccgctgctcccgggactgtggctgcagcttccacagccactgccgcaagcggggccctggcttctgcgacgagtgccaggactggacatggggggagcactgcgaacgatgccggcccggcagcttcggcaacgccacaggctctaggggctgccggccctgccagtgcaacgggcacggggacccacgccgtggccactgcgacaacctcagtgggctctgcttctgccaggaccacaccgagggtgcccactgccagctctgctccccaggctattatggggatccccgggccggtggttcctgctttcgggagtgtgggggtcgcgccctcctcaccaacgtgtcctcagtggcactgggctcacgccgggtcggggggctgctgcctccaggtggcggggctgcaagagccgggcctggcctgtcctactgtgtgtgggttgtctcggccactgaggagctacagccctgtgctcccgggaccctctgtcccccactcaccctcaccttctcccccgacagcagcaccccctgcacgctgagctacgtcctggcgtttgatggattcccacgcttcctggacactggtgttgtccagtcggaccgcagcctcatagctgccttctgcggccagcgacgggacaggcccctcactgttcaggccctgtctgggctgctcgtgctgcactgggaggccaatggctcctcatcctggggcttcaatgcttcggtgggctctgcccgctgtgggtcagggggccccgggagctgtcccgtcccccaggaatgcgtgccccaggacggtgctgcaggtgcggggctctgccgatgtcctcagggctgggctggcccacactgccgcatggctctgtgtcctgagaactgcaatgcccacactggggcaggaacttgtaaccagagcctgggtgtgtgcatctgtgccgagggcttcgggggccccgactgcgccaccaagctggatggcgggcagctggtctgggagaccctcatggacagccgcctctcagccgacactgccagccgcttcctgcaccgcctgggccacaccatggtggatggacccgatgccaccttgtggatgtttgggggcctgggcctgccccaggggctgctgggaaacctgtacaggtactcagtgagtgagcggcggtggacacagatgctggcgggagccgaggacgggggcccaggcccatcgccccgctccttccatgcagccgcatatgtgcccgctggccgtggtgccatgtatctgctggggggacttaccgctggaggcgtcacccgtgatttctgggtcctcaacctcaccaccctgcaatggcggcaggagaaggccccccagaccgtggagctgccagccgttgctggtcacacccttactgcccgccgaggcctgtctctgctcctggtgggcggttactccccggaaaatggcttcaaccagcagctgctggagtaccagctggcaaccggcacctgggtgtcaggagcccagagtgggacaccccccacaggtctctatggtcactctgctgtctaccacgaggccaccgactccctctacgtgtttggggggttccgattccatgtggagctggcggccccatcccccgagctctactccctgcactgtcctgaccgcacctggagtctgctggccccttctcagggggcaaagccccgcccccggcttttccacgcctcagccctgttaggggacaccatggtggttcttggggggcgctcggaccctgacgagttcagcagcgacgttctgctctaccaggtcaactgcaatgcctggcttctgcccgacctcacccgctcggcctctgtggggcccccaatggaggagtctgtggcccatgctgtggcagcagtcgggagccgcctgtatatctctgggggtttcgggggagtggccctgggccgcctgctggcactgaccctgccccctgacccctgccgcctgctgtcctcacctgaagcttgtaaccagtctggggcctgcacctggtgccatggggcctgcttgtccggggatcaggcccacaggctgggctgcgggggctccccctgctccccaatgcctcgctccccggaggaatgtcgacgtctccggacctgcagtgagtgcctggcccgccatcctcggaccctgcaacctggagatggagaggcgtccaccccccgctgtaagtggtgtaccaactgccccgaaggtgcttgcattggacgcaatgggtcctgcacctctgagaatgactgtcggatcaaccagcgagaggtcttctgggcagggaactgctccgaggctgcgtgcggggctgctgactgcgagcagtgcacgcgggagggcaagtgcatgtggacgcggcagttcaagaggacaggggagacccgccgcatcctctccgtgcagcccacctatgactggacgtgcttcagccactctctgctgaatgtgtcccccatgccggtggaatcatcacccccactgccctgccccaccccttgtcacctcctacccaactgtacctcctgcctggactctaagggagcagatgggggctggcagcactgtgtttggagcagcagcctgcagcagtgtctgagcccttcctacctgcccctgcgatgtatggccggaggctgtgggcggctgctccggggacctgagagctgctccctgggctgtgctcaggcaactcagtgcgccttgtgcctgcggcgcccccattgcggctggtgtgcctgggggggccaggatgggggtggccgctgcatggagggtggactcagcggcccccgtgatgggctgacatgtgggcgtccgggggcctcctgggccttcctgtcctgcccccctgaggacgagtgtgcaaacgggcaccacgactgcaacgagacgcagaattgccacgaccagccccacggctatgagtgcagctgcaagaccggctataccatggacaacatgacagggctgtgccgccctgtgtgcgcccagggctgcgtgaacggctcatgtgtggagcccgaccactgccgctgccactttggctttgtgggccgcaactgctccacggaatgccgctgcaaccgccacagtgaatgcgctggtgttggggcgcgtgaccactgcttgctctgccgcaaccacaccaagggcagccactgtgagcagtgcctcccgctgtttgtgggttcagctgtcggaggcgggacctgccggccctgccacgccttttgtcgtggaaatagccacatctgcatctccaggaaggagttacaaatgtccaagggagagccaaagaagtactcactggacccagaggagattgaaaactgggtgacagagggtcctagtgaagacgaggccgtgtgcgtgaactgccagaataacagctatggggagaaatgcgagagctgcctgcagggctacttcctcctggacgggaagtgcaccaagccaagcaggctctggaccagcggcaggagcagcgccggcacttgcaggagatgaccaagatggccagccgccccttcgccaaggtcaccgtctgcttcccacctgaccctactgccccggcctccgcctggaagccggctgggctcccacctcccgccttccgccgctctgagcccttcctggcacccctgctgctgacaggggccggtgggccctggggacccatgggagggggctgctgcccaccagccatccccgccaccactgctgggctgcgagctgggcccatcactctcgagcccacagaagatggcatggctggcgtggccacactgctgctccagctgcctggcgggccccatgcacccaacggcgcctgcctggggtcagccctcgtcacactgcggcacaggctgcacgagtactgtgggggtggtgggggtgctgggggcagtgggcatgggactggtgcgggccggaagggactgttgagccaggacaacctcaccagcatgtccctctgacatgcccagggttctcatccacagcagctgggtcacctgatagggccgccctggacttggggtccctccacctgggggcccctggacactgtctacttggagaccactggcccccttcccccagggttgcccagatggggcctcctttgttctgcattcagcagctatttatcgagtacctactctgtcaggcactgtcataggcgtggggcaaagcaggaaccaagagacgaggttccctgatctcatgggacttaggttctggtgaagggagacaatcagtgcacatgcacacaccccacacgcatacacacatgaacacatgcacatgtgcacacacaagtaagatggcttcagagagggagaagcactgtgaggcctccagaggatgtggcagtgagggacgatggggtgaagtcagctgggcattcaaagaagctagactgagaacgcctgagaagaaccagctacgggaagagctttgggaagcaaaggcagaggccctggggtgggagcaggcttgttttattggaaggaccagaaaactggtaagtgtgacccagatcaagtgtgaggagatgaggctggggatagtcaggggctggatcacccagggccttgtgggccccacatagggttttgggttttattctcagggcaatgggaagctgttggatggtttgatgaaggggagtgacaggatccgatgtacctatttaagaatttaagagggtcgggtgcggtggctcatgcctataatcctagcactttgagaggccaaggtgggctgatcacaaggtcaagagttcgtgaccagcctggccaatatggtgaaaccccatgtctactaaaaatacaaaaattagctgggcatggtggcacacacttgtagtccgagctactcgggaggctgaggcagaagaatcgcttgaacccaggaggcggaggttgcagtgagctcagattgcgtcactgcactccaacctgggtgacagagcgagactccacctcaaaaaaaaaa

SEQ ID NO: 25590 - DNA, 3140 bp, Homo sapiens
gtgatggcatctcacactgcaaccgcacgtgcttggaggactgtggccatggtgtgtgcagtggccccccggactttacctgcgtgtgtgacctaggctggacatcagacctgccccctcccacacccgccccgggtccgccagccccccgctgctcccgggactgtggctgcagcttccacagccactgccgcaagcggggccctggcttctgcgacgagtgccaggactggacatggggggagcactgcgaacgatgccggcccggcagcttcggcaacgccacaggctctaggggctgccggccctgccagtgcaacgggcacggggacccacgccgtggccactgcgacaacctcagtgggctctgcttctgccaggaccacaccgagggtgcccactgccagctctgctccccaggctattatggggatccccgggccggtggttcctgctttcgggagtgtgggggtcgcgccctcctcaccaacgtgtcctcagtggcactgggctcacgccgggtcggggggctgctgcctccaggtggcggggctgcaagagccgggcctggcctgtcctactgtgtgtgggttgtctcggccactgaggagctacagccctgtgctcccgggaccctctgtcccccactcaccctcaccttctcccccgacagcagcaccccctgcacgctgagctacgtcctggcgtttgatggattcccacgcttcctggacactggtgttgtccagtcggaccgcagcctcatagctgccttctgcggccagcgacgggacaggcccctcactgttcaggccctgtctgggctgctcgtgctgcactgggaggccaatggctcctcatcctggggcttcaatgcttcggtgggctctgcccgctgtgggtcagggggccccgggagctgtcccgtcccccaggaatgcgtgccccaggacggtgctgcaggtgcggggctctgccgatgtcctcagggctgggctggcccacactgccgcatggctctgtgtcctgagaactgcaatgcccacactggggcaggaacttgtaaccagagcctgggtgtgtgcatctgtgccgagggcttcgggggccccgactgcgccaccaagctggatggcgggcagctggtctgggagaccctcatggacagccgcctctcagccgacactgccagccgcttcctgcaccgcctgggccacaccatggtggatggacccgatgccaccttgtggatgtttgggggcctgggcctgccccaggggctgctgggaaacctgtacaggtactcagtgagtgagcggcggtggacacagatgctggcgggagccgaggacgggggcccaggcccatcgccccgctccttccatgcagccgcatatgtgcccgctggccgtggtgccatgtatctgctggggggacttaccgctggaggcgtcacccgtgatttctgggtcctcaacctcaccaccctgcaatggcggcaggagaaggccccccagaccgtggagctgccagccgttgctggtcacacccttactgcccgccgaggcctgtctctgctcctggtgggcggttactccccggaaaatggcttcaaccagcagctgctggagtaccagctggcaaccggcacctgggtgtcaggagcccagagtgggacaccccccacaggtctctatggtcactctgctgtctaccacgaggccaccgactccctctacgtgtttggggggttccgattccatgtggagctggcggccccatcccccgagctctactccctgcactgtcctgaccgcacctggagtctgctggccccttctcagggggcaaagccccgcccccggcttttccacgcctcagccctgttaggggacaccatggtggttcttggggggcgctcggaccctgacgagttcagcagcgacgttctgctctaccaggtcaactgcaatgcctggcttctgcccgacctcacccgctcggcctctgtggggcccccaatggaggagtctgtggcccatgctgtggcagcagtcgggagccgcctgtatatctctgggggtttcgggggagtggccctgggccgcctgctggcactgaccctgccccctgacccctgccgcctgctgtcctcacctgaagcttgtaaccagtctggggcctgcacctggtgccatggggcctgcttgtccggggatcaggcccacaggctgggctgcgggggctccccctgctccccaatgcctcgctccccggaggaatgtcgacgtctccggacctgcagtgagtgcctggcccgccatcctcggaccctgcaacctggagatggagaggcgtccaccccccgctgtaagtggtgtaccaactgccccgaaggtgcttgcattggacgcaatgggtcctgcacctctgagaatgactgtcggatcaaccagcgagaggtcttctgggcagggaactgctccgaggctgcgtgcggggctgctgactgcgagcagtgcacgcgggagggcaagtgcatgtggacgcggcagttcaagaggacaggggagacccgccgcatcctctccgtgcagcccacctatgactggacgtgcttcagccactctctgctgaatgtgtcccccatgccggtggaatcatcacccccactgccctgccccaccccttgtcacctcctacccaactgtacctcctgcctggactctaagggagcagatgggggctggcagcactgtgtttggagcagcagcctgcagcaggtactgcacctggccaggaccgtgccaggcaagggcccgggcaggtctccctcctctctgcgctggcagggacctttcttccaccatctcctccaccctcctccttccatctccctggctctagctgcagtcgtgcttccttctcgtgccaccatctctttcctccctcgttgcctcatgagggtccctgttgtgtcctccagccatgcttctgtgtgtgccactttcccaacccctggcctctgcctctccaactcttgtccatggtatcatggtctcctcatcctttccatgactttaaaaaaattttaatttaattttttgtttttaattttgtcgatataattcataggttca

SEQ ID NO: 25591 - DNA, 2430 bp, Homo sapiens
gtgatggcatctcacactgcaaccgcacgtgcttggaggactgtggccatggtgtgtgcagtggccccccggactttacctgcgtgtgtgacctaggctggacatcagacctgccccctcccacacccgccccgggtccgccagccccccgctgctcccgggactgtggctgcagcttccacagccactgccgcaagcggggccctggcttctgcgacgagtgccaggactggacatggggggagcactgcgaacgatgccggcccggcagcttcggcaacgccacaggctctaggggctgccggccctgccagtgcaacgggcacggggacccacgccgtggccactgcgacaacctcagtgggctctgcttctgccaggaccacaccgagggtgcccactgccagctctgctccccaggctattatggggatccccgggccggtggttcctgctttcgggagtgtgggggtcgcgccctcctcaccaacgtgtcctcagtggcactgggctcacgccgggtcggggggctgctgcctccaggtggcggggctgcaagagccgggcctggcctgtcctactgtgtgtgggttgtctcggccactgaggagctacagccctgtgctcccgggaccctctgtcccccactcaccctcaccttctcccccgacagcagcaccccctgcacgctgagctacgtcctggcgtttgatggattcccacgcttcctggacactggtgttgtccagtcggaccgcagcctcatagctgccttctgcggccagcgacgggacaggcccctcactgttcaggccctgtctgggctgctcgtgctgcactgggaggccaatggctcctcatcctggggcttcaatgcttcggtgggctctgcccgctgtgggtcagggggccccgggagctgtcccgtcccccaggaatgcgtgccccaggacggtgctgcaggtgcggggctctgccgatgtcctcagggctgggctggcccacactgccgcatggctctgtgtcctgagaactgcaatgcccacactggggcaggaacttgtaaccagagcctgggtgtgtgcatctgtgccgagggcttcgggggccccgactgcgccaccaagctggatggcgggcagctggtctgggagaccctcatggacagccgcctctcagccgacactgccagccgcttcctgcaccgcctgggccacaccatggtggatggacccgatgccaccttgtggatgtttgggggcctgggcctgccccaggggctgctgggaaacctgtacaggtactcagtgagtgagcggcggtggacacagatgctggcgggagccgaggacgggggcccaggcccatcgccccgctccttccatgcagccgcatatgtgcccgctggccgtggtgccatgtatctgctggggggacttaccgctggaggcgtcacccgtgatttctgggtcctcaacctcaccaccctgcaatggcggcaggagaaggccccccagaccgtggagctgccagccgttgctggtcacacccttactgcccgccgaggcctgtctctgctcctggtgggcggttactccccggaaaatggcttcaaccagcagctgctggagtaccagctggcaaccggcacctgggtgtcaggagcccagagtgggacaccccccacaggtctctatggtcactctgctgtctaccacgaggccaccgactccctctacgtgtttggggggttccgattccatgtggagctggcggccccatcccccgagctctactccctgcactgtcctgaccgcacctggagtctgctggccccttctcagggggcaaagccccgcccccggcttttccacgcctcagccctgttaggggacaccatggtggttcttggggggcgctcggaccctgacgagttcagcagcgacgttctgctctaccaggtcaactgcaatgcctggcttctgcccgacctcacccgctcggcctctgtggggcccccaatggaggagtctgtggcccatgctgtggcagcagtcgggagccgcctgtatatctctgggggtttcgggggagtggccctgggccgcctgctggcactgaccctgccccctgacccctgccgcctgctgtcctcacctgaagcttgtaaccagtctggggcctgcacctggtgccatggggcctgcttgtccggggatcaggcccacaggctgggctgcgggggctccccctgctccccaatgcctcgctccccggaggaatgtcgacgtctccggacctgcagtgagtgcctggcccgccatcctcggaccctgcaacctggagatggagaggtggtggggaccacatcagaagaagaggggggtgatgaaattaacaaataaaaagtatggggaaaaccaaaaaaaa

SEQ ID NO: 25592 - DNA, 959 bp, Homo sapiens
cagttgtgctgtggagaatggaccggagggacaagaggggcagcagggatggtgggctggagtagggtgctggcaatgagggagtctggctcagatgtgggatgtgtatggaagaatataaatgatggtgtggatgtcagggtgagggaggagacaaaaccacgatgacccctagctttgtggcctgaactgtgggtggctgaggggatcgttaattgaatggggcagactgaggcttgtgaggaagatcagagtctggttcttgacatgagatgcccttcagacatctcttcactcaggtccaactagggatacagaaacactgaatatttcaacagcagaaattgaatggggggattgatagcgctggcgagggaagcagctggaaagagacagatggcaccctgagacagcccagaggtgaataggacccccaggctgcagggataaagctcagtggtggtgttacctcaccggggaccagggtcacacagcaaagctggaacaacagaggcgtgttgtgggggagcctcagaggggacaaaacctctgcctgagatcccaccccaggtgggcatgggggccactgaggttggggatgaaaatgccggtaccgtcagtgcacagccctgttccagacagtgctgcctggaagatttctgggctctcctgaggcgccaccccgcacctgagccacctccttggactcctgtcctctaccccttgaggacctccctcccttctaccctagctgtcttcttgaacttgggactctcctttcccaagacttccatcactagctcctggagggactggactttgcatcttcccttcgcgtggagcctcagtgtgagaggccctagccaatgcgtgcatgtcagaggtggtggggaccacatcagaagaagaggggggtgatgaaattaacaaataaaaagtatggggaaaaccaaaaaaaa

SEQ ID NO: 25593 - DNA, 6237 bp, Homo sapiens
gtgatggcatctcacactgcaaccgcacgtgcttggaggactgtggccatggtgtgtgcagtggccccccggactttacctgcgtgtgtgacctaggctggacatcagacctgccccctcccacacccgccccgggtccgccagccccccgctgctcccgggactgtggctgcagcttccacagccactgccgcaagcggggccctggcttctgcgacgagtgccaggactggacatggggggagcactgcgaacgatgccggcccggcagcttcggcaacgccacaggctctaggggctgccggccctgccagtgcaacgggcacggggacccacgccgtggccactgcgacaacctcagtgggctctgcttctgccaggaccacaccgagggtgcccactgccagctctgctccccaggctattatggggatccccgggccggtggttcctgctttcgggagtgtgggggtcgcgccctcctcaccaacgtgtcctcagtggcactgggctcacgccgggtcggggggctgctgcctccaggtggcggggctgcaagagccgggcctggcctgtcctactgtgtgtgggttgtctcggccactgaggagctacagccctgtgctcccgggaccctctgtcccccactcaccctcaccttctcccccgacagcagcaccccctgcacgctgagctacgtcctggcgtttgatggattcccacgcttcctggacactggtgttgtccagtcggaccgcagcctcatagctgccttctgcggccagcgacgggacaggcccctcactgttcaggccctgtctgggctgctcgtgctgcactgggaggccaatggctcctcatcctggggcttcaatgcttcggtgggctctgcccgctgtgggtcagggggccccgggagctgtcccgtcccccaggaatgcgtgccccaggacggtgctgcaggtgcggggctctgccgatgtcctcagggctgggctggcccacactgccgcatggctctgtgtcctgagaactgcaatgcccacactggggcaggaacttgtaaccagagcctgggtgtgtgcatctgtgccgagggcttcgggggccccgactgcgccaccaagctggatggcgggcagctggtctgggagaccctcatggacagccgcctctcagccgacactgccagccgcttcctgcaccgcctgggccacaccatggtggatggacccgatgccaccttgtggatgtttgggggcctgggcctgccccaggggctgctgggaaacctgtacaggtactcagtgagtgagcggcggtggacacagatgctggcgggagccgaggacgggggcccaggcccatcgccccgctccttccatgcagccgcatatgtgcccgctggccgtggtgccatgtatctgctggggggacttaccgctggaggcgtcacccgtgatttctgggtcctcaacctcaccaccctgcaatggcggcaggagaaggccccccagaccgtggagctgccagccgttgctggtcacacccttactgcccgccgaggcctgtctctgctcctggtgggcggttactccccggaaaatggcttcaaccagcagctgctggagtaccagctggcaaccggcacctgggtgtcaggagcccagagtgggacaccccccacaggtctctatggtcactctgctgtctaccacgaggccaccgactccctctacgtgtttggggggttccgattccatgtggagctggcggccccatcccccgagctctactccctgcactgtcctgaccgcacctggagtctgctggccccttctcagggggcaaagcgagatcgtatgaggaatgtgcgtggctcatctcggggtctgggccaagttcctggggagcagcctgggtcatgggggttccgggaagtcaggaagaagatggctctgtgggctgctcttgctggtacaggaggtttcctggaggaaatctcacctcacctgaaggagccccgcccccggcttttccacgcctcagccctgttaggggacaccatggtggttcttggggggcgctcggaccctgacgagttcagcagcgacgttctgctctaccaggtcaactgcaatgcctggcttctgcccgacctcacccgctcggcctctgtggggcccccaatggaggagtctgtggcccatgctgtggcagcagtcgggagccgcctgtatatctctgggggtttcgggggagtggccctgggccgcctgctggcactgaccctgccccctgacccctgccgcctgctgtcctcacctgaagcttgtaaccagtctggggcctgcacctggtgccatggggcctgcttgtccggggatcaggcccacaggctgggctgcgggggctccccctgctccccaatgcctcgctccccggaggaatgtcgacgtctccggacctgcagtgagtgcctggcccgccatcctcggaccctgcaacctggagatggagaggcgtccaccccccgctgtaagtggtgtaccaactgccccgaaggtgcttgcattggacgcaatgggtcctgcacctctgagaatgactgtcggatcaaccagcgagaggtcttctgggcagggaactgctccgaggctgcgtgcggggctgctgactgcgagcagtgcacgcgggagggcaagtgcatgtggacgcggcagttcaagaggacaggggagacccgccgcatcctctccgtgcagcccacctatgactggacgtgcttcagccactctctgctgaatgtgtcccccatgccggtggaatcatcacccccactgccctgccccaccccttgtcacctcctacccaactgtacctcctgcctggactctaagggagcagatgggggctggcagcactgtgtttggagcagcagcctgcagcagtgtctgagcccttcctacctgcccctgcgatgtatggccggaggctgtgggcggctgctccggggacctgagagctgctccctgggctgtgctcaggcaactcagtgcgccttgtgcctgcggcgcccccattgcggctggtgtgcctgggggggccaggatgggggtggccgctgcatggagggtggactcagcggcccccgtgatgggctgacatgtgggcgtccgggggcctcctgggccttcctgtcctgcccccctgaggacgagtgtgcaaacgggcaccacgactgcaacgagacgcagaattgccacgaccagccccacggctatgagtgcagctgcaagaccggctataccatggacaacatgacagggctgtgccgccctgtgtgcgcccagggctgcgtgaacggctcatgtgtggagcccgaccactgccgctgccactttggctttgtgggccgcaactgctccacggaatgccgctgcaaccgccacagtgaatgcgctggtgttggggcgcgtgaccactgcttgctctgccgcaaccacaccaagggcagccactgtgagcagtgcctcccgctgtttgtgggttcagctgtcggaggcgggacctgccggccctgccacgccttttgtcgtggaaatagccacatctgcatctccaggaaggagttacaaatgtccaagggagagccaaagaagtactcactggacccagaggagattgaaaactgggtgacagagggtcctagtgaagacgaggccgtgtgcgtgaactgccagaataacagctatggggagaaatgcgagagctgcctgcagggctacttcctcctggacgggaagtgcaccaaatgccagtgtaatggccacgcggacacatgtaacgagcaggatgggacgggctgtccatgtcagaataacacagagacgggcacatgccagggcagctcccccagtgaccgtcgagactgctacaagtaccagtgcgccaagtgccgggaatcatttcacgggagtccgctgggcggccagcagtgctaccgcctcatctcggtggagcaggagtgctgcctggaccccacgtcccagaccaactgcttccatgagcccaaacgccgggcgctaggccccggccgcactgtcctctttggcgtgcagcccaaattcaccaacgtggacatccgcctgacgctggacgtgaccttcggggccgtggacctctatgtctccacctcctatgacaccttcgtggtccgtgtggcccctgacactggcgtccatactgtacacatccagccacccccagccccaccacctccaccaccccctgcagatggtgggccccggggggctggggatccaggaggagcaggggccagcagtgggccgggcgccccagcagagccacgggtacgggaggtatggccgcggggcctgattacctacgtgacggtgacggagccgtcggcagtgctggtggtccgcggcgtgcgggaccggctggtcatcacctacccacacgagcaccatgccctcaagtcgagccgcttctacctgctgctgctgggcgtgggagacccaagtgggcccggcgccaacggctcagccgactcgcagggcctgctcttcttccggcaggaccaggcccacattgacctgtttgtcttcttctccgtcttcttctcctgcttcttcctcttcctctcactctgtgtgctcctctggaaggccaagcaggctctggaccagcggcaggagcagcgccggcacttgcaggagatgaccaagatggccagccgccccttcgccaaggtcaccgtctgcttcccacctgaccctactgccccggcctccgcctggaagccggctgggctcccacctcccgccttccgccgctctgagcccttcctggcacccctgctgctgacaggggccggtgggccctggggacccatgggagggggctgctgcccaccagccatccccgccaccactgctgggctgcgagctgggcccatcactctcgagcccacagaagatggcatggctggcgtggccacactgctgctccagctgcctggcgggccccatgcacccaacggcgcctgcctggggtcagccctcgtcacactgcggcacaggctgcacgagtactgtgggggtggtgggggtgctgggggcagtgggcatgggactggtgcgggccggaagggactgttgagccaggacaacctcaccagcatgtccctctgacatgcccagggttctcatccacagcagctgggtcacctgatagggccgccctggacttggggtccctccacctgggggcccctggacactgtctacttggagaccactggcccccttcccccagggttgcccagatggggcctcctttgttctgcattcagcagctatttatcgagtacctactctgtcaggcactgtcataggcgtggggcaaagcaggaaccaagagacgaggttccctgatctcatgggacttaggttctggtgaagggagacaatcagtgcacatgcacacaccccacacgcatacacacatgaacacatgcacatgtgcacacacaagtaagatggcttcagagagggagaagcactgtgaggcctccagaggatgtggcagtgagggacgatggggtgaagtcagctgggcattcaaagaagctagactgagaacgcctgagaagaaccagctacgggaagagctttgggaagcaaaggcagaggccctggggtgggagcaggcttgttttattggaaggaccagaaaactggtaagtgtgacccagatcaagtgtgaggagatgaggctggggatagtcaggggctggatcacccagggccttgtgggccccacatagggttttgggttttattctcagggcaatgggaagctgttggatggtttgatgaaggggagtgacaggatccgatgtacctatttaagaatttaagagggtcgggtgcggtggctcatgcctataatcctagcactttgagaggccaaggtgggctgatcacaaggtcaagagttcgtgaccagcctggccaatatggtgaaaccccatgtctactaaaaatacaaaaattagctgggcatggtggcacacacttgtagtccgagctactcgggaggctgaggcagaagaatcgcttgaacccaggaggcggaggttgcagtgagctcagattgcgtcactgcactccaacctgggtgacagagcgagactccacctcaaaaaaaaaa

SEQ ID NO: 25594 - DNA, 5909 bp, Homo sapiens
gtgatggcatctcacactgcaaccgcacgtgcttggaggactgtggccatggtgtgtgcagtggccccccggactttacctgcgtgtgtgacctaggctggacatcagacctgccccctcccacacccgccccgggtccgccagccccccgctgctcccgggactgtggctgcagcttccacagccactgccgcaagcggggccctggcttctgcgacgagtgccaggactggacatggggggagcactgcgaacgatgccggcccggcagcttcggcaacgccacaggctctaggggctgccggccctgccagtgcaacgggcacggggacccacgccgtggccactgcgacaacctcagtgggctctgcttctgccaggaccacaccgagggtgcccactgccagctctgctccccaggctattatggggatccccgggccggtggttcctgctttcgggagtgtgggggtcgcgccctcctcaccaacgtgtcctcagtggcactgggctcacgccgggtcggggggctgctgcctccaggtggcggggctgcaagagccgggcctggcctgtcctactgtgtgtgggttgtctcggccactgaggagctacagccctgtgctcccgggaccctctgtcccccactcaccctcaccttctcccccgacagcagcaccccctgcacgctgagctacgtcctggcgtttgatggattcccacgcttcctggacactggtgttgtccagtcggaccgcagcctcatagctgccttctgcggccagcgacgggacaggcccctcactgttcaggccctgtctgggctgctcgtgctgcactgggaggccaatggctcctcatcctggggcttcaatgcttcggtgggctctgcccgctgtgggtcagggggccccgggagctgtcccgtcccccaggaatgcgtgccccaggacggtgctgcaggtgcggggctctgccgatgtcctcagggctgggctggcccacactgccgcatggctctgtgtcctgagaactgcaatgcccacactggggcaggaacttgtaaccagagcctgggtgtgtgcatctgtgccgagggcttcgggggccccgactgcgccaccaagctggatggcgggcagctggtctgggagaccctcatggacagccgcctctcagccgacactgccagccgcttcctgcaccgcctgggccacaccatggtggatggacccgatgccaccttgtggatgtttgggggcctgggcctgccccaggggctgctgggaaacctgtacaggtactcagtgagtgagcggcggtggacacagatgctggcgggagccgaggacgggggcccaggcccatcgccccgctccttccatgcagccgcatatgtgcccgctggccgtggtgccatgtatctgctggggggacttaccgctggaggcgtcacccgtgatttctgggtcctcaacctcaccaccctgcaatggcggcaggagaaggccccccagaccgtggagctgccagccgttgctggtcacacccttactgcccgccgaggcctgtctctgctcctggtgggcggttactccccggaaaatggcttcaaccagcagctgctggagtaccagctggcaaccggcacctgggtgtcaggagcccagagtgggacaccccccacaggtctctatggtcactctgctgtctaccacgaggccaccgactccctctacgtgtttggggggttccgattccatgtggagctggcggccccatcccccgagctctactccctgcactgtcctgaccgcacctggagtctgctggccccttctcagggggcaaagccccgcccccggcttttccacgcctcagccctgttaggggacaccatggtggttcttggggggcgctcggaccctgacgagttcagcagcgacgttctgctctaccaggtcaactgcaatgcctggcttctgcccgacctcacccgctcggcctctgtggggcccccaatggaggagtctgtggcccatgctgtggcagcagtcgggagccgcctgtatatctctgggggtttcgggggagtggccctgggccgcctgctggcactgaccctgccccctgacccctgccgcctgctgtcctcacctgaagcttgtaaccagtctggggcctgcacctggtgccatggggcctgcttgtccggggatcaggcccacaggctgggctgcgggggctccccctgctccccaatgcctcgctccccggaggaatgtcgacgtctccggacctgcagtgagtgcctggcccgccatcctcggaccctgcaacctggagatggagaggcgtccaccccccgctgtaagtggtgtaccaactgccccgaaggtgcttgcattggacgcaatgggtcctgcacctctgagaatgactgtcggatcaaccagcgagaggtcttctgggcagggaactgctccgaggctgcgtgcggggctgctgactgcgagcagtgcacgcgggagggcaagtgcatgtggacgcggcagttcaagaggacaggggagacccgccgcatcctctccgtgcagcccacctatgactggacgtgcttcagccactctctgctgaatgtgtcccccatgccggtggaatcatcacccccactgccctgccccaccccttgtcacctcctacccaactgtacctcctgcctggactctaagggagcagatgggggctggcagcactgtgtttggagcagcagcctgcagcagtgtctgagcccttcctacctgcccctgcgatgtatggccggaggctgtgggcggctgctccggggacctgagagctgctccctgggctgtgctcaggcaactcagtgcgccttgtgcctgcggcgcccccattgcggctggtgtgcctgggggggccaggatgggggtggccgctgcatggagggtggactcagcggcccccgtgatgggctgacatgtgggcgtccgggggcctcctgggccttcctgtcctgcccccctgaggacgagtgtgcaaacgggcaccacgactgcaacgagacgcagaattgccacgaccagccccacggctatgagtgcagctgcaagaccggctataccatggacaacatgacagggctgtgccgccctgtgtgcgcccagggctgcgtgaacggctcatgtgtggagcccgaccactgccgctgccactttggctttgtgggccgcaactgctccacggaatgccgctgcaaccgccacagtgaatgcgctggtgttggggcgcgtgaccactgcttgctctgccgcaaccacaccaagggcagccactgtgagcagtgcctcccgctgtttgtgggttcagctgtcggaggcgggacctgccggccctgccacgccttttgtcgtggaaatagccacatctgcatctccaggaaggagttacaaatgtccaagggagagccaaagaagtactcactggacccagaggagattgaaaactgggtgacagagggtcctagtgaagacgaggccgtgtgcgtgaactgccagaataacagctatggggagaaatgcgagagctgcctgcagggctacttcctcctggacgggaagtgcaccaatgcgccaagtgccgggaatcatttcacgggagtccgctgggcggccagcagtgctaccgcctcatctcggtggagcaggagtgctgcctggaccccacgtcccagaccaactgcttccatgagcccaaacgccgggcgctaggccccggccgcactgtcctctttggcgtgcagcccaaattcaccaacgtggacatccgcctgacgctggacgtgaccttcggggccgtggacctctatgtctccacctcctatgacaccttcgtggtccgtgtggcccctgacactggcgtccatactgtacacatccagccacccccagccccaccacctccaccaccccctgcagatggtgggccccggggggctggggatccaggaggagcaggggccagcagtgggccgggcgccccagcagagccacgggtacgggaggtatggccgcggggcctgattacctacgtgacggtgacggagccgtcggcagtgctggtggtccgcggcgtgcgggaccggctggtcatcacctacccacacgagcaccatgccctcaagtcgagccgcttctacctgctgctgctgggcgtgggagacccaagtgggcccggcgccaacggctcagccgactcgcagggcctgctcttcttccggcaggaccaggcccacattgacctgtttgtcttcttctccgtcttcttctcctgcttcttcctcttcctctcactctgtgtgctcctctggaaggccaagcaggctctggaccagcggcaggagcagcgccggcacttgcaggagatgaccaagatggccagccgccccttcgccaaggtcaccgtctgcttcccacctgaccctactgccccggcctccgcctggaagccggctgggctcccacctcccgccttccgccgctctgagcccttcctggcacccctgctgctgacaggggccggtgggccctggggacccatgggagggggctgctgcccaccagccatccccgccaccactgctgggctgcgagctgggcccatcactctcgagcccacagaagatggcatggctggcgtggccacactgctgctccagctgcctggcgggccccatgcacccaacggcgcctgcctggggtcagccctcgtcacactgcggcacaggctgcacgagtactgtgggggtggtgggggtgctgggggcagtgggcatgggactggtgcgggccggaagggactgttgagccaggacaacctcaccagcatgtccctctgacatgcccagggttctcatccacagcagctgggtcacctgatagggccgccctggacttggggtccctccacctgggggcccctggacactgtctacttggagaccactggcccccttcccccagggttgcccagatggggcctcctttgttctgcattcagcagctatttatcgagtacctactctgtcaggcactgtcataggcgtggggcaaagcaggaaccaagagacgaggttccctgatctcatgggacttaggttctggtgaagggagacaatcagtgcacatgcacacaccccacacgcatacacacatgaacacatgcacatgtgcacacacaagtaagatggcttcagagagggagaagcactgtgaggcctccagaggatgtggcagtgagggacgatggggtgaagtcagctgggcattcaaagaagctagactgagaacgcctgagaagaaccagctacgggaagagctttgggaacaggcttgttttattggaaggaccagaaaactggtaagtgtgacccagatcaagtgtgaggagatgaggctggggatagtcaggggctggatcacccagggccttgtgggccccacatagggttttgggttttattctcagggcaatgggaagctgttggatggtttgatgaaggggagtgacaggatccgatgtacctatttaagaatttaagagggtcgggtgcggtggctcatgcctataatcctagcactttgagaggccaaggtgggctgatcacaaggtcaagagttcgtgaccagcctggccaatatggtgaaaccccatgtctactaaaaatacaaaaattagctgggcatggtggcacacacttgtagtccgagctactcgggaggctgaggcagaagaatcgcttgaacccaggaggcggaggttgcagtgagctcagattgcgtcactgcactccaacctgggtgacagagcgagactccacctcaaaaaaaaaa

SEQ ID NO: 25595 - DNA, 1736 bp, Homo sapiens
gtgatggcatctcacactgcaaccgcacgtgcttggaggactgtggccatggtgtgtgcagtggccccccggactttacctgcgtgtgtgacctaggctggacatcagacctgccccctcccacacccgccccgggtccgccagccccccgctgctcccgggactgtggctgcagcttccacagccactgccgcaagcggggccctggcttctgcgacgagtgccaggactggacatggggggagcactgcgaacgatgccggcccggcagcttcggcaacgccacaggctctaggggctgccggccctgccagtgcaacgggcacggggacccacgccgtggccactgcgacaacctcagtgggctctgcttctgccaggaccacaccgagggtgcccactgccagctctgctccccaggctattatggggatccccgggccggtggttcctgctttcgggagtgtgggggtcgcgccctcctcaccaacgtgtcctcagtggcactgggctcacgccgggtcggggggctgctgcctccaggtggcggggctgcaagagccgggcctggcctgtcctactgtgtgtgggttgtctcggccactgaggagctacagccctgtgctcccgggaccctctgtcccccactcaccctcaccttctcccccgacagcagcaccccctgcacgctgagctacgtcctggcgtttgatggattcccacgcttcctggacactggtgttgtccagtcggaccgcagcctcatagctgccttctgcggccagcgacgggacaggcccctcactgttcaggccctgtctgggctgctcgtgctgcactgggaggccaatggctcctcatcctggggcttcaatgcttcggtgggctctgcccgctgtgggtcagggggccccgggagctgtcccgtcccccaggaatgcgtgccccaggacggtgctgcaggtgcggggctctgccgatgtcctcagggctgggctggcccacactgccgcatggctctgtgtcctgagaactgcaatgcccacactggggcaggaacttgtaaccagagcctgggtgtgtgcatctgtgccgagggcttcgggggccccgactgcgccaccaagctggatggcgggcagctggtctgggagaccctcatggacagccgcctctcagccgacactgccagccgcttcctgcaccgcctgggccacaccatggtggatggacccgatgccaccttgtggatgtttgggggcctgggcctgccccaggggctgctgggaaacctgtacaggtactcagtgagtgagcggcggtggacacagatgctggcgggagccgaggacgggggcccaggcccatcgccccgctccttccatgcagccgcatatgtgcccgctggccgtggtgccatgtatctgctggggggacttaccgctggaggcgtcacccgtgatttctgggtcctcaacctcaccaccctgcaatggcggcaggagaaggccccccagaccgtggagctgccagccgttgctggtcacacccttactgcccgccgaggcctgtctctgctcctggtgggcggttactccccggaaaatggcttcaaccagcagctgctggagtaccagctggcaaccggcacctgggtgtcaggagcccagagtgggacaccccccacagtttatgtcactctgctgtctaccacgccacccctgctggtacgagcc

SEQ ID NO: 25596 - DNA, 395 bp, Homo sapiens
gaaaacaatgagatgatagccatttgtgtttacctgggagcttcactcagaaattaaacttgataggaagagggaatgtggagaggttgggcagcaagctgataatgacttggtacctgaagtttagagatgtggtcggagcaagtctgtcaataggaaataaaatttatagaaggaatttaaatataattcagggagcttttggggatttagtgttaaggatcaacatggtcaaaattacagcaggaaataatttgcattcaggatgcagactcacaaagaagccagggagaggcattttaggggaaagaatgtggttaccttacttactgtgtgttggatgggacacaccatagcacatcaacatacccacgttctgcaatggatgcaactta

SEQ ID NO: 25597 - DNA, 375 bp, Homo sapiens
atggtttcattcttttgcattgctgattaccctctccaaatgaggcaatcaggtatgcatttatctcggtgagcagatgggtgactttggatacaatgggaggcgggtttgccctaagcagttcccagcttgacttttccctttagcttagtgattttgattccccaagatttattttcccttcataaggttttcctatgagcattaattattcattgtgtattttatcacacaaataaggcacagatttttaaaaaatcatcaacttcctggctacctatatagacataattacatagaagctcaactaaatttgcaaacattccagagtttgggtttccaataattctttgtgattctttaaaaggtaaagta

SEQ ID NO: 25598 - DNA, 802 bp, Homo sapiens
gtataattcaatgactggctttgccgcgtctttgtactgtcttagcctggcagcaactgcttcgggtttatcatcctcctgctggactaatggttcaccagtgacgtcatcaataccatgtacatgaggtggattgaagtccaggttatatacccttccgctaggagggtgaatccaacggcggctgagacgatattttgtccagggcttcggcttgtcctaatgtcctaggaaaaccatcaaggagccagtgctggccacgcctattctccaactcggacatcattaggcgtgtgatcacatggtctggaaccaaaagacttttctctatatactgctttgccatctcaccaacttcggtgctggccttgatgttctcccgcaagaagtggccgctggagagatgctggagaccaaagttctgggcgatcctctggcacacggtgcccttgcccgagccgggcggcccgaggatgaccgcgcgcaggagtttggaagccattgccttcgcgaggaggggggcggtcaaacgcgcagccccgaccgcggccccggagggagccccaggaactttgtttctcggccccctacctctggcaccctccgctctcactgggactcgccggccgcccctacagggggaaggcggtcttgatttcttaatctcatgcttcagtctcctcacctgcaaaatgagaatggtgataataggacctacattagggatgtgatattgtgaaatatttatttggtcttcctaccatctcctggcataaaatctttggaatctcccaagtgataa

SEQ ID NO: 25599 - DNA, 593 bp, Homo sapiens
aaaaaaccccccagaaccacagaatgttcatggtacatgctacagtaagcctacttgcatgaattatttctcccaggaatgtctaacaacaaaatcttttttaaaaaaacaaaggatatatgtacacaagttcttatagtgttgtcatttatttcagacaaggtctcactttgtcacctgggctggaatggagtggcacaacctcaacctcctgggccgaggcgatcctcccacttcagcctccctaggactacaggtgcgcccattacactcagctaatgtttacattttttgtagatacctggtttcgccatgttgcccaggctggtctcgaactcctgggctcaagtgatccacatgccttggtctcccaaagtgctgggattgcaggtgtgagccactgtgcccagctccatcatttataatagcaaaaaccaggaaatggctttaactcgagcaggagtagggaaccacagcgtgccagtgtggcctgccctagagtgaggcggcctccactgcctgggcagtgagggtaaactcagtctctttttcagaaagtgcattctccattttttgattgagacaagaagctg

SEQ ID NO: 25600 - DNA, 320 bp, Homo sapiens
aggggctcaggggcaggggcttggaagagatattgatcaaaggatgtgaaatttcagttagataggaggaataagttcaagagatctatagtataacggagttactattgttaatagctgtatattatattcctgataattgctacaagagtagcttttgcattctcaccacaaaaaaaaattatgtgaggtaatgagtatgtgaattagcctgatttagccatgtgctacctgataaatatgtacgacttgtatttgtcagcataaaaataattttaaaagacttgcatttctgagtatttcattcggaagattttaca

SEQ ID NO: 25601 - DNA, 478 bp, Homo sapiens
aggaggcactatagatatctgtacaggtaagagacaatctagtgcatatgaaaaagaagaaaagactggctgaaaaatattcttcctagatatattcgttagcaagaatattttttaaatctacatctgctgtgtgtctgtaaaatgactgacagtggtactgtaattaaaaaatatatatttatgtaaatatagtgacacttatagtctggcggatggattgcccagttgttcaaaagtataattgagtatacgattggattctggctttctgcttaggaaatagaaatagaattttataaagacccaatttacttagaaaggaaaaggcaaagggaaagatggggcaactagaaatacagaaaagagatgttaagaaatgtgagttgtgtttaaccagttatgtgccaagtatggaagaaaaaaaaggtggaggacagttagtgaatgacagatttctatgaagaatgttttgcta

SEQ ID NO: 25602 - DNA, 1113 bp, Homo sapiens
ttaaactgccccacagaaggcgaaaggaatgcttgaggctggaccacgtgggtctagcgtgtactgcgtttctggtccccagcccctgttttaccttttgctcctcctgccccatcaaccaagtgtcttcatttgtttctatggcaattaacttttggagatagaagtcccagcacacgagatccccaagcacattatctaccttgctgaacaggctggcagtcacacatgagccaggcgacccagggaaatgccagcccaaacaaagctgctgccacatccagagagggccggactctttctcccttgtagtcactcaagctaatcatccaaaacctgcatcctccatctccaagccccatcttattagcaccatctgggattgccaaccaagaaactgttttatctgagaactctaagaccaaagaacaagatttatttcctctactacagatttggcagtgacgcataaaaggcccatttctcaggaagaatacatgtcctaaggatgtaaaaaagaaaaaaatattagatctagttaccatggtctataaactggtcttttcccgccccaccctgatcctggcttctgtccaccctcaaatagctgtttgttcataaaccctaaatactagataattctaagttggaaggagacctctaagtcactgtagcatttccaaatcgccattcccaagagacatgtggatctgacatcgtgttttattcttgactgagcctcgcatatttgttctgtgtggaacaaaggcaaaggcagcccaagaacccgggtccttgcctacagtcagctttaggaaatgattgtgaacttgggaagcatttaaatagcaatactagacagtaaatggaaaaggccaaagtcagaaaataagtagggattccaaaggaagcctttattggttgggctaggctgggctagctgtggaagatagacttctatgtccctgccccaaccacaattttactttaattattatgtaattagtgaatcgatgtctgtcaccgtctgtagatgctgaggtcttgttcatctctttatttgcattgatatacatagccattgctcaataaatatgtgacccatgaaaaaaa

SEQ ID NO: 25603 - DNA, 332 bp, Homo sapiens
gaaaaacaaatgttaaccattcccccaaaagtccaagactgagatgactttggtagggaagtgtgtgcacacaagcactgtcttagtccatttgtgctgttataagaaaatacctgagaaatagcctgagacaaggtaatttataaagaacagaaatgtattttctcacagttctggaggcttggaagtccaagatcaaggtgctggtaggttgagtgactggtgagggcccctgtctctgattccacaatggccatcttgttgctggttcctcacatgttggaggatggaaaagcaaaagggcccagctaattctctccagccccttaata

SEQ ID NO: 25604 - DNA, 446 bp, Homo sapiens
cacatacacttacccagttttgcccaacaggagcatgttgcagaactgtagtataatatcacaaacagttgttatcattgataagccaagatacagaatatttccatcatctcaaggacccctcatgttgctttttataatgacttcaagaccctcttaaccctgacatctgccactctgttctttatttctgtaattttgctatttcaaaacaacaagaagttgtaatttttcccttgatatacctatacaagctaagactctcaaatatcttacctttagtttgggaatatattaatttattgagccaattggttcttatgtgcatcagaatttctgaccagcagtttttttggtctttgattaataaaacaaatgtgaattaataagtccaggtgattaatacagtttttcaaatgggatagtctgataagggtggtggcagc

SEQ ID NO: 25605 - DNA, 809 bp, Homo sapiens
ctcagtttatcagttctagtgctaacgtggcctgttttagcggtgtctcccattctgtgttctctggaaagacaagttaaaggggagagtttgtattaacaggtgtcacgtcttctcactctcgccatatccctgtaccttctggtagatgtaaacggacacaactgtgcttataaaaccaataactcgccagtcttcctcaggtccattcaagaccatttgagtgggtccttgggtgccatggacagaaatcttgtggggacatggatgaggggggcctccagccctgcaggactgtcaagaccagggccttggggaagggcagccgagcttcacattgtccccacttagccacttgtcagggttgctgtgaggctccagatgaaaatacatggagtttccttaactaccgtggcccacagaaatgacacatgagattcttttccttggtcgtaggatactgggggcggggtcagtgagaggcactgtccatctcagaaaaatctgtatcactcttgtttgctcatcttgaggaagccatggagagcacagtttctatggagtcagcagaaacaaaaatgagattaattcacacgtaaattctgcctttagatacagagacctaggttataggatcttgactgtatacacagttaagccatttgtagagttttccctatttgggggtagtttttgttctgattttttttttcagaggggatgtttgccaaattctttctagattataaaattaatacaaactctcataaaagtgaatacactaaaatataaagaagaaaaaaaaaatc

SEQ ID NO: 25606 - DNA, 323 bp, Homo sapiens
tttttaaaaaggaagacttatagaagccacagcagtcctcaaagtgtagtcccagaaccagcagcatcacctataaactagttagaaatgcaaattctcagaccccaacccaggcctaaagaatggcaaactcagcatgggcaaaaccctatctctgtgaaaaataaaaaaattagctgggcgtggtggtgcacgcctgtagtcccagctactaaggaggctgaggtgggaggatcacttgagcctgggaggtcaaggctgcaatgagctgtgatagcaccacagcactccaacctgggagaaagagtgagaccctgtctcag

SEQ ID NO: 25607 - DNA, 428 bp, Homo sapiens
agtgttcatgaggagcatcattcacagtggcccaaaaatggaaaccacccaaatgtctatcaactgatggataggtaaacaaagtgtagtgttttcatacaatagaatactattaggcaataaaaatgaaggaagtactgaatcaggctgcagcatgcatgaacctcaaaatgttatgctaagtgaaagaagccagacacaatgattgcatattgtatgattctgtatatatgaaatgtctagaaaatgcaaatctacggaggtagaaagtagattactggttggctagggtggagaggaaaacagggagtgcctgtaaatgggccggagggatctttttgggtgatgaaaatgcttcaatattggatggtggtaacctgagtgaattttatggtatgtaagtacctcaataaaggtgttaaagtata

SEQ ID NO: 25608 - DNA, 184 bp, Homo sapiens
ccttgggaacggaggagtaaggactgcccttctagtggaggaagactttaagcctcctctaaacctctctgcaaccagagccctgaaggaacagccaccactctcaggacaggcctcagctctgcagggtctcccagcaccaggtaccaggctcctgccaggctccacacaggctccacccttc

SEQ ID NO: 25609 - DNA, 354 bp, Homo sapiens
acgtctggagcatcctgcctggtctgtactgcaatgcctcatgaagttttctctccttaagagttgggcatcttggccaggcgcggtggctcacgcctgtaatcccagcactttgggaggccgaggcgggtggatcacgagatcaagagattgagaccatcctggccaacatggtgaaaccccgtcttactaaaaatacaaaaattaaccagtcatggtggcacacgcctgtagtcccagctacttgggaggctgaggcaggagaatctcttgaacctgggaggcaggggttgcagtgagcggattttgcaccactgcactccagcctgggcaacagagtgagactctgtctca

SEQ ID NO: 25610 - DNA, 472 bp, Homo sapiens
ttttattaaacctatgagtaagcagctcatcctaattgcgaagagtgttttggagttcactggatttggttgacctttgtggaacacaaataatgaaggagcagaacattgacaagctaagatgaaattctgacatagtacatctctgccaaaaaccacacaccctctgtggatatggatatgaattcccagattttatatactcttgaataaaaggtttatttttatttataagtgggcataaaataagaaatgtccatgcagccatttttccaacagatgctgtacaccgttcattttatatagactagggagattcaaatacagtgcattttctattggtatttgttctgtgcatttttagcaacttctaccagcaaataaagtattctcagtaaaacgaaaatgattctcaagttatcagtttgcaaaaaaaaacacttatttcatgccctgccaaattcaagttaca

SEQ ID NO: 25611 - DNA, 594 bp, Homo sapiens
  misc_feature (151)..(151): n is a, c, g, or t
  misc_feature (172)..(173): n is a, c, g, or t
  misc_feature (200)..(200): n is a, c, g, or t
  misc_feature (212)..(213): n is a, c, g, or t
  misc_feature (218)..(219): n is a, c, g, or t
gcgtcgatcgtgttgcaggtgagctgaagatgcacacgcacgtgcgaatagggagacagcatctcgggtcatacgagcatccctagcgttgacgagcagcgagatgagacgggatgatgttcgtggcatttcgcatcatggagtgtacctngaggatcgatcgtgcacgtgnngggaaagtgaccagactaatgtgggcngctaggccatgnntgtgnntgtgcagcacctgtgcgcgagccgagagcagggcgatggcattgcctcactctgggaagcgcaaggggtcagggagttccctttccgagtcaaagaaaggggtgatggacgcacctggaaaatcgggtcactcccacccgaatattgcgcttttcagaccggcttaagaaacggcgcaccacgagactatatcccacacctggctcagagggtcctacgcccacggaatctcgctgattgctagcacagcagtctgagatcaaactgcaaggcggcaacgaggctgggggaggggcgcccgccattgcccaggcttgcttaggtaaacaaagcagccgggaagctcgaactgggtggagcccaccacaactcaag

SEQ ID NO: 25612 - DNA, 340 bp, Homo sapiens
cccagcaaatatttttatgtttttgtcttacctttctctttctctaacttaaagtgttgcatctcgggaatgtgcaacacataaagcaacctgccaaaggaagtggtcccctctggagaagaacaacataatttctgccagcttctgttatcaaaagcacagtcctttcatgtgatcttaagtcggagtagaaggggttgcacatttttattattatttttatgtaatttgtttttagcatggaagcagaaaaacattgttatatccagccatatggataatttgagctagccacaatatataaaacttcagagaacaagacaggatgaggagacggtag

SEQ ID NO: 25613 - DNA, 485 bp, Homo sapiens
tggcagtgatatgtaaagggtctggagaaggagaagctgggagaagaaagtctacagttatagcgcagaagagtggtcctaaaagcctaaaccaggatattgatatttgagataaagataagactatccaaaatgctccttccttttcctaaatatcccaactgtaagacttacacatatttctcaagttgtataaaatcttctcaatgtcctctacgtccttagcccatcagtccatcttattttcatgttaaactcttctgtgcatcatgtcaggctcagtgattgtggagcgagtaatagctctcttttactgtactttgagaatgggtagaatcaagagggtgagtgcaatattggtttatacaacttggtatagcctaagttggtaagcattttcttttaccctaagttacaaagtgtgtgcactttggatagatacatgactactttattgtagaggcacaggtttgagaagggagata

SEQ ID NO: 25614 - DNA, 415 bp, Homo sapiens
tgagatcatgtggctcttccagtgacgttgtctgtaggcactcagaatggtccagcgtttgacataccaatgtaggctttcctacaatacagcgtccaacaaaactagactgccccgaacccctggtaatagaattgtttacctttataccaagaaggttgggaaagcaccaagatctgcaagtggcatgtgcccaggaagacttcgaggggttcgtgctgtaagacctaaagttcttatgaaattgtcaaaaagaaagaaacatgtcagcagggcctatggtggttccatgtgtgctaaatgtgttcgtggcaggatcaagcgtgctttccttatcggggagcagaaaatcgttgtgaaagtgttgaaggcacaagtacaaagtcacaaagctaaataaaattgaaactttttt

SEQ ID NO: 25615 - DNA, 643 bp, Homo sapiens
gaaaataagccaaagtgatttcgtttttgttttaggaatcaatactgtattagtttcttagggttgctgtaacaaaactgggtttttgccacccataaactgggtggcttaaaataacagaaatgtattttctcatagctctgaagggtagaagtctgaaatcaaggtgtcatggggccatactccctccggaggttctgaagaagaatccctccttgcttcctcctggcttctagtggtggccagcaatgcttggccttccttagcttgcagctacgtcactctaatctcggcttccaccatcatatgaccttttctgtatctctgtcttcacatgccttttttatgaggataccggttggatttagggcccactctaattcagaaggacctcatcttaacttgatcatatctgcagtgctcttatttctaaataaggtcacattcatagattccaggtggacatgaattttagggggacagtagttatatactgtgcatcacaacacttagaaccaagtaagttgggtttgcttcacattaatagtcttaactataaaaatattttggatttttatttttatttatttgttgttttttttttaaacagagcctgggtgacacagtgagaccccgtctccaa

SEQ ID NO: 25616 - DNA, 321 bp, Homo sapiens
tattgaataaagtgaaaaccaatttcatagacattatttttattaaaaaatagtgatgagtaggaaaataatatagtcacatgatttaaaattcaaagtagaccaggcactacggttcatccctgtaattccaacactttgggaggctgacgtgggagaatcacttgaggccaggagttcaagaccaacctgggcaatatagtgggacccccatctctacaaaaaaattttttttttaattagctgggcatggtggtagctgtagtcccagctactcaggaggctgagatgagaggatcacttgagcctggtgggggtcga

SEQ ID NO: 25617 - DNA, 189 bp, Homo sapiens
gaattgaagtgtatttataataagctagcagttttgatttttatgtattttttagttgtgctgtaatgggccatcaaaaaatgacaatttggtaatttttaggatttcctactggccttatgtggcaggtactagatatcattatatgtatttcatctttctgaccaaaagaggcttttttagaggaag

SEQ ID NO: 25618 - DNA, 283 bp, Homo sapiens
ttttttaagataaaaatctcgctgtgtcactaagactggggtgccatggcacgatcacaacgcactgagacctggaactcctaggtcaagaaatcgtcctgcctcagggcctctagtagctaagactacaagtgcatgccaccatacccactaattttttttccatgtagacagggtatcactttgttgcccaggcttatcttgaacccctgggccaaagcaaccatcctgcttcagcctcctaaatagctggaattataggtgtgggccaccacccctggct

SEQ ID NO: 25619 - DNA, 682 bp, Homo sapiens
tttgtcacttccagctggatctaccatgaaagacttctgaatccaggaaaagagactgactgggtaacatgttattcagggtctccctctcttttccaaggctggagtgtagtagtgctatcacagctgactgcagcctcaaccttccaggctgaagcgatcctcccatctcaacctcccacgtggctgagactataggtgcttgccactatgcccaactaatatttggaattttcctatacatggattccagaggggtgacagcaaaacgtgggaccatccagttgcaggaaaacaagcttaacacgcccactgattctacattatgctcctacctcccggcagcctctccaggcccagaactttctccagtcagcctcggcagaccaagctcatgactcacaatggcctatttaggcccataccctacctcacggcagtctccgcagatgaggcctactgcctcacaacagcctccacaggcacagctccatcgttacaatggcctctttagacccagctcctgcctcccagccttctctccaggccctgaacttcctcaagtcgacctcaccaggcccagctcatgcttcttggcagcctctccaggcccagctcctgcatcttggcagcctctccaggcccagcctctgcctcccgtcagcctctacagtcccaacat

SEQ ID NO: 25620 - DNA, 528 bp, Homo sapiens
gtcactttctcccatcacgctcaggtgggaccatccagttgcaggaaaacaagcttaacacgcccactgattctacattatggtgagttgtataattattttattatatattacagtgtaataatggaaataaagtgcctaataaatgtaatgtgcttaaatcttttggcccagctcctacctcccggcagcctctccaggcccagaactttctccagtcagcctcggcagaccaagctcatgactcacaatggcctatttaggcccataccctacctcacggcagtctccgcagatgaggcctactgcctcacaacagcctccacaggcacagctccatcgttacaatggcctctttagacccagctcctgcctcccagccttctctccaggccctgaacttcctcaagtcgacctcaccaggcccagctcatgcttcttggcagcctctccaggcccagctcctgcatcttggcagcctctccaggcccagcctctgcctcccgtcagcctctacagtcccaacat

SEQ ID NO: 25621 - DNA, 714 bp, Homo sapiens
tttagaaatgcaattatagccttttacctcctcctcaccagatactctctacagggcaagttcatcaaactgtgtgcttagaagctctggagcagaactctcacccaccagaagattgcctcaagagataaaagatgatttacaacccaaagtatgcccactagaggttttggccatttttacaatgtattcctgcccatgaagatgccaacttgactgcccaatacataaagcaccaaagcaagtatgcggacccccccacacctcctcacttctgctcctgtgtagacccccatctttaaaagcacttactttctcctgcaaaagcaaatcagacccttacagcaggaaggcttttcttcttctcctaaactagctttggaataaaaagttattttctttataccagacctcactcgtgttaattggaccctgcaaatggcatgtgactgaacctgtgtttggttacattatctttagtttctagtgaaaccaagcatcccctgattctaacttccttgttattgttttaggttactattaccttcttgtttatcaagttcacatttacttcttagggctagctaggtgcctggaatttcccttgaaagaactcaggattttccttggtttctatgcttgggggactacagggccctaaaagggggcccctcctctgtctcaacaccctaattcccagaatctgtttggaac

SEQ ID NO: 25622 - DNA, 2453 bp, Homo sapiens
aaatccttcttccaatgttcctcccctctctgtatgaaccctgtgttggggggcagaagatggaagcccttggcaagctcgatcgaaccaagctactaaattgctgagctcgttttaactgaagtgtgagaaggaggtttaaggcaagtagacaacatcctgttgttggggtgcttctctcttttttgcacatctggctgaactgggagtcaggtggttgacttgtgcctggctgcagtagcagcggcatctcccttgcacagttctcctcctcggcctgcccaagagtccaccaggccatggacgcagtggctgtgtatcatggcaaaatcagcagggaaaccggcgagaagctcctgcttgccactgggctggatggcagctatttgctgagggacagcgagagcgtgccaggcgtgtactgcctatgtgtgctgtatcacggttacatttatacataccgagtgtcccagacagaaacaggttcttggagtgctgagacagcacctggggtacataaaagatatttccggaaaataaaaaatctcatttcagcatttcagaagccagatcaaggcattgtaatacctctgcagtatccagttgagaagaagtcctcagctagaagtacacaaggtactacagggataagagaagatcctgatgtctgcctgaaagccccatgaagaaaaataaaacaccttgtactttattttctataatttaaatatatgctaagtcttatatattgtagataatacagttcggtgagctacaaatgcatttctaaagccattgtagtcctgtaatggaagcatctagcatgtcgtcaaagctgaaatggacttttgtacatagtgaggagctttgaaacgaggattgggaaaaagtaattccgtaggttattttcagttattatatttacaaatgggaaacaaaaggataatgaatactttataaaggattaatgtcaattcttgccaaatataaataaaaataatcctcagtttttgtgaaaagctccatttttagtgaaatattattttatagctactaattttaaaatgtcttgcttgattgtatggtgggaagttggctggtgtcccttgtctttgccaagttctccactagctatggtgtcataggctcttttgggatttttgaagctgtatactgtgtgctaaaacaagcactaaacaaagagtgaaggatttatgtttaattctgaaagcaaccttcttgcctagtgttctgatattggacagtaaaatccacagaccaacctggagttgaaaatcttataatttaaaatatgctctaaacatgtttatcgtatttgatgctacaggatttgaaattgtattacaaatccaatgaaatgagtttttcttttcatttacctctgccccagttgtttctactacatggaagacctcattttgaagggaaatttcagcagctgcagctcatgagtaactgatttgtaacaagcctccttttaaagtaaccctacaaaaccactggaaagtttatggttgtattattttttaaaaaaattccaagtgattgaaacctacacgagatacagaattttatgcggcattttcttctcacatttatatttttgtgattttgtgattgattatatgtcactttgctacagggctcacagaattcattcactcaacaaacataatagggcgctgagggcatagaagtaaaaacacctggtccctgctctcagttcactgtcttgttggacgagaaaagaaacaataacgataaaagacagtgaaagaaaataacgataaaagacagtgaaagaaaataacaataaaagacaaggaaaaaataacaatgaaagttgataagtacatgataagcgaggttccccgtgtgtaggtagatctggtctttagaggcagatagataggtcagtgcaaatactctggtccatgggccatatgaaaaggctaagcttcactgtaaaataataactgggaattctggattgtgtatgggtgttggtgaacttggttttaattagtgaactgctgagagacagagctattctccatgtactggcaagacctgatttctgagcatttaatatggatgccgtgggagtacaaaagtggagtgtggcctgagtaatgcattatgggtggtttaccatttcttgaggtaaaagcatcacatgaacttgtaaaggaatttaaaaatcctactttcataataagttgcataggtttaataatttttaattatatggcttgagtttaaattgtaataggcgtaactaattttaactctataatgtgttcattctggaataatcctaaacatatgaattatgtttgcatgttcacttccaagagcctttttttgaaaaaaagctttttttgaatcatcaagtctttcacatttaaataaagtgtttgaaagctttattt

SEQ ID NO: 25623 - DNA, 2484 bp, Homo sapiens
aaatccttcttccaatgttcctcccctctctgtatgaaccctgtgttggggggcagaagatggaagcccttggcaagctcgatcgaaccaagctactaaattgctgagctcgttttaactgaagtgtgagaaggaggtttaaggcaagtagacaacatcctgttgttggggtgcttctctcttttttgcacatctggctgaactgggagtcaggtggttgacttgtgcctggctgcagtagcagcggcatctcccttgcacagttctcctcctcggcctgcccaagagtccaccaggccatggacgcagtggctgtgtatcatggcaaaatcagcagggaaaccggcgagaagctcctgcttgccactgggctggatggcagctatttgctgagggacagcgagagcgtgccaggcgtgtactgcctatgtgtgctgtatcacggttacatttatacataccgagtgtcccagacagaaacaggttcttggagtgctgagacagcacctggggtacataaaagatatttccggaaaataaaaaatctcatttcagcatttcagaagccagatcaaggcattgtaatacctctgcagtatccagttgagaagaagtcctcagctagaagtacacaaggtactacagggataagagaagatcctgatgtctgcctgaaagccccatgaagaaaaataaaacaccttgtactttattttctataatttaaatatatgctaagtcttatatattgtagataatacagttcggtgagctacaaatgcatttctaaagccattgtagtcctgtaatggaagcatctagcatgtcgtcaaagctgaaatggacttttgtacatagtgaggagctttgaaacgaggattgggaaaaagtaattccgtaggttattttcagttattatatttacaaatgggaaacaaaaggataatgaatactttataaaggattaatgtcaattcttgccaaatataaataaaaataatcctcagtttttgtgaaaagctccatttttagtgaaatattattttatagctactaattttaaaatgtcttgcttgattgtatggtgggaagttggctggtgtcccttgtctttgccaagttctccactagctatggtgtcataggctcttttgggatttttgaagctgtatactgtgtgctaaaacaagcactaaacaaagagtgaaggatttatgtttaattctgaaagcaaccttcttgcctagtgttctgatattggacagtaaaatccacagaccaacctggagttgaaaatcttataatttaaaatatgctctaaacatgtttatcgtatttgatgctacaggatttgaaattgtattacaaatccaatgaaatgagtttttcttttcatttacctctgccccagttgtttctactacatggaagacctcattttgaagggaaatttcagcagctgcagctcatgagtaactgatttgtaacaagcctccttttaaagtaaccctacaaaaccactggaaagtttatggttgtattattttttaaaaaaattccaagtgattgaaacctacacgagatacagaattttatgcggcattttcttctcacatttatatttttgtgattttgtgattgattatatgtcactttgctacagggctcacagaattcattcactcaacaaacataatagggcgctgagggcatagaagtaaaaacacctggtccctgctctcagttcactgtcttgttggacgagaaaagaaacaataacgataaaagacagtgaaagaaaataacgataaaagacagtgaaagaaaataacaataaaagacaaggaaaaaataacaatgaaagttgataagtacatgataagcgaggttccccgtgtgtaggtagatctggtctttagaggcagatagataggtcagtgcaaatactctggtccatgggccatatgaaaaggctaagcttcactgtaaaataataactgggaattctggattgtgtatgggtgttggtgaacttggttttaattagtgaactgctgagagacagagctattctccatgtactggcaagacctgatttctgagcatttaatatggatgccgtgggagtacaaaagtggagtgtggcctgagtaatgcattatgggtggtttaccatttcttgaggtaaaagcatcacatgaacttgtaaaggaatttaaaaatcctactttcataataagttgcataggtttaataatttttaattatatggcttgagtttaaattgtaataggcgtaactaattttaactctataatgtgttcattctggaataatcctaaacatatgaattatgtttgcatgttcacttccaagagcctttttttgaaaaaaagctttttttgaatcatcaagtctttcacatttaaataaagtgtttgaaagctttatttttttttttttttttttttttttttttttttt

SEQ ID NO: 25624 - DNA, 2389 bp, Homo sapiens
aaatccttcttccaatgttcctcccctctctgtatgaaccctgtgttggggggcagaagatggaagcccttggcaagctcgatcgaaccaagctactaaattgctgagctcgttttaactgaagtgtgagaaggaggtttaaggcaagtagacaacatcctgttgttggggtgcttctctcttttttgcacatctggctgaactgggagtcaggtggttgacttgtgcctggctgcagtagcagcggcatctcccttgcacagttctcctcctcggcctgcccaagagtccaccaggccatggacgcagtggctgtgtatcatggcaaaatcagcagggaaaccggcgagaagctcctgcttgccactgggctggatggcagctatttgctgagggacagcgagagcgtgccaggcgtgtactgcctatgtgtgctacagcacctggggtacataaaagatatttccggaaaataaaaaatctcatttcagcatttcagaagccagatcaaggcattgtaatacctctgcagtatccagttgagaagaagtcctcagctagaagtacacaaggtactacagggataagagaagatcctgatgtctgcctgaaagccccatgaagaaaaataaaacaccttgtactttattttctataatttaaatatatgctaagtcttatatattgtagataatacagttcggtgagctacaaatgcatttctaaagccattgtagtcctgtaatggaagcatctagcatgtcgtcaaagctgaaatggacttttgtacatagtgaggagctttgaaacgaggattgggaaaaagtaattccgtaggttattttcagttattatatttacaaatgggaaacaaaaggataatgaatactttataaaggattaatgtcaattcttgccaaatataaataaaaataatcctcagtttttgtgaaaagctccatttttagtgaaatattattttatagctactaattttaaaatgtcttgcttgattgtatggtgggaagttggctggtgtcccttgtctttgccaagttctccactagctatggtgtcataggctcttttgggatttttgaagctgtatactgtgtgctaaaacaagcactaaacaaagagtgaaggatttatgtttaattctgaaagcaaccttcttgcctagtgttctgatattggacagtaaaatccacagaccaacctggagttgaaaatcttataatttaaaatatgctctaaacatgtttatcgtatttgatgctacaggatttgaaattgtattacaaatccaatgaaatgagtttttcttttcatttacctctgccccagttgtttctactacatggaagacctcattttgaagggaaatttcagcagctgcagctcatgagtaactgatttgtaacaagcctccttttaaagtaaccctacaaaaccactggaaagtttatggttgtattattttttaaaaaaattccaagtgattgaaacctacacgagatacagaattttatgcggcattttcttctcacatttatatttttgtgattttgtgattgattatatgtcactttgctacagggctcacagaattcattcactcaacaaacataatagggcgctgagggcatagaagtaaaaacacctggtccctgctctcagttcactgtcttgttggacgagaaaagaaacaataacgataaaagacagtgaaagaaaataacgataaaagacagtgaaagaaaataacaataaaagacaaggaaaaaataacaatgaaagttgataagtacatgataagcgaggttccccgtgtgtaggtagatctggtctttagaggcagatagataggtcagtgcaaatactctggtccatgggccatatgaaaaggctaagcttcactgtaaaataataactgggaattctggattgtgtatgggtgttggtgaacttggttttaattagtgaactgctgagagacagagctattctccatgtactggcaagacctgatttctgagcatttaatatggatgccgtgggagtacaaaagtggagtgtggcctgagtaatgcattatgggtggtttaccatttcttgaggtaaaagcatcacatgaacttgtaaaggaatttaaaaatcctactttcataataagttgcataggtttaataatttttaattatatggcttgagtttaaattgtaataggcgtaactaattttaactctataatgtgttcattctggaataatcctaaacatatgaattatgtttgcatgttcacttccaagagcctttttttgaaaaaaagctttttttgaatcatcaagtctttcacatttaaataaagtgtttgaaagctttattt

SEQ ID NO: 25625 - DNA, 2376 bp, Homo sapiens
aaatccttcttccaatgttcctcccctctctgtatgaaccctgtgttggggggcagaagatggaagcccttggcaagctcgatcgaaccaagctactaaattgctgagctcgttttaactgaagtgtgagaaggaggtttaaggcaagtagacaacatcctgttgttggggtgcttctctcttttttgcacatctggctgaactgggagtcaggtggttgacttgtgcctggctgcagtagcagcggcatctcccttgcacagttctcctcctcggcctgcccaagagtccaccaggccatggacgcagtggctgtgtatcatggcaaaatcagcagggaaaccggcgagaagctcctgcttgccactgggctggatggcagctatttgctgagggacagcgagagcgtgccaggtatcacggttacatttatacataccgagtgtcccagacagaaacaggttcttggagtgctgagcatttcagaagccagatcaaggcattgtaatacctctgcagtatccagttgagaagaagtcctcagctagaagtacacaaggtactacagggataagagaagatcctgatgtctgcctgaaagccccatgaagaaaaataaaacaccttgtactttattttctataatttaaatatatgctaagtcttatatattgtagataatacagttcggtgagctacaaatgcatttctaaagccattgtagtcctgtaatggaagcatctagcatgtcgtcaaagctgaaatggacttttgtacatagtgaggagctttgaaacgaggattgggaaaaagtaattccgtaggttattttcagttattatatttacaaatgggaaacaaaaggataatgaatactttataaaggattaatgtcaattcttgccaaatataaataaaaataatcctcagtttttgtgaaaagctccatttttagtgaaatattattttatagctactaattttaaaatgtcttgcttgattgtatggtgggaagttggctggtgtcccttgtctttgccaagttctccactagctatggtgtcataggctcttttgggatttttgaagctgtatactgtgtgctaaaacaagcactaaacaaagagtgaaggatttatgtttaattctgaaagcaaccttcttgcctagtgttctgatattggacagtaaaatccacagaccaacctggagttgaaaatcttataatttaaaatatgctctaaacatgtttatcgtatttgatgctacaggatttgaaattgtattacaaatccaatgaaatgagtttttcttttcatttacctctgccccagttgtttctactacatggaagacctcattttgaagggaaatttcagcagctgcagctcatgagtaactgatttgtaacaagcctccttttaaagtaaccctacaaaaccactggaaagtttatggttgtattattttttaaaaaaattccaagtgattgaaacctacacgagatacagaattttatgcggcattttcttctcacatttatatttttgtgattttgtgattgattatatgtcactttgctacagggctcacagaattcattcactcaacaaacataatagggcgctgagggcatagaagtaaaaacacctggtccctgctctcagttcactgtcttgttggacgagaaaagaaacaataacgataaaagacagtgaaagaaaataacgataaaagacagtgaaagaaaataacaataaaagacaaggaaaaaataacaatgaaagttgataagtacatgataagcgaggttccccgtgtgtaggtagatctggtctttagaggcagatagataggtcagtgcaaatactctggtccatgggccatatgaaaaggctaagcttcactgtaaaataataactgggaattctggattgtgtatgggtgttggtgaacttggttttaattagtgaactgctgagagacagagctattctccatgtactggcaagacctgatttctgagcatttaatatggatgccgtgggagtacaaaagtggagtgtggcctgagtaatgcattatgggtggtttaccatttcttgaggtaaaagcatcacatgaacttgtaaaggaatttaaaaatcctactttcataataagttgcataggtttaataatttttaattatatggcttgagtttaaattgtaataggcgtaactaattttaactctataatgtgttcattctggaataatcctaaacatatgaattatgtttgcatgttcacttccaagagcctttttttgaaaaaaagctttttttgaatcatcaagtctttcacatttaaataaagtgtttgaaagctttattt

SEQ ID NO: 25626 - DNA, 2334 bp, Homo sapiens
aaatccttcttccaatgttcctcccctctctgtatgaaccctgtgttggggggcagaagatggaagcccttggcaagctcgatcgaaccaagctactaaattgctgagctcgttttaactgaagtgtgagaaggaggtttaaggcaagtagacaacatcctgttgttggggtgcttctctcttttttgcacatctggctgaactgggagtcaggtggttgacttgtgcctggctgcagtagcagcggcatctcccttgcacagttctcctcctcggcctgcccaagagtccaccaggccatggacgcagtggctgtgtatcatggcaaaatcagcagggaaaccggcgagaagctcctgcttgccactgggctggatggcagctatttgctgagggacagcgagagcgtgccaggcgtgtactgcctatgtgtgctcatttcagaagccagatcaaggcattgtaatacctctgcagtatccagttgagaagaagtcctcagctagaagtacacaaggtactacagggataagagaagatcctgatgtctgcctgaaagccccatgaagaaaaataaaacaccttgtactttattttctataatttaaatatatgctaagtcttatatattgtagataatacagttcggtgagctacaaatgcatttctaaagccattgtagtcctgtaatggaagcatctagcatgtcgtcaaagctgaaatggacttttgtacatagtgaggagctttgaaacgaggattgggaaaaagtaattccgtaggttattttcagttattatatttacaaatgggaaacaaaaggataatgaatactttataaaggattaatgtcaattcttgccaaatataaataaaaataatcctcagtttttgtgaaaagctccatttttagtgaaatattattttatagctactaattttaaaatgtcttgcttgattgtatggtgggaagttggctggtgtcccttgtctttgccaagttctccactagctatggtgtcataggctcttttgggatttttgaagctgtatactgtgtgctaaaacaagcactaaacaaagagtgaaggatttatgtttaattctgaaagcaaccttcttgcctagtgttctgatattggacagtaaaatccacagaccaacctggagttgaaaatcttataatttaaaatatgctctaaacatgtttatcgtatttgatgctacaggatttgaaattgtattacaaatccaatgaaatgagtttttcttttcatttacctctgccccagttgtttctactacatggaagacctcattttgaagggaaatttcagcagctgcagctcatgagtaactgatttgtaacaagcctccttttaaagtaaccctacaaaaccactggaaagtttatggttgtattattttttaaaaaaattccaagtgattgaaacctacacgagatacagaattttatgcggcattttcttctcacatttatatttttgtgattttgtgattgattatatgtcactttgctacagggctcacagaattcattcactcaacaaacataatagggcgctgagggcatagaagtaaaaacacctggtccctgctctcagttcactgtcttgttggacgagaaaagaaacaataacgataaaagacagtgaaagaaaataacgataaaagacagtgaaagaaaataacaataaaagacaaggaaaaaataacaatgaaagttgataagtacatgataagcgaggttccccgtgtgtaggtagatctggtctttagaggcagatagataggtcagtgcaaatactctggtccatgggccatatgaaaaggctaagcttcactgtaaaataataactgggaattctggattgtgtatgggtgttggtgaacttggttttaattagtgaactgctgagagacagagctattctccatgtactggcaagacctgatttctgagcatttaatatggatgccgtgggagtacaaaagtggagtgtggcctgagtaatgcattatgggtggtttaccatttcttgaggtaaaagcatcacatgaacttgtaaaggaatttaaaaatcctactttcataataagttgcataggtttaataatttttaattatatggcttgagtttaaattgtaataggcgtaactaattttaactctataatgtgttcattctggaataatcctaaacatatgaattatgtttgcatgttcacttccaagagcctttttttgaaaaaaagctttttttgaatcatcaagtctttcacatttaaataaagtgtttgaaagctttattt

SEQ ID NO: 25627 - DNA, 1855 bp, Homo sapiens
ggttgcagtgagccaagaccgcacactacactccagcctgggcatagagcaagactccatctcaaaaaaaaaagaaaaaagaaaatagtctctggtataaataacctctagaaagactccaccaaaaatttcatcttagcatttctccccaaacttcatgtaaaataaaatagagttgagagaaaaatagaaaggcaagggagtacctgttcactatttttattaaaccagtgttctactttattttaggtgtatcttttcttatttaaatgtcagctaaactttctttttaagatatggaatgaaagatgcccatccttcaggtttcgtttaagcaagaatccccattctcaaataatataatataaactttccaaattcttaagtagatcatctgagattgaaagctaagtttaactttctcaaagatattttagccgccatgacacctagacaaagtggtatattaaattctgattaatttggtcctaaagcacctaagaatcattcttactttcttatccacaggggttattaagttttcacattaaaaaaaatccaacagtgaataatactgcattggggttactgtaattgttaagtaaaataagaaatacaaatctttagttagatcacatggcacctgactactgcttagaaaatggtaagacttactacataaatcatgagtcactattgacatctactatatcatatcataggttaggtatctaattataaatagtcaaatcagctgactcaaggtggcatagctcaagcagaggaagataatacaagttgagtatggatttaacactctaaacctgtcagcactgtaggaaaagtaacttaaaactgcacaccccacttatgcataatcatcagatataaagagggtacattcctgtaatttattgttgctctagtgatcttaaagaattaagtccacattcataaagtccaaacttgtctccaaggatttgctttgactttgggagtatctggatcattaagtaatttccggaggctcagagtaaaagctttttatctctaaatattacttccctggaatattagatgtagcagaagtcagtaacggagtgacctttctcttaaacaattcatagattcactgaaattttcttcaactttaggaaaattaaatatattccacagtgctgtaagtcttaaatattgattttcctctgaaatcttgactcatcctacccaccaacattctccctttgtacactatgttctttgtaatgttcatgttacacaagtgaaaattagtaacattagtaaattttcattgcaggtttatttgttcatatttctggatatataatccattactgttaaacttcatatcaatgttccgatatttcttcatcttatgttttatgttacaaaacaggttatttcactatatgtatgtttaattgattaattcttccctttttttggaaatgaaacagcactctcaattattgggacagaaaagttatttcatagggaatacttcaaacactgatatctacaacaggcagtaagattcgtcacaacaattggtatactgtcaatataccatacaaagttccatctggtcttgattaaaaattattttagttttctcaggaaaatgatacagagggagaattgcctagattatatgagagaaaaaaaagtagagagaaacataatgttttcttagattattacagcagtgaactatttccacctggtaagaagtgccttggatgggtcagtctctagacctgatgtgtctggtgccaattgttggttctgtagtggaattcaagcgaaagggatcccattaatggctccgttgagg

SEQ ID NO: 25628 - DNA, 2429 bp, Homo sapiens
ggttgcagtgagccaagaccgcacactacactccagcctgggcatagagcaagactccatctcaaaaaaaaaagaaaaaagaaaatagtctctggtataaataacctctagaaagactccaccaaaaatttcatcttagcatttctccccaaacttcatgtaaaataaaatagagttgagagaaaaatagaaaggcaagggagtacctgttcactatttttattaaaccagtgttctactttattttaggtgtatcttttcttatttaaatgtcagctaaactttctttttaagatatggaatgaaagatgcccatccttcaggtttcgtttaagcaagaatccccattctcaaataatataatataaactttccaaattcttaagtagatcatctgagattgaaagctaagtttaactttctcaaagatattttagccgccatgacacctagacaaagtggtatattaaattctgattaatttggtcctaaagcacctaagaatcattcttactttcttatccacaggggttattaagttttcacattaaaaaaaatccaacagtgaataatactgcattggggttactgtaattgttaagtaaaataagaaatacaaatctttagttagatcacatggcacctgactactgcttagaaaatggtaagacttactacataaatcatgagtcactattgacatctactatatcatatcataggttaggtatctaattataaatagtcaaatcagctgactcaaggtggcatagctcaagcagaggaagataatacaagttgagtatggatttaacactctaaacctgtcagcactgtaggaaaagtaacttaaaactgcacaccccacttatgcataatcatcagatataaagagggtacattcctgtaatttattgttgctctagtgatcttaaagaattaagtccacattcataaagtccaaacttgtctccaaggatttgctttgactttgggagtatctggatcattaagtaatttccggaggctcagagtaaaagctttttatctctaaatattacttccctggaatattagatgtagcagaagtcagtaacggagtgacctttctcttaaacaattcatagattcactgaaattttcttcaactttaggaaaattaaatatattccacagtgctgtaagtcttaaatattgattttcctctgaaatcttgactcatcctacccaccaacattctccctttgtacactatgttctttgtaatgttcatgttacacaagtgaaaattagtaacattagtaaattttcattgcaggtttatttgttcatatttctggatatataatccattactgttaaacttcatatcaatgttccgatatttcttcatcttatgttttatgttacaaaacaggttatttcactatatgtatgtttaattgattaattcttccctttttttggaaatgaaacagcactctcaattattgggacagaaaagttatttcatagggaatacttcaaacactgatatctacaacaggcagtaagattcgtcacaacaattggtatactgtcaatataccatacaaagttccatctggtcttgattaaaaattattttagttttctcaggaaaatgatacagagggagaattgcctagattatatgagagaaaaaaaagtagagagaaacataatgttttcttagattattacagcagtgaactatttccacctggtaagaagggtgcacttgagaatggggttcaagtactctaggaacatagatgtaagttctggatgcacagtagttgttgcttagctgtaagctggaaatttcaaggcagaaacagcagataccacaactataactgggtctccttgttttttgttttatgtgtatacgtgagattatggggaaagacaaaagtaatgcatagagatttattttttaacattcaattcataagcagtgtttatacctctttgtacttacttgaaaagtgtatattatgtaaatttagtataaaaacacttggactaattcataccatgtggtaaaatttcacattcaaaagaaatacccttctgttattaaaaataaaaaaaaaaggagccaggagggtggctcatgactgtaatcccagtgctctgggaagccaaggtggagggatcatttgaggccaggactacttgagaacagcctgggcaacatagctagatcccttctctacaaaaagtaaaaaaaaaaaaaaaaaaaaaaaaaaaaaatagctaggcagggtggcacatgactggctattaaggaggctcaggtggagggatctcttcagcccaggaatttaaggcttcagtgagctaagattgggccattgcactccagccagggcaacagaccaagacccagtctcaaaataaataaa

SEQ ID NO: 25629 - DNA, 2636 bp, Homo sapiens
ggttgcagtgagccaagaccgcacactacactccagcctgggcatagagcaagactccatctcaaaaaaaaaagaaaaaagaaaatagtctctggtataaataacctctagaaagactccaccaaaaatttcatcttagcatttctccccaaacttcatgtaaaataaaatagagttgagagaaaaatagaaaggcaagggagtacctgttcactatttttattaaaccagtgttctactttattttaggtgtatcttttcttatttaaatgtcagctaaactttctttttaagatatggaatgaaagatgcccatccttcaggtttcgtttaagcaagaatccccattctcaaataatataatataaactttccaaattcttaagtagatcatctgagattgaaagctaagtttaactttctcaaagatattttagccgccatgacacctagacaaagtggtatattaaattctgattaatttggtcctaaagcacctaagaatcattcttactttcttatccacaggggttattaagttttcacattaaaaaaaatccaacagtgaataatactgcattggggttactgtaattgttaagtaaaataagaaatacaaatctttagttagatcacatggcacctgactactgcttagaaaatggtaagacttactacataaatcatgagtcactattgacatctactatatcatatcataggttaggtatctaattataaatagtcaaatcagctgactcaaggtggcatagctcaagcagaggaagataatacaagttgagtatggatttaacactctaaacctgtcagcactgtaggaaaagtaacttaaaactgcacaccccacttatgcataatcatcagatataaagagggtacattcctgtaatttattgttgctctagtgatcttaaagaattaagtccacattcataaagtccaaacttgtctccaaggatttgctttgactttgggagtatctggatcattaagtaatttccggaggctcagagtaaaagctttttatctctaaatattacttccctggaatattagatgtagcagaagtcagtaacggagtgacctttctcttaaacaattcatagattcactgaaattttcttcaactttaggaaaattaaatatattccacagtgctgtaagtcttaaatattgattttcctctgaaatcttgactcatcctacccaccaacattctccctttgtacactatgttctttgtaatgttcatgttacacaagtgaaaattagtaacattagtaaattttcattgcaggtttatttgttcatatttctggatatataatccattactgttaaacttcatatcaatgttccgatatttcttcatcttatgttttatgttacaaaacaggttatttcactatatgtatgtttaattgattaattcttccctttttttggaaatgaaacagcactctcaattattgggacagaaaagttatttcatagggaatacttcaaacactgatatctacaacaggcagtaagattcgtcacaacaattggtatactgtcaatataccatacaaagttccatctggtcttgattaaaaattattttagttttctcaggaaaatgatacagagggagaattgcctagattatatgagagaaaaaaaagtagagagaaacataatgttttcttagattattacagcagtgaactatttccacctggtaagaagggtgcacttgagaatggggttcaagtactctaggaacatagatgtaagttctggatgcacagtagttgttgcttagctgtaagctggaaatttcaaggcagaaacagcagataccacaactataactgggtctccttgttttttgttttatgtgtatacgtgagattatggggaaagacaaaagtaatgcatagagatttattttttaacattcaattcataagcagtgtttatacctctttgtacttacttgaaaagtgtatattatgtaaatttagtataaaaacacttggactaattcataccatgtggtaaaatttcacattcaaaagaaatacccttctgttattaaaaataaaaaaaaaaggagccaggagggtggctcatgactgtaatcccagtgctctgggaagccaaggtggagggatcatttgaggccaggactacttgagaacagcctgggcaacatagctagatcccttctctacaaaaagtaaaaaaaaaaaaaaaaaaaaaaaaaaaaaggcgctgggcgggggggccaaagaacggggaaaaaaagggggccccagggggagggggcaccccctcacccccagggaataaaagggcccacaggaacaaaaaggggcccagggagccacccagcggggggacgaagacacaagaaccactgtctttcaaaatatattaacatacaacattgaagaaaaagagggcgtgggaccggaaactaacactcaagatttatccagggcgtgtggtttgagaccccagtgggaacttgctcatagaggacattaaaaaacctttgaacacttttcttcaaaattcttcaaatttttatcaccacaatatattccccctccatgtagcggaatatt

SEQ ID NO: 25630 - DNA, 260 bp, Homo sapiens
ccagtagttcccgttgtacagtgctaccaatgtcctttccatacttcgcttagattaaaaaaaaagtcattaaccagatcctgttttgaaaatactttgaaatatggtaatgaagtattcttttcttacttctttgttacctttcccctaaacatccagaatcatccatcaatgttcagtttctgacttctgaaataagctcctaaaactagtttcagagtaaactgatgtgaatggcaaagcttttcttctttctcgag

SEQ ID NO: 25631 - DNA, 385 bp, Homo sapiens
tcgagaattcatgaggagactgccaccttccttaataaagtggagccccaaatgccaagattgtcatacagggagaatctccaagtggtaaggggttattgctggatctggcaataatctgattcttgttctgaggcttcccctttaacacgtattgagggttcaatttagtgctgctgcctccatctttcttctccagtttaagtctctgatccaagtatgaacacattagtctttccctaatgccaatggaacagctgatgtaaggctaggacatttaaatcaagctttgctaaaagctggaggataatgaatagagagcaacatgaaactatttagtctggcttacaaagacatttttctcatgcccttatcttttggtgtg

SEQ ID NO: 25632 - DNA, 395 bp, Homo sapiens
taggaaatatactgaacaagaatgaaaccaagcatcaaaatttgtggggtccagctaaggcagtacatagaggaaaattataacttttaatgcctatattagaataaaggaggccaggcacagtggctcatccctgtaatcccagcacttcgggaagccaaggtgagaggattgcttgagctcagaagtttgagaccagcctgggcaacatagtgagagctcgcctctatgaaaaattttaaaaaattatcctggggtggtggcatgcacctgtagtcccagttactctggtggctaatattagaggatcacttaagcccaggaggtcgaggctgcagtgagctgttattacaccactgcactccagtctgggcaacaaagtgagatcctattca

SEQ ID NO: 25633 - DNA, 428 bp, Homo sapiens
attttagagtcagtttgctgatatccacaaaacaatttgctagtattttgactaggattacattgaatctagagattgcgtgggaaaaaattctaacttagtgatattgagtctttctatcaatgaacatctaatatctgtcaatgtatttatatctttgatatctttcattagacttgtataattttccttatattgaaccctgtgctattttgttagatttgctcctagtaaatgtttctattgcaaattcttattgttcattgttgttatgggaaatcatttgagttttttgtattaagattgcatttggcaaccttgttataattgcttattagtttcaggagttttttgttgattctttgggattttctacacagacagatgtcatctgtgaacaatgacagtttcatttctttttttctaat

SEQ ID NO: 25634 - DNA, 670 bp, Homo sapiens
tccgttttggaagaatggcagcactttccaagcacaggttggggttcagggttaatttgcaaagttcccccaaggtgaggctttgaggacagtagcattgcccaggtgagccttgtggtattgaaaacccgcccaagctgatcattgaaggtgggcgcccagcaaggctggctgtttccagagaagaggccgggcccaggattaatgttgcattgcagacgcatctctgaacaatcacatgctgttctgcaccagggaagctggggtttttaacatccttttgtggtccctgcttacgatgcatactgccctgtgggagaagcttcctacccgcgtggagtacaggtgctgctccctgacctggctctggatgttcccctctcgcttattctacttcctgctgaagggccccttctaaagggggttgagagaaggccttgcctttgtatctcctctgagactctgaccacccacttcctgccagggcagggccgtgggagacccaggccgtggggccgggtctgtgtgcggggccaggcagccgtctgcgtcgctgttttccagcctccgtgttgagcatgacgtaaagtgacaagtgtttaagtcagcacgaaaacactgaaggcccctccgtccctgcagcctgtgaacacgtctactcggccacccg

SEQ ID NO: 25635 - DNA, 456 bp, Homo sapiens
cctgaccccagtgtccgagagcagcaaggtcgtcgtggtggagagtgtcatgggacagctcagctcacatcaccagctcacctctggtctgtggggcaagaggctgcaatattccatcctgggtgtctgggctgctaacctggcctgctcaggcttcccaccctgtgccctgggctgggcacacccccgggaagggaccccggacacggctcccacatccaggctcaaggcggatgcacttcctgcacctccagtcttctgtgtagcggctttaacccacgtatgtctgtcacgtccagtcccgagacggctgagtgaccccaagaaaggcttccctgacacccggacagaggctggagggctggggctgcgtgagggtggtgggcctgcggggacattcttactgtgctaaaaagccactgcaaacatagcaataaaaacctgtcattttccaaa

SEQ ID NO: 25636 - DNA, 417 bp, Homo sapiens
ttaactcattagcttagcagaaacatgttgtaggccagatttgtcctgcaggctgttatttgccagcctatcttagaatacagatatacctcattttgttgtgcttcacagatagtgtgattttcacagtttgaaggtttgcagtgaccctgcattgagcaagtctgttagtaccatttttccaacagcatgtgcccacttcatgtctctgtgtcacattttgataattctcacaatatttcaggctttttcattattctgttgtggtgattctgtaatcagtgatctttgatgttactttagtaattgttttggggtaccaggaaccaccttgtacctggcaaacttaatcagtaaatgtatgtgttctgactgttcaactgactggctgttccacttgtctctcttcctcttctt

SEQ ID NO: 25637 - DNA, 355 bp, Homo sapiens
ttgtgaaatgaggctggtaatatctccattgtagtttcagctaaagtatccagtacctagtaaatgctcaaaataccattattttggcctggcacagtggctcaggcctgtaattccagcactttcggaggccgaggcaggtcaatcacttgaggtcaggagttcgagaccagcctggccaacaaggtgaaaccccatctctactaaaaatacaaaaaattagccgggtgtggtggcgcatgcctgtaatcctagctacttgggaggctgaagccggagaatcacttgaacctgggaggcagaggttgcagtgagctgagattgcaccatggcactccagcctgggtgacaagag

SEQ ID NO: 25638 - DNA, 482 bp, Homo sapiens
attaatttgtaactacaggattgcaaaaaattttaatagctttaacctctagaaacaggatatgtaaatgctgaaaaacaaagtcccaaccagataagtcctgtgggtggtttcccagtcatgattcatggaaggagaaatgtactgatgagaaatcacatccaaaatattgtctctgcagtggtaatacttacaaagtcgacgcagtctcaggcggagctcactgaagatggtttccaagcttatatgtacttcacccatcccccaccctccagcccaaaacaaatcccaaacatactgcttagaactcagcctgcgcagcccagaggtacagagaggcaggaagcacccaggtgtccacatacggtgccattgtggacttgtagggcaggattccaggatatgggtgatgggcgtgtggaaccgcggcgccccctgcacagtgtggctcatttgagccggatgggggccgtgaaggcatc

SEQ ID NO: 25639 - DNA, 693 bp, Homo sapiens
aaaaaaaaaaaaaaaaagccccaaaccagctgagcttagatggatctctctggccatctttttaaacagtaagggacctttaaaaagtttgattcctctcttccccacagcaaggctatttgcttcctgaagataaatcaattgtaaaaagtagcttaatttaaagcgttcaattcccctgctttttacattgaggagaaattatggtgacagctattcctgttttgcgtgcttagtaccagccaggcactgagcccaaaactccaactcactcttggctgttgagccaaccctgtgccagaagaaaatccccactccctacaatgtgtggaattcacattatagttggagacagaaggggagaaacaaacacagcctgccaatcctggagaatgcctggtgggggtgctgggggaagaagtccaatttcagctgggaaaatgggacaggagccttgggagtgggtttacacctcaaattcccttatggccacagtccattggcccctagcctcctccccactttacagatgaagagactaggtttagagagaggaacagccggcttggcagaggcaactgctgaggcagttgaggaaaggtgaggacctcccagagtgagaggggcaagggaactggaagtcaactgtgggacctggaagtaggggagggaagaataaatctgcggaggggt

SEQ ID NO: 25640 - DNA, 390 bp, Homo sapiens
gcccgcactgtaagccaggctgtgattatgaggggcagctttatgaggagggggtcaccttcctgtccagctccaacccttgtctacagtgcacctgcctgaggagccgagttcgctgcatggccctgaagtgcccgcctagcccctgcccagagccagtgctgaggcctgggcactgctgcccaacctgccaaggctgcacagaaggtggctctcactgggaacatggccaagagtggacaacacctggggacccctgccgaatctgccggtgcctgggtacagaggtgcttaatcagaaagcatcggcatggcgagggccattcataactctgagttccaacaaaagttgatatctggaagattaataaaagtttaatttaagaaaac

SEQ ID NO: 25641 - DNA, 441 bp, Homo sapiens
agaaagaagtctcggcgtcggtgtaccaggtccctctcaagtcttcagctcagtactgattaattagcacatgcgtataaactaccagagaagccccagaaagaagcagtggaaacaatccccacaactcacagaagtagcagagtaattcctccttccactacccaaagtgagaatctcacaaggcatcagatgagtagtcagaaggttcctgccctcagtagcatggaaaaactagtctctaaaagctgctgcgactctgctgaacaaaagcttaaaaacaagccttgaaaggatcaaacagtctccaagtaacttagcctcatcccagaacgaagcttcaaggattatttgtagtacaaaaatatccagcaacaaagtaaaattttacaaggtaaaactcacaatagctggaaaattaaccaggccaagaaagaagca

SEQ ID NO: 25642 - DNA, 497 bp, Homo sapiens
agttaatgacatttgttatgccatagaaaatatttgttgaattgccactctaatgactttatatcagccaactcattatcaacactagaaaagatgattaaaaaatacttcagtacgttcatgtgttggcttgttaacatttttaagagtctataagagaaaaatgcatccaatctcgacaaaaatatttttcaagtatcttgtaggtacgtacaactaactaccttgtgaacaaaagtcactatataattatataatttctgacacttaaaaaagtttattgtgcaaaagaagatatatgttctaataccaaatccacatataaaataattgacttatttaaataatttaagatgctcttttatatatttatattaaaaactttacagagaataaaaaaggcattatacaggctgcttatggtttttgatgtttggatatacaatacatgtatcaaagattgtggaaataaatcaagcaatatattcaattggact

SEQ ID NO: 25643 - DNA, 493 bp, Homo sapiens
tcactttccatgtcttttctgattcttatatagacaatgtcaaggacttagaacatttgaaaaaaaaatttgaaagaaaaagttatcagaaaccctatccctaatttttcctgaatcacctgtaagatgtaacatggatggagctgcaagccattaccttaagggaactaatgcaagaacataaaaccaaacatcacatgttctcgcttataggtgggagctaaacattgagttcatatgaacacgagatgggaacaacagacaccagggcctacttgagggtgcggtgtaggcagagagtgagtgtgggaaattatctattggatactgtgcttattacctgggtgatgaaataaggtatacaccaaaccatcacaagacactatgcatagaacaaaactgcacttgtacccctgaaactaaaagttaaaaaaagaaaacaaaaatctccccaaaacaatttaagtaatattttgcagtaaatgccttactt

SEQ ID NO: 25644 - DNA, 835 bp, Homo sapiens
tgagatggagtttcactcttgctgtccaggctggggtgcaatggcccaatctcggctcaccacaacctccaccttccaggttcagcgattctcctgcctcagcctccggagtacctgggattacaggcatgcaccaccacgcctggctaattttgtatttttagtagagacggggtttttccatgttggtcaggctggtctcgaactcccgacctcaggtgatccgcccacctcggcctcccgaagcctttatctttgctaacaaaaatcctccaagaatgtctgcattctctgcctttgcttcctgggtgctcacggcctgccttcctgccttcactgctcacaaactgctcccaagggtgaacaaccttgagcgctcctaagaaccagtgtgtcctcggcctctctgctctcccgatactgggtccttggcctgtggatggacggcaaacagcacttagccctcaaacctggtcctgtcttccagaactcgttcagtctccgttaaatgacaaggagctcaccactaccaaccgcagcttgaacttaacaaaaacagagtggggttttcatttggaagagaaaaagaggaaaaaagcccttagtgcttttagaaaagtacatggggccgggtgtggtggctcacgcctgtaatcccagaaccttgggaagctgaggcaggcggatcacggggtcaagagatggacatcattctggccaacatggtgaaaccccatctctactaaaaataccaaaattaactgggcgtggtggcgcgcacctgtagtcccagctactcgggaggctgaggcaagagaatcgcttgaacccggga

SEQ ID NO: 25645 - DNA, 433 bp, Homo sapiens
agatactattcaacaatttaaaagaataaactattgatacatgcaacataagtgaatcccaaaattattatgctgagtggaaaaagtaagatttttaaaaagagtatatgctgtatgagtccatttatagtaagctgtaaaacatgcaaactggcctgccacagtggctcctgcctatgatcccagcactttgggaggccgaggtgggaggatcacttgagctcaggagttccagaccaacctgagcaacatggcaaaaccatgtctccaccaaacaaacaaaaattagccaggcatggtgacatgtgcctgtagtcccagctatttgggaggctaaggtgggaggatcacttgagcccaggaggtggaagctgcagtgagccgagatcatgccactgcactccagcctgggcgacagagtgagacccggtct

SEQ ID NO: 25646 - DNA, 634 bp, Homo sapiens
tccttgccgacttaactcgttgctcggttataggtccagtttcattattgtcggtgttaaatgccgccccaggagaatgtgcgttgccgcagtttgagaagcttgaagttaagatgctggccttggagtcggatcgttctgtccagttctgattctgcccacttactggctttgattttaaccaacttctcttgtcctcggtagaatcctgtgtttttaatcattatgtaatataccatacagcattattatatagtacattgcagtattataaataatttggaaagttaaaacaaattcatagtcccattgcagaaacacagtattgccattttagtgcactacagcaattaacttgataggcataccttagaatctcattttagagataatgcctgagcccaaccaaacaaggctaaaatgaaaaagcttgtaaattccctgatgattcttatgcacattaaggtttgagaagcattgctctggcacagtattttttattctcaggtgtctctctctaccttgtatattgcttaaatgtgtgttttgtgattgaataattatccaattttagttatggatgtaatccacatgcttgacatttttattaaatacaatataaaaacactatata

SEQ ID NO: 25647 - DNA, 1344 bp, Homo sapiens
gcatttcgggtctgcgaggtggggtaggcgggcaaggcgggcgccgaggtttgcaaaggctcgcagcggccagaaacccggctccgagcggcggcggcccggcttccgctgcccgtgagctaaggacggtccgctccctctagccagctccgaatcctgatccaggcgggggccaggggcccctcgcctcccctctgaggaccgaagatgagcttcctcttcagcagccgctcttctaaaacattcaaaccaaagaagaatatccctgaaggatctcatcagtatgaactcttaaaacatgcagaagcaactctaggaagtgggaatctgagacaagctgttatgttgcctgagggagaggatctcaatgaatggattgctgtgaacactgtggatttctttaaccagatcaacatgttatatggaactattacagaattctgcactgaagcaagctgtccagtcatgtctgcaggtccgagatatgaatatcactgggcagatggtactaatattaaaaagccaatcaaatgttctgcaccaaaatacattgactatttgatgacttgggttcaagatcagcttgatgatgaaactctttttccttctaagattggtgtcccatttcccaaaaactttatgtctgtggcaaagactattctaaagcgtctgttcagggtttatgcccatatttatcaccagcactttgattctgtgatgcagctgcaagaggaggcccacctcaacacctcctttaagcactttattttctttgttcaggagtttaatctgattgataggcgtgagctggcacctcttcaagaattaatagagaaacttggatcaaaagacagataaatgtttcttctagaacacagttacccccttgcttcatctattgctagaactatctcattgctatctgttatagactagtgatacaaactttaagaaaacaggataaaaagatacccattgcctgtgtctactgataaaattatcccaaaggtaggttggtgtgatagtttccgagtaagaccttaaggacacagccaaatcttaagtactgtgtgaccactcttgttgttatcacatagtcatacttggttgtaatatgtgatggttaacctgtagcttataaatttacttattattcttttactcatttactcagtcatttctttacaagaaaatgattgaatctgttttaggtgacagcacaatggacattaagaatttccatcaataatttatgaataagtttccagaacaaatttcctaataacacaatcagattggttttattcttttattttacgaataaaaaatgtatttttcagtatc

SEQ ID NO: 25648 - DNA, 516 bp, Homo sapiens
cttgggcgcgttattttttttcccccgatccatccaagaaaaggtagtttttcccaccgtagagttctgaaaagaggtaaaatagtagtcctttggtcatcctatttttgctttcaattttgatatttcagactgtaaaaggccttgggggatgatagtacatgtggtagcagtaatttttttgaagcaactgcactgacattcatttgagttttctctcattatcagattctgttccaaacaagtattctgtagatccaaatggattaccagtgtgctacagacttcttattatagaacagcattctattctacatcaaaaatagtttgtgtaagttagttttggttaccatctaaaatatttttaaatgttctttacataaaaatttatgttgtgttttaaaatccttaggggctttatctatttttctaagtcagttaactgtacttctaaaaaaagtattttgtatctacttttgtaacttcgtcagaataaaatatattgaaagcaaaaaa

SEQ ID NO: 25649 - DNA, 657 bp, Homo sapiens
ctacaatatattatgtaatataaacaatataaataaatgatcctgtaggcccacctcaacacctcctttaagcactttattttctttgttcaggagtttaatctgattgataggcgtgagctggcacctcttcaagaattaatagagaaacttggatcaaaagacagataaatgtttcttctagaacacagttacccccttgcttcatctattgctagaactatctcattgctatctgttatagactagtgatacaaactttaagaaaacaggataaaaagatacccattgcctgtgtctactgataaaattatcccaaaggtaggttggtgtgatagtttccgagtaagaccttaaggacacagccaaatcttaagtactgtgtgaccactcttgttgttatcacatagtcatacttggttgtaatatgtgatggttaacctgtagcttataaatttacttattattcttttactcatttactcagtcatttctttacaagaaaatgattgaatctgttttaggtgacagcacaatggacattaagaatttccatcaataatttatgaataagtttccagaacaaatttcctaataacacaatcagattggttttattcttttattttacgaataaaaaatgtatttttcagtatc

SEQ ID NO: 25650 - DNA, 560 bp, Homo sapiens
aattattagaaaaaaaagattccaacattacaataagagaacagaacactaacgcttggagctgatcctgctagcccagtggaggccaagtgccacagtgagaaaagccctctattagacattccacaatccatgttttaagcttatccaaaggtccaaatgtcagccattctgtatgttcatgttgatcatttgcgaacaagaaagcaggtttctaggtatcacttaggatgtgaactgcctctcaactttaaaccctgttagctttacttttttaagtccacaagtgatgaaactagtttctcagctaggcttgtactttcctcattatttctagtatttcaaatattctcaaacaaaagagttaccacttttctccatttattttcagttatggaaatgttccctctcttcaccactaagctccaaagcaaatgaaagacgatcacatgtcaggacagtagtaaaggcagcttataaatgggacataaatcagagatgtgttggtattttgagactcaagactgtcctttttttttctataaacttggtgccggctc

SEQ ID NO: 25651 - DNA, 4974 bp, Homo sapiens
  misc_feature (4845)..(4845): n is a, c, g, or t
  misc_feature (4860)..(4861): n is a, c, g, or t
  misc_feature (4865)..(4865): n is a, c, g, or t
  misc_feature (4873)..(4873): n is a, c, g, or t
  misc_feature (4880)..(4880): n is a, c, g, or t
  misc_feature (4884)..(4884): n is a, c, g, or t
gcatttcgggtctgcgaggtggggtaggcgggcaaggcgggcgccgaggtttgcaaaggctcgcagcggccagaaacccggctccgagcggcggcggcccggcttccgctgcccgtgagctaaggacggtccgctccctctagccagctccgaatcctgatccaggcgggggccaggggcccctcgcctcccctctgaggaccgaagatgagcttcctcttcagcagccgctcttctaaaacattcaaaccaaagaagaatatccctgaaggatctcatcagtatgaactcttaaaacatgcagaagcaactctaggaagtgggaatctgagacaagctgttatgttgcctgagggagaggatctcaatgaatggattgctgtgaacactgtggatttctttaaccagatcaacatgttatatggaactattacagaattctgcactgaagcaagctgtccagtcatgtctgcaggtccgagatatgaatatcactgggcagatggtactaatattaaaaagccaatcaaatgttctgcaccaaaatacattgactatttgatgacttgggttcaagatcagcttgatgatgaaactctttttccttctaagattggtgtcccatttcccaaaaactttatgtctgtggcaaagactattctaaagcgtctgttcagggtttatgcccatatttatcaccagcactttgattctgtgatgcagctgcaagaggaggcccacctcaacacctcctttaagcactttattttctttgttcaggagtttaatctgattgataggcgtgagctggcacctcttcaagaattaatagagaaacttggatcaaaagacagataaatgtttcttctagaacacagttacccccttgcttcatctattgctagaactatctcattgctatctgttatagactagtgatacaaactttaagaaaacaggataaaaagatacccattgcctgtgtctactgataaaattatcccaaaggtaggttggtgtgatagtttccgagtaagaccttaaggacacagccaaatcttaagtactgtgtgaccactcttgttgttatcacatagtcatacttggttgtaatatgtgatggttaacctgtagcttataaatttacttattattcttttactcatttactcagtcatttctttacaagaaaatgattgaatctgttttaggtgacagcacaatggacattaagaatttccatcaataatttatgaataagtttccagaacaaatttcctaataacacaatcagattggttttattcttttattttacgaataaaaaatgtatttttcagtatccttgagatttagaacatctgtgtcacttcagataacattttagtttcaagtttgtatggtagtgtttttatagataagatacgtctattttttcaaaattcatgattgcagtttaaatcatcatatgacgtgtgggtgggagcaaccaaagttatttttacagggactttattttttgatctttatttgagattgttttcatatctatctaaattattaggagtgtgtgtatcagaagtaattttttaatgtcttctaaggatggtcttccaggcttttaaactgaaaagcttaattcagatagtagcttttggctgagaaaaggaatccaaaatattaataaatttagatctcaaaaccactatttttattatttcattatttttcagaggccttaaaattctggataagagaatggaggaaaatactcagagtacttgattattttatttccttttattaaaaaattacttctatgtttttattgtctcttgagccttagttaagagtagtgtagaaatgcatgaacttcatcctaataaggataaaacttaaggaaaaccacaataaaccatgaaggtgtacacatcttataacacagataaagttttggtgtgctacctattcttgagagagtgagtgagtgtatgtgtttaaaggaaacaaaatgggagaaataagttttaaaaaaatcctcattttgttaatattcaaaagatggactgagcttccacttgggttttatcttgttttaattgtttttgtatcaaaacttgaaattcctctatttctattgggatataaaagccttccccttcagtgaagaaaacatttattttttatttgattcctaggatttagtaaactctagctgtctatttaaaatgtactgaggcacaacaagtattatactggaagacttgccaaactggcaaagctttaagttcatcagcattctatgtggttcagagctgtgatttttgcaaagtattttaccaacctcctcgatggctttgataaaggttagatttgatgtttttttttagatttatttttcttactccactaaactataaagaaaataattacttagaaactccattttaaataatcatttcctagaaattcttaaatatatacagaattttaaagaaaacatttcatctgatttagttagcatccacatatcattgaggaattaaagtgtgggacagtcattattaaaaaaaagagagaaaagccctctattagacattccacaatccatgttttaagcttatccaaaggtccaaatgtcagccattctgtatgttcatgttgatcatttgcgaacaagaaagcaggtttctaggtatcacttaggatgtgaactgcctctcaactttaaaccctgttagctttacttttttaagtccacaagtgatgaaactagtttctcagctaggcttgtactttcctcattatttctagtatttcaaatattctcaaacaaaagagttaccacttttctccatttattttcagttatggaaatgttccctctcttcaccactaagctccaaagcaaatgaaagacgatcacatgtcaggacagtagtaaaggcagcttataaatgggacataaatcagagatgtgttggtattttgagactcaagactgtccttttttaaaataaaaataaaaacattaccaggttcccaagccaatctggcttaaccaacagtgcactgaaatattagtgtttacctccaaggctagggagccaaggggaggaggagaattggaggaaggggagataatgggaagaggatggcgccttcctgagttggctagagggccaacctttgataacagtttgacgaaatcaatcttttttttttttttttttttgagacagagtctcactctgtcacccaggctggagtacagtggtgggatctcggctcactgcaagctctgcctcccaggttcatgccattctcctgccccagcctctcctgagtagctggaactacaggtgcccgccaccacgcccagctaattttttctatttttagtcatgcctggctaattttttgtatttttagtagagatggggtttcaccgtgttagccaggatggtctccatctccttacctcgcaatccgcccgcctcagcctcccaaagtgttgggattacaggcatgagccaccgtgcccggcctatagaaatcaatctttttgactcttctcacttttatctccccatgcccaaggtttgcctgttccataacactcactcccttcccccttgctaatcagaagccatctcctctcagtgtctgatctctgctcttcatacatgattacagtcatggggtagagagtgcttgctaaattatgcagttaatcctatggtgctttaattttcaggccttcaaaaaacacttgtacagtgatgtgcagatttttaaacagttgaacttccttgtactacagtttttgtattgacagccaaatttgtctttcattcttcagattgtgaataaagtgatttttacagggcttccagcaaagtttttcctttcatctaaggcttgtagaaccctagcttatatagctgcttacatgagaaatgcaaaatctgtattcaccatgactttagtaacaaaggtaaagttttttagtagtgccaaggcaagaggaacaatcttggtggtagtactaagttttgtcaatattgtggtttcctgattgtattgttggctttctctctgagcattgaggtatactagaagtagagcttctcaaacataatatcattacctcataagcattaacaaatcaggcccaaagagcgtaagtcctagaaatttgttttaaagcagccctagtcatggtgctggtgctaccgccttgttttaggagcctgcctcctgtcagtatgaaaccctcacctgaaaaatgccagcctggacaccaaacactgagccccttcaacaggcacattatttccccctgagatccataagggaatttagtttctactattgtagagttctgaaaagaggtaaaatagtagtcctttggtcatcctatttttgctttcaattttgatatttcagactgtaaaaggccttgggggatgatagtacatgtggtagcagtaatttttttgaagcaactgcactgacattcatttgagttttctctcattatcagattctgttccaaacaagtattctgtagatccaaatggattaccagtgtgctacagacttcttattatagaacagcattctattctacatcaaaaatagtttgtgtaagttagttttggttaccatctaaaatatttttaaatgttctttacataaaaatttatgttgtgttttaaaatccttaggggctttatctatttttctaagtcagttaactgtacttctaaaaaaagtattttgtatctacttttgtaacttcgtcagaataaaatatattgaaagcaaaaaaaacacaaacanaaaaaactttttggnngccncgggcccnaaaagtntttnaacccattgttgtgggcggggccattggtagcgacacgggcaaagggtgcccaggaaaccgggccagaagggcgggttcttccaataacg

SEQ ID NO: 25652 - DNA, 4900 bp, Homo sapiens
gcatttcgggtctgcgaggtggggtaggcgggcaaggcgggcgccgaggtttgcaaaggctcgcagcggccagaaacccggctccgagcggcggcggcccggcttccgctgcccgtgagctaaggacggtccgctccctctagccagctccgaatcctgatccaggcgggggccaggggcccctcgcctcccctctgaggaccgaagatgagcttcctcttcagcagccgctcttctaaaacattcaaaccaaagaagaatatccctgaaggatctcatcagtatgaactcttaaaacatgcagaagcaactctaggaagtgggaatctgagacaagctgttatgttgcctgagggagaggatctcaatgaatggattgctgtgaacactgtggatttctttaaccagatcaacatgttatatggaactattacagaattctgcactgaagcaagctgtccagtcatgtctgcaggtccgagatatgaatatcactgggcagatggtactaatattaaaaagccaatcaaatgttctgcaccaaaatacattgactatttgatgacttgggttcaagatcagcttgatgatgaaactctttttccttctaagattggtgtcccatttcccaaaaactttatgtctgtggcaaagactattctaaagcgtctgttcagggtttatgcccatatttatcaccagcactttgattctgtgatgcagctgcaagaggaggcccacctcaacacctcctttaagcactttattttctttgttcaggagtttaatctgattgataggcgtgagctggcacctcttcaagaattaatagagaaacttggatcaaaagacagataaatgtttcttctagaacacagttacccccttgcttcatctattgctagaactatctcattgctatctgttatagactagtgatacaaactttaagaaaacaggataaaaagatacccattgcctgtgtctactgataaaattatcccaaaggtaggttggtgtgatagtttccgagtaagaccttaaggacacagccaaatcttaagtactgtgtgaccactcttgttgttatcacatagtcatacttggttgtaatatgtgatggttaacctgtagcttataaatttacttattattcttttactcatttactcagtcatttctttacaagaaaatgattgaatctgttttaggtgacagcacaatggacattaagaatttccatcaataatttatgaataagtttccagaacaaatttcctaataacacaatcagattggttttattcttttattttacgaataaaaaatgtatttttcagtatccttgagatttagaacatctgtgtcacttcagataacattttagtttcaagtttgtatggtagtgtttttatagataagatacgtctattttttcaaaattcatgattgcagtttaaatcatcatatgacgtgtgggtgggagcaaccaaagttatttttacagggactttattttttgatctttatttgagattgttttcatatctatctaaattattaggagtgtgtgtatcagaagtaattttttaatgtcttctaaggatggtcttccaggcttttaaactgaaaagcttaattcagatagtagcttttggctgagaaaaggaatccaaaatattaataaatttagatctcaaaaccactatttttattatttcattatttttcagaggccttaaaattctggataagagaatggaggaaaatactcagagtacttgattattttatttccttttattaaaaaattacttctatgtttttattgtctcttgagccttagttaagagtagtgtagaaatgcatgaacttcatcctaataaggataaaacttaaggaaaaccacaataaaccatgaaggtgtacacatcttataacacagataaagttttggtgtgctacctattcttgagagagtgagtgagtgtatgtgtttaaaggaaacaaaatgggagaaataagttttaaaaaaatcctcattttgttaatattcaaaagatggactgagcttccacttgggttttatcttgttttaattgtttttgtatcaaaacttgaaattcctctatttctattgggatataaaagccttccccttcagtgaagaaaacatttattttttatttgattcctaggatttagtaaactctagctgtctatttaaaatgtactgaggcacaacaagtattatactggaagacttgccaaactggcaaagctttaagttcatcagcattctatgtggttcagagctgtgatttttgcaaagtattttaccaacctcctcgatggctttgataaaggttagatttgatgtttttttttagatttatttttcttactccactaaactataaagaaaataattacttagaaactccattttaaataatcatttcctagaaattcttaaatatatacagaattttaaagaaaacatttcatctgatttagttagcatccacatatcattgaggaattaaagtgtgggacagtcattattaaaaaaaagagagaaaagccctctattagacattccacaatccatgttttaagcttatccaaaggtccaaatgtcagccattctgtatgttcatgttgatcatttgcgaacaagaaagcaggtttctaggtatcacttaggatgtgaactgcctctcaactttaaaccctgttagctttacttttttaagtccacaagtgatgaaactagtttctcagctaggcttgtactttcctcattatttctagtatttcaaatattctcaaacaaaagagttaccacttttctccatttattttcagttatggaaatgttccctctcttcaccactaagctccaaagcaaatgaaagacgatcacatgtcaggacagtagtaaaggcagcttataaatgggacataaatcagagatgtgttggtattttgagactcaagactgtccttttttaaaataaaaataaaaacattaccaggttcccaagccaatctggcttaaccaacagtgcactgaaatattagtgtttacctccaaggctagggagccaaggggaggaggagaattggaggaaggggagataatgggaagaggatggcgccttcctgagttggctagagggccaacctttgataacagtttgacgaaatcaatcttttttttttttttttttttgagacagagtctcactctgtcacccaggctggagtacagtggtgggatctcggctcactgcaagctctgcctcccaggttcatgccattctcctgccccagcctctcctgagtagctggaactacaggtgcccgccaccacgcccagctaattttttctatttttagtcatgcctggctaattttttgtatttttagtagagatggggtttcaccgtgttagccaggatggtctccatctccttacctcgcaatccgcccgcctcagcctcccaaagtgttgggattacaggcatgagccaccgtgcccggcctatagaaatcaatctttttgactcttctcacttttatctccccatgcccaaggtttgcctgttccataacactcactcccttcccccttgctaatcagaagccatctcctctcagtgtctgatctctgctcttcatacatgattacagtcatggggtagagagtgcttgctaaattatgcagttaatcctatggtgctttaattttcaggccttcaaaaaacacttgtacagtgatgtgcagatttttaaacagttgaacttccttgtactacagtttttgtattgacagccaaatttgtctttcattcttcagattgtgaataaagtgatttttacagggcttccagcaaagtttttcctttcatctaaggcttgtagaaccctagcttatatagctgcttacatgagaaatgcaaaatctgtattcaccatgactttagtaacaaaggtaaagttttttagtagtgccaaggcaagaggaacaatcttggtggtagtactaagttttgtcaatattgtggtttcctgattgtattgttggctttctctctgagcattgaggtatactagaagtagagcttctcaaacataatatcattacctcataagcattaacaaatcaggcccaaagagcgtaagtcctagaaatttgttttaaagcagccctagtcatggtgctggtgctaccgccttgttttaggagcctgcctcctgtcagtatgaaaccctcacctgaaaaatgccagcctggacaccaaacactgagccccttcaacaggcacattatttccccctgagatccataagggaatttagtttctactattgtagagttctgaaaagaggtaaaatagtagtcctttggtcatcctatttttgctttcaattttgatatttcagactgtaaaaggccttgggggatgatagtacatgtggtagcagtaatttttttgaagcaactgcactgacattcatttgagttttctctcattatcagattctgttccaaacaagtattctgtagatccaaatggattaccagtgtgctacagacttcttattatagaacagcattctattctacatcaaaaatagtttgtgtaagttagttttggttaccatctaaaatatttttaaatgttctttacataaaaatttatgttgtgttttaaaatccttaggggctttatctatttttctaagtcagttaactgtacttctaaaaaaagtattttgtatctacttttgtaacttcgtcagaataaaatatattgaaagcaaaaaatgactgattaaagtatgtatatcaacacacatttctatttaaatatagaaacttgagagttttgca

SEQ ID NO: 25653 - DNA, 4874 bp, Homo sapiens
gcatttcgggtctgcgaggtggggtaggcgggcaaggcgggcgccgaggtttgcaaaggctcgcagcggccagaaacccggctccgagcggcggcggcccggcttccgctgcccgtgagctaaggacggtccgctccctctagccagctccgaatcctgatccaggcgggggccaggggcccctcgcctcccctctgaggaccgaagatgagcttcctcttcagcagccgctcttctaaaacattcaaaccaaagaagaatatccctgaaggatctcatcagtatgaactcttaaaacatgcagaagcaactctaggaagtgggaatctgagacaagctgttatgttgcctgagggagaggatctcaatgaatggattgctgtgaacactgtggatttctttaaccagatcaacatgttatatggaactattacagaattctgcactgaagcaagctgtccagtcatgtctgcaggtccgagatatgaatatcactgggcagatggtactaatattaaaaagccaatcaaatgttctgcaccaaaatacattgactatttgatgacttgggttcaagatcagcttgatgatgaaactctttttccttctaagattggtgtcccatttcccaaaaactttatgtctgtggcaaagactattctaaagcgtctgttcagggtttatgcccatatttatcaccagcactttgattctgtgatgcagctgcaagaggaggcccacctcaacacctcctttaagcactttattttctttgttcaggagtttaatctgattgataggcgtgagctggcacctcttcaagaattaatagagaaacttggatcaaaagacagataaatgtttcttctagaacacagttacccccttgcttcatctattgctagaactatctcattgctatctgttatagactagtgatacaaactttaagaaaacaggataaaaagatacccattgcctgtgtctactgataaaattatcccaaaggtaggttggtgtgatagtttccgagtaagaccttaaggacacagccaaatcttaagtactgtgtgaccactcttgttgttatcacatagtcatacttggttgtaatatgtgatggttaacctgtagcttataaatttacttattattcttttactcatttactcagtcatttctttacaagaaaatgattgaatctgttttaggtgacagcacaatggacattaagaatttccatcaataatttatgaataagtttccagaacaaatttcctaataacacaatcagattggttttattcttttattttacgaataaaaaatgtatttttcagtatccttgagatttagaacatctgtgtcacttcagataacattttagtttcaagtttgtatggtagtgtttttatagataagatacgtctattttttcaaaattcatgattgcagtttaaatcatcatatgacgtgtgggtgggagcaaccaaagttatttttacagggactttattttttgatctttatttgagattgttttcatatctatctaaattattaggagtgtgtgtatcagaagtaattttttaatgtcttctaaggatggtcttccaggcttttaaactgaaaagcttaattcagatagtagcttttggctgagaaaaggaatccaaaatattaataaatttagatctcaaaaccactatttttattatttcattatttttcagaggccttaaaattctggataagagaatggaggaaaatactcagagtacttgattattttatttccttttattaaaaaattacttctatgtttttattgtctcttgagccttagttaagagtagtgtagaaatgcatgaacttcatcctaataaggataaaacttaaggaaaaccacaataaaccatgaaggtgtacacatcttataacacagataaagttttggtgtgctacctattcttgagagagtgagtgagtgtatgtgtttaaaggaaacaaaatgggagaaataagttttaaaaaaatcctcattttgttaatattcaaaagatggactgagcttccacttgggttttatcttgttttaattgtttttgtatcaaaacttgaaattcctctatttctattgggatataaaagccttccccttcagtgaagaaaacatttattttttatttgattcctaggatttagtaaactctagctgtctatttaaaatgtactgaggcacaacaagtattatactggaagacttgccaaactggcaaagctttaagttcatcagcattctatgtggttcagagctgtgatttttgcaaagtattttaccaacctcctcgatggctttgataaaggttagatttgatgtttttttttagatttatttttcttactccactaaactataaagaaaataattacttagaaactccattttaaataatcatttcctagaaattcttaaatatatacagaattttaaagaaaacatttcatctgatttagttagcatccacatatcattgaggaattaaagtgtgggacagtcattattaaaaaaaagagagaaaagccctctattagacattccacaatccatgttttaagcttatccaaaggtccaaatgtcagccattctgtatgttcatgttgatcatttgcgaacaagaaagcaggtttctaggtatcacttaggatgtgaactgcctctcaactttaaaccctgttagctttacttttttaagtccacaagtgatgaaactagtttctcagctaggcttgtactttcctcattatttctagtatttcaaatattctcaaacaaaagagttaccacttttctccatttattttcagttatggaaatgttccctctcttcaccactaagctccaaagcaaatgaaagacgatcacatgtcaggacagtagtaaaggcagcttataaatgggacataaatcagagatgtgttggtattttgagactcaagactgtccttttttaaaataaaaataaaaacattaccaggttcccaagccaatctggcttaaccaacagtgcactgaaatattagtgtttacctccaaggctagggagccaaggggaggaggagaattggaggaaggggagataatgggaagaggatggcgccttcctgagttggctagagggccaacctttgataacagtttgacgaaatcaatcttttttttttttttttttttgagacagagtctcactctgtcacccaggctggagtacagtggtgggatctcggctcactgcaagctctgcctcccaggttcatgccattctcctgccccagcctctcctgagtagctggaactacaggtgcccgccaccacgcccagctaattttttctatttttagtcatgcctggctaattttttgtatttttagtagagatggggtttcaccgtgttagccaggatggtctccatctccttacctcgcaatccgcccgcctcagcctcccaaagtgttgggattacaggcatgagccaccgtgcccggcctatagaaatcaatctttttgactcttctcacttttatctccccatgcccaaggtttgcctgttccataacactcactcccttcccccttgctaatcagaagccatctcctctcagtgtctgatctctgctcttcatacatgattacagtcatggggtagagagtgcttgctaaattatgcagttaatcctatggtgctttaattttcaggccttcaaaaaacacttgtacagtgatgtgcagatttttaaacagttgaacttccttgtactacagtttttgtattgacagccaaatttgtctttcattcttcagattgtgaataaagtgatttttacagggcttccagcaaagtttttcctttcatctaaggcttgtagaaccctagcttatatagctgcttacatgagaaatgcaaaatctgtattcaccatgactttagtaacaaaggtaaagttttttagtagtgccaaggcaagaggaacaatcttggtggtagtactaagttttgtcaatattgtggtttcctgattgtattgttggctttctctctgagcattgaggtatactagaagtagagcttctcaaacataatatcattacctcataagcattaacaaatcaggcccaaagagcgtaagtcctagaaatttgttttaaagcagccctagtcatggtgctggtgctaccgccttgttttaggagcctgcctcctgtcagtatgaaaccctcacctgaaaaatgccagcctggacaccaaacactgagccccttcaacaggcacattatttccccctgagatccataagggaatttagtttctactattgtagagttctgaaaagaggtaaaatagtagtcctttggtcatcctatttttgctttcaattttgatatttcagactgtaaaaggccttgggggatgatagtacatgtggtagcagtaatttttttgaagcaactgcactgacattcatttgagttttctctcattatcagattctgttccaaacaagtattctgtagatccaaatggattaccagtgtgctacagacttcttattatagaacagcattctattctacatcaaaaatagtttgtgtaagttagttttggttaccatctaaaatatttttaaatgtaaagaacatttaaaaatattttagatggtaaccaaaactatctttacataaaaatttatgttgtgttttaaaatccttaggggctttatctatttttctaagtcagttaactgtacttctaaaaaaagtattttgtatctacttttgtaacttcgtcagaataaaatatattgaaagcaaaaaa

SEQ ID NO: 25654 - DNA, 5031 bp, Homo sapiens
  misc_feature (4902)..(4902): n is a, c, g, or t
  misc_feature (4917)..(4918): n is a, c, g, or t
  misc_feature (4922)..(4922): n is a, c, g, or t
  misc_feature (4930)..(4930): n is a, c, g, or t
  misc_feature (4937)..(4937): n is a, c, g, or t
  misc_feature (4941)..(4941): n is a, c, g, or t
gcatttcgggtctgcgaggtggggtaggcgggcaaggcgggcgccgaggtttgcaaaggctcgcagcggccagaaacccggctccgagcggcggcggcccggcttccgctgcccgtgagctaaggacggtccgctccctctagccagctccgaatcctgatccaggcgggggccaggggcccctcgcctcccctctgaggaccgaagatgagcttcctcttcagcagccgctcttctaaaacattcaaaccaaagaagaatatccctgaaggatctcatcagtatgaactcttaaaacatgcagaagcaactctaggaagtgggaatctgagacaagctgttatgttgcctgagggagaggatctcaatgaatggattgctgtgaacactgtggatttctttaaccagatcaacatgttatatggaactattacagaattctgcactgaagcaagctgtccagtcatgtctgcaggtccgagatatgaatatcactgggcagatggtactaatattaaaaagccaatcaaatgttctgcaccaaaatacattgactatttgatgacttgggttcaagatcagcttgatgatgaaactctttttccttctaagattggtgtcccatttcccaaaaactttatgtctgtggcaaagactattctaaagcgtctgttcagggtttatgcccatatttatcaccagcactttgattctgtgatgcagctgcaagaggaggcccacctcaacacctcctttaagcactttattttctttgttcaggagtttaatctgattgataggcgtgagctggcacctcttcaagaattaatagagaaacttggatcaaaagacagataaatgtttcttctagaacacagttacccccttgcttcatctattgctagaactatctcattgctatctgttatagactagtgatacaaactttaagaaaacaggataaaaagatacccattgcctgtgtctactgataaaattatcccaaaggtaggttggtgtgatagtttccgagtaagaccttaaggacacagccaaatcttaagtactgtgtgaccactcttgttgttatcacatagtcatacttggttgtaatatgtgatggttaacctgtagcttataaatttacttattattcttttactcatttactcagtcatttctttacaagaaaatgattgaatctgttttaggtgacagcacaatggacattaagaatttccatcaataatttatgaataagtttccagaacaaatttcctaataacacaatcagattggttttattcttttattttacgaataaaaaatgtatttttcagtatcttatctataaaaacactaccatacaaacttgaaactaaaatgttatctgaagtgacacagatgttctaaatctcaaggatactgaaaaataacattttagtttcaagtttgtatggtagtgtttttatagataagatacgtctattttttcaaaattcatgattgcagtttaaatcatcatatgacgtgtgggtgggagcaaccaaagttatttttacagggactttattttttgatctttatttgagattgttttcatatctatctaaattattaggagtgtgtgtatcagaagtaattttttaatgtcttctaaggatggtcttccaggcttttaaactgaaaagcttaattcagatagtagcttttggctgagaaaaggaatccaaaatattaataaatttagatctcaaaaccactatttttattatttcattatttttcagaggccttaaaattctggataagagaatggaggaaaatactcagagtacttgattattttatttccttttattaaaaaattacttctatgtttttattgtctcttgagccttagttaagagtagtgtagaaatgcatgaacttcatcctaataaggataaaacttaaggaaaaccacaataaaccatgaaggtgtacacatcttataacacagataaagttttggtgtgctacctattcttgagagagtgagtgagtgtatgtgtttaaaggaaacaaaatgggagaaataagttttaaaaaaatcctcattttgttaatattcaaaagatggactgagcttccacttgggttttatcttgttttaattgtttttgtatcaaaacttgaaattcctctatttctattgggatataaaagccttccccttcagtgaagaaaacatttattttttatttgattcctaggatttagtaaactctagctgtctatttaaaatgtactgaggcacaacaagtattatactggaagacttgccaaactggcaaagctttaagttcatcagcattctatgtggttcagagctgtgatttttgcaaagtattttaccaacctcctcgatggctttgataaaggttagatttgatgtttttttttagatttatttttcttactccactaaactataaagaaaataattacttagaaactccattttaaataatcatttcctagaaattcttaaatatatacagaattttaaagaaaacatttcatctgatttagttagcatccacatatcattgaggaattaaagtgtgggacagtcattattaaaaaaaagagagaaaagccctctattagacattccacaatccatgttttaagcttatccaaaggtccaaatgtcagccattctgtatgttcatgttgatcatttgcgaacaagaaagcaggtttctaggtatcacttaggatgtgaactgcctctcaactttaaaccctgttagctttacttttttaagtccacaagtgatgaaactagtttctcagctaggcttgtactttcctcattatttctagtatttcaaatattctcaaacaaaagagttaccacttttctccatttattttcagttatggaaatgttccctctcttcaccactaagctccaaagcaaatgaaagacgatcacatgtcaggacagtagtaaaggcagcttataaatgggacataaatcagagatgtgttggtattttgagactcaagactgtccttttttaaaataaaaataaaaacattaccaggttcccaagccaatctggcttaaccaacagtgcactgaaatattagtgtttacctccaaggctagggagccaaggggaggaggagaattggaggaaggggagataatgggaagaggatggcgccttcctgagttggctagagggccaacctttgataacagtttgacgaaatcaatcttttttttttttttttttttgagacagagtctcactctgtcacccaggctggagtacagtggtgggatctcggctcactgcaagctctgcctcccaggttcatgccattctcctgccccagcctctcctgagtagctggaactacaggtgcccgccaccacgcccagctaattttttctatttttagtcatgcctggctaattttttgtatttttagtagagatggggtttcaccgtgttagccaggatggtctccatctccttacctcgcaatccgcccgcctcagcctcccaaagtgttgggattacaggcatgagccaccgtgcccggcctatagaaatcaatctttttgactcttctcacttttatctccccatgcccaaggtttgcctgttccataacactcactcccttcccccttgctaatcagaagccatctcctctcagtgtctgatctctgctcttcatacatgattacagtcatggggtagagagtgcttgctaaattatgcagttaatcctatggtgctttaattttcaggccttcaaaaaacacttgtacagtgatgtgcagatttttaaacagttgaacttccttgtactacagtttttgtattgacagccaaatttgtctttcattcttcagattgtgaataaagtgatttttacagggcttccagcaaagtttttcctttcatctaaggcttgtagaaccctagcttatatagctgcttacatgagaaatgcaaaatctgtattcaccatgactttagtaacaaaggtaaagttttttagtagtgccaaggcaagaggaacaatcttggtggtagtactaagttttgtcaatattgtggtttcctgattgtattgttggctttctctctgagcattgaggtatactagaagtagagcttctcaaacataatatcattacctcataagcattaacaaatcaggcccaaagagcgtaagtcctagaaatttgttttaaagcagccctagtcatggtgctggtgctaccgccttgttttaggagcctgcctcctgtcagtatgaaaccctcacctgaaaaatgccagcctggacaccaaacactgagccccttcaacaggcacattatttccccctgagatccataagggaatttagtttctactattgtagagttctgaaaagaggtaaaatagtagtcctttggtcatcctatttttgctttcaattttgatatttcagactgtaaaaggccttgggggatgatagtacatgtggtagcagtaatttttttgaagcaactgcactgacattcatttgagttttctctcattatcagattctgttccaaacaagtattctgtagatccaaatggattaccagtgtgctacagacttcttattatagaacagcattctattctacatcaaaaatagtttgtgtaagttagttttggttaccatctaaaatatttttaaatgttctttacataaaaatttatgttgtgttttaaaatccttaggggctttatctatttttctaagtcagttaactgtacttctaaaaaaagtattttgtatctacttttgtaacttcgtcagaataaaatatattgaaagcaaaaaaaacacaaacanaaaaaactttttggnngccncgggcccnaaaagtntttnaacccattgttgtgggcggggccattggtagcgacacgggcaaagggtgcccaggaaaccgggccagaagggcgggttcttccaataacg

SEQ ID NO: 25655 - DNA, 4807 bp, Homo sapiens
  misc_feature (4678)..(4678): n is a, c, g, or t
  misc_feature (4693)..(4694): n is a, c, g, or t
  misc_feature (4698)..(4698): n is a, c, g, or t
  misc_feature (4706)..(4706): n is a, c, g, or t
  misc_feature (4713)..(4713): n is a, c, g, or t
  misc_feature (4717)..(4717): n is a, c, g, or t
gcatttcgggtctgcgaggtggggtaggcgggcaaggcgggcgccgaggtttgcaaaggctcgcagcggccagaaacccggctccgagcggcggcggcccggcttccgctgcccgtgagctaaggacggtccgctccctctagccagctccgaatcctgatccaggcgggggccaggggcccctcgcctcccctctgaggaccgaagatgagcttcctcttctgtggatttctttaaccagatcaacatgttatatggaactattacagaattctgcactgaagcaagctgtccagtcatgtctgcaggtccgagatatgaatatcactgggcagatggtactaatattaaaaagccaatcaaatgttctgcaccaaaatacattgactatttgatgacttgggttcaagatcagcttgatgatgaaactctttttccttctaagattggtgtcccatttcccaaaaactttatgtctgtggcaaagactattctaaagcgtctgttcagggtttatgcccatatttatcaccagcactttgattctgtgatgcagctgcaagaggaggcccacctcaacacctcctttaagcactttattttctttgttcaggagtttaatctgattgataggcgtgagctggcacctcttcaagaattaatagagaaacttggatcaaaagacagataaatgtttcttctagaacacagttacccccttgcttcatctattgctagaactatctcattgctatctgttatagactagtgatacaaactttaagaaaacaggataaaaagatacccattgcctgtgtctactgataaaattatcccaaaggtaggttggtgtgatagtttccgagtaagaccttaaggacacagccaaatcttaagtactgtgtgaccactcttgttgttatcacatagtcatacttggttgtaatatgtgatggttaacctgtagcttataaatttacttattattcttttactcatttactcagtcatttctttacaagaaaatgattgaatctgttttaggtgacagcacaatggacattaagaatttccatcaataatttatgaataagtttccagaacaaatttcctaataacacaatcagattggttttattcttttattttacgaataaaaaatgtatttttcagtatccttgagatttagaacatctgtgtcacttcagataacattttagtttcaagtttgtatggtagtgtttttatagataagatacgtctattttttcaaaattcatgattgcagtttaaatcatcatatgacgtgtgggtgggagcaaccaaagttatttttacagggactttattttttgatctttatttgagattgttttcatatctatctaaattattaggagtgtgtgtatcagaagtaattttttaatgtcttctaaggatggtcttccaggcttttaaactgaaaagcttaattcagatagtagcttttggctgagaaaaggaatccaaaatattaataaatttagatctcaaaaccactatttttattatttcattatttttcagaggccttaaaattctggataagagaatggaggaaaatactcagagtacttgattattttatttccttttattaaaaaattacttctatgtttttattgtctcttgagccttagttaagagtagtgtagaaatgcatgaacttcatcctaataaggataaaacttaaggaaaaccacaataaaccatgaaggtgtacacatcttataacacagataaagttttggtgtgctacctattcttgagagagtgagtgagtgtatgtgtttaaaggaaacaaaatgggagaaataagttttaaaaaaatcctcattttgttaatattcaaaagatggactgagcttccacttgggttttatcttgttttaattgtttttgtatcaaaacttgaaattcctctatttctattgggatataaaagccttccccttcagtgaagaaaacatttattttttatttgattcctaggatttagtaaactctagctgtctatttaaaatgtactgaggcacaacaagtattatactggaagacttgccaaactggcaaagctttaagttcatcagcattctatgtggttcagagctgtgatttttgcaaagtattttaccaacctcctcgatggctttgataaaggttagatttgatgtttttttttagatttatttttcttactccactaaactataaagaaaataattacttagaaactccattttaaataatcatttcctagaaattcttaaatatatacagaattttaaagaaaacatttcatctgatttagttagcatccacatatcattgaggaattaaagtgtgggacagtcattattaaaaaaaagagagaaaagccctctattagacattccacaatccatgttttaagcttatccaaaggtccaaatgtcagccattctgtatgttcatgttgatcatttgcgaacaagaaagcaggtttctaggtatcacttaggatgtgaactgcctctcaactttaaaccctgttagctttacttttttaagtccacaagtgatgaaactagtttctcagctaggcttgtactttcctcattatttctagtatttcaaatattctcaaacaaaagagttaccacttttctccatttattttcagttatggaaatgttccctctcttcaccactaagctccaaagcaaatgaaagacgatcacatgtcaggacagtagtaaaggcagcttataaatgggacataaatcagagatgtgttggtattttgagactcaagactgtccttttttaaaataaaaataaaaacattaccaggttcccaagccaatctggcttaaccaacagtgcactgaaatattagtgtttacctccaaggctagggagccaaggggaggaggagaattggaggaaggggagataatgggaagaggatggcgccttcctgagttggctagagggccaacctttgataacagtttgacgaaatcaatcttttttttttttttttttttgagacagagtctcactctgtcacccaggctggagtacagtggtgggatctcggctcactgcaagctctgcctcccaggttcatgccattctcctgccccagcctctcctgagtagctggaactacaggtgcccgccaccacgcccagctaattttttctatttttagtcatgcctggctaattttttgtatttttagtagagatggggtttcaccgtgttagccaggatggtctccatctccttacctcgcaatccgcccgcctcagcctcccaaagtgttgggattacaggcatgagccaccgtgcccggcctatagaaatcaatctttttgactcttctcacttttatctccccatgcccaaggtttgcctgttccataacactcactcccttcccccttgctaatcagaagccatctcctctcagtgtctgatctctgctcttcatacatgattacagtcatggggtagagagtgcttgctaaattatgcagttaatcctatggtgctttaattttcaggccttcaaaaaacacttgtacagtgatgtgcagatttttaaacagttgaacttccttgtactacagtttttgtattgacagccaaatttgtctttcattcttcagattgtgaataaagtgatttttacagggcttccagcaaagtttttcctttcatctaaggcttgtagaaccctagcttatatagctgcttacatgagaaatgcaaaatctgtattcaccatgactttagtaacaaaggtaaagttttttagtagtgccaaggcaagaggaacaatcttggtggtagtactaagttttgtcaatattgtggtttcctgattgtattgttggctttctctctgagcattgaggtatactagaagtagagcttctcaaacataatatcattacctcataagcattaacaaatcaggcccaaagagcgtaagtcctagaaatttgttttaaagcagccctagtcatggtgctggtgctaccgccttgttttaggagcctgcctcctgtcagtatgaaaccctcacctgaaaaatgccagcctggacaccaaacactgagccccttcaacaggcacattatttccccctgagatccataagggaatttagtttctactattgtagagttctgaaaagaggtaaaatagtagtcctttggtcatcctatttttgctttcaattttgatatttcagactgtaaaaggccttgggggatgatagtacatgtggtagcagtaatttttttgaagcaactgcactgacattcatttgagttttctctcattatcagattctgttccaaacaagtattctgtagatccaaatggattaccagtgtgctacagacttcttattatagaacagcattctattctacatcaaaaatagtttgtgtaagttagttttggttaccatctaaaatatttttaaatgttctttacataaaaatttatgttgtgttttaaaatccttaggggctttatctatttttctaagtcagttaactgtacttctaaaaaaagtattttgtatctacttttgtaacttcgtcagaataaaatatattgaaagcaaaaaaaacacaaacanaaaaaactttttggnngccncgggcccnaaaagtntttnaacccattgttgtgggcggggccattggtagcgacacgggcaaagggtgcccaggaaaccgggccagaagggcgggttcttccaataacg

SEQ ID NO: 25656 - DNA, 4920 bp, Homo sapiens
  misc_feature (4791)..(4791): n is a, c, g, or t
  misc_feature (4806)..(4807): n is a, c, g, or t
  misc_feature (4811)..(4811): n is a, c, g, or t
  misc_feature (4819)..(4819): n is a, c, g, or t
  misc_feature (4826)..(4826): n is a, c, g, or t
  misc_feature (4830)..(4830): n is a, c, g, or t
gcatttcgggtctgcgaggtggggtaggcgggcaaggcgggcgccgaggtttgcaaaggctcgcagcggccagaaacccggctccgagcggcggcggcccggcttccgctgcccgtgagctaaggacggtccgctccctctagccagctccgaatcctgatccaggcgggggccaggggcccctcgcctcccctctgaggaccgaagatgagcttcctcttcagcagccgctcttctaaaacattcaaaccaaagaagaatatccctgaaggatctcatcagtatgaactgttgcctgagggagaggatctcaatgaatggattgctgtgaacactgtggatttctttaaccagatcaacatgttatatggaactattacagaattctgcactgaagcaagctgtccagtcatgtctgcaggtccgagatatgaatatcactgggcagatggtactaatattaaaaagccaatcaaatgttctgcaccaaaatacattgactatttgatgacttgggttcaagatcagcttgatgatgaaactctttttccttctaagattggtgtcccatttcccaaaaactttatgtctgtggcaaagactattctaaagcgtctgttcagggtttatgcccatatttatcaccagcactttgattctgtgatgcagctgcaagaggaggcccacctcaacacctcctttaagcactttattttctttgttcaggagtttaatctgattgataggcgtgagctggcacctcttcaagaattaatagagaaacttggatcaaaagacagataaatgtttcttctagaacacagttacccccttgcttcatctattgctagaactatctcattgctatctgttatagactagtgatacaaactttaagaaaacaggataaaaagatacccattgcctgtgtctactgataaaattatcccaaaggtaggttggtgtgatagtttccgagtaagaccttaaggacacagccaaatcttaagtactgtgtgaccactcttgttgttatcacatagtcatacttggttgtaatatgtgatggttaacctgtagcttataaatttacttattattcttttactcatttactcagtcatttctttacaagaaaatgattgaatctgttttaggtgacagcacaatggacattaagaatttccatcaataatttatgaataagtttccagaacaaatttcctaataacacaatcagattggttttattcttttattttacgaataaaaaatgtatttttcagtatccttgagatttagaacatctgtgtcacttcagataacattttagtttcaagtttgtatggtagtgtttttatagataagatacgtctattttttcaaaattcatgattgcagtttaaatcatcatatgacgtgtgggtgggagcaaccaaagttatttttacagggactttattttttgatctttatttgagattgttttcatatctatctaaattattaggagtgtgtgtatcagaagtaattttttaatgtcttctaaggatggtcttccaggcttttaaactgaaaagcttaattcagatagtagcttttggctgagaaaaggaatccaaaatattaataaatttagatctcaaaaccactatttttattatttcattatttttcagaggccttaaaattctggataagagaatggaggaaaatactcagagtacttgattattttatttccttttattaaaaaattacttctatgtttttattgtctcttgagccttagttaagagtagtgtagaaatgcatgaacttcatcctaataaggataaaacttaaggaaaaccacaataaaccatgaaggtgtacacatcttataacacagataaagttttggtgtgctacctattcttgagagagtgagtgagtgtatgtgtttaaaggaaacaaaatgggagaaataagttttaaaaaaatcctcattttgttaatattcaaaagatggactgagcttccacttgggttttatcttgttttaattgtttttgtatcaaaacttgaaattcctctatttctattgggatataaaagccttccccttcagtgaagaaaacatttattttttatttgattcctaggatttagtaaactctagctgtctatttaaaatgtactgaggcacaacaagtattatactggaagacttgccaaactggcaaagctttaagttcatcagcattctatgtggttcagagctgtgatttttgcaaagtattttaccaacctcctcgatggctttgataaaggttagatttgatgtttttttttagatttatttttcttactccactaaactataaagaaaataattacttagaaactccattttaaataatcatttcctagaaattcttaaatatatacagaattttaaagaaaacatttcatctgatttagttagcatccacatatcattgaggaattaaagtgtgggacagtcattattaaaaaaaagagagaaaagccctctattagacattccacaatccatgttttaagcttatccaaaggtccaaatgtcagccattctgtatgttcatgttgatcatttgcgaacaagaaagcaggtttctaggtatcacttaggatgtgaactgcctctcaactttaaaccctgttagctttacttttttaagtccacaagtgatgaaactagtttctcagctaggcttgtactttcctcattatttctagtatttcaaatattctcaaacaaaagagttaccacttttctccatttattttcagttatggaaatgttccctctcttcaccactaagctccaaagcaaatgaaagacgatcacatgtcaggacagtagtaaaggcagcttataaatgggacataaatcagagatgtgttggtattttgagactcaagactgtccttttttaaaataaaaataaaaacattaccaggttcccaagccaatctggcttaaccaacagtgcactgaaatattagtgtttacctccaaggctagggagccaaggggaggaggagaattggaggaaggggagataatgggaagaggatggcgccttcctgagttggctagagggccaacctttgataacagtttgacgaaatcaatcttttttttttttttttttttgagacagagtctcactctgtcacccaggctggagtacagtggtgggatctcggctcactgcaagctctgcctcccaggttcatgccattctcctgccccagcctctcctgagtagctggaactacaggtgcccgccaccacgcccagctaattttttctatttttagtcatgcctggctaattttttgtatttttagtagagatggggtttcaccgtgttagccaggatggtctccatctccttacctcgcaatccgcccgcctcagcctcccaaagtgttgggattacaggcatgagccaccgtgcccggcctatagaaatcaatctttttgactcttctcacttttatctccccatgcccaaggtttgcctgttccataacactcactcccttcccccttgctaatcagaagccatctcctctcagtgtctgatctctgctcttcatacatgattacagtcatggggtagagagtgcttgctaaattatgcagttaatcctatggtgctttaattttcaggccttcaaaaaacacttgtacagtgatgtgcagatttttaaacagttgaacttccttgtactacagtttttgtattgacagccaaatttgtctttcattcttcagattgtgaataaagtgatttttacagggcttccagcaaagtttttcctttcatctaaggcttgtagaaccctagcttatatagctgcttacatgagaaatgcaaaatctgtattcaccatgactttagtaacaaaggtaaagttttttagtagtgccaaggcaagaggaacaatcttggtggtagtactaagttttgtcaatattgtggtttcctgattgtattgttggctttctctctgagcattgaggtatactagaagtagagcttctcaaacataatatcattacctcataagcattaacaaatcaggcccaaagagcgtaagtcctagaaatttgttttaaagcagccctagtcatggtgctggtgctaccgccttgttttaggagcctgcctcctgtcagtatgaaaccctcacctgaaaaatgccagcctggacaccaaacactgagccccttcaacaggcacattatttccccctgagatccataagggaatttagtttctactattgtagagttctgaaaagaggtaaaatagtagtcctttggtcatcctatttttgctttcaattttgatatttcagactgtaaaaggccttgggggatgatagtacatgtggtagcagtaatttttttgaagcaactgcactgacattcatttgagttttctctcattatcagattctgttccaaacaagtattctgtagatccaaatggattaccagtgtgctacagacttcttattatagaacagcattctattctacatcaaaaatagtttgtgtaagttagttttggttaccatctaaaatatttttaaatgttctttacataaaaatttatgttgtgttttaaaatccttaggggctttatctatttttctaagtcagttaactgtacttctaaaaaaagtattttgtatctacttttgtaacttcgtcagaataaaatatattgaaagcaaaaaaaacacaaacanaaaaaactttttggnngccncgggcccnaaaagtntttnaacccattgttgtgggcggggccattggtagcgacacgggcaaagggtgcccaggaaaccgggccagaagggcgggttcttccaataacg

SEQ ID NO: 25657 - DNA, 2357 bp, Homo sapiens
aattattagaaaaaaaagattccaacattacaataagagaacagaacactaacgcttggagctgatcctgctagcccagtggaggccaagtgccacagtgagaaaagccctctattagacattccacaatccatgttttaagcttatccaaaggtccaaatgtcagccattctgtatgttcatgttgatcatttgcgaacaagaaagcaggtttctaggtatcacttaggatgtgaactgcctctcaactttaaaccctgttagctttacttttttaagtccacaagtgatgaaactagtttctcagctaggcttgtactttcctcattatttctagtatttcaaatattctcaaacaaaagagttaccacttttctccatttattttcagttatggaaatgttccctctcttcaccactaagctccaaagcaaatgaaagacgatcacatgtcaggacagtagtaaaggcagcttataaatgggacataaatcagagatgtgttggtattttgagactcaagactgtccttttttaaaataaaaataaaaacattaccaggttcccaagccaatctggcttaaccaacagtgcactgaaatattagtgtttacctccaaggctagggagccaaggggaggaggagaattggaggaaggggagataatgggaagaggatggcgccttcctgagttggctagagggccaacctttgataacagtttgacgaaatcaatcttttttttttttttttttttgagacagagtctcactctgtcacccaggctggagtacagtggtgggatctcggctcactgcaagctctgcctcccaggttcatgccattctcctgccccagcctctcctgagtagctggaactacaggtgcccgccaccacgcccagctaattttttctatttttagtcatgcctggctaattttttgtatttttagtagagatggggtttcaccgtgttagccaggatggtctccatctccttacctcgcaatccgcccgcctcagcctcccaaagtgttgggattacaggcatgagccaccgtgcccggcctatagaaatcaatctttttgactcttctcacttttatctccccatgcccaaggtttgcctgttccataacactcactcccttcccccttgctaatcagaagccatctcctctcagtgtctgatctctgctcttcatacatgattacagtcatggggtagagagtgcttgctaaattatgcagttaatcctatggtgctttaattttcaggccttcaaaaaacacttgtacagtgatgtgcagatttttaaacagttgaacttccttgtactacagtttttgtattgacagccaaatttgtctttcattcttcagattgtgaataaagtgatttttacagggcttccagcaaagtttttcctttcatctaaggcttgtagaaccctagcttatatagctgcttacatgagaaatgcaaaatctgtattcaccatgactttagtaacaaaggtaaagttttttagtagtgccaaggcaagaggaacaatcttggtggtagtactaagttttgtcaatattgtggtttcctgattgtattgttggctttctctctgagcattgaggtatactagaagtagagcttctcaaacataatatcattacctcataagcattaacaaatcaggcccaaagagcgtaagtcctagaaatttgttttaaagcagccctagtcatggtgctggtgctaccgccttgttttaggagcctgcctcctgtcagtatgaaaccctcacctgaaaaatgccagcctggacaccaaacactgagccccttcaacaggcacattatttccccctgagatccataagggaatttagtttctactattgtagagttctgaaaagaggtaaaatagtagtcctttggtcatcctatttttgctttcaattttgatatttcagactgtaaaaggccttgggggatgatagtacatgtggtagcagtaatttttttgaagcaactgcactgacattcatttgagttttctctcattatcagattctgttccaaacaagtattctgtagatccaaatggattaccagtgtgctacagacttcttattatagaacagcattctattctacatcaaaaatagtttgtgtaagttagttttggttaccatctaaaatatttttaaatgttctttacataaaaatttatgttgtgttttaaaatccttaggggctttatctatttttctaagtcagttaactgtacttctaaaaaaagtattttgtatctacttttgtaacttcgtcagaataaaatatattgaaagcaaaaaa

SEQ ID NO: 25658 - DNA, 2038 bp, Homo sapiens
gtgaggtgatggatatgttaattagctggattgtggtaatcagagttaccacttttctccatttattttcagttatggaaatgttccctctcttcaccactaagctccaaagcaaatgaaagacgatcacatgtcaggacagtagtaaaggcagcttataaatgggacataaatcagagatgtgttggtattttgagactcaagactgtccttttttaaaataaaaataaaaacattaccaggttcccaagccaatctggcttaaccaacagtgcactgaaatattagtgtttacctccaaggctagggagccaaggggaggaggagaattggaggaaggggagataatgggaagaggatggcgccttcctgagttggctagagggccaacctttgataacagtttgacgaaatcaatcttttttttttttttttttttgagacagagtctcactctgtcacccaggctggagtacagtggtgggatctcggctcactgcaagctctgcctcccaggttcatgccattctcctgccccagcctctcctgagtagctggaactacaggtgcccgccaccacgcccagctaattttttctatttttagtcatgcctggctaattttttgtatttttagtagagatggggtttcaccgtgttagccaggatggtctccatctccttacctcgcaatccgcccgcctcagcctcccaaagtgttgggattacaggcatgagccaccgtgcccggcctatagaaatcaatctttttgactcttctcacttttatctccccatgcccaaggtttgcctgttccataacactcactcccttcccccttgctaatcagaagccatctcctctcagtgtctgatctctgctcttcatacatgattacagtcatggggtagagagtgcttgctaaattatgcagttaatcctatggtgctttaattttcaggccttcaaaaaacacttgtacagtgatgtgcagatttttaaacagttgaacttccttgtactacagtttttgtattgacagccaaatttgtctttcattcttcagattgtgaataaagtgatttttacagggcttccagcaaagtttttcctttcatctaaggcttgtagaaccctagcttatatagctgcttacatgagaaatgcaaaatctgtattcaccatgactttagtaacaaaggtaaagttttttagtagtgccaaggcaagaggaacaatcttggtggtagtactaagttttgtcaatattgtggtttcctgattgtattgttggctttctctctgagcattgaggtatactagaagtagagcttctcaaacataatatcattacctcataagcattaacaaatcaggcccaaagagcgtaagtcctagaaatttgttttaaagcagccctagtcatggtgctggtgctaccgccttgttttaggagcctgcctcctgtcagtatgaaaccctcacctgaaaaatgccagcctggacaccaaacactgagccccttcaacaggcacattatttccccctgagatccataagggaatttagtttctactattgtagagttctgaaaagaggtaaaatagtagtcctttggtcatcctatttttgctttcaattttgatatttcagactgtaaaaggccttgggggatgatagtacatgtggtagcagtaatttttttgaagcaactgcactgacattcatttgagttttctctcattatcagattctgttccaaacaagtattctgtagatccaaatggattaccagtgtgctacagacttcttattatagaacagcattctattctacatcaaaaatagtttgtgtaagttagttttggttaccatctaaaatatttttaaatgttctttacataaaaatttatgttgtgttttaaaatccttaggggctttatctatttttctaagtcagttaactgtacttctaaaaaaagtattttgtatctacttttgtaacttcgtcagaataaaatatattgaaagcaaaaaa

SEQ ID NO: 25659 - DNA, 1237 bp, Homo sapiens
actggaactcaggattaagaaactcactcccttcccccttgctaatcagaagccatctcctctcagtgtctgatctctgctcttcatacatgattacagtcatggggtagagagtgcttgctaaattatgcagttaatcctatggtgctttaattttcaggccttcaaaaaacacttgtacagtgatgtgcagatttttaaacagttgaacttccttgtactacagtttttgtattgacagccaaatttgtctttcattcttcagattgtgaataaagtgatttttacagggcttccagcaaagtttttcctttcatctaaggcttgtagaaccctagcttatatagctgcttacatgagaaatgcaaaatctgtattcaccatgactttagtaacaaaggtaaagttttttagtagtgccaaggcaagaggaacaatcttggtggtagtactaagttttgtcaatattgtggtttcctgattgtattgttggctttctctctgagcattgaggtatactagaagtagagcttctcaaacataatatcattacctcataagcattaacaaatcaggcccaaagagcgtaagtcctagaaatttgttttaaagcagccctagtcatggtgctggtgctaccgccttgttttaggagcctgcctcctgtcagtatgaaaccctcacctgaaaaatgccagcctggacaccaaacactgagccccttcaacaggcacattatttccccctgagatccataagggaatttagtttctactattgtagagttctgaaaagaggtaaaatagtagtcctttggtcatcctatttttgctttcaattttgatatttcagactgtaaaaggccttgggggatgatagtacatgtggtagcagtaatttttttgaagcaactgcactgacattcatttgagttttctctcattatcagattctgttccaaacaagtattctgtagatccaaatggattaccagtgtgctacagacttcttattatagaacagcattctattctacatcaaaaatagtttgtgtaagttagttttggttaccatctaaaatatttttaaatgttctttacataaaaatttatgttgtgttttaaaatccttaggggctttatctatttttctaagtcagttaactgtacttctaaaaaaagtattttgtatctacttttgtaacttcgtcagaataaaatatattgaaagcaaaaaa

SEQ ID NO: 25660 - DNA, 1281 bp, Homo sapiens
tggagacagagtcttgctctgtcgcccagactggagtgcagtggcacgatctcggctaactgcaacctttgcctcctgggttcaagcagttctcctgcctcagcctcctcagtagctgggattataggcacctgccaccacgcccggctaatttttatgtttactagaaatggggtttcaccatgttggctaggctgatctcgaactcctgacctcaaatgatccacccaccttgtcctcccaaaatgctgggattacaggcatgagccaccatgcccggccccaaacactttctttcatgaatggtcgacgcggccggtattgatttttacagggcttccagcaaagtttttcctttcatctaaggcttgtagaaccctagcttatatagctgcttacatgagaaatgcaaaatctgtattcaccatgactttagtaacaaaggtaaagttttttagtagtgccaaggcaagaggaacaatcttggtggtagtactaagttttgtcaatattgtggtttcctgattgtattgttggctttctctctgagcattgaggtatactagaagtagagcttctcaaacataatatcattacctcataagcattaacaaatcaggcccaaagagcgtaagtcctagaaatttgttttaaagcagccctagtcatggtgctggtgctaccgccttgttttaggagcctgcctcctgtcagtatgaaaccctcacctgaaaaatgccagcctggacaccaaacactgagccccttcaacaggcacattatttccccctgagatccataagggaatttagtttctactattgtagagttctgaaaagaggtaaaatagtagtcctttggtcatcctatttttgctttcaattttgatatttcagactgtaaaaggccttgggggatgatagtacatgtggtagcagtaatttttttgaagcaactgcactgacattcatttgagttttctctcattatcagattctgttccaaacaagtattctgtagatccaaatggattaccagtgtgctacagacttcttattatagaacagcattctattctacatcaaaaatagtttgtgtaagttagttttggttaccatctaaaatatttttaaatgttctttacataaaaatttatgttgtgttttaaaatccttaggggctttatctatttttctaagtcagttaactgtacttctaaaaaaagtattttgtatctacttttgtaacttcgtcagaataaaatatattgaaagcaaaaaa

SEQ ID NO: 25661 - DNA, 1133 bp, Homo sapiens
  misc_feature (1071)..(1071): n is a, c, g, or t
  misc_feature (1115)..(1115): n is a, c, g, or t
  misc_feature (1131)..(1131): n is a, c, g, or t
gcatttcgggtctgcgaggtggggtaggcgggcaaggcgggcgccgaggtttgcaaaggctcgcagcggccagaaacccggctccgagcggcggcggcccggcttccgctgcccgtgagctaaggacggtccgctccctctagccagctccgaatcctgatccaggcgggggccaggggcccctcgcctcccctctgaggaccgaagatgagcttcctcttcagcagccgctcttctaaaacattcaaaccaaagaagaatatccctgaaggatctcatcagtatgaactcttaaaacatgcagaagcaactctaggaagtgggaatctgagacaagctgttatgttgcctgagggagaggatctcaatgaatggattgctgtgaacactgtggatttctttaaccagatcaacatgttatatggaactattacagaattctgcactgaagcaagctgtccagtcatgtctgcaggtccgagatatgaatatcactgggcagatggtactaatattaaaaagccaatcaaatgttctgcaccaaaatacattgactatttgatgacttgggttcaagatcagcttgatgatgaaactctttttccttctaagattggtgtcccatttcccaaaaactttatgtctgtggcaaagactattctaaagcgtctgttcagggtttatgcccatatttatcaccagcactttgattctgtgatgcagctgcaagaggaggcccacctcaacacctcctttaagcactttattttctttgttcaggagtttaatctgattgataggcgtgagctggcacctcttcaagaattaatagagaaacttggatcaaaagacagataaatgtttcttctagaacacagttacccccttgcttcatctattgctagaactatctcattgctatctgttatagactagtgatacaaactttaagaaaacaggataaaaagatacccattgcctgtgtctactgataaaattatcccaaaggtaggttggtgtgatagtttccgagtaagaccttaaggacacagccaaatcttaagtactgtngcactctgtggaacacaagcaactggtgaaatggtggacctgantaaatactatatcttnct

SEQ ID NO: 25662 - DNA, 893 bp, Homo sapiens
gtcttgctctgtcacctgggctggagtgcagtgatgcgatttcagcttactgcaacctctgcctcccaggttcaagccattcttctgcctcagcctcccaagtagctgggactacaggtgtgcgccatcatgcttggctaatttttgtatttttagtagacgtgtggtttcaccatgttggtcaggctggtcttgaactcctgacctcaggtgatcccaaagtgctgggattacaggcatgagccaccatgcctggcccagagagtattttttattttatttttacaggctactttatatacctaaaattatgttgttctacctgttctacttccagtcttaaaaattcatatacttgcacttttaatcttacagcagcagccgctcttctaaaacattcaaaccaaagaagaatatccctgaaggatctcatcagtatgaactcttaaaacatgcagaagcaactctaggaagtgggaatctgagacaagctgttatgttgcctgagggagaggatctcaatgaatggattgctgtgaacactgtggatttctttaaccagatcaacatgttatatggaactattacagaattctgcactgaagcaagctgtccagtcatgtctgcaggtccgagatatgaatatcactgggcagatggtactaatattaaaaagccaatcaaatgttctgcaccaaaatactttgtgtaagttagttttggttaccatctaaaatatttttaaatgttctttacataaaaatttatgttgtgttttaaaatccttaggggctttatctatttttctaagtcagttaactgtacttctaaaaaaagtattttgtatctacttttgtaacttcgtcagaataaaatatattgaaagcaaaaaa

SEQ ID NO: 25663 - DNA, 4645 bp, Homo sapiens
gaaaagttgtcagtccttactgttcaggacgttggtcaggtgatgcctggagctaatgtatgtgttgtgaagttagaaggtaccccttatctttgtaaaactgatgaagtgggagaaatatgcgtcagttccagtgcaactggcacagcgtactatggattgcttggaatcacgaagaatgtgtttgaggcagttccggtcaccacaggaggagcacccatctttgacaggccattcaccaggacaggcctgctgggcttcatcgggcctgacaacctggtcttcatcgtgggcaaactggacgggctgatggtcactggagttcgcagacacaatgcagatgacgttgtggccaccgcactggccgtggagcccatgaagtttgtctacagaggcaggatcgctgtgttctctgtgaccgtgctgcacgacgaccggattgtcctggtggctgagcagcggccggatgcctcggaggaggacagcttccagtggatgagccgtgtgctgcaggccattgatagcatccaccaggtgggcgtgtactgtctggccctggttcctgccaacaccttgcccaaggctcctctcggagggattcacatttctgaaaccaaacagcgctttctggaagggacgctgcacccgtgtaatgtgctgatgtgccctcacacctgtgttaccaacctccccaaacctcgtcagaaacaaccagaggttggaccagcctcaatgatcgtggggaacctggttgctgggaagagaatcgctcaggcttccgggagagagctcgcccacctggaggacagcgaccaggcacggaagttcctgttcctggctgacgtgctgcagtggcgtgcccacaccactcctgaccacccgctgttcttgctgctgaacgccaagggcaccgtcacaagcactgcaacctgtgtccagctgcacaaaagggctgagagagtggccgcggctctgatggagaagggaagactgagtgttggggaccatgtggctctggtctacccaccaggggtggacctcattgccgcgttctatggctgcttgtactgtggctgcgtgcctgtcaccgtgcggcccccgcaccctcagaacctcggcaccacactgcccaccgtcaagatgatcgtggaggtcagcaagtctgcatgcgtcctcaccacgcaggctgtcacacggctgctcaggtccaaggaggctgctgctgccgtggacatcaggacctggcccaccatcctagacacagatgacatcccaaaaaagaagatagcaagcgttttcaggcccccctcccccgatgtcctcgcatacttggacttcagcgtgtcaaccactgggatattagcgggagtgaagatgtcgcacgcggccacaagcgccttatgccgctccataaagctgcagtgtgagctgtacccctcgcggcagatcgccatctgcctcgacccctactgtggccttggttttgccctgtggtgtctgtgcagtgtctactcgggacaccaatcagtgctggtgcccccgctggagctggagagcaacgtgtccctgtggctgtcggccgtcagccagtacaaggcccgcgtcaccttctgctcctactctgtgatggagatgtgcaccaagggcctaggcgcacagacgggtgtcctcaggatgaagggggtgaacctgtcatgtgtgcgcacgtgcatggtggtcgccgaggagcggcccaggattgcgctgacccagtccttctccaagctcttcaaggacctgggcctgccggcccgcgccgtaagcaccacgttcgggtgcagggtcaacgtggccatctgcctccagggcacagctggcccggaccccacaaccgtctacgtggacatgcgggcactgcgccatgacagggttcgtttggtagaacggggttctccgcacagcctgccattgatggagtctggaaagatcctccccggcgtgaaggtcatcatcgcacacaccgagaccaaaggacccttgggagactcacacctgggagagatctgggtaagcagcccccacaatgccaccgggtactacaccgtttacggggaggaggcgcttcatgctgaccacttcagtgcccggctgagttttggagacacacagaccatctgggcaaggaccggctaccttggcttccttcggcgaacagagctcactgatgccagtggagggcggcacgatgcactgtatgtggttgggtctctggatgaaactctggagctcagaggcatgcggtaccaccccatcgacattgagacctctgtcatccgagcacacaggagcatcgctgagtgtgccgtattcacctggaccaacctgctggtggtggtggtggagctggatgggctagagcaggatgccctggacctggtggccctggtgaccaacgtggtgctggaggagcactacctggtcgtgggagtggtggtcatcgtggacccaggggtgatccctatcaactctcggggtgagaagcagcgcatgcacctgcgggacggcttcctggctgaccagctggaccccatctatgtcgcctacaacatgtgagcgcagcacaccggcccaggtgccggagatgaatgagccccagcagtccaaggtgtgatgtgggaagacaccgcagagctcactcaccgggactcgcccttcctgtgctcttacagatccctctcaacaatccccgcatctccttttagaaagcacttcctgaattatttaaagaaatattttgaatctgccaagtacatttacaaaaacacggatgctggtattttaacagatggagagacaaggaaaggaaaggaaaggcctggcatgggcattgtgaggaatcacaggcaccgaggttgttctctgctgtactgcaagtttgcactttctttaggctaaaaatatagttcctgatttttaaaattcagttatttattcccacttcaaatgacaagttcatatatagaatttacgggagaaacttgagaccatttacggggagacatttgattctgggaagatagcagagtacaaaccagctgcctcacttctgtttcacagggaggctgatggaaaaaggaagcaagctggacccatcctccctgctcacagagggcactgtggtcacacacagtgcctcctctgccagttcctttattgaaagaggtgtgctggctggccacggtggcttacacctgtaatcccagcactttgggaggccgaggcgagcagatcacgatggtctccatctccttacctcgcaatccgcccgcctcagcctcccaaagtgttgggattacaggcatgagccaccgtgcccggcctatagaaatcaatctttttgactcttctcacttttatctccccatgcccaaggtttgcctgttccataacactcactcccttcccccttgctaatcagaagccatctcctctcagtgtctgatctctgctcttcatacatgattacagtcatggggtagagagtgcttgctaaattatgcagttaatcctatggtgctttaattttcaggccttcaaaaaacacttgtacagtgatgtgcagatttttaaacagttgaacttccttgtactacagtttttgtattgacagccaaatttgtctttcattcttcagattgtgaataaagtgatttttacagggcttccagcaaagtttttcctttcatctaaggcttgtagaaccctagcttatatagctgcttacatgagaaatgcaaaatctgtattcaccatgactttagtaacaaaggtaaagttttttagtagtgccaaggcaagaggaacaatcttggtggtagtactaagttttgtcaatattgtggtttcctgattgtattgttggctttctctctgagcattgaggtatactagaagtagagcttctcaaacataatatcattacctcataagcattaacaaatcaggcccaaagagcgtaagtcctagaaatttgttttaaagcagccctagtcatggtgctggtgctaccgccttgttttaggagcctgcctcctgtcagtatgaaaccctcacctgaaaaatgccagcctggacaccaaacactgagccccttcaacaggcacattatttccccctgagatccataagggaatttagtttctactattgtagagttctgaaaagaggtaaaatagtagtcctttggtcatcctatttttgctttcaattttgatatttcagactgtaaaaggccttgggggatgatagtacatgtggtagcagtaatttttttgaagcaactgcactgacattcatttgagttttctctcattatcagattctgttccaaacaagtattctgtagatccaaatggattaccagtgtgctacagacttcttattatagaacagcattctattctacatcaaaaatagtttgtgtaagttagttttggttaccatctaaaatatttttaaatgttctttacataaaaatttatgttgtgttttaaaatccttaggggctttatctatttttctaagtcagttaactgtacttctaaaaaaagtattttgtatctacttttgtaacttcgtcagaataaaatatattgaaagcaaaaaa

SEQ ID NO: 25664 - DNA, 1811 bp, Homo sapiens
gcatttcgggtctgcgaggtggggtaggcgggcaaggcgggcgccgaggtttgcaaaggctcgcagcggccagaaacccggctccgagcggcggcggcccggcttccgctgcccgtgagctaaggacggtccgctccctctagccagctccgaatcctgatccaggcgggggccaggggcccctcgcctcccctctgaggaccgaagatgagcttcctcttcagcagccgctcttctaaaacattcaaaccaaagaagaatatccctgaaggatctcatcagtatgaactcttaaaacatgcagaagcaactctaggaagtgggaatctgagacaagctgttatgttgcctgagggagaggatctcaatgaatggattgctgtgaacactgtggatttctttaaccagatcaacatgttatatggaactattacagaattctgcactgaagcaagctgtccagtcatgtctgcaggtccgagatatgaatatcactgggcagatggtactaatattaaaaagccaatcaaatgttctgcaccaaaatacattgactatttgatgacttgggttcaagatcagcttgatgatgaaactctttttccttctaagattggtgagttaacattgtcgaagtattctttctttttttaaaattttattttattaatataaatagagttgggggggtttgctgtgttgtccaggttggtctcaaactcctggcctcaagtgatcctcctgccttggcctcccacagtgctgggattacaggtttgagccaccgtatccagcctgtttctctttttgaatgataaatctgctctttttaacattgttatacttgtagagactgccaaattctcctccaaaaagtttgtaccaacatgtactccccccagccctgtttgtgtttgccagtgtttcttcaccaacactggttattactcattttttaatattttctaatttggttaaatttctgttttaatatgcatttaaaaaatgttgatgagattgagcattttagcctttttgtttgttttattgatcattgtgtgttttctgtttatatctttcatctatttctgtgtaaaggatattagcgctttgtcgtatgtgttgtatatctttttccccgggttaccttttgtctcattttgttcatggagtatttttgctgtacacaaccttactattttgtcctattatatcttttatgacttgattttaatataacaattagaaagcttttccctgcttcaagattataaaaatatttattcatgttttcttttttatttttttattttttgagacagagtctcactctgttgcccaggctggagtgcagcggcacaatcttggctcactgcaatctccacctcccaggttcaagcagttctcatgcctcagtccctgggtagctgggactacaggcacatgccaccatgcccagctaatttttgtatttttagtagagatggggtttcaccatgttggccaggctggtcttgaacgcctgacctaaagtgatctacctgccttggcatcccaaagtgttgggattacaggcatgagccaccacgcctggctgggaagttttttttccctgaatgctacattaatttttttccaaatggaaatactagtcagtttgtcccattaccatttattaaacacatttgccttttctcccctgattatcttatgtgcacaacaaattgccatatatttttgcatgttttagtctctttatctgttcctatagaaattccacacgttggtgactgtggctctgcatctgttag

SEQ ID NO: 25665 - DNA, 4834 bp, Homo sapiens
gcatttcgggtctgcgaggtggggtaggcgggcaaggcgggcgccgaggtttgcaaaggctcgcagcggccagaaacccggctccgagcggcggcggcccggcttccgctgcccgtgagctaaggacggtccgctccctctagccagctccgaatcctgatccaggcgggggccaggggcccctcgcctcccctctgaggaccgaagatgagcttcctcttcagcagccgctcttctaaaacattcaaaccaaagaagaatatccctgaaggatctcatcagtatgaactcttaaaacatgcagaagcaactctaggaagtgggaatctgagacaagctgttatgttgcctgagggagaggatctcaatgaatggattgctgtgaacactgtggatttctttaaccagatcaacatgttatatggaactattacagaattctgcactgaagcaagctgtccagtcatgtctgcaggtccgagatatgaatatcactgggcagatggtactaatattaaaaagccaatcaaatgttctgcaccaaaatacattgactatttgatgacttgggttcaagatcagcttgatgatgaaactctttttccttctaagattggtgtcccatttcccaaaaactttatgtctgtggcaaagactattctaaagcgtctgttcagggtttatgcccatatttatcaccagcactttgattctgtgatgcagctgcaagaggaggcccacctcaacacctcctttaagcactttattttctttgttcaggagtttaatctgattgataggcgtgagctggcacctcttcaagaattaatagagaaacttggatcaaaagacagataaatgtttcttctagaacacagttacccccttgcttcatctattgctagaactatctcattgctatctgttatagactagtgatacaaactttaagaaaacaggataaaaagatacccattgcctgtgtctactgataaaattatcccaaaggtaggttggtgtgatagtttccgagtaagaccttaaggacacagccaaatcttaagtactgtgtgaccactcttgttgttatcacatagtcatacttggttgtaatatgtgatggttaacctgtagcttataaatttacttattattcttttactcatttactcagtcatttctttacaagaaaatgattgaatctgttttaggtgacagcacaatggacattaagaatttccatcaataatttatgaataagtttccagaacaaatttcctaataacacaatcagattggttttattcttttattttacgaataaaaaatgtatttttcagtatccttgagatttagaacatctgtgtcacttcagataacattttagtttcaagtttgtatggtagtgtttttatagataagatacgtctattttttcaaaattcatgattgcagtttaaatcatcatatgacgtgtgggtgggagcaaccaaagttatttttacagggactttattttttgatctttatttgagattgttttcatatctatctaaattattaggagtgtgtgtatcagaagtaattttttaatgtcttctaaggatggtcttccaggcttttaaactgaaaagcttaattcagatagtagcttttggctgagaaaaggaatccaaaatattaataaatttagatctcaaaaccactatttttattatttcattatttttcagaggccttaaaattctggataagagaatggaggaaaatactcagagtacttgattattttatttccttttattaaaaaattacttctatgtttttattgtctcttgagccttagttaagagtagtgtagaaatgcatgaacttcatcctaataaggataaaacttaaggaaaaccacaataaaccatgaaggtgtacacatcttataacacagataaagttttggtgtgctacctattcttgagagagtgagtgagtgtatgtgtttaaaggaaacaaaatgggagaaataagttttaaaaaaatcctcattttgttaatattcaaaagatggactgagcttccacttgggttttatcttgttttaattgtttttgtatcaaaacttgaaattcctctatttctattgggatataaaagccttccccttcagtgaagaaaacatttattttttatttgattcctaggatttagtaaactctagctgtctatttaaaatgtactgaggcacaacaagtattatactggaagacttgccaaactggcaaagctttaagttcatcagcattctatgtggttcagagctgtgatttttgcaaagtattttaccaacctcctcgatggctttgataaaggttagatttgatgtttttttttagatttatttttcttactccactaaactataaagaaaataattacttagaaactccattttaaataatcatttcctagaaattcttaaatatatacagaattttaaagaaaacatttcatctgatttagttagcatccacatatcattgaggaattaaagtgtgggacagtcattattaaaaaaaagagagaaaagccctctattagacattccacaatccatgttttaagcttatccaaaggtccaaatgtcagccattctgtatgttcatgttgatcatttgcgaacaagaaagcaggtttctaggtatcacttaggatgtgaactgcctctcaactttaaaccctgttagctttacttttttaagtccacaagtgatgaaactagtttctcagctaggcttgtactttcctcattatttctagtatttcaaatattctcaaacaaaagagttaccacttttctccatttattttcagttatggaaatgttccctctcttcaccactaagctccaaagcaaatgaaagacgatcacatgtcaggacagtagtaaaggcagcttataaatgggacataaatcagagatgtgttggtattttgagactcaagactgtccttttttaaaataaaaataaaaacattaccaggttcccaagccaatctggcttaaccaacagtgcactgaaatattagtgtttacctccaaggctagggagccaaggggaggaggagaattggaggaaggggagataatgggaagaggatggcgccttcctgagttggctagagggccaacctttgataacagtttgacgaaatcaatcttttttttttttttttttttgagacagagtctcactctgtcacccaggctggagtacagtggtgggatctcggctcactgcaagctctgcctcccaggttcatgccattctcctgccccagcctctcctgagtagctggaactacaggtgcccgccaccacgcccagctaattttttctatttttagtcatgcctggctaattttttgtatttttagtagagatggggtttcaccgtgttagccaggatggtctccatctccttacctcgcaatccgcccgcctcagcctcccaaagtgttgggattacaggcatgagccaccgtgcccggcctatagaaatcaatctttttgactcttctcacttttatctccccatgcccaaggtttgcctgttccataacactcactcccttcccccttgctaatcagaagccatctcctctcagtgtctgatctctgctcttcatacatgattacagtcatggggtagagagtgcttgctaaattatgcagttaatcctatggtgctttaattttcaggccttcaaaaaacacttgtacagtgatgtgcagatttttaaacagttgaacttccttgtactacagtttttgtattgacagccaaatttgtctttcattcttcagattgtgaataaagtgatttttacagggcttccagcaaagtttttcctttcatctaaggcttgtagaaccctagcttatatagctgcttacatgagaaatgcaaaatctgtattcaccatgactttagtaacaaaggtaaagttttttagtagtgccaaggcaagaggaacaatcttggtggtagtactaagttttgtcaatattgtggtttcctgattgtattgttggctttctctctgagcattgaggtatactagaagtagagcttctcaaacataatatcattacctcataagcattaacaaatcaggcccaaagagcgtaagtcctagaaatttgttttaaagcagccctagtcatggtgctggtgctaccgccttgttttaggagcctgcctcctgtcagtatgaaaccctcacctgaaaaatgccagcctggacaccaaacactgagccccttcaacaggcacattatttccccctgagatccataagggaatttagtttctactattgtagagttctgaaaagaggtaaaatagtagtcctttggtcatcctatttttgctttcaattttgatatttcagactgtaaaaggccttgggggatgatagtacatgtggtagcagtaatttttttgaagcaactgcactgacattcatttgagttttctctcattatcagattctgttccaaacaagtattctgtagatccaaatggattaccagtgtgctacagacttcttattatagaacagcattctattctacatcaaaaatagtttgtgtaagttagttttggttaccatctaaaatatttttaaatgttctttacataaaaatttatgttgtgttttaaaatccttaggggctttatctatttttctaagtcagttaactgtacttctaaaaaaagtattttgtatctacttttgtaacttcgtcagaataaaatatattgaaagcaaaaaa

SEQ ID NO: 25666 - DNA, 4539 bp, Homo sapiens
gcatttcgggtctgcgaggtggggtaggcgggcaaggcgggcgccgaggtttgcaaaggctcgcagcggccagaaacccggctccgagcggcggcggcccggcttccgctgcccgtgagctaaggacggtccgctccctctagccagctccgaatcctgatccaggcgggggccaggggcccctcgcctcccctctgaggaccgaagatgagcttcctcttcagcagccgctcttctaaaacattcaaaccaaagaagaatatccctgaaggatctcatcagtatgaactcttaaaacatgcagaagcaactctaggaagtgggaatctgagacaagctgttatgttgcctgagggagaggatctcaatgaatggattgctgtgaacactgtggatttctttaaccagatcaacatgttatatggaactattacagaattctgcactgaagcaagctgtccagtcatgtctgcaggtccgagatatgaatatcactgggcagatggtactaatattaaaaagccaatcaaatgttctgcaccaaaatacattgactatttgatgacttgggttcaagatcagcttgatgatgaaactctttttccttctaagattggtgtcccatttcccaaaaactttatgtctgtggcaaagactattctaaagcgtctgttcagggtttatgcccatatttatcaccagcactttgattctgtgatgcagctgcaagaggaggcccacctcaacacctcctttaagcactttattttctttgttcaggagtttaatctgattgataggcgtgagctggcacctcttcaagaattaatagagaaacttggatcaaaagacagataaatgtttcttctagaacacagttacccccttgcttcatctattgctagaactatctcattgctatctgttatagactagtgatacaaactttaagaaaacaggataaaaagatacccattgcctgtgtctactgataaaattatcccaaaggtaggttggtgtgatagtttccgagtaagaccttaaggacacagccaaatcttaagtactgtgtgaccactcttgttgttatcacatagtcatacttggttgtaatatgtgatggttaacctgtagcttataaatttacttattattcttttactcatttactcagtcatttctttacaagaaaatgattgaatctgttttaggtgacagcacaatggacattaagaatttccatcaataatttatgaataagtttccagaacaaatttcctaataacacaatcagattggttttattcttttattttacgaataaaaaatgtatttttcagtatccttgagatttagaacatctgtgtcacttcagataacattttagtttcaagtttgtatggtagtgtttttatagataagatacgtctattttttcaaaattcatgattgcagtttaaatcatcatatgacgtgtgggtgggagcaaccaaagttatttttacagggactttattttttgatctttatttgagattgttttcatatctatctaaattattaggagtgtgtgtatcagaagtaattttttaatgtcttctaaggatggtcttccaggcttttaaactgaaaagcttaattcagatagtagcttttggctgagaaaaggaatccaaaatattaataaatttagatctcaaaaccactatttttattatttcattatttttcagaggccttaaaattctggataagagaatggaggaaaatactcagagtacttgattattttatttccttttattaaaaaattacttctatgtttttattgtctcttgagccttagttaagagtagtgtagaaatgcatgaacttcatcctaataaggataaaacttaaggaaaaccacaataaaccatgaaggtgtacacatcttataacacagataaagttttggtgtgctacctattcttgagagagtgagtgagtgtatgtgtttaaaggaaacaaaatgggagaaataagttttaaaaaaatcctcattttgttaatattcaaaagatggactgagcttccacttgggttttatcttgttttaattgtttttgtatcaaaacttgaaattcctctatttctattgggatataaaagccttccccttcagtgaagaaaacatttattttttatttgattcctaggatttagtaaactctagctgtctatttaaaatgtactgaggcacaacaagtattatactggaagacttgccaaactggcaaagctttaagttcatcagcattctatgtggttcagagctgtgatttttgcaaagtattttaccaacctcctcgatggctttgataaaggttagatttgatgtttttttttagatttatttttcttactccactaaactataaagaaaataattacttagaaactccattttaaataatcatttcctagaaattcttaaatatatacagaattttaaagaaaacatttcatctgatttagttagcatccacatatcattgaggaattaaagtgtgggacagtcattattaaaaaaaagagagaaaagccctctattagacattccacaatccatgttttaagcttatccaaaggtccaaatgtcagccattctgtatgttcatgttgatcatttgcgaacaagaaagcaggtttctaggtatcacttaggatgtgaactgcctctcaactttaaaccctgttagctttacttttttaagtccacaagtgatgaaactagtttctcagctaggcttgtactttcctcattatttctagtatttcaaatattctcaaacaaaagagttaccacttttctccatttattttcagttatggaaatgttccctctcttcaccactaagctccaaagcaaatgaaagacgatcacatgtcaggacagtagtaaaggcagcttataaatgggacataaatcagagatgtgttggtattttgagactcaagactgtccttttttaaaataaaaataaaaacattaccaggttcccaagccaatctggcttaaccaacagtgcactgaaatattagtgtttacctccaaggctagggagccaaggggaggaggagaattggaggaaggggagataatgggaagaggatggcgccttcctgagttggctagagggccaacctttgataacagtttgacgaaatcaatcttttttttttttttttttttgagacagagtctcactctgtcacccaggctggagtacagtggtgggatctcggctcactgcaagctctgcctcccaggttcatgccattctcctgccccagcctctcctgagtagctggaactacaggtgcccgccaccacgcccagctaattttttctatttttagtcatgcctggctaattttttgtatttttagtagagatggggtttcaccgtgttagccaggatggtctccatctccttacctcgcaatccgcccgcctcagcctcccaaagtgttgggattacaggcatgagccaccgtgcccggcctatagaaatcaatctttttgactcttctcacttttatctccccatgcccaaggtttgcctgttccataacactcactcccttcccccttgctaatcagaagccatctcctctcagtgtctgatctctgctcttcatacatgattacagtcatggggtagagagtgcttgctaaattatgcagttaatcctatggtgctttaattttcaggccttcaaaaaacacttgtacagtgatgtgcagatttttaaacagttgaacttccttgtactacagtttttgtattgacagccaaatttgtctttcattcttcagattgtgaataaagtgatttttacagggcttccagcaaagtttttcctttcatctaaggcttgtagaaccctagcttatatagctgcttacatgagaaatgcaaaatctgtattcaccatgactttagtaacaaaggtaaagttttttagtagtgccaaggcaagaggaacaatcttggtggtagtactaagttttgtcaatattgtggtttcctgattgtattgttggctttctctctgagcattgaggtatactagaagtagagcttctcaaacataatatcattacctcataagcattaacaaatcaggcccaaagagcgtaagtcctagaaatttgttttaaagcagccctagtcatggtgctggtgctaccgccttgttttaggagcctgcctcctgtcagtatgaaaccctcacctgaaaaatgccagcctggacaccaaacactgagccccttcaacaggcacattatttccccctgagatccataagggaatttagtttctactattgtagagttctgaaaagaggtaaaatagtagtcctttggtcatcctatttttgctttcaattttgatatttcagactgtaaaaggccttgggggatgatagtacatgtggtagcagtaatttttttgaagcaccagtacgacttccggtagcaccagcacgaat

SEQ ID NO: 25667 - DNA, 5011 bp, Homo sapiens
  misc_feature (28)..(28): n is a, c, g, or t
  misc_feature (38)..(38): n is a, c, g, or t
  misc_feature (4882)..(4882): n is a, c, g, or t
  misc_feature (4897)..(4898): n is a, c, g, or t
  misc_feature (4902)..(4902): n is a, c, g, or t
  misc_feature (4910)..(4910): n is a, c, g, or t
  misc_feature (4917)..(4917): n is a, c, g, or t
  misc_feature (4921)..(4921): n is a, c, g, or t
cagtactaaggaccgtatggtctgtatnactctagaanaacgaagactagccacacatacaaaagacaaacaaaacaaacaccaaaaaaacaaaaacacacagcggccagaaacccggctccgagcggcggcggcccggcttccgctgcccgtgagctaaggacggtccgctccctctagccagctccgaatcctgatccaggcgggggccaggggcccctcgcctcccctctgaggaccgaagatgagcttcctcttcagcagccgctcttctaaaacattcaaaccaaagaagaatatccctgaaggatctcatcagtatgaactcttaaaacatgcagaagcaactctaggaagtgggaatctgagacaagctgttatgttgcctgagggagaggatctcaatgaatggattgctgtgaacactgtggatttctttaaccagatcaacatgttatatggaactattacagaattctgcactgaagcaagctgtccagtcatgtctgcaggtccgagatatgaatatcactgggcagatggtactaatattaaaaagccaatcaaatgttctgcaccaaaatacattgactatttgatgacttgggttcaagatcagcttgatgatgaaactctttttccttctaagattggtgtcccatttcccaaaaactttatgtctgtggcaaagactattctaaagcgtctgttcagggtttatgcccatatttatcaccagcactttgattctgtgatgcagctgcaagaggaggcccacctcaacacctcctttaagcactttattttctttgttcaggagtttaatctgattgataggcgtgagctggcacctcttcaagaattaatagagaaacttggatcaaaagacagataaatgtttcttctagaacacagttacccccttgcttcatctattgctagaactatctcattgctatctgttatagactagtgatacaaactttaagaaaacaggataaaaagatacccattgcctgtgtctactgataaaattatcccaaaggtaggttggtgtgatagtttccgagtaagaccttaaggacacagccaaatcttaagtactgtgtgaccactcttgttgttatcacatagtcatacttggttgtaatatgtgatggttaacctgtagcttataaatttacttattattcttttactcatttactcagtcatttctttacaagaaaatgattgaatctgttttaggtgacagcacaatggacattaagaatttccatcaataatttatgaataagtttccagaacaaatttcctaataacacaatcagattggttttattcttttattttacgaataaaaaatgtatttttcagtatccttgagatttagaacatctgtgtcacttcagataacattttagtttcaagtttgtatggtagtgtttttatagataagatacgtctattttttcaaaattcatgattgcagtttaaatcatcatatgacgtgtgggtgggagcaaccaaagttatttttacagggactttattttttgatctttatttgagattgttttcatatctatctaaattattaggagtgtgtgtatcagaagtaattttttaatgtcttctaaggatggtcttccaggcttttaaactgaaaagcttaattcagatagtagcttttggctgagaaaaggaatccaaaatattaataaatttagatctcaaaaccactatttttattatttcattatttttcagaggccttaaaattctggataagagaatggaggaaaatactcagagtacttgattattttatttccttttattaaaaaattacttctatgtttttattgtctcttgagccttagttaagagtagtgtagaaatgcatgaacttcatcctaataaggataaaacttaaggaaaaccacaataaaccatgaaggtgtacacatcttataacacagataaagttttggtgtgctacctattcttgagagagtgagtgagtgtatgtgtttaaaggaaacaaaatgggagaaataagttttaaaaaaatcctcattttgttaatattcaaaagatggactgagcttccacttgggttttatcttgttttaattgtttttgtatcaaaacttgaaattcctctatttctattgggatataaaagccttccccttcagtgaagaaaacatttattttttatttgattcctaggatttagtaaactctagctgtctatttaaaatgtactgaggcacaacaagtattatactggaagacttgccaaactggcaaagctttaagttcatcagcattctatgtggttcagagctgtgatttttgcaaagtattttaccaacctcctcgatggctttgataaaggttagatttgatgtttttttttagatttatttttcttactccactaaactataaagaaaataattacttagaaactccattttaaataatcatttcctagaaattcttaaatatatacagaattttaaagaaaacatttcatctgatttagttagcatccacatatcattgaggaattaaagtgtgggacagtcattattaaaaaaaagagagaaaagccctctattagacattccacaatccatgttttaagcttatccaaaggtccaaatgtcagccattctgtatgttcatgttgatcatttgcgaacaagaaagcaggtttctaggtatcacttaggatgtgaactgcctctcaactttaaaccctgttagctttacttttttaagtccacaagtgatgaaactagtttctcagctaggcttgtactttcctcattatttctagtatttcaaatattctcaaacaaaagagttaccacttttctccatttattttcagttatggaaatgttccctctcttcaccactaagctccaaagcaaatgaaagacgatcacatgtcaggacagtagtaaaggcagcttataaatgggacataaatcagagatgtgttggtattttgagactcaagactgtccttttttaaaataaaaataaaaacattaccaggttcccaagccaatctggcttaaccaacagtgcactgaaatattagtgtttacctccaaggctagggagccaaggggaggaggagaattggaggaaggggagataatgggaagaggatggcgccttcctgagttggctagagggccaacctttgataacagtttgacgaaatcaatcttttttttttttttttttttgagacagagtctcactctgtcacccaggctggagtacagtggtgggatctcggctcactgcaagctctgcctcccaggttcatgccattctcctgccccagcctctcctgagtagctggaactacaggtgcccgccaccacgcccagctaattttttctatttttagtcatgcctggctaattttttgtatttttagtagagatggggtttcaccgtgttagccaggatggtctccatctccttacctcgcaatccgcccgcctcagcctcccaaagtgttgggattacaggcatgagccaccgtgcccggcctatagaaatcaatctttttgactcttctcacttttatctccccatgcccaaggtttgcctgttccataacactcactcccttcccccttgctaatcagaagccatctcctctcagtgtctgatctctgctcttcatacatgattacagtcatggggtagagagtgcttgctaaattatgcagttaatcctatggtgctttaattttcaggccttcaaaaaacacttgtacagtgatgtgcagatttttaaacagttgaacttccttgtactacagtttttgtattgacagccaaatttgtctttcattcttcagattgtgaataaagtgatttttacagggcttccagcaaagtttttcctttcatctaaggcttgtagaaccctagcttatatagctgcttacatgagaaatgcaaaatctgtattcaccatgactttagtaacaaaggtaaagttttttagtagtgccaaggcaagaggaacaatcttggtggtagtactaagttttgtcaatattgtggtttcctgattgtattgttggctttctctctgagcattgaggtatactagaagtagagcttctcaaacataatatcattacctcataagcattaacaaatcaggcccaaagagcgtaagtcctagaaatttgttttaaagcagccctagtcatggtgctggtgctaccgccttgttttaggagcctgcctcctgtcagtatgaaaccctcacctgaaaaatgccagcctggacaccaaacactgagccccttcaacaggcacattatttccccctgagatccataagggaatttagtttctactattgtagagttctgaaaagaggtaaaatagtagtcctttggtcatcctatttttgctttcaattttgatatttcagactgtaaaaggccttgggggatgatagtacatgtggtagcagtaatttttttgaagcaactgcactgacattcatttgagttttctctcattatcagattctgttccaaacaagtattctgtagatccaaatggattaccagtgtgctacagacttcttattatagaacagcattctattctacatcaaaaatagtttgtgtaagttagttttggttaccatctaaaatatttttaaatgttctttacataaaaatttatgttgtgttttaaaatccttaggggctttatctatttttctaagtcagttaactgtacttctaaaaaaagtattttgtatctacttttgtaacttcgtcagaataaaatatattgaaagcaaaaaaaacacaaacanaaaaaactttttggnngccncgggcccnaaaagtntttnaacccattgttgtgggcggggccattggtagcgacacgggcaaagggtgcccaggaaaccgggccagaagggcgggttcttccaataacg

SEQ ID NO: 25668 - DNA, 4953 bp, Homo sapiens
  misc_feature (4824)..(4824): n is a, c, g, or t
  misc_feature (4839)..(4840): n is a, c, g, or t
  misc_feature (4844)..(4844): n is a, c, g, or t
  misc_feature (4852)..(4852): n is a, c, g, or t
  misc_feature (4859)..(4859): n is a, c, g, or t
  misc_feature (4863)..(4863): n is a, c, g, or t
tccttgccgacttaactcgttgctcggttataggtccagtttcattattgtcggtgttaaatgccgccccaggagaatgtgcgttgccgcagtttgagaagcttgaagttaagatgctggccttggagtcggatcgttctgtccagttctgattctgcccacttactggctttgattttaaccaacttctcttgtcctcgcagcagccgctcttctaaaacattcaaaccaaagaagaatatccctgaaggatctcatcagtatgaactcttaaaacatgcagaagcaactctaggaagtgggaatctgagacaagctgttatgttgcctgagggagaggatctcaatgaatggattgctgtgaacactgtggatttctttaaccagatcaacatgttatatggaactattacagaattctgcactgaagcaagctgtccagtcatgtctgcaggtccgagatatgaatatcactgggcagatggtactaatattaaaaagccaatcaaatgttctgcaccaaaatacattgactatttgatgacttgggttcaagatcagcttgatgatgaaactctttttccttctaagattggtgtcccatttcccaaaaactttatgtctgtggcaaagactattctaaagcgtctgttcagggtttatgcccatatttatcaccagcactttgattctgtgatgcagctgcaagaggaggcccacctcaacacctcctttaagcactttattttctttgttcaggagtttaatctgattgataggcgtgagctggcacctcttcaagaattaatagagaaacttggatcaaaagacagataaatgtttcttctagaacacagttacccccttgcttcatctattgctagaactatctcattgctatctgttatagactagtgatacaaactttaagaaaacaggataaaaagatacccattgcctgtgtctactgataaaattatcccaaaggtaggttggtgtgatagtttccgagtaagaccttaaggacacagccaaatcttaagtactgtgtgaccactcttgttgttatcacatagtcatacttggttgtaatatgtgatggttaacctgtagcttataaatttacttattattcttttactcatttactcagtcatttctttacaagaaaatgattgaatctgttttaggtgacagcacaatggacattaagaatttccatcaataatttatgaataagtttccagaacaaatttcctaataacacaatcagattggttttattcttttattttacgaataaaaaatgtatttttcagtatccttgagatttagaacatctgtgtcacttcagataacattttagtttcaagtttgtatggtagtgtttttatagataagatacgtctattttttcaaaattcatgattgcagtttaaatcatcatatgacgtgtgggtgggagcaaccaaagttatttttacagggactttattttttgatctttatttgagattgttttcatatctatctaaattattaggagtgtgtgtatcagaagtaattttttaatgtcttctaaggatggtcttccaggcttttaaactgaaaagcttaattcagatagtagcttttggctgagaaaaggaatccaaaatattaataaatttagatctcaaaaccactatttttattatttcattatttttcagaggccttaaaattctggataagagaatggaggaaaatactcagagtacttgattattttatttccttttattaaaaaattacttctatgtttttattgtctcttgagccttagttaagagtagtgtagaaatgcatgaacttcatcctaataaggataaaacttaaggaaaaccacaataaaccatgaaggtgtacacatcttataacacagataaagttttggtgtgctacctattcttgagagagtgagtgagtgtatgtgtttaaaggaaacaaaatgggagaaataagttttaaaaaaatcctcattttgttaatattcaaaagatggactgagcttccacttgggttttatcttgttttaattgtttttgtatcaaaacttgaaattcctctatttctattgggatataaaagccttccccttcagtgaagaaaacatttattttttatttgattcctaggatttagtaaactctagctgtctatttaaaatgtactgaggcacaacaagtattatactggaagacttgccaaactggcaaagctttaagttcatcagcattctatgtggttcagagctgtgatttttgcaaagtattttaccaacctcctcgatggctttgataaaggttagatttgatgtttttttttagatttatttttcttactccactaaactataaagaaaataattacttagaaactccattttaaataatcatttcctagaaattcttaaatatatacagaattttaaagaaaacatttcatctgatttagttagcatccacatatcattgaggaattaaagtgtgggacagtcattattaaaaaaaagagagaaaagccctctattagacattccacaatccatgttttaagcttatccaaaggtccaaatgtcagccattctgtatgttcatgttgatcatttgcgaacaagaaagcaggtttctaggtatcacttaggatgtgaactgcctctcaactttaaaccctgttagctttacttttttaagtccacaagtgatgaaactagtttctcagctaggcttgtactttcctcattatttctagtatttcaaatattctcaaacaaaagagttaccacttttctccatttattttcagttatggaaatgttccctctcttcaccactaagctccaaagcaaatgaaagacgatcacatgtcaggacagtagtaaaggcagcttataaatgggacataaatcagagatgtgttggtattttgagactcaagactgtccttttttaaaataaaaataaaaacattaccaggttcccaagccaatctggcttaaccaacagtgcactgaaatattagtgtttacctccaaggctagggagccaaggggaggaggagaattggaggaaggggagataatgggaagaggatggcgccttcctgagttggctagagggccaacctttgataacagtttgacgaaatcaatcttttttttttttttttttttgagacagagtctcactctgtcacccaggctggagtacagtggtgggatctcggctcactgcaagctctgcctcccaggttcatgccattctcctgccccagcctctcctgagtagctggaactacaggtgcccgccaccacgcccagctaattttttctatttttagtcatgcctggctaattttttgtatttttagtagagatggggtttcaccgtgttagccaggatggtctccatctccttacctcgcaatccgcccgcctcagcctcccaaagtgttgggattacaggcatgagccaccgtgcccggcctatagaaatcaatctttttgactcttctcacttttatctccccatgcccaaggtttgcctgttccataacactcactcccttcccccttgctaatcagaagccatctcctctcagtgtctgatctctgctcttcatacatgattacagtcatggggtagagagtgcttgctaaattatgcagttaatcctatggtgctttaattttcaggccttcaaaaaacacttgtacagtgatgtgcagatttttaaacagttgaacttccttgtactacagtttttgtattgacagccaaatttgtctttcattcttcagattgtgaataaagtgatttttacagggcttccagcaaagtttttcctttcatctaaggcttgtagaaccctagcttatatagctgcttacatgagaaatgcaaaatctgtattcaccatgactttagtaacaaaggtaaagttttttagtagtgccaaggcaagaggaacaatcttggtggtagtactaagttttgtcaatattgtggtttcctgattgtattgttggctttctctctgagcattgaggtatactagaagtagagcttctcaaacataatatcattacctcataagcattaacaaatcaggcccaaagagcgtaagtcctagaaatttgttttaaagcagccctagtcatggtgctggtgctaccgccttgttttaggagcctgcctcctgtcagtatgaaaccctcacctgaaaaatgccagcctggacaccaaacactgagccccttcaacaggcacattatttccccctgagatccataagggaatttagtttctactattgtagagttctgaaaagaggtaaaatagtagtcctttggtcatcctatttttgctttcaattttgatatttcagactgtaaaaggccttgggggatgatagtacatgtggtagcagtaatttttttgaagcaactgcactgacattcatttgagttttctctcattatcagattctgttccaaacaagtattctgtagatccaaatggattaccagtgtgctacagacttcttattatagaacagcattctattctacatcaaaaatagtttgtgtaagttagttttggttaccatctaaaatatttttaaatgttctttacataaaaatttatgttgtgttttaaaatccttaggggctttatctatttttctaagtcagttaactgtacttctaaaaaaagtattttgtatctacttttgtaacttcgtcagaataaaatatattgaaagcaaaaaaaacacaaacanaaaaaactttttggnngccncgggcccnaaaagtntttnaacccattgttgtgggcggggccattggtagcgacacgggcaaagggtgcccaggaaaccgggccagaagggcgggttcttccaataacg

SEQ ID NO: 25669 - DNA, 5128 bp, Homo sapiens
  misc_feature (4999)..(4999): n is a, c, g, or t
  misc_feature (5014)..(5015): n is a, c, g, or t
  misc_feature (5019)..(5019): n is a, c, g, or t
  misc_feature (5027)..(5027): n is a, c, g, or t
  misc_feature (5034)..(5034): n is a, c, g, or t
  misc_feature (5038)..(5038): n is a, c, g, or t
gtcttgctctgtcacctgggctggagtgcagtgatgcgatttcagcttactgcaacctctgcctcccaggttcaagccattcttctgcctcagcctcccaagtagctgggactacaggtgtgcgccatcatgcttggctaatttttgtatttttagtagacgtgtggtttcaccatgttggtcaggctggtcttgaactcctgacctcaggtgatcccaaagtgctgggattacaggcatgagccaccatgcctggcccagagagtattttttattttatttttacaggctactttatatacctaaaattatgttgttctacctgttctacttccagtcttaaaaattcatatacttgcacttttaatcttacagcagcagccgctcttctaaaacattcaaaccaaagaagaatatccctgaaggatctcatcagtatgaactcttaaaacatgcagaagcaactctaggaagtgggaatctgagacaagctgttatgttgcctgagggagaggatctcaatgaatggattgctgtgaacactgtggatttctttaaccagatcaacatgttatatggaactattacagaattctgcactgaagcaagctgtccagtcatgtctgcaggtccgagatatgaatatcactgggcagatggtactaatattaaaaagccaatcaaatgttctgcaccaaaatacattgactatttgatgacttgggttcaagatcagcttgatgatgaaactctttttccttctaagattggtgtcccatttcccaaaaactttatgtctgtggcaaagactattctaaagcgtctgttcagggtttatgcccatatttatcaccagcactttgattctgtgatgcagctgcaagaggaggcccacctcaacacctcctttaagcactttattttctttgttcaggagtttaatctgattgataggcgtgagctggcacctcttcaagaattaatagagaaacttggatcaaaagacagataaatgtttcttctagaacacagttacccccttgcttcatctattgctagaactatctcattgctatctgttatagactagtgatacaaactttaagaaaacaggataaaaagatacccattgcctgtgtctactgataaaattatcccaaaggtaggttggtgtgatagtttccgagtaagaccttaaggacacagccaaatcttaagtactgtgtgaccactcttgttgttatcacatagtcatacttggttgtaatatgtgatggttaacctgtagcttataaatttacttattattcttttactcatttactcagtcatttctttacaagaaaatgattgaatctgttttaggtgacagcacaatggacattaagaatttccatcaataatttatgaataagtttccagaacaaatttcctaataacacaatcagattggttttattcttttattttacgaataaaaaatgtatttttcagtatccttgagatttagaacatctgtgtcacttcagataacattttagtttcaagtttgtatggtagtgtttttatagataagatacgtctattttttcaaaattcatgattgcagtttaaatcatcatatgacgtgtgggtgggagcaaccaaagttatttttacagggactttattttttgatctttatttgagattgttttcatatctatctaaattattaggagtgtgtgtatcagaagtaattttttaatgtcttctaaggatggtcttccaggcttttaaactgaaaagcttaattcagatagtagcttttggctgagaaaaggaatccaaaatattaataaatttagatctcaaaaccactatttttattatttcattatttttcagaggccttaaaattctggataagagaatggaggaaaatactcagagtacttgattattttatttccttttattaaaaaattacttctatgtttttattgtctcttgagccttagttaagagtagtgtagaaatgcatgaacttcatcctaataaggataaaacttaaggaaaaccacaataaaccatgaaggtgtacacatcttataacacagataaagttttggtgtgctacctattcttgagagagtgagtgagtgtatgtgtttaaaggaaacaaaatgggagaaataagttttaaaaaaatcctcattttgttaatattcaaaagatggactgagcttccacttgggttttatcttgttttaattgtttttgtatcaaaacttgaaattcctctatttctattgggatataaaagccttccccttcagtgaagaaaacatttattttttatttgattcctaggatttagtaaactctagctgtctatttaaaatgtactgaggcacaacaagtattatactggaagacttgccaaactggcaaagctttaagttcatcagcattctatgtggttcagagctgtgatttttgcaaagtattttaccaacctcctcgatggctttgataaaggttagatttgatgtttttttttagatttatttttcttactccactaaactataaagaaaataattacttagaaactccattttaaataatcatttcctagaaattcttaaatatatacagaattttaaagaaaacatttcatctgatttagttagcatccacatatcattgaggaattaaagtgtgggacagtcattattaaaaaaaagagagaaaagccctctattagacattccacaatccatgttttaagcttatccaaaggtccaaatgtcagccattctgtatgttcatgttgatcatttgcgaacaagaaagcaggtttctaggtatcacttaggatgtgaactgcctctcaactttaaaccctgttagctttacttttttaagtccacaagtgatgaaactagtttctcagctaggcttgtactttcctcattatttctagtatttcaaatattctcaaacaaaagagttaccacttttctccatttattttcagttatggaaatgttccctctcttcaccactaagctccaaagcaaatgaaagacgatcacatgtcaggacagtagtaaaggcagcttataaatgggacataaatcagagatgtgttggtattttgagactcaagactgtccttttttaaaataaaaataaaaacattaccaggttcccaagccaatctggcttaaccaacagtgcactgaaatattagtgtttacctccaaggctagggagccaaggggaggaggagaattggaggaaggggagataatgggaagaggatggcgccttcctgagttggctagagggccaacctttgataacagtttgacgaaatcaatcttttttttttttttttttttgagacagagtctcactctgtcacccaggctggagtacagtggtgggatctcggctcactgcaagctctgcctcccaggttcatgccattctcctgccccagcctctcctgagtagctggaactacaggtgcccgccaccacgcccagctaattttttctatttttagtcatgcctggctaattttttgtatttttagtagagatggggtttcaccgtgttagccaggatggtctccatctccttacctcgcaatccgcccgcctcagcctcccaaagtgttgggattacaggcatgagccaccgtgcccggcctatagaaatcaatctttttgactcttctcacttttatctccccatgcccaaggtttgcctgttccataacactcactcccttcccccttgctaatcagaagccatctcctctcagtgtctgatctctgctcttcatacatgattacagtcatggggtagagagtgcttgctaaattatgcagttaatcctatggtgctttaattttcaggccttcaaaaaacacttgtacagtgatgtgcagatttttaaacagttgaacttccttgtactacagtttttgtattgacagccaaatttgtctttcattcttcagattgtgaataaagtgatttttacagggcttccagcaaagtttttcctttcatctaaggcttgtagaaccctagcttatatagctgcttacatgagaaatgcaaaatctgtattcaccatgactttagtaacaaaggtaaagttttttagtagtgccaaggcaagaggaacaatcttggtggtagtactaagttttgtcaatattgtggtttcctgattgtattgttggctttctctctgagcattgaggtatactagaagtagagcttctcaaacataatatcattacctcataagcattaacaaatcaggcccaaagagcgtaagtcctagaaatttgttttaaagcagccctagtcatggtgctggtgctaccgccttgttttaggagcctgcctcctgtcagtatgaaaccctcacctgaaaaatgccagcctggacaccaaacactgagccccttcaacaggcacattatttccccctgagatccataagggaatttagtttctactattgtagagttctgaaaagaggtaaaatagtagtcctttggtcatcctatttttgctttcaattttgatatttcagactgtaaaaggccttgggggatgatagtacatgtggtagcagtaatttttttgaagcaactgcactgacattcatttgagttttctctcattatcagattctgttccaaacaagtattctgtagatccaaatggattaccagtgtgctacagacttcttattatagaacagcattctattctacatcaaaaatagtttgtgtaagttagttttggttaccatctaaaatatttttaaatgttctttacataaaaatttatgttgtgttttaaaatccttaggggctttatctatttttctaagtcagttaactgtacttctaaaaaaagtattttgtatctacttttgtaacttcgtcagaataaaatatattgaaagcaaaaaaaacacaaacanaaaaaactttttggnngccncgggcccnaaaagtntttnaacccattgttgtgggcggggccattggtagcgacacgggcaaagggtgcccaggaaaccgggccagaagggcgggttcttccaataacg

SEQ ID NO: 25670 - DNA, 4914 bp, Homo sapiens
  misc_feature (4785)..(4785): n is a, c, g, or t
  misc_feature (4800)..(4801): n is a, c, g, or t
  misc_feature (4805)..(4805): n is a, c, g, or t
  misc_feature (4813)..(4813): n is a, c, g, or t
  misc_feature (4820)..(4820): n is a, c, g, or t
  misc_feature (4824)..(4824): n is a, c, g, or t
gaggtggggtaggcgggcaaggcgggcgccgaggtttgcaaaggctcgcagcggccagaaacccggctccgagcggcggcggcccggcttccgctgcccgtgagctaaggacggtccgccccctcgcctcccctctgaggaccgaagatgagcttcctcttcagcagccgctcttctaaaacattcaaaccaaagaagaatatccctgaaggatctcatcagtatgaactcttaaaacatgcagaagcaactctaggaagtgggaatctgagacaagctgttatgttgcctgagggagaggatctcaatgaatggattgctgtgaacactgtggatttctttaaccagatcaacatgttatatggaactattacagaattctgcactgaagcaagctgtccagtcatgtctgcaggtccgagatatgaatatcactgggcagatggtactaatattaaaaagccaatcaaatgttctgcaccaaaatacattgactatttgatgacttgggttcaagatcagcttgatgatgaaactctttttccttctaagattggtgtcccatttcccaaaaactttatgtctgtggcaaagactattctaaagcgtctgttcagggtttatgcccatatttatcaccagcactttgattctgtgatgcagctgcaagaggaggcccacctcaacacctcctttaagcactttattttctttgttcaggagtttaatctgattgataggcgtgagctggcacctcttcaagaattaatagagaaacttggatcaaaagacagataaatgtttcttctagaacacagttacccccttgcttcatctattgctagaactatctcattgctatctgttatagactagtgatacaaactttaagaaaacaggataaaaagatacccattgcctgtgtctactgataaaattatcccaaaggtaggttggtgtgatagtttccgagtaagaccttaaggacacagccaaatcttaagtactgtgtgaccactcttgttgttatcacatagtcatacttggttgtaatatgtgatggttaacctgtagcttataaatttacttattattcttttactcatttactcagtcatttctttacaagaaaatgattgaatctgttttaggtgacagcacaatggacattaagaatttccatcaataatttatgaataagtttccagaacaaatttcctaataacacaatcagattggttttattcttttattttacgaataaaaaatgtatttttcagtatccttgagatttagaacatctgtgtcacttcagataacattttagtttcaagtttgtatggtagtgtttttatagataagatacgtctattttttcaaaattcatgattgcagtttaaatcatcatatgacgtgtgggtgggagcaaccaaagttatttttacagggactttattttttgatctttatttgagattgttttcatatctatctaaattattaggagtgtgtgtatcagaagtaattttttaatgtcttctaaggatggtcttccaggcttttaaactgaaaagcttaattcagatagtagcttttggctgagaaaaggaatccaaaatattaataaatttagatctcaaaaccactatttttattatttcattatttttcagaggccttaaaattctggataagagaatggaggaaaatactcagagtacttgattattttatttccttttattaaaaaattacttctatgtttttattgtctcttgagccttagttaagagtagtgtagaaatgcatgaacttcatcctaataaggataaaacttaaggaaaaccacaataaaccatgaaggtgtacacatcttataacacagataaagttttggtgtgctacctattcttgagagagtgagtgagtgtatgtgtttaaaggaaacaaaatgggagaaataagttttaaaaaaatcctcattttgttaatattcaaaagatggactgagcttccacttgggttttatcttgttttaattgtttttgtatcaaaacttgaaattcctctatttctattgggatataaaagccttccccttcagtgaagaaaacatttattttttatttgattcctaggatttagtaaactctagctgtctatttaaaatgtactgaggcacaacaagtattatactggaagacttgccaaactggcaaagctttaagttcatcagcattctatgtggttcagagctgtgatttttgcaaagtattttaccaacctcctcgatggctttgataaaggttagatttgatgtttttttttagatttatttttcttactccactaaactataaagaaaataattacttagaaactccattttaaataatcatttcctagaaattcttaaatatatacagaattttaaagaaaacatttcatctgatttagttagcatccacatatcattgaggaattaaagtgtgggacagtcattattaaaaaaaagagagaaaagccctctattagacattccacaatccatgttttaagcttatccaaaggtccaaatgtcagccattctgtatgttcatgttgatcatttgcgaacaagaaagcaggtttctaggtatcacttaggatgtgaactgcctctcaactttaaaccctgttagctttacttttttaagtccacaagtgatgaaactagtttctcagctaggcttgtactttcctcattatttctagtatttcaaatattctcaaacaaaagagttaccacttttctccatttattttcagttatggaaatgttccctctcttcaccactaagctccaaagcaaatgaaagacgatcacatgtcaggacagtagtaaaggcagcttataaatgggacataaatcagagatgtgttggtattttgagactcaagactgtccttttttaaaataaaaataaaaacattaccaggttcccaagccaatctggcttaaccaacagtgcactgaaatattagtgtttacctccaaggctagggagccaaggggaggaggagaattggaggaaggggagataatgggaagaggatggcgccttcctgagttggctagagggccaacctttgataacagtttgacgaaatcaatcttttttttttttttttttttgagacagagtctcactctgtcacccaggctggagtacagtggtgggatctcggctcactgcaagctctgcctcccaggttcatgccattctcctgccccagcctctcctgagtagctggaactacaggtgcccgccaccacgcccagctaattttttctatttttagtcatgcctggctaattttttgtatttttagtagagatggggtttcaccgtgttagccaggatggtctccatctccttacctcgcaatccgcccgcctcagcctcccaaagtgttgggattacaggcatgagccaccgtgcccggcctatagaaatcaatctttttgactcttctcacttttatctccccatgcccaaggtttgcctgttccataacactcactcccttcccccttgctaatcagaagccatctcctctcagtgtctgatctctgctcttcatacatgattacagtcatggggtagagagtgcttgctaaattatgcagttaatcctatggtgctttaattttcaggccttcaaaaaacacttgtacagtgatgtgcagatttttaaacagttgaacttccttgtactacagtttttgtattgacagccaaatttgtctttcattcttcagattgtgaataaagtgatttttacagggcttccagcaaagtttttcctttcatctaaggcttgtagaaccctagcttatatagctgcttacatgagaaatgcaaaatctgtattcaccatgactttagtaacaaaggtaaagttttttagtagtgccaaggcaagaggaacaatcttggtggtagtactaagttttgtcaatattgtggtttcctgattgtattgttggctttctctctgagcattgaggtatactagaagtagagcttctcaaacataatatcattacctcataagcattaacaaatcaggcccaaagagcgtaagtcctagaaatttgttttaaagcagccctagtcatggtgctggtgctaccgccttgttttaggagcctgcctcctgtcagtatgaaaccctcacctgaaaaatgccagcctggacaccaaacactgagccccttcaacaggcacattatttccccctgagatccataagggaatttagtttctactattgtagagttctgaaaagaggtaaaatagtagtcctttggtcatcctatttttgctttcaattttgatatttcagactgtaaaaggccttgggggatgatagtacatgtggtagcagtaatttttttgaagcaactgcactgacattcatttgagttttctctcattatcagattctgttccaaacaagtattctgtagatccaaatggattaccagtgtgctacagacttcttattatagaacagcattctattctacatcaaaaatagtttgtgtaagttagttttggttaccatctaaaatatttttaaatgttctttacataaaaatttatgttgtgttttaaaatccttaggggctttatctatttttctaagtcagttaactgtacttctaaaaaaagtattttgtatctacttttgtaacttcgtcagaataaaatatattgaaagcaaaaaaaacacaaacanaaaaaactttttggnngccncgggcccnaaaagtntttnaacccattgttgtgggcggggccattggtagcgacacgggcaaagggtgcccaggaaaccgggccagaagggcgggttcttccaataacg

SEQ ID NO: 25671 - DNA, 3770 bp, Homo sapiens
  misc_feature (3249)..(3249): n is a, c, g, or t
gcatttcgggtctgcgaggtggggtaggcgggcaaggcgggcgccgaggtttgcaaaggctcgcagcggccagaaacccggctccgagcggcggcggcccggcttccgctgcccgtgagctaaggacggtccgctccctctagccagctccgaatcctgatccaggcgggggccaggggcccctcgcctcccctctgaggaccgaagatgagcttcctcttcagcagccgctcttctaaaacattcaaaccaaagaagaatatccctgaaggatctcatcagtatgaactcttaaaacatgcagaagcaactctaggaagtgggaatctgagacaagctgttatgttgcctgagggagaggatctcaatgaatggattgctgtgaacactgtggatttctttaaccagatcaacatgttatatggaactattacagaattctgcactgaagcaagctgtccagtcatgtctgcaggtccgagatatgaatatcactgggcagatggtactaatattaaaaagccaatcaaatgttctgcaccaaaatacattgactatttgatgacttgggttcaagatcagcttgatgatgaaactctttttccttctaagattggtgtcccatttcccaaaaactttatgtctgtggcaaagactattctaaagcgtctgttcagggtttatgcccatatttatcaccagcactttgattctgtgatgcagctgcaagaggaggcccacctcaacacctcctttaagcactttattttctttgttcaggagtttaatctgattgataggcgtgagctggcacctcttcaagaattaatagagaaacttggatcaaaagacagataaatgtttcttctagaacacagttacccccttgcttcatctattgctagaactatctcattgctatctgttatagactagtgatacaaactttaagaaaacaggataaaaagatacccattgcctgtgtctactgataaaattatcccaaaggtaggttggtgtgatagtttccgagtaagaccttaaggacacagccaaatcttaagtactgtgtgaccactcttgttgttatcacatagtcatacttggttgtaatatgtgatggttaacctgtagcttataaatttacttattattcttttactcatttactcagtcatttctttacaagaaaatgattgaatctgttttaggtgacagcacaatggacattaagaatttccatcaataatttatgaataagtttccagaacaaatttcctaataacacaatcagattggttttattcttttattttacgaataaaaaatgtatttttcagtatccttgagatttagaacatctgtgtcacttcagataacattttagtttcaagtttgtatggtagtgtttttatagataagatacgtctattttttcaaaattcatgattgcagtttaaatcatcatatgacgtgtgggtgggagcaaccaaagttatttttacagggactttattttttgatctttatttgagattgttttcatatctatctaaattattaggagtgtgtgtatcagaagtaattttttaatgtcttctaaggatggtcttccaggcttttaaactgaaaagcttaattcagatagtagcttttggctgagaaaaggaatccaaaatattaataaatttagatctcaaaaccactatttttattatttcattatttttcagaggccttaaaattctggataagagaatggaggaaaatactcagagtacttgattattttatttccttttattaaaaaattacttctatgtttttattgtctcttgagccttagttaagagtagtgtagaaatgcatgaacttcatcctaataaggataaaacttaaggaaaaccacaataaaccatgaaggtgtacacatcttataacacagataaagttttggtgtgctacctattcttgagagagtgagtgagtgtatgtgtttaaaggaaacaaaatgggagaaataagttttaaaaaaatcctcattttgttaatattcaaaagatggactgagcttccacttgggttttatcttgttttaattgtttttgtatcaaaacttgaaattcctctatttctattgggatataaaagccttccccttcagtgaagaaaacatttattttttatttgattcctaggatttagtaaactctagctgtctatttaaaatgtactgaggcacaacaagtattatactggaagacttgccaaactggcaaagctttaagttcatcagcattctatgtggttcagagctgtgatttttgcaaagtattttaccaacctcctcgatggctttgataaaggttagatttgatgtttttttttagatttatttttcttactccactaaactataaagaaaataattacttagaaactccattttaaataatcatttcctagaaattcttaaatatatacagaattttaaagaaaacatttcatctgatttagttagcatccacatatcattgaggaattaaagtgtgggacagtcattattaaaaaaaagagagaaaagccctctattagacattccacaatccatgttttaagcttatccaaaggtccaaatgtcagccattctgtatgttcatgttgatcatttgcgaacaagaaagcaggtttctaggtatcacttaggatgtgaactgcctctcaactttaaaccctgttagctttacttttttaagtccacaagtgatgaaactagtttctcagctaggcttgtactttcctcattatttctagtatttcaaatattctcaaacaaaagagttaccacttttctccatttattttcagttatggaaatgttccctctcttcaccactaagctccaaagcaaatgaaagacgatcacatgtcaggacagtagtaaaggcagcttataaatgggacataaatcagagatgtgttggtattttgagactcaagactgtccttttttaaaataaaaataaaaacattaccaggttcccaagccaatctggcttaaccaacagtgcactgaaatattagtgtttacctccaaggctagggagccaaggggaggaggagaattggaggaaggggagataatgctaagaccgactccccgtaccccgaacaccctgctgcccttgaaaccaacacctggctccccttctcacactctaactcccattttttgcatcgacggccgcnaccacgcccccaatccaggtataaaggactccccccaacccgcttccctagactccaccctttttaccgtcatctgcacctattacaatcccctccctcccaccctcttccacatcttccctgcttcccccccgcctctccatgtcccctccacctacgcactcttttccctaccttctcatacaagctcctcatatcgaacttccctacctcctcaaccgtacttcactctctccctcacctttccatctctccccaccaccttaccttccccttttgattcaactcccacatctctcctttttttgtgtcccccccagcccccactcctcccaccatcccaaactcccgcaccccattcctcccttctctctcttatttcttacctccttcacgcactcctttcgccctccttcctctcttcccctcccccttcctccgccccctctcctccctccacctcctatttccttcctccttccaacttcctttaccttgtcctctctctccctttactaaat

SEQ ID NO: 25672 - DNA, 1708 bp, Homo sapiens
gcatttcgggtctgcgaggtggggtaggcgggcaaggcgggcgccgaggtttgcaaaggctcgcagcggccagaaacccggctccgagcggcggcggcccggcttccgctgcccgtgagctaaggacggtccgctccctctagccagctccgaatcctgatccaggcgggggccaggggcccctcgcctcccctctgaggaccgaagatgagcttcctcttcagcagccgctcttctaaaacattcaaaccaaagaagaatatccctgaaggatctcatcagtatgaactcttaaaacatgcagaagcaactctaggaagtgggaatctgagacaagctgttatgttgcctgagggagaggatctcaatgaatggattgctgtgaacactgtggatttctttaaccagatcaacatgttatatggaactattacagaattctgcactgaagcaagctgtccagtcatgtctgcaggtccgagatatgaatatcactgggcagatggtactaatattaaaaagccaatcaaatgttctgcaccaaaatacattgactatttgatgacttgggttcaagatcagcttgatgatgaaactctttttccttctaagattggtgtcccatttcccaaaaactttatgtctgtggcaaagactattctaaagcgtctgttcagggtttatgcccatatttatcaccagcactttgattctgtgatgcagctgcaagaggaggcccacctcaacacctcctttaagcactttattttctttgttcaggagtttaatctgattgataggcgtgagctggcacctcttcaagaattaatagagaaacttggatcaaaagacagataaatgtttcttctagaacacagttacccccttgcttcatctattgctagaactatctcattgctatctgttatagactagtgatacaaactttaagaaaacaggataaaaagatacccattgcctgtgtctactgataaaattatcccaaaggtaggttggtgtgatagtttccgagtaagaccttaaggacacagccaaatcttaagtactgtgtgaccactcttgttgttatcacatagtcatacttggttgtaatatgtgatggttaacctgtagcttataaatttacttattattcttttactcatttactcagtcatttctttacaagaaaatgattgaatctgttttaggtgacagcacaatggacattaagaatttccatcaataatttatgaataagtttccagaacaaatttcctaataacacaatcagattggttttattcttttattttacgaataaaaaatgtatttttcagtatccttgagatttagaacatctgtgtcacttcagataacattttagtttcaagtttgtatggtagtgtttttatagataagatacgtctattttttcaaaattcatgattgcagtttaaatcatcatatgacgtgtgggtgggagcaaccaaagttatttttacagggactttattttttgatctttatttgagattgttttcatatctatctaaattattaggagtgtgtgtatcagaagtaattttttaatgtcttctaaggatggtcttccaggcttttaaactgaaaagcttaattcagatagtagcttttggctgagaaaaggaatccaaaatattaataaatttagatctcaaaaccacta

SEQ ID NO: 25673 - DNA, 463 bp, Homo sapiens
caaataaaaataaataaataaaagctccttagggctgagaactactgctcctgtcctatgggtccccagctttattttaactcaaaatgagtttagaaaaatttatgaacccatttaaaaatatttattgagtatctcctgtgtgcaaggcactgtgttatgttaagtggctgaagggaaattagactggggaaaaagacgaggtcatggcctaggtttcaaactaatataaaagacataacgaataagaaaggatgccaccttcttccaaccctcatccctcttccttttgacagttgcagatgttgctaattcattttggcaccctttttctctgacccaaatatagtcttataaaccttttcaacccacggctctaggcaagtatcaccttttgctcttttggcaccagatctcttgaacactatttactggttttggaaagattatacatgtatgtctg

SEQ ID NO: 25674 - DNA, 379 bp, Homo sapiens
gggagaagggttctgtgctcctgagattagttcagatggtctaaccattgttctatatgtgcattttagttaatattgtgtattaaaggataagtcttaatgctcaaagtatgttaaaaatagatgtagtaaatcagtccctgtgtgaatgtcccttgttagctttaggaggcctgtctctggagtgaccttattagtcacccttgagctagacatctgtacttagtaggggatgtgagagagaagagaaggtaaggaaggcccttctagtcctcataactgacgatggctagatatacagctcaaacggttagtagtctgtcatgtgcaagtatattcacacacgtccatggtcacataaactgccagtctccctgac

SEQ ID NO: 25675 - DNA, 426 bp, Homo sapiens
ataatgggaatatagtgagaattaaatgaaatattatgaaattattcaaaggaagacacccagttactatgtttcaccccatccactgcttttcaagacagaaagatctctaagattttttaagaggcgtagcacatattagctctcaataatattgttttaagaaaattaggctgggtgcggtggctcacgcctgtaattccagcactttgggaggccgaggcaggaggatcacgaggtcaggagttcgagaccagcctggccaacatggtgaaaccctgactgtactaaaaatacgaaaaattagctgggcgtggtggcatgtgcctaaaatcccagctacttcagaggctgaggcaggagaatcacttgaacctgagaggcggaggttgcagtgagccgagatcatgccattgcactccagcc

SEQ ID NO: 25676 - DNA, 295 bp, Homo sapiens
ggaagggaaataaagaggcccgggggaatgggctgggacagggaaggaaaatcaggaaaaggggggaagagcagagaacagactaaggagcatctggaggtattagggattcgagagagaggatcctcagaaacagtgcacagtgccaccggagttggctattaacgttttgttccattatttaaccattccgtcaaccacttgggggggttctgtaaggatctgcagattgcatagcccctgaaactggatgaagtcaagctgcatcccatagccacacacttttttttttttt

SEQ ID NO: 25677 - DNA, 318 bp, Homo sapiens
gcggccgcctactactactactactactaaattcgcggccgcgtagacccattacctgtttcaaactctggtttgatggggagtgtttttccttcagaactctaggaagaagacaccaggaggggataaataagagtaatggtggctgggcgtggtggctcacacctgtaatcccagcactttgggaggtggatcatgaggtcaggagttcgagaccagcctggccaacatagtgaaaccctgtctctactaaaaatacaaaaattatccaggcatggtggcatgtgcctgtaatcccagctacttgggaggctgagg

SEQ ID NO: 25678 - DNA, 184 bp, Homo sapiens
gagtgattatgcctccgtggacatttgacaaatgtctggaaacgctgcagctggcatctggtgggtgcatagaggtcaggggtgctgctaagtgtcttagaatgcacgggctagaccctacagccaagaactctctggcgcaaaatgtcaacagtgccgcagttgagaaaccctgcattataca

SEQ ID NO: 25679 - DNA, 246 bp, Homo sapiens
ttctgaattaagagatttaaacaattgtagttaatactgtcatcctgggttacatttcatgtggtcacattccataacccggagcttatgggaaaaatttagggcatctgaagttccctctaaagcacttggtgcccagaaattagcccttggtttgctttggttcagagttgacctctgttagatgttgggtggtggtcactgaaactgttttcggctgtatcctgtttagagaataaaagggct

SEQ ID NO: 25680 - DNA, 881 bp, Homo sapiens
catgattaggataaaatgtaaagctttgaagcatctaattcagagtgttcaccaaagatcatcacttgacccacatccccactctgcatttatctgtatttatttcaaaatgtttatgtggatgtagcctacttattcttacataaatatttttgccattctgtattaagatttctggcttctgaaagaaaagccctggtttctccccagttgcagttagaaaagcattgtgttaggaagccattatgtatgtctctctcatcctatacataaatgaggctctctattacttcagtagtctctgctcagacaaacagcagtttacctaaggtttccaaaaagtacatgattttttcattgtttaatttggagtaatatagtttctaaatcctatcttctaggcttatatgacggtacttcttgagttagtttaaaggtgacaccattcagagactaatgccatataaattgaacagtaattgggcctctatctaaaagggcacattcattgtttctgtctggtttcatatagtagctgactgctttactgtgccttatgcagctttgattgtaatgtgctgttgggagccaacaggccgtgctatttatttggcctaatgccaagtctgactccttgactcctcaagaagttgctaccagcccagagggggcaaaatcaatgagccatagggcatgctttttattaaagaggagtcaaaagagcgaaaagaaaccacatcagctgctgtcaatactgagctagtgccagaaaccccaaggctactactgttgcagaacaactgccaagcactataaatctgagatttactgtgacgtaaagtttccttaagagcttaatttctgaagctactgtattactt

SEQ ID NO: 25681 - DNA, 1195 bp, Homo sapiens
tgacgtttgttgagtgcttgttatgaatgtggcattattctagctcttgtaaggttaccaattttttaaaaaacaaaagtaatgcaagactgctgatgaaaatttggaatatgagaaaagcataaagaagaaaatacatatctttaagcacaccacccactgttaacattctgatctatgtacttctaatattttctccattttcatatgtacacatacatttatttacatgcatatataaatatcaaagtgtatatatataattttctctgccatttaaatttttactgtgtaacaatcatggattgtaaaaaaagtgaataaaatgtacgcagtcagtttaaagactaacaaaatatgcattaaatcaccagccaggttaagaagaaatactattacttataccctggcatctccctcccacctttacatagccaaatccagaaaagatccgttttcctaaccttgttcgcctattttattatttaaattgcagcaggagggaagcatgtctactttatccaatttcacacagacgctggaagacgtcttccgaaggatttttattacttatatggacaattggcgccagaacacaacagctgagcaagaggccctccaagccaaagttgatgctgagaacttctactatgtcatcctgtacctcatggtgatgattggaatgttctctttcatcatcgtggccatcctggtgagcactgtgaaatccaagagacgggaacactccaatgacccctaccaccagtacattgtagaggactggcaggaaaagtacaagagccaaatcttgaatctagaagaatcgaaggccaccatccatgagaacattggtgcggctgggttcaaaatgtccccctgataagggagaaaggcaccaagctaacatctgacgtccagacatgaagagatgccagtgccacgaggcaaatccaaattgtctttgcttagaagaaagtgagttccttgctctctgttgagaattttcatggagattatgtggttggccaataaagatagatgacatttcaatctcagtgatttatgcttgcttgttggagcaatattttgtgctgaagacctcttttactttccgggcaagtgaatgtcattttaatcaatatcaatgatgaaaataaagccaaatttgaagtaaagtgtctgggcagtggctgtg

SEQ ID NO: 25682 - DNA, 827 bp, Homo sapiens
gtaaggtgaaggtgcccagcaggctgaggcttgtgtgcaacccagaagagagctcgctaacgccagcaagaaggttcagaacagcctggctttggaaaggaatttcatcctgcccacacactgcatagcaggagggaagcatgtctactttatccaatttcacacagacgctggaagacgtcttccgaaggatttttattacttatatggacaattggcgccagaacacaacagctgagcaagaggccctccaagccaaagttgatgctgagaacttctactatgtcatcctgtacctcatggtgatgattggaatgttctctttcatcatcgtggccatcctggtgagcactgtgaaatccaagagacgggaacactccaatgacccctaccaccagtacattgtagaggactggcaggaaaagtacaagagccaaatcttgaatctagaagaatcgaaggccaccatccatgagaacattggtgcggctgggttcaaaatgtccccctgataagggagaaaggcaccaagctaacatctgacgtccagacatgaagagatgccagtgccacgaggcaaatccaaattgtctttgcttagaagaaagtgagttccttgctctctgttgagaattttcatggagattatgtggttggccaataaagatagatgacatttcaatctcagtgatttatgcttgcttgttggagcaatattttgtgctgaagacctcttttactttccgggcaagtgaatgtcattttaatcaatatcaatgatgaaaataaagccaaatttgaagtaaagtgtctgggcagtggctgtg

SEQ ID NO: 25683 - DNA, 382 bp, Homo sapiens
ctcccgtaaaagctcaaagcatgctggaaagaattagagttgttttaaaaatggaaaaatacggccaggtgcagtggctcatgcctgtaatcccaacattttggaaggctgaggcgggtgtatcatgaggccaggagttcaggaccagcctggccaatatggtgaaaccccatctctactaaaaatataaacattagccgggcgtggtggtgggtgcctgtagtcccagttacttgggagacttaggcagaagaatcgcttgaacctgagagtcagaggttgcagtgagctgagattgtgttactgcactgcagcctgggcgacagagcgagactccatctcagaaaaaaaaagggggggaaaattacttatcagcttatcc

SEQ ID NO: 25684 - DNA, 356 bp, Homo sapiens
gattgcatgaagacattactccagagagagagctcacactgggtcccacaaacccctgagtcctcagcagctgcagtgtggcatcatctggagagctcagcctccatcagactgtgtcttgccttggggttcaacagcctctacatctccacatccctgaagccccagtgacattccccaccacagctgctgtggctgctgctgctggtgccaaggtgggagccactgccagtgaccctatcacccccagcagaggggtgggcacacattttcatgcaccctgaggacaaattccactgcctgtaactgtagctgcaagggccaaggtgctagcaaatcatgagtcaccctcatcc

SEQ ID NO: 25685 - DNA, 401 bp, Homo sapiens
ccaacatcattgctgggtgtgtttgtgagagtgtttctggatgagattagcaggtgatttggaagactgaggaaagcagattgtcctccccattgtggtttaggatgtcactaaagcagtgtgtgtgtgtgtgtgtgtgtgtgtgtgtgtgtatttattttattggttcttttgttcctctggagaacgctgactaataaagtatcaactccaatattttactgaatgtgggacatttgttcattaccattattataaaattagtcaaagaaataaaaatacatgtagttggaaatacaacagtcaaaatctaatattaattatgttttaagaataattcattaacagatatcataccaagtaaatatttatggagtaactccattacttgtattgtgact

SEQ ID NO: 25686 - DNA, 269 bp, Homo sapiens
tggaaggaagaagagatgagataagggaaatgaactcataatagccccagttaaaatacttacagtaaaatatcattagtactacttgatgttggtgaaaggctctagactcaagtcagaaggcccaatttgttgctgtgatttcttgaacaaattatgtaattgtgttgagattcagttttcttttctatcattgggtattaataacttctatgtgatgtcagagttatgatgtgaagttaaaataactaataaatgggtaaaccctg

SEQ ID NO: 25687 - DNA, 473 bp, Homo sapiens
agatagcatcgctgcctagcccaatagcaaaagatagactcgggcactgggaatttaccggctgctttaggcctaatacctcgtcaagttgcaccatttgataaaatcagaggaattaattaaaaaccatattagaaaccttcatataattgctgatttcctgcttatgctctaagcacatgccaaggtagcaaaatgtacagattgaaactggatttcttgtccttttaccattaatgtaaaacatgtctatatttcctgctaggtcacccattggccttataaactttttttataaccaggaaagatactccaagggagaaagagtatccctgtaaggaaatagggtttcttccaaggcaaggaagaaaataatatttccttagaggagtacaacaggacaagggcacaggaaggtgaggagactctgcctcttcaaaggaaattagcagaatgcatggaaaagaagcaaa

SEQ ID NO: 25688 - DNA, 174 bp, Homo sapiens
tttttcttttagaaaagaattacaaaaatatagatgtgtcatgctttgtcattcgggctgaagggtggtggcatgatcactcactgcagcctcaaactcctgggctcaagcgatcctctgaagtagcattcaaatgatttttcaacttttcaaaagcatctttccctgggcatt

SEQ ID NO: 25689 - DNA, 426 bp, Homo sapiens
gcacacacgctcctgagttaagcctttgtcaatgaaatgaacacccacttaaaaggaataacctgtccaggcacgatggaacattgagtaaccccttattctaaattcctggtccctgtaagactccttccccatgcccttgcccttttctgaccttcccctaaagtccttgaggcttaagcgggcatagtctgcagcaaacactggggaagctgagtccagacttcagagcacaggctttggatctaggccagctggatttgaacctcacatttgtgatcagctggcatgactgtttccaaaaagtccattttaatcctctacgtgaccctctgtaaaatgggatactgaatggtgagctagcacgattttacagagagtgaattttttttgtgtgtgtgtgaggcagtcttactctgttgccca

SEQ ID NO: 25690 - DNA, 595 bp, Homo sapiens
gggaaggccttcaggcagagggcttccctcatccgccactggaaaattcacactggagaaaggccttaggatgggagataattccgtttccttgttcaacataataactgacatcagagagaagctccaagcatagcctttatgtgtagccgacagccagaagtagaactttatacactcaaacactcaccctggggaggttcttccgagtgccagctatatgggaagccttctggagctatgctgaattttctagactcttgctggaatttcgtcaaggcagtgcctgttagaagccatctgtctttgtgctggaagagtcctgccttgtgccaaagtaaccccaatgtgtttcaaaagacagacctctgtactattcccttccctggagggaatcatcagtagcctgaggccatcaaggattctcactttttttctgccccactactggtttaagcatgagcatgacccagttttagccagaaaaatgggagctttgttctgctgaccactggcagaggtttcccttcatggatatagttgatctcacatggcacttgggacgaatttttctagccttcaagacacctgacct

SEQ ID NO: 25691 - DNA, 300 bp, Homo sapiens
tgtaggcctaatcttttggtctatatgttaagattttttgtgtaattgaggtcaccctaagcagtgggcatttgttgtgataatctctaatgtgtctgggagcaacatgaattacgtcccttgttcccagaagatacttcatattcccaaggcttcttgaggagaatttgaactcagtggacatgtcaagatctctgaagtctatttttcagtaggcagttgatattggctgtcctccagaggggacaagttttattcctatgaaggggaagatgccggccattaatggaggccactcat

SEQ ID NO: 25692 - DNA, 731 bp, Homo sapiens
atatagttgatctcacatggcacttgggacgaatttttctagccttcaagacacctgacctgaaattggctgcctcatattctggttttgcaacaaatgccttaatttttagactatctgaaatcttgaggattctgttcgctttgtgggttgggttgagaacagaattgagctaagccagtatgaagggaagaacagcttttgtgagagctccaactatctgtatctctgaagtgatagtaggatggcaaagactagctcttatgctagtgtcaagctaacttacttgactgcttcagctctcctaggaaagaatgccagtctttgtaggcctaatcttttggtctatatgttaagattttttgtgtaattgaggtcaccctaagcagtgggcatttgttgtgataatctctaatgtgtctgggagcaacatgaattacgtcccttgttcccagaagatacttcatattcccaaggcttcttgaggagaatttgaactcagtggacatgtcaagatctctgaagtctatttttcagtaggcagttgatattggctgtcctccagaaggcccaggtaggaatcatagttggtgcagaaacccagattaataaaggaatgagaaaactgcagcaaactatagggaatatgacccttctaaaggtacatccacatgtgtttccattactctggctccattatgagggtttacagaaatatttccatacctgtg

SEQ ID NO: 25693 - DNA, 559 bp, Homo sapiens
ataaatccatcctggtccaccagcctttcttccctaacacactctgaattgacagtggtgttgaagcatgcacagattgactgatcctgaaagaggcctgccttctgttttagttaaggctggagaaatgtccttggccatttttaagagcaagtttattcccattcccacaccttatttatccttgtcatgataatttgaggaaacctgtgattcttatctttctattgagtctaatttaaacctaaaccaacttgtggtctaactttggtttattcaagagcagcattgcccagtagaactttctgtgatggtggaaatgtaagtgtctgtgctgcttctgcagtaactactagctacgtgtgatagtaagcccttaaaatatggctagtacaactgggtgttttatttaattaaattataactcgatgaagccgggcatggtggctcacgcctgtagtcccagcactttgggaggccgagacaggaggatcgcttgagcccaggagttcgagaccaacctggggcacatagcgagacctcatctctatttatatta

SEQ ID NO: 25694 - DNA, 511 bp, Homo sapiens
ataaatccatcctggtccaccagcctttcttccctaacacactctgaattgacagtggtgttgaagcatgcacagattgactgatcctgaaagaggcctgccttctgttttagttaaggctggagaaatgtccttggccatttttaagagcaagtttattcccattcccacaccttatttatccttgtcatgataatttgaggaaacctgtgattcttatctttctattgagtctaatttaaacctaaaccaacttgtggtctaactttggtttattcaagagcagcattgcccagtagaactttctgtgatggtggaaatgtaagtgtctgtgctgcttctgcagtaactactagctacgtgtgatagtaagcccttaaaatatggctagtacaactgggtgttttatttaattaaattataacccaaagtgctgggattataggtgtgagccactgtggccggccgttttggacctcttaaaacaacgctctcgtgtgtgtgtatacac

SEQ ID NO: 25695 - DNA, 395 bp, Homo sapiens
atctcaagatgtggcatggtagaatgctaacagacaaataggtccagggagctcaaaatccatttccaccatttattatcaataactctgggactttttgttctggttacttattctctgtgagcttttgttgtgagttattgtgagagttaaaagatataaatgaaacactaaaatagggattggtacatagttagtacttaatatatgtgagctgtcttctctcccgtttcttaaatttctcaagccatgtttacatacacaaacaagtatatttatccatacatatctgggtaatcattcaataatttattcattaaaaaaaggtattgacctcctacttattaggtgccagccctgttctggattctggagttggaacaaacaaaaaaata

SEQ ID NO: 25696 - DNA, 350 bp, Homo sapiens
tatggtttgggtgaggctgctgttagacatactgttcgctaaagttaaggaaattggatatatcagattgattggcctcattaatagagatatttcataaattcactatgaagccgaagtctgggagagtgttggtgggttttatggtttgcagtatatttttatttcaatggacctttcaggaatattaaatgaattttgactactgtaatatatatatatatgttgtgattagggttatgaactactgcaataatatgaaacctgaatccagcatgcaaattaaaatgtttgctttctgatatttgtgagggaatattctgaaaaagctgattgtctgggaaattagc

SEQ ID NO: 25697 - DNA, 503 bp, Homo sapiens
gagactcatgtactcagatgctgaaacaagcaggaaactctggtgaatatcatttacttgtgtccatcttctaggtagatctgtttcctcctctctgatcctatactattttgtgtatctaaaactaataatgatatttattgtatgcttactacattgccaggtattattctgtatattttatatacatggtaatttaattttcagaacagttcttcaagatagttattatttttcctcttttacagatgaaaaaaatgtaggcactcataaacttaagtatattttctgagataatattgctagtaagtgatggagccaagacttggacacggatctttaagacactaaagcctgcgctgttttcccctatatcatgctactgcttttcacattttattgtaattgtttcttctcctaaccagactgtggaaaagcagactgttgaatgaaatatggaaaaaatgaaacatatatttggaaatatagcatacactaaagta

SEQ ID NO: 25698 - DNA, 567 bp, Homo sapiens
gtacttccaatagtaaactttttttttttaatagagtctgaacttgagatcaaatgctatttaatggtggtaggaaggcaggatgtaaatgtgttaagtgtcagccattgaaccaagcatgttgtatactataccttgttttatattatttaatcccaactacccccattggtagaaatttttatactcattttacatatgaggaaattaaggcttcaaagaaattaacttgcctgagttacacagtaaaaggcaaggctgggatttgaagccaggtctgagtgacatctgatcccatatacttgccctgtcacagtgctggactgttatgtaaaggacataaagattctgtgttaaggccaggcgcgatggctcacgcctgtaatcccagcactttgggaggccggaggaggcagatcacctgaggtcaggagttcgggaccagcgtggccaacatgatgaaaccctgtctctacaaaaaatacaaaaattagctgggcatggtggcaggcgcctgtaatgccagctacttgggaggctgaggcaggagaatcgcttgaacccagg

SEQ ID NO: 25699 - DNA, 236 bp, Homo sapiens
gtgctgagattacaggcacgagacactgctccccgccacaaggatttcttaatcgggacacaaacataaaaaatatatatatagagagagattggtttatattaaaactaagaacttttgttcatcaaaacataccattaagagaatgaaaagacagtcacagagtgggagaagatattcttaatacacacatctgacaaatgactcattcagattacataagaactcctgcaaat

SEQ ID NO: 25700 - DNA, 495 bp, Homo sapiens
ggcactctcttcaattttgcagtcgtttttacagatgttaaaagacctggctatcgagttaaggaagttggtagcaccaagtctggcagaaaggggactgatgattccatgaccctgccgtcgcagaagttccaggtagattacttggacatagcaattacccctccgcatcgggcaccacctccttcagggcacatgagaccacattaaattctatttactatttcttgtgtttattttttggtcagttatgtaaaataaacttactctttttcctccccagattattgtcattaagcctttgaattctaagcaaattataatccatcatctatttaggaattagatttggatgtgctattgtataattactaatacaaagtccatatgtttccagcctttttgtaaaatatgaagaaatgctcttagcattctatgtaaaactgtactgttaaatatatgtgtgtaataaaaaaagcaacagaaaaacagaca

SEQ ID NO: 25701 - DNA, 711 bp, Homo sapiens
agccgttatcctcaggaagccctgagcgctgagaggcactgttacagaaccgaactggggtccactcgctaggcctacctaggtgcctggaatttcccttcgaggaacgcaggagttttctttattttcatgcttgggaaggctcattaggcccctaagagagggtcccttccccatctcaggactaaaatgcaatgaagatgttgctcagaggcagctggagagggatgggtctgtggaggatgccccgcagagtgaagtcgagatgatgcagccaccagggccggaggggagggacattccactttttaaatcagctttctgaagcatgatctccatataatcacctagaagcgtacagcacaatgatcttgacagatgccagcatccttggaaccactgccaccaccaacgtctcaaaccattccatcaaacccagaacactcctggtgccctgaagcgtctcccttcagtggcagaaccagcagagattcagtggtcacaaggctggtctggaactcctgggtgcaagcgatccttccacctcggcctcccaaagtgctgggattagaggcataagccaccgcgcccagccaggaatggattttctcacagttctcgatggcggaagtctgagatcaaggtcttggcagggctaggtctctctgaggcctttctccccagcttataggtcgccgcctcctctctctg

SEQ ID NO: 25702 - DNA, 635 bp, Homo sapiens
agccgttatcctcaggaagccctgagcgctgagaggcactgttacagaaccgaactggggtccactcgctaggcctacctaggtgcctggaatttcccttcgaggaacgcaggagttttctttattttcatgcttgggaaggctcattaggcccctaagagagggtcccttccccatctcaggactaaaatgcaatgaagatgttgctcagaggcagctggagagggatgggtctgtggaggatgccccgcagagtgaagtcgagatgatgcagccaccagggccggaggggagggacattccactttttaaatcagctttctgaagcatgatctccatataatcacctagaagcgtacagcacaatgatcttgacagatgccagcatccttggaaccactgccaccaccaacgtctcaaaccattccatcaaacccagaacactcctggtgccctgaagcgtctcccttcagtggcagaaccagcagagattcagtggtcacaaggtgagtgaggcggcctgggtctggctcctggccattaattttaaataatttgcatttaactttgaaccaccacacctggccatattggatagtgcaggaggaataaactcactggcacatccttctggg

SEQ ID NO: 25703 - DNA, 497 bp, Homo sapiens
tcaacccagaaagaacccactgttcagccacagcagcctgagtgggcttttctagtgaccccactctgtatggccgctcgagatctaaagggcattagctggtataggccacctgttaactactcgggccagctttaccctggcccaggactggagttctcagctctggcagcatatttgaatcaccaaggagcttttaaaattcccaacatggaggtctggcgcagtggctcatgcctgtaatcccagcactttgggaggccgagataggcagatcacctgaggtcaggagttggagaccagtctggccaacatggtgaaacctcatctctactgaaaatacaaaaaattcggcaggcatggtggcgggcgcctgttatcccagctactcaggaggctgaggcagaagaattgctgatatcctgtaggcagaggttgcagtgagccaagatcatgccactgcactccagcctgggtgacagagggagactctatct

SEQ ID NO: 25704 - DNA, 384 bp, Homo sapiens
aggatgttgcttgagacgggataccatttagcctgtgcaagcaacagtaaaaaggttacagatgaagtgcctaaacccaagacggagggtggtactttaagactatatagggtgcagtggctccccagcactttgggaggccgaggtatgtaggatgattgagctcaagagtccaagaccagcctgggcaacatagcaagattccatttccactaaaaatacaaatagaaatcaggcaggtgtggtggagtgtgcctgttgttccagctactcaggaggctggggcgggaggatcgcttgagcctgggggatctagtctgtagtgagccatgattccaccactgcactccagcctgggtggctgcaagacttcacctcaaaaaa

SEQ ID NO: 25705 - DNA, 569 bp, Homo sapiens
gtgggctcaggcccagagtgccagctttgccctatcccatagcctggagccaccacaggaggggcactccactctcttgggctcctggagcctcagaggcagagccagccgggagtgcaggagggagaactttcctgtggacgtcctgtgttctccagacgcagagaaccctcatcaaccgagggggaggtcacttccgaatccacagatggcgtgtgagtgcatggcgagcgcctccaggacacacttactgttcccttgctctggccagacgccagccggaccctgtgtgtgcgcgccgtgctgctctttgcagctgcctgcaaggggttcctgcgaagaccagcaccttggggaagagcctgcggctgaacttgaactcgcagctacctgagtcagacctgtgctttttcacctctacggaagatgtcagagcgtttccctagcaatgttttagaagttacttctgtctggaaaaaaatggaaaaaatggcaaattatgttatgtataatttgataattttaaagaattaatgatgtaattattactcaaacccaaaaaaaaaaaa

SEQ ID NO: 25706 - DNA, 622 bp, Homo sapiens
gagattcggtccaaaaaaagacttcagaggagaccctgcctcctggtgctctgtacattcttcccctaaactgggctcaacttccttgttttatgtaaaagttgggcagatggaattaagccctcagagcattcaacttacttcataattttcagagccagccgggagtgcaggagggagaactttcctgtggacgtcctgtgttctccagacgcagagaaccctcatcaaccgagggggaggtcacttccgaatccacagatggcgtgtgagtgcatggcgagcgcctccaggacacacttactgttcccttgctctggccagacgccagccggaccctgtgtgtgcgcgccgtgctgctctttgcagctgcctgcaaggggttcctgcgaagaccagcaccttggggaagagcctgcggctgaacttgaactcgcagctacctgagtcagacctgtgctttttcacctctacggaagatgtcagagcgtttccctagcaatgttttagaagttacttctgtctggaaaaaaatggaaaaaatggcaaattatgttatgtataatttgataattttaaagaattaatgatgtaattattactcaaacccaaaaaaaaaaaa

SEQ ID NO: 25707 - DNA, 355 bp, Homo sapiens
ttagatctatctggggtactatgggagactctgaggtgaataagataaggatttaaagtctagaacaagggccagcaaacttctgtaaagtggcagatagtacctaaaataaaagcactaaaataggctttgtgggccatgcagcccctattgcaaatactcaactctgccactgtagcatgcaggcagccatagacagtacacaaattaatgtgtactgttccaaaaaagccctttatttataaaaactggtagttggctggattcctggtctagaaccagtgataggatatacccaaatatctacatactcaacctaactgttcaggcttttatttcttgcctgaactgttat

SEQ ID NO: 25708 - DNA, 258 bp, Homo sapiens
gcagaaaaagagtaaaggggagaaaagaacagatgtgacaaatagaaagcaaataacaaggtgacagactctaacctaaccataccagtaagcacattaaatatcaatgggctaaactcccctattaagaagcagaggggccatgcatggtggctcactcctgtaatcccagcacttttagaggctggtagaggaggatcccttgagtccaggagttcaagaccagcctgggcaacagagggagaactcatctctcca

SEQ ID NO: 25709 - DNA, 717 bp, Homo sapiens
taatggactcaaataagcagtctcagttattttaacagcagtaaactcaggattcttagatttaataatatccatttgggtactgattgctggcatattctgctaccattcagatttctacctggcttgagggaagaactattattttacatgttgcctcccatgtcctttctcaaacatagttattttgatctcacctatgttgcttttaagagggactagtttggggcctgcagaattagaagctttacccttatggttttcaactgagtataataaacatcttttaaagaaaccaaacaacaatagcaaagctatagccccagtggaggcattaaaggggagttggcacccatttagaaatcccagctgtgtttgttctgattataatccaggctactgtctacccatttagttctcttgggaggtgatacagttaaaatcccagcatctgtagaaatagcaagtttatccactcagttatatacactgagctttctgttttaataaagagaggtggggtacaatgatcagattaaggagtatgggcaatttttaccttgagcagaaggaagcagtcctccagtgtgttttagaatcctattcattgctgacactgggagaagactgctgacaatatgggtaagctcaccttgatcttttggaggggagcctcctccaaccatttagaacagtacagtgggaggaaaacaaaac

SEQ ID NO: 25710 - DNA, 491 bp, Homo sapiens
actggtttgtcagaactgaagatgctctaattcattcatatttttaagtaaaaagtgagaaatgaaaaaaagaagctggttttagaaaagagcatatgatttcagtttcgtaaaagtcttcaacaaaaaacaagaataaagttcttaagacaaggttaggggttacaaaaagttaaattatagtgacaatttctgactaggccaggctcagactcgtttaacaaagagctggtaccatctttttccctgaaatacttatctgctctggtcagacagtgtctttactaccctaccctttccccccaactctccgcaacatatatgtaattttaagctctatgcccatgcctgttgtttccacagttccttgcaaaatgctatacaagtccactaggtacttaacaagcacaagataataggtagagtcaaagctattactgttatctgtaataacccaaataagaaaaccagcaaaggccgggtgcagtggc

SEQ ID NO: 25711 - DNA, 416 bp, Homo sapiens
aaagaaacaaatgtgttggccctgaatttgcagaggagcaaaattctgccatccttctctctattgccagccttactctgaactagttgttagtgtatccattgaaaactggatttaaaaagctagaaagattaaaatgagtgatgaatgaagccaaacaaggtatccaatttttcttcattatttatatctttctggacatgttttatcataactaaataaagccacaggtgactcttaaagtatctgcaagagctgggcatggtggcacatgcctacagtcccagttacacaggaggctgagaaaggaagattgcttgagcccaggaattcagggctgtagtgcgctacgattgtgcctgtgagtagacactgtactccagcctgggcaacataaggagaatcttgtctcttga

SEQ ID NO: 25712 - DNA, 387 bp, Homo sapiens
gcagggcggacgctttaaacctcgatctccccactcagtgtgcagggcggacgctttaaacctcgatctttctactcagagggtggatgatagaaagatttgaatgagtgaatgaaagtagagacttgaaaagtcagcacaaaagcaacaaaatgcagcaactccactcggaatccctgggtggaaagctctggttgacttcctgcggactcaggctggtgagatcctacagctgggaacggcccatatgggtcagtccctgtgatgcctccagtgtggcgggaaggtggcttggccaccatggatgactcgcgcctgccttcacgaccgccgggacctgtgcggggggggaagagggcggctgcaggggaggccgcacgtggcaca

SEQ ID NO: 25713 - DNA, 476 bp, Homo sapiens
tagttgaaagatcactgtctgctgtgtagaggatggattggaagagtcacagaggcaggaataagaggttaagggcctgcaccagggctgtagcagagagtttaagaagtctgggagattgagtcaccttgacctactgattcattggaaggtggaatgcaatcatggtgtcagtcctctaagataggacctttaaagtgtagggatagtggtttggttttacacgtgttacacatgttgaatttgaggttcttgttggcggtcaaggcagagaagtccagactggaggtggaagtacaggcctagttctttaggacctactctgggctggagcatcagttgcggccgggcccttgtggtagtaggagctttgggttgaacataagttttcagcaggagtgcgtggagtgaaaagagagatggggttggatttttggtcaactccaactttaagagattcagaggatgtgattcct

SEQ ID NO: 25714 - DNA, 652 bp, Homo sapiens
tgtgaagtctgggtttccatcgaacccagacttcgttcagaatctttaatttcaccaccgcatcgggagcacatcctgttttctggagcacagctgagctctggggtgtatgtctcttttgattgctattgcattttgaattttttgttgtgtttgagactcgccgtcttgccccccatcccagccatcattctcttcctctcttaccaccacgccccaccaatcaataagttaattaagatgtgtcatgaaagggcccttcctgccacggctggggctgtgtgggtgctggggacatgcccaggcctcgctagatcccggctgaaaaggagaagctggggttgttttaaaaggcttcaggtgctctgcgtgtataacctgtcatttcactattatccctaatcactcctccaaacaccttcttaaaggatgctgcacatggctaaggaaaccacatcatatcacaaggagagtgttaaaagggagaggacaggtgtggcctgaacaggtgtacatcatttatgcactaggcgtggtcctgaaatggaaggtacatttttcagaattgaatgatagttgaaatgatttgtttctccgggaaatgtgaaagaacaccacagtgcttgttttgagtgattcaagtaatatataa

SEQ ID NO: 25715 - DNA, 301 bp, Homo sapiens
gggaaattagcagtttttgttttatttacctattagattgagataaaggaaccacactcttcgatagatcaaactagaacctgagaagtaacctatgatgattcttcttcctcaaaaactctaattacccaagccagtggcaaacaagggagtaattcaattgattgctgttttagttattggaatattgagtcttataatgcaacacagcttatagacaaatgaagttaaaatattcctttgaatgcattgtgatctctccattgaactggtcttcctgtttcaacctttgtttccctac

SEQ ID NO: 25716 - DNA, 155 bp, Homo sapiens
cacccttctactttctgtttctatgaatttgcctacctaagaacctatttaagtggatcatgcaatatttgtccttttgtgactggcttacttcacttagcataatgtcttcaggattccctcagaacaaggacctctaaggacaaaaataagtg

SEQ ID NO: 25717 - DNA, 357 bp, Homo sapiens
gtatcgtcccttccatgattcaccagaaagacgttaccagaccctaccacttacccaaagttactctttgggtctggggtttccacactatagtcacttctgtggtcgccagaaagatgttacaggaccccatcacttaaccaaagtaaacctttgagtcaagggtttccacactatggttctttccatggtcaccagaaagatgttacaggaaaggggtcccaatccagaccccgagagagggttcttggatctcacgcaagaaagaattcagtgcaagttcatgaagtgaaagcaaatttattaagaaagtaaaggaataaaaaaagggctacccatagacaaagcagccctgag

SEQ ID NO: 25718 - DNA, 292 bp, Homo sapiens
gccatatctatgtattcacatacatagtattcttttcttacatctatcctagaatatgtatgtataacaccataatacaagtcaactgtctcttatctgcaaccacaaatccataaagctctgaaaaccagaagtttgttttatgattggtaccaaaatttattttgtgcaaaacctggcttgaacagacatgaggcttgctagctgatatgccccactagatgtaagaaaagaatactatgtatgtgaatacatagatatggccccaacacagactggtgaagagtcgacg

SEQ ID NO: 25719 - DNA, 336 bp, Homo sapiens
gtagtctacaccttcagttccaagtaactcagatttgcctgtgggggatgaggcaaggaaaaggctaaagatagataactttaaatatacagagagattactttttttttccctttccctttccctccttctctgtctctctcttcccatgtcatctttgctgcttcgtatgttagcttcattctataacagattttctcagtgtggtggagaatatggccattgagggctccagatttgtatcttctgcaaatctacagaactacagtagaaacaaggacttttctctgtcagtgtccatgtgtcaatttagggaagaactcaggtactgtttgg

SEQ ID NO: 25720 - DNA, 360 bp, Homo sapiens
ccctcccggttcccgctctcgtttttgtttttggtcgggtaaggcgatgctgtagaggctggcgatctccagtcttcacgaatccgcacgtctctccattatccaccgcgcccgcccactgggccccggggcggccggcggccgggtctctcgggctccgcgtgtcgcccgagccgccgccggagcgagggtccctgccccctggggagcggtctccagccgcttcgaagccgccttcttccccctccgtgagtcagaaacaaaggcgggggggcggggggagcgcccgagctgcggctccgcgattcgccctttattctgaactcgcaacgtcagcggcccgcggatggagctgcgggg

SEQ ID NO: 25721 - DNA, 1545 bp, Homo sapiens
ctggtctggcccggaattttggcatggaggccggccttgagtgaaaccggagctacaaagaaggggagagtccgggagcgggagggcgcgagggaggagcggcggcgccggggcagctccgacgccctcccgcggggaaggagcccccgcggtgccgccgaggccccgacgcggggccgcccctcggctcgccgccccgcgcccgcgcccgctgggaatgatgaagaagaacaattccgccaagcggggacctcaggatggaaaccagcagcctgcaccgcccgagaaggtcggctgggtccggaaattctgcgggaaagggattttcagggagatttggaaaaaccgctatgtggtgctgaaaggggaccagctctacatctctgagaaggaggtaaaagatgagaaaaatattcaagaggtatttgacctgagtgactatgagaagtgtgaagagctccggaagtccaagagcaggagcaagaaaaatcatagcaagtttactcttgcccactccaaacagcccggtaacacggcacccaacctgatcttcctggcagtgagtccagaagagaaggaatcgtggatcaatgccctcaactctgccatcacccgagccaagaaccgtatcttggatgaggtcaccgttgaggaggacagctatcttgcccatcccactcgagacagggcaaaaatccagcactcccgccgccccccaacaaggggacacctaatggctgtggcttccacctctacctcggatgggatgctgaccttggacttgatccaagaggaagacccttcccctgaggaaccaacctcttgtgctgagagctttcgggttgacctggacaagtctgtggcccagctggcagggagccggcggagagcggactcagaccgcatccagccctccgcagaccgggcaagcagtctctcccgaccttgggaaaaaacagacaaaggggccacctacaccccccaggcacccaagaagttgacgcccacagagaaaggccgctgcgcctccctggaggagatcctatctcagcgggatgctgcctctgcccgcaccctccagctgcgggctgaggaacccccaacccctgccctccccaacccggggcagctgtcccggatccaggacctggtagcaaggaaactggaggagactcaggagcttctggcagaggttcagggactgggagatgggaagcgaaaggccaaggacccccctcggtctccgccggattctgagtcagagcagctgctgctggagacggaacggctgctgggagaggcatcatcgaattggagccaggcaaagagggtgctgcaggaggtcagggagctgagagacctgtacagacagatggacctgcagaccccggactcccacctcagacagaccaccccgcacagtcagtaccggaagagcctgatgtgagggcagggtggggtctggaacttgtcgggttggacagactcttatctccgtgttgctggataaagcttttttatttacctcaatcaaaaaaagaaaac

SEQ ID NO: 25722 - DNA, 2111 bp, Homo sapiens
cgggggagcggccgcgctgggccgggcgggcgggtggcgggggtgcgctcggggacccgggccgcgtgggcgccgggatggagggcgccaaggggcggggagcgggcgtgcgtgtgtgtgcgagtgcgaatgcgagggaggccggccttgagtgaaaccggagctacaaagaaggggagagtccgggagcgggagggcgcgagggaggagcggcggcgccggggcagctccgacgccctcccgcggggaaggagcccccgcggtgccgccgaggccccgacgcggggccgcccctcggctcgccgccccgcgcccgcgcccgctgggaatgatgaagaagaacaattccgccaagcggggacctcaggatggaaaccagcagcctgcaccgcccgagaaggtcggctgggtccggaaattctgcgggaaagggattttcagggagatttggaaaaaccgctatgtggtgctgaaaggggaccagctctacatctctgagaaggaggtaaaagatgagaaaaatattcaagaggtatttgacctgagtgactatgagaagtgtgaagagctccggaagtccaagagcaggagcaagaaaaatcatagcaagtttactcttgcccactccaaacagcccggtaacacggcacccaacctgatcttcctggcagtgagtccagaagagaaggaatcgtggatcaatgccctcaactctgccatcacccgagccaagaaccgtatcttggatgaggtcaccgttgaggaggacagctatcttgcccatcccactcgagacagggcaaaaatccagcactcccgccgccccccaacaaggggacacctaatggctgtggcttccacctctacctcggatgggatgctgaccttggacttgatccaagaggaagacccttcccctgaggaaccaacctcttgtgctgagagctttcgggttgacctggacaagtctgtggcccagctggcagggagccggcggagagcggactcagaccgcatccagccctccgcagaccgggcaagcagtctctcccgaccttgggaaaaaacagacaaaggggccacctacaccccccaggcacccaagaagttgacgcccacagagaaaggccgctgcgcctccctggaggagatcctatctcagcgggatgctgcctctgcccgcaccctccagctgcgggctgaggaacccccaacccctgccctccccaacccggggcagctgtcccggatccaggacctggtagcaaggaaactggaggagactcaggagcttctggcagaggttcagggactgggagatgggaagcgaaaggccaaggacccccctcggtctccgccggattctgagtcagagcagctgctgctggagacggaacggctgctgggagaggcatcatcgaattggagccaggcaaagagggtgctgcaggaggtcagggagctgagagacctgtacagacagatggacctgcagaccccggactcccacctcagacagaccaccccgcacagtcagtaccggaagagcctgatgtgagggcagggtggggtctggaacttgtcgggttggacagactcttatctccgtgttgctggataaagcttttttatttacctcaatcaaaaaaagaaaacaaaaatgaactcattgctcttgctgatgcctgaccccactacaacccttattgccccacctactttccatatgcccctcgtatgcccctcaggtttgaggaagtgaccccgcagcagtagcaggaagtttttacccagccagagagagagaaggcacggtaaagacacagtctgaccactccacacaccgcccgcccccaagacggcacagggagtccactgctgctcccaaggatacagtgggcttctaagcttagagcgggagggggatgaggatgttttctgttatgtcccaccccaggccttcagtttgagggtgaagtttcagctgcccaactctagttgtagggatgtggaggccagtgtcacctgtccgtgcacatggaagtgaaatttatcccagccctgaggaggatttgtggaattaaaatctccccagccagacactggcttct

SEQ ID NO: 25723 - DNA, 1703 bp, Homo sapiens
caggcttcctctgtttcccaagatgatctaaactaacagtctgggtggaggggctaaataattttatcctcctcacctcaccccaaccctcccctaggtaaaagatgagaaaaatattcaagaggtatttgacctgagtgactatgagaagtgtgaagagctccggaagtccaagagcaggagcaagaaaaatcatagcaagtttactcttgcccactccaaacagcccggtaacacggcacccaacctgatcttcctggcagtgagtccagaagagaaggaatcgtggatcaatgccctcaactctgccatcacccgagccaagaaccgtatcttggatgaggtcaccgttgaggaggacagctatcttgcccatcccactcgagacagggcaaaaatccagcactcccgccgccccccaacaaggggacacctaatggctgtggcttccacctctacctcggatgggatgctgaccttggacttgatccaagaggaagacccttcccctgaggaaccaacctcttgtgctgagagctttcgggttgacctggacaagtctgtggcccagctggcagggagccggcggagagcggactcagaccgcatccagccctccgcagaccgggcaagcagtctctcccgaccttgggaaaaaacagacaaaggggccacctacaccccccaggcacccaagaagttgacgcccacagagaaaggccgctgcgcctccctggaggagatcctatctcagcgggatgctgcctctgcccgcaccctccagctgcgggctgaggaacccccaacccctgccctccccaacccggggcagctgtcccggatccaggacctggtagcaaggaaactggaggagactcaggagcttctggcagaggttcagggactgggagatgggaagcgaaaggccaaggacccccctcggtctccgccggattctgagtcagagcagctgctgctggagacggaacggctgctgggagaggcatcatcgaattggagccaggcaaagagggtgctgcaggaggtcagggagctgagagacctgtacagacagatggacctgcagaccccggactcccacctcagacagaccaccccgcacagtcagtaccggaagagcctgatgtgagggcagggtggggtctggaacttgtcgggttggacagactcttatctccgtgttgctggataaagcttttttatttacctcaatcaaaaaaagaaaacaaaaatgaactcattgctcttgctgatgcctgaccccactacaacccttattgccccacctactttccatatgcccctcgtatgcccctcaggtttgaggaagtgaccccgcagcagtagcaggaagtttttacccagccagagagagagaaggcacggtaaagacacagtctgaccactccacacaccgcccgcccccaagacggcacagggagtccactgctgctcccaaggatacagtgggcttctaagcttagagcgggagggggatgaggatgttttctgttatgtcccaccccaggccttcagtttgagggtgaagtttcagctgcccaactctagttgtagggatgtggaggccagtgtcacctgtccgtgcacatggaagtgaaatttatcccagccctgaggaggatttgtggaattaaaatctccccagccagacactggcttct

SEQ ID NO: 25724 - DNA, 2480 bp, Homo sapiens
cgggggagcggccgcgctgggccgggcgggcgggtggcgggggtgcgctcggggacccgggccgcgtgggcgccgggatggagggcgccaaggggcggggagcgggcgtgcgtgtgtgtgcgagtgcgaatgcgagggaggccggccttgagtgaaaccggagctacaaagaaggggagagtccgggagcgggagggcgcgagggaggagcggcggcgccggggcagctccgacgccctcccgcggggaaggagcccccgcggtgccgccgaggccccgacgcggggccgcccctcggctcgccgccccgcgcccgcgcccgctgggaatgatgaagaagaacaattccgccaagcggggacctcaggatggaaaccagcagcctgcaccgcccgagaaggtcggctgggtccggaaattctgcgggaaagggattttcagggagatttggaaaaaccgctatgtggtgctgaaaggggaccagctctacatctctgagaaggaggtaaaagatgagaaaaatattcaagaggtatttgacctgagtgactatgagaagtgtgaagagctccggaagtccaagagcaggagcaagaaaaatcatagcaagtttactcttgcccactccaaacagcccggtaacacggcacccaacctgatcttcctggcagtgagtccagaagagaaggaatcgtggatcaatgccctcaactctgccatcacccgagccaagaaccgtatcttggatgaggtcagggggctcactgtggggagagggaggaacgctggggcagagggaacagctgtgacccactgaagggggaggattgtgcaggccccgtttactcgctcctccaccagctctacttctttaccgcccttttaaaagccctgatctctttctaccttctctccaagtctcatctgacacctcctcttccccgcttcatgatgggggagccagccttgggtcagcttaaagagcccccttcgtgtccagtaaatccccttgcccattcagaagcagtgaatggagtgggcacatgttcaggcctcgggatgctgggttgggacagcgagtcgtgaaagagcactcatgattcacagtacatctcttcaggtcaccgttgaggaggacagctatcttgcccatcccactcgagacagggcaaaaatccagcactcccgccgccccccaacaaggggacacctaatggctgtggcttccacctctacctcggatgggatgctgaccttggacttgatccaagaggaagacccttcccctgaggaaccaacctcttgtgctgagagctttcgggttgacctggacaagtctgtggcccagctggcagggagccggcggagagcggactcagaccgcatccagccctccgcagaccgggcaagcagtctctcccgaccttgggaaaaaacagacaaaggggccacctacaccccccaggcacccaagaagttgacgcccacagagaaaggccgctgcgcctccctggaggagatcctatctcagcgggatgctgcctctgcccgcaccctccagctgcgggctgaggaacccccaacccctgccctccccaacccggggcagctgtcccggatccaggacctggtagcaaggaaactggaggagactcaggagcttctggcagaggttcagggactgggagatgggaagcgaaaggccaaggacccccctcggtctccgccggattctgagtcagagcagctgctgctggagacggaacggctgctgggagaggcatcatcgaattggagccaggcaaagagggtgctgcaggaggtcagggagctgagagacctgtacagacagatggacctgcagaccccggactcccacctcagacagaccaccccgcacagtcagtaccggaagagcctgatgtgagggcagggtggggtctggaacttgtcgggttggacagactcttatctccgtgttgctggataaagcttttttatttacctcaatcaaaaaaagaaaacaaaaatgaactcattgctcttgctgatgcctgaccccactacaacccttattgccccacctactttccatatgcccctcgtatgcccctcaggtttgaggaagtgaccccgcagcagtagcaggaagtttttacccagccagagagagagaaggcacggtaaagacacagtctgaccactccacacaccgcccgcccccaagacggcacagggagtccactgctgctcccaaggatacagtgggcttctaagcttagagcgggagggggatgaggatgttttctgttatgtcccaccccaggccttcagtttgagggtgaagtttcagctgcccaactctagttgtagggatgtggaggccagtgtcacctgtccgtgcacatggaagtgaaatttatcccagccctgaggaggatttgtggaattaaaatctccccagccagacactggcttct

SEQ ID NO: 25725 - DNA, 1859 bp, Homo sapiens
ctggtctggcccggaattttggcatggaggccggccttgagtgaaaccggagctacaaagaaggggagagtccgggagcgggagggcgcgagggaggagcggcggcgccggggcagctccgacgccctcccgcggggaaggagcccccgcggtgccgccgaggccccgacgcggggccgcccctcggctcgccgccccgcgcccgcgcccgctgggaatgatgaagaagaacaattccgccaagcggggacctcaggatggaaaccagcagcctgcaccgcccgagaaggtcggctgggtccggaaattctgcgggaaagggattttcagggagatttggaaaaaccgctatgtggtgctgaaaggggaccagctctacatctctgagaaggaggcacccaacctgatcttcctggcagtgagtccagaagagaaggaatcgtggatcaatgccctcaactctgccatcacccgagccaagaaccgtatcttggatgaggtcaccgttgaggaggacagctatcttgcccatcccactcgagacagggcaaaaatccagcactcccgccgccccccaacaaggggacacctaatggctgtggcttccacctctacctcggatgggatgctgaccttggacttgatccaagaggaagacccttcccctgaggaaccaacctcttgtgctgagagctttcgggttgacctggacaagtctgtggcccagctggcagggagccggcggagagcggactcagaccgcatccagccctccgcagaccgggcaagcagtctctcccgaccttgggaaaaaacagacaaaggggccacctacaccccccaggcacccaagaagttgacgcccacagagaaaggccgctgcgcctccctggaggagatcctatctcagcgggatgctgcctctgcccgcaccctccagctgcgggctgaggaacccccaacccctgccctccccaacccggggcagctgtcccggatccaggacctggtagcaaggaaactggaggagactcaggagcttctggcagaggttcagggactgggagatgggaagcgaaaggccaaggacccccctcggtctccgccggattctgagtcagagcagctgctgctggagacggaacggctgctgggagaggcatcatcgaattggagccaggcaaagagggtgctgcaggaggtcagggagctgagagacctgtacagacagatggacctgcagaccccggactcccacctcagacagaccaccccgcacagtcagtaccggaagagcctgatgtgagggcagggtggggtctggaacttgtcgggttggacagactcttatctccgtgttgctggataaagcttttttatttacctcaatcaaaaaaagaaaacaaaaatgaactcattgctcttgctgatgcctgaccccactacaacccttattgccccacctactttccatatgcccctcgtatgcccctcaggtttgaggaagtgaccccgcagcagtagcaggaagtttttacccagccagagagagagaaggcacggtaaagacacagtctgaccactccacacaccgcccgcccccaagacggcacagggagtccactgctgctcccaaggatacagtgggcttctaagcttagagcgggagggggatgaggatgttttctgttatgtcccaccccaggccttcagtttgagggtgaagtttcagctgcccaactctagttgtagggatgtggaggccagtgtcacctgtccgtgcacatggaagtgaaatttatcccagccctgaggaggatttgtggaattaaaatctccccagccagacactggcttct

SEQ ID NO: 25726 - DNA, 1926 bp, Homo sapiens
cgggggagcggccgcgctgggccgggcgggcgggtggcgggggtgcgctcggggacccgggccgcgtgggcgccgggatggagggcgccaaggggcggggagcgggcgtgcgtgtgtgtgcgagtgcgaatgcgagggaggccggccttgagtgaaaccggagctacaaagaaggggagagtccgggagcgggagggcgcgagggaggagcggcggcgccggggcagctccgacgccctcccgcggggaaggagcccccgcggtgccgccgaggccccgacgcggggccgcccctcggctcgccgccccgcgcccgcgcccgctgggaatgatgaagaagaacaattccgccaagcggggacctcaggatggaaaccagcagcctgcaccgcccgagaaggtcggctgggtccggaaattctgcgggaaagggattttcagggagatttggaaaaaccgctatgtggtgctgaaaggggaccagctctacatctctgagaaggaggtaaaagatgagaaaaatattcaagaggtatttgacctgagtgactatgagaagtgtgaagagctccggaagtccaagagcaggagcaagaaaaatcatagcaagtttactcttgcccactccaaacagcccggtaacacggcacccaacctgatcttcctggcagtgagtccagaagagaaggaatcgtggatcaatgccctcaactctgccatcacccgagccaagaaccgtatcttggatgaggtcaccgttgaggaggacagctatcttgcccatcccactcgagacagggcaaaaatccagcactcccgccgccccccaacaaggggacacctaatggctgtggcttccacctctacctcggatgggatgctgaccttggacttgatccaagaggaagacccttcccctgaggaaccaacctcttgtgctgagagctttcgggttgacctggacaagtctgtggcccagctggcagggagccggcggagagcggactcagaccgcatccagccctccgcagaccgggcaagcagtctctcccgaccttgggaaaaaacagacaaaggggccacctacaccccccaggcacccaagaagttgacgcccacagagaaaggccgctgcgcctccctggaggagatcctatctcagcgggatgctgcctctgcccgcaccctccagctgcgggctgaggaacccccaacccctgccctccccaacccggggcagctgtcccggatccaggacctggtagcaaggaaactggaggagactcaggagcttctggcagaggttcagggactgggagatgggaagcgaaaggccaaggacccccctcggtctccgccggattctgagtcagagcagctgctgctggagacggaacggctgctgggagaggcatcatcgaattggagccaggcaaagagggtgctgcaggaggtcagggagctgagagacctgtacagacagatggacctgcagaccccggactcccacctcagacagaccaccccgcacaatattaaagccatgacagcaaacagcccctttctcctaaggttcctgatttgaagtggcaaaacaaggcagtggcatagtctcctgtcctatgtccttggcatgcagcctccacccagctctggctgcagagggccgcactccgcttgtaccgcaattcatgcacagtccagacttatacagcagccggcaaccctaagggcaggatgattccgagacacaccaaatctgtatgttgatgtgttgtcccaaatttatttctccagcctaaatttccctctctggcacttagagctaagtgtcaacttgacatctttacctgggtatctaacatgcatcttaaatgtactataaatgtaataaatgactaaataatgatcctcagtgaaccagcc

SEQ ID NO: 25727 - DNA, 2072 bp, Homo sapiens
caggcttcctctgtttcccaagatgatctaaactaacagtctgggtggaggggctaaataattttatcctcctcacctcaccccaaccctcccctaggtaaaagatgagaaaaatattcaagaggtatttgacctgagtgactatgagaagtgtgaagagctccggaagtccaagagcaggagcaagaaaaatcatagcaagtttactcttgcccactccaaacagcccggtaacacggcacccaacctgatcttcctggcagtgagtccagaagagaaggaatcgtggatcaatgccctcaactctgccatcacccgagccaagaaccgtatcttggatgaggtcagggggctcactgtggggagagggaggaacgctggggcagagggaacagctgtgacccactgaagggggaggattgtgcaggccccgtttactcgctcctccaccagctctacttctttaccgcccttttaaaagccctgatctctttctaccttctctccaagtctcatctgacacctcctcttccccgcttcatgatgggggagccagccttgggtcagcttaaagagcccccttcgtgtccagtaaatccccttgcccattcagaagcagtgaatggagtgggcacatgttcaggcctcgggatgctgggttgggacagcgagtcgtgaaagagcactcatgattcacagtacatctcttcaggtcaccgttgaggaggacagctatcttgcccatcccactcgagacagggcaaaaatccagcactcccgccgccccccaacaaggggacacctaatggctgtggcttccacctctacctcggatgggatgctgaccttggacttgatccaagaggaagacccttcccctgaggaaccaacctcttgtgctgagagctttcgggttgacctggacaagtctgtggcccagctggcagggagccggcggagagcggactcagaccgcatccagccctccgcagaccgggcaagcagtctctcccgaccttgggaaaaaacagacaaaggggccacctacaccccccaggcacccaagaagttgacgcccacagagaaaggccgctgcgcctccctggaggagatcctatctcagcgggatgctgcctctgcccgcaccctccagctgcgggctgaggaacccccaacccctgccctccccaacccggggcagctgtcccggatccaggacctggtagcaaggaaactggaggagactcaggagcttctggcagaggttcagggactgggagatgggaagcgaaaggccaaggacccccctcggtctccgccggattctgagtcagagcagctgctgctggagacggaacggctgctgggagaggcatcatcgaattggagccaggcaaagagggtgctgcaggaggtcagggagctgagagacctgtacagacagatggacctgcagaccccggactcccacctcagacagaccaccccgcacagtcagtaccggaagagcctgatgtgagggcagggtggggtctggaacttgtcgggttggacagactcttatctccgtgttgctggataaagcttttttatttacctcaatcaaaaaaagaaaacaaaaatgaactcattgctcttgctgatgcctgaccccactacaacccttattgccccacctactttccatatgcccctcgtatgcccctcaggtttgaggaagtgaccccgcagcagtagcaggaagtttttacccagccagagagagagaaggcacggtaaagacacagtctgaccactccacacaccgcccgcccccaagacggcacagggagtccactgctgctcccaaggatacagtgggcttctaagcttagagcgggagggggatgaggatgttttctgttatgtcccaccccaggccttcagtttgagggtgaagtttcagctgcccaactctagttgtagggatgtggaggccagtgtcacctgtccgtgcacatggaagtgaaatttatcccagccctgaggaggatttgtggaattaaaatctccccagccagacactggcttct

SEQ ID NO: 25728 - DNA, 1899 bp, Homo sapiens
ccctcccggttcccgctctcgtttttgtttttggtcgggtaaggcgatgctgtagaggctggcgatctccagtcttcacgaatccgcacgtctctccattatccaccgcgcccgcccactgggccccggggcggccggcggccgggtctctcgggctccgcgtgtcgcccgagccgccgccggagcgagggtccctgccccctggggagcggtctccagccgcttcgaagccgccttcttccccctccggacctcaggatggaaaccagcagcctgcaccgcccgagaaggtcggctgggtccggaaattctgcgggaaagggattttcagggagatttggaaaaaccgctatgtggtgctgaaaggggaccagctctacatctctgagaaggaggtaaaagatgagaaaaatattcaagaggtatttgacctgagtgactatgagaagtgtgaagagctccggaagtccaagagcaggagcaagaaaaatcatagcaagtttactcttgcccactccaaacagcccggtaacacggcacccaacctgatcttcctggcagtgagtccagaagagaaggaatcgtggatcaatgccctcaactctgccatcacccgagccaagaaccgtatcttggatgaggcttccacctctacctcggatgggatgctgaccttggacttgatccaagaggaagacccttcccctgaggaaccaacctcttgtgctgagagctttcgggttgacctggacaagtctgtggcccagctggcagggagccggcggagagcggactcagaccgcatccagccctccgcagaccgggcaagcagtctctcccgaccttgggaaaaaacagacaaaggggccacctacaccccccaggcacccaagaagttgacgcccacagagaaaggccgctgcgcctccctggaggagatcctatctcagcgggatgctgcctctgcccgcaccctccagctgcgggctgaggaacccccaacccctgccctccccaacccggggcagctgtcccggatccaggacctggtagcaaggaaactggaggagactcaggagcttctggcagaggttcagggactgggagatgggaagcgaaaggccaaggacccccctcggtctccgccggattctgagtcagagcagctgctgctggagacggaacggctgctgggagaggcatcatcgaattggagccaggcaaagagggtgctgcaggaggtcagggagctgagagacctgtacagacagatggacctgcagaccccggactcccacctcagacagaccaccccgcacagtcagtaccggaagagcctgatgtgagggcagggtggggtctggaacttgtcgggttggacagactcttatctccgtgttgctggataaagcttttttatttacctcaatcaaaaaaagaaaacaaaaatgaactcattgctcttgctgatgcctgaccccactacaacccttattgccccacctactttccatatgcccctcgtatgcccctcaggtttgaggaagtgaccccgcagcagtagcaggaagtttttacccagccagagagagagaaggcacggtaaagacacagtctgaccactccacacaccgcccgcccccaagacggcacagggagtccactgctgctcccaaggatacagtgggcttctaagcttagagcgggagggggatgaggatgttttctgttatgtcccaccccaggccttcagtttgagggtgaagtttcagctgcccaactctagttgtagggatgtggaggccagtgtcacctgtccgtgcacatggaagtgaaatttatcccagccctgaggaggatttgtggaattaaaatctccccagccagacactggcttct

SEQ ID NO: 25729 - DNA, 257 bp, Homo sapiens
ggacctcaggatggaaaccagcagcctgcaccgcccgagaaggtcggctgggtccggaaattctgcgggaaagggattttcagggagatttggaaaaaccgctatgtggtgctgaaaggggaccagctctacatctctgagaaggaggtgggtgcctcttgcctctaactctccgttttctcatagcccccactttgtcactccccaagggctcgcctagcttactccacccccgttttgttccaaaggcaagttca

SEQ ID NO: 25730 - DNA, 1656 bp, Homo sapiens
cgggggagcggccgcgctgggccgggcgggcgggtggcgggggtgcgctcggggacccgggccgcgtgggcgccgggatggagggcgccaaggggcggggagcgggcgtgcgtgtgtgtgcgagtgcgaatgcgagggaggccggccttgagtgaaaccggagctacaaagaaggggagagtccgggagcgggagggcgcgagggaggagcggcggcgccggggcagctccgacgccctcccgcggggaaggagcccccgcggtgccgccgaggccccgacgcggggccgcccctcggctcgccgccccgcgcccgcgcccgctgggaatgatgaagaagaacaattccgccaagcggggacctcaggatggaaaccagcagcctgcaccgcccgagaaggtcggctgggtccggaaattctgcgggaaagggattttcagggagatttggaaaaaccgctatgtggtgctgaaaggggaccagctctacatctctgagaaggaggtaaaagatgagaaaaatattcaagaggtatttgacctgagtgactatgagaagtgtgaagagctccggaagtccaagagcaggagcaagaaaaatcatagcaagtttactcttgcccactccaaacagcccggtaacacggcacccaacctgatcttcctggcagtgagtccagaagagaaggaatcgtggatcaatgccctcaactctgccatcacccgagccaagaaccgtatcttggatgaggtcaccgttgaggaggacagctatcttgcccatcccactcgagacagggcaaaaatccagcactcccgccgccccccaacaaggggacacctaatggctgtggcttccacctctacctcggatgggatgctgaccttggacttgatccaagaggaagacccttcccctgaggaaccaacctcttgtgctgagagctttcgggttgacctggacaagtctgtggcccagctggcagggagccggcggagagcggactcagaccgcatccagccctccgcagaccgggcaagcagtctctcccgaccttgggaaaaaacagacaaaggggccacctacaccccccaggcacccaagaagttgacgcccacagagaaaggccgctgcgcctccctggaggagatcctatctcagcgggatgctgcctctgcccgcaccctccagctgcgggctgaggaacccccaacccctgccctccccaacccggggcagctgtcccggatccaggacctggtagcaaggaaactggaggagactcaggagcttctggcagaggttcagggactgggagatgggaagcgaaaggccaaggacccccctcggtctccgccggattctgagtcagagcagctgctgctggagacggaacggctgctgggagaggcatcatcgaattggagccaggcaaagagggtgctgcaggaggtcagggagctgagagacctgtacagacagatggacctgcagaccccggactcccacctcagacagaccaccccgcacagtcagtaccggaagagcctgatgtgagggcagggtggggtctggaacttgtcgggttggacagactcttatctccgtgttgctggataaagcttttttatttacctcaatcaaaaaaagaaaac

SEQ ID NO: 25731 - DNA, 722 bp, Homo sapiens
agtccccgcgcggcgaggacggggcggcgggggcgcagggcctggagggaacctgggagcctctccgcgcccggccggcgcccctgccacttgcagccccggttgtttattcgggagcgggggaggggagcggggggagttcctcggagtgaaaacctttccgaagtgggagcgaacctggggcggccccccgccccccggccgcagccttcggaggagactgggccgccgaggcggtcgtgagagacggacggagaggaagcgccggctggaatctcctaaccgcccgcttctcatcttgtcctggggcagggacctcaggatggaaaccagcagcctgcaccgcccgagaaggtcggctgggtccggaaattctgcgggaaagggattttcagggagatttggaaaaaccgctatgtggtgctgaaaggggaccagctctacatctctgagaaggaggaaactctagttacgaatcagggagaacttcctacacatcaaagagaaaaacataatagtgaaagggtaagaggaataagacatccattgcttgtttgtatttgcccaaagagcagagtctgggggcaaaagcgtagttgatccttgcttttaggtacagagacagaggaaaggatggaatgacctcagcctaggatatctggtgtcctatgagtcaggaccatctgactggtcatggagccagctgtctcctgctgggaagg

SEQ ID NO: 25732 - DNA, 1758 bp, Homo sapiens
cgggggagcggccgcgctgggccgggcgggcgggtggcgggggtgcgctcggggacccgggccgcgtgggcgccgggatggagggcgccaaggggcggggagcgggcgtgcgtgtgtgtgcgagtgcgaatgcgagggaggccggccttgagtgaaaccggagctacaaagaaggggagagtccgggagcgggagggcgcgagggaggagcggcggcgccggggcagctccgacgccctcccgcggggaaggagcccccgcggtgccgccgaggccccgacgcggggccgcccctcggctcgccgccccgcgcccgcgcccgctgggaatgatgaagaagaacaattccgccaagcggggacctcaggatggaaaccagcagcctgcaccgcccgagaaggtcggctgggtccggaaattctgcgggaaagggattttcagggagatttggaaaaaccgctatgtggtgctgaaaggggaccagctctacatctctgagaaggaggtaaaagatgagaaaaatattcaagaggtatttgacctgagtgactatgagaagtgtgaagagctccggaagtccaagagcaggagcaagaaaaatcatagcaagtttactcttgcccactccaaacagcccggtaacacggcacccaacctgatcttcctggcagtgagtccagaagagaaggaatcgtggatcaatgccctcaactctgccatcacccgagccaagaaccgtatcttggatgaggtcaccgttgaggaggacagctatcttgcccatcccactcgagacagggcaaaaatccagcactcccgccgccccccaacaaggggacacctaatggctgtggcttccacctctacctcggatgggatgctgaccttggacttgatccaagaggaagacccttcccctgaggaaccaacctcttgtgctgagagctttcgggttgacctggacaagtctgtggcccagctggcagggagccggcggagagcggactcagaccgcatccagccctccgcagaccgggcaagcagtctctcccgaccttgggaaaaaacagacaaaggggccacctacaccccccaggcacccaagaagttgacgcccacagagaaaggccgctgcgcctccctggaggagatcctatctcagcgggatgctgcctctgcccgcaccctccagctgcgggctgaggaacccccaacccctgccctccccaacccggggcagctgtcccggatccaggacctggtagcaaggaaactggaggagactcaggagcttctggcagaggttcagggactgggagatgggaagcgaaaggccaaggacccccctcggtctccgccggattctgagtcagagcagctgctgctggagacggaacggctgctgggagaggcatcatcgaattggagccaggcaaagagggtgctgcaggaggtcagggagctgagagacctgtacagacagatggacctgcagaccccggactcccacctcagacagaccaccccgcacagtcagtaccggaagagcctgatgtgagggcagggtggggtctggaacttgtcgggttggacagactcttatctccgtgttgctggataaagcttttttatttacctcaatcaaaaaaagaaaaccgtaatgaccatccctgtactctgtaatatctagaataaaaaaatttaaggggggtcccggaccccatttcgccccttagcgagtccgtttacaatttactg

SEQ ID NO: 25733 - DNA, 2065 bp, Homo sapiens
agtccccgcgcggcgaggacggggcggcgggggcgcagggcctggagggaacctgggagcctctccgcgcccggccggcgcccctgccacttgcagccccggttgtttattcgggagcgggggaggggagcggggggagttcctcggagtgaaaacctttccgaagtgggagcgaacctggggcggccccccgccccccggccgcagccttcggaggagactgggccgccgaggcggtcgtgagagacggacggagaggaagcgccggctggaatctcctaaccgcccgcttctcatcttgtcctggggcagggacctcaggatggaaaccagcagcctgcaccgcccgagaaggtcggctgggtccggaaattctgcgggaaagggattttcagggagatttggaaaaaccgctatgtggtgctgaaaggggaccagctctacatctctgagaaggaggtaaaagatgagaaaaatattcaagaggtatttgacctgagtgactatgagaagtgtgaagagctccggaagtccaagagcaggagcaagaaaaatcatagcaagtttactcttgcccactccaaacagcccggtaacacggcacccaacctgatcttcctggcagtgagtccagaagagaaggaatcgtggatcaatgccctcaactctgccatcacccgagccaagaaccgtatcttggatgaggtcaccgttgaggaggacagctatcttgcccatcccactcgagacagggcaaaaatccagcactcccgccgccccccaacaaggggacacctaatggctgtggcttccacctctacctcggatgggatgctgaccttggacttgatccaagaggaagacccttcccctgaggaaccaacctcttgtgctgagagctttcgggttgacctggacaagtctgtggcccagctggcagggagccggcggagagcggactcagaccgcatccagccctccgcagaccgggcaagcagtctctcccgaccttgggaaaaaacagacaaaggggccacctacaccccccaggcacccaagaagttgacgcccacagagaaaggccgctgcgcctccctggaggagatcctatctcagcgggatgctgcctctgcccgcaccctccagctgcgggctgaggaacccccaacccctgccctccccaacccggggcagctgtcccggatccaggacctggtagcaaggaaactggaggagactcaggagcttctggcagaggttcagggactgggagatgggaagcgaaaggccaaggacccccctcggtctccgccggattctgagtcagagcagctgctgctggagacggaacggctgctgggagaggcatcatcgaattggagccaggcaaagagggtgctgcaggaggtcagggagctgagagacctgtacagacagatggacctgcagaccccggactcccacctcagacagaccaccccgcacagtcagtaccggaagagcctgatgtgagggcagggtggggtctggaacttgtcgggttggacagactcttatctccgtgttgctggataaagcttttttatttacctcaatcaaaaaaagaaaacaaaaatgaactcattgctcttgctgatgcctgaccccactacaacccttattgccccacctactttccatatgcccctcgtatgcccctcaggtttgaggaagtgaccccgcagcagtagcaggaagtttttacccagccagagagagagaaggcacggtaaagacacagtctgaccactccacacaccgcccgcccccaagacggcacagggagtccactgctgctcccaaggatacagtgggcttctaagcttagagcgggagggggatgaggatgttttctgttatgtcccaccccaggccttcagtttgagggtgaagtttcagctgcccaactctagttgtagggatgtggaggccagtgtcacctgtccgtgcacatggaagtgaaatttatcccagccctgaggaggatttgtggaattaaaatctccccagccagacactggcttct

SEQ ID NO: 25734 - DNA, 2132 bp, Homo sapiens
tttggaggagaaaggatcacaatgaactcctgaaacatacaacgtgctagtttctttcatgcctctgagctcttaagtcttcagagagagaggcaggcaggtataatgcagagaacacaggctttggagttagaacctgagttggaacctcactgtaatcagctacctgtgtggttccctgaagttgcatgtctccaactgtaaaatgaggcagaatcatgcctgccttgaagggctgctgtgaggaatgactaaaacaacatatttggtattgaatactcatcatttttagtattctggaaataagagaacaaattttattataaggcaagggggctgaagtgtgggactcagaggatgcagatggaggaggacagtcgtgccatggggagcatcctgtgtgcatcagatgcagtttaattgctgagagtccacaataccaaggaagagggcgcccctcaggaagcttatggtagagtggagaatacaggaaacaagtaacaaactaaatcacagaagaagaaacattcaagtcactatcaaaggaataagaaacagcacattcagtaggagggttcagtcaagagcagagggctttgccaggcgtggtggtgcacgcatgtaatcccagctactcgggaggctgaggcaggagaatggcgtgaacccgggaggcggagcttgcagtgagctcaaatcgtgccactgcactccagcctgggtgacagagcaagactctgtctctaaaaaaaagtacttctcattcaaggaaggcttgtagaggaaaatgaccacagcttgcatcttttaggcagtcattccgaaaatccctcctgatgacaggttccccactcattccccccttcctccacaggcttccacctctacctcggatgggatgctgaccttggacttgatccaagaggaagacccttcccctgaggaaccaacctcttgtgctgagagctttcgggttgacctggacaagtctgtggcccagctggcagggagccggcggagagcggactcagaccgcatccagccctccgcagaccgggcaagcagtctctcccgaccttgggaaaaaacagacaaaggggccacctacaccccccaggcacccaagaagttgacgcccacagagaaaggccgctgcgcctccctggaggagatcctatctcagcgggatgctgcctctgcccgcaccctccagctgcgggctgaggaacccccaacccctgccctccccaacccggggcagctgtcccggatccaggacctggtagcaaggaaactggaggagactcaggagcttctggcagaggttcagggactgggagatgggaagcgaaaggccaaggacccccctcggtctccgccggattctgagtcagagcagctgctgctggagacggaacggctgctgggagaggcatcatcgaattggagccaggcaaagagggtgctgcaggaggtcagggagctgagagacctgtacagacagatggacctgcagaccccggactcccacctcagacagaccaccccgcacagtcagtaccggaagagcctgatgtgagggcagggtggggtctggaacttgtcgggttggacagactcttatctccgtgttgctggataaagcttttttatttacctcaatcaaaaaaagaaaacaaaaatgaactcattgctcttgctgatgcctgaccccactacaacccttattgccccacctactttccatatgcccctcgtatgcccctcaggtttgaggaagtgaccccgcagcagtagcaggaagtttttacccagccagagagagagaaggcacggtaaagacacagtctgaccactccacacaccgcccgcccccaagacggcacagggagtccactgctgctcccaaggatacagtgggcttctaagcttagagcgggagggggatgaggatgttttctgttatgtcccaccccaggccttcagtttgagggtgaagtttcagctgcccaactctagttgtagggatgtggaggccagtgtcacctgtccgtgcacatggaagtgaaatttatcccagccctgaggaggatttgtggaattaaaatctccccagccagacactggcttct

SEQ ID NO: 25735 - DNA, 995 bp, Homo sapiens
tccctgctgctcttgcagcaggtactctcccagggtagggggacctgggaatgcctcagccacaggccacaggtcttatttcctgcctctccccagatcactgcctctcccagcagcagcagcagcgggagcagcagggaaagacatgtctttccctgctgctctgactcaggagcttctggcagaggttcagggactgggagatgggaagcgaaaggccaaggacccccctcggtctccgccggattctgagtcagagcagctgctgctggagacggaacggctgctgggagaggcatcatcgaattggagccaggcaaagagggtgctgcaggaggtcagggagctgagagacctgtacagacagatggacctgcagaccccggactcccacctcagacagaccaccccgcacagtcagtaccggaagagcctgatgtgagggcagggtggggtctggaacttgtcgggttggacagactcttatctccgtgttgctggataaagcttttttatttacctcaatcaaaaaaagaaaacaaaaatgaactcattgctcttgctgatgcctgaccccactacaacccttattgccccacctactttccatatgcccctcgtatgcccctcaggtttgaggaagtgaccccgcagcagtagcaggaagtttttacccagccagagagagagaaggcacggtaaagacacagtctgaccactccacacaccgcccgcccccaagacggcacagggagtccactgctgctcccaaggatacagtgggcttctaagcttagagcgggagggggatgaggatgttttctgttatgtcccaccccaggccttcagtttgagggtgaagtttcagctgcccaactctagttgtagggatgtggaggccagtgtcacctgtccgtgcacatggaagtgaaatttatcccagccctgaggaggatttgtggaattaaaatctccccagccagacactggcttct

SEQ ID NO: 25736 - DNA, 897 bp, Homo sapiens
  misc_feature (44)..(44): n is a, c, g, or t
gtgtaaattttctaatgtgatgtaaaataaagagagaaagaagnaaaaaggttaggcaacagcatgactttctgcaaaggcactgataatagctatgaggaataaatattgcagatggattaaatcaaagaatcgaatttcaaagccaaattagtcgtgaaaaggagggagaagcagaaatgaagaaaaaagaaccacagaagtaaaatcagcagcattgaaaagaaaatcatctgctgtttgaataaagacccaagatctttcattgttggatccccaaagccagtgcctggggtgagcagcaagtcccaagatcaagaaatcagaaggaactaatactttaactaattagtagtaatgaaaatttactagacatcaatgacaaatttacaaggcaaatttatttccaaagtacattcatatatatcacaggtaaaatgaggttttcacaaacaccattttaaacatagggtttatttgcaggagctatttttgtggcttagggaacaaatggttcattgaaacagaactttgctggtctggtttcaaagaattctattatataaaagattctgtagaacagatgggatcaaaagtccctgaacacagaacaggaatatcaggtaatgaaaatgttcttttggtataggattatggtttatgctttgaaagtattagtatgcaaggaactcaggcaagagcataaaagaggaagtaggaataatactttatgtttgaataggctttagactttccaaatacttacatcctactgaagcttggtagcaagtattatccttggtttattgatgaaaacatgcttccaagaaagatgctttacaagcgacaaaaactcaaaggggattacacagtaaaaggtatctgtctctctgtctg

SEQ ID NO: 25737 - DNA, 892 bp, Homo sapiens
  misc_feature (36)..(36): n is a, c, g, or t
gcggtacggtccttgcagatctcgaagagaaaggancctcgggcgaccttgcaacagcatgactttctgcaaaggcactgataatagctatgaggaataaatattgcagatggattaaatcaaagaatcgaatttcaaagccaaattagtcgtgaaaaggagggagaagcagaaatgaagaaaaaagaaccacagaagtaaaatcagcagcattgaaaagaaaatcatctgctgtttgaataaagacccaagatctttcattgttggatccccaaagccagtgcctggggtgagcagcaagtcccaagatcaagaaatcagaaggaactaatactttaactaattagtagtaatgaaaatttactagacatcaatgacaaatttacaaggcaaatttatttccaaagtacattcatatatatcacaggtaaaatgaggttttcacaaacaccattttaaacatagggtttatttgcaggagctatttttgtggcttagggaacaaatggttcattgaaacagaactttgctggtctggtttcaaagaattctattatataaaagattctgtagaacagatgggatcaaaagtccctgaacacagaacaggaatatcaggtaatgaaaatgttcttttggtataggattatggtttatgctttgaaagtattagtatgcaaggaactcaggcaagagcataaaagaggaagtaggaataatactttatgtttgaataggctttagactttccaaatacttacatcctactgaagcttggtagcaagtattatccttggtttattgatgaaaacatgcttccaagaaagatgctttacaagcgacaaaaactcaaaggggattacacagtaaaaggtatctgtctctctgtctg

SEQ ID NO: 25738 - DNA, 277 bp, Homo sapiens
gttgtattatttttttttctttgtgatgaatgtgaaaaggagacttcagcacacgcaacagcatgactttctgcaaaggcactgataatagctatgaggaataaatattgcagatggattaaatcaaagaatcgaatttcaaagccaaattagtcgtgaaaaggagggagaagcagaaatgaagaaaaaagaaccacagaagtaaaatcagcagcattgaaaagaaaatcatctgctgtttgaataaagacccaagatctttcattgttggatcccc

SEQ ID NO: 25739 - DNA, 864 bp, Homo sapiens
  misc_feature (44)..(44): n is a, c, g, or t
gtgtaaattttctaatgtgatgtaaaataaagagagaaagaagnaaaaaggttaggcaacagcatgactttctgcaaaggcactgataatagctatgaggaataaatattgcagatggattaaatcaaagaatcgaatttcaaagccaaattagtcgtgaaaaggagggagaagcagaaatgaagaaaaaagaaccacagaagtaaaatcagcagcattgaaaagaaaatcatctgctgtttgaataaagacccaagatctttcattgttggatccccaaagccagtgcctggggtgagcagcaagtcccaagatcaagaaatcagaaggaactaatactttaactaattagtagtaatgaaaatttactagacatcaatgacaaatttacaaggcaaatttatttccaaagtacattcatatatatcacaggatcacttcaccgaggaactgaacacgagcatttaacttgtgtgactagttatggcctggtctggatttccttctggttctcaagatgtcttacatgaaaaaagctctgtggcacattacatttgggagctgctgattaaagacatataagctcttttgctgaccatttttccagaaccttgactggaatgttaatatccattgtaaatctctaagtgggtaccagtgttctgcaaagcactctgggaaatgtttccctttcctttatcttttttagccagtcccaatgtattataacttgagtgaaacagagctgtcctatacgccactctcagcatactgagacatccaaaggaaatccaagtctggctgaaaaaatcacccaccttgaaaaacaacgtatgttgatcaagacagatgcctcttggagag

SEQ ID NO: 25740 - DNA, 788 bp, Homo sapiens
aaaaaaaaacacacacatacaagtgagacacgataactgaagaaaaatgaaacaaaacagaggcaaaaggaaaattaaatcgaaattatgcaaagtctaattacgctgtttaacctccaaggcattttcccatggaaataaccgcgtgattccaggcaagtgacttaccctgtctatgcctcagtttccctatctgtaaaatgaggctaatagggagtacccaccctttagggctgttgtgatcattaaaatgcatgaatatatggaaagtacttggaatagtacctggcacacaataggcattactgaatgtttattgacttttaatttgacaaaaaaatagtgtcacgttaccctcgattttctttggtttattcctaatggtacgtcatccatgtcagtagacacagacctacatcatcgctgttaccgacggcagttactgattccattgtgtaggatgtgccattgttttagacaatcccctatcatgggcacttaggtgatttccagtttttcacactcataaatcatgctgggatgaacattgttgcacacatacctgctcatattatctttattctcctagaggtggagaggtatgaatcactttctttcaacaaatagtgattgcatgcatgcttaccagaggccacatgttgtgcagggcagagacgtaacggggtcaggaacaggtagaatcaggtcatgggtatatggttcactgtaaaattcttccaatatgtccatacatttgaaattttttataataaaatactggggaaaaa

SEQ ID NO: 25741 - DNA, 777 bp, Homo sapiens
aaacagccacaggcagtatttgcagctcctcagagcgatgccctatcgatttttaagtgtcactgttaataacaacaacaactggcagtgatacaacatttttcttccaaaacaatcagagcattttatagagacaatttcatctatctctccatggctccagcaggagcaggagaatattccccacttcaagtaaagggcaggagaggccaaggggtttggccaaggtcactgtacaagtcagtgggatgccggtgctcctggtctctgcggccctctgcatccctggatggcatctccctaggacagaacttccctagcatagttcttttcagatgtttagcaaagttaaccttttaacaaaacacccatgggtggagggtggcatcaagcactattccaaaaagcatcctcttggcgggaagcccttagacatgaccactccttggcttagtcttcctcttcctgtgtgccatcaagaatcacacctaccagttgggcgtggtggctcatgcctgtaatcccagcactttgggaggctgaggcaggcagatcacctaaggttaggagttcgaggccagcctgggcaacatggtgaaacaccatctctgctaaaaatacaaaaattagccaggcatggcggcttgcacctattagtcccagcaactcaggggggctgaggcacgagaatcacttgaacccagaaggcagagggtgcagtgagccaagatcatgccactgcactccattctgggtgacagagtgagacactgtctc

SEQ ID NO: 25742 - DNA, 621 bp, Homo sapiens
cagcctcccaaagtgttgggattacaggcatgagccactgcacccagcctttcctcttttcttttccagtccatcaggcctcctgtggcctcaaagagccatgcctcccatgcccaccccacaccctgcaagacgcctttccagaatgcccactccttgcttgtgccttgtcctttaagatccttcccacgccttctagaagtcctctgccaactgcctcccaccttacggggcccttatgctttggcagaacacccagaggccagcacagccctgtgggttctgcttcttgggttggacccccacattccacatacccgggctcagccacacgtgtgggtgcccccatgaatggaacgccaagctgggtcccaggaggcgcccctgtggctgggaggcttgaggtacaaatgtggagtgaggccgccatgtccccacccacaggctgaccttggccttctctctctgcccagatggacttgcccaagccatgcaccatcccagctctgtaccctggtggtgtctgggaggggactttacacagaagcacagccctcctgagcctattgtggctgttcaagggcctgtaattggtcccaaagtcattatattttcttaata

SEQ ID NO: 25743 - DNA, 671 bp, Homo sapiens
gcttgaaccagggaggtggaggttgtagtgagccgagatcacgccactgcactccagcctgggcaaccgaacaagaactctgtctccaaaaaaacaaataaataaataaaattaaataaaaatttaaaaaggatgaattgtcccaaatttctgtctttcgaaagctaataatctattgggaaagataaataaaaggacacttatgcatactaatgtaagatgttaatgacgggaaactaggtataggttatgtgagaactccctgtactatcttcacaatttttctttttctttcttttttttttttttaattaatttattttgtaggtcagggatctctctgtgttgcccacactggtctcgaactcctgggctcaagcaatcctcctgcctcggactcccaaagtgctgggattacagatatgagccaccacacctagcccacaatttttctataaatctaataatattctaaaacaaaaagtttattttttgctgggcacggtggcacatgcatatattcccagttattcaggaggcaggtgcaggtaaggcaagaggatcatgcaaacccaggagtttgaggctgtagtgcactatgatcatgcctatgaatagccactgcaccccagcctgggcagcctagtgagaccccgtctctaaaaaaaaaa

SEQ ID NO: 25744 - DNA, 574 bp, Homo sapiens
ctggtctcgaactcctgacctcaggtgatccaccctcctcagcctcccacagtgcagggattacaggcgtgagccactgcgcctggccataatttttaaatggtgaaatagcatagcttttccaggaaacacttacaatttatgtgtatcattatcttctgaagagtaatacgttagcaggtttcttgaaatataaacttgtatattgataattgctctgtttgaagacacacaggacattttaaacattcactatttgtagttagctttcaaaataactagttctgatttgttatttataaactcctggaatgattaacttccagaagagtggctttgcaggaaagctgttagggaaatacatggcttgcattcttttgaattttttatataacacagcatttaaagcagttacctgctatgttattgcatttgccactgagtgtcatgatgcagtcagtgttccagctttgaaattagtgactttcagtgtaatgtaatgaagagagtagtaagaggaagggtttaactgagagagtaaaagacattagagaaccttccattttagtttctt

SEQ ID NO: 25745 - DNA, 342 bp, Homo sapiens
ggaaacattttgcagcatatctacttgctctgaactgaatggaagggccccagagctgcagcagtaaggttaatttattcacggattattaattattaattattatatgtgactctgtagtaacccaccatttataaaaaattgctttctgtttaaatttaggttagatacattgataaataacaattagagaacatattttacacatccaaccttaagggttcttattgttctttaaaactgattattataagatgtttggagcaagatttggcctaaaggccaattaatttgaaatacctcactaaaccaaagaagagttgatttagaaatggccaattt

SEQ ID NO: 25746 - DNA, 379 bp, Homo sapiens
cagggaggggcagtggaccaggaggaggggctgacggaacagcagaggcttctggggcttctatcctgccctaccctcccggttctgggagagtggtctggaccagaaagaataaaacagagaaaaattcttaatataatgaccttcaagaagagcaactacattttaccttgaaaactgcagaactgaaagcacagtctgtatagacaatgcaaatgatatgcaaacacgaatgcaaatggaccaggggccctgccacctcggaagcattcttaggccccatgtgcctccagtgggaggcagaggaaaacagacagagggcaattaggaaggtctccaggaactgcaggaggcttttttgcggggaggaggacaccat

SEQ ID NO: 25747 - DNA, 1010 bp, Homo sapiens
gaattttgagttgtgattagaacgtactactgaaatgttggcaggcctttgaggtgtggcagtgataaatttaaatagtttgtagattttgttactaggaattatatccacaaatgctttgactgcagatgagtagttgtcagttcaggaatataaagaactgctagagcttgtatgttaagtttatgactatttgtcaatagaaaggaaattaacttacttgtgtcttagggctggagagaattttgaaataatagtgtaaagcacactatggaatacagttcaaaagtagaaaataatatttgcttggaacaggttgctgggaattctgccctctttcaacttcagctttaaacccaaacgttgccatgtttaaaccaaggacagctgcacatcttacagcactcccaagttctatagagatttctggttgaagagagctctgactgactaggtggggtagaaaggtatatagaacttaggagtagatagtgaaaacctctgtatacatcgaggggaatcctttgtacatctatggacctctcaagagctctctctttttctctctctcaatctgtatggttgccttccttctaatattgtaccttggcttccacaaacactgaactttgtttcctaaactcaaggtgaccagtatgctctgagttccccttccctacactgtggactggcaattctagacagcaaactggggtcatcacagggcctttccactttatttccatatgtactgcattcactgttttccaatttctgaataccactgtttcatgtatttttgtccagtatttaagtggtttaaagtagaaaagtaattctggtccctgatgctccatcatggatgaaagcagaaatccctgtacccacttatagtctaatggaatacatcttccaatcataaaaccacatttcaaaaggataaaatatagttgagattttgctcatggttctaaaggggaacagaggacagaattatattgtacaatatg

SEQ ID NO: 25748 - DNA, 417 bp, Homo sapiens
taataacagtaccaacaaacattagaactagtttttttatgtttagtaggtttatcagttacctaataaatacattaaaatagcatactatgtatcagttaggaattgtaataaaaatcaagacatgtactctccacaaatttatttaaatttaatgaattatgagtcggggggcaagataaaatagctgtgaaatgtaattagaagaatatacaaacaacaaacaataacgtttcaaacctagaacgatgcaaggaaacatgcactatttgatattatgaagtcctgtgaagtccaaagatgagttacagaaagtgacttcaggggcccatggcacatgctttctgtgtgtatgtgcctgtgtgttaagtggtttcttcattgcccatttttgtattttccaccgcaccgggaaag

SEQ ID NO: 25749 - DNA, 259 bp, Homo sapiens
ccaacatcgtgccatccagcctgggcgacaagagcaaaactccatctcaaaaaaaaaattcatcaactcaaataatactcgattagaccacgtgtgtttcttttcttcttcttcttcttcttttttttttttaagatggaggttcactatgtcacccaagctggagtggagtggctcgatctcagctcactgcaactcccaagtagctgggattacagtcatgcaccaccacacccaggtaatttttgtatttttagta

SEQ ID NO: 25750 - DNA, 268 bp, Homo sapiens
ataactaaagtaaaatgctgatggagatcatttaagactgtctctatgctgttgattgcatgcttgtggctcataatcagaatgatgcaaagtaattgttagactgacttgccaaggctacattttgtgtcgttgccactgtcagcactttggtcccgctgtgctgcctgaagaacgcttgcctggcacctgttgggcactaatacacaactttccactgaatgtcatgggtaacttttgttctcatatcctcgcttgctatcttcac

SEQ ID NO: 25751 - DNA, 203 bp, Homo sapiens
tctgggggccagaagtccaaaataggtctattaaggctaaagtcaaggtgtcagcaggactgcatcccttctggaggttctggagagaatgtgttcccttgcctttcccagttgctaaagccacccctattctttggctcatggcccctaactgcatcttcaaagccagaagcaaagcatattcgaatctccctctgtgacct

SEQ ID NO: 25752 - DNA, 803 bp, Homo sapiens
ttacaggtgcccaccaccacaactggctaattttttgtatttttaatggagatggggtttcactatgttggccaaggttaaactcctgaccttgtggtgatccgcccgccttggcctcccaaagtgctgagattacaggtgtgagccaccgcgcctggcccttacatgctatttaaaagatttctttacactttcaaggtcaaattttgatatacagaatgggggaggggagctgaaggggccgttgtgccagagttcctaaaactggctgtcagtcagaatttctggggagagttggggtacgggtgtttgcccaggatgtaatttccaaggcccaccccagatatactgaattagaatccacagaggtgaggtctcagcatctgcattttaattacattccctaggttagtctgatgtagcttgtcagagaaccagcatttgggagccattgactccagtggcttctcatcacaattagaataaaataaaaaactccttgcctgagcctacaggaccttgtgtaatcttgccctagctttatctctaatctcttttccttgtttgtgcttctcttccccttgcttactatgcttcagcatggtagtcttctttcttttcctaaaacaagccgagtgcattcccaccattgggcctttgcacttgctgtttcctctgcctggaataccctgtccctagatattcaaatagatgattcattctgctcttagatcaaatgtctctttctcagggatgcctcttgacactcccagtctgaagtcccttacaccccatcattgtct

SEQ ID NO: 25753 - DNA, 457 bp, Homo sapiens
gattttaccccctaggggatacctggcagtgcctggagacattgagtggggctggcctctacgggatggacagtgaggttgctgctagctgctagacatcttacaggatggctcccacaacagagatccagcccaaatgtctgtagtgcagaggtggagaagcaccgatgttacctggtgctctgggacattttgcagttctccattctttttttttttttttttttttaaagggagtctcactgtgccactcaggctggtgtgcagtggcacaatctctactcactacaaccttcgtcttccaattcaagtgatactcccacctcagctacttaggaagctgaggcaggagaatcgcttgaacctgggaggcggaggttgcggtgagccgagatagcaccatggcactccagcctgggcaacaagagcgaaactccctctcaaaaaaaaatttttg

SEQ ID NO: 25754 - DNA, 462 bp, Homo sapiens
tgtcctatcgtcttaggttaagttccttggaaacagattctgggacagttatttgtgaacagaaagtttactggaaggaagcaaaattaagcagaggaagaaactaaactgtgatatagtcacaactatggtctcggctatgaagctgtgattgcctttcagatttgtcctgaattaaggaaaagcacttcaggtcattctgctagagatgcttgggaacaataccttgaaaaacatgaatccagtggacccatttgaggaggcccgctgtcaactctaaagccattgtaccactccatagcttggactgccgagcaactaaccatgaagtatgaagagaatctcaaagcaggttttcttgaaaaatgaaatgtgaacgaaaacttatctattccatttagtcacttcttattgatagagaagtttccatctgaatatctgaattaaacattcattaacaga

SEQ ID NO: 25755 - DNA, 406 bp, Homo sapiens
tgcctgtcattcaaaagcagctaccttttctaaggcagcgtcaaggagggcactggaggtactcaacacagtaatgattactttaccaagtccaaggcaattgtcaaatgtggcaaagaaaaacacttcattgggtttttcttagaaatgatttttcatccaatttcaatcaagatcttaatggaaattttgaaaattactcatgaggttatttaataaatccatccccattatttaaagaaagccatgtaaagacaacaaaatatgggccaagcacttgttcttgaacattattgctgagaaaaaaatatgcatttgtaaaatggggggggcagtattttgtttctgaagtgagatcaaatgtagaaaatattgcatatgtatagtaaaatgactgaaacactga

SEQ ID NO: 25756 - DNA, 979 bp, Homo sapiens
gatgacctgccttcttcatgactcaacccatgatttcaaaatgaaattggggaaatagtaggttaatgctttatcaaagaaaaatcaatttggtctgataggggactcaacggattagagatcacagactgaggttctagtcccagctttaccacaagcagccttgacctgccctcaacctgggtcccagtgcctcaatgaccctaggcttccatccctgatataggctttcagaagtcagtggaaagattattcatagtgcctaagaaatgcctgtttccaatatttgaccttgtggatctcaggctttggagagcctaataccaacacaccagcctgcagattttgtctttcccaaactgtgttccaggaatgggctcaaaacttcagggctgacgctgtcctcaccccagactattagagtcctgtgtgctcacagagaacatgaagaagagcaatgtgtagaagacttaactttctcataactgcagcagggactgaaaattgacctccatccaaatgaaaaataatgttgaggatgattctaaagctaaacctaggcttggtgggaaaaaaaaaaaaattgtgattaattggtgatctctgccacaagtgtggggctcagagtgtcagcacatgtacctcatgtttaccaagtctagaagagatttctctgaaaaggtaatgagctgtcttgaaaaatggggagttcaccatcactcaaagtgctcaagggaagactgggtgattactcatcttgactgttgctaagaaaatctgtgtcaactttggaggaaggtgtttggaatagatatgttgaggggctcttctaactcttacatgctaaagttgtttgagtaagatctacttacagcctgccatcgtaatgtgtggcttgtggtttgggcgatttcctatacttgcttctaaaatgaaacaacgtgtcctaaagtaaagtaaagtgcacttgaattagcaa

SEQ ID NO: 25757 - DNA, 925 bp, Homo sapiens
gatgacctgccttcttcatgactcaacccatgatttcaaaatgaaattggggaaatagtaggttaatgctttatcaaagaaaaatcaatttggtctgataggggactcaacggattagagatcacagactgaggttctagtcccagctttaccacaagcagccttgacctgccctcaacctgggtcccagtgcctcaatgaccctaggcttccatccctgatataggctttcagaagtcagtggaaagattattcatagtgcctaagaaatgcctgtttccaatatttgaccttgtggatctcaggctttggagagcctaataccaacacaccagcctgcagattttgtctttcccaaactgtgttccaggaatgggctcaaaacttcagggctgacgctgtcctcaccccagactattagagtcctgtgtgctcacagagaacatgaagaagagcaatgtgtagaagacttaactttctcataactgcagcagggactgaaaattgacctccatccaaatgaaaaataatgttgaggatgattctaaagctaaacctaggcttggtgggaaaaaaaaaaaaattgtgattaattggtgatctctgccacaagtgtggggctcagagtgtcagcacatgtacctcatgtttaccaagtctagaagagatttctctgaaaaggtaatgagctgtcttgaaaaatggggagttcaccatcactcaaagtgctcaagggaagactgggtgattactcatcttgactgttgctaagcttctaactcttacatgctaaagttgtttgagtaagatctacttacagcctgccatcgtaatgtgtggcttgtggtttgggcgatttcctatacttgcttctaaaatgaaacaacgtgtcctaaagtaaagtaaagtgcacttgaattagcaa

SEQ ID NO: 25758 - DNA, 570 bp, Homo sapiens
gatgacctgccttcttcatgactcaacccatgatttcaaaatgaaattggggaaatagtaggttaatgctttatcaaagaaaaatcaatttggtctgataggggactcaacggattagagatcacagactgaggttctagtcccagctttaccacaagcagccttgacctgccctcaacctgggtcccagtgcctcaatgaccctaggcttccatccctgatataggctttcagaagtcagtggaaagattattcatagtgcctaagaaatgcctgtttccaatatttgaccttgtggatctcaggctttggagagcctaataccaacacaccagcctgcagattttgtctttcccaaactgtgttccaggaatgggctcaaaacttcagggctgacgctgtcctcaccccagactattagagtcctgtgtgctcacagagaacatgaagaagagcaatgtgtagaagacttaactttctcataactgcagcaggggttggaggtcgccctccatctaattgccaccccatgatccccttgattataaagataaacaaaggaaaaaaggg

SEQ ID NO: 25759 - DNA, 496 bp, Homo sapiens
cagcttgcccactgcgcaggcgtgccccgaaagaccagcttgaacaatgaagaggacctcggcgttaggtgggaccgcaaccaacaaggactacagttcccagcgggcagagcgccaactccaagtgaaggtccggttgctgggcatgctaggagttgtagtgtcggccgcctttacaatctaggctgtttggaagatttagagcttctatttcttgaagatttattcgaccgttttaaaaaatctcgcaactgaagcagggttcagagtttactatctgcgtccttgagtagcctggggatcaactgctgcatattagcaaatttcgaagcgtcaaggccttcagtgagccctttctgtcatttgggtggtccaggcagctgaagagtgggatggaggcgggactaaaccaggctgggctggaggaaaagggcggggcctgcaagcctgtctcttggcagcaggctctggcagccaaaccgtccaagctagcgcc

SEQ ID NO: 25760 - DNA, 215 bp, Homo sapiens
ggtcgacgttacagggcaaaaaataaggggagccagtgagaggggaggcacgctggggtcttccttggtaacctgtcattacttgccctgtaacttcctcctgatctctcaagccccctttctcagttcccaggaactctgcccctatgggaggcaccacccacatgttgtcattgcccacaggatgtggcttttctctctgcaggaaaggcaga

SEQ ID NO: 25761 - DNA, 1594 bp, Homo sapiens
acgaagcccagtaattccttaagtaaaagaggaatgtgaagacttcttaaggggccgggcgcggtggttcacgcctgtaatccaagcactttggaaggccgaggatgaatcacctgaggacagaagttcaagaccagcctggtcaacatggtgaaaccccgtctctactaaatatacaaaaattagccgggcgtggtggcgggggcctgtaatcccagctactcgggaggccgaggcaggagaatcgcttgaacccgggagccggaaattgcagtgagccgagatcgcgccattgcgctccagcctgggcaacaacagcgaaacttcgtctcaaaaaaaaaaattattcgtaattggtaacattaacaaggaattatgactgggggggtcaggaaacctggattctggtccaagttctacctttatagttgtcaaatatatatatttgtttatttatacacatacatatgtcatatatgattaataattgtatatatttatggtgtacaacatgatgttttgaaatatatgtacattggccaccacacccggcccaatagatctcctcaattttaccttaccttgatgtatgattttaggcaagtcagttttcctcaccagagtttgataaatcaggggcaaggaggaagttaaacaagcagatgactgcagagggtccttccagttctaacatcaacggaagctaactacattccccactcaaatcatctctgcacatacagcccgcaggaagccctttgaaatgtatttaaccacctttctcgctctcagaatgatctcaacaagaacagctttgctttccttggagctctgcatcaatctaggaaggctgctttgtctcttcactacttgagcaggatggagagatatgagcgggaaagacagataagaaatctgagaaagccccacaaggtgggttgatagtgtgaagaacatgggctgaagcatccaaatcttggttcagctacttacagggtaaccttgagaaagttacttaaacttgtcagctcggacgggcgtggtggctcacgcctgtaatcccagcacattgggaggccgaggtggacggatcacgaggtcagatcgagaccaccctggctaacacggtgaaaccctgtctctactaaaaatacaaaaaaattagctgggcgcctgtagtcccagctactagggaggctgaggcaggagaatggcgtgaacccgggaggcggagcttgcagtgagccgagatcgagcctctgcactccagcctgggccacagagcaaaagaaaaacaaacttgtcagctccatttgctgtaagaattatatgagtaacatggaaatgcctgactagaccctgttcccgtttttacccttagcccgttcaaatcttcataaggataattagtagcagtttgagttctgggattcacactccaaactactgttttactcacccagctacccttttctgaaatactactgaaaaccatacctgtatcagtttacctccattgttttacttgaagtgaattcctggaccatcagacattagaccaaggcaaaaaaaataaaaataatcaatcaaccct

SEQ ID NO: 25762 - DNA, 1775 bp, Homo sapiens
  misc_feature (27)..(27): n is a, c, g, or t
  misc_feature (1389)..(1389): n is a, c, g, or t
ttcgtcccgggcggtgcgttccactgntctggggccggcgccgcgcccagtcccgcttcgggccgcaagccccaccgctcccctccccgggcaggggcgccgcgcagcccgctcccgccgccacctcctcccctgccgccctcctagccggcaggaattgcgcgaccacagcgccgctcgcgtcgcccgcatcagctcagcccgctgccgctcggccctcggcaccgctccgggtccggccgccgcgcggccagggctccccctgcccagcgctcccaggccccgccacgcgtcgccgcgcccagctccagtctcccctccccggggtctcgccagccccttcctgcagccgccgcctccgaaggagcgggtccgccgcgggtaaccatgcctagcaaaaccaagtacaaccttgtggacgatgggcacgacctgcggatccccttgcacaacgaggacgccttccagcacggcatctgctttgaggccaagtacgtaggaagcctggacgtgccaaggcccaacagcagggtggagatcgtggctgccatgcgccggatacggtatgagtttaaagccaagaacatcaagaagaagaaagtgagcattatggtttcagtggatggagtgaaagtgattctgaagaagaagaaaaagcttcttttattgcagaaaaaggaatggacgtgggatgagagcaagatgctggtgatgcaggaccccatctacaggatcttctatgtctctcatgattcccaagacttgaagatcttcagctatatcgctcgagatggtgccagcaatatcttcaggtgtaacgtctttaaatccaagaagaagagccaagctatgagaatcgttcggacggtggggcaggcctttgaggtctgccacaagctgagcctgcagcacacgcagcagaatgcagatggccaggaagatggagagagcgagaggaacagcaacagctcaggagacccaggccgccagctcactggagccgagagggcctccacggccactgcagaggagactgacatcgatgcggtggaggtcccacttccagggaatgatgtcctggaattcagccgaggtgtgactgatctagatgctgtagggaaggaaggaggctctcacacaggctccaaggtttcgcacccccaggagcccatgctgacagcctcacccaggatgctgctcccttcttcttcctcgaagcctccaggcctgggcacagagacaccgctgtccactcaccaccagatgcagctcctccagcagctcctccagcagcagcagcagcagacacaagtggctgtggcccaggtacacttgctgaaggaccagttggctgctgaggctgcggcgcggctggaggcccaggctcgngtgcatcagcttttgctgcagaacaaggacatgctccagcacatctccctgctggtcaagcaggtgcaagagctggaactgaagctgtcaggacagaacgccatgggctcccaggacagcttgctggagatcaccttccgctccggagccctgcccgtgctctgtgaccccacgacccctaagccagaggacctgcattcgccgccgctgggcgcgggcttggctgactttgcccaccctgcgggcagccccttagttgaccacggcatgtttgagaatttgaacacagccctcactccaaagctccaggccagccgctccttcccccacttgtccaagcccgtggcccccggctctgcccctctgggctctggtgagcctggggg

SEQ ID NO: 25763 - DNA, 2891 bp, Homo sapiens
  misc_feature (27)..(27): n is a, c, g, or t
  misc_feature (1389)..(1389): n is a, c, g, or t
ttcgtcccgggcggtgcgttccactgntctggggccggcgccgcgcccagtcccgcttcgggccgcaagccccaccgctcccctccccgggcaggggcgccgcgcagcccgctcccgccgccacctcctcccctgccgccctcctagccggcaggaattgcgcgaccacagcgccgctcgcgtcgcccgcatcagctcagcccgctgccgctcggccctcggcaccgctccgggtccggccgccgcgcggccagggctccccctgcccagcgctcccaggccccgccacgcgtcgccgcgcccagctccagtctcccctccccggggtctcgccagccccttcctgcagccgccgcctccgaaggagcgggtccgccgcgggtaaccatgcctagcaaaaccaagtacaaccttgtggacgatgggcacgacctgcggatccccttgcacaacgaggacgccttccagcacggcatctgctttgaggccaagtacgtaggaagcctggacgtgccaaggcccaacagcagggtggagatcgtggctgccatgcgccggatacggtatgagtttaaagccaagaacatcaagaagaagaaagtgagcattatggtttcagtggatggagtgaaagtgattctgaagaagaagaaaaagcttcttttattgcagaaaaaggaatggacgtgggatgagagcaagatgctggtgatgcaggaccccatctacaggatcttctatgtctctcatgattcccaagacttgaagatcttcagctatatcgctcgagatggtgccagcaatatcttcaggtgtaacgtctttaaatccaagaagaagagccaagctatgagaatcgttcggacggtggggcaggcctttgaggtctgccacaagctgagcctgcagcacacgcagcagaatgcagatggccaggaagatggagagagcgagaggaacagcaacagctcaggagacccaggccgccagctcactggagccgagagggcctccacggccactgcagaggagactgacatcgatgcggtggaggtcccacttccagggaatgatgtcctggaattcagccgaggtgtgactgatctagatgctgtagggaaggaaggaggctctcacacaggctccaaggtttcgcacccccaggagcccatgctgacagcctcacccaggatgctgctcccttcttcttcctcgaagcctccaggcctgggcacagagacaccgctgtccactcaccaccagatgcagctcctccagcagctcctccagcagcagcagcagcagacacaagtggctgtggcccaggtacacttgctgaaggaccagttggctgctgaggctgcggcgcggctggaggcccaggctcgngtgcatcagcttttgctgcagaacaaggacatgctccagcacatctccctgctggtcaagcaggtgcaagagctggaactgaagctgtcaggacagaacgccatgggctcccaggacagcttgctggagatcaccttccgctccggagccctgcccgtgctctgtgaccccacgacccctaagccagaggacctgcattcgccgccgctgggcgcgggcttggctgactttgcccaccctgcgggcagccccttaggtaggcgcgactgcttggtgaagctggagtgctttcgctttcttccgcccgaggacaccccgcccccagcgcagggcgaggcgctcctgggcggtctggagctcatcaagttccgagagtcaggcatcgcctcggagtacgagtccaacacggacgagagcgaggagcgcgactcgtggtcccaggaggagctgccgcgcctgctgaatgtcctgcagaggcaggaactgggcgacggcctggatgatgagatcgccgtgtaggtgccgagggcgaggagatggaggcggcggcgtggctggaggggccgtgtctggctgctgcccgggtaggggatgcccagtgaatgtgcactgccgaggagaatgccagccagggcccgggagagtgtgaggtttcaggaaagtattgagattctgctttggagggtaaagtggggaagaaatcggattcccagaggtgaatcagctcctctcctacttgtgactagagggtggtggaggtaaggccttccagagcccatggcttcaggagagggtctctctccaggactgccaggctgctggaggacctgcccctacctgctgcatcgtcaggctcccacgctttgtccgtgatgcccccctaccccctcactctccccgtctccatggtcccgaccaggaagggaagccatcggtaccttctcaggtactttgtttctggatatcacgatgctgcgagttgcctaaccctccccctacctttatgagaggaattccttctccaggcccttgctgagattgtagagattgagtgctctggaccgcaaaagccaggctagtccttgtagggtgagcatggaattggaatgtgtcacagtggataagcttttagaggaactgaatccaaacattttctccagccggacattgaatgttgctacaaagggagccttgaagctttaacatggttcaggcccttggtgtgagagcccagggggaggacagcttgtctgctgctccaaatcacttagatctgattcctgttttgaaagtcctgccctgccttcctcctgcctgtagcccagcccatctaaatggaagctgggaattgcccctcacctcccctgtgtcctgtccagctgaagcttttgcagcactttacctctctgaaagccccagaggaccagagcccccagccttacctctcaacctgtcccctccactgggcagtggtggtcagtttttactgcaaaaaaaaaaaa

SEQ ID NO: 25764 - DNA, 820 bp, Homo sapiens
gtactcagaaggctgaggtaggattgttagaggccagcctgggcaccacagggagaccccatctctaaaatttagccaggaaccatggctcatgcctgtagccccaggaatttgggaggctgagtggggaggatcgcttgaggtcaggagtttgagaccagcctgggcaacatagggagacctaaaaaaattaattgggcatctgtagtcccagctactcaggcggctgagctgagaggatggcttgagtccgagagattgagggtgcagtgagctgtgatcataccactgcactccagcctgggcggcagtgagacactatctgaaaaaagtttaaaaattttaaaaaagaaggaactgcccctgaggtaagaaccaagggagggcctcccagaggtcaggtggaaaaagttttaggaaggaggaagtagtcaacagggttacctgttgcaaagtacttaagtaatatgaggcctgatagtggtaaacttgactaccgttggatttcactagtgggaaaggaagtctaattaaaatgcactcaagagactaacagtcgcaggcatgaaatacaatacaggtacatggttttttattatgtgtgcatctgcttcagtaataggtgtgaattactcatttggatcattaggagtttcaaaatctagttaaatgactagatttttgttgatgtaaattctgtcattctgaactgcagggattgtcagtaacttaactgcaaactaaactggtgataattatggtaaaattgcaagacgagcaataaatctcaaccaacttgagagaacactgataaaaaaaa

SEQ ID NO: 25765 - DNA, 421 bp, Homo sapiens
cgtctcaaaaaaaagttttgtaattttgtaaaatggttacatggcaccaaagcgaaaactacaaaaaaggtgcattctgagacgtcagagggaaatgtgtcaggctccccgtccgcagcgccgtgcggtcgttcagaaatttgcattcccataagcattgtgggagcaccgtctcccgagacttgccagcacagtgtggtgtgaaggttggacgtgccactgtgatgtgtgagaaacacatcagtcctctgtatcgggggtccacgccgtggatccagccaaccgtaggttggaaatgttcaggtaaaaatgcactgaacacgcgcggacattttttattgacacagcgttcacgttgtattggtcatgagtcaccgagagctgatttcaggtatgagggagggtgtgcttaggctctgtg

SEQ ID NO: 25766 - DNA, 1283 bp, Homo sapiens
caaataatgatgtctctttttaaagatggagggagtgctaaagttgctgaaagtaggatcagatttcaagaagcctctatgagagatctgcttcccatcacactgtttctccatgtcctggacatagttcattcaactcttacatcttgatgtacatagactggtatctctaggtgataaaaagataagacaggaatttgtgagaaacagataaatatataagtataaaacagtataatagaagattaatagaggtttaaacaaagtgttgtggtgctgtgtagacaaaggaatatgtgaaaggtaattcaagagcaatattaaaggaagccttgaagaattaaatattgacagactgagatgaggaaaaatgtgttatagtctgagggaattgttggtttttccagggacctataagtaatagtccagtagtgggggtgagatgggatcataatgaaagttaaaatggaaaatatagcttggggtgagctaatggctgaccttgaatgccatgttaagagtttgaacttttattctataaacaggaactattgaaggcttctgagaagagtagggacatgattagagttgtaattttagatggtaactgacagcagtaggagagttttacaagagagaaatcagatgtgtagatttttgagagaatcatatgtgtagattcatgtcaccatcacaataatcaagatacagaactcttccaccactaaaaaactccttcatgcaatccctctatagctacacatccccttccctgaacattggcaacctctaatctgttcaccatctgtgtattttattatttcaagaatgttatataaatggaattatgcagtatgtaactttttgtggttggcttttttcccttgaggtccgtccaagttgtcgtatgtatcagtacatcctttttatttctgtgtggtattccgcattatggatgtaccacaatttaaccattcatctgttaaaggatatctggagccgggcgcggtggctcacacctgtaatcccaacagtttgggaggccaaggcgagtggatcatttgaggtcaggagttcaagaccagcctggccaatatggtgaaaccccatctgtactaaaaatacaaaaattagccaggcagtagtggcacacacctgtaatcccagctactcgggagacaaaagcaggagaatcgcttgagcctgggagacggaggttgcggtgagccaagatcataccactgcaccccagtctgggtgacagaatgagaccctatctcaaa

SEQ ID NO: 25767 - DNA, 480 bp, Homo sapiens
ggccctgtgatgactgtgaagattgtttgcttatcatgctccaatgaccccttcttgactgtatttctgatgaaatatagagggttatacaaaagagagaggaggaggagaaggaggaggtgggagaagagaagaaggaactggatggcgaaggaagctgtgtttgggattaaaatagttgctgctggccaggcacagtggctcacacctataatcccagcactttgggaggccaaagcatgcagataacagggtcaggagtttgagtccaggctggccaatacagtgtaactccgtctctactaaaaaaaaaaaaaaaatacaagaattagctgggcttggtggcgggtgcctgtaatcccagctacttgggaggctgaggcaggagaattgcttgaacctgggaggccgaggttgcagtgagccaagatgacgccactgtactccagcctgggcgacagagtgagatgctgtctccca

SEQ ID NO: 25768 - DNA, 189 bp, Homo sapiens
ttttcgtatttattcttacctcaaggctagaatgtaagtactgttaatactattcccatcttacaaatgaagaaattgaggcatggtggggttaaataacatctcaaaggttcacttaatcaggaaatggtaaaaccattatttgaaccagttatattttatggtgcatctgttattaatttctccatc

SEQ ID NO: 25769 - DNA, 488 bp, Homo sapiens
tccccttgcaagtttaaactcctaagggtctggcagaaccccctgagcatattcaatttcctgttataaattctgtactctactggttacctcactgtcaaccttcaaaaacctcatgttcatttttgattccatgtctttgaggttatcctggatgctagaatacatttcctcttcactactgcctatttaaatgaatttccccaaaaggtttgcaaacttagttgaactcaagcagtacaggtcagaatgtaacctcaggactttggaaggcccaagtgaaaggcttgcctgaggccaggagttcaagaccagccaggccaacattttgaaactctgtccctactgaaaatacataaaattagccgggcatggcagtgcgcgcctgtaatcccagctacttgggaggttgagacaggagaatcacttgaacccgggagatggaggttgcagtgagccaagatcacgccactgtactccagctgggg

SEQ ID NO: 25770 - DNA, 469 bp, Homo sapiens
acttcagcgttcatcatcggacagttgtttcaatgaactgtggttcatctagacaatggaatgcatagcccttaaaaatattactgtggatctacatttactgaaatggaaagattcccatactatgggatggtatgataagcatgatataaagttctgaaattatagtgctattaaacttttttaatacattaggatttaaacttttatgtaccaatatcagaacaaaaggccataaaaagattaaaatataatgacaagccgagaatagattacatttctattatgatcactggtgtattttcttcacaacacttacatccacttgaattatatatattttttgttttttattatctttcattctcactaacctaaagtgagggaatgtaagtttactgttgcacaccagaaccttgaacatcatgagtatttgttgcataaattatgaataaattccacttctgca

SEQ ID NO: 25771 - DNA, 441 bp, Homo sapiens
gaaaaaatctaactctatgcattttccatgttgctagatacttagttatatttatttatcgattcatttatgtattttgttttgttttgtttttttgagacagagtctcactctgtcacccagtggcacgatctcggctcactgcagccctgcctcctgggttcaagcgattcttttgccccagcctcccgagtagctgggagtacaggtgcacgccaccatgcccagctaatttttgtatttttagtagagatggggtttcaccatattggccagactggtcttgaactcctgacctcgtgatctgccctcctcggcctcccaaagtgctgggattacaggcgtgagccactgcgcctggctcctgctagatttttggtacaaatgtaataatgtatgtccattcatgataattgggaaaatgcaaaaaaaatagaaata

SEQ ID NO: 25772 - DNA, 551 bp, Homo sapiens
ggtgacattgaatataagataaagtaaatatgtggttaatgtattttcctcattagccttttaccctaatgagtacataggggtcgcagttgcagggtcaggagagggatggttgattttgtgctgcctttgtgcttcatccaataggcaggttgtaatcggtgcctgtcagtgtgatatttgacagactctggccttgcaggtgaggttcagctttcgttcataggcccggtttctattacccatatggccaagatgcagccattttagacaatttttttttcttcagactttccttattttctgacacctatcaagaaagtaaatttgaccaggcgtggtggctcacgcctgtaatcccaacactttgggaggctgaggtgggtggatcacctgaggtcaggagtttaggaccagcctggccaacatggtggaaccccatctctattaaaaatacaaaaattagccaggcatggtggtgcacgcctgtgatcccagctactagggaggctggggcaggagaatcgcttgaacctgagagatggattttg

SEQ ID NO: 25773 - DNA, 418 bp, Homo sapiens
gagatacctgcggagggacctgtggagggactcctgtgtgaagtggtagttgacgctgcaatgcatcactttgcagttttgtattcttcttcacctaacttttttatgcctcactttagctgtcctgggttgatacagtctaaatagtccttgcctcaagctctaattttttgggaatctggtatcaaacacacatgaatctggattgagaaaaacacaatcattcactcctaattagatactcctgtcttcatataataaagcatttaaaaaaaaaacaggtacacctacatccagattcaaattttcagaaaatgtattcactggaaaaataggcaaacactctgcttacatggcaagtaggcagaattagtatccactttgactatacatcttcctgagagagagaggaagagag

SEQ ID NO: 25774 - DNA, 331 bp, Homo sapiens
gcgatgttttattttttttccccctttctctttctaggtattttagtgagcacttgggggagactattggagagatgttagccagatatcattttatctatgaaacctagagctattcttactgagattttttgataggattctttttgaaatgtgatctattacttcaattctctttacagttgcataatggataagtttaggataagtcagcatcatcacttttggaataaattatcgtgatttgctgtagattcaatcacagattagtttgtaggcctaaactctaaatgcacactgacctttccattactttgaaacttgatttctt

SEQ ID NO: 25775 - DNA, 457 bp, Homo sapiens
ccatggtccaggtgctgatgagaagagaaaaaggtaccagttctccccagattaccagaggaagtaactcttctgctctcccaatacaaaaccctcgccagtgtgcctgagcatggcctggcactgatacttgccaacatgccacagggtgaattttggaatcacggggcctgatggcctgcacctgagccacagaatatatgacattaccattatcatagggagagtgactgtgacatccactgtgctttgagtgtttgtgtcccctccaaaagtcatgttgaggccaggtgcagtggctcaacaaatcgcagcactttgagaagccaagaacaaatcccagcactttgggaggccaagcacaagtcccagcattttgggaggctggggcgggaggatcacttgaggtcaggagttcaagatcagcctggccaatatggtgaaaccccgtctctac

SEQ ID NO: 25776 - DNA, 431 bp, Homo sapiens
gtaagtgtttggggcatttctttttctctgttctttcccttccttctccacacatctatcccaaggcacaggcattttattttgcattttggacctgctgtctgtttgacagtgtcctcttttgatttatttattattgttgtttgcaaagaagagggaaattttgaagcatgaacttgctgtgctaccttgatttggaggtctcctggcccagtgtggaaaaagttaaaatcatctgacatatgtttatatatatttaagcatctcagttggcttcatttgtgcaatgaggtcccaagatccactcaaactcctacttacatacaggaaagaaaaacatctgctgctttgactaaaagttcctcctggccttccctgtgaaactcaggtgaaacctccagccaacagaattgtaacagagtcattctatt

SEQ ID NO: 25777 - DNA, 358 bp, Homo sapiens
gtattttttagtagagacgaggtttcactgtgttagccaggatggttcgatctcctgaccttgtgatccacccgcctcggcctcccaaagtgctgggattacaggcatgagccacggcacccggccggccagcattcttgtcttgttcctgatcatagatgaaaatagtttttcatcattgagtgtgatattagatttgggctggtcatatatggctttattatgttaaggtgcatttcttctctatatctaattgtttgagagttgttaatcataaaagaatgttgaattttgtcaaatgctttttatctattgatactatcacatgatttttattcttcattttattaatgtggtg

SEQ ID NO: 25778 - DNA, 425 bp, Homo sapiens
tttcttcaccacagatcagtgtagcctgttttagaacttcatataaatggaactgtacatacgtattcttctttgttaaggcttctttcatttagtacatttttgagattcataacttttgttgtgcacattagtaattcattcctttttattgttaatatccaattttgagcatatggtacagtttgtttatccattctcctgttaataggtccttgtgatgtttacagtttgggattattatgaaaaaaagctgcaatagccattctcataagtgttttcaggaacgcttgctttcatatttatttatttatgtatttcttgcatcaaagtctcgatctttcaccaggctggagtgcagtggcacgacctcagctcactgcaagctccgcctcctgggttcaagtgattcacctgccgcagcc

SEQ ID NO: 25779 - DNA, 224 bp, Homo sapiens
ggaaatggaagagtcattggagggaggggcagttttttagacccagacatgtccttggcaatcataatggtctcctggtgctgttctcaggagtcagacatgagtcctggggagagtagaggggctgtcagtaagagcccaaagagctgttccactgaacagtctgtgtcttatctgagcatacgcagtcttgttctgaagttaggtaagaaaggcatttgtcc

SEQ ID NO: 25780 - DNA, 354 bp, Homo sapiens
gggtttcactttcgagcttgccagatgtagaaaatgctggagaatggagtactatgaggaccattagaagatctttcaaggccggacgcagtggctcacccctgtaatcccggtactcttggaggccgaggcaggtggatcacttgagcgcaggagtttgagaccagcctgggcaacatggcgaatccccatctctactaaaaatacaaaaattagccaggtgtggtgtttagcgcctgtagtcccagctgctcaggaggctgaggtgggaggatctgcttgagctcaggaagtcgaggctgcagtgagctgagatcacgccactgcactccagcctaggcgcctagtgaaacc

SEQ ID NO: 25781 - DNA, 171 bp, Homo sapiens
ccatattgcgttttcaccgcattctgagatatgatgagatgtctcaagaagcacttatggattatttgagttgttagctgaactagccaatgtttctccttatttttatttggtttttcatgaaatattatttttacttggaagaatgacagataaactgtatttcttatg

SEQ ID NO: 25782 - DNA, 875 bp, Homo sapiens
tctgtctcccaggttcaagtgattctcctgcctcggcctcccaagtagctgagtccacaggcacgcaccaccatgctcggctaattttttgtatttttagtagagacgtggtttcaccatgttgggcaggctggtctcgaactcctgacctcaggtaatccacctgcctcggcctcccaaagtgctgggattacaggcgtaagccactgtgcccggccagcgaatttgcactcccaacagagtgtgtgtcagcgttcattttcccttaacatccttcctgacccttgatacattccagctcttcagtttggggcaatcagatagtcatgcgttattttcatttccctgaccatcccatgaacttgaaacagagaaaagtatttcacacaagaggagagagagaagtgagagtgggtgccaggttaatgacaactataggttaccatcacagaattatgatatttctttccatcttaggttaaagttattcgtataggactgaaaaacactttctttagagcgtgttgctttcctttccttagtgggttttgaagggatttaggacatagaaggcttctgaaccatttgatggaagttctgagtagaggagagtgaggaaggagggaggccgggcaaggtgacctgggaggcactaagttgcctctttctcaggcgcagctgttctcatgcctcctggcgtttccactaagcaggaagttcttttggtgtttgagtcataaagaaaacaaatgcactgggctgggctcagtggctcacgcctgtaatcccagcactttgggaggctgaggcgggcggatcacgaggtcagaagatcgagaccatcctggctaacacagtgaaaccccgtctctact

SEQ ID NO: 25783 - DNA, 2288 bp, Homo sapiens
  misc_feature (974)..(974): n is a, c, g, or t
aaatcttttgtagttatcccacagttcttatatcttgtttttttattcttctctttgcttttcaggtgtggatgtttctgctgatatattctcaagctctttagttggctgtttcttggccaataataagcctaccaaagacattcttcatttctgttacactgtcttcaatttctagcatttctttgtggttcttagaatttccatctctgtgtttacactgcctgtctgttcttggatgctgtctgctttatccagtagaacccatggcatatcaatcataattgttttaaattcccagtctgataatttcagcaatcctgctatatctggttctggttcttactctttctctttaaactaacttttgccttttagtatgcttgtaatttttccttagctggacatggcatactggataagaggaaatgctgtaagcaggcctctagtaatcatgataagctgtggggagaggggcagcattctattgtccagggattagatgtcagtcttgcagtgagtctgtgcttctgcactgcgaacttcagtttttcccaccctttagttgggtcaggatgtatagagttggctggagttggatatttcccttcctccaggtcactgaagctctgactaaaactccaggtgtggtggcttatgcctgtaataccagcactttgggaggccaaggcaggtggatcacctgaggttgggagttcatgaccagcctgaattgcttgaatccaggaggtggaggtcacagtgagccgagattgtgatactgcactccagcctgggaaacagtgagacactgtctcaaaaaaataaataaataaataaaaggctaggcgcagtggctcaaccctgtaatcccactaattttgtatttttagtgaaggcagggattctccatgttgatcaggctggtctcgaactcctgacctccagtgatctgcctggtttgacctcccaangtgctgagattacaggcatgagccatcacgcccagccagttcttcaattcttacagtccctttccatgtcattaaagaactcacactggagagaaatcttatcaatgttagaattgtggtaaagctctctgttgttcccatttacatgaaagatgtgaacagtcacattgtagaaaaatgctgtgagagttgggaatctggaaccacttctttattatctcaggtcataatgaacttgtaagaattcacagtggcaggaaaccctatgtaaatggaaaatatgggaaaggcttcatttaatccataggactgataccacaaaactcccactaggagaaaacctatgtttatacggaatgtgggaaaatcttcacttatttctcaagccttaaagtgtatgtcaggattcccagtggagagaagccatattgatgtaaggaatgtgggaaagcccttgcctgccacttagtccttgataaacattttagaacacaaactggagagaaactatgaattcaaggattgtgggaaaacccttttatgttccacaagctttaatattcatatgcaatgtatgctggagaataacttgatgactataataagtggaatggcctaggtcagggatccccaaacccctgggccatggactggtactggtctgtggcctgctaggatccagggtgcacagcaggaggtgaatgtaggatgagcaaacattactgcctgagctcaactttctgtcagatcagcagtggcattagattctcataggagcatgaactttattgtgaactgcacatgcaagggatctaggttgcacactccttatgagaatctaatgcctgatgatctgaactggaacagtttaatccccaactccagtccgtgggaaaaatgtcttccacgaaactggtccctggtgccaaaaagttaggggaccactgatttagattatgtcacatgtcccatccactcattaacattaaggctttcatccctgggacctcaagataatggtggtatttagagatgtggttttttaaagaggtgattttaaaatgaggcagttagaatggggccctcattcaatatgactggtttccttataagaagtgaaagagataccagggtagcaggcacagaattttatgtgaagtgaccggaaatggttaccttcaaggcaaagagagattcctggaggagatccttcttttaaggctcattatagaggaaatcatccttatctacactttgatcctggacttccagcctcaaaaattatgagcaaataaatttctgttgtttaagcca

SEQ ID NO: 25784 - DNA, 1979 bp, Homo sapiens
  misc_feature (440)..(440): n is a, c, g, or t
cgtgagccaccgcgcccagccaatccttcctttttaatatccacatacaaactcactgaagaaaaaccctgaaaatgtaaagcaatgttgaaaaacctagttatttaaattcatttcaagtatatgaactcacatggtaaagaaaccctgtgaatataagtagtatgataaattcttgaatttttttttttttggaggcagagttttgctcttgttggcccaggctggagtgcaatggctcaatcttggctcactacaacctctatcacccaggttcaagtgattattctgcctcagcctcccaagtagctgggattacaggcatgtaccaccatgcccagctaattttgtatttttagtgaaggcagggattctccatgttgatcaggctggtctcgaactcctgacctccagtgatctgcctggtttgacctcccaangtgctgagattacaggcatgagccatcacgcccagccagttcttcaattcttacagtccctttccatgtcattaaagaactcacactggagagaaatcttatcaatgttagaattgtggtaaagctctctgttgttcccatttacatgaaagatgtgaacagtcacattgtagaaaaatgctgtgagagttgggaatctggaaccacttctttattatctcaggtcataatgaacttgtaagaattcacagtggcaggaaaccctatgtaaatggaaaatatgggaaaggcttcatttaatccataggactgataccacaaaactcccactaggagaaaacctatgtttatacggaatgtgggaaaatcttcacttatttctcaagccttaaagtgtatgtcaggattcccagtggagagaagccatattgatgtaaggaatgtgggaaagcccttgcctgccacttagtccttgataaacattttagaacacaaactggagagaaactatgaattcaaggattgtgggaaaacccttttatgttccacaagctttaatattcatatgcaatgtatgctggagaataacttgatgactataataagtggaatggcctaggtcagggatccccaaacccctgggccatggactggtactggtctgtggcctgctaggatccagggtgcacagcaggaggtgaatgtaggatgagcaaacattactgcctgagctcaactttctgtcagatcagcagtggcattagattctcataggagcatgaactttattgtgaactgcacatgcaagggatctaggttgcacactccttatgagaatctaatgcctgatgatctgaactggaacagtttaatccccaactccagtccgtgggaaaaatgtcttccacgaaactggtccctggtgccaaaaagttaggggaccactgatttagattatgtcacatgtcccatccactcattaacattaaggctttcatccctgggacctcaagataatggtggtatttagagatgtggttttttaaagaggtgattttaaaatgaggcagttagaatggggccctcattcaatatgactggtttccttataagaagtgaaagagataccagggtagcaggcacagaattttatgtgaagtgaccggaaatggttaccttcaaggcaaagagagattcctggaggagatccttcttttaaggctcattatagaggaaatcatccttatctacactttgatcctggacttccagcctcaaaaattatgagcaaataaatttctgttgtttaagccaaaaaaaaaaaaaaaaaaaaccaacaacctttttgggcgcgccggccctgaaaaaatttttaaacaccccttcttggggccggggccctggttagtgaaaccgtggccaacggggtccaaagaaaccgggccaggactggggtggttttccccaaaaaaaacgccgggggccccgcggttgaccaaccgagggctcggggcttccggcttcacaggcccgggcgta

SEQ ID NO: 25785 - DNA, 1809 bp, Homo sapiens
  misc_feature (440)..(440): n is a, c, g, or t
cgtgagccaccgcgcccagccaatccttcctttttaatatccacatacaaactcactgaagaaaaaccctgaaaatgtaaagcaatgttgaaaaacctagttatttaaattcatttcaagtatatgaactcacatggtaaagaaaccctgtgaatataagtagtatgataaattcttgaatttttttttttttggaggcagagttttgctcttgttggcccaggctggagtgcaatggctcaatcttggctcactacaacctctatcacccaggttcaagtgattattctgcctcagcctcccaagtagctgggattacaggcatgtaccaccatgcccagctaattttgtatttttagtgaaggcagggattctccatgttgatcaggctggtctcgaactcctgacctccagtgatctgcctggtttgacctcccaangtgctgagattacaggcatgagccatcacgcccagccagttcttcaattcttacagtccctttccatgtcattaaagaactcacactggagagaaatcttatcaatgttagaattgtggtaaagctctctgttgttcccatttacatgaaagatgtgaacagtcacattgtagaaaaatgctgtgagagttgggaatctggaaccacttctttattatctcaggtcataatgaacttgtaagaattcacagtggcaggaaaccctatgtaaatggaaaatatgggaaaggcttcatttaatccataggactgataccacaaaactcccactaggagaaaacctatgtttatacggaatgtgggaaaatcttcacttatttctcaagccttaaagtgtatgtcaggattcccagtggagagaagccatattgatgtaaggaatgtgggaaagcccttgcctgccacttagtccttgataaacattttagaacacaaactggagagaaactatgaattcaaggattgtgggaaaacccttttatgttccacaagctttaatattcatatgcaatgtatgctggagaataacttgatgactataataagtggaatggcctaggtcagggatccccaaacccctgggccatggactggtactggtctgtggcctgctaggatccagggtgcacagcaggaggtgaatgtaggatgagcaaacattactgcctgagctcaactttctgtcagatcagcagtggcattagattctcataggagcatgaactttattgtgaactgcacatgcaagggatctaggttgcacactccttatgagaatctaatgcctgatgatctgaactggaacagtttaatccccaactccagtccgtgggaaaaatgtcttccacgaaactggtccctggtgccaaaaagttaggggaccactgatttagattatgtcacatgtcccatccactcattaacattaaggctttcatccctgggacctcaagataatggtggtatttagagatgtggttttttaaagaggtgattttaaaatgaggcagttagaatggggccctcattcaatatgactggtttccttataagaagtgaaagagataccagggtagcaggcacagaattttatgtgaagtgaccggaaatggttaccttcaaggcaaagagagattcctggaggagatccttcttttaaggctcattatagaggaaatcatccttatctacactttgatcctggacttccagcctcaaaaattatgagcaaataaatttctgttgtttaagccaaaaaaaaaattaatatagtcgatcggccgttaatttagtagtagtagtcggccgc

SEQ ID NO: 25786 - DNA, 2423 bp, Homo sapiens
agcggggaggaggtggagagtgaggccgaggcgtggggagcccgggaactccctcctcctgaagtaacgcgtcccgggccggctctgccgtcgttgctgccgccgggcgcccgggacgaggaggtggaggagggagagggcccgcgggcctcgcctccgccctccgccacctcgagctgcggtagcagcgactcatgagagcgcggcggaggacagatttgataatgggctgcattaaaagtaaagaaaacaaaagtccagccattaaatacagacctgaaaatactccagagcctgtcagtacaagtgtgagccattatggagcagaacccactacagtgtcaccatgtccgtcatcttcagcaaagggaacagcagttaatttcagcagtctttccatgacaccatttggaggatcctcaggggtaacgccttttggaggtgcatcttcctcattttcagtggtgccaagttcatatcctgctggtttaacaggtggtgttactatatttgtggccttatatgattatgaagctagaactacagaagacctttcatttaagaagggtgaaagatttcaaataattaacaatacggaaggagattggtgggaagcaagatcaatcgctacaggaaagaatggttatatcccgagcaattatgtagcgcctgcagattccattcaggcagaagaatggtattttggcaaaatggggagaaaagatgctgaaagattacttttgaatcctggaaatcaacgaggtattttcttagtaagagagagtgaaacaactaaaggtgcttattccctttctattcgtgattgggatgagataaggggtgacaatgtgaaacactacaaaattaggaaacttgacaatggtggatactatatcacaaccagagcacaatttgatactctgcagaaattggtgaaacactacacaggtatgtgaatatttcaaaggtaaaaattatttcttcatattctagtttatgaggacaaaatccatatcctcatttctcttaagatttaacacacttatttacacataatacatgcccaataaatgtctgttgtattctaaagggaggaacaggtaatacttagtacttgcattgtgctactcagataatgtgctaatagactctcatcatttgggtccttatatcttactggcatagtatttacattggagttcatttcaccacatgtaccttatgaaaataaacctaaaagcaaatatttatgggcacttagtaagtaaaactaaacattgggtaacagaaaaagctatgtcagaaggattaccttcctctgcatgggctggatcgcataagctttcctaaagtataaatccagtgaaatttggtctgacgatgcatttttcttatcctagaaaattaacctatagcaattatagacatttttgtctttcaaggacctctgaaggtatttaatattagaatcttctgtctcaaaatttttcattaccaatttggcatatgaatgcacctgaaagtctttacatgattaatactaggagaggggatgtttccatggtaatgtcttcaatgacagctagctgcaaactgagtctatcaagtcagccagcaatcttgacattgatcaagcatgttaccaagcagtggcatcacttgtaattgcctttgtcacaatgtgaatttatgtggtgattttagtgagaataggagagaacatgtctcatttataataagaaagattgtataagcagaattcataagtcaagctgttatgaatctagggttccctgactttgtgtctcccttatttaaaaaaatcagtctcctgttaggcatgtggattgtgcctttaatcccaactactgatgcaggaggatcacttgaggccaggagttcaagaacagcctgggcaacatagcaagacctcatctcttaaaaaaaaaaaaaaaaaaaaaaaaaaagaggcccagggcgtgttggggggctccccacctcctgtggttatctccccaccacatttgggggaaggccgaacaaccagacaaaagaactccacttgtgagaggctcgagagaagtttttgaaaacccaccctgtgggccaaaacaagtgggaaaacacccctttttctttttacaacatttaaaaaatttgtagcccgggcggcggtggtgggccatgcaccccctgggtgaggcctccgacgactccactgggggaaaggcactgaaggacaggcagaaactccaaatttgaaaaccgcggggaagggtgtggaaaagttgtgtgcccagtgtgaagcttgaagaaaacacacaacccagtttggcgacctccaactccggtgggtgcgcgaacccaaataggtgtgtagaacttcccgtgttcctccaaccaaaagacacaccaaaaagagt

SEQ ID NO: 25787 - DNA, 2503 bp, Homo sapiens
agcggggaggaggtggagagtgaggccgaggcgtggggagcccgggaactccctcctcctgaagtaacgcgtcccgggccggctctgccgtcgttgctgccgccgggcgcccgggacgaggaggtggaggagggagagggcccgcgggcctcgcctccgccctccgccacctcgagctgcggtagcagcgactcatgagagcgcggcggaggacagatgctgtggaagagagccaccattatcaaaatgatcacagttgcaaacattcgtgcttcaaataccagccactatgttagatttgataatgggctgcattaaaagtaaagaaaacaaaagtccagccattaaatacagacctgaaaatactccagagcctgtcagtacaagtgtgagccattatggagcagaacccactacagtgtcaccatgtccgtcatcttcagcaaagggaacagcagttaatttcagcagtctttccatgacaccatttggaggatcctcaggggtaacgccttttggaggtgcatcttcctcattttcagtggtgccaagttcatatcctgctggtttaacaggtggtgttactatatttgtggccttatatgattatgaagctagaactacagaagacctttcatttaagaagggtgaaagatttcaaataattaacaatacggaaggagattggtgggaagcaagatcaatcgctacaggaaagaatggttatatcccgagcaattatgtagcgcctgcagattccattcaggcagaagaatggtattttggcaaaatggggagaaaagatgctgaaagattacttttgaatcctggaaatcaacgaggtattttcttagtaagagagagtgaaacaactaaaggtgcttattccctttctattcgtgattgggatgagataaggggtgacaatgtgaaacactacaaaattaggaaacttgacaatggtggatactatatcacaaccagagcacaatttgatactctgcagaaattggtgaaacactacacaggtatgtgaatatttcaaaggtaaaaattatttcttcatattctagtttatgaggacaaaatccatatcctcatttctcttaagatttaacacacttatttacacataatacatgcccaataaatgtctgttgtattctaaagggaggaacaggtaatacttagtacttgcattgtgctactcagataatgtgctaatagactctcatcatttgggtccttatatcttactggcatagtatttacattggagttcatttcaccacatgtaccttatgaaaataaacctaaaagcaaatatttatgggcacttagtaagtaaaactaaacattgggtaacagaaaaagctatgtcagaaggattaccttcctctgcatgggctggatcgcataagctttcctaaagtataaatccagtgaaatttggtctgacgatgcatttttcttatcctagaaaattaacctatagcaattatagacatttttgtctttcaaggacctctgaaggtatttaatattagaatcttctgtctcaaaatttttcattaccaatttggcatatgaatgcacctgaaagtctttacatgattaatactaggagaggggatgtttccatggtaatgtcttcaatgacagctagctgcaaactgagtctatcaagtcagccagcaatcttgacattgatcaagcatgttaccaagcagtggcatcacttgtaattgcctttgtcacaatgtgaatttatgtggtgattttagtgagaataggagagaacatgtctcatttataataagaaagattgtataagcagaattcataagtcaagctgttatgaatctagggttccctgactttgtgtctcccttatttaaaaaaatcagtctcctgttaggcatgtggattgtgcctttaatcccaactactgatgcaggaggatcacttgaggccaggagttcaagaacagcctgggcaacatagcaagacctcatctcttaaaaaaaaaaaaaaaaaaaaaaaaaaagaggcccagggcgtgttggggggctccccacctcctgtggttatctccccaccacatttgggggaaggccgaacaaccagacaaaagaactccacttgtgagaggctcgagagaagtttttgaaaacccaccctgtgggccaaaacaagtgggaaaacacccctttttctttttacaacatttaaaaaatttgtagcccgggcggcggtggtgggccatgcaccccctgggtgaggcctccgacgactccactgggggaaaggcactgaaggacaggcagaaactccaaatttgaaaaccgcggggaagggtgtggaaaagttgtgtgcccagtgtgaagcttgaagaaaacacacaacccagtttggcgacctccaactccggtgggtgcgcgaacccaaataggtgtgtagaacttcccgtgttcctccaaccaaaagacacaccaaaaagagt

SEQ ID NO: 25788 - DNA, 1136 bp, Homo sapiens
agcggggaggaggtggagagtgaggccgaggcgtggggagcccgggaactccctcctcctgaagtaacgcgtcccgggccggctctgccgtcgttgctgccgccgggcgcccgggacgaggaggtggaggagggagagggcccgcgggcctcgcctccgccctccgccacctcgagctgcggtagcagcgactcatgagagcgcggcggaggacagatttgataatgggctgcattaaaagtaaagaaaacaaaagtccagccattaaatacagacctgaaaatactccagagcctgtcagtacaagtgtgagccattatggagcagaacccactacagtgtcaccatgtccgtcatcttcagcaaagggaacagcagttaatttcagcagtctttccatgacaccatttggaggatcctcaggggtaacgccttttggaggtgcatcttcctcattttcagtggtgccaagttcatatcctgctggtttaacaggtggtgttactatatttgtggccttatatgattatgaagctagaactacagaagacctttcatttaagaagggtgaaagatttcaaataattaacaatacggaaggagattggtgggaagcaagatcaatcgctacaggaaagaatggttatatcccgagcaattatgtagcgcctgcagattccattcaggcagaagaatggtattttggcaaaatggggagaaaagatgctgaaagattacttttgaatcctggaaatcaacgaggtattttcttagtaagagagagtgaaacaactaaaggtgcttattccctttctattcgtgattgggatgagataaggggtgacaatgtgaaacactacaaaattaggaaacttgacaatggtggatactatatcacaaccagagcacaatttgatactctgcagaaattggtgaaacactacacagaacatgctgatggtttatgccacaagttgacaactgtgtgtccaactgtgaaacctcagactcaaggtctagcaaaagatgcttgggaaatccctcgagaatctttgcgactagaggttaaactaggacaaggatgtttcggcgaagtgtggatggaacatggaatggaaccacgaaagtagcaatca

SEQ ID NO: 25789 - DNA, 735 bp, Homo sapiens
tgctgaaagattacttttgaatcctggaaatcaacgaggtattttcttagtaagagagagtgaaacaactaaaggtatgaatattgttatattagtataagtataaaatttcttggggcagtattttgagaaagatatagtgaaagtatttatttttcacccaggtgcttattccctttctattcgtgattgggatgagataaggggtgacaatgtgaaacactacaaaattaggaaacttgacaatggtggatactatatcacaaccagagcacaatttgatactctgcagaaattggtgaaacactacacaggtatgtgaatatttcaaaggtaaaaattatttcttcatattctagtttatgaggacaaaatccatatcctcatttctcttaagatttaacacacttatttacacataatacatgcccaataaatgtctgttgtattctaaagggaggaacaggtaatacttagtacttgcattgtgctactcagataatgtgctaatagactctcatcatttgggtccttatatcttactggcatagtatttacattggagttcatttcaccacatgtaccttatgaaaataaacctaaaagcaaatatttatgggcacttagtaagtaaaactaaacattgggtaacagaaaaagctatgtcagaaggattaccttcctctgcatgggctggatcgcataagctttcctaaagtataaatccagtgaaat

SEQ ID NO: 25790 - DNA, 401 bp, Homo sapiens
gacaagatccaaagagatattcatctgattgccctgagttaaccaacaataggccataagctcagtgaagttacactggccccagtgctttccttagctgctctcatataaatattcaaaagtcttagtcggtgctcacgcctgtaatcccagcactttgggaggccgaggtgggcagatcacgaggtcaggagatcgagaccatcctggctaacatggtgaaaccccatctctactaaaaatgcaaaaaattagcggggcttggtggcaggcacctgtagtcccagctactcgggaggctgaggcaggagaatggcgtgaacccgggaggtggagcttgcagtgagccaagatcgcaccactgcactccagcctgggagacaaggtgagactctgtctca

SEQ ID NO: 25791 - DNA, 394 bp, Homo sapiens
tgagaaggagttttgctgttgttgcccaggctggagtgcagtggcacaatctcggctccctgcaacctccgcctcctgggttcaagcgattctctggccccagcctcccaagtagctgggattacaggtatacaccaccatgcccagctaatttttgtatttttagtagagacagggtttcaccatgttggccaggctggtcttgaaatcctgacttcaggtgatccacccacgtcggcctctgaaagggctgggattacaggcatgagccaccacgcccagcctagactctcttttgaggtctctaaaatgatacaactgtgggggattatggaaacttgggggccaaacagaggagtggggactggacacaagggagctttggtttccaggc

SEQ ID NO: 25792 - DNA, 167 bp, Homo sapiens
tcaaagccatgagttcacactgatgcctctaattccaattctaaccattctagttttctctctttccgtattataattgccatccctaacaattaaaaacctagctaccattatctttaatatatttacttatttgatcaatccttttatgtaaccaatctctcata

SEQ ID NO: 25793 - DNA, 318 bp, Homo sapiens
ggaaatcttcagtcatctgatcatcacttgtcagttaatttagtgtgtgtttaatctcgtctcctaattagtatatcagctccccacaggcagggaccaccttagaatcttcagtggcctccaaggcaccaagcacagcgatgagtccccacctctgtcttccacaaatactggacagctattgatttggtcaacctatgctaaaacacaactgtagaatatttttaaagtgtactagaatcagtggatgaaagaaagatagaaattttgtcttcatttttaaacatatttcttaacttttagaactgtccaacaatg

SEQ ID NO: 25794 - DNA, 430 bp, Homo sapiens
tgtgcccggtttgaatgtaagcccgtgggagcctcgcagccttcctccccaggctctggagcccgggtgggcccgtcctgggcggcacagtggatgctcacgtgcctccccccctgcggcagcgcgagtgcttagcacctgaggctttaccctgggggctgtcttccctctgtgaggaccccagcaaggactcatgatgtccacaggtgcttaggggtggcctctgggctacttggcctcgcttgaccacaccttccggcccaggtgagccttgcgggtctaggtgaccaatgcggcctccaggtaaagggcacctgccttaggggacgcccacaagtgtctgcatttcaaactgctttgaaagaccaccctaaccgaccactgccacaatgtacccacaagtgcagatggtggctttggtctccaagat

SEQ ID NO: 25795 - DNA, 453 bp, Homo sapiens
tttatatagatagatagatagatagatagatagatagatagatagatagatagataaagtttttagaaagaactctgtgaagaactgtaaacatactcatgccatcttttggtataaaacttccgggaatttattccaaggaagtcagctggaagtcagccggaagaaagggaaagctacaagcacaagctcattatacattatttacaatacttgaaagtcagaaaaaatgaaaaatatctggccaccagggaacagttacgtaaattatttgatgtgtctttttaacaagatattaggaagtgctcggcattgttaggattttttttggccacgtggaaaaacacacatgatataaagcaaaggaaaataaggcagtctgcaaatggatctgcttagaactgccattacgtaaaacagtcctcagctcatactcgacttggagagaaatcc

SEQ ID NO: 25796 - DNA, 602 bp, Homo sapiens
gtgtatgtgtggggttttgtcttttgttttctgagaataaagtatatgagatcatggaaaaaatcagaaaacgaggaaaatcataaattcattaccaaaataatttctgatttggtattatagctctgcaaattacttcactaattgtgttcataggtactatggtacactgtacactgttttgtaacttgctttttagatggattatatcatatttttctgtatcaataaatatgaattcattacatcagtttaaactgatcaaaaacattttaatcaaagtaatacaattaaattgctaaatatcatagggaatcgaagagtttataatcccaaaccatactctttcttttcctagccagctggggacatttttaattgtttctattttcattctttctgtttcagttcttataaaaatacatatataaaattggctaaatgattaaatgttatagtagttctttaattataaatttgaataatatttgttgacttccaaactgcataccccttgccttgtccaagtaaaactgtaccatcgtttattctctgtgttgtcaataaaacactaagtgatatctgagtttctaaatttcagt

SEQ ID NO: 25797 - DNA, 481 bp, Homo sapiens
gactgatctcagccggggcaaaaaatgggaaagtgtagtcttttctatgtaggctattgtgaggctggggtgcaggagaggaactatgagcttttcagccctgagaaaggtattctccttcatcctatagtgttgggatacttttgtcctgggaaaatataggactaacttcaaactgaggagttgatgttttgccagctctcttaagaggagatgaagcaatgttcttctagctgagaacatttgtccctgtgttgacaccctgcctcagggtcttggtagcttacaatgttttcaatttttttgttaaaaaaatttttttttttggagacagggtctcattctgtcatccgggctagagtgcagtggtgcagtcatagctcattgcagcctccaactcttgggctcaagtgatcctcctatctcaacctcttgctgagtagctaggagtactggtgcatgccaccacatccagctaatt

SEQ ID NO: 25798 - DNA, 800 bp, Homo sapiens
gttgttgaaccagtgaaagtagatgagattacttgggaagaagatcagacctcctagaagatcagcagttaagggttggatagtgaaaggaactcacaaagatgggaaacagagaggttatatgagaaagagattattgtgctattttcatgatttttaaaaaataatgaaattctggctctgcaaccatctctcacaccagtaaaaataaaagaggaaaagtgctcttttttgaggacttcttagtttagatacttttctaaggtccttgaatgtattacctcttcattgttttcttttttgagatacagaaattaaaacagattagataatttgtccaagtggaacctgctagtaagcggtagaggtggtccatggtctggctcccaagtccatgctgttagcctctacactagtgtgctgatattgccaccatctcctaataatgaacttcggcactacaaccgttactcataccagtgaaacaaaaacaggatggtggctcatgcctgtaatcccagcacttttgagaggccaaggtgggtgattacctgagcctaggagtttgaggccagcctgagcaacttggtgaaacctgtctctacaaaaaaaaataaaaaataaaagatagatagatagatagatagctgggagtggtgctgctgcacgcctgtagtcctagctactcaggaggctgaggcaggcagttcaattgagcctgggagatcgaggctgcagtgagctgagatcacaccactgcactccagcctgagtgacagaatgagaccctatgtccaaaa

SEQ ID NO: 25799 - DNA, 308 bp, Homo sapiens
gtatactttattagtttaccaactggggtcaccctttgaaccaaaataaacatgaatcttttactgccaatttctcaaggcgaaaatgcgtaatttataatgtaggaaagataggctataaaatagttgataagatttaagtctagattgccttttcagttcggttgtggtggctgttgtttgagaaaaaggttattgatgttaaaggatagttgcattctagacgcaatgagccaaaatagaatttgttgcgaacttgttaatgtgttcatgtgtgttttttgttgaagtgagttgacatttttatg

SEQ ID NO: 25800 - DNA, 342 bp, Homo sapiens
gggaagggcgcactcactgaactaactcccttccctctactcccagagcccgcccggcaggaccaccgagcaaggccttggaaaaccagagagattagagcgcagaatggggaaatggagagagaacctgaaagagccccaaactcgaggacctattgctccccaagaataacatcttccagaagaactagacagaaaactaggcgtctgggaactctgaaatccttggaggagtagcatcatcatgaccctctgtgttccttttggcaaaggacttgctcccattgtttgcttgttccattgtctgtctgttaaataaataaaacccttttcatatatctt

SEQ ID NO: 25801 - DNA, 745 bp, Homo sapiens
gggaagggcgcactcactgaactaactcccttccctctactcccagagcccgcccggcaggaccaccgagcaaggccttggaaaaccagagagattagagcgcagaatggggaaatggagagagaacctgaaagagccccaaactcgaggacctattgctccccaagaataacatcttccagaagaactagacagaaaactaggcgtctgggaactctgaaatccttggaggagtagcatcatcatgaccctctgtgttccttttggcaaaggacttgctcccattgtttgcttgttccattgtctgtctgttaaataaataaaacccttttcatatatcttgcaaaaaaaacaaacaaacaaaaacaaaaaaaaaaaaatttggtgcggcgccggcctccgcgggcgcccctgaaaaaaggttttctagacacccactcgcggtcggggcgcgcgggggccccacagattggcgtaacatggcaacaactgtggcccaaaccgcgcggtgccccacgcaggaaaacaaccgcccgggctcgaaagaccaaccgacctgaccagaaactcgcccacccacaatcaacaaaacagcgcgccgcgggcgacaccaccgcacacgcgttctcggaacacaacctccccacaggcaccacacacgacggactccctacgcggggaccccacacaaaccgacgagcgccccaaacgacgacgaccagtacagacgttaggcccgcgactc

SEQ ID NO: 25802 - DNA, 1105 bp, Homo sapiens
gggaagggcgcactcactgaactaactcccttccctctactcccagagcccgcccggcaggaccaccgagcaaggccttggaaaaccagagagattagagcggtgagtcgcgccggtcacgttggacgcctgcgcgttaggagattctggagccagaacagcagaattgccttcgcccgccctgcccctcgcctgcttcagaagcttccaggaactcccgggtcggcgacccagcccgagccgcctggggccccaagggaagctgaacgccctgtgggctcctgggatggttcttcccgttctttgcgccgccttcacccattgaagagcctgtgcccaccctgcccagtcgctctcggggccgcggaggagcttccgctgccatcttcggatcctgtgttccgcacgggggctccaccagggcagggatggtggtgagggtcgctcgtgggtcccctcggggggagcagggtctggcactcaccagggctcacgactaggacttgtcgaatgaattcattgtcgcctttagcttttagtcctttgaagagccctgagagcggaaatcaacagatttttttccatggggaagttctttttacaaatcgttgatttctcagtaccctgcagggcgggaaactggcagggcctccggcgcaccttctgcgcggtggagccgcgggggctcagctgggccgtggtccggccctggggccgtagggcgagagcaggtaaagggaaaagcaaaagctgggaaagaagcccgggagcggtggaccagacatccagacctcctgaaaggcgcatgcagaggcacaggcgggatcttctggaagtgagaattgtttttgtttgtttattgtagcagaatggggaaatggagagagaacctgaaagagccccaaactcgaggacctattgctccccaagaataacatcttccagaagaactagacagaaaactaggcgtctgggaactctgaaatccttggaggagtagcatcatcatgaccctctgtgttccttttggcaaaggacttgctcccattgtttgcttgttccattgtctgtctgttaaataaataaaacccttttcatatatctt

SEQ ID NO: 25803 - DNA, 674 bp, Homo sapiens
gggaagggcgcactcactgaactaactcccttccctctactcccagagcccgcccggcaggaccaccgagcaaggccttggaaaaccagagagattagagcggtgagtcgcgccggtcacgttggacgcctgcgcgttaggagattctggagccagaacagcagaattgccttcgcccgccctgcccctcgcctgcttcagaagcttccaggaactcccgggtcggcgacccagcccgagccgcctggggccccaagggaagctgaacgccctgtgggctcctgggatggttcttcccgttctttgcgccgccttcacccattgaagagcctgtgcccaccctgcccagtcgctctcggggccgcggaggagcttccgctgccatcttcggatcctgtgttccgcacgggggctccaccagggcagggatggtgcagaatggggaaatggagagagaacctgaaagagccccaaactcgaggacctattgctccccaagaataacatcttccagaagaactagacagaaaactaggcgtctgggaactctgaaatccttggaggagtagcatcatcatgaccctctgtgttccttttggcaaaggacttgctcccattgtttgcttgttccattgtctgtctgttaaataaataaaacccttttcatatatctt

SEQ ID NO: 25804 - DNA, 571 bp, Homo sapiens
aaattagtaggtgcctgtcactcattcccatgcagaaggcatgctgaaaaccccagcccttcaaggggaagcaggggataaagggataagtctaagtagaatttttactgtagtttttattagtaaaaaagaatgatatatgtagcacaacaggaacagaagcgtatttaaagtcatctctagcttaccagaaacacccctaaaactgctggtttagattcattaatcaacctcatggtcctcagatgggttgtgactccctgttgcgtaaacacgaaccatgttacttcctggtcctcctgacctccactagctgatttcagcgaggatcaggagttaggtcgccagctgatctaaagcagcgagtcccaaagttcagccatttgtaaaccacctgcatggttttggaccaactcttgtgtcaccccatagtttctcagattttaatatgcatacaagtggcatgggatatgttgttcaaatgcggattctggttcagtagggagtgagaggggacaaagatccagtaccttttaacaaatgcccaggtgatgctgatggctctggccca

SEQ ID NO: 25805 - DNA, 660 bp, Homo sapiens
attctcaccgttcagaaaatattcctctgtacataccccagaggatgtctcaacaatcagaagtgaacacacagcatggctgggtctcgagggcatcacgctgagtgaaaaagccgctccgcagaggtcacacactggatgtttctaggtatgacagtcccagggaggagagattcgtgggtgcagggggagcatcaggatggggcgaaggggatgggcgggccacaaaggggagttctccttggtggtagcttgttctttatcttgtctgtggtggtggcttcatgaatctgcatgtggcagcattgcatagaaccacacacacacagagatgagctcgcgtgaaactggtgaacttggaatgggatctgtgggttgagccagtgtccattttctgattgtgacactgcactataattatgtaagatgttaccattagataaactgggtgtagggcataagacctctcagtatatttttgcaatttcctgggaatctacaatcatttcgaaataaaaactttccaaaaaattaatgtcctccttctaggaaaggattatacttccccacctcataagacttgctttggccaacaaaatgtgaaaggaggcagggtgctgtggttcatgcctgtaatcccaacactttgggaggccaagg

SEQ ID NO: 25806 - DNA, 736 bp, Homo sapiens
acttcagcctcccaaagagctgggattacaggcatgagccactgtgccagacagagatg[450 bp omitted]ttgctcttgttgcccaggctggagtgcagtggcacgatcttggctcactgcaatctccgccttctgggttcaagcgattctcctgcctaagcctcctgagtagctgggattacaggcgcacaccaccatgcccggctaacttttgtatttttagtagagaccgggtttcaccatgttggccaggctggtctcaaactcctgacctcaggtgatccacccacctcggc

SEQ ID NO: 25807 - DNA, 688 bp, Homo sapiens
atgtaatgctggaagatcttaaggactacatacattctagagatgacagtgttgttcaaagacagcctagtaagtaattggtagaaatgcccttataaaaaccattctcttgtcatctactgggactagggttttaaatacagcttttaaaaacaaaaacagggaataaaagcttttcaactcaaccacttctttgtaagacaaaactgaagtatctgtgtgcttccagaaagcttacagataaatgggtttcaagcacaagaatatgactagatttcagaaattaattattacagggagctattgatctactagcatcaaacaaaggcaagctctaattccacaggtaatacaatttagtgcaattaaagaaacacggcttgtatttttatgagggaattctgcagctagggattgtgactcctaaatcctcctctaaaagaaggcacttgccattaatcctaattcagtgctatccagttataaatggaatcttgagacaaaaccttaacaaagaaataacagtaatgatttccttagcagaagccgtatttgtacgcacaacattaaatcaagggctacaattcaagcacttttattcgtatcattggcctcttagatgatataagcatgaggtggggcctgtaatatttttttctgagtttcttctgcccaaaaatataatata

SEQ ID NO: 25808 - DNA, 266 bp, Homo sapiens
tcctggaaaagcaaaacccaatgccatggctgcctccctccggcagcaccagcacgagtgagccagatcctcacctttgatcatcaaggctgagaggtaatatctgaggtcgacagatcaagaagtagagacaaaagcaaaccaggctggtggtaaagaggaggaatgaccgtaagatgcctctgaaaagtgggaatatggggaatctcctcttggtttctggttgcacatgtgaatttattgaaaactgaatatattaagatgtg

SEQ ID NO: 25809 - DNA, 239 bp, Homo sapiens
aagaaaacatgcagtgtgttggagagaggtaggtgggacaacagtgaggagaccagagtttctggaacagaagactcccgtatgttagcagggggagtgaggtatattagaaaggctgggccgggtgcggtggctcacgcctgtaatcctagcactttgggaggccaaggtgggtggatcacgaggtcaggagttcgagaccagcctggccaagatggtgaaaccgtgtctgtacttaa

SEQ ID NO: 25810 - DNA, 476 bp, Homo sapiens
agcaccttgtgggatgaggagccgggcgcggtggctcacgagtgtcatccagtactttgagagaccaaggcagggggatcacctgaggtcaggaattcaagaccagcctggctaacatcacaaaacctcatctctacaaaaatataaaaattagccaggcatggtggcatgtgcttgtaatcccagctactcgggaggctgaatcatgagaatcacttgaacctggaaggcgagggctgcagtgagccaagcttgctccattgcactccatcctggatgaagagcgagaccctgtctcaaaaaaacaaaacaaaacaaaaaaagcaccagcacactgtggcatgaggggcgggattgtgaccacctctacctcccctcttagtgctcaccaagtctctgcagtagtgagcgtgtcctcatctcctgtcttctccctcagctactttgtctgcaactgctcctgttgtgtttgtcca

SEQ ID NO: 25811 - DNA, 4479 bp, Homo sapiens
gtgctcggggcttcactcccgcgcgtgaggcgagcgggcaagttggctgagggcgtgcggcagaggctgcttccctcggcgacgcgacccctcagcaactcaagctatgaactgaagctccctagggacggagaccggagcggagcggcggaggcagcagcagcagcagcagcagcagcagcagcagcagccgccgccgccgccgccttagcgggaactgagcagacccggcgcggagccacgactcctgcacgtttacctccctgtcgccgttcctgccggcggttggctaaaagacgttacagccgcgagacccgacacacaaaagccgctttctccgcgccgcccgcccagggaggctgcggccagcaagggaccccacctgagagcagctcgggctgctgagttcgttttgtgtctgagctctgcgctctgcacggaaccgaccccgtacccatggctctgataatggaaccggtgagcaaatggtctccgagtcaagtagtggactggatgaaaggtcttgatgactgtttgcagcagtatattaagaactttgagagggagaagatcagtggggaccagctgctgcgcattacacatcaggagctagaagatctgggggtcagccgcattggccatcaggaactgatcttggaagcagttgaccttctgtgtgcattgaattatggcttggaaacagaaaatctaaaaaccctttctcacaagttgaatgcatctgccaaaaatctgcagaattttataacaggaaggagaaggagtggccattatgatgggaggaccagccgaaaattgccaaacgactttctgacctcagttgtggatctgattggagcagccaagagtctgcttgcctggttggacaggtcaccatttgctgctgtgacagactattcagttacaagaaataatgtcatacaactctgcctggagttaacaacaattgtgcaacaggattgtactgtatatgaaacagagaataaaattcttcacgtgtgtaaaactctttctggagtctgtgaccacatcatatccctgtcgtcagatcctctggtttcacagtctgctcacctggaagtgattcagctggcaaacattaaaccaagcgaagggctgggtatgtatattaaatctacatatgatggcctccatgtaattactggaaccacagaaaattcacctgcagatcggtgcaagaaaatccatgctggcgatgaagtgattcaagttaatcatcagactgtggtggggtggcagttgaaaaatttggtgaatgcactacgagaggacccgagtggtgttatcttaactttgaaaaagcgacctcagagcatgcttacctcagcaccagctttactgaaaaatatgagatggaagccccttgctctgcagcctcttatacctagaagtcccacaagcagcgttgccacgccttccagcaccatcagtacacccaccaaaagagacagttctgccctccaggatctctacattccccctcctcctgcagaaccatatattcccagggatgaaaaaggaaaccttccttgtgaagacctcagaggacatatggtgggcaagccagtgcataagggatctgaatcaccaaattcatttctggatcaggaatatcgaaagagatttaatattgtcgaagaagatactgtcttatattgctatgaatatgaaaaaggaagatcaagtagtcaaggaagacgagaaagcaccccaacttatggcaagctacgacctatatctatgccagtggaatataattgggtgggggactatgaagatccaaataagatgaagagagatagtagaagagaaaactctctacttcggtatatgagcaatgaaaagattgctcaagaagaatacatgtttcagagaaacagcaaaaaggacacagggaagaagtcaaaaaagaagggtgataagagtaatagcccaactcactattcattgctacctagtttacaaatggatgcactgagacaagacatcatgggcactcctgtgccagagaccacactataccatacatttcagcagtcctcactgcagcacaaatcaaagaagaaaaacaaaggtcctatagcaggcaagagcaaaagacgaatttcttgcaaagatcttggccgtggtgactgtgagggctggctttggaaaaagaaagatgcgaagagttacttttcacagaaatggaaaaaatattggtttgtcctaaaggatgcatccctttattggtatattaatgaggaggatgaaaaagcagaaggattcattagcctgcctgaatttaaaattgatagagccagtgaatgccgcaaaaaatatgcattcaaagcctgtcatcctaaaatcaaaagcttttattttgctgctgaacatcttgatgatatgaacaggtggcttaacagaattaatatgctgactgcaggatatgcagaaagagagaggattaagcaggaacaagattactggagtgagagtgacaaggaagaagcagatactccatcaacaccaaaacaagatagccctccacccccatatgatacatacccacgacctccctcgatgagttgcgccagtccttatgtggaagcaaaacatagccgactttcctccacggagacttctcagtctcagtcttctcatgaggagtttcgccaggaagtaactgggagcagtgcagtgtctcccattcgcaagacagccagtcagcgccgctcctggcaggatttaattgagacgccactgacaagttcaggcttacactatcttcagactctgcccctggaggattctgtcttctctgactccgcggccatctccccagagcacaggcggcagtctaccctgccaactcagaaatgccacctgcaggatcactatgggccataccccttagctgagagtgagaggatgcaagtgctaaatggaaatgggggcaagcctcgaagttttactctgcctcgagatagcgggttcaaccattgctgtctgaatgctccagttagtgcctgtgacccacaggatgacgtgcaacccccagaggtggaggaagaggaggaggaggaggaggaggaaggggaggcagcaggggaaaacataggagaaaaaagctaatacactgcgagagttggtagaacctctccatgccaaatcggatccacttctgttggcactcaacccattggactcacagattgataagctaatgtttagagaatttagatcggagagagtcggtacggcgcagactcaacatcaacctcttgcaagcaactaaaatggcctcgtccttgctgtttataacagaaaacagacttgtaaaaagcttagatcatcaagtgttttggattgggggcctcccaaagggatataagaggggcaggccactcttaagaagaatgcgagctttctacattgggactagcataagatcaaagccaatcaagatggagcacagtaacagaaaactgcggtttctgtgggagaacagaaggggaaagggtcttaactgggaaagggctctgtgtggtaacacctcagttgtgttctcctgacaccaggaaaagagagggatcagcttcaataactagaaaattctggctgtttaatggactctttggtggcctctttaaggcaaagcagagaaagcaaattatgtattaagtgtattttgcatttttaaaacttgacgtgctgtattgtactaaattaagtgtaatctattaaggcaaggtatacacaatttgctttgaaacttactatgtttattctattataaagtgtattcaggtgcaacacagagactgctttcggtgacattaatgaagaaaatttctcatgccaggctttattatagaatcttcagctaaaatcctaactttctccttatttcttggcacttgtatacaagtggtgttgcctcttagggcaggcatgagctattcttttctgtaaaatattttgaatctataggctgtgggtttcatttttgaaaagtattttgtctggatgtctttcaaactagcttcagatattatttaatactatgtaactgggtcccctatggctcaatcaatattgcttatttttcttctgtagtggatgtgaaatttcctttagttggataagatacactgtaataattttaatgctaattaatgatatttcatactgtgcaatgaacagataatttaacactgtattttgaaatgtttttttcttcctgtcaccgcagtgtgtggtattgcataatgtgaatacctgtaaaaatataaattacttaaaaataaaaatatgaccaattggtatcagatcttttcagatagctaaataatttgctaagtatgcctgatagtaaatatctttctaaaaagaagtaatcagtgcttctttctcacaaatggaatttgtgtctgtgaataaaatcacattgatctgcct

SEQ ID NO: 25812 - DNA, 360 bp, Homo sapiens
gcatgatggtatttctaatacaaatactaatatgctttggaaataatggcactcgcaggtctttcatcatattgtatcactgctttatcatattaggctaatacactgcgagagttggtagaacctctccatgccaaatcggatccacttctgttggcactcaacccattggactcacagattgataagctaatgtttagagaatttagatcggagagagtcggtacggcgcagactcaacatcaacctcttgcaagcaactaaaatggcctcgtccttgctgtttataacagaaaacagacttgtaaaaagcttagatcatcaagtgttttggattgggggcctcccaaagggatataa

SEQ ID NO: 25813 - DNA, 525 bp, Homo sapiens
cacaagcaggatgtgcagaggatgcagggtttaggaaacagttgagagctaagggccagtgagtggaggaggggagttggagagtaggtccctgttgcaggagcactaatgccagagagggagactgcagcacagctgccatgggctgaggggggcggaactgccatgaggtgggtgtggaagcagggaacactcttgggggatgatacagtcccagagatcatcctctgtctgtgcctctctgagagaggcaatgtgccactctgtacctgacctgacttggctgggtcaatagaagaagctacttacgcttccttaccctcagttttctcatctgccaaatagggctaatcatagtgaccgtatgggtttgtaagaggatcaaatgaaaggaggcaagtaagtgtttcacagtgcctggtgcatcatcacttgataaataggtgcctgatgcatggtggagagcaggacacagggtcctttccctgcctcaggcacttcttccctgactgctgcttttgttgc

SEQ ID NO: 25814 - DNA, 417 bp, Homo sapiens
gtctatgtagaagatccaaaagaattgacaaactggaaccaataagcacaaggtagcaggatacaaggttaatatgcaaaagtagattatattcctatataccagcagtgaacaagtggaattctaaaattaaaaacacaataccattacattaatatctcccaaaataaatacttaggtataaatctaataaaatatatataaaatatgtacaaagaaaacttcaaaactctgataaacaagaactaaataacatgttcatggataggaagactatattaacaaggtgtcagttcttcacaattttatttgtagactgaatataattctagtcaaaattgcagtttgttgtagatattaacaaactgattccaataagtttatatggagaggcaaaagacccagaataggcaactt

SEQ ID NO: 25815 - DNA, 339 bp, Homo sapiens
ttcattataggattggagaagagagcttcatggttaacatggttacatctttctatattttactgcaattgcagaaaactgactagatattggggttctaattttctgtgtctaggccttttaattggctttccccaagtctgtcaacacagtatcagctactgactcgagaggtagaaaaataaaataaggccggccgagatggctcacgcctgtaatcctagcattttggtaggcggaggagggcggatcacctgaggtcgggagtttgagaccagcctggccatcatggtgaaaccccatctctactaaaaatacaaaaattagccgggtgtggtg

SEQ ID NO: 25816 - DNA, 733 bp, Homo sapiens
tacgcaaccccataaggtagcacgccgttacccgtggggagcgtttccgccatttttgaaaattaattgggaaggtactggttttaagtgtagttgccgacgcaatggcagcctttgcagtggaacctcaggggcccgcgttaggatctgaaccaatgatgctgggttcacccacatctccaaagccaggagttaatgcccagttcttacctggatttttaatgggggatttgccagctccggtgactccacaacctcgatcaattagtggcccttcagtaggagtaatggaaatgagatcacctttacttgcaggtgggtcaccaccacaaccagttgtaccagctcataaagataaaagtggcgctccaccagttagaagtatatatgatgacatttctagcccaggacttggatcaacacctttaacttcaagaagacagccaaacatttcagtaatgcagagtcctcttgttggagttacatctactcctggaacagggcaaagtatgtttagtccagcaagtatcggtcagccacgaaagacgacattatctcctgcccagttggatcctttttatactcaaggagattctttgactttcaagaaagaatcacccttcgaatgaacttcttgtgggtgtgaaccttgtaatttcgggggttttcccttccaagggcattcctgggctttccccttaaaccatttattttactcttaacaaaaattttg

SEQ ID NO: 25817 - DNA, 780 bp, Homo sapiens
tacgcaaccccataaggtagcacgccgttacccgtggggagcgtttccgccatttttgaaaattaattgggaaggtactggttttaagtgtagttgccgacgcaatggcagcctttgcagtggaacctcaggggcccgcgttaggatctgaaccaatgatgctgggttcacccacatctccaaagccaggagttaatgcccagttcttacctggatttttaatgggggatttgccagctccggtgactccacaacctcgatcaattagtggcccttcagtaggagtaatggaaatgagatcacctttacttgcaggtgggtcaccaccacaaccagttgtaccagctcataaagataaaagtggcgctccaccagttagaagtatatatgatgacatttctagcccaggacttggatcaacacctttaacttcaagaagacagggtccccaacagggtcctgctcagttgcccaggctagagtgcagcggcacagtcataactctgcagccttgaactcctgggttcaaccaatcctccctgtctcaaaaataaaataataaaaactaaaaaattaaaaaattgtttgttgcaagaaccactggcttctaaatttgtgcaaggttttattacttctctgatgatacagacaaaggcttacagatattgctgtattcaaaatgtttgaaagactcgtgggtcataatttatagagaatgtttttgatttgaaagttggtaagaatattattgctagattagagcccaaattagttatgccc

SEQ ID NO: 25818 - DNA, 1644 bp, Homo sapiens
tacgcaaccccataaggtagcacgccgttacccgtggggagcgtttccgccatttttgaaaattaattgggaaggtactggttttaagtgtagttgccgacgcaatggcagcctttgcagtggaacctcaggggcccgcgttaggatctgaaccaatgatgctgggttcacccacatctccaaagccaggagttaatgcccagttcttacctggatttttaatgggggatttgccagctccggtgactccacaacctcgatcaattagtggcccttcagtaggagtaatggaaatgagatcacctttacttgcaggtgggtcaccaccacaaccagttgtaccagctcataaagataaaagtggcgctccaccagttagaagtatatatgatgacatttctagcccaggacttggatcaacacctttaacttcaagaagacagccaaacatttcagtaatgcagagtcctcttgttggagttacatctactcctggaacagggcaaagtatgtttagtccagcaagtatcggtcagccacgaaagacgacattatctcctgcccagttggatcctttttatactcaaggagattctttgacttcagaagatcacctcgatgactcttgggtgactgtatttgggtttcctcaagcatctgcttcctacatattactacaatttgcacagtatgggaatatcttaaaacatgtgatgtctaatacaggaaattggatgcatattcgttatcaatctaaactgcaggctcggaaagccttaagcaaagatgggaggattttggagaatccatcatgattggtgtaaaaccatgtattgacaaaagtgttatggaaagcagtgacagatgtgctttatcatctccatctttagcctttacaccaccaatcaaaactctaggtacaccaacacaacctggaagtactcctaggatttctaccatgagacctcttgctacagcatacaaagcctctactagtgattatcaggttatttctgacagacaaacgccaaaaaaagatgaaagtcttgtatccaaagcaatggagtacatgtttggctggtagtagaacaccaagaaggaggttgctacactaaaacagagttagcagagtgctgctggttccttcggttagttatataactgttcctgcagtattggatagctatctcatacttcttttagaaagaagcctttttcattaaggatacaacctatttgtagctcgcactttaaaagatgcttgagatacattttaaagaaaactaaaaatccctgtaaataggattttgtgctttctgtaacagtgcatgcttcagcacagaaaactcagcattgattattgtaaattaaataactgaaattgtggtgagacgtcatagtcttcatgagaacgtgggggtgaatttcatgaaggggaactatagttatttctaccgacacaaatattataattagcaatttgaattatggtcttttaatttagatagtatttaatattttaattatccttgtttgtatatgtcctgtcacagagtgtcctcttggtgtattctaaaacgagcattcttttaaaaaacctaaagtttcttgataataaacattgtcaatgataaaaaaaaaaaa

SEQ ID NO: 25819 - DNA, 1378 bp, Homo sapiens
  misc_feature (1286)..(1286): n is a, c, g, or t
  misc_feature (1289)..(1289): n is a, c, g, or t
  misc_feature (1291)..(1291): n is a, c, g, or t
  misc_feature (1298)..(1298): n is a, c, g, or t
tacgcaaccccataaggtagcacgccgttacccgtggggagcgtttccgccatttttgaaaattaattgggaaggtactggttttaagtgtagttgccgacgcaatggcagcctttgcagtggaacctcaggggcccgcgttaggatctgaaccaatgatgctgggttcacccacatctccaaagccaggagttaatgcccagttcttacctggatttttaatgggggatttgccagctccggtgactccacaacctcgatcaattagtggcccttcagtaggagtaatggaaatgagatcacctttacttgcaggtgggtcaccaccacaaccagttgtaccagctcataaagataaaagtggcgctccaccagttagaagtatatatgatgacatttctagcccaggacttggatcaacacctttaacttcaagaagacagccaaacatttcagtaatgcagagtcctcttgttggagttacatctactcctggaacagggcaaagtatgtttagtccagcaagtatcggtcagccacgaaagacgacattatctcctgcccagttggatcctttttatactcaaggagattctttgacttcagaagatcacctcgatgactcttgggtgactgtatttgggtttcctcaagcatctgcttcctacatattactacaatttgcacagtatgggaatatcttaaaacatgtgatgtctaatacaggaaattggatgcatattcgttatcaatctaaactgcaggctcggaaagccttaagcaaagatgggaggattttggagaatccatcatgattggtgtaaaaccatgtattgacaaaagtgttatggaaagcagtgacagatgtgctttatcatctccatctttagcctttacaccaccaatcaaaactctaggtacaccaacacaacctggaagtactcctaggatttctaccatgagacctcttgctacagcatacaaagcctctactagtgattatcaggttatttctgacagacaaacgccaaaaaaagatgaaagtcttgtatccaaagcaatggagtacatgtttggctggtagtagaacaccaagaaggaggttgctacactaaaacagagttagcagagtgctgctggttccttcggttagttatataactgttcctgcagtattggatagctatctcatacttcttttagaaagaagcctttttcattaaggatacaacctatttgtagctcgcactttaaaagatgcttgagatacattttaagaactaaanccngnaaagggntgggtctggacgggtggtccgaaaccgtgtttggataaaacgcaggggggggcatcaaaggggggcagggatttcccata

SEQ ID NO: 25820 - DNA, 1914 bp, Homo sapiens
aattttatatctctcccaacattctctcagcatttagttctggttgctaaatgaagctatttgagatttccttagtttaattagaatctgttttaaaaaatctttattgagttctagagagattctgttctcatttattgattggatattgtctttgttttagaaggattttaaactattttaatccttaattttcttatatttaaaggaactaaaatggataatttaccagttttggaactttctactggtagtggtagggatatgctgtcttttattgtttagactgatttgaatctatagtgtttcatggtttctaagtatctgttgaaaatcaaattttgtcacccttctgtttttctgtatgaacctggtcattttaaaaattaccattatctctgttatttcaaatattgtacattagaaactaaaaacaaatagttaacatgtcaccttttacagaagatagtctttttttttttttttaacataatatgacttttcttattttaaacaaatactaagggatctagtaaattttaggttaatactgtttaacttatggggaaaaaagagtgcctttgtactttgagctaattagaggcatctctagcacatgataaaaattcagttatccattgaatgaagccttttaacacttactgtatttatgttttgcatttttaccataacactttcttctgtttgtgtagccaaacatttcagtaatgcagagtcctcttgttggagttacatctactcctggaacagggcaaagtatgtttagtccagcaagtatcggtcagccacgaaagacgacattatctcctgcccagttggatcctttttatactcaaggagattctttgacttcagaagatcacctcgatgactcttgggtgactgtatttgggtttcctcaagcatctgcttcctacatattactacaatttgcacagtatgggaatatcttaaaacatgtgatgtctaatacaggaaattggatgcatattcgttatcaatctaaactgcaggctcggaaagccttaagcaaagatgggaggattttggagaatccatcatgattggtgtaaaaccatgtattgacaaaagtgttatggaaagcagtgacagatgtgctttatcatctccatctttagcctttacaccaccaatcaaaactctaggtacaccaacacaacctggaagtactcctaggatttctaccatgagacctcttgctacagcatacaaagcctctactagtgattatcaggttatttctgacagacaaacgccaaaaaaagatgaaagtcttgtatccaaagcaatggagtacatgtttggctggtagtagaacaccaagaaggaggttgctacactaaaacagagttagcagagtgctgctggttccttcggttagttatataactgttcctgcagtattggatagctatctcatacttcttttagaaagaagcctttttcattaaggatacaacctatttgtagctcgcactttaaaagatgcttgagatacattttaaagaaaactaaaaatccctgtaaataggattttgtgctttctgtaacagtgcatgcttcagcacagaaaactcagcattgattattgtaaattaaataactgaaattgtggtgagacgtcatagtcttcatgagaacgtgggggtgaatttcatgaaggggaactatagttatttctaccgacacaaatattataattagcaatttgaattatggtcttttaatttagatagtatttaatattttaattatccttgtttgtatatgtcctgtcacagagtgtcctcttggtgtattctaaaacgagcattcttttaaaaaacctaaagtttcttgataataaacattgtcaatgataaaaaaaaaaaa

SEQ ID NO: 25821 - DNA, 1598 bp, Homo sapiens
tacgcaaccccataaggtagcacgccgttacccgtggggagcgtttccgccatttttgaaaattaattgggaaggtactggttttaagtgtagttgccgacgcaatggcagcctttgcagtggaacctcaggggcccgcgttaggatctgaaccaatgatgctgggttcacccacatctccaaagccaggagttaatgcccagttcttacctggatttttaatgggggatttgccagctccggtgactccacaacctcgatcaattagtggcccttcagtaggagtaatggaaatgagatcacctttacttgcaggtgggtcaccaccacaaccagttgtaccagctcataaagataaaagtggcgctccaccagttagaagtatatatgatgacatttctagcccaggacttggatcaacacctttaacttcaagaagacagccaaacatttcagtaatgcagagtcctcttgttggagttacatctactcctggaacagggcaaagtatgtttagtccagcaagtatcggtcagccacgaaagacgacattatctcctgcccagttggatcctttttatactcaaggagattctttgacttcagaagatcacctcgatgactcttgggtgactgtatttgggtttcctcaagcatctgcttcctacatattactacaatttgcacagtatgggaatatcttaaaacatgtgtgcaggctcggaaagccttaagcaaagatgggaggattttggagaatccatcatgattggtgtaaaaccatgtattgacaaaagtgttatggaaagcagtgacagatgtgctttatcatctccatctttagcctttacaccaccaatcaaaactctaggtacaccaacacaacctggaagtactcctaggatttctaccatgagacctcttgctacagcatacaaagcctctactagtgattatcaggttatttctgacagacaaacgccaaaaaaagatgaaagtcttgtatccaaagcaatggagtacatgtttggctggtagtagaacaccaagaaggaggttgctacactaaaacagagttagcagagtgctgctggttccttcggttagttatataactgttcctgcagtattggatagctatctcatacttcttttagaaagaagcctttttcattaaggatacaacctatttgtagctcgcactttaaaagatgcttgagatacattttaaagaaaactaaaaatccctgtaaataggattttgtgctttctgtaacagtgcatgcttcagcacagaaaactcagcattgattattgtaaattaaataactgaaattgtggtgagacgtcatagtcttcatgagaacgtgggggtgaatttcatgaaggggaactatagttatttctaccgacacaaatattataattagcaatttgaattatggtcttttaatttagatagtatttaatattttaattatccttgtttgtatatgtcctgtcacagagtgtcctcttggtgtattctaaaacgagcattcttttaaaaaacctaaagtttcttgataataaacattgtcaatgataaaaaaaaaaaa

SEQ ID NO: 25822 - DNA, 1502 bp, Homo sapiens
tacgcaaccccataaggtagcacgccgttacccgtggggagcgtttccgccatttttgaaaattaattgggaaggtactggttttaagtgtagttgccgacgcaatggcagcctttgcagtggaacctcaggggcccgcgttaggatctgaaccaatgatgctgggttcacccacatctccaaagccaggagttaatgcccagttcttacctggatttttaatgggggatttgccagctccggtgactccacaacctcgatcaattagtggcccttcagtaggagtaatggaaatgagatcacctttacttgcaggtgggtcaccaccacaaccagttgtaccagctcataaagataaaagtggcgctccaccagttagaagtatatatgatgacatttctagcccaggacttggatcaacacctttaacttcaagaagacagccaaacatttcagtaatgcagagtcctcttgttggagttacatctactcctggaacaggtttcctcaagcatctgcttcctacatattactacaatttgcacagtatgggaatatcttaaaacatgtgatgtctaatacaggaaattggatgcatattcgttatcaatctaaactgcaggctcggaaagccttaagcaaagatgggaggattttggagaatccatcatgattggtgtaaaaccatgtattgacaaaagtgttatggaaagcagtgacagatgtgctttatcatctccatctttagcctttacaccaccaatcaaaactctaggtacaccaacacaacctggaagtactcctaggatttctaccatgagacctcttgctacagcatacaaagcctctactagtgattatcaggttatttctgacagacaaacgccaaaaaaagatgaaagtcttgtatccaaagcaatggagtacatgtttggctggtagtagaacaccaagaaggaggttgctacactaaaacagagttagcagagtgctgctggttccttcggttagttatataactgttcctgcagtattggatagctatctcatacttcttttagaaagaagcctttttcattaaggatacaacctatttgtagctcgcactttaaaagatgcttgagatacattttaaagaaaactaaaaatccctgtaaataggattttgtgctttctgtaacagtgcatgcttcagcacagaaaactcagcattgattattgtaaattaaataactgaaattgtggtgagacgtcatagtcttcatgagaacgtgggggtgaatttcatgaaggggaactatagttatttctaccgacacaaatattataattagcaatttgaattatggtcttttaatttagatagtatttaatattttaattatccttgtttgtatatgtcctgtcacagagtgtcctcttggtgtattctaaaacgagcattcttttaaaaaacctaaagtttcttgataataaacattgtcaatgataaaaaaaaaaaa

SEQ ID NO: 25823 - DNA, 1625 bp, Homo sapiens
tacgcaaccccataaggtagcacgccgttacccgtggggagcgtttccgccatttttgaaaattaattgggaaggtactggttttaagtgtagttgccgacgcaatggcagcctttgcagtggaacctcaggggcccgcgttaggatctgaaccaatgatgctgggttcacccacatctccaaagccaggagttaatgcccagttcttacctggatttttaatgggggatttgccagctccggtgactccacaacctcgatcaattagtggcccttcagtaggagtaatggaaatgagatcacctttacttgcaggtgggtcaccaccacaaccagttgtaccagctcataaagataaaagtggcgctccaccagttagaagtatatatgatgacatttctagcccaggacttggatcaacacctttaacttcaagaagacagggtccccaacagggtcctgctcagttgcccaggctagagtgcagcggcacagtcataactctgcagccttgaactcctgggttcaaccaatcctcctgcctcaactgtcctattgggatatagccaaacatttcagtaatgcagagtcctcttgttggagttacatctactcctggaacaggtttcctcaagcatctgcttcctacatattactacaatttgcacagtatgggaatatcttaaaacatgtgatgtctaatacaggaaattggatgcatattcgttatcaatctaaactgcaggctcggaaagccttaagcaaagatgggaggattttggagaatccatcatgattggtgtaaaaccatgtattgacaaaagtgttatggaaagcagtgacagatgtgctttatcatctccatctttagcctttacaccaccaatcaaaactctaggtacaccaacacaacctggaagtactcctaggatttctaccatgagacctcttgctacagcatacaaagcctctactagtgattatcaggttatttctgacagacaaacgccaaaaaaagatgaaagtcttgtatccaaagcaatggagtacatgtttggctggtagtagaacaccaagaaggaggttgctacactaaaacagagttagcagagtgctgctggttccttcggttagttatataactgttcctgcagtattggatagctatctcatacttcttttagaaagaagcctttttcattaaggatacaacctatttgtagctcgcactttaaaagatgcttgagatacattttaaagaaaactaaaaatccctgtaaataggattttgtgctttctgtaacagtgcatgcttcagcacagaaaactcagcattgattattgtaaattaaataactgaaattgtggtgagacgtcatagtcttcatgagaacgtgggggtgaatttcatgaaggggaactatagttatttctaccgacacaaatattataattagcaatttgaattatggtcttttaatttagatagtatttaatattttaattatccttgtttgtatatgtcctgtcacagagtgtcctcttggtgtattctaaaacgagcattcttttaaaaaacctaaagtttcttgataataaacattgtcaatgataaaaaaaaaaaa

SEQ ID NO: 25824 - DNA, 1374 bp, Homo sapiens
tacgcaaccccataaggtagcacgccgttacccgtggggagcgtttccgccatttttgaaaattaattgggaaggtactggttttaagtgtagttgccgacgcaatggcagcctttgcagtggaacctcaggggcccgcgttaggatctgaaccaatgatgctgggttcacccacatctccaaagccaggagttaatgcccagttcttacctggatttttaatgggggatttgccagctccggtgactccacaacctcgatcaattagtggcccttcagtaggagtaatggaaatgagatcacctttacttgcaggtgggtcaccaccacaaccagttgtaccagctcataaagataaaagtggcgctccaccagttagaagtatatatgatgacatttctagcccaggacttggatcaacacctttaacttcaagaagacagatgtctaatacaggaaattggatgcatattcgttatcaatctaaactgcaggctcggaaagccttaagcaaagatgggaggattttggagaatccatcatgattggtgtaaaaccatgtattgacaaaagtgttatggaaagcagtgacagatgtgctttatcatctccatctttagcctttacaccaccaatcaaaactctaggtacaccaacacaacctggaagtactcctaggatttctaccatgagacctcttgctacagcatacaaagcctctactagtgattatcaggttatttctgacagacaaacgccaaaaaaagatgaaagtcttgtatccaaagcaatggagtacatgtttggctggtagtagaacaccaagaaggaggttgctacactaaaacagagttagcagagtgctgctggttccttcggttagttatataactgttcctgcagtattggatagctatctcatacttcttttagaaagaagcctttttcattaaggatacaacctatttgtagctcgcactttaaaagatgcttgagatacattttaaagaaaactaaaaatccctgtaaataggattttgtgctttctgtaacagtgcatgcttcagcacagaaaactcagcattgattattgtaaattaaataactgaaattgtggtgagacgtcatagtcttcatgagaacgtgggggtgaatttcatgaaggggaactatagttatttctaccgacacaaatattataattagcaatttgaattatggtcttttaatttagatagtatttaatattttaattatccttgtttgtatatgtcctgtcacagagtgtcctcttggtgtattctaaaacgagcattcttttaaaaaacctaaagtttcttgataataaacattgtcaatgataaaaaaaaaaaa

SEQ ID NO: 25825 - DNA, 1946 bp, Homo sapiens
  misc_feature (1615)..(1615): n is a, c, g, or t
  misc_feature (1857)..(1858): n is a, c, g, or t
  misc_feature (1917)..(1917): n is a, c, g, or t
acgcgggtttttaaggccgaaccctaggcaggctctgcagaggcagcggttggaggcgcggtgggtgtctgcgggggtctcgcggggcggctgcggtgtttcaccgggaaaggctcgaggagagcgcggctcacgagagataacccagctgtgctccctggaaccttcaatttcaaggcctccctgcctctactaggcgccttagctcactatggggaaccacttgactgagatggcgcccactgcctcctccttcttgccccacttccaagccctgcatgtcgtggtcattgggctggactctgctggaaagacctccctcctttaccgcctcaagttcaaggagtttgtccagagtgtccccaccaaaggcttcaacaccgagaagatccgggtgcccctcgggggatcgcgtggcatcaccttccaagtgtgggacgtcggggggcaggagaagctgcgaccactgtggcgctcttatacccgccggacagacggtctagtgtttgtggtggacgctgcggaggctgagcggctggaggaagccaaggtggagttgcaccgaatcagccgggcctcggacaaccagggcgtgccagtgctggtgctggccaacaagcaggaccagcccggggcactgagcgctgctgaggtggagaagaggctggcagtccgagagctagcagccgccactctcactcatgtgcaaggctgcagcgctgtggacggtctgggcctgcagcagggccttgagcgcctctatgagatgatcctcaagaggaagaaggcagctcggggtggcaagaagagacggtgacccaagccccccctccctttcctcccacctagtaggggtctgcacacttggacagcagggtgggaccagcctgtgacctctcagtcagactggggtgcaggacctgtccacctcaatgaaggagagaggagcatggggtgtcccgttttggtgccacactggggtggggatgggagatgggatgtctttgcatatctctctcatcctctctggagaagtgggcgctgcaggactgtggagacgtaaatgtaaactgtgactctacctcgaccctgtttcttatttttcttctctggctaaaaatttttaattggatgtgtttgggggcggggggatggaagtgacttggagaatgtgtttgggatgaaataactatctccccttcctctgtcccccaactggggagtctccccaggctgcttttctaggaataccagtcacatagtttttatttttgtgtctgtgaaagtgccaagaacccctccccacatttgtagatccatgaccctttttataagctgtgtgtgtcctctgtattattgttattaactattttttagcatttgcctgtaagttattaaagactgataactgtagctcttaccttggtctggggcattttcctctccttatcttgccccagagacaattcaagatttctatatggggttgtggcgcagggggagggagatttatcttgaagctgaatttgcaaagcaagcacttataaaaattagattgtgtgttacgggatggcttgtgaaaattataggggggagtggaaaacccctcaagctnccgtcaaagaagttgatattttaacagagtacagagtcctcaattccttaaaactcggcaaaataagccagacaacaggaatgtgcagctactatgaaatgctccaagcaggatggatgccttcatgcatgccaaatccagagaccaaaagctatcaggtcactaaaactgaaaactgaccagtgtctaatcctttcctcctctttcagcaactacagactgagttacctagggaaaacaanncaaaatacgatgtctctttgaagtcctcagattcaggtactgtttttccaccgtcacanagtttgatgttgtagaatggttcttaccg

SEQ ID NO: 25826 - DNA, 1934 bp, Homo sapiens
  misc_feature (1603)..(1603): n is a, c, g, or t
  misc_feature (1845)..(1846): n is a, c, g, or t
  misc_feature (1905)..(1905): n is a, c, g, or t
cataggctaggtagaggcccgtggttatcggcagcggttggaggcgcggtgggtgtctgcgggggtctcgcggggcggctgcggtgtttcaccgggaaaggctcgaggagagcgcggctcacgagagataacccagctgtgctccctggaaccttcaatttcaaggcctccctgcctctactaggcgccttagctcactatggggaaccacttgactgagatggcgcccactgcctcctccttcttgccccacttccaagccctgcatgtcgtggtcattgggctggactctgctggaaagacctccctcctttaccgcctcaagttcaaggagtttgtccagagtgtccccaccaaaggcttcaacaccgagaagatccgggtgcccctcgggggatcgcgtggcatcaccttccaagtgtgggacgtcggggggcaggagaagctgcgaccactgtggcgctcttatacccgccggacagacggtctagtgtttgtggtggacgctgcggaggctgagcggctggaggaagccaaggtggagttgcaccgaatcagccgggcctcggacaaccagggcgtgccagtgctggtgctggccaacaagcaggaccagcccggggcactgagcgctgctgaggtggagaagaggctggcagtccgagagctagcagccgccactctcactcatgtgcaaggctgcagcgctgtggacggtctgggcctgcagcagggccttgagcgcctctatgagatgatcctcaagaggaagaaggcagctcggggtggcaagaagagacggtgacccaagccccccctccctttcctcccacctagtaggggtctgcacacttggacagcagggtgggaccagcctgtgacctctcagtcagactggggtgcaggacctgtccacctcaatgaaggagagaggagcatggggtgtcccgttttggtgccacactggggtggggatgggagatgggatgtctttgcatatctctctcatcctctctggagaagtgggcgctgcaggactgtggagacgtaaatgtaaactgtgactctacctcgaccctgtttcttatttttcttctctggctaaaaatttttaattggatgtgtttgggggcggggggatggaagtgacttggagaatgtgtttgggatgaaataactatctccccttcctctgtcccccaactggggagtctccccaggctgcttttctaggaataccagtcacatagtttttatttttgtgtctgtgaaagtgccaagaacccctccccacatttgtagatccatgaccctttttataagctgtgtgtgtcctctgtattattgttattaactattttttagcatttgcctgtaagttattaaagactgataactgtagctcttaccttggtctggggcattttcctctccttatcttgccccagagacaattcaagatttctatatggggttgtggcgcagggggagggagatttatcttgaagctgaatttgcaaagcaagcacttataaaaattagattgtgtgttacgggatggcttgtgaaaattataggggggagtggaaaacccctcaagctnccgtcaaagaagttgatattttaacagagtacagagtcctcaattccttaaaactcggcaaaataagccagacaacaggaatgtgcagctactatgaaatgctccaagcaggatggatgccttcatgcatgccaaatccagagaccaaaagctatcaggtcactaaaactgaaaactgaccagtgtctaatcctttcctcctctttcagcaactacagactgagttacctagggaaaacaanncaaaatacgatgtctctttgaagtcctcagattcaggtactgtttttccaccgtcacanagtttgatgttgtagaatggttcttaccg

SEQ ID NO: 25827 - DNA, 995 bp, Homo sapiens
acgcgggtttttaaggccgaaccctaggcaggctctgcagaggcagcggttggaggcgcggtgggtgtctgcgggggtctcgcggggcggctgcggtgtttcaccgggaaaggctcgaggagagcgcggctcacgagagataacccagctgtgctccctggaaccttcaatttcaaggcctccctgcctctactaggcgccttagctcactatggggaaccacttgactgagatggcgcccactgcctcctccttcttgccccacttccaagccctgcatgtcgtggtcattgggctggactctgctggaaagacctccctcctttaccgcctcaagttcaaggagtttgtccagagtgtccccaccaaaggcttcaacaccgagaagatccgggtgcccctcgggggatcgcgtggcatcaccttcctagtaggggtctgcacacttggacagcagggtgggaccagcctgtgacctctcagtcagactggggtgcaggacctgtccacctcaatgaaggagagaggagcatggggtgtcccgttttggtgccacactggggtggggatgggagatgggatgtctttgcatatctctctcatcctctctggagaagtgggcgctgcaggactgtggagacgtaaatgtaaactgtgactctacctcgaccctgtttcttatttttcttctctggctaaaaatttttaattggatgtgtttgggggcggggggatggaagtgacttggagaatgtgtttgggatgaaataactatctccccttcctctgtcccccaactggggagtctccccaggctgcttttctaggaataccagtcacatagtttttatttttgtgtctgtgaaagtgccaagaacccctccccacatttgtagatccatgaccctttttataagctgtgtgtgtcctctgtattattgttattaactattttttagcatttgcctgtaagttattaaagactgataactgta

SEQ ID NO: 25828 - DNA, 1893 bp, Homo sapiens
  misc_feature (4)..(4): n is a, c, g, or t
  misc_feature (1562)..(1562): n is a, c, g, or t
  misc_feature (1804)..(1805): n is a, c, g, or t
  misc_feature (1864)..(1864): n is a, c, g, or t
cggncggtcttaagctgttcttgcataggctcttaagcagcatggaaaaatggttgatggaaaataaagagcgcggctcacgagagataacccagctgtgctccctggaaccttcaatttcaaggcctccctgcctctactaggcgccttagctcactatggggaaccacttgactgagatggcgcccactgcctcctccttcttgccccacttccaagccctgcatgtcgtggtcattgggctggactctgctggaaagacctccctcctttaccgcctcaagttcaaggagtttgtccagagtgtccccaccaaaggcttcaacaccgagaagatccgggtgcccctcgggggatcgcgtggcatcaccttccaagtgtgggacgtcggggggcaggagaagctgcgaccactgtggcgctcttatacccgccggacagacggtctagtgtttgtggtggacgctgcggaggctgagcggctggaggaagccaaggtggagttgcaccgaatcagccgggcctcggacaaccagggcgtgccagtgctggtgctggccaacaagcaggaccagcccggggcactgagcgctgctgaggtggagaagaggctggcagtccgagagctagcagccgccactctcactcatgtgcaaggctgcagcgctgtggacggtctgggcctgcagcagggccttgagcgcctctatgagatgatcctcaagaggaagaaggcagctcggggtggcaagaagagacggtgacccaagccccccctccctttcctcccacctagtaggggtctgcacacttggacagcagggtgggaccagcctgtgacctctcagtcagactggggtgcaggacctgtccacctcaatgaaggagagaggagcatggggtgtcccgttttggtgccacactggggtggggatgggagatgggatgtctttgcatatctctctcatcctctctggagaagtgggcgctgcaggactgtggagacgtaaatgtaaactgtgactctacctcgaccctgtttcttatttttcttctctggctaaaaatttttaattggatgtgtttgggggcggggggatggaagtgacttggagaatgtgtttgggatgaaataactatctccccttcctctgtcccccaactggggagtctccccaggctgcttttctaggaataccagtcacatagtttttatttttgtgtctgtgaaagtgccaagaacccctccccacatttgtagatccatgaccctttttataagctgtgtgtgtcctctgtattattgttattaactattttttagcatttgcctgtaagttattaaagactgataactgtagctcttaccttggtctggggcattttcctctccttatcttgccccagagacaattcaagatttctatatggggttgtggcgcagggggagggagatttatcttgaagctgaatttgcaaagcaagcacttataaaaattagattgtgtgttacgggatggcttgtgaaaattataggggggagtggaaaacccctcaagctnccgtcaaagaagttgatattttaacagagtacagagtcctcaattccttaaaactcggcaaaataagccagacaacaggaatgtgcagctactatgaaatgctccaagcaggatggatgccttcatgcatgccaaatccagagaccaaaagctatcaggtcactaaaactgaaaactgaccagtgtctaatcctttcctcctctttcagcaactacagactgagttacctagggaaaacaanncaaaatacgatgtctctttgaagtcctcagattcaggtactgtttttccaccgtcacanagtttgatgttgtagaatggttcttaccg

SEQ ID NO: 25829 - DNA, 1413 bp, Homo sapiens
acgcgggtttttaaggccgaaccctaggcaggctctgcagaggcagcggttggaggcgcggtgggtgtctgcgggggtctcgcggggcggctgcggtgtttcaccgggaaaggctcgaggagagcgcggctcacgagagataacccagctgtgctccctggaaccttcaatttcaaggcctccctgcctctactaggcgccttagctcactatggggaaccacttgactgagatggcgcccactgcctcctccttcttgccccacttccaagccctgcatgtcgtggtcattgggctggactctgctggaaagacctccctcctttaccgcctcaagttcaaggagtttgtccagagtgtccccaccaaaggcttcaacaccgagaagatccgggtgcccctcgggggatcgcgtggcatcaccttccaagtgtgggacgtcggggggcaggagaagctgcgaccactgtggcgctcttatacccgccggacagacggtctagtgtttgtggtggacgctgcggaggctgagcggctggaggaagccaaggtggagttgcaccgaatcagccgggcctcggacaaccagggcgtgccagtgctggtgctggccaacaagcaggaccagcccggggcactgagcgctgctgaggtggagaagaggctggcagtccgagagctagcagccgccactctcactcatgtgcaaggctgcagcgctgtggacggtctgggcctgcagcagggccttgagcgcctctatgagatgatcctcaagaggaagaaggcagctcggggtggcaagaagagacggtgacccaagccccccctccctttcctcccacctagtaggggtctgcacacttggacagcagggtgggaccagcctgtgacctctcagtcagactggggtgcaggacctgtccacctcaatgaaggagagaggagcatggggtgtcccgttttggtgccacactggggtggggatgggagatgggatgtctttgcatatctctctcatcctctctggagaagtgggcgctgcaggactgtggagacgtaaatgtaaactgtgactctacctcgaccctgtttcttatttttcttctctggctaaaaatttttaattggatgtgtttgggggcggggggatggaagtgacttggagaatgtgtttgggatgaaataactatctccccttcctctgtcccccaactggggagtctccccaggctgcttttctaggaataccagtcacatagtttttatttttgtgtctgtgaaagtgccaagaacccctccccacatttgtagatccatgaccctttttataagctgtgtgtgtcctctgtattattgttattaactattttttagcatttgcctgtaagttattaaagactgataactgta

SEQ ID NO: 25830 - DNA, 1078 bp, Homo sapiens
acgcgggtttttaaggccgaaccctaggcaggctctgcagaggcagcggttggaggcgcggtgggtgtctgcgggggtctcgcggggcggctgcggtgtttcaccgggaaaggctcgaggagagcgcggctcacgagagataacccagctgtgctccctggaaccttcaatttcaaggcctccctgcctctactaggcgccttagctcactatggggaaccacttgactgagatggcgcccactgcctcctccttcttgccccacttccaagccctgcatgtcgtggtcattgggctggactctgctggaaagacctccctcctttaccgcctcaagttcaaggagtttgtccagagtgtccccaccaaaggcttcaacaccgagaagatccgggtgcccctcgggggatcgcgtggcatcaccttccaagtgtgggacgtcggggggcaggagaagctgcgaccactgtggcgctcttatacccgccggacagacggtctagtgtttgtggtggacgctgcggaggctgagcggctggaggaagccaaggtggagttgcaccgaatcagccgggcctcggacaaccagggcgtgccagtgctggtgctggccaacaagcaggaccagcccggggcactgagcgctgctgaggtggagaagaggctggcagtccgagagctagcagccgccactctcactcatgtgcaaggctgcagcgctgtggacggtctgggcctgcagcagggccttgagcgcctctatgagatgatcctcaagaggaagaaggcagctcggggtggcaagaagagacggtgacccaagccccccctccctttcctcccacctagtaggggtctgcacacttggacagcagggtgggaccagcctgtgacctctcagtcagactggggtgcaggacctgtccacctcaatgaaggagagaggagcatggggtgtcccgttttggtgccacactggggtggggatgggaatacggattttaaaacttttttggggttttagaccaacatttaaaattggtgaaaaccgttttaactaaaaaaacttaaccggtta

SEQ ID NO: 25831 - DNA, 583 bp, Homo sapiens
ttttaaacatatgagttagatgtgtgctgtttattttcttttattgcttacaactaaacttggtagtttatggagtattttctaagactgttatttataaaatgtaataaaaccaaattattcatatatttttatattaaaccctctcagataattctgttaatatgatgagaactggaaatatagacctcttaaacatttttgttttttcttgataggaagaagaaaagaagtcggtcagttatccttctctccttagccacataacttcttctctcatgaatcatccagtcattccaatggcaaataagttctcctcacctacccttgagctgcaaggtgaattctctccattacagtcatctttgccttgtgacattcatctggttaatttgagaacaatacagtcaaaggtgggcaatgggcactccaatgaggcagccttgatcctccacagaaaagggtttgattgtcggttctctagcaaaggcacagggctgttttgttctactactcagggaaaggtaagttgaaaaggttatttttgcttactgttagtgtgctttgaaatcctctttctgca

SEQ ID NO: 25832 - DNA, 7972 bp, Homo sapiens
ggcggggccagccgcccgctcggctcaggcgctgcgggcgcctattgacccagcggctgctgcgccgccgctgtctcctcctgctcgtggcgggcggtgctggagcgccaagtggcgctggagaaccggcgcttcctttcgccgcttccgccgccatctccgcgtttgtggggcgggaaagagggagggggctagcggctgcagctggagcgggcttctctccggggacggtcctttcctccctgctctccttttccttctttccgcgttgccgccgcccgccccctgcgcctccccgcggagcctgggtccgggagggggaaggtaggggcggcggggggcgggagagtctggcgagcggacgctagctctgaggaaactcatcaatccgtgagccccggagtccggggtgcacatcggcccagccgcagcgtcggcggcggcggcggcagcagcacgaaggggctcagtcggggtaggcgggggcggtgccggtgccgcgggggcgggcccgaccgtcccgcccagaagttgtagggcttggctcctcgcgatcttgttcctttcccctccgcttctctgacctagctgcgcggccccggcccgggagctgccgaacccgcgcctcccctgggtgaggaggacacgcctgccctcgtcgagaaaacttttcctgccgactcagttggggcggcggtggcaggaagtgcgggcagcgacctctcctccgcctgccccgcgcgccctgccggaggtcggcgctgagcttgcgatcaagtttgtgggggccccccttcccagttgccggcgagtctcgcctcgagaggggcgcccgaccccggggagggcggcaggccagggcgaaggccaagggcgttttgtggcgccggagactaggtgcggagcaaggcggggactcgcacccgcatccgagagcgcggaggtcgcgcagcccgggagaagggagcctccggcggctgcttcctagagtccacagtgcgctgtctcctttggctgaggagagtgtcctggccccgagtctatcgaggaaaatgaagttaagccgccagttcaccgtgttcggcagtgcgatcttctgtgtggtgattttctcgctctacctgatgctggaccggggtcacttagactaccccaggaacccgcgccgcgagggctccttccctcagggccagctctcaatgttgcaagaaaaaatagaccatttggagcgtttgctagctgagaataatgagatcatctcaaatattagagactcagtcatcaatttgagtgagtctgtggaggatggtccgaaaagttcacaaagcaatttcagccaaggtgctggctcacatcttctgccctcacaattatccctctcagttgacactgcagactgtctgtttgcttcacaaagtggaagtcacaattcagatgtgcagatgttggatgtttacagtctaatttcttttgacaatccagatggtggagtttggaagcaaggatttgacattacttatgaatctaatgaatgggacactgaaccccttcaagtctttgtggtgcctcattcccataacgacccaggttggttgaagactttcaatgactactttagagacaagactcagtatatttttaataacatggtcctaaagctgaaagaagactcacggaggaagtttatttggtctgagatctcttacctttcaaagtggtgggatattatagatattcagaagaaggatgctgttaaaagtttaatagaaaatggtcagcttgaaattgtgacaggtggctgggttatgcctgatgaagctactccacattattttgccttaattgatcaactaattgaaggacatcagtggctggaaaataatataggagtgaaacctcggtccggctgggctattgatccctttggacactcaccaacaatggcttatcttctaaaccgtgctggactttctcacatgcttatccagagagttcattatgcagttaaaaaacactttgcactgcataaaacattggagtttttttggagacagaattgggatctgggatctgtcacagatattttatgccacatgatgcccttctacagctatgacatccctcacacttgtggacctgatcctaaaatatgctgccagtttgattttaaacgtcttcctggaggcagatttggttgtccctggggagtccccccagaaacaatacatcctggaaatgtccaaagcagggctcggatgctactagatcagtaccgaaagaagtcaaagctttttcgtaccaaagttctcctggctccactaggagatgatttccgctactgtgaatacacggaatgggatttacagtttaagaattatcagcagctttttgattatatgaattctcagtccaagtttaaagttaagatacagtttggaactttatcagatttttttgatgcgctggataaagcagatgaaactcagagagacaagggccaatcgatgttccctgttttaagtggagattttttcacttatgccgatcgagatgatcattactggagtggctattttacatccagacccttttacaaacgaatggacagaatcatggaatctcatttaagggctgctgaaattctttactatttcgccctgagacaagctcacaaatacaagataaataaatttctctcatcatcactttacacggcactgacagaagccagaaggaatttgggactgtttcaacatcatgatgctatcacaggaactgcaaaagactgggtggttgtggattatggtaccagactttttcattcgttaatggttttggagaagataattggaaattctgcatttcttcttattttgaaggacaaactcacatacgactcttactctcctgataccttcctggagatggatttgaaacaaaaatcacaagattctctgccacaaaaaaatataataaggctgagtgcggagccaaggtaccttgtggtctataatcctttagaacaagaccgaatctcgttggtctcagtctatgtgagttccccgacagtgcaagtgttctctgcttcaggaaaacctgtggaagttcaagtcagcgcagtttgggatacagcaaatactatttcagaaacagcctatgagatctcttttcgagcacatataccgccattgggactgaaagtgtataagattttggaatcagcaagttcaaattcacatttagctgattatgtcttgtataagaataaagtagaagatagcggaattttcaccataaagaatatgataaatactgaagaaggtataacactagagaactcctttgttttacttcggtttgatcaaactggacttatgaagcaaatgatgactaaagaagatggtaaacaccatgaagtaaatgtgcaattttcatggtatggaaccacaattaaaagagacaaaagtggtgcctacctcttcttacctgatggtaatgccaagccttatgtttacacaacaccgccctttgtcagagtgacacatggaaggatttattcggaagtgacttgcttttttgaccatgttactcatagagtccgactataccacatacagggaatagaaggacagtctgtggaagtttccaatattgtggacatccgaaaagtatataaccgtgagattgcaatgaaaatttcttctgatataaaaagccaaaatagattttatactgacctaaatgggtaccagattcaacctagaatgacactgagcaaattgcctcttcaagcaaatgtctatcccatgaccacaatggcctatatccaggatgccaaacatcgtttgacactgctctctgctcagtctttaggggtttcgagtttgaatagtggtcagattgaagttatcatggatcgaagactcatgcaagatgataatcgtggccttgagcaaggtatccaggataacaagattacagctaatctatttcgaatactactagaaaaaagaagtgctgttaatacggaagaagaaaagaagtcggtcagttatccttctctccttagccacataacttcttctctcatgaatcatccagtcattccaatggcaaataagttctcctcacctacccttgagctgcaaggtgaattctctccattacagtcatctttgccttgtgacattcatctggttaatttgagaacaatacagtcaaaggtgggcaatgggcactccaatgaggcagccttgatcctccacagaaaagggtttgattgtcggttctctagcaaaggcacagggctgttttgttctactactcagggaaagatattggtacagaaacttttaaacaagtttattgtcgaaagtctcacaccttcatcactatccttgatgcattcacctcccggcactcagaatataagtgagatcaacttgagtccaatggaaatcagcacattccgaatccagttgaggtgaacctgactttcacatttggattgagaatcattggcttttatacctttcttggtttgacgtgcaataaagaagcacattattttagcttctggctactgtgagaacatgaattctgtgattctgtgggttttttcttttttcttttaccagtacagtaagaaaaaaaaaaaaaaaaaaaaagccatgctatcaatcaagattctttttttttaaactttctcccatgaactaccaccatcagtatgaattgatgcaacaaatgaagaaatatttaaagacagcctctcaacagattgtatctcaggttaaatgctaactaattatgtctgtgttgggggttgcgaagagattcttaaaagtatctgtgtgttgatcatcagttttacaaaaacacctatttggctgaaatggaataaaatgtttgtgggtaaaagctaatggccaaaatggttgcaatcattcatactagttagaaaaattatgtgttgaaataagtggaaaagtgcaatccatccacccttatgattaacgtagatgatttttatacctttttctgatgtacctcttgaccttctccttcccttcctaccctttctaagtatttccagaaatacctgattttgaatcattcaacagtagaaaaagaggcatattttcattacttgacaatgtgggatgggtgcaatttattccatcttcactaaaatagaagcaattccataggtaccataaacctattttaggtaccacaaggtgtctttttacacagctcatttgaatacaggtgttctgagaaggggtttctattttaaaattaccatatcaaaataaatgtgccttatttttttataagtcttgttaaatcagtgtccatattactgtttggggaagggggaatgttgtggggtctgggagagggtgggtactttctatgacacataaattgtgtaatttttgcctgacaatgctggccacattctgatctgtttcattaaatttgtggtgatgttactctaaacattttgactatttgaatgtactgagatgtcagaaaacaaaacaaggaaggaaaatattgttaattaaaatgtgctgctgccaaggaaactgcaacttgaagcaaggattttgtaaaatgcaaaatccagctactgtttccatttcacagtagttaactatattaaagagagaatgctttaaaattgatcttgttttgaaacccacttttatgtagctcatcatggtttatcttactaaggaatatgtttgttcattcagttctcaacttttgtatgtgctaaccttaaagtgaagttctgagcccgtgtgccattacagtgcttttaataaaatttatttgggattattgtttccttaacattaaaataatagcgacatttagactatgcaattttagcatagaaaggagtctttgagtatgtacagttttgaaaattctctttgagataattgatttcatattctgtggctttcaacctccatttacctcttgtcattccaacatctttatagagaaataaaaacccaatttctctttcaccatttagtttgattatcatctggattttcactcaagatgcagctcctaagattattgttatgttaaattcataaactccttcacctttaataattaaggaaacaataccagtgttgataaagatattacaaggggtaatttcatgcaataaacatgtaccgtaagttttcttccacatattttgggaaaaaactaaaaaaagaaaaaggacttcctttttgtggacatctacagatgttagggttgccagaagcaaatcccaggaatgagatcagtattttcattgcatcttaaatgtataaccttcctgtgggagttcagtttgtctgtggttaagtgggtgtgcttaatcattctcgaaattgtgatcagatgaaataaaaaaaaaatcttgatgcaataacagtggttttgccacttctggttgtttgcgatggatctgtcccatgtcagtctggggttttattcagcttgtgttgctaccagcagttcacaggtaaagcagaaattctctttaaccagcaagtttctgctttttaaggttacttttagaataaatcatcagggaaacagagaggatgctttgctttgggttgtagtcaaaaactgattaaataatttaatgtctctggcacacactaaaaaccatacacttcagttgtgatctcagtggcatatttatttggttaggtttcgttacatttattattacagatgttcagttgaccaagtagttcagtgttttctttcctttttttggaaattttagtttgagtttgtgactgcagtgttcaagaactcagcatccttgttttctacaaatactgattaaaataaaatgctgtaaaatgtgatgtaaaacattatcatgatcttcccatgcctttgttgtacttgtgccgaagtgttttgatattcctttgtctggaagaaaatgtttgctttcattttgatcattttgttcaccttggaatcaacaggttttgatattttctcttggaagattttatatctttttgggaatatgtaatataagatctctaataaaagataatcttatcatgtaaaaaaaaaaaaaaaaaaaaaaaaaaaaaaaaaaaaaaaaaaaaaaaaaaaaaaaaaaaaaaaaaaaaaaaaaaacccaacaaaacaaaaaaaaaaaaaaaaaccacaaaaaaagacaagaaaacgaaaaaaaagagaaggcaacgcagaaacagccgacgcgacaccaccaccaggacacagcacgaaacacgacagcgctccaccacaacaccacaagcgcaggaacacagagacacagagaacgaacgcacccacgacacgaaaacaaacgaacaaaaagaaaccgcgaggcacacacacagggaacaaaaagagaacagaaaagagaaccaacaacgaaccgaagaaatagagcgaacaagcgaggccaccgcaagcacagacacaaacaagagcacacacccaggccaagaacacaacacacacaaaagccaacgaaccactaagcgaacaggaagacacaacgccggcgcagcgagaggcaagcgacagacgacaacgacgaacgagcaacgaaggacagagaagacccccgcgggccgcacagcgcagaacgacacagcaaaggacgacaccaacgcgaaagaaacgtcaacaaccgaccacaagagcgaccaggacagacagcgaacacaaagacacggaggagacagaccagcccaagacgccacggcacaggaacggaccccaaggagaagaaacgcacccgcagcacccaccgcagagaccgagcagagcaaaccaaccaagagaaacgggacaggacaaacaaagacacggccaccgcgacacaggaggaccactcagccgaagaacaggaaagaaagcacacacgaaccgaacaaaaaaaacaaaa

SEQ ID NO: 25833 - DNA, 7165 bp, Homo sapiens
ggcggggccagccgcccgctcggctcaggcgctgcgggcgcctattgacccagcggctgctgcgccgccgctgtctcctcctgctcgtggcgggcggtgctggagcgccaagtggcgctggagaaccggcgcttcctttcgccgcttccgccgccatctccgcgtttgtggggcgggaaagagggagggggctagcggctgcagctggagcgggcttctctccggggacggtcctttcctccctgctctccttttccttctttccgcgttgccgccgcccgccccctgcgcctccccgcggagcctgggtccgggagggggaaggtaggggcggcggggggcgggagagtctggcgagcggacgctagctctgaggaaactcatcaatccgtgagccccggagtccggggtgcacatcggcccagccgcagcgtcggcggcggcggcggcagcagcacgaaggggctcagtcggggtaggcgggggcggtgccggtgccgcgggggcgggcccgaccgtcccgcccagaagttgtagggcttggctcctcgcgatcttgttcctttcccctccgcttctctgacctagctgcgcggccccggcccgggagctgccgaacccgcgcctcccctgggtgaggaggacacgcctgccctcgtcgagaaaacttttcctgccgactcagttggggcggcggtggcaggaagtgcgggcagcgacctctcctccgcctgccccgcgcgccctgccggaggtcggcgctgagcttgcgatcaagtttgtgggggccccccttcccagttgccggcgagtctcgcctcgagaggggcgcccgaccccggggagggcggcaggccagggcgaaggccaagggcgttttgtggcgccggagactaggtgcggagcaaggcggggactcgcacccgcatccgagagcgcggaggtcgcgcagcccgggagaagggagcctccggcggctgcttcctagagtccacagtgcgctgtctcctttggctgaggagagtgtcctggccccgagtctatcgaggaaaatgaagttaagccgccagttcaccgtgttcggcagtgcgatcttctgtgtggtgattttctcgctctacctgatgctggaccggggtcacttagactaccccaggaacccgcgccgcgagggctccttccctcagggccagctctcaatgttgcaagaaaaaatagaccatttggagcgtttgctagctgagaataatgagatcatctcaaatattagagactcagtcatcaatttgagtgagtctgtggaggatggtccgaaaagttcacaaagcaatttcagccaaggtgctggctcacatcttctgccctcacaattatccctctcagttgacactgcagactgtctgtttgcttcacaaagtggaagtcacaattcagatgtgcagatgttggatgtttacagtctaatttcttttgacaatccagatggtggagtttggaagcaaggatttgacattacttatgaatctaatgaatgggacactgaaccccttcaagtctttgtggtgcctcattcccataacgacccaggttggttgaagactttcaatgactactttagagacaagactcagtatatttttaataacatggtcctaaagctgaaagaagactcacggaggaagtttatttggtctgagatctcttacctttcaaagtggtgggatattatagatattcagaagaaggatgctgttaaaagtttaatagaaaatggtcagcttgaaattgtgacaggtggctgggttatgcctgatgaagctactccacattattttgccttaattgatcaactaattgaaggacatcagtggctggaaaataatataggagtgaaacctcggtccggctgggctattgatccctttggacactcaccaacaatggcttatcttctaaaccgtgctggactttctcacatgcttatccagagagttcattatgcagttaaaaaacactttgcactgcataaaacattggagtttttttggagacagaattgggatctgggatctgtcacagatattttatgccacatgatgcccttctacagctatgacatccctcacacttgtggacctgatcctaaaatatgctgccagtttgattttaaacgtcttcctggaggcagatttggttgtccctggggagtccccccagaaacaatacatcctggaaatgtccaaagcagggctcggatgctactagatcagtaccgaaagaagtcaaagctttttcgtaccaaagttctcctggctccactaggagatgatttccgctactgtgaatacacggaatgggatttacagtttaagaattatcagcagctttttgattatatgaattctcagtccaagtttaaagttaagatacagtttggaactttatcagatttttttgatgcgctggataaagcagatgaaactcagagagacaagggccaatcgatgttccctgttttaagtggagattttttcacttatgccgatcgagatgatcattactggagtggctattttacatccagacccttttacaaacgaatggacagaatcatggaatctcatttaagggctgctgaaattctttactatttcgccctgagacaagctcacaaatacaagataaataaatttctctcatcatcactttacacggcactgacagaagccagaaggaatttgggactgtttcaacatcatgatgctatcacaggaactgcaaaagactgggtggttgtggattatggtaccagactttttcattcgttaatggttttggagaagataattggaaattctgcatttcttcttattttgaaggacaaactcacatacgactcttactctcctgataccttcctggagatggatttgaaacaaaaatcacaagattctctgccacaaaaaaatataataaggctgagtgcggagccaaggtaccttgtggtctataatcctttagaacaagaccgaatctcgttggtctcagtctatgtgagttccccgacagtgcaagtgttctctgcttcaggaaaacctgtggaagttcaagtcagcgcagtttgggatacagcaaatactatttcagaaacagcctatgagatctcttttcgagcacatataccgccattgggactgaaagtgtataagattttggaatcagcaagttcaaattcacatttagctgattatgtcttgtataagaataaagtagaagatagcggaattttcaccataaagaatatgataaatactgaagaaggtataacactagagaactcctttgttttacttcggtttgatcaaactggacttatgaagcaaatgatgactaaagaagatggtaaacaccatgaagtaaatgtgcaattttcatggtatggaaccacaattaaaagagacaaaagtggtgcctacctcttcttacctgatggtaatgccaagccttatgtttacacaacaccgccctttgtcagagtgacacatggaaggatttattcggaagtgacttgcttttttgaccatgttactcatagagtccgactataccacatacagggaatagaaggacagtctgtggaagtttccaatattgtggacatccgaaaagtatataaccgtgagattgcaatgaaaatttcttctgatataaaaagccaaaatagattttatactgacctaaatgggtaccagattcaacctagaatgacactgagcaaattgcctcttcaagcaaatgtctatcccatgaccacaatggcctatatccaggatgccaaacatcgtttgacactgctctctgctcagtctttaggggtttcgagtttgaatagtggtcagattgaagttatcatggatcgaagactcatgcaagatgataatcgtggccttgagcaaggtatccaggataacaagattacagctaatctatttcgaatactactagaaaaaagaagtgctgttaatacggaagaagaaaagaagtcggtcagttatccttctctccttagccacataacttcttctctcatgaatcatccagtcattccaatggcaaataagttctcctcacctacccttgagctgcaaggtgaattctctccattacagtcatctttgccttgtgacattcatctggttaatttgagaacaatacagtcaaaggtgggcaatgggcactccaatgaggcagccttgatcctccacagaaaagggtttgattgtcggttctctagcaaaggcacagggctgttttgttctactactcagggaaagatattggtacagaaacttttaaacaagtttattgtcgaaagtctcacaccttcatcactatccttgatgcattcacctcccggcactcagaatataagtgagatcaacttgagtccaatggaaatcagcacattccgaatccagttgaggtgaacctgactttcacatttggattgagaatcattggcttttatacctttcttggtttgacgtgcaataaagaagcacattattttagcttctggctactgtgagaacatgaattctgtgattctgtgggttttttcttttttcttttaccagtacagtaagaaaaaaaaaaaaaaaaaaaaagccatgctatcaatcaagattctttttttttaaactttctcccatgaactaccaccatcagtatgaattgatgcaacaaatgaagaaatatttaaagacagcctctcaacagattgtatctcaggttaaatgctaactaattatgtctgtgttgggggttgcgaagagattcttaaaagtatctgtgtgttgatcatcagttttacaaaaacacctatttggctgaaatggaataaaatgtttgtgggtaaaagctaatggccaaaatggttgcaatcattcatactagttagaaaaattatgtgttgaaataagtggaaaagtgcaatccatccacccttatgattaacgtagatgatttttatacctttttctgatgtacctcttgaccttctccttcccttcctaccctttctaagtatttccagaaatacctgattttgaatcattcaacagtagaaaaagaggcatattttcattacttgacaatgtgggatgggtgcaatttattccatcttcactaaaatagaagcaattccataggtaccataaacctattttaggtaccacaaggtgtctttttacacagctcatttgaatacaggtgttctgagaaggggtttctattttaaaattaccatatcaaaataaatgtgccttatttttttataagtcttgttaaatcagtgtccatattactgtttggggaagggggaatgttgtggggtctgggagagggtgggtactttctatgacacataaattgtgtaatttttgcctgacaatgctggccacattctgatctgtttcattaaatttgtggtgatgttactctaaacattttgactatttgaatgtactgagatgtcagaaaacaaaacaaggaaggaaaatattgttaattaaaatgtgctgctgccaaggaaactgcaacttgaagcaaggattttgtaaaatgcaaaatccagctactgtttccatttcacagtagttaactatattaaagagagaatgctttaaaattgatcttgttttgaaacccacttttatgtagctcatcatggtttatcttactaaggaatatgtttgttcattcagttctcaacttttgtatgtgctaaccttaaagtgaagttctgagcccgtgtgccattacagtgcttttaataaaatttatttgggattattgtttccttaacattaaaataatagcgacatttagactatgcaattttagcatagaaaggagtctttgagtatgtacagttttgaaaattctctttgagataattgatttcatattctgtggctttcaacctccatttacctcttgtcattccaacatctttatagagaaataaaaacccaatttctctttcaccatttagtttgattatcatctggattttcactcaagatgcagctcctaagattattgttatgttaaattcataaactccttcacctttaataattaaggaaacaataccagtgttgataaagatattacaaggggtaatttcatgcaataaacatgtaccgtaagttttcttccacatattttgggaaaaaactaaaaaaagaaaaaggacttcctttttgtggacatctacagatgttagggttgccagaagcaaatcccaggaatgagatcagtattttcattgcatcttaaatgtataaccttcctgtgggagttcagtttgtctgtggttaagtgggtgtgcttaatcattctcgaaattgtgatcagatgaaataaaaaaaaaatcttgatgcaataacagtggttttgccacttctggttgtttgcgatggatctgtcccatgtcagtctggggttttattcagcttgtgttgctaccagcagttcacaggtaaagcagaaattctctttaaccagcaagtttctgctttttaaggttacttttagaataaatcatcagggaaacagagaggatgctttgctttgggttgtagtcaaaaactgattaaataatttaatgtctctggcacacactaaaaaccatacacttcagttgtgatctcagtggcatatttatttggttaggtttcgttacatttattattacagatgttcagttgaccaagtagttcagtgttttctttcctttttttggaaattttagtttgagtttgtgactgcagtgttcaagaactcagcatccttgttttctacaaatactgattaaaataaaatgctgtaaaatgtgatgtaaaacattatcatgatcttcccatgcctttgttgtacttgtgccgaagtgttttgatattcctttgtctggaagaaaatgtttgctttcattttgatcattttgttcaccttggaatcaacaggttttgatattttctcttggaagattttatatctttttgggaatatgtaatataagatctctaataaaagataatcttatcatgtaaaaaaaacaaaaaaaattctggaaaaattaaatatctaaagggaaaaatgt

SEQ ID NO: 25834 - DNA, 5397 bp, Homo sapiens
ggcggggccagccgcccgctcggctcaggcgctgcgggcgcctattgacccagcggctgctgcgccgccgctgtctcctcctgctcgtggcgggcggtgctggagcgccaagtggcgctggagaaccggcgcttcctttcgccgcttccgccgccatctccgcgtttgtggggcgggaaagagggagggggctagcggctgcagctggagcgggcttctctccggggacggtcctttcctccctgctctccttttccttctttccgcgttgccgccgcccgccccctgcgcctccccgcggagcctgggtccgggagggggaaggtaggggcggcggggggcgggagagtctggcgagcggacgctagctctgaggaaactcatcaatccgtgagccccggagtccggggtgcacatcggcccagccgcagcgtcggcggcggcggcggcagcagcacgaaggggctcagtcggggtaggcgggggcggtgccggtgccgcgggggcgggcccgaccgtcccgcccagaagttgtagggcttggctcctcgcgatcttgttcctttcccctccgcttctctgacctagctgcgcggccccggcccgggagctgccgaacccgcgcctcccctgggtgaggaggacacgcctgccctcgtcgagaaaacttttcctgccgactcagttggggcggcggtggcaggaagtgcgggcagcgacctctcctccgcctgccccgcgcgccctgccggaggtcggcgctgagcttgcgatcaagtttgtgggggccccccttcccagttgccggcgagtctcgcctcgagaggggcgcccgaccccggggagggcggcaggccagggcgaaggccaagggcgttttgtggcgccggagactaggtgcggagcaaggcggggactcgcacccgcatccgagagcgcggaggtcgcgcagcccgggagaagggagcctccggcggctgcttcctagagtccacagtgcgctgtctcctttggctgaggagagtgtcctggccccgagtctatcgaggaaaatgaagttaagccgccagttcaccgtgttcggcagtgcgatcttctgtgtggtgattttctcgctctacctgatgctggaccggggtcacttagactaccccaggaacccgcgccgcgagggctccttccctcagggccagctctcaatgttgcaagaaaaaatagaccatttggagcgtttgctagctgagaataatgagatcatctcaaatattagagactcagtcatcaatttgagtgagtctgtggaggatggtccgaaaagttcacaaagcaatttcagccaaggtgctggctcacatcttctgccctcacaattatccctctcagttgacactgcagactgtctgtttgcttcacaaagtggaagtcacaattcagatgtgcagatgttggatgtttacagtctaatttcttttgacaatccagatggtggagtttggaagcaaggatttgacattacttatgaatctaatgaatgggacactgaaccccttcaagtctttgtggtgcctcattcccataacgacccaggttggttgaagactttcaatgactactttagagacaagactcagtatatttttaataacatggtcctaaagctgaaagaagactcacggaggaagtttatttggtctgagatctcttacctttcaaagtggtgggatattatagatattcagaagaaggatgctgttaaaagtttaatagaaaatggtcagcttgaaattgtgacaggtggctgggttatgcctgatgaagctactccacattattttgccttaattgatcaactaattgaaggacatcagtggctggaaaataatataggagtgaaacctcggtccggctgggctattgatccctttggacactcaccaacaatggcttatcttctaaaccgtgctggactttctcacatgcttatccagagagttcattatgcagttaaaaaacactttgcactgcataaaacattggagtttttttggagacagaattgggatctgggatctgtcacagatattttatgccacatgatgcccttctacagctatgacatccctcacacttgtggacctgatcctaaaatatgctgccagtttgattttaaacgtcttcctggaggcagatttggttgtccctggggagtccccccagaaacaatacatcctggaaatgtccaaagcagggctcggatgctactagatcagtaccgaaagaagtcaaagctttttcgtaccaaagttctcctggctccactaggagatgatttccgctactgtgaatacacggaatgggatttacagtttaagaattatcagcagctttttgattatatgaattctcagtccaagtttaaagttaagatacagtttggaactttatcagatttttttgatgcgctggataaagcagatgaaactcagagagacaagggccaatcgatgttccctgttttaagtggagattttttcacttatgccgatcgagatgatcattactggagtggctattttacatccagacccttttacaaacgaatggacagaatcatggaatctcatttaagggctgctgaaattctttactatttcgccctgagacaagctcacaaatacaagataaataaatttctctcatcatcactttacacggcactgacagaagccagaaggaatttgggactgtttcaacatcatgatgctatcacaggaactgcaaaagactgggtggttgtggattatggtaccagactttttcattcgttaatggttttggagaagataattggaaattctgcatttcttcttattttgaaggacaaactcacatacgactcttactctcctgataccttcctggagatggatttgaaacaaaaatcacaagattctctgccacaaaaaaatataataaggctgagtgcggagccaaggtaccttgtggtctataatcctttagaacaagaccgaatctcgttggtctcagtctatgtgagttccccgacagtgcaagtgttctctgcttcaggaaaacctgtggaagttcaagtcagcgcagtttgggatacagcaaatactatttcagaaacagcctatgagatctcttttcgagcacatataccgccattgggactgaaagtgtataagattttggaatcagcaagttcaaattcacatttagctgattatgtcttgtataagaataaagtagaagatagcggaattttcaccataaagaatatgataaatactgaagaaggtataacactagagaactcctttgttttacttcggtttgatcaaactggacttatgaagcaaatgatgactaaagaagatggtaaacaccatgaagtaaatgtgcaattttcatggtatggaaccacaattaaaagagacaaaagtggtgcctacctcttcttacctgatggtaatgccaagccttatgtttacacaacaccgccctttgtcagagtgacacatggaaggatttattcggaagtgacttgcttttttgaccatgttactcatagagtccgactataccacatacagggaatagaaggacagtctgtggaagtttccaatattgtggacatccgaaaagtatataaccgtgagattgcaatgaaaatttcttctgatataaaaagccaaaatagattttatactgacctaaatgggtaccagattcaacctagaatgacactgagcaaattgcctcttcaagcaaatgtctatcccatgaccacaatggcctatatccaggatgccaaacatcgtttgacactgctctctgctcagtctttaggggtttcgagtttgaatagtggtcagattgaagttatcatggatcgaagactcatgcaagatgataatcgtggccttgagcaaggtatccaggataacaagattacagctaatctatttcgaatactactagaaaaaagaagtgctgttaatacggaagaagaaaagaagtcggtcagttatccttctctccttagccacataacttcttctctcatgaatcatccagtcattccaatggcaaataagttctcctcacctacccttgagctgcaaggtgaattctctccattacagtcatctttgccttgtgacattcatctggttaatttgagaacaatacagtcaaaggtgggcaatgggcactccaatgaggcagccttgatcctccacagaaaagggtttgattgtcggttctctagcaaaggcacagggctgttttgttctactactcagggaaagatattggtacagaaacttttaaacaagtttattgtcgaaagtctcacaccttcatcactatccttgatgcattcacctcccggcactcagaatataagtgagatcaacttgagtccaatggaaatcagcacattccgaatccagttgaggtgaacctgactttcacatttggattgagaatcattggcttttatacctttcttggtttgacgtgcaataaagaagcacattattttagcttctggctactgtgagaacatgaattctgtgattctgtgggttttttcttttttcttttaccagtacagtaagaaaaaaaaaaaaaaaaaaaaaagcgccgggcttttcacccaaaatccttttttttaaaatttccccccagggaattacccccatttcggtttgattgggggccccaatggaaaaattttttaaaggaccaggcttccctccaaccaggttgtgttttccccaggtgtaaatgtgctaccctaattcatggtccgggggtgggggggtggggaaaaagaggattccttaaaaccggtttctggtgcgtggtcggacacctccagtttaaccaacaacaccccctattgggcgctggaacgtgggcttacactcggtcgggcggcgttaaaaggctagttgggccaaattgggttggcatcctttccatacctaaggttgggaaaaactttcttcgtgctggaactcagggtggacaggtgtattcaattccaccctttatgattaaacggtaaaacgaattttaaaccccttttcggatgtacctctggagcttttcgttcccttcctaccctttctaaggtttcccggaaatccggtttgaccctcaccggtgaagggcgggcttttcttctggccgggggtgtgcgctttcctcttccttatgggcctcctggtccctaccttttcggttccggtgttctccgctggaacgggtggagggtcttaactccaaggcgtttaacggacagccagggggaggggggacggcacaccgtgccccgttcgtaaacgccgtgtgtggcgtgtccgt

SEQ ID NO: 25835 - DNA, 3304 bp, Homo sapiens
ttttaaacatatgagttagatgtgtgctgtttattttcttttattgcttacaactaaacttggtagtttatggagtattttctaagactgttatttataaaatgtaataaaaccaaattattcatatatttttatattaaaccctctcagataattctgttaatatgatgagaactggaaatatagacctcttaaacatttttgttttttcttgataggaagaagaaaagaagtcggtcagttatccttctctccttagccacataacttcttctctcatgaatcatccagtcattccaatggcaaataagttctcctcacctacccttgagctgcaaggtgaattctctccattacagtcatctttgccttgtgacattcatctggttaatttgagaacaatacagtcaaaggtgggcaatgggcactccaatgaggcagccttgatcctccacagaaaagggtttgattgtcggttctctagcaaaggcacagggctgttttgttctactactcagggaaagatattggtacagaaacttttaaacaagtttattgtcgaaagtctcacaccttcatcactatccttgatgcattcacctcccggcactcagaatataagtgagatcaacttgagtccaatggaaatcagcacattccgaatccagttgaggtgaacctgactttcacatttggattgagaatcattggcttttatacctttcttggtttgacgtgcaataaagaagcacattattttagcttctggctactgtgagaacatgaattctgtgattctgtgggttttttcttttttcttttaccagtacagtaagaaaaaaaaaaaaaaaaaaaaagccatgctatcaatcaagattctttttttttaaactttctcccatgaactaccaccatcagtatgaattgatgcaacaaatgaagaaatatttaaagacagcctctcaacagattgtatctcaggttaaatgctaactaattatgtctgtgttgggggttgcgaagagattcttaaaagtatctgtgtgttgatcatcagttttacaaaaacacctatttggctgaaatggaataaaatgtttgtgggtaaaagctaatggccaaaatggttgcaatcattcatactagttagaaaaattatgtgttgaaataagtggaaaagtgcaatccatccacccttatgattaacgtagatgatttttatacctttttctgatgtacctcttgaccttctccttcccttcctaccctttctaagtatttccagaaatacctgattttgaatcattcaacagtagaaaaagaggcatattttcattacttgacaatgtgggatgggtgcaatttattccatcttcactaaaatagaagcaattccataggtaccataaacctattttaggtaccacaaggtgtctttttacacagctcatttgaatacaggtgttctgagaaggggtttctattttaaaattaccatatcaaaataaatgtgccttatttttttataagtcttgttaaatcagtgtccatattactgtttggggaagggggaatgttgtggggtctgggagagggtgggtactttctatgacacataaattgtgtaatttttgcctgacaatgctggccacattctgatctgtttcattaaatttgtggtgatgttactctaaacattttgactatttgaatgtactgagatgtcagaaaacaaaacaaggaaggaaaatattgttaattaaaatgtgctgctgccaaggaaactgcaacttgaagcaaggattttgtaaaatgcaaaatccagctactgtttccatttcacagtagttaactatattaaagagagaatgctttaaaattgatcttgttttgaaacccacttttatgtagctcatcatggtttatcttactaaggaatatgtttgttcattcagttctcaacttttgtatgtgctaaccttaaagtgaagttctgagcccgtgtgccattacagtgcttttaataaaatttatttgggattattgtttccttaacattaaaataatagcgacatttagactatgcaattttagcatagaaaggagtctttgagtatgtacagttttgaaaattctctttgagataattgatttcatattctgtggctttcaacctccatttacctcttgtcattccaacatctttatagagaaataaaaacccaatttctctttcaccatttagtttgattatcatctggattttcactcaagatgcagctcctaagattattgttatgttaaattcataaactccttcacctttaataattaaggaaacaataccagtgttgataaagatattacaaggggtaatttcatgcaataaacatgtaccgtaagttttcttccacatattttgggaaaaaactaaaaaaagaaaaaggacttcctttttgtggacatctacagatgttagggttgccagaagcaaatcccaggaatgagatcagtattttcattgcatcttaaatgtataaccttcctgtgggagttcagtttgtctgtggttaagtgggtgtgcttaatcattctcgaaattgtgatcagatgaaataaaaaaaaaatcttgatgcaataacagtggttttgccacttctggttgtttgcgatggatctgtcccatgtcagtctggggttttattcagcttgtgttgctaccagcagttcacaggtaaagcagaaattctctttaaccagcaagtttctgctttttaaggttacttttagaataaatcatcagggaaacagagaggatgctttgctttgggttgtagtcaaaaactgattaaataatttaatgtctctggcacacactaaaaaccatacacttcagttgtgatctcagtggcatatttatttggttaggtttcgttacatttattattacagatgttcagttgaccaagtagttcagtgttttctttcctttttttggaaattttagtttgagtttgtgactgcagtgttcaagaactcagcatccttgttttctacaaatactgattaaaataaaatgctgtaaaatgtgatgtaaaacattatcatgatcttcccatgcctttgttgtacttgtgccgaagtgttttgatattcctttgtctggaagaaaatgtttgctttcattttgatcattttgttcaccttggaatcaacaggttttgatattttctcttggaagattttatatctttttgggaatatgtaatataagatctctaataaaagataatcttatcatgta

SEQ ID NO: 25836 - DNA, 3551 bp, Homo sapiens
ctcttagctgacttgtcatgtttagtatttttatttttgcctgcctatcaacaatagcttctgcagtatcaatttaaatgatacatcaagctggtaaatgtgagctggcctaccaagtgaaagcataactaaatttaaatagctctgatataaaaataatgaatcagtacatcaaagattaagaatgcagttagcaaaaattaatgttcaataaagaagcatgtgtgacttttaagttagatggtatgtcattcaatgaccagataaggactaagttcaggtgcagtttattcaactgatgtgtgtgtttgaaaaataagacgaaaacataatgctttatttgaataaactttaataaaacaatatataatgtatggacataaggaaacctaagtcctcggggattataggggaaaccaaggcatgaggttacctaacaaggaaccttagaacataatcttacctggctcagtacaagtaggagagaatggtagcaggtgaatgggcagtgagcatggacctgaggagaaatgaatttgcctaactttcttgctaaataaatgtgcttttggatgctgacatcgagagagtggtgtgtgaagtaccataaatatttgctttattgtctgcgcggtgtgactgcattctgctcatttgcaggtgggcaatgggcactccaatgaggcagccttgatcctccacagaaaagggtttgattgtcggttctctagcaaaggcacagggctgttttgttctactactcagggaaagatattggtacagaaacttttaaacaagtttattgtcgaaagtctcacaccttcatcactatccttgatgcattcacctcccggcactcagaatataagtgagatcaacttgagtccaatggaaatcagcacattccgaatccagttgaggtgaacctgactttcacatttggattgagaatcattggcttttatacctttcttggtttgacgtgcaataaagaagcacattattttagcttctggctactgtgagaacatgaattctgtgattctgtgggttttttcttttttcttttaccagtacagtaagaaaaaaaaaaaaaaaaaaaaagccatgctatcaatcaagattctttttttttaaactttctcccatgaactaccaccatcagtatgaattgatgcaacaaatgaagaaatatttaaagacagcctctcaacagattgtatctcaggttaaatgctaactaattatgtctgtgttgggggttgcgaagagattcttaaaagtatctgtgtgttgatcatcagttttacaaaaacacctatttggctgaaatggaataaaatgtttgtgggtaaaagctaatggccaaaatggttgcaatcattcatactagttagaaaaattatgtgttgaaataagtggaaaagtgcaatccatccacccttatgattaacgtagatgatttttatacctttttctgatgtacctcttgaccttctccttcccttcctaccctttctaagtatttccagaaatacctgattttgaatcattcaacagtagaaaaagaggcatattttcattacttgacaatgtgggatgggtgcaatttattccatcttcactaaaatagaagcaattccataggtaccataaacctattttaggtaccacaaggtgtctttttacacagctcatttgaatacaggtgttctgagaaggggtttctattttaaaattaccatatcaaaataaatgtgccttatttttttataagtcttgttaaatcagtgtccatattactgtttggggaagggggaatgttgtggggtctgggagagggtgggtactttctatgacacataaattgtgtaatttttgcctgacaatgctggccacattctgatctgtttcattaaatttgtggtgatgttactctaaacattttgactatttgaatgtactgagatgtcagaaaacaaaacaaggaaggaaaatattgttaattaaaatgtgctgctgccaaggaaactgcaacttgaagcaaggattttgtaaaatgcaaaatccagctactgtttccatttcacagtagttaactatattaaagagagaatgctttaaaattgatcttgttttgaaacccacttttatgtagctcatcatggtttatcttactaaggaatatgtttgttcattcagttctcaacttttgtatgtgctaaccttaaagtgaagttctgagcccgtgtgccattacagtgcttttaataaaatttatttgggattattgtttccttaacattaaaataatagcgacatttagactatgcaattttagcatagaaaggagtctttgagtatgtacagttttgaaaattctctttgagataattgatttcatattctgtggctttcaacctccatttacctcttgtcattccaacatctttatagagaaataaaaacccaatttctctttcaccatttagtttgattatcatctggattttcactcaagatgcagctcctaagattattgttatgttaaattcataaactccttcacctttaataattaaggaaacaataccagtgttgataaagatattacaaggggtaatttcatgcaataaacatgtaccgtaagttttcttccacatattttgggaaaaaactaaaaaaagaaaaaggacttcctttttgtggacatctacagatgttagggttgccagaagcaaatcccaggaatgagatcagtattttcattgcatcttaaatgtataaccttcctgtgggagttcagtttgtctgtggttaagtgggtgtgcttaatcattctcgaaattgtgatcagatgaaataaaaaaaaaatcttgatgcaataacagtggttttgccacttctggttgtttgcgatggatctgtcccatgtcagtctggggttttattcagcttgtgttgctaccagcagttcacaggtaaagcagaaattctctttaaccagcaagtttctgctttttaaggttacttttagaataaatcatcagggaaacagagaggatgctttgctttgggttgtagtcaaaaactgattaaataatttaatgtctctggcacacactaaaaaccatacacttcagttgtgatctcagtggcatatttatttggttaggtttcgttacatttattattacagatgttcagttgaccaagtagttcagtgttttctttcctttttttggaaattttagtttgagtttgtgactgcagtgttcaagaactcagcatccttgttttctacaaatactgattaaaataaaatgctgtaaaatgtgatgtaaaacattatcatgatcttcccatgcctttgttgtacttgtgccgaagtgttttgatattcctttgtctggaagaaaatgtttgctttcattttgatcattttgttcaccttggaatcaacaggttttgatattttctcttggaagattttatatctttttgggaatatgtaatataagatctctaataaaagataatcttatcatgta

SEQ ID NO: 25837 - DNA, 3407 bp, Homo sapiens
ctcttagctgacttgtcatgtttagtatttttatttttgcctgcctatcaacaatagcttctgcagtatcaatttaaatgatacatcaagctggtaaatgtgagctggcctaccaagtgaaagcataactaaatttaaatagctctgatataaaaataatgaatcagtacatcaaagattaagaatgcagttagcaaaaattaatgttcaataaagaagcatgtgtgacttttaagttagatggtatgtcattcaatgaccagataaggactaagttcaggtgcagtttattcaactgatgtgtgtgtttgaaaaataagacgaaaacataatgctttatttgaataaactttaataaaacaatatataatgtatggacataaggaaacctaagtcctcggggattataggggaaaccaaggcatgaggttacctaacaaggaaccttagaacataatcttacctggctcagtacaagtaggagagaatggtagcaggtgaatgggcagtgagcatggacctgaggagaaatgaatttgcctaactttcttgctaaataaatgtgcttttggatgctgacatcgagagagtggtgtgtgaagtaccataaatatttgctttattgtctgcgcggtgtgactgcattctgctcatttgcaggtgggcaatgggcactccaatgaggcagccttgatgcattcacctcccggcactcagaatataagtgagatcaacttgagtccaatggaaatcagcacattccgaatccagttgaggtgaacctgactttcacatttggattgagaatcattggcttttatacctttcttggtttgacgtgcaataaagaagcacattattttagcttctggctactgtgagaacatgaattctgtgattctgtgggttttttcttttttcttttaccagtacagtaagaaaaaaaaaaaaaaaaaaaaagccatgctatcaatcaagattctttttttttaaactttctcccatgaactaccaccatcagtatgaattgatgcaacaaatgaagaaatatttaaagacagcctctcaacagattgtatctcaggttaaatgctaactaattatgtctgtgttgggggttgcgaagagattcttaaaagtatctgtgtgttgatcatcagttttacaaaaacacctatttggctgaaatggaataaaatgtttgtgggtaaaagctaatggccaaaatggttgcaatcattcatactagttagaaaaattatgtgttgaaataagtggaaaagtgcaatccatccacccttatgattaacgtagatgatttttatacctttttctgatgtacctcttgaccttctccttcccttcctaccctttctaagtatttccagaaatacctgattttgaatcattcaacagtagaaaaagaggcatattttcattacttgacaatgtgggatgggtgcaatttattccatcttcactaaaatagaagcaattccataggtaccataaacctattttaggtaccacaaggtgtctttttacacagctcatttgaatacaggtgttctgagaaggggtttctattttaaaattaccatatcaaaataaatgtgccttatttttttataagtcttgttaaatcagtgtccatattactgtttggggaagggggaatgttgtggggtctgggagagggtgggtactttctatgacacataaattgtgtaatttttgcctgacaatgctggccacattctgatctgtttcattaaatttgtggtgatgttactctaaacattttgactatttgaatgtactgagatgtcagaaaacaaaacaaggaaggaaaatattgttaattaaaatgtgctgctgccaaggaaactgcaacttgaagcaaggattttgtaaaatgcaaaatccagctactgtttccatttcacagtagttaactatattaaagagagaatgctttaaaattgatcttgttttgaaacccacttttatgtagctcatcatggtttatcttactaaggaatatgtttgttcattcagttctcaacttttgtatgtgctaaccttaaagtgaagttctgagcccgtgtgccattacagtgcttttaataaaatttatttgggattattgtttccttaacattaaaataatagcgacatttagactatgcaattttagcatagaaaggagtctttgagtatgtacagttttgaaaattctctttgagataattgatttcatattctgtggctttcaacctccatttacctcttgtcattccaacatctttatagagaaataaaaacccaatttctctttcaccatttagtttgattatcatctggattttcactcaagatgcagctcctaagattattgttatgttaaattcataaactccttcacctttaataattaaggaaacaataccagtgttgataaagatattacaaggggtaatttcatgcaataaacatgtaccgtaagttttcttccacatattttgggaaaaaactaaaaaaagaaaaaggacttcctttttgtggacatctacagatgttagggttgccagaagcaaatcccaggaatgagatcagtattttcattgcatcttaaatgtataaccttcctgtgggagttcagtttgtctgtggttaagtgggtgtgcttaatcattctcgaaattgtgatcagatgaaataaaaaaaaaatcttgatgcaataacagtggttttgccacttctggttgtttgcgatggatctgtcccatgtcagtctggggttttattcagcttgtgttgctaccagcagttcacaggtaaagcagaaattctctttaaccagcaagtttctgctttttaaggttacttttagaataaatcatcagggaaacagagaggatgctttgctttgggttgtagtcaaaaactgattaaataatttaatgtctctggcacacactaaaaaccatacacttcagttgtgatctcagtggcatatttatttggttaggtttcgttacatttattattacagatgttcagttgaccaagtagttcagtgttttctttcctttttttggaaattttagtttgagtttgtgactgcagtgttcaagaactcagcatccttgttttctacaaatactgattaaaataaaatgctgtaaaatgtgatgtaaaacattatcatgatcttcccatgcctttgttgtacttgtgccgaagtgttttgatattcctttgtctggaagaaaatgtttgctttcattttgatcattttgttcaccttggaatcaacaggttttgatattttctcttggaagattttatatctttttgggaatatgtaatataagatctctaataaaagataatcttatcatgta

SEQ ID NO: 25838 - DNA, 3276 bp, Homo sapiens
aagaacccagaggcttctggggaggatgggcggtcaccatcccttagcctcacttctaggtggctcctccactgtagttgttttaaatgtgattgttttctggaagcagctggagctgactagagtcagtgagcatagggttttaccttctgtaaacgaagcctggaacttgttttttatgtcacctttttttgtggttactcacttcttcacatccttcctgcttttgactattttcttgtaatacaaatctaatcacttctcagatgaaaaatcccgttgcctactgaattggttcagacactgagcattcaggtcctctgcagcctggcctctacttactgcagccacctggcttcccgttgctcttcgtgcctttggacaggtgggcaatgggcactccaatgaggcagccttgatcctccacagaaaagggtttgattgtcggttctctagcaaaggcacagggctgttttgttctactactcagggaaagatattggtacagaaacttttaaacaagtttattgtcgaaagtctcacaccttcatcactatccttgatgcattcacctcccggcactcagaatataagtgagatcaacttgagtccaatggaaatcagcacattccgaatccagttgaggtgaacctgactttcacatttggattgagaatcattggcttttatacctttcttggtttgacgtgcaataaagaagcacattattttagcttctggctactgtgagaacatgaattctgtgattctgtgggttttttcttttttcttttaccagtacagtaagaaaaaaaaaaaaaaaaaaaaagccatgctatcaatcaagattctttttttttaaactttctcccatgaactaccaccatcagtatgaattgatgcaacaaatgaagaaatatttaaagacagcctctcaacagattgtatctcaggttaaatgctaactaattatgtctgtgttgggggttgcgaagagattcttaaaagtatctgtgtgttgatcatcagttttacaaaaacacctatttggctgaaatggaataaaatgtttgtgggtaaaagctaatggccaaaatggttgcaatcattcatactagttagaaaaattatgtgttgaaataagtggaaaagtgcaatccatccacccttatgattaacgtagatgatttttatacctttttctgatgtacctcttgaccttctccttcccttcctaccctttctaagtatttccagaaatacctgattttgaatcattcaacagtagaaaaagaggcatattttcattacttgacaatgtgggatgggtgcaatttattccatcttcactaaaatagaagcaattccataggtaccataaacctattttaggtaccacaaggtgtctttttacacagctcatttgaatacaggtgttctgagaaggggtttctattttaaaattaccatatcaaaataaatgtgccttatttttttataagtcttgttaaatcagtgtccatattactgtttggggaagggggaatgttgtggggtctgggagagggtgggtactttctatgacacataaattgtgtaatttttgcctgacaatgctggccacattctgatctgtttcattaaatttgtggtgatgttactctaaacattttgactatttgaatgtactgagatgtcagaaaacaaaacaaggaaggaaaatattgttaattaaaatgtgctgctgccaaggaaactgcaacttgaagcaaggattttgtaaaatgcaaaatccagctactgtttccatttcacagtagttaactatattaaagagagaatgctttaaaattgatcttgttttgaaacccacttttatgtagctcatcatggtttatcttactaaggaatatgtttgttcattcagttctcaacttttgtatgtgctaaccttaaagtgaagttctgagcccgtgtgccattacagtgcttttaataaaatttatttgggattattgtttccttaacattaaaataatagcgacatttagactatgcaattttagcatagaaaggagtctttgagtatgtacagttttgaaaattctctttgagataattgatttcatattctgtggctttcaacctccatttacctcttgtcattccaacatctttatagagaaataaaaacccaatttctctttcaccatttagtttgattatcatctggattttcactcaagatgcagctcctaagattattgttatgttaaattcataaactccttcacctttaataattaaggaaacaataccagtgttgataaagatattacaaggggtaatttcatgcaataaacatgtaccgtaagttttcttccacatattttgggaaaaaactaaaaaaagaaaaaggacttcctttttgtggacatctacagatgttagggttgccagaagcaaatcccaggaatgagatcagtattttcattgcatcttaaatgtataaccttcctgtgggagttcagtttgtctgtggttaagtgggtgtgcttaatcattctcgaaattgtgatcagatgaaataaaaaaaaaatcttgatgcaataacagtggttttgccacttctggttgtttgcgatggatctgtcccatgtcagtctggggttttattcagcttgtgttgctaccagcagttcacaggtaaagcagaaattctctttaaccagcaagtttctgctttttaaggttacttttagaataaatcatcagggaaacagagaggatgctttgctttgggttgtagtcaaaaactgattaaataatttaatgtctctggcacacactaaaaaccatacacttcagttgtgatctcagtggcatatttatttggttaggtttcgttacatttattattacagatgttcagttgaccaagtagttcagtgttttctttcctttttttggaaattttagtttgagtttgtgactgcagtgttcaagaactcagcatccttgttttctacaaatactgattaaaataaaatgctgtaaaatgtgatgtaaaacattatcatgatcttcccatgcctttgttgtacttgtgccgaagtgttttgatattcctttgtctggaagaaaatgtttgctttcattttgatcattttgttcaccttggaatcaacaggttttgatattttctcttggaagattttatatctttttgggaatatgtaatataagatctctaataaaagataatcttatcatgta

SEQ ID NO: 25839 - DNA, 2885 bp, Homo sapiens
ttttaatcccctcctcatacctaattttccacagaaatatgtagttgtgctgcctaatcttcaaagttgatcctaaatatgtaaattttatcatttacttttcagatattggtacagaaacttttaaacaagtttattgtcgaaagtctcacaccttcatcactatccttgatgcattcacctcccggcactcagaatataagtgagatcaacttgagtccaatggaaatcagcacattccgaatccagttgaggtgaacctgactttcacatttggattgagaatcattggcttttatacctttcttggtttgacgtgcaataaagaagcacattattttagcttctggctactgtgagaacatgaattctgtgattctgtgggttttttcttttttcttttaccagtacagtaagaaaaaaaaaaaaaaaaaaaaagccatgctatcaatcaagattctttttttttaaactttctcccatgaactaccaccatcagtatgaattgatgcaacaaatgaagaaatatttaaagacagcctctcaacagattgtatctcaggttaaatgctaactaattatgtctgtgttgggggttgcgaagagattcttaaaagtatctgtgtgttgatcatcagttttacaaaaacacctatttggctgaaatggaataaaatgtttgtgggtaaaagctaatggccaaaatggttgcaatcattcatactagttagaaaaattatgtgttgaaataagtggaaaagtgcaatccatccacccttatgattaacgtagatgatttttatacctttttctgatgtacctcttgaccttctccttcccttcctaccctttctaagtatttccagaaatacctgattttgaatcattcaacagtagaaaaagaggcatattttcattacttgacaatgtgggatgggtgcaatttattccatcttcactaaaatagaagcaattccataggtaccataaacctattttaggtaccacaaggtgtctttttacacagctcatttgaatacaggtgttctgagaaggggtttctattttaaaattaccatatcaaaataaatgtgccttatttttttataagtcttgttaaatcagtgtccatattactgtttggggaagggggaatgttgtggggtctgggagagggtgggtactttctatgacacataaattgtgtaatttttgcctgacaatgctggccacattctgatctgtttcattaaatttgtggtgatgttactctaaacattttgactatttgaatgtactgagatgtcagaaaacaaaacaaggaaggaaaatattgttaattaaaatgtgctgctgccaaggaaactgcaacttgaagcaaggattttgtaaaatgcaaaatccagctactgtttccatttcacagtagttaactatattaaagagagaatgctttaaaattgatcttgttttgaaacccacttttatgtagctcatcatggtttatcttactaaggaatatgtttgttcattcagttctcaacttttgtatgtgctaaccttaaagtgaagttctgagcccgtgtgccattacagtgcttttaataaaatttatttgggattattgtttccttaacattaaaataatagcgacatttagactatgcaattttagcatagaaaggagtctttgagtatgtacagttttgaaaattctctttgagataattgatttcatattctgtggctttcaacctccatttacctcttgtcattccaacatctttatagagaaataaaaacccaatttctctttcaccatttagtttgattatcatctggattttcactcaagatgcagctcctaagattattgttatgttaaattcataaactccttcacctttaataattaaggaaacaataccagtgttgataaagatattacaaggggtaatttcatgcaataaacatgtaccgtaagttttcttccacatattttgggaaaaaactaaaaaaagaaaaaggacttcctttttgtggacatctacagatgttagggttgccagaagcaaatcccaggaatgagatcagtattttcattgcatcttaaatgtataaccttcctgtgggagttcagtttgtctgtggttaagtgggtgtgcttaatcattctcgaaattgtgatcagatgaaataaaaaaaaaatcttgatgcaataacagtggttttgccacttctggttgtttgcgatggatctgtcccatgtcagtctggggttttattcagcttgtgttgctaccagcagttcacaggtaaagcagaaattctctttaaccagcaagtttctgctttttaaggttacttttagaataaatcatcagggaaacagagaggatgctttgctttgggttgtagtcaaaaactgattaaataatttaatgtctctggcacacactaaaaaccatacacttcagttgtgatctcagtggcatatttatttggttaggtttcgttacatttattattacagatgttcagttgaccaagtagttcagtgttttctttcctttttttggaaattttagtttgagtttgtgactgcagtgttcaagaactcagcatccttgttttctacaaatactgattaaaataaaatgctgtaaaatgtgatgtaaaacattatcatgatcttcccatgcctttgttgtacttgtgccgaagtgttttgatattcctttgtctggaagaaaatgtttgctttcattttgatcattttgttcaccttggaatcaacaggttttgatattttctcttggaagattttatatctttttgggaatatgtaatataagatctctaataaaagataatcttatcatgta

SEQ ID NO: 25840 - DNA, 422 bp, Homo sapiens
atttttaataacatggtcctaaagctgaaagaagactcacggaggaagtttatttggtctgagatctcttacctttcaaagtggtgggatattatagatattcagaagaaggatgctgttaaaaggtttgttttaaaacttttttggaatttggtaatattaaagcttaattgtacaatgaactaagtattgaatttttagatggtgaaaattcttagctttatatttgaaacttaaaatatttcttcacataccgttttcgttgattttggttcatctctgaaaaagccatttgaaacttttccatttaaatcctgtgttccactggaagcagtggcttactgctgtaatcctagcactttgggaggccgaggtgggcggatcacctgagggcaggagttcaagaccactctggccaacat

SEQ ID NO: 25841 - DNA, 7114 bp, Homo sapiens
ggcggggccagccgcccgctcggctcaggcgctgcgggcgcctattgacccagcggctgctgcgccgccgctgtctcctcctgctcgtggcgggcggtgctggagcgccaagtggcgctggagaaccggcgcttcctttcgccgcttccgccgccatctccgcgtttgtggggcgggaaagagggagggggctagcggctgcagctggagcgggcttctctccggggacggtcctttcctccctgctctccttttccttctttccgcgttgccgccgcccgccccctgcgcctccccgcggagcctgggtccgggagggggaaggtaggggcggcggggggcgggagagtctggcgagcggacgctagctctgaggaaactcatcaatccgtgagccccggagtccggggtgcacatcggcccagccgcagcgtcggcggcggcggcggcagcagcacgaaggggctcagtcggggtaggcgggggcggtgccggtgccgcgggggcgggcccgaccgtcccgcccagaagttgtagggcttggctcctcgcgatcttgttcctttcccctccgcttctctgacctagctgcgcggccccggcccgggagctgccgaacccgcgcctcccctgggtgaggaggacacgcctgccctcgtcgagaaaacttttcctgccgactcagttggggcggcggtggcaggaagtgcgggcagcgacctctcctccgcctgccccgcgcgccctgccggaggtcggcgctgagcttgcgatcaagtttgtgggggccccccttcccagttgccggcgagtctcgcctcgagaggggcgcccgaccccggggagggcggcaggccagggcgaaggccaagggcgttttgtggcgccggagactaggtgcggagcaaggcggggactcgcacccgcatccgagagcgcggaggtcgcgcagcccgggagaagggagcctccggcggctgcttcctagagtccacagtgcgctgtctcctttggctgaggagagtgtcctggccccgagtctatcgaggaaaatgaagttaagccgccagttcaccgtgttcggcagtgcgatcttctgtgtggtgattttctcgctctacctgatgctggaccggggtcacttagactaccccaggaacccgcgccgcgagggctccttccctcagggccagctctcaatgttgcaagaaaaaatagaccatttggagcgtttgctagctgagaataatgagatcatctcaaatattagagactcagtcatcaatttgagtgagtctgtggaggatggtccgaaaagttcacaaagcaatttcagccaaggtgctggctcacatcttctgccctcacaattatccctctcagttgacactgcagactgtctgtttgcttcacaaagtggaagtcacaattcagatgtgcagatgttggatgtttacagtctaatttcttttgacaatccagatggtggagtttggaagcaaggatttgacattacttatgaatctaatgaatgggacactgaaccccttcaagtctttgtggtgcctcattcccataacgacccaggttggttgaagactttcaatgactactttagagacaagactcagtatatttttaataacatggtcctaaagctgaaagaagactcacggaggaagtttatttggtctgagatctcttacctttcaaagtggtgggatattatagatattcagaagaaggatgctgttaaaagtttaatagaaaatggtcagcttgaaattgtgacaggtggctgggttatgcctgatgaagctactccacattattttgccttaattgatcaactaattgaaggacatcagtggctggaaaataatataggagtgaaacctcggtccggctgggctattgatccctttggacactcaccaacaatggcttatcttctaaaccgtgctggactttctcacatgcttatccagagagttcattatgcagttaaaaaacactttgcactgcataaaacattggagtttttttggagacagaattgggatctgggatctgtcacagatattttatgccacatgatgcccttctacagctatgacatccctcacacttgtggacctgatcctaaaatatgctgccagtttgattttaaacgtcttcctggaggcagatttggttgtccctggggagtccccccagaaacaatacatcctggaaatgtccaaagcagggctcggatgctactagatcagtaccgaaagaagtcaaagctttttcgtaccaaagttctcctggctccactaggagatgatttccgctactgtgaatacacggaatgggatttacagtttaagaattatcagcagctttttgattatatgaattctcagtccaagtttaaagttaagatacagtttggaactttatcagatttttttgatgcgctggataaagcagatgaaactcagagagacaagggccaatcgatgttccctgttttaagtggagattttttcacttatgccgatcgagatgatcattactggagtggctattttacatccagacccttttacaaacgaatggacagaatcatggaatctcatttaagggctgctgaaattctttactatttcgccctgagacaagctcacaaatacaagataaataaatttctctcatcatcactttacacggcactgacagaagccagaaggaatttgggactgtttcaacatcatgatgctatcacaggaactgcaaaagactgggtggttgtggattatggtaccagactttttcattcgttaatggttttggagaagataattggaaattctgcatttcttcttattttgaaggacaaactcacatacgactcttactctcctgataccttcctggagatggatttgaaacaaaaatcacaagattctctgccacaaaaaaatataataaggctgagtgcggagccaaggtaccttgtggtctataatcctttagaacaagaccgaatctcgttggtctcagtctatgtgagttccccgacagtgcaagtgttctctgcttcaggaaaacctgtggaagttcaagtcagcgcagtttgggatacagcaaatactatttcagaaacagcctatgagatctcttttcgagcacatataccgccattgggactgaaagtgtataagattttggaatcagcaagttcaaattcacatttagctgattatgtcttgtataagaataaagtagaagatagcggaattttcaccataaagaatatgataaatactgaagaaggtataacactagagaactcctttgttttacttcggtttgatcaaactggacttatgaagcaaatgatgactaaagaagatggtaaacaccatgaagtaaatgtgcaattttcatggtatggaaccacaattaaaagagacaaaagtggtgcctacctcttcttacctgatggtaatgccaagccttatgtttacacaacaccgccctttgtcagagtgacacatggaaggatttattcggaagtgacttgcttttttgaccatgttactcatagagtccgactataccacatacagggaatagaaggacagtctgtggaagtttccaatattgtggacatccgaaaagtatataaccgtgagattgcaatgaaaatttcttctgatataaaaagccaaaatagattttatactgacctaaatgggtaccagattcaacctagaatgacactgagcaaattgcctcttcaagcaaatgtctatcccatgaccacaatggcctatatccaggatgccaaacatcgtttgacactgctctctgctcagtctttaggggtttcgagtttgaatagtggtcagattgaagttatcatggatcgaagactcatgcaagatgataatcgtggccttgagcaaggtatccaggataacaagattacagctaatctatttcgaatactactagaaaaaagaagtgctgttaatacggaagaagaaaagaagtcggtcagttatccttctctccttagccacataacttcttctctcatgaatcatccagtcattccaatggcaaataagttctcctcacctacccttgagctgcaaggtgaattctctccattacagtcatctttgccttgtgacattcatctggttaatttgagaacaatacagtcaaaggtgggcaatgggcactccaatgaggcagccttgatcctccacagaaaagggtttgattgtcggttctctagcaaaggcacagggctgttttgttctactactcagggaaagatattggtacagaaacttttaaacaagtttattgtcgaaagtctcacaccttcatcactatccttgatgcattcacctcccggcactcagaatataagtgagatcaacttgagtccaatggaaatcagcacattccgaatccagttgaggtgaacctgactttcacatttggattgagaatcattggcttttatacctttcttggtttgacgtgcaataaagaagcacattattttagcttctggctactgtgagaacatgaattctgtgattctgtgggttttttcttttttcttttaccagtacagtaagaaaaaaaaaaaaaaaaaaaaagccatgctatcaatcaagattctttttttttaaactttctcccatgaactaccaccatcagtatgaattgatgcaacaaatgaagaaatatttaaagacagcctctcaacagattgtatctcaggttaaatgctaactaattatgtctgtgttgggggttgcgaagagattcttaaaagtatctgtgtgttgatcatcagttttacaaaaacacctatttggctgaaatggaataaaatgtttgtgggtaaaagctaatggccaaaatggttgcaatcattcatactagttagaaaaattatgtgttgaaataagtggaaaagtgcaatccatccacccttatgattaacgtagatgatttttatacctttttctgatgtacctcttgaccttctccttcccttcctaccctttctaagtatttccagaaatacctgattttgaatcattcaacagtagaaaaagaggcatattttcattacttgacaatgtgggatgggtgcaatttattccatcttcactaaaatagaagcaattccataggtaccataaacctattttaggtaccacaaggtgtctttttacacagctcatttgaatacaggtgttctgagaaggggtttctattttaaaattaccatatcaaaataaatgtgccttatttttttataagtcttgttaaatcagtgtccatattactgtttggggaagggggaatgttgtggggtctgggagagggtgggtactttctatgacacataaattgtgtaatttttgcctgacaatgctggccacattctgatctgtttcattaaatttgtggtgatgttactctaaacattttgactatttgaatgtactgagatgtcagaaaacaaaacaaggaaggaaaatattgttaattaaaatgtgctgctgccaaggaaactgcaacttgaagcaaggattttgtaaaatgcaaaatccagctactgtttccatttcacagtagttaactatattaaagagagaatgctttaaaattgatcttgttttgaaacccacttttatgtagctcatcatggtttatcttactaaggaatatgtttgttcattcagttctcaacttttgtatgtgctaaccttaaagtgaagttctgagcccgtgtgccattacagtgcttttaataaaatttatttgggattattgtttccttaacattaaaataatagcgacatttagactatgcaattttagcatagaaaggagtctttgagtatgtacagttttgaaaattctctttgagataattgatttcatattctgtggctttcaacctccatttacctcttgtcattccaacatctttatagagaaataaaaacccaatttctctttcaccatttagtttgattatcatctggattttcactcaagatgcagctcctaagattattgttatgttaaattcataaactccttcacctttaataattaaggaaacaataccagtgttgataaagatattacaaggggtaatttcatgcaataaacatgtaccgtaagttttcttccacatattttgggaaaaaactaaaaaaagaaaaaggacttcctttttgtggacatctacagatgttagggttgccagaagcaaatcccaggaatgagatcagtattttcattgcatcttaaatgtataaccttcctgtgggagttcagtttgtctgtggttaagtgggtgtgcttaatcattctcgaaattgtgatcagatgaaataaaaaaaaaatcttgatgcaataacagtggttttgccacttctggttgtttgcgatggatctgtcccatgtcagtctggggttttattcagcttgtgttgctaccagcagttcacaggtaaagcagaaattctctttaaccagcaagtttctgctttttaaggttacttttagaataaatcatcagggaaacagagaggatgctttgctttgggttgtagtcaaaaactgattaaataatttaatgtctctggcacacactaaaaaccatacacttcagttgtgatctcagtggcatatttatttggttaggtttcgttacatttattattacagatgttcagttgaccaagtagttcagtgttttctttcctttttttggaaattttagtttgagtttgtgactgcagtgttcaagaactcagcatccttgttttctacaaatactgattaaaataaaatgctgtaaaatgtgatgtaaaacattatcatgatcttcccatgcctttgttgtacttgtgccgaagtgttttgatattcctttgtctggaagaaaatgtttgctttcattttgatcattttgttcaccttggaatcaacaggttttgatattttctcttggaagattttatatctttttgggaatatgtaatataagatctctaataaaagataatcttatcatgta

SEQ ID NO: 25842 - DNA, 2957 bp, Homo sapiens
ttaacaaagagccataaatcctctagagacaagacaaagaagaaagcaccttcaggcttccaaaaggtgggcaatgggcactccaatgaggcagccttgatcctccacagaaaagggtttgattgtcggttctctagcaaaggcacagggctgttttgttctactactcagggaaagatattggtacagaaacttttaaacaagtttattgtcgaaagtctcacaccttcatcactatccttgatgcattcacctcccggcactcagaatataagtgagatcaacttgagtccaatggaaatcagcacattccgaatccagttgaggtgaacctgactttcacatttggattgagaatcattggcttttatacctttcttggtttgacgtgcaataaagaagcacattattttagcttctggctactgtgagaacatgaattctgtgattctgtgggttttttcttttttcttttaccagtacagtaagaaaaaaaaaaaaaaaaaaaaagccatgctatcaatcaagattctttttttttaaactttctcccatgaactaccaccatcagtatgaattgatgcaacaaatgaagaaatatttaaagacagcctctcaacagattgtatctcaggttaaatgctaactaattatgtctgtgttgggggttgcgaagagattcttaaaagtatctgtgtgttgatcatcagttttacaaaaacacctatttggctgaaatggaataaaatgtttgtgggtaaaagctaatggccaaaatggttgcaatcattcatactagttagaaaaattatgtgttgaaataagtggaaaagtgcaatccatccacccttatgattaacgtagatgatttttatacctttttctgatgtacctcttgaccttctccttcccttcctaccctttctaagtatttccagaaatacctgattttgaatcattcaacagtagaaaaagaggcatattttcattacttgacaatgtgggatgggtgcaatttattccatcttcactaaaatagaagcaattccataggtaccataaacctattttaggtaccacaaggtgtctttttacacagctcatttgaatacaggtgttctgagaaggggtttctattttaaaattaccatatcaaaataaatgtgccttatttttttataagtcttgttaaatcagtgtccatattactgtttggggaagggggaatgttgtggggtctgggagagggtgggtactttctatgacacataaattgtgtaatttttgcctgacaatgctggccacattctgatctgtttcattaaatttgtggtgatgttactctaaacattttgactatttgaatgtactgagatgtcagaaaacaaaacaaggaaggaaaatattgttaattaaaatgtgctgctgccaaggaaactgcaacttgaagcaaggattttgtaaaatgcaaaatccagctactgtttccatttcacagtagttaactatattaaagagagaatgctttaaaattgatcttgttttgaaacccacttttatgtagctcatcatggtttatcttactaaggaatatgtttgttcattcagttctcaacttttgtatgtgctaaccttaaagtgaagttctgagcccgtgtgccattacagtgcttttaataaaatttatttgggattattgtttccttaacattaaaataatagcgacatttagactatgcaattttagcatagaaaggagtctttgagtatgtacagttttgaaaattctctttgagataattgatttcatattctgtggctttcaacctccatttacctcttgtcattccaacatctttatagagaaataaaaacccaatttctctttcaccatttagtttgattatcatctggattttcactcaagatgcagctcctaagattattgttatgttaaattcataaactccttcacctttaataattaaggaaacaataccagtgttgataaagatattacaaggggtaatttcatgcaataaacatgtaccgtaagttttcttccacatattttgggaaaaaactaaaaaaagaaaaaggacttcctttttgtggacatctacagatgttagggttgccagaagcaaatcccaggaatgagatcagtattttcattgcatcttaaatgtataaccttcctgtgggagttcagtttgtctgtggttaagtgggtgtgcttaatcattctcgaaattgtgatcagatgaaataaaaaaaaaatcttgatgcaataacagtggttttgccacttctggttgtttgcgatggatctgtcccatgtcagtctggggttttattcagcttgtgttgctaccagcagttcacaggtaaagcagaaattctctttaaccagcaagtttctgctttttaaggttacttttagaataaatcatcagggaaacagagaggatgctttgctttgggttgtagtcaaaaactgattaaataatttaatgtctctggcacacactaaaaaccatacacttcagttgtgatctcagtggcatatttatttggttaggtttcgttacatttattattacagatgttcagttgaccaagtagttcagtgttttctttcctttttttggaaattttagtttgagtttgtgactgcagtgttcaagaactcagcatccttgttttctacaaatactgattaaaataaaatgctgtaaaatgtgatgtaaaacattatcatgatcttcccatgcctttgttgtacttgtgccgaagtgttttgatattcctttgtctggaagaaaatgtttgctttcattttgatcattttgttcaccttggaatcaacaggttttgatattttctcttggaagattttatatctttttgggaatatgtaatataagatctctaataaaagataatcttatcatgta

SEQ ID NO: 25843 - DNA, 2241 bp, Homo sapiens
cgcctggctccggccccaccccgccatcccctggccatgggctgactcgccacccccgacactgcagcgcctgccgacctcggggccccgccctctgccttcgctcgcgccgctctccttcagtctccccagggcctgtttcatggatagggtccccttgcccgcgtgaaagtctcattcctcctcagctcagaaacactccaaggtctcggcgccctatattttccattcccactccctactctggcagtctagcttctaagctgaggagtttggccttcgctccaggtgcggggactcgtggaaggatttgattcgcgcttgagaaagatcgctccgctcctgtaaggaagagagcgtgtaggggctgcaaccagagacacagtcagaagctccgaggctaccgcgatggtccaggtgccacaggacacagcctaacagaggcccaggttggagccatggaccatggagtcatgagaatggaagggaagctgacgccatgtgggatggggtagaactgtccgcaaattcgtcccgcctctggagtcttcagaccagtcaaggccgaaattcaaccaagcctctcctctctctagctgttatttgtttgcagcacgcggtctggtggcaccctgcaggatttaccagctttttgccaacattctggcctatgcaatcaatacgtcccttcagcgttgcacttggatggattggacctatagttgttatatatggatattgtctaatttatttattacagtattaactgactcctatgttctggccttcagaatttctcctttggatcaattactagcctgtcttacattttctgcttcattcttttaaaatgtttagagatgatttgctaagttttcttcattgctgtcaatgatgcaatttaaactgtcaaaaaaattttttctcaagcagggtagtaatggtgaaccattcccttgctattcagacagcatggtttagatgaggcgcacctatccccagctttaggaatggaaacaggacccaagtctggctaatcagagactggtttagggtcggccccatggtctgagccagaccaatgagaattggtagagggacttccttttgcaacttctattttagaatcgggggtatatatgcaggcttgttacagaggtatattgcatggtgctgaggtttggagtatgaacgaatccgtccttcaggtaatgagcatagtacccaataggtagtttcaacccttgcccccttcctccttccccagtcttgtattccccagtgtctgttgttcccagacattgatctttttcctctatgttgctaagctggtagaaaggctggagttgctggcaaccatctttgcaaccatgcagggagaactactttggaaatgaagcaagacaaagaagaaaacagataaaaggagacaaatgtttgactttgtacagctggaaaccagcaatgctggaaatgagcactgaaggcagtttaatgggtttgtcacttgtaaccaagtgacccatggcaagctcacagatttgtattggcagaattcctccttttctttatttaaaatggtacttttggccaggcaaggtggttcacacctgtaatccaaagactttgggaggccgaggcgcactgatcacccaaggtcagaagttcgagaacagcctggccaacattggcgaaaccccatctctactaaaaatacaaaccattagctggctgcggtggcctttctaccagctttttgtctcaaaaaaaaaaaaaaaaaggtacttttgcttatctctaaccttcctcttccccataatttaacagttgcccatactatctgttactctgagctactctctgccccattctcctcctcttatcttcagttcctcctaggctgtcagagccatctgaaatgaaaacatttaggccgggcatagtggttcatgcctgtaatcccagcactttgggaggctgaggcaggcggatcagctgaggtcaggagttcaagaccaccctggtcaacatggtgaaaccccatctctactaaaaatacaaaaattatccagacatggtggcacatgcctctactcccagctacttgggaggctgaggcaggagaatcgcttgaacctaggaggcaggggttgcagtgagccgagattgagccactgcactctagcctgggcgacagagtgagactttgtctaaaaaacataaataaaataaaatgaaatg

SEQ ID NO: 25844 - DNA, 2284 bp, Homo sapiens
cgcctggctccggccccaccccgccatcccctggccatgggctgactcgccacccccgacactgcagcgcctgccgacctcggggccccgccctctgccttcgctcgcgccgctctccttcagtctccccagggcctgtttcatggatagggtccccttgcccgcgtgaaagtctcattcctcctcagctcagaaacactccaaggtctcggcgccctatactggccttccctcatccgaatacccctcgtgctcctgatgtacttttccattcccactccctactctggcagtctagcttctaagctgaggagtttggccttcgctccaggtgcggggactcgtggaaggatttgattcgcgcttgagaaagatcgctccgctcctgtaaggaagagagcgtgtaggggctgcaaccagagacacagtcagaagctccgaggctaccgcgatggtccaggtgccacaggacacagcctaacagaggcccaggttggagccatggaccatggagtcatgagaatggaagggaagctgacgccatgtgggatggggtagaactgtccgcaaattcgtcccgcctctggagtcttcagaccagtcaaggccgaaattcaaccaagcctctcctctctctagctgttatttgtttgcagcacgcggtctggtggcaccctgcaggatttaccagctttttgccaacattctggcctatgcaatcaatacgtcccttcagcgttgcacttggatggattggacctatagttgttatatatggatattgtctaatttatttattacagtattaactgactcctatgttctggccttcagaatttctcctttggatcaattactagcctgtcttacattttctgcttcattcttttaaaatgtttagagatgatttgctaagttttcttcattgctgtcaatgatgcaatttaaactgtcaaaaaaattttttctcaagcagggtagtaatggtgaaccattcccttgctattcagacagcatggtttagatgaggcgcacctatccccagctttaggaatggaaacaggacccaagtctggctaatcagagactggtttagggtcggccccatggtctgagccagaccaatgagaattggtagagggacttccttttgcaacttctattttagaatcgggggtatatatgcaggcttgttacagaggtatattgcatggtgctgaggtttggagtatgaacgaatccgtccttcaggtaatgagcatagtacccaataggtagtttcaacccttgcccccttcctccttccccagtcttgtattccccagtgtctgttgttcccagacattgatctttttcctctatgttgctaagctggtagaaaggctggagttgctggcaaccatctttgcaaccatgcagggagaactactttggaaatgaagcaagacaaagaagaaaacagataaaaggagacaaatgtttgactttgtacagctggaaaccagcaatgctggaaatgagcactgaaggcagtttaatgggtttgtcacttgtaaccaagtgacccatggcaagctcacagatttgtattggcagaattcctccttttctttatttaaaatggtacttttggccaggcaaggtggttcacacctgtaatccaaagactttgggaggccgaggcgcactgatcacccaaggtcagaagttcgagaacagcctggccaacattggcgaaaccccatctctactaaaaatacaaaccattagctggctgcggtggcctttctaccagctttttgtctcaaaaaaaaaaaaaaaaaggtacttttgcttatctctaaccttcctcttccccataatttaacagttgcccatactatctgttactctgagctactctctgccccattctcctcctcttatcttcagttcctcctaggctgtcagagccatctgaaatgaaaacatttaggccgggcatagtggttcatgcctgtaatcccagcactttgggaggctgaggcaggcggatcagctgaggtcaggagttcaagaccaccctggtcaacatggtgaaaccccatctctactaaaaatacaaaaattatccagacatggtggcacatgcctctactcccagctacttgggaggctgaggcaggagaatcgcttgaacctaggaggcaggggttgcagtgagccgagattgagccactgcactctagcctgggcgacagagtgagactttgtctaaaaaacataaataaaataaaatgaaatg

SEQ ID NO: 25845 - DNA, 952 bp, Homo sapiens
cgcctggctccggccccaccccgccatcccctggccatgggctgactcgccacccccgacactgcagcgcctgccgacctcggggccccgccctctgccttcgctcgcgccgctctccttcagtctccccagggcctgtttcatggatagggtccccttgcccgcgtgaaagtctcattcctcctcagctcagaaacactccaaggtctcggcgccctatactggccttccctcatccgaatacccctcgtgctcctgatgtacttttccattcccactccctactctggcagtctagcttctaagctgaggagtttggccttcgctccaggtgcggggactcgtggaaggatttgattcgcgcttgagaaagatcgctccgctcctgtaaggaagagagcgtgtaggggctgcaaccagagacacagtcagaagctccgaggctaccgcgatggtccaggtgccacaggacacagcctaacagaggcccaggttggagccatggaccatggagtcatgagaatggaagggaagctgacgccatgtgggatggggtagaactgtccgcaaattcgtcccgcctctggagtcttcagaccagtcaaggccgaaattcaaccaagcctctcctctctctagctgttatttgtttgcagcacgcggtctggtggcaccctgcaggatttaccagctttttgccaacattctggcctatgcaatcaatacgtcccttcagcgttgcacttggatggattggacctatagttgttatatatggatattgtctaatttatttattacagtattaactgactcctatgttcagagccagggtcctgttcgaaaccaagcatcctgtggcacgctgctactcatttgcttctatgggtatgctagaagcgagaatccgtatactaaccacaattctcagaccccatcctaagttcagagc

SEQ ID NO: 25846 - DNA, 2088 bp, Homo sapiens
cgcctggctccggccccaccccgccatcccctggccatgggctgactcgccacccccgacactgcagcgcctgccgacctcggggccccgccctctgccttcgctcgcgccgctctccttcagtctccccagggcctgtttcatggatagggtccccttgcccgcgtgaaagtctcattcctcctcagctcagaaacactccaaggtctcggcgccctatactggccttccctcatccgaatacccctcgtgctcctgatgtacttttccattcccactccctactctggcagtctagcttctaagctgaggagtttggccttcgctccaggtgcggggactcgtggaaggatttgattcgcgcttgagaaagatcgctccgctcctgtaaggaagagagcgtgtaggggctgcaaccagagacacagtcagaagctccgaggctaccgcgatggtccagcacgcggtctggtggcaccctgcaggatttaccagctttttgccaacattctggcctatgcaatcaatacgtcccttcagcgttgcacttggatggattggacctatagttgttatatatggatattgtctaatttatttattacagtattaactgactcctatgttctggccttcagaatttctcctttggatcaattactagcctgtcttacattttctgcttcattcttttaaaatgtttagagatgatttgctaagttttcttcattgctgtcaatgatgcaatttaaactgtcaaaaaaattttttctcaagcagggtagtaatggtgaaccattcccttgctattcagacagcatggtttagatgaggcgcacctatccccagctttaggaatggaaacaggacccaagtctggctaatcagagactggtttagggtcggccccatggtctgagccagaccaatgagaattggtagagggacttccttttgcaacttctattttagaatcgggggtatatatgcaggcttgttacagaggtatattgcatggtgctgaggtttggagtatgaacgaatccgtccttcaggtaatgagcatagtacccaataggtagtttcaacccttgcccccttcctccttccccagtcttgtattccccagtgtctgttgttcccagacattgatctttttcctctatgttgctaagctggtagaaaggctggagttgctggcaaccatctttgcaaccatgcagggagaactactttggaaatgaagcaagacaaagaagaaaacagataaaaggagacaaatgtttgactttgtacagctggaaaccagcaatgctggaaatgagcactgaaggcagtttaatgggtttgtcacttgtaaccaagtgacccatggcaagctcacagatttgtattggcagaattcctccttttctttatttaaaatggtacttttggccaggcaaggtggttcacacctgtaatccaaagactttgggaggccgaggcgcactgatcacccaaggtcagaagttcgagaacagcctggccaacattggcgaaaccccatctctactaaaaatacaaaccattagctggctgcggtggcctttctaccagctttttgtctcaaaaaaaaaaaaaaaaaggtacttttgcttatctctaaccttcctcttccccataatttaacagttgcccatactatctgttactctgagctactctctgccccattctcctcctcttatcttcagttcctcctaggctgtcagagccatctgaaatgaaaacatttaggccgggcatagtggttcatgcctgtaatcccagcactttgggaggctgaggcaggcggatcagctgaggtcaggagttcaagaccaccctggtcaacatggtgaaaccccatctctactaaaaatacaaaaattatccagacatggtggcacatgcctctactcccagctacttgggaggctgaggcaggagaatcgcttgaacctaggaggcaggggttgcagtgagccgagattgagccactgcactctagcctgggcgacagagtgagactttgtctaaaaaacataaataaaataaaatgaaatg

SEQ ID NO: 25847 - DNA, 541 bp, Homo sapiens
cggggactcgtggaaggatttgattcgcgcttgagaaagatcgctccgctcctgtaaggaagagagcgtgtaggggctgcaaccagagacacagtcagaagctccgaggctaccgcgatggtccaggtgagaatggaggggcctaactaaaccagtggcgggagggatggaagaatgaactgagacacttgggaggtgaatggaatcgagcgactgcatgtggaggtgtgagtgggaaggtatctgagatgactccagtttctggcttggacaatgacttggatggagggttaggtgggggctgagcagagtccacgaacagtttttaatttgcctgagtttaaggtgccacaggacacagcctaacagaggcccaggttggagccatggaccatggagtcatgagaatggaagggaagctgacgccatgtgggatggggtagaactgtccgcaaattcgtcccgcctctggagtcttcagaccagtcaaggccgaaattcaaccaagcctctcctctctctagctgttatttgtttgcag

SEQ ID NO: 25848 - DNA, 426 bp, Homo sapiens
gctgtcaatgatgcaatttaaactgtcaaaaaaattttttctcaagcagggtagtaatggtgaaccattcccttgctattcagacagcatggtttagatgaggcgcacctatccccagctttaggaatggaaacaggacccaagtctggctaatcagagactggtttagggtcggccccatggtctgagccagaccaatgagaattggtagagggacttccttttgcaacttctattttagaatcgggggtatatatgcaggcttgttacagaggtatattgcatggtgctgaggtttggagtatgaacgaatccgtccttcaggtaatgagcatagtacccaataggtagtttcaacccttgcccccttcctccttccccagtcttgtattccccagtgtctgttgttcccagacattgatcttt

SEQ ID NO: 25849 - DNA, 1275 bp, Homo sapiens
ttaattaaatttaatcccagggaaattagatgtgaatttgaacacctaactttccatgtactctctcatttttgtggaagtgtttctatactctaatgcctttacaaatgtgatttttctcttagctcgtttgaagtatgagaattagagtttttggtctcgcattcacctgctacatctaggattgcccactgtcatgactcccaggaaaaggtcctatcttagcttcctcctccctactttcctctacatggtcagcactgtaatgtagctaagatatagtaaggcattgctccctccccctacacttcaaggagttcacagtctaatggggagttcaggaaggccagagtattaatatccccatctgtgtcttttgccttccatgaacctgggttttgagccctctcttgtaaaatgggcacagtaatattacctacctcagggagttgtgaggattaaacatgaagtgctaagcatagtgcctggtacaaagacagtactcaataagtgctacctaaaactagtattcatagcaatactgttaggataaagaattatcatatatgagatagttccaaatttttgtttttttaaaaaagagttttataagttcaagataatattttcttacttcaaagaaacaatctcacaacgagggaatggtaagaatcaggagagattactaacctggcagaggagctatcacaatcacaaaggtggtttttccagggcacggctcatccattacactccagatgtgctgacccctgccatttccccaaatgtgggaaacccaactgcacagtttgtagtagtgggtgactgtgttcatgcgctcccctgaatcccgaaaacaacaacaacaacaaagaatcagaagagatactaggctatctaattcctaaatccaaacctgatatttctaagtaagattataagaatttttattgcattttctgaatttgcttttgcataagttatgttatttttacagggtctatattactattatttcttagaataatactaattataaaacaaaattctgtatatcacatttaaatgtaatttaatagaattataatcacaagacaagaccaaactttgttgataatcctcagtaattgcgaaaggggtatatacatgtaggccagcatacatgcataaactacttcttattgctagtctaattgttccatatgtagcaaatacagcagttcagcaatatcttgtgcttacagggtagctcatggtgctagctctcctcgtgcc

SEQ ID NO: 25850 - DNA, 1716 bp, Homo sapiens
ttaattaaatttaatcccagggaaattagatgtgaatttgaacacctaactttccatgtactctctcatttttgtggaagtgtttctatactctaatgcctttacaaatgtgatttttctcttagctcgtttgaagtatgagaattagagtttttggtctcgcattcacctgctacatctaggattgcccactgtcatgactcccaggaaaaggtcctatcttagcttcctcctccctactttcctctacatggtcagcactgtaatgtagctaagatatagtaaggcattgctccctccccctacacttcaaggagttcacagtctaatggggagttcaggaaggccagagtattaatatccccatctgtgtcttttgccttccatgaacctgggttttgagccctctcttgtaaaatgggcacagtaatattacctacctcagggagttgtgaggattaaacatgaagtgctaagcatagtgcctggtacaaagacagtactcaataagtgctacctaaaactagtattcatagcaatactgttaggataaagaattatcatatatgagatagttccaaatttttgtttttttaaaaaagagttttataagttcaagataatattttcttacttcaaagaaacaatctcacaacgagggaatggtaagaatcaggagagattactaacctggcagaggagctatcacaatcacaaaggtggtttttccagggcacggctcatccattacactccagatgtgctgacccctgccatttccccaaatgtgggaaacccaactgcacagtttgtagtagtgggtgactgtgttcatgcgctcccctgaatcccctgatatttctaagtaagattataagaatttttattgcattttctgaatttgcttttgcataagttatgttatttttacagggtctatattactattatttcttagaataatactaattataaaacaaaattctgtatatcacatttaaatgtaatttaatagaattataatcacaagacaagaccaaactttgttgataatcctcagtaattgcgaaaggggtatatacatgtaggccagcatacatgcataaactacttcttattgctagtctaattgttccatatgtagcaaatacagcagttcagcaatatcttgtgcttacagggtcctaagcagaggtgatgagtcaagtgtaaatatatatatatatttttttatttttcatggcaattgtatattagtaacctggggagaaaaggtttattgacaaccactctgatccatctgctgctatttttactgctaatttggtgcacattaaaaagaatgatcatgaaaagatattactttgagttaaaagtatatatatatatatatatatatatatatacacacacacatatatatacaatagtttgatgtcaataaatacatttctgaatgcttagtgttgcttcatttacatagaaaaaaacacactttaaaaactgatattggtttattatatatattcatttccttctcacagtactttcccattctcattttagaaataaaatgtgaatgattttttaaggccaaattttattcccatctggcagttgttttgattataagtagtggattgatggaaataatttaattgagcaaatatttagttgagttccttttatgaacaagatactttgttaaagttctgt

SEQ ID NO: 25851 - DNA, 1780 bp, Homo sapiens
ttaattaaatttaatcccagggaaattagatgtgaatttgaacacctaactttccatgtactctctcatttttgtggaagtgtttctatactctaatgcctttacaaatgtgatttttctcttagctcgtttgaagtatgagaattagagtttttggtctcgcattcacctgctacatctaggattgcccactgtcatgactcccaggaaaaggtcctatcttagcttcctcctccctactttcctctacatggtcagcactgtaatgtagctaagatatagtaaggcattgctccctccccctacacttcaaggagttcacagtctaatggggagttcaggaaggccagagtattaatatccccatctgtgtcttttgccttccatgaacctgggttttgagccctctcttgtaaaatgggcacagtaatattacctacctcagggagttgtgaggattaaacatgaagtgctaagcatagtgcctggtacaaagacagtactcaataagtgctacctaaaactagtattcatagcaatactgttaggataaagaattatcatatatgagatagttccaaatttttgtttttttaaaaaagagttttataagttcaagataatattttcttacttcaaagaaacaatctcacaacgagggaatggtaagaatcaggagagattactaacctggcagaggagctatcacaatcacaaaggtggtttttccagggcacggctcatccattacactccagatgtgctgacccctgccatttccccaaatgtgggaaacccaactgcacagtttgtagtagtgggtgactgtgttcatgcgctcccctgaatcccgaaaacaacaacaacaacaaagaatcagaagagatactaggctatctaattcctaaatccaaacctgatatttctaagtaagattataagaatttttattgcattttctgaatttgcttttgcataagttatgttatttttacagggtctatattactattatttcttagaataatactaattataaaacaaaattctgtatatcacatttaaatgtaatttaatagaattataatcacaagacaagaccaaactttgttgataatcctcagtaattgcgaaaggggtatatacatgtaggccagcatacatgcataaactacttcttattgctagtctaattgttccatatgtagcaaatacagcagttcagcaatatcttgtgcttacagggtcctaagcagaggtgatgagtcaagtgtaaatatatatatatatttttttatttttcatggcaattgtatattagtaacctggggagaaaaggtttattgacaaccactctgatccatctgctgctatttttactgctaatttggtgcacattaaaaagaatgatcatgaaaagatattactttgagttaaaagtatatatatatatatatatatatatatatacacacacacatatatatacaatagtttgatgtcaataaatacatttctgaatgcttagtgttgcttcatttacatagaaaaaaacacactttaaaaactgatattggtttattatatatattcatttccttctcacagtactttcccattctcattttagaaataaaatgtgaatgattttttaaggccaaattttattcccatctggcagttgttttgattataagtagtggattgatggaaataatttaattgagcaaatatttagttgagttccttttatgaacaagatactttgttaaagttctgt

SEQ ID NO: 25852 - DNA, 1705 bp, Homo sapiens
ttaattaaatttaatcccagggaaattagatgtgaatttgaacacctaactttccatgtactctctcatttttgtggaagtgtttctatactctaatgcctttacaaatgtgatttttctcttagctcgtttgaagtatgagaattagagtttttggtctcgcattcacctgctacatctaggattgcccactgtcatgactcccaggaaaaggtcctatcttagcttcctcctccctactttcctctacatggtcagcactgtaatgtagctaagatatagtaaggcattgctccctccccctacacttcaaggagttcacagtctaatggggagttcaggaaggccagagtattaatatccccatctgtgtcttttgccttccatgaacctgggttttgagccctctcttgtaaaatgggcacagtaatattacctacctcagggagttgtgaggattaaacatgaagtgctaagcatagtgcctggtacaaagacagtactcaataagtgctacctaaaactagtattcatagcaatactgttaggataaagaattatcatatatgagatagttccaaatttttgtttttttaaaaaagagttttataagttcaagataatattttcttacttcaaagaaacaatctcacaacgagggaatggtaagaatcaggagagattactaacctggcagaggagctatcacaatcacaaaggtggtttttccagggcacggctcatccattacactccagatgtgctgacccctgccatgaaaacaacaacaacaacaaagaatcagaagagatactaggctatctaattcctaaatccaaacctgatatttctaagtaagattataagaatttttattgcattttctgaatttgcttttgcataagttatgttatttttacagggtctatattactattatttcttagaataatactaattataaaacaaaattctgtatatcacatttaaatgtaatttaatagaattataatcacaagacaagaccaaactttgttgataatcctcagtaattgcgaaaggggtatatacatgtaggccagcatacatgcataaactacttcttattgctagtctaattgttccatatgtagcaaatacagcagttcagcaatatcttgtgcttacagggtcctaagcagaggtgatgagtcaagtgtaaatatatatatatatttttttatttttcatggcaattgtatattagtaacctggggagaaaaggtttattgacaaccactctgatccatctgctgctatttttactgctaatttggtgcacattaaaaagaatgatcatgaaaagatattactttgagttaaaagtatatatatatatatatatatatatatatacacacacacatatatatacaatagtttgatgtcaataaatacatttctgaatgcttagtgttgcttcatttacatagaaaaaaacacactttaaaaactgatattggtttattatatatattcatttccttctcacagtactttcccattctcattttagaaataaaatgtgaatgattttttaaggccaaattttattcccatctggcagttgttttgattataagtagtggattgatggaaataatttaattgagcaaatatttagttgagttccttttatgaacaagatactttgttaaagttctgt

SEQ ID NO: 25853 - DNA, 1412 bp, Homo sapiens
ttaattaaatttaatcccagggaaattagatgtgaatttgaacacctaactttccatgtactctctcatttttgtggaagtgtttctatactctaatgcctttacaaatgtgatttttctcttagctcgtttgaagtatgagaattagagtttttggtctcgcattcacctgctacatctaggattgcccactgtcatgactcccaggaaaaggtcctatcttagcttcctcctccctactttcctctacatggtcagcactgtaatgtagctaagatatagtaaggcattgctccctccccctacacttcaaggagttcacagtctaatggggagttcaggaaggccagagtattaatatccccatctgtgtcttttgccttccatgaacctgggttttgagccctctcttgtaaaatgggcacagtaatattacctacctcagggagttgtgaggattaaacatgaagtgctaagcatagtgcctggtacaaagacagtactcaataagtgctacctaaaactagtattcatagcaatactgttaggataaagaattatcatatatgagatagttccaaatttttgtttttttaaaaaagagttttataagttcaagataatattttcttacttcaaagaaacaatctcacaacgagggaatggtaagaatcaggagagattactaacctggcagaggagctatcacaatcacaaaggtggtttttccagggcacggctcatccattacactccagatgtgctgacccctgccatttccccaaatgtgggaaacccaactgcacagtttgtagtagtgggtgactgtgttcatgcgctcccctgaatcccgaaaacaacaacaacaacaaagaatcagaagagatactaggctatctaattcctaaatccaaacctgatatttctaagtaagattataagaatttttattgcattttctgaatttgcttttgcataagttatgttatttttacagggtctatattactattatttcttagaataatactaattataaaacaaaattctgtatatcacatttaaatgtaatttaatagaattataatcacaagacaagaccaaactttgttgataatcctcagtaattgcgaaaggggtatatacatgtaggccagcatacatgcataaactacttcttattgctagtctaattgttccatatgtagcaaatacagcagttcagcaatatcttgtgcttacagggtcctaagcagaggtgatgagtcaagtgtaaatatatatatatatttttttatgaatgattagaactgggaaaagtatgcacattgacttgtgtatttatgtatgggccttaaatgctgaaaatactgggttttttttttcccccttttcatgtgagatatttgagt

SEQ ID NO: 25854 - DNA, 1613 bp, Homo sapiens
ttaattaaatttaatcccagggaaattagatgtgaatttgaacacctaactttccatgtactctctcatttttgtggaagtgtttctatactctaatgcctttacaaatgtgatttttctcttagctcgtttgaagtatgagaattagagtttttggtctcgcattcacctgctacatctaggattgcccactgtcatgactcccaggaaaaggtcctatcttagcttcctcctccctactttccagagtattaatatccccatctgtgtcttttgccttccatgaacctgggttttgagccctctcttgtaaaatgggcacagtaatattacctacctcagggagttgtgaggattaaacatgaagtgctaagcatagtgcctggtacaaagacagtactcaataagtgctacctaaaactagtattcatagcaatactgttaggataaagaattatcatatatgagatagttccaaatttttgtttttttaaaaaagagttttataagttcaagataatattttcttacttcaaagaaacaatctcacaacgagggaatggtaagaatcaggagagattactaacctggcagaggagctatcacaatcacaaaggtggtttttccagggcacggctcatccattacactccagatgtgctgacccctgccatttccccaaatgtgggaaacccaactgcacagtttgtagtagtgggtgactgtgttcatgcgctcccctgaatcccctgatatttctaagtaagattataagaatttttattgcattttctgaatttgcttttgcataagttatgttatttttacagggtctatattactattatttcttagaataatactaattataaaacaaaattctgtatatcacatttaaatgtaatttaatagaattataatcacaagacaagaccaaactttgttgataatcctcagtaattgcgaaaggggtatatacatgtaggccagcatacatgcataaactacttcttattgctagtctaattgttccatatgtagcaaatacagcagttcagcaatatcttgtgcttacagggtcctaagcagaggtgatgagtcaagtgtaaatatatatatatatttttttatttttcatggcaattgtatattagtaacctggggagaaaaggtttattgacaaccactctgatccatctgctgctatttttactgctaatttggtgcacattaaaaagaatgatcatgaaaagatattactttgagttaaaagtatatatatatatatatatatatatatatacacacacacatatatatacaatagtttgatgtcaataaatacatttctgaatgcttagtgttgcttcatttacatagaaaaaaacacactttaaaaactgatattggtttattatatatattcatttccttctcacagtactttcccattctcattttagaaataaaatgtgaatgattttttaaggccaaattttattcccatctggcagttgttttgattataagtagtggattgatggaaataatttaattgagcaaatatttagttgagttccttttatgaacaagatactttgttaaagttctgt

SEQ ID NO: 25855 - DNA, 1726 bp, Homo sapiens
ttaattaaatttaatcccagggaaattagatgtgaatttgaacacctaactttccatgtactctctcatttttgtggaagtgtttctatactctaatgcctttacaaatgtgatttttctcttagctcgtttgaagtatgagaattagagtttttggtctcgcattcacctgctacatctaggattgcccactgtcatgactcccaggaaaaggtcctatcttagcttcctcctccctactttcctctacatggtcagcactgtaatgtagctaagatatagtaaggcattgctccctccccctacacttcaaggagttcacagtctaatggggagttcaggaaggccagagtattaatatccccatctgtgtcttttgccttccatgaacctgggttttgagccctctcttgtaaaatgggcacagtaatattacctacctcagggagttgtgaggattaaacatgaagtgctaagcatagtgcctggtacaaagacagtactcaataagtgctacctaaaactagtattcatagcaatactgttaggataaagaattatcatatatgagatagttccaaatttttgtttttttaaaaaagagttttataagttcaagataatattttcttacttcaaagaaacaatctcacaacgagggaatggtaagaatcaggagagattactaacctggcagaggagctatcacaatcacaaaggtggtttttccagggcacggctcatccattacactccagatgtgctgacccctgccatttccccaaatgtgggaaacccaactgcacagtttgtagtagtgggtgactgtgttcatgcgctcccctgaatcccgaaaacaacaacaacaacaaagaatcagaagagatactaggctatctaattcctaaatccaaacctgatatttctaagtaagattataagaatttttattgcattttctgaatttgcttttgcataagttatgttatttttacagggtctatattactattatttcttagaataatactaattataaaacaagaccaaactttgttgataatcctcagtaattgcgaaaggggtatatacatgtaggccagcatacatgcataaactacttcttattgctagtctaattgttccatatgtagcaaatacagcagttcagcaatatcttgtgcttacagggtcctaagcagaggtgatgagtcaagtgtaaatatatatatatatttttttatttttcatggcaattgtatattagtaacctggggagaaaaggtttattgacaaccactctgatccatctgctgctatttttactgctaatttggtgcacattaaaaagaatgatcatgaaaagatattactttgagttaaaagtatatatatatatatatatatatatatatacacacacacatatatatacaatagtttgatgtcaataaatacatttctgaatgcttagtgttgcttcatttacatagaaaaaaacacactttaaaaactgatattggtttattatatatattcatttccttctcacagtactttcccattctcattttagaaataaaatgtgaatgattttttaaggccaaattttattcccatctggcagttgttttgattataagtagtggattgatggaaataatttaattgagcaaatatttagttgagttccttttatgaacaagatactttgttaaagttctgt

SEQ ID NO: 25856 - DNA, 1722 bp, Homo sapiens
ttaattaaatttaatcccagggaaattagatgtgaatttgaacacctaactttccatgtactctctcatttttgtggaagtgtttctatactctaatgcctttacaaatgtgatttttctcttagctcgtttgaagtatgagaattagagtttttggtctcgcattcacctgctacatctaggattgcccactgtcatgactcccaggaaaaggtcctatcttagcttcctcctccctactttcctctacatggtcagcactgtaatgtagctaagatatagtaaggcattgctccctccccctacacttcaaggagttcacagtctaatggggagttcaggaaggccagagtattaatatccccatctgtgtcttttgccttccatgaacctgggttttgagccctctcttgtaaaatgggcacagtaatattacctacctcagggagttgtgaggattaaacatgaagtgctaagcatagtgcctggtacaaagacagtactcaataagtgctacctaaaactagtattcatagcaatactgttaggataaagaattatcatatatgagatagttccaaatttttgtttttttaacgagggaatggtaagaatcaggagagattactaacctggcagaggagctatcacaatcacaaaggtggtttttccagggcacggctcatccattacactccagatgtgctgacccctgccatttccccaaatgtgggaaacccaactgcacagtttgtagtagtgggtgactgtgttcatgcgctcccctgaatcccgaaaacaacaacaacaacaaagaatcagaagagatactaggctatctaattcctaaatccaaacctgatatttctaagtaagattataagaatttttattgcattttctgaatttgcttttgcataagttatgttatttttacagggtctatattactattatttcttagaataatactaattataaaacaaaattctgtatatcacatttaaatgtaatttaatagaattataatcacaagacaagaccaaactttgttgataatcctcagtaattgcgaaaggggtatatacatgtaggccagcatacatgcataaactacttcttattgctagtctaattgttccatatgtagcaaatacagcagttcagcaatatcttgtgcttacagggtcctaagcagaggtgatgagtcaagtgtaaatatatatatatatttttttatttttcatggcaattgtatattagtaacctggggagaaaaggtttattgacaaccactctgatccatctgctgctatttttactgctaatttggtgcacattaaaaagaatgatcatgaaaagatattactttgagttaaaagtatatatatatatatatatatatatatatacacacacacatatatatacaatagtttgatgtcaataaatacatttctgaatgcttagtgttgcttcatttacatagaaaaaaacacactttaaaaactgatattggtttattatatatattcatttccttctcacagtactttcccattctcattttagaaataaaatgtgaatgattttttaaggccaaattttattcccatctggcagttgttttgattataagtagtggattgatggaaataatttaattgagcaaatatttagttgagttccttttatgaacaagatactttgttaaagttctgt

SEQ ID NO: 25857 - DNA, 532 bp, Homo sapiens
gctgcaggattcggcacgagagctgctccaggaacagaggtgccatgcagccccgggtactccttgttgttgccctcctggcgctcctggcctctgcccgagcttcagaggccgaggatgcctcccttctcagcttcatgcagggctacatgaagcacgccaccaagaccgccaaggatgcactgagcagcgtgcaggagtcccaggtggcccagcaggccaggggctgggtgaccgatggcttcagttccctgaaagactactggagcaccgttaaggacaagttctctgagttctgggatttggaccctgaggtcagaccaacttcagccgtggctgcctgagacctcaataccccaagtccacctgcctatccatcctgccagctccttgggtcctgcaatctccagggctgcccctgtaggttgcttaaaagggacagtattctcagtgctctcctaccccacctcatgcctggcccccctccaggcatgctggcctcccaataaagctggacaagaagctgctatga

SEQ ID NO: 25858 - DNA, 550 bp, Homo sapiens
aaccctcctgcctgtctgctcagttcatccctagaggcagctgctccaggaacagaggtgccatgcagccccgggtactccttgttgttgccctcctggcgctcctggcctctgcccgagcttcagaggccgaggatgcctcccttctcagcttcatgcagggctacatgaagcacgccaccaagaccgccaaggatgcactgagcagcgtgcaggagtcccaggtggcccagcaggccaggggctgggtgaccgatggcttcagttccctgaaagactactggagcaccgttaaggacaagttctctgagttctgggatttggaccctgaggtcagaccaacttcagccgtggctgcctgagacctcaataccccaagtccacctgcctatccatcctgccagctccttgggtcctgcaatctccagggctgcccctgtaggttgcttaaaagggacagtattctcagtgctctcctaccccacctcatgcctggcccccctccaggcatgctggcctcccaataaagctggacaagaagctgctatga

SEQ ID NO: 25859 - DNA, 820 bp, Homo sapiens
ggctttggggtaggtgttattttctcactttgcagatgagaaaattgaggctcagagcgattaggtgacctgccccagatcacacaactaatcaatcctccaatgactttccaaatgagaggctgcctccctctgtcctaccctgctcagagccaccaggttgtgcaactccaggcggtgctgtttgcacagaaaacaatgacagccttgacctttcacatctccccaccctgtcactttgtgcctcaggcccaggggcataaacatctgaggtgacctgggagatggcagggtttgacttgtgctggggttcctgcaaggatatctcttctcccagggtgggcagctgtgggggattcctgcctgaggtctcagggctgtcgtccagtgaagttgagagggtggtgtggtcctgactggtgtcgtccagtggggaacatgggtgtgggtcccatggttgcctacagaggagttctcatgccctgctctgttgcttcccctgactatttaggggctgggtgaccgatggcttcagttccctgaaagactactggagcaccgttaaggacaagttctctgagttctgggatttggaccctgaggtcagaccaacttcagccgtggctgcctgagacctcaataccccaagtccacctgcctatccatcctgccagctccttgggtcctgcaatctccagggctgcccctgtaggttgcttaaaagggacagtattctcagtgctctcctaccccacctcatgcctggcccccctccaggcatgctggcctcccaataaagctggacaagaagctgctatga

SEQ ID NO: 25860 - DNA, 855 bp, Homo sapiens
  misc_feature (849)..(849): n is a, c, g, or t
ggctttggggtaggtgttattttctcactttgcagatgagaaaattgaggctcagagcgattaggtgacctgccccagatcacacaactaatcaatcctccaatgactttccaaatgagaggctgcctccctctgtcctaccctgctcagagccaccaggttgtgcaactccaggcggtgctgtttgcacagaaaacaatgacagccttgacctttcacatctccccaccctgtcactttgtgcctcaggcccaggggcataaacatctgaggtgacctgggagatggcagggtttgacttgtgctggggttcctgcaaggatatctcttctcccagggtgggcagctgtgggggattcctgcctgaggtctcagggctgtcgtccagtgaagttgagagggtggtgtggtcctgactggtgtcgtccagtggggaacatgggtgtgggtcccatggttgcctacagaggagttctcatgccctgctctgttgcttcccctgactatttaggggctgggtgaccgatggcttcagttccctgaaagactactggagcaccgttaaggacaagttctctgagttctgggatttggaccctgaggtcagaccaacttcagccgtggctgcctgagacctcaataccccaagtccacctgcctatccatcctgccagctccttgggtcctgcaatctccagggctgcccctgtaggttgcttaaaagggacagtattctcagtgctctcctaccccacctcatgcctggcccccctccaggcatgctggcctcccaataaagctggacaagaagctgctatgaaaaaaaaaaaaaaaaaaaaaaaaaaaacnaaaaaa

SEQ ID NO: 25861 - DNA, 445 bp, Homo sapiens
gatcacccggcaagttcaggctgaattctgaaggcaaacttgagcagacggtctccatggcaacccgagcttcagaggccgaggatgcctcccttctcagcttcatgcagggctacatgaagcacgccaccaagaccgccaaggatgcactgagcagcgtgcaggagtcccaggtggcccagcaggccaggggctgggtgaccgatggcttcagttccctgaaagactactggagcaccgttaaggacaagttctctgagttctgggatttggaccctgaggtcagaccaacttcagccgtggctgcctgagacctcaataccccaagtccacctgcctatccatcctgccagctccttgggtcctgcaatctccagggctgcccctgtaggttgcctccaggcatgctggcctcccaataaagctggacaagaagctgctatga

SEQ ID NO: 25862 - DNA, 609 bp, Homo sapiens
gctgcaggattcggcacgagagctgctccaggggccacgccacctccccagggaggggtccagaggcatggggacctggggtgcccctcacaggacacttccttgcaggaacagaggtgccatgcagccccgggtactccttgttgttgccctcctggcgctcctggcctctgcccgagcttcagaggccgaggatgcctcccttctcagcttcatgcagggctacatgaagcacgccaccaagaccgccaaggatgcactgagcagcgtgcaggagtcccaggtggcccagcaggccaggggctgggtgaccgatggcttcagttccctgaaagactactggagcaccgttaaggacaagttctctgagttctgggatttggaccctgaggtcagaccaacttcagccgtggctgcctgagacctcaataccccaagtccacctgcctatccatcctgccagctccttgggtcctgcaatctccagggctgcccctgtaggttgcttaaaagggacagtattctcagtgctctcctaccccacctcatgcctggcccccctccaggcatgctggcctcccaataaagctggacaagaagctgctatga

SEQ ID NO: 25863 - DNA, 706 bp, Homo sapiens
gctgcaggattcggcacgagagctgctccaggaacagaggtgccatgcagccccgggtactccttgttgttgccctcctggcgctcctggcctctgcccgagcttcagaggccgaggatgcctcccttctcagcttcatgcagggctacatgaagcacgccaccaagaccgccaaggatgcactgagcagcgtgcaggagtcccaggtggcccagcaggccaggggctgggtgaccgatggcttcagttccctgaaagactactggagcaccgttaaggacaagttctctgagttctgggatttggaccctgaggtcagaccaacttcagccgtggctgcctgagacctcaataccccaagtccacctgcctatccatcctgccagctccttgggtcctgcaatctccagggctgcccctgtaggttgcttaaaagggacagtattctcagtgctctcctaccccacctcatgcctggcccccctccaggcatgctggcctcccaataaagctggacaagaagctgctatgaaaaaaaaaaggaataacaataaaaagaactatacgaaaagaatacaaatactcaagggggggcccgagacccaaattgtcttatagtgagacgccttacaattaaatggcgggggggcccagtacccaaaattgcgaaaaccggggcgtatcccaattcactggccgtgcttta

SEQ ID NO: 25864 - DNA, 499 bp, Homo sapiens
gatcacccggcaagttcaggctgaattctgaaggcaaacttgagcagacggtctccatggcaacccgagcttcagaggccgaggatgcctcccttctcagcttcatgcagggctacatgaagcacgccaccaagaccgccaaggatgcactgagcagcgtgcaggagtcccaggtggcccagcaggccaggggctgggtgaccgatggcttcagttccctgaaagactactggagcaccgttaaggacaagttctctgagttctgggatttggaccctgaggtcagaccaacttcagccgtggctgcctgagacctcaataccccaagtccacctgcctatccatcctgccagctccttgggtcctgcaatctccagggctgcccctgtaggttgcttaaaagggacagtattctcagtgctctcctaccccacctcatgcctggcccccctccaggcatgctggcctcccaataaagctggacaagaagctgctatga

SEQ ID NO: 25865 - DNA, 567 bp, Homo sapiens
  misc_feature (561)..(561): n is a, c, g, or t
gctgcaggattcggcacgagagctgctccaggaacagaggtgccatgcagccccgggtactccttgttgttgccctcctggcgctcctggcctctgcccgagcttcagaggccgaggatgcctcccttctcagcttcatgcagggctacatgaagcacgccaccaagaccgccaaggatgcactgagcagcgtgcaggagtcccaggtggcccagcaggccaggggctgggtgaccgatggcttcagttccctgaaagactactggagcaccgttaaggacaagttctctgagttctgggatttggaccctgaggtcagaccaacttcagccgtggctgcctgagacctcaataccccaagtccacctgcctatccatcctgccagctccttgggtcctgcaatctccagggctgcccctgtaggttgcttaaaagggacagtattctcagtgctctcctaccccacctcatgcctggcccccctccaggcatgctggcctcccaataaagctggacaagaagctgctatgaaaaaaaaaaaaaaaaaaaaaaaaaaaacnaaaaaa

SEQ ID NO: 25866 - DNA, 436 bp, Homo sapiens
ggctgcagggctggcgggacagcagcgtggactcagtctcctagggatttcccaactctcccgcccgcttgctgcatctggacaccctgcctcaggccctcatctccactggtcagcaggtgacctttgcccagcgccctgggtcctcagtgcctgctgccctggagatgatatgctccaggaacagaggtgccatgcagccccgggtactccttgttgttgccctcctggcgctcctggcctctgcccgagcttcagaggccgaggatgcctcccttctcagcttcatgcagggctacatgaagcacgccaccaagaccgccaaggatgcactgagcagcgtgcaggagtcccaggtggcccagcaggccagggcctttgtcaggctgctgcgggagagatgacagagttgagactgcattcctcccaggtccct

SEQ ID NO: 25867 - DNA, 682 bp, Homo sapiens
ggctgcagggctggcgggacagcagcgtggactcagtctcctagggatttcccaactctcccgcccgcttgctgcatctggacaccctgcctcaggccctcatctccactggtcagcaggtgacctttgcccagcgccctgggtcctcagtgcctgctgccctggagatgatatgctccaggaacagaggtgccatgcagccccgggtactccttgttgttgccctcctggcgctcctggcctctgcccgagcttcagaggccgaggatgcctcccttctcagcttcatgcagggctacatgaagcacgccaccaagaccgccaaggatgcactgagcagcgtgcaggagtcccaggtggcccagcaggccaggggctgggtgaccgatggcttcagttccctgaaagactactggagcaccgttaaggacaagttctctgagttctgggatttggaccctgaggtcagaccaacttcagccgtggctgcctgagacctcaataccccaagtccacctgcctatccatcctgccagctccttgggtcctgcaatctccagggctgcccctgtaggttgcttaaaagggacagtattctcagtgctctcctaccccacctcatgcctggcccccctccaggcatgctggcctcccaataaagctggacaagaagctgctatga

SEQ ID NO: 25868 - DNA, 448 bp, Homo sapiens
cccatggtgtttgaatctgctccggctcctgttttatatcccatccttctccattttggtcagaaatattttctgttaccctgagattagcttgtactctaacagaaagaaagaaaattcctgtttaagattataagtggttcacttttagaattatctttttgctagtgccaaaagtttaatttattgttaagaataatgatttttttaattttgaaaatttaatttgtgttctttaaaagtaggcagtgtggaaaagtataaagaggagagtttaaaattattctaaattctatcaatagggctaatcttcattagtattagttaaatgtcattccagagagcattctcttcacatgtatattaatatgagaaagaaaaagtaggcagacagacatagcttatactatcatgaaaaagacatttttcattaaaaacattattcatc

SEQ ID NO: 25869 - DNA, 346 bp, Homo sapiens
ccccattgcagttcttccacaaactctgctagtctggcttcctccacttggatcttggcctccctatctctgacaaattcccctgaatgctgcagaagcccactcatatgtcactgatggttgggtatatgattgaacagattagaccctgcggcatggggctgccttagcctagaggaaggtgtgcccttttagaaagttatccaccaagagtgagacttcttcctactttgcacaaaggtgctgtacaggcaggcagaagctctgatcctctgctcccattgtcctctaggtgtttatggcactgagggcatgcttccccaagccagacctagcatctgactca

SEQ ID NO: 25870 - DNA, 408 bp, Homo sapiens
gattcaggagagggctgaagttcttgaatatcaagatgccgtcttcaacagtcctccttctgcctggacatgaatgggaaggaagctctcggcctcccacaccagcctgactcattttgaaggagaccgattacttcaaggcattcttctgtatctccttcaaaccccattctcttttaagttcgttcttttggcctcgttctgccctccggaaccctctcagattgaaattttcctggaactggagattctgtttttttgagacactctcactcactctactgcccgggctggagtccagtggcgcgatctcggctcactgcaaccttcgcctcccgagttccagcagttctcctgcctcagcctcccgagtaggtgacagagtgagactttgtctgcaaaaaaaaa

SEQ ID NO: 25871 - DNA, 487 bp, Homo sapiens
gccattatccacctagtacttgggagagggaactgagaatgcaggagaaaggtatctgctgaaggtggcagggcagtggcagctctatcagaagcttttgaggtaaagctttgtggctgtaggtgttgattctggggtccatgaggctgtcagtctttgctgtaatggcacagttgtagtcactgtggtggttgggtgagactgagggtatcctcaggtctcgcttgtaactgcaagtggtttgtggtgagctcctggatttagcaattgtggaggctttttttttttttttttttttaagaagactgccccgagtttcagcatccactgccttctcagcaggtgccttcatgcttctgcagtccagatttgctgtaacagtatagatatgcatcaatttatccattcaacaaatatttattcagccttttccatagagtagatgaggtgctagggatgcagccctaaatatgacatgattcctgtc

SEQ ID NO: 25872 - DNA, 478 bp, Homo sapiens
ctcactgtatgaaattgttcaataaactagttacatatacatatgatataataaactccatagatatttttaatgtaacattctatataatactatattaatataatattaattatatattagttatataatatatgtaatctatattaattaaaaatactatattaatctaatagagatattagattctagttgtggccaggcatggtgactcacgtctgtaatcccagtactttgggaggccaaggcagatggatcacttgaggccaggagttcaagaccagcctggccaacacagcaaaaccccatctctactaaaaatacaaaaaaattagccaggcatggtgacacatgcctgtaagctactcaggaggctgaggcaggagaattgcttgaacccgggaggcagaggttggggtgagctgagattgcgccgctgcactacagcctgggtgacagagagagactctgtctcaaa

SEQ ID NO: 25873 - DNA, 244 bp, Homo sapiens
taggaatttgtccatttcatctcagttttctacgttgatggcataaagttgttcataatattgtttcataatattttttaagtttgtacagttggtagtaatgtcacctctttcacttctgaagttggtaatttgggtctgctttttttctagtcagtgtagctaaatgtttttcaactttagtgatctctgcaaacttttagttacactgatttttctctagtacttttctgtttcattggtt

SEQ ID NO: 25874 - DNA, 124 bp, Homo sapiens
taaaaatctgacagtctctgagccccctctccctgcaatccatcctccatgatgccagaaatccaattatgtaacagagctaggatccagccactcctctgctcgcttcctgttaggggctgtg

SEQ ID NO: 25875 - DNA, 303 bp, Homo sapiens
aggataatttcttctccactcagctacctgagagacttttttaaaaaacatctgtcatggttgggcgcgatggctcaagcctctaatcccagcactttgggaggcctggcaggtggatcacttgaggtcaggagttcaagaccagcctggggtctttaacatagcaaaaccctgtctctacaaaatgtaaaaaaattagctagatgtaggtgtgcctgtagtcccagctactcaggaggctgagatggggggattgcttgaacctgggaggcgtgggttgcagtgagctgagatctgctactg

SEQ ID NO: 25876 - DNA, 364 bp, Homo sapiens
aacgccagcatctaacatgttcactatctacctagcccacttttctggagctctaagaataaaatctctgggctgggcgcggtggctcacgcctgtaatcctggcactttgggaggccgacgcaggcggatcaccagaggtcaggagtttgagaccagcctggccaatatggtgaaacccggcctctactaaaaatacaaaaaccagccaggcttggtggctggcgcctgtaatcccagctatttgggaggttgaggcaggagaattgcttgaacctgggaggcggaagttgcagtgagccaagactgtgctactgcactccagcctgggtgacagagcaagactgtctcaaaaaataaattaa

SEQ ID NO: 25877 - DNA, 327 bp, Homo sapiens
gcaacctccgcctcccagattcaagcaattctcctgcctcagcctaacaagtagctgagattacaggtacctgccaccacacctggctaatttttgtatttttggtagagacgaggtttcaccatgttggtcaggctggtcttgaactcctgacctcaagtgatcctcctgcctctgcctcccaaagtgctgggattgcagacatctgtcactgtgccctgccgcgggactgagcctttttaagaaatatttagggccaggcgcggtggctcacacctgtaatcccagcactgtaatcccagctacttgggaggctgaggcttgaac

SEQ ID NO: 25878 - DNA, 846 bp, Homo sapiens
gcctcaagaaagcctcagaaccagaaaaacaggctgctttaggttggaaaggaggtgttacagcagaggaactggccatgaccaccatccttggaatgtgaaacgcaaatcatcctgaaagcaacaagaataatggttgtaataattgtttccaggcctgggaccctgcatcttgttttttaagttgacctgatgaactagtaattgtaggaataaactgaatgtttgccagcaggagtcactctaggcttcctaataaaacgttagtaaattaaactctgtccttaaagctctgaaaggctgaggtgattgtgtgatatcagatggctttagggaaacactgactcttttcgttaagcatagcagcattcttagattattccttgggccttcttttgttcaccatcggttcttggatcttgttcctttcaagattggtccttaatgcatttttaaaaagcaacgtatatgggtaaggatatcaatatcttagtatgctgtattctgtatgttagctcattttggctttctaggatgaactgactctatcccacatcatgtaacttgaaatgaatagactcatatcctttccactgattgctgtccattctaatcatgcagcagaactcagtggagcgagctgtagtgtgaaaggagatgtcagttcatgcttttctgaaaagaatgggtccggtgtgatgatattctgaaatatttcagcaatagccatgaaatataatagtttcccaagcacacaaagctcaagaagttaattgttcatttatgtttgatactgggattgaaacattggattaaaaccaattaaatgttcctagaagcaacaga

SEQ ID NO: 25879 - DNA, 363 bp, Homo sapiens
tgagacatagtctcgctctgttgcccaggctggagtgcaatggcacaatcttggctcactgcaacctctgtctccaaggttcaagcaattctgcctcagcctcccgagtacctgggattacaggcacccaccatcacgcccagctgacttttctatttgtatttttagtagagacagggtttcaccatattggccagactagtcttgaactcctgacctcaagttatccacctaccttggcttcccaaagtgctgggattacccacgtgagccaccgctcctggccctgaggttctgattcctgtttgatgaacctgaagatgattagtcagcaaaccggggctaggtgggatgggcccatca

SEQ ID NO: 25880 - DNA, 497 bp, Homo sapiens
catcaccagcgaggggccatggaaggagcagactagactgctcaatctgctgtctccacctggcggacctaccatgtgattcacttacagacagttggtttgtttttgttttttgtttctctttttgacactgagtttcgctcttgttgcccaagccggagtgcagtggctcgatctcggctcaccacaacctctacctcccgggttcaagtgattctcctgcctcagccacccgagtaggtgggattacaggaacccaccaccacacctggctgattttctacttttagtaaagatggggtttctctatgttgatcaggctggtctgaaactaccgacttcaggaccgcctgcctcggccttccaaagtgcggggattactggcatgagccactgcccctggtcaagaattggtttttaatgcttccttcctccatacaacagaattcttttcaataatgatcattaaacaaaaggaataataataatgtccagaa

SEQ ID NO: 25881 - DNA, 463 bp, Homo sapiens
gatagaaaatggccaaacataagaatttaaagctgtagtcgaatgacccagtgagaaaaatggaaaacacctaagttcaaatctggctctgctttttcctttctcattttggacaggttacttcacctttctgagttgcattatctttagtcaccttataaaatgcaggaactggccaggtgtggtggcacatacctgtaatcccagcactttgggaggccgaggcgggtggatcacgaggtcaggagttcaagaccagcctggccaagatggtgaaacccagtctctactaaaaatacaaaaattagccaggtgtggtggcaggcgcctgtaatcccagctacttgggaggctgaggcagagaattccttgaacctgggaggcagaggttgcagtgagctgagatcgtgccactacgctccagcctgggcaacagagtgagactctgtctcaaaaaaaaaaa

SEQ ID NO: 25882 - DNA, 308 bp, Homo sapiens
gctttaagttggcagcacttcccaccccctgcagagaggaagtttgcatgccatgcacctaccttcttgattgcagctctcatggctacacagcaatagattagaaccccctcgtgctgaatcttgacttgatgaagacaatcaaaatgccccccaaaatgccccccaatacacaacacacgcacacacacacacctgcagccacctcagtttcctgttaagttattgtggtttgggagtcttcattgtcagttcacattagctgtgaagtcagaatccttctgtcatgggacttttagcaaaaaaaa

SEQ ID NO: 25883 - DNA, 622 bp, Homo sapiens
gtgagaaatgctgtgtagaatatgcagcttaggagtttggtagtaaatggttgtttttgaaggtaatttttgtgcattctcatctgatccttaaataaggctgtaaaaaagtagactgtgctttgcttcagaatgttgctttgaaatcagagtttaaggaagaggctgtcagtgtcagctagctggtactagaagaacccaaaggtggagatggctgccagtccaagtttgcttccaggggcgtatgctgcacccctttttcctcaggttctcttcttcacatctgtattctgattcttgtcctatcagatggattactctgtccacttaacaaccttgttaagtcttgcttgaattactgtaacataagaatgttccctggattcctggttaattcaaatctaaagcgcaggacacttgagggaaattaatggcttccttcattgagatgatctatttgttttccattgatgataggaatgacttccattatgaaaaattagttcactggcacacacactgtgggcggggacacacagggcttctgtggtttatttttacttctcgaaacaagaatgcacatccaagtaatctttcttctccgttgaagacaaaaaggtga

SEQ ID NO: 25884 - DNA, 451 bp, Homo sapiens
ggagaaatctggagatgcaattgctctcaaatagagaagaggcccagtaacaagaatgttaaaatgtggctgacttcaagaataggatcaaggtctcaaactagatagttctgaattcttcccccttcctataaggttgttctttcttctgcctggtgagttatgggagagtgacgggatatccttccttccaatctaacttatttctcttcttatagtccatatttataataaagacatcatcattccctttattgagttaaaaatccagaaatcaggctgggggcatggtggcttacacctgtaatcccagcactttgggaggccaaggtgggcaagagttcaagattcagcctgggcaacatgggcaaaaccccatgtccacaaaaaacacggagtttcaagaccagcctaggcaacatggcaaagccccatctctacaaaaaataga

SEQ ID NO: 25885 - DNA, 249 bp, Homo sapiens
taaaataaagcatgtcaaatagaaagcatcaagtcctgatataacagaatatataacactaaatataatcccaatacatacaaatgcattttttatttgcacatatttatgggggtaaatgagatgttgtgttacatgaatataatgtggtaatcaagtctggatattaaaggtgtccatcacttaagtacagtacatttttgttaagtatagtcatccgaagctactatcaaacaatgaatttattcc

SEQ ID NO: 25886 - DNA, 499 bp, Homo sapiens
tgctttggcggggcaaggcttgtttttcttagattgtatgatactagtcagaaaaataacgtggtctaaagatgccgaatttttaaatttatttttactgcttatggggggggggtgttgtagctgatggaaagcttaagcccctaagcccccaccccccattattaataatcagaatccttggaagtctcccgccgcctcccccttctgaccgcccagatttcatcaagccccaggaaggctccacaaggtccaggggaactgagccattttctggctcgtcgaagacaaatccaccgggcgggggaggggggcaactcgtgggaggccccaactcaccggaggggtgccctgggaggcgaacctggggtttacctcgaagagctcgcctcgaggtgcaggtgatgggggaatggggcgggggttgattaaaaaatgttcttcctttcttaaaaagaggagggggaagaacagactttaaattcttttgcaaacattc

SEQ ID NO: 25887 - DNA, 736 bp, Homo sapiens
ccgcctctgtgcattacagatgataaaacgaacccagaaaaaatgcaggggtcttgcctgacattctccagagagaatctggtcatctgactctggtcaactgacatccagcattttttttttgctagaccagctgaccagcatccgccggcagcacccccttccctctcccatcatgtgtgggtcatcctcctttccaccgcccacatggacccctccctctggtctcctgcatcctgcatggtgttggttatgtgaacaagttctttagtggtgatttctgagattttgggtgcacccatgattgggagcagtgtacactgtacctgtgtacactgtgtagtcttttatccctcacccccttcccaccctttcccccaaagtccccaaagtccattgtatctttttatgcctttggatcctcatagcttagctcccacttatgagtgagaacatacaatatttggttttccattcctgagttacttcacttagaatactaatctccagttccattctttttttttttttaacagcttataagttcctaggtccagtgtttcctgtctctaatcccagtttctcaggagggtgaggcgggagcaggcccctcctaccctcctgttcggtcattttagcagatgactttcaccctcatgccttttgcactgtgattgcaagaagggattatttttaactttatgaataggttatatgttcacatggacaccattga

SEQ ID NO: 25888 - DNA, 958 bp, Homo sapiens
tgccaagagctttcataattgttacttgaccctcacacaaaccttgtaatttgagataggtggtggtgtttctgttttacaggtaagaaacttaagatgcttagatattttgcccaaaatgatacaagcttgtcagctgcagagctgatacctgatcccaggactactttattctaagttgaatcttctttcttatacataggtactatgtagaacagactcaaatacaatttgatttgaatctgagtatagcagatattattggtacttccttaatttccgtgttccctggaaactttatagtaatactgattgtaaaaatgactataaaattactttttaaaagtgagataatttttctgtctacagggcactgtatctaaatattcacaccagtctttttctttttttaaccctcacaacactttgaagcagataatggctgatatactttattttactgacagtattgagatataaggagattaaatgagttaactgccttatatggcaataatttggcaatgatcttaaccttatctgtgagactatgttgagatttctgtagaagtgaaatttattgacttgtgaaactgaaacctttcagaggtagggctggcttaaagcattccttgatattgaggctcagatgatataatcagttctcttgctctccatttcttgtttccatttccactgggttgattccattctcagatagactttctccttattttggcaagagggctatagtacatctagctacatgtacttataatttcaaatttggtgaagagtgcctctcttctggcatttcctggaaaagacctgaaattcagtctgattggattggcttattggccttttcctatgacataaaacttctaatattgaaatctgaccagggcaaaaaacacttcgtggtgattgtatagtttaattttgtccttactcacgg

SEQ ID NO: 25889 - DNA, 511 bp, Homo sapiens
gccttatatggcaataatttggcaatgatcttaaccttatctgtgagactatgttgagatttctgtagaaaaactggttgttagaatttttcagttgtaagaaagaactaaacccaaactaagagtgaaatttattgacttgtgaaactgaaacctttcagaggtagggctggcttaaagcattccttgatattgaggctcagatgatataatcagttctcttgctctccatttcttgtttccatttccactgggttgattccattctcagatagactttctccttattttggcaagagggctatagtacatctagctacatgtacttataatttcaaatttggtgaagagtgcctctcttctggcatttcctggaaaagacctgaaattcagtctgattggattggcttattggccttttcctatgacataaaacttctaatattgaaatctgaccagggcaaaaaacacttcgtggtgattgtatagtttaattttgtccttactcacg

SEQ ID NO: 25890 - DNA, 265 bp, Homo sapiens
gatgagatttgggtggggacacagccaaaccataacagtgatggtatttgaaagcagggcttttggaagataattaggtttggaggaggtcatgagagtagggctcctgtaatgagaatagtgtacttataagaagagaaagagaccatagctctcactctgccatgtgaagacagtgagaaggtagtcaactgcatgccaggaagaggctctcaccaaacaccaaatccactgctcccttgatctcagacttcctaccctctag

SEQ ID NO: 25891 - DNA, 1346 bp, Homo sapiens
gcctccgcctcctcctcagtctccggctcttcccggccctgtctgtctctagcctgtggtgcagagcgggcggcggcggcggcggcgccggcggcgggatgaagcccgcactgcgcctgcgcgctcacggccccgcccggccccgcccctcgttcggggctggctgagggctccgaggccccaccgcagcgcgtctctccggtgaatggccgagggctgggtggggctgcggtgggcagcggtggcctttctccttcacacacatacacatgccttccaaatgtgcatggcttgggattcgcgtatttgtttaagagacgacggccacatccttttgttcggcgttcagcagactcctccgagttccgggatttctcccgactgaggcgtctccgtctcagtactctcggaggaaagcctcgaggggcagaactgccctctgttgtttcacggggctggaacctccctctccgcagcccaaagaatccggatggacccgcctttcccagaaccggagaccttggcctcctcaggctcccctctgactcaaacaaaagccggaattggaaagaccacccctttgatgtgttcgctgtaatcgacgtcctgctttcctcaaccgcccattcccttagccttcttagttgacaggaatattgagtatttgcaaggatgcgaagccagaaaaaaaaaaaagacttttaattctataaatcgtcccgctgcgtgcgcgcgtctgtccgtacagcgcggtgcccaccccgagagagggcctggattcaccaaggctgggggccttgagggctttttagggcacgtgaaaggaaaatggagttagagttgtgtcgggatagagagtgggatcattttgcactcaaggaattgagaagatcccgttggtaccgcagtttccaaggatttgtgtagtgcgttttttggatctggtttgtacaagcgaccagtataggagacgggatccctcccgcccttacaccccgctgcggggtcagccgacgtgggtgggattttgctggcggcgaggggagaaggtgacgtgcgtggcgccatgatcggaagtctggactgaattcttagctgcgaggtggaaaatgcgcgtgggagggcgatcttgaggggtgaagtctggccttcccatctcctaccaggcaggagggttatgctgaaggctggttttgctggtctttcattgtggctaagggcagttccacagatacagtcatagatagactccttaagtcatgctctgcttgcttcttctagtccgctgttacctctttatctgaatttgatgtaaataaatctccacattccttaaactggttctg

SEQ ID NO: 25892 - DNA, 279 bp, Homo sapiens
tggatggttggtgatgtattctggaagatggggatccaggagaaatgaaagagtgtggtttgaggagttcatctacagccaatgagacaggccagggggtcctgagacattcctccttggatatcatctgcgccagcttcctgattcacagatcgggaaactgagacccagagaaacacatagttagttagaggaggcttaaacccaggcttcctgacagcaaacaaccctgaatttaaccctaataaaagcatcactttgtttggtgaatttcccttc

SEQ ID NO: 25893 - DNA, 405 bp, Homo sapiens
cttctttccatcttacactgttgaattctgtactgcttctaaagcacctacaattaactctacaagaactgcacaattaacactcggcattgccttcttcctaattctaacatcgacattcatcagctttctccaatacagtcagatgattccttataatcatatctagccaaatgatgtaacttttgcttgatgtatgggaaaatagcttacattatgaatttagaagagctatagtagtatttgacaatatagatggaaaagtatttttaatttaaagaacatattgcacatctttcagaatttctgtaaaaacttttgaatgtccattttggctaggagcttagaaatgatcatgcttaagtttaattttgtgtttacattaaatcttttggattttcattc

SEQ ID NO: 25894 - DNA, 337 bp, Homo sapiens
ggagtcattttaataacataactaggctgatatatatgtacatttttcaatcatgtaacatttagattttactcattttaagtcattaacatcatccagcaaacaaaaattttccagaaatttttttcacaattacagttttagtctttaaaccaaaatgaaaaaatttctgccgggcatggtggctcacacctgtaatcccagcactttgggaggtcaaggtgggtggatcacctgaggtcaggagttcgaggccagcctggccaacgtggtgaaaccctgtctctaccaaaaatacaaaaattagcccagcgtgatggcccacctgtagtctcag

SEQ ID NO: 25895 - DNA, 1000 bp, Homo sapiens
ggccttccaaagtgctgggattacaggcgtgagtcaccgcgcccggccaaataaaataaaatgttaaagcaaattcaggactacccctcctccaagtcttctgttccctttgggcgcccaggtgagcgggggaggggctgggggagtaataacatcaaaagagcgccttttcctcccttattccgaggagacttccctgggcctgactcccggtcctgtccccagcgccccgcggcctctggagccccttcagtgaccaagatacagagatcaggacgcctttgcgccgccccaggtgcccgcccctagctggctctgcttgggccgcgagggaaggtgaggtcgggggcggagccggggcgtgacagccggggtgtgtgtccgccgggcttggtgcctccggtggccctgcagcaccgtcccacctctgccaccctccgatggggccgctacctgtgtgcctgccaatcatgctgctcctgctactgccgtcgctgctgctgctgctgcttctacctggccccgggtccggcgaggcctccaggatattacgtgtgcaccggcgtgggatcctggaactggcaggaactgtgggttgtgttggtccccgaacccccatcgcctatatgaaatatggttgcttttgtggcttgggaggccatggccagccccgcgatgccattgactggtgctgccatggccacgactgttgttacactcgagctgaggaggccggctgcagccccaagacagagcgctactcctggcagtgcgtcaatcagagcgtcctgtgcggaccggcagagaacaaatgccaagaactgttgtgcaagtgtgaccaggagattgctaactgcttagcccaaactgagtacaacttaaagtacctcttctacccccagttcctatgtgagccggactcgcccaagtgtgactgactaccttgacttgaaatgctcttttgcacaaggaaataaagcgtcctctcagtaatgaacaa

SEQ ID NO: 25896 - DNA, 170 bp, Homo sapiens
aaaatccttggcttaccactcaaatatgcaaatacaagggagcctccagggagccaggcttaacaaagcagaacctgggagccaaaagaactgagcacagaggtctgaccaccaaggctgctgaagccgcaacagcctaactctcccactgatcacaactaaaaactcta

SEQ ID NO: 25897 - DNA, 315 bp, Homo sapiens
cacactgagcctttgatcgcagctctccaccagacaccctcccatccaagcagccccagctgctcatttcaatctggtatgaattcctgctgagacaggaaccccctgcgggctgaaggggagggaaacttcagcagaaagaccttcagttggtctgagcagagtgggataggctctgcgccaggcctcccagttagaagtcaggagcctggaggagtctcagagcccagggagagaagcaggagcttgggccaccttaccctacctcctcaatggttgagtacttgctgtccacatttgccaagttgctacaga

SEQ ID NO: 25898 - DNA, 472 bp, Homo sapiens
tgcagtggagggcggtatccccagggtctgagcaagcctcaatcccactgatgagagtacaggccgaggccgggtgcaatggcttctgtctgtaatcccagcactttgagaggccattgtgggaggtttgcttgaggccagaagttggagatcagcctgggcaacatagcgagaccccatctctgcaaaagaataaaaatttaactggctgtggtggcatgcacctgtggttctagctacttaggaggctgaggtgggaggatcacttggaagcccaggagttcgaggctacagtgagctatgatcctgccactgcgctccagcttaggcaacagagtgagaccctgtctctattttaaaaaaagaaatcaaagaaatataaattggaaatgaaaaaataaactgtcactatttgcagtaacaagattgtgtatatatagacagagcaagacccagtctctcaaaaaaaaaa

SEQ ID NO: 25899 - DNA, 475 bp, Homo sapiens
caggaatctggcttgggttgctggatgcctttacttttaatgaagacatggaaggcaggaagaagaacaatggagaccaaggctggttaactctgatcaattgtttgatgatttcaatataaaagtattataataataacatattaaaatacttgagatatgagttcattacccttccacgtcaaaatacatccttgagtcaaaaaacatagccttgaatcaaaagaaattgattttctttctgttaaaagacagaaaatccttctctgagaagtggtattgcattatatttgaaataaccttgtacaatttataccaatcttgaatattattttaaaaattagaggtaggaaaagacattaaagatcctcttgctcttggccaggcgcagtggctcacgcctataatcccagcactttgggaggccgaggtgggtagatcacctgaggtcagatgttcaagaccagcctggcca

SEQ ID NO: 25900 - DNA, 277 bp, Homo sapiens
tattctccaatttcctaatgcgtcaaatggcagtattgactgctttgtgtgcctggctatttgggattaagtaccaataaataaattttaaaaaccacaaaacccagaaacatcatagcccttctctacatgagttcacagtttacgtctgggacagacacatgaacataagataaaatgataagtactactgtatgtgaaaacacttagacttatgaagtgcttctgtaagatacatttcttaaaatggttaaagtcagttgaagacctgttaaaa

SEQ ID NO: 25901 - DNA, 672 bp, Homo sapiens
gacaaaattaattcatatttagtctaatatattccaaaatccaagacttaatagggtaggaagcactgctgtgggccttaaaagttggttgctagattattattcctcttcctcgtcatcctgcccaatccctcatactaccctatttgtcctacgcagttgtcataatcatcacacagacacccacatgcctactatgtcatggtgtcaagtttaaattcttgaagtttgagaactttcatatacttccttggcatcttatgtttcctttaaaccttttattaatttcccaatctgtctgcaattctgcctaagacttttctgtcatccttaggaaggtgatgctgatttttttccccatactttggtccacctttctttaacccattactttctagcaattattttggcagttatttcattttcctaagacaaagattggaatgtgttgtcactgatgaaataatagaaatatatggttgagtcatgtacaaaataacttacaggccccaaccagtggccctcttcagggggtatttggaattatttaagtgacagacaacaaatttggactgaatcttaatatctagattctgtgggtaacaaaatctgtaaatagaaaataataaaatggttaggattagtccatatgagagtttgcgttcagaggtt

SEQ ID NO: 25902 - DNA, 410 bp, Homo sapiens
ttttttttttttgagatgaagtctcactcttttgcccaggcgagagtgcagtggggcaatctcggctcactgcaacctctgcctcttgggttcaagtgattctcgtgcctcagcctcccaagtagctgggactacaggcatgcatcactacacctggctaatttctgtactttttagtagagacatggaccatgttggccaaactggtctcagactcctgacctcaagtgatctgcccacctcggcctcccaaagtgctaggattataagcatgagccactgtgcccggcccaaatgaaggatcttttactaagccacgtggaagaggttcttggctaggcccaattagacttctaattgagacgaaagtctcaactggttaaaactgcaaaaatcaactatttaaaaga

SEQ ID NO: 25903 - DNA, 500 bp, Homo sapiens
gttttctcccatggtgttcatgtggagtaggcaggtttttttctcctgcggcgttaccccttttcccattcatttggctttttttctttgtctgtatccattgatgttttctggttgtagaccattgcacccaagccaaaagaaagcaaaagaaggcaaaaagtaagtataggaaagaccccaggaagcttactcccaggatattccacatatccgagagtgcctagattttatttataattagcaagaggaatagactggaatatacttggctccatcttgtgtggaatttgaagtgcccaaagcagcctttcaaagacagatttttaatctaagaaaccctgtctctactaacagtacaaaaattagccgggcatcgtggcaggcatccaagagaccaaggcaggagaatcacttgaactcaggaggaggaggttgcagtgagccaagggcatgtcactgcactccagcttgggcgacaagagcaaaactccatctca

SEQ ID NO: 25904 - DNA, 284 bp, Homo sapiens
tgactggagcagagagggtcagacttgcaacgcttttcagaatgaaatatccaacccaactcagtgattggattctgcggtataacttcacattgtcaagaatattcaaccagaaaaataaaatgcctctgacacactcttctgttcatggacttacctacagaagagaagaaaaaactctcttctcagcagttcttgcctatttctcagcaatctcctaatacaattgctgtatttgattttatgcattgtttgtgcctgcaaataacatacatcctgtttcc

SEQ ID NO: 25905 - DNA, 365 bp, Homo sapiens
cttgttttactatcacgttgctttttaaagccagcctgctttttccagttgggaggcctcggggagaaaagtctgacccaagtgagaaacacctgtaatatctaccagatgccagcagggtgtcccatggtgctgtctttgatccatgttcttaccctgtgtgctgagggttgttctagagtaggactacatctagtcacagtggccatgttccagagcctggcagcaagaaagagggatgcctagctccttggctttccagtgtgcagtgcacagccagctctctcagagaagccctggccctcttttgacccctactattgaggctggccccacaggaggacagctggtcacacagtggctgg

SEQ ID NO: 25906 - DNA, 412 bp, Homo sapiens
tgctatttcatcattctttttcttaaagtaaaattcaaagttaaaactttcttacattgggttgtttcacctaatccctgaaggcatttgagttttcaactcctgtcttaacctctaagcctgacttctcatctgtcaaatcttctcatctgtcaaatgcaaaaaaataacatttatctataattctgaaaaaaagccctgcagggtaaagcatgcatagagaacactgcctggcacatggaaagtgtttgaaaacggttaatataaggagctcaaaaaccatttacaaaatgaatgaatagaccaggcatagtggctcatgcctgtaatcccaacaccttgagacgccgaaagatcgcttagtccaggagtctgggaacagcctagccaacataacaagacccagtctgta

SEQ ID NO: 25907 - DNA, 351 bp, Homo sapiens
taagtcttgtatttcacctcctggaggtaaatattttttaacaatttgtcactgttcctccttttgttttcctttctgtgagcaatttcacccaaattggaaccatgctgtatacagtttggtagctggctttttatgtcttaccattatctctcatttgcattctcccacatctttaattatagcgtatcagttagggcccagcaggaaacagatggcccgtcaatttaggataatttgaggtggggttgataccagaagcctttataaagcgattggatagtaaaggcaaatgacaagagctagtgcaagctcctggggccagcatgggtgaggggcctcatccacagg

SEQ ID NO: 25908 - DNA, 387 bp, Homo sapiens
tgacagagtcttgctctgttgcccaggatggagtgcagtgctccgatctcggctcactgcaacctcagcttcctgggttcaagcgatctcctgccccagcctcttgagtagctgggaccacagacacgcaccaccacacccggccaattccaccttttatcttagtaagcagtaatatcaatgtccttctataaatatttttgctcttctataaatcacttttacaagtgttggtagtatattgctgtttataaaagaactgaaccgcctttaatgaaaacatatttacactaaaattaaaactctatcaaggatttgaaattgcttgtatcataaactattgttagtatttgctcctatttatattcccaagtggagagtaagctg

SEQ ID NO: 25909 - DNA, 334 bp, Homo sapiens
gcagatgctgaagaaaatttccaaaaaccataaaaaagacaaaataactttcaataaaatgtttactaaataaagtcaagaaatgtatcaaagtagaacagaaagtcaaagacatgtacagtataaaaggtaagaaaaatcaaaacaaatacagaagatccagtaattaccccatagtggtaataggaagggtaataggaataggtaataggaagaaagaacagaaaatgagaagattttatcaactaatgctggaaaattttccagaatgaaaagactttagcatctagaataaagtggcccaccaacagctcagcacaatatgtatgttaaa

SEQ ID NO: 25910 - DNA, 283 bp, Homo sapiens
ggtattttaaaatatttggtagtcacttaaaatgcataatgacagacaatagggtgtcataatatggtttattaatcttttttcattttccactagatgtggcaactacatagttggaagaaatgtggcggccgggggcagtggctcacgcctgtaatcctagcactttgggaggctgaggcaggagagtcgcttgaacctgcgagtcagaggttgcagtgagccaagatcgctccacttcactccagcctggtcaaaagagtgagactctgtctcaaaaaaa

SEQ ID NO: 25911 - DNA, 398 bp, Homo sapiens
ccaaaacctagcacatgtttgtgaatgcaggcacccgtatggggcgataggtataagtgctaattactaacttgcaccagtcttcacttcttgaatgtcgcctccttcccaagagaggatgggaaaacctcccagctgtattctgtttggaataattggatgtgagcataggaaataaatatgttttacatactccttttatgattcactataaaaggaggtgatcagtttttgttttcacttttttgagacagggtctcactttgtcacctaggctggagtgcagtggcatgatcatggctcactgcagcctcaaacttctgggctcaggcaatcctcctgccttatcctctcaagtagctaggactacaggcaagtacctccacacccagctaatt

SEQ ID NO: 25912 - DNA, 471 bp, Homo sapiens
gtgacagtcatatttgaattatgcctgtagcctgctatctggtcccccttttttaagtctttcttactctagttcattatatataccatttccagaataaacttcacagttaatgccttctctacatttgagaaccaatggtagcagtctgtattcattgcatttgctttgaccataccatacaagaattaacaaggttctgattatttcatttgtcttctatcttggccctactctggctaccccttttcagcctaatcagtttttaccaatcctccaatccttgcatctgattttcttccccctctctgccccttattattattatttttttttatttttatttttatttttatttatttatttttttttgaggcagggtctcactctgttatccaggctggaggttgtggtgagctgagatcgcaccattgtactccagtgtgggcaacacgagtgaaattcgtcaca

SEQ ID NO: 25913 - DNA, 494 bp, Homo sapiens
gtgcttacttgaggcagaatgatgatttgcacatacctgtgatagcctttttctttaatatctggtcccccttttttaagtctttcttactctagttcattatatataccatttccagaataaacttcacagttaatgccttctctacatttgagaaccaatggtagcagtctgtattcattgcatttgctttgaccataccatacaagaattaacaaggttctgattatttcatttgtcttctatcttggccctactctggctaccccttttcagcctaatcagtttttaccaatcctccaatccttgcatctgattttcttccccctctctgccccttattattattatttttttttatttttatttttatttttatttatttatttttttttgaggcagggtctcactctgttatccaggctggaggttgtggtgagctgagatcgcaccattgtactccagtgtgggcaacacgagtgaaattcgtcaca

SEQ ID NO: 25914 - DNA, 855 bp, Homo sapiens
aaagcttctgttttgtcaagaaagcaaaacagagttgaagtgatagctcgtaagatttaagcatgaaggtctaacaggactatgccataggagaggatcaaaaaaaagaaaaaatgataattttatcattaaacccacggtctcagcccaaattctctgctccagaaaagctaatccaaacatttcagaaactgtcattacctggcaggcaatttccaacttcattcctacaaaaatgtaaggagggcatgcacagcttcttacagcaccctgatctttgagagagaaatgccagctcttctctgcctcatgacttataccttcaggcagaggaaggaaaagcagtgtgaattatgtttacatatgcttaggaattgcatttgacaaggcataatgaatcagcgatgttttcttgtttggtttctgtctcaaaattgatctagctccaagtttagaagaccctacgacgtgactcagtaagtggcctcaccttcatccgattgctcagaattaaaacctagaagtcatccttgattttctcctctcaaatctgtctccattcatcagcacgtgcttttgactcgatgaaacgctccaaacacaactgcttcccaccgcctccactgctgcctcttgtccctgcagcatcatctctcacccacattggccacagcggcttgttgttggtgttcctgcttctacttttgacttgtttctattgtcttccatgcccactggaactgtaattattttttgcaaatgtaagttagataatgacattccactgtaaaaaaaaaaacaaaacagaaaacaaaatgaaagaacaaaataaaaatgtctagtgaccccctgtta

SEQ ID NO: 25915 - DNA, 1230 bp, Homo sapiens
gctctctgttcaagtcattccacacatttccctattttaggctattataatatagaaagaaaatgggaagcattagttggagctagaaaatgaactgtatattattgctatatttgctaataccaactatttcaataagtgttgtaccatatgtagcattaaatataaaatacataaaagaatgtacagaaaatagcttttattgagtaatattacatttcatttatactgtagcaatatatttgtaggtatactatgtaagggctttaaataaaagaggtccattaatacttccttataaaaattctagtctgtttcattactgcccagatgttttagagataaatatttatgcagaaggtatttttgaagtctccttttgtctgatagagtttaacagatatttaaatttagtgctcagaatccacaagtcacggtctaaacacacttagaatactacagcataaatctgttagcattattgccaaataagacagttgggatccaaacccaagtcttgagcaatgtttttctcaaaaagctgctatccaatgatataggaaaatacattgtgttttcctaaacacacttttctttttaaatgtgcttcattgtttgatttggtcctgcctaaatttcacaagctaggccaatgaaggctgaatcaaagacatttcatccaccaatatcatgtgtagatattatgtatagaaaataaaataaattatggctctaacttctgtgttgctcttccagacttctcatggctaacttttggtctgtattttgctccttagatgtgaatatttcttattagtctgcttcctgctacgcaatgactgcatttctatcatttctcagtttgttagtatatgtggatagtattctactgtataaatgattgcaaagtttatcaaaaacaaattattatatgtagcttttctacagtgctttgctaaaccatgtagtactagttaagtcttccttgaaaataaagatacactcttataggggacagttcctgttcactcccaggaaacttttttaaaagatgacactgaatgtttattgcactttagtgcagtgaagtggcaataaaacctaacatgaatcaaggttgtttatggcagatgcatgtgttgctttacagagtttagcaaaagctcttaattttatgtcatactgtattctactgaataataaagctaacattattcaataataaaatgg

SEQ ID NO: 25916 - DNA, 738 bp, Homo sapiens
tttaaataaaagaggtccattaatacttccttataaaaattctagtctgtttcattactgcccagatgttttagagataaatatttatgcagaaggtatttttgaagtctccttttgtctgatagagtttaacagatatttaaatttagtgctcagaatccacaagtcacggtctaaacacacttagaatactacagcataaatctgttagcattattgccaaataagacagttgggatccaaacccaagtcttgagcaatgtttttctcaaaaagctgctatccaatgatataggaaaatacattgtgttttcctaaacacacttttctttttaaatgtgcttcattgtttgatttggtcctgcctaaatttcacaagctaggccaatgaaggctgaatcaaagacatttcatccaccaatatcatgtgtagatattatgtatagaaaataaaataaattatggctctaacttctgtgttgctgtttatcttgttatttttcggcgttatactaatgtgtttattgagagcattttaccttccagacttctcatggctaacttttggtctgtattttgctccttagatgtgaatatttcttattagtctgcttcctgctacgcaatgactgcatttctatcatttctcagtttgttagtatatgtggatagtattctactgtataaatgattgcaaagtttatcaaaaacaaattattatatgtagcttttctacag

SEQ ID NO: 25917 - DNA, 4660 bp, Homo sapiens
gcaaaggtgactggcttcagtgaaggtgtggtggatagtgtcaaaggtgggttttccagcttctcccaggccacccattcagcagcaggcgctgtagtctcaaagcccagagagattgcctcactcattcggaacaaatttggcagtgcagacaacatccccaacctgaaggactctttagaggaagggcaagtggatgatgcggggaaggctttgggagtgatttcaaactttcagtctagcccaaaatatggtagtgaagaagattgttctagtgccacttcaggctcagtgggagccaacagcaccacagggggcatcgctgtaggagcatccagctccaaaacaaacaccctggacatgcagagctcaggatttgatgcactactacatgagatccaggagatccgggaaacccaggccagactagaggaatcctttgagactctcaaggaacattatcagagggactattccttaataatgcagaccttacaggaggagcgatatagatgtgaacgattggaagaacagctaaatgacctaacagagctccaccagaatgaaatcttgaacttgaagcaggaactggcaagcatggaagaaaaaatcgcgtatcagtcctatgaacgggcccgggacatccaggaggccctggaggcatgccagacgcgcatctccaagatggagctgcagcagcagcagcagcaggtggtgcagctagaagggctggagaatgccactgcccggaaccttctgggcaaactcatcaacatcctcctggctgtcatggcagtccttttggtctttgtctccactgtagccaactgtgtggtccccctcatgaagactcgcaacaggacgttcagcactttattccttgtggtttttattgcctttctctggaagcactgggacgccctcttcagctatgtggaacggttcttttcatcccctagatgatgctggcacagaaggcattgttccctaccctctggcgagtgcatgcagcagagagttagacagcaacttacctactctgaagttttctacaacaaaaaaagagttgagtgaatctgtttacatttagaataatgtttttttcttcaagagacgcaattgcaatagtattttttagattttatccaagaagttttttgggcgaaaatcttggatcatttttatgtagcatgattttccttgggatgcaaatcttaaaacagtcctttaatatgaaccaacaatctggagcacaccgaagggcaatctaaattgtggcttgaaggactgcactaaaacccactaaaaagatgcgaaaacctgatgagggcaaaccagttaaacctaacaccctgccttgtctgggctcatcacctctccctatcccagactaactttactgtgaaatcctaccacattccatgtctgaatttttggattcggggtggattttcgttgtccgtggaagaacacatggatctctctggctttctcacccaagttggccacttacgctaatcctggaagtatgatcacttttgaacctgccccttaaccttgacgaggatacaaaagtgaaagcatcatcccccaaaggatcactgcacagtcctactacagtatttttaagtagccctctaaatacttaattttaagcaaaatcccttggccgcacttttaaggtttttttatatgtgtatagttaccaacctaaaaataaaaaatccgaacagcatacttgaagaatgtaatactcaaactctcagtgcttccttatggtttctaataggattttttattattgttattattattattgggtttttttggacagggttgggagggtcttttatttttcctttgaaataaagaagtgatgtttttaaatgaagaaatgtgtggatatttaagtgtgctgctccctcttgtcttgaaacagtttgagtaagaaagtcttgctgtaaatgctgccctctgccgcctttgttttgagatgcagtttaaactccctctggctgctgctgctgctttttggtgtcccgacatacctacgcccccgttttatgggtttggcttagttgaagaggaaagggttgtgcaaggagagcaggaggctgtttccaaaaaccagtgtagtaggatagggatttttttttttttttttgccccaagaaaacgttcacccagtgatcttgggctggggttgtctttaggaaaagttgagactataagagtcataaataagtccttgtgtttccttaatttattttgttaacacccctaattacaaccaaagtgatgatgtggagtcttctgtcttcattttggccccagcattcttaatttcaaagctttattctgtctgcctaagagaatcaaccaaaggtgattctcctaaagagcagtgaaggaaatgtcaggttagcaggacccaagttttgggtgtgaaatgttgccagcttcctataatgtaaacggacttgttaacctaacctaattatgctcagtggacttctatagatggttttgaaaaatgaactgagctgccttcccgcatcgcataaccagttccatcatcctggtggaacttgaacatttagagtttatctagagagcttggttaatctttccatattatttgtagtattggtcacaaatgctgttccctcttagcctcattctgtgcaaccaagtgcatataagatgccctgaaaagagtaacaaagtatgctttgcctgtttccacttaccaggaaattccttcagaactagattagcattgccctgcctgtctgaaaggacagtttacctaatggtgccagcctccttttgctttggcaagctggatttctcagagccagcatgttgtttccataactactttgatattttaactcaggtactccagtcttcaccccaacctcagctgattgtagtacacctgctagctctgttgccccctcaaaactgcacccagagcagggccacaagggtgctttttttctttaaaaaaaaaaaaattagaaccaattcatgttcatgccaaaaacaaattgtccccaagcctatatgtattaaaatgttaactttgcctaaaaatattgcagtgactttttaggcaggagtgccaaaggacactatgaactttttgaactgacagtttctcctaactttctgctttagcgtaattgctcagagtagagagcccccacaaagttatttaaaagatgccctagcagcaatccaccagtttttctaagctagaacctttgagtcccccaaactgcctgaagacttaagttttgtgggcactggaagtcactttgatagatggattgaaactgttcctatttgccctgggacggtttctatctatcaaaggaaggttttcacctgtagaaagccccctgcctccagccaaatagtcccatgctgactttctatcttcctttctcaaactgtcttaggaaggaccttcagtgcagatcaggtgcagtaatggctttcttgtcccttaattattcaccagacccagaagttgtacgcatttaatgctgtttgtaaccatgcatctgttttcattctttgctgtaccttttgctgcccatcctgttacttttgagtttctttcattgtggttgttcttgggttcttttgtcttgtcagagctcttctataacctcgctctaatggcttaacagttgttctgggtggaaacgtcccctcatttgaatgctcctctaaaaaaaaaaagaaaagaaaactgtattcattccctttaaaatgaaacattcctggtttatttgtccatgcctctagcctgggtgagtgaagctggctgtgttggcctgggtgattgttcaggttgtagaatgcgcattttacattgtttatgataattgaagggtacttctgtctgctccaatttccattccttggtatactcagtatgtcctagtaaggaaggctttccactctactggctccttaagaagcaaaagtaggttaaattttatacttcactgactagggtcttctctctcccctgttctgaatggagtaaaagtctgatgccaagacaaatattgggagcgagccttcctcactagccatgtccaaataatgagcgtattttcatgtggtcttcactgcatttggttttgtttctgatttcatgttcctttgaggtacagtcagatgaaaatgctgagttctgagagagttccaatgaggagctgcctttcagctttggaaaatatgcatctaaaacaaaaccaaacattattgtaatctgacacaggcaaaattatggttcccacaccccaaccccaaatgaaacctgggattttgaatgtggctctaagagttaacattgctgtctgtatgtcgtgtatgctaggtgatatcctcagtagggattgactactagactgtgtgttttatcaaagtgtgtaagaataaaaactcacttgcacgaattgaaacgtaaagaaatgacacttgtgaacgtgtgaacgttaacactgtagttgatagatcttaagctgctaattgttgagagagatttaaatttatgttctgtctggtcgctgcagattctcagcagcacttttactgtatatagaaattgaaataaagacctcagctattaaaaaaaaaa

SEQ ID NO: 25918 - DNA, 4219 bp, Homo sapiens
agaaggcagtatagagactcctatcaaggataaagaagaactaaatagagtttagtaacatcgtaaaaaggatgtgaacgattggaagaacagctaaatgacctaacagagctccaccagaatgaaatcttgaacttgaagcaggaactggcaagcatggaagaaaaaatcgcgtatcagtcctatgaacgggcccgggacatccaggaggccctggaggcatgccagacgcgcatctccaagatggagctgcagcagcagcagcagcaggtggtgcagctagaagggctggagaatgccactgcccggaaccttctgggcaaactcatcaacatcctcctggctgtcatggcagtccttttggtctttgtctccactgtagccaactgtgtggtccccctcatgaagactcgcaacaggacgttcagcactttattccttgtggtttttattgcctttctctggaagcactgggacgccctcttcagctatgtggaacggttcttttcatcccctagatgatgctggcacagaaggcattgttccctaccctctggcgagtgcatgcagcagagagttagacagcaacttacctactctgaagttttctacaacaaaaaaagagttgagtgaatctgtttacatttagaataatgtttttttcttcaagagacgcaattgcaatagtattttttagattttatccaagaagttttttgggcgaaaatcttggatcatttttatgtagcatgattttccttgggatgcaaatcttaaaacagtcctttaatatgaaccaacaatctggagcacaccgaagggcaatctaaattgtggcttgaaggactgcactaaaacccactaaaaagatgcgaaaacctgatgagggcaaaccagttaaacctaacaccctgccttgtctgggctcatcacctctccctatcccagactaactttactgtgaaatcctaccacattccatgtctgaatttttggattcggggtggattttcgttgtccgtggaagaacacatggatctctctggctttctcacccaagttggccacttacgctaatcctggaagtatgatcacttttgaacctgccccttaaccttgacgaggatacaaaagtgaaagcatcatcccccaaaggatcactgcacagtcctactacagtatttttaagtagccctctaaatacttaattttaagcaaaatcccttggccgcacttttaaggtttttttatatgtgtatagttaccaacctaaaaataaaaaatccgaacagcatacttgaagaatgtaatactcaaactctcagtgcttccttatggtttctaataggattttttattattgttattattattattgggtttttttggacagggttgggagggtcttttatttttcctttgaaataaagaagtgatgtttttaaatgaagaaatgtgtggatatttaagtgtgctgctccctcttgtcttgaaacagtttgagtaagaaagtcttgctgtaaatgctgccctctgccgcctttgttttgagatgcagtttaaactccctctggctgctgctgctgctttttggtgtcccgacatacctacgcccccgttttatgggtttggcttagttgaagaggaaagggttgtgcaaggagagcaggaggctgtttccaaaaaccagtgtagtaggatagggatttttttttttttttttgccccaagaaaacgttcacccagtgatcttgggctggggttgtctttaggaaaagttgagactataagagtcataaataagtccttgtgtttccttaatttattttgttaacacccctaattacaaccaaagtgatgatgtggagtcttctgtcttcattttggccccagcattcttaatttcaaagctttattctgtctgcctaagagaatcaaccaaaggtgattctcctaaagagcagtgaaggaaatgtcaggttagcaggacccaagttttgggtgtgaaatgttgccagcttcctataatgtaaacggacttgttaacctaacctaattatgctcagtggacttctatagatggttttgaaaaatgaactgagctgccttcccgcatcgcataaccagttccatcatcctggtggaacttgaacatttagagtttatctagagagcttggttaatctttccatattatttgtagtattggtcacaaatgctgttccctcttagcctcattctgtgcaaccaagtgcatataagatgccctgaaaagagtaacaaagtatgctttgcctgtttccacttaccaggaaattccttcagaactagattagcattgccctgcctgtctgaaaggacagtttacctaatggtgccagcctccttttgctttggcaagctggatttctcagagccagcatgttgtttccataactactttgatattttaactcaggtactccagtcttcaccccaacctcagctgattgtagtacacctgctagctctgttgccccctcaaaactgcacccagagcagggccacaagggtgctttttttctttaaaaaaaaaaaaattagaaccaattcatgttcatgccaaaaacaaattgtccccaagcctatatgtattaaaatgttaactttgcctaaaaatattgcagtgactttttaggcaggagtgccaaaggacactatgaactttttgaactgacagtttctcctaactttctgctttagcgtaattgctcagagtagagagcccccacaaagttatttaaaagatgccctagcagcaatccaccagtttttctaagctagaacctttgagtcccccaaactgcctgaagacttaagttttgtgggcactggaagtcactttgatagatggattgaaactgttcctatttgccctgggacggtttctatctatcaaaggaaggttttcacctgtagaaagccccctgcctccagccaaatagtcccatgctgactttctatcttcctttctcaaactgtcttaggaaggaccttcagtgcagatcaggtgcagtaatggctttcttgtcccttaattattcaccagacccagaagttgtacgcatttaatgctgtttgtaaccatgcatctgttttcattctttgctgtaccttttgctgcccatcctgttacttttgagtttctttcattgtggttgttcttgggttcttttgtcttgtcagagctcttctataacctcgctctaatggcttaacagttgttctgggtggaaacgtcccctcatttgaatgctcctctaaaaaaaaaaagaaaagaaaactgtattcattccctttaaaatgaaacattcctggtttatttgtccatgcctctagcctgggtgagtgaagctggctgtgttggcctgggtgattgttcaggttgtagaatgcgcattttacattgtttatgataattgaagggtacttctgtctgctccaatttccattccttggtatactcagtatgtcctagtaaggaaggctttccactctactggctccttaagaagcaaaagtaggttaaattttatacttcactgactagggtcttctctctcccctgttctgaatggagtaaaagtctgatgccaagacaaatattgggagcgagccttcctcactagccatgtccaaataatgagcgtattttcatgtggtcttcactgcatttggttttgtttctgatttcatgttcctttgaggtacagtcagatgaaaatgctgagttctgagagagttccaatgaggagctgcctttcagctttggaaaatatgcatctaaaacaaaaccaaacattattgtaatctgacacaggcaaaattatggttcccacaccccaaccccaaatgaaacctgggattttgaatgtggctctaagagttaacattgctgtctgtatgtcgtgtatgctaggtgatatcctcagtagggattgactactagactgtgtgttttatcaaagtgtgtaagaataaaaactcacttgcacgaattgaaacgtaaagaaatgacacttgtgaacgtgtgaacgttaacactgtagttgatagatcttaagctgctaattgttgagagagatttaaatttatgttctgtctggtcgctgcagattctcagcagcacttttactgtatatagaaattgaaataaagacctcagctattaaaaaaaaaa

SEQ ID NO: 25919 - DNA, 3738 bp, Homo sapiens
atgaaggcatgttgtagacattgtgatgcagcacagatgaagttaacagtgaagacatggatgcttactgcaggaaagaaaacacttcagaaatctgcagtcacaatggagagtgcgtctgcggaagtatgtagtcgactacatacttctgaatctgtttacatttagaataatgtttttttcttcaagagacgcaattgcaatagtattttttagattttatccaagaagttttttgggcgaaaatcttggatcatttttatgtagcatgattttccttgggatgcaaatcttaaaacagtcctttaatatgaaccaacaatctggagcacaccgaagggcaatctaaattgtggcttgaaggactgcactaaaacccactaaaaagatgcgaaaacctgatgagggcaaaccagttaaacctaacaccctgccttgtctgggctcatcacctctccctatcccagactaactttactgtgaaatcctaccacattccatgtctgaatttttggattcggggtggattttcgttgtccgtggaagaacacatggatctctctggctttctcacccaagttggccacttacgctaatcctggaagtatgatcacttttgaacctgccccttaaccttgacgaggatacaaaagtgaaagcatcatcccccaaaggatcactgcacagtcctactacagtatttttaagtagccctctaaatacttaattttaagcaaaatcccttggccgcacttttaaggtttttttatatgtgtatagttaccaacctaaaaataaaaaatccgaacagcatacttgaagaatgtaatactcaaactctcagtgcttccttatggtttctaataggattttttattattgttattattattattgggtttttttggacagggttgggagggtcttttatttttcctttgaaataaagaagtgatgtttttaaatgaagaaatgtgtggatatttaagtgtgctgctccctcttgtcttgaaacagtttgagtaagaaagtcttgctgtaaatgctgccctctgccgcctttgttttgagatgcagtttaaactccctctggctgctgctgctgctttttggtgtcccgacatacctacgcccccgttttatgggtttggcttagttgaagaggaaagggttgtgcaaggagagcaggaggctgtttccaaaaaccagtgtagtaggatagggatttttttttttttttttgccccaagaaaacgttcacccagtgatcttgggctggggttgtctttaggaaaagttgagactataagagtcataaataagtccttgtgtttccttaatttattttgttaacacccctaattacaaccaaagtgatgatgtggagtcttctgtcttcattttggccccagcattcttaatttcaaagctttattctgtctgcctaagagaatcaaccaaaggtgattctcctaaagagcagtgaaggaaatgtcaggttagcaggacccaagttttgggtgtgaaatgttgccagcttcctataatgtaaacggacttgttaacctaacctaattatgctcagtggacttctatagatggttttgaaaaatgaactgagctgccttcccgcatcgcataaccagttccatcatcctggtggaacttgaacatttagagtttatctagagagcttggttaatctttccatattatttgtagtattggtcacaaatgctgttccctcttagcctcattctgtgcaaccaagtgcatataagatgccctgaaaagagtaacaaagtatgctttgcctgtttccacttaccaggaaattccttcagaactagattagcattgccctgcctgtctgaaaggacagtttacctaatggtgccagcctccttttgctttggcaagctggatttctcagagccagcatgttgtttccataactactttgatattttaactcaggtactccagtcttcaccccaacctcagctgattgtagtacacctgctagctctgttgccccctcaaaactgcacccagagcagggccacaagggtgctttttttctttaaaaaaaaaaaaattagaaccaattcatgttcatgccaaaaacaaattgtccccaagcctatatgtattaaaatgttaactttgcctaaaaatattgcagtgactttttaggcaggagtgccaaaggacactatgaactttttgaactgacagtttctcctaactttctgctttagcgtaattgctcagagtagagagcccccacaaagttatttaaaagatgccctagcagcaatccaccagtttttctaagctagaacctttgagtcccccaaactgcctgaagacttaagttttgtgggcactggaagtcactttgatagatggattgaaactgttcctatttgccctgggacggtttctatctatcaaaggaaggttttcacctgtagaaagccccctgcctccagccaaatagtcccatgctgactttctatcttcctttctcaaactgtcttaggaaggaccttcagtgcagatcaggtgcagtaatggctttcttgtcccttaattattcaccagacccagaagttgtacgcatttaatgctgtttgtaaccatgcatctgttttcattctttgctgtaccttttgctgcccatcctgttacttttgagtttctttcattgtggttgttcttgggttcttttgtcttgtcagagctcttctataacctcgctctaatggcttaacagttgttctgggtggaaacgtcccctcatttgaatgctcctctaaaaaaaaaaagaaaagaaaactgtattcattccctttaaaatgaaacattcctggtttatttgtccatgcctctagcctgggtgagtgaagctggctgtgttggcctgggtgattgttcaggttgtagaatgcgcattttacattgtttatgataattgaagggtacttctgtctgctccaatttccattccttggtatactcagtatgtcctagtaaggaaggctttccactctactggctccttaagaagcaaaagtaggttaaattttatacttcactgactagggtcttctctctcccctgttctgaatggagtaaaagtctgatgccaagacaaatattgggagcgagccttcctcactagccatgtccaaataatgagcgtattttcatgtggtcttcactgcatttggttttgtttctgatttcatgttcctttgaggtacagtcagatgaaaatgctgagttctgagagagttccaatgaggagctgcctttcagctttggaaaatatgcatctaaaacaaaaccaaacattattgtaatctgacacaggcaaaattatggttcccacaccccaaccccaaatgaaacctgggattttgaatgtggctctaagagttaacattgctgtctgtatgtcgtgtatgctaggtgatatcctcagtagggattgactactagactgtgtgttttatcaaagtgtgtaagaataaaaactcacttgcacgaattgaaacgtaaagaaatgacacttgtgaacgtgtgaacgttaacactgtagttgatagatcttaagctgctaattgttgagagagatttaaatttatgttctgtctggtcgctgcagattctcagcagcacttttactgtatatagaaattgaaataaagacctcagctattaaaaaaaaaa

SEQ ID NO: 25920 - DNA, 1895 bp, Homo sapiens
gcaaaggtgactggcttcagtgaaggtgtggtggatagtgtcaaaggtgggttttccagcttctcccaggccacccattcagcagcaggcgctgtagtctcaaagcccagagagattgcctcactcattcggaacaaatttggcagtgcagacaacatccccaacctgaaggactctttagaggaagggcaagtggatgatgcggggaaggctttgggagtgatttcaaactttcagtctagcccaaaatatggtagtgaagaagattgttctagtgccacttcaggctcagtgggagccaacagcaccacagggggcatcgctgtaggagcatccagctccaaaacaaacaccctggacatgcagagctcaggatttgatgcactactacatgagatccaggagatccgggaaacccaggccagactagaggaatcctttgagactctcaaggaacattatcagagggactattccttaataatgcagaccttacaggaggagcgatatagatgtgaacgattggaagaacagctaaatgacctaacagagctccaccagaatgaaatcttgaacttgaagcaggaactggcaagcatggaagaaaaaatcgcgtatcagtcctatgaacgggcccgggacatccaggaggccctggaggcatgccagacgcgcatctccaagatggagctgcagcagcagcagcagcaggtggtgcagctagaagggctggagaatgccactgcccggaaccttctgggcaaactcatcaacatcctcctggctgtcatggcagtccttttggtctttgtctccactgtagccaactgtgtggtccccctcatgaagactcgcaacaggacgttcagcactttattccttgtggtttttattgcctttctctggaagcactgggacgccctcttcagctatgtggaacggttcttttcatcccctagatgatgctggcacagaaggcattgttccctaccctctggcgagtgcatgcagcagagagttagacagcaacttacctactctgaagttttctacaacaaaaaaagagttgagtgaatctgtttacatttagaataatgtttttttcttcaagagacgcaattgcaatagtattttttagattttatccaagaagttttttgggcgaaaatcttggatcatttttatgtagcatgattttccttgggatgcaaatcttaaaacagtcctttaatatgaaccaacaatctggagcacaccgaagggcaatctaaattgtggcttgaaggactgcactaaaacccactaaaaagatgcgaaaacctgatgagggcaaaccagttaaacctaacaccctgccttgtctgggctcatcacctctccctatcccagactaactttactgtgaaatcctaccacattccatgtctgaatttttggattcggggtggattttcgttgtccgtggaagaacacatggatctctctggctttctcacccaagttggccacttacgctaatcctggaagtatgatcacttttgaacctgccccttaaccttgacgaggatacaaaagtgaaagcatcatcccccaaaggatcactgcacagtcctactacagtatttttaagtagccctctaaatacttaattttaagcaaaatcccttggccgcacttttaaggtttttttatatgtgtatagttaccaacctaaaaataaaaaatccgaacagcatacttgaagaatgtaatactcaaactctcagtgcttccttatggtttctaataggattttttattattgttattattattattgggtttttttggacagggttgggagggtcttttatttttcctttgaaataaagaagtgatgtttttaaatgaagaaa

SEQ ID NO: 25921 - DNA, 2234 bp, Homo sapiens
gcaaaggtgactggcttcagtgaaggtgtggtggatagtgtcaaaggtgggttttccagcttctcccaggccacccattcagcagcaggcgctgtagtctcaaagcccagagagattgcctcactcattcggaacaaatttggcagtgcagacaacatccccaacctgaaggactctttagaggaagggcaagtggatgatgcggggaaggctttgggagtgatttcaaactttcagtctagcccaaaatatggtagtgaagaagattgttctagtgccacttcaggctcagtgggagccaacagcaccacagggggcatcgctgtaggagcatccagctccaaaacaaacaccctggacatgcagagctcaggatttgatgcactactacatgagatccaggagatccgggaaacccaggccagactagaggaatcctttgagactctcaaggaacattatcagagggactattccttaataatgcagaccttacaggaggagcgatatagatgtgaacgattggaagaacagctaaatgacctaacagagctccaccagaatgaaatcttgaacttgaagcaggaactggcaagcatggaagaaaaaatcgcgtatcagtcctatgaacgggcccgggacatccaggaggccctggaggcatgccagacgcgcatctccaagatggagctgcagcagcagcagcagcaggtggtgcagctagaagggctggagaatgccactgcccggaaccttctgggcaaactcatcaacatcctcctggctgtcatggcagtccttttggtctttgtctccactgtagccaactgtgtggtccccctcatgaagactcgcaacaggacgttcagcactttattccttgtggtttttattgcctttctctggaagcactgggacgccctcttcagctatgtggaacggttcttttcatcccctagatgatgctggcacagaaggcattgttccctaccctctggcgagtgcatgcagcagagagttagacagcaacttacctactctgaagttttctacaacaaaaaaagagttgagtgaatctgtttacatttagaataatgtttttttcttcaagagacgcaattgcaatagtattttttagattttatccaagaagttttttgggcgaaaatcttggatcatttttatgtagcatgattttccttgggatgcaaatcttaaaacagtcctttaatatgaaccaacaatctggagcacaccgaagggcaatctaaattgtggcttgaaggactgcactaaaacccactaaaaagatgcgaaaacctgatgagggcaaaccagttaaacctaacaccctgccttgtctgggctcatcacctctccctatcccagactaactttactgtgaaatcctaccacattccatgtctgaatttttggattcggggtggattttcgttgtccgtggaagaacacatggatctctctggctttctcacccaagttggccacttacgctaatcctggaagtatgatcacttttgaacctgccccttaaccttgacgaggatacaaaagtgaaagcatcatcccccaaaggatcactgcacagtcctactacagtatttttaagtagccctctaaatacttaattttaagcaaaatcccttggccgcacttttaaggtttttttatatgtgtatagttaccaacctaaaaataaaaaatccgaacagcatacttgaagaatgtaatactcaaactctcagtgcttccttatggtttctaataggattttttattattgttattattattattgggtttttttggacagggttgggagggtcttttatttttcctttgaaataaagaagtgatgtttttaaatgaagaaaaacaaaaaaaaaaaaaaacaaaaaagcaacaaaaaaaaaaggggggggcgcgccaaaaaattccccacgggggggccccagatctcgcgcgagacccacgggtttctgtggcacacagcgggcgcccaatatggggacggaccgaataaaacagaccagcagcacagggagcgccgctgttataaacaaacgccgcggacggggcggaaaccacctgcggcacgcggggacacaccatggggagagagagacaccccaactcccgcggggggcggcgcccaagtggggcgcacaacacccccacacggaattataacaccgcccagggggaagaacacc

SEQ ID NO: 25922 - DNA, 1193 bp, Homo sapiens
  misc_feature (23)..(23): n is a, c, g, or t
acctctgaatccattggcgcctnctactactatgctgcgagaagacgacagattggcaccagacccagaagttgtacgcatttaatgctgtttgtaaccatgcatctgttttcattctttgctgtaccttttgctgcccatcctgttacttttgagtttctttcattgtggttgttcttgggttcttttgtcttgtcagagctcttctataacctcgctctaatggcttaacagttgttctgggtggaaacgtcccctcatttgaatgctcctctaaaaaaaaaaagaaaagaaaactgtattcattccctttaaaatgaaacattcctggtttatttgtccatgcctctagcctgggtgagtgaagctggctgtgttggcctgggtgattgttcaggttgtagaatgcgcattttacattgtttatgataattgaagggtacttctgtctgctccaatttccattccttggtatactcagtatgtcctagtaaggaaggctttccactctactggctccttaagaagcaaaagtaggttaaattttatacttcactgactagggtcttctctctcccctgttctgaatggagtaaaagtctgatgccaagacaaatattgggagcgagccttcctcactagccatgtccaaataatgagcgtattttcatgtggtcttcactgcatttggttttgtttctgatttcatgttcctttgaggtacagtcagatgaaaatgctgagttctgagagagttccaatgaggagctgcctttcagctttggaaaatatgcatctaaaacaaaaccaaacattattgtaatctgacacaggcaaaattatggttcccacaccccaaccccaaatgaaacctgggattttgaatgtggctctaagagttaacattgctgtctgtatgtcgtgtatgctaggtgatatcctcagtagggattgactactagactgtgtgttttatcaaagtgtgtaagaataaaaactcacttgcacgaattgaaacgtaaagaaatgacacttgtgaacgtgtgaacgttaacactgtagttgatagatcttaagctgctaattgttgagagagatttaaatttatgttctgtctggtcgctgcagattctcagcagcacttttactgtatatagaaattgaaataaagacctcagctattaaaaaaaaaa

SEQ ID NO: 25923 - DNA, 3813 bp, Homo sapiens
gcaaaggtgactggcttcagtgaaggtgtggtggatagtgtcaaaggtgggttttccagcttctcccaggccacccattcagcagcaggcgctgtagtctcaaagcccagagagattgcctcactcattcggaacaaatttggcagtgcagacaacatccccaacctgaaggactctttagaggaagggcaagtggatgatgcggggaaggctttgggagtgatttcaaactttcagtctagcccaaaatatggtagtgaagaagattgttctagtgccacttcaggctcagtgggagccaacagcaccacagggggcatcgctgtaggagcatccagctccaaaacaaacaccctggacatgcagagctcaggatttgatgcactactacatgagatccaggagatccgggaaacccaggccagactagaggaatcctttgagactctcaaggaacattatcagagggactattccttaataatgcagaccttacaggaggagcgatatagatgtgaacgattggaagaacagctaaatgacctaacagagctccaccagaatgaaatcttgaacttgaagcaggaactggcaagcatggaagaaaaaatcgcgtatcagtcctatgaacgggcccgggacatccaggaggccctggaggcatgccagacgcgcatctccaagatggagctgcagcagcagcagcagcaggtggtgcagctagaagggctggagaatgccactgcccggaaccttctgggcaaactcatcaacatcctcctggctgtcatggcagtccttttggtctttgtctccactgtagccaactgtgtggtccccctcatgaagactcgcaacaggacgttcagcactttattccttgtggtttttattgcctttctctggaagcactgggacgccctcttcagctatgtggaacggttcttttcatcccctagatgatgctggcacagaaggcattgttccctaccctctggcgagtgcatgcagcagagagttagacagcaacttacctactctgaagttttctacaacaaaaaaagagttgagtgaatctgtttacatttagaataatgtttttttcttcaagagacgcaattgcaatagtattttttagattttatccaagaagttttttgggcgaaaatcttggatcatttttatgtagcatgattttccttgggatgcaaatcttaaaacagtcctttaatatgaaccaacaatctggagcacaccgaagggcaatctaaattgtggcttgaaggactgcactaaaacccactaaaaagatgcgaaaacctgatgagggcaaaccagttaaacctaacaccctgccttgtctgggctcatcacctctccctatcccagactaactttactgtgaaatcctaccacattccatgtctgaatttttggattcggggtggattttcgttgtccgtggaagaacacatggatctctctggctttctcacccaagttggccacttacgctaatcctggaagtatgatcacttttgaacctgccccttaaccttgacgaggatacaaaagtgaaagcatcatcccccaaaggatcactgcacagtcctactacagtatttttaagtagccctctaaatacttaattttaagcaaaatcccttggccgcacttttaaggtttttttatatgtgtatagttaccaacctaaaaataaaaaatccgaacagcatacttgaagaatgtaatactcaaactctcagtgcttccttatggtttctaataggattttttattattgttattattattattgggtttttttggacagggttgggagggtcttttatttttcctttgaaataaagaagtgatgtttttaaatgaagaaatgtgtggatatttaagtgtgctgctccctcttgtcttgaaacagtttgagtaagaaagtcttgctgtaaatgctgccctctgccgcctttgttttgagatgcagtttaaactccctctggctgctgctgctgctttttggtgtcccgacatacctacgcccccgttttatgggtttggcttagttgaagaggaaagggttgtgcaaggagagcaggaggctgtttccaaaaaccagtgtagtaggatagggatttttttttttttttttgccccaagaaaacgttcacccagtgatcttgggctggggttgtctttaggaaaagttgagactataagagtcataaataagtccttgtgtttccttaatttattttgttaacacccctaattacaaccaaagtgatgatgtggagtcttctgtcttcattttggccccagcattcttaatttcaaagctttattctgtctgcctaagagaatcaaccaaaggtgattctcctaaagagcagtgaaggaaatgtcaggttagcaggacccaagttttgggtgtgaaatgttgccagcttcctataatgtaaacggacttgttaacctaacctaattatgctcagtggacttctatagatggttttgaaaaatgaactgagctgccttcccgcatcgcataaccagttccatcatcctggtggaacttgaacatttagagtttatctagagagcttggttaatctttccatattatttgtagtattggtcacaaatgctgttccctcttagcctcattctgtgcaaccaagtgcatataagatgccctgaaaagagtaacaaagtatgctttgcctgtttccacttaccaggaaattccttcagaactagattagcattgccctgcctgtctgaaaggacagtttacctaatggtgccagcctccttttgctttggcaagctggatttctcagagccagcatgttgtttccataactactttgatattttaactcaggtactccagtcttcaccccaacctcagctgattgtagtacacctgctagctctgttgccccctcaaaactgcacccagagcagggccacaagggtgctttttttctttaaaaaaaaaaaaattagaaccaattcatgttcatgccaaaaacaaattgtccccaagcctatatgtattaaaatgttaactttgcctaaaaatattgcagtgactttttaggcaggagtgccaaaggacactatgaactttttgaactgacagtttctcctaactttctgctttagcgtaattgctcagagtagagagcccccacaaagttatttaaaagatgccctagcagcaatccaccagtttttctaagctagaacctttgagtcccccaaactgcctgaagacttaagttttgtgggcactggaagtcactttgatagatggattgaaactgttcctatttgccctgggacggtttctatctatcaaaggaaggttttcacctgtagaaagccccctgcctccagccaaatagtcccatgctgactttctatcttcctttctcaaactgtcttaggaaggaccttcagtgcagatcaggtgcagtaatggctttcttgtcccttaattattcaccagacccagaagttgtacgcatttaatgctgtttgtaaccatgcatctgttttcattctttgctgtaccttttgctgcccatcctgttacttttgagtccttcatgggggtgtctgggtcttggctgtagagtctttatacttggttatgttacaagtgttggtggaaagtcctcatgaagtctttaaaaaaaaagggggcaaaatctcgggcagtggacgattgtaggccaagagaaaaaagcgggaaggggaaagttgaatggggaccaagaattttgtgataaa

SEQ ID NO: 25924 - DNA, 527 bp, Homo sapiens
cctcttagcacttctgttccctacaaaggactctgtggaaagcgagaggctgtatttaatccagaagagcccctagcttctatgcctagcatgggttggggacttattaacagcagtttctctcgttacagccatccccacatggggagaccaactgcataccaacttgctgctgcacctccaaaggattgggatagccagcagggcagaggagaggagaaaatgttgtagcccctttgtggagctcccactgttgccctaatagccagttcctttctcaggggaggctgatgttcaggctgtttatttacctgctgcctttcatctgcaatctacaaaccctttactttaataacagcttctgttagtttagtgcctctctcctaggaggttaaaatactccctatagatgatctcttttatctttgtgatggtcccagaaggtagggtggggacatgattatatgattatgcttattccatcctttggaagacagaaatacaaggacggtaagggagatgagaca

SEQ ID NO: 25925 - DNA, 437 bp, Homo sapiens
ccgggaggcagaggttgcagtgagccaagattgcgccattgcactccagcctgggtgacagagcaacactccatctcggaaaaaaaaaaaaaaaatttggtctgttcgttttaggtgttgcccgtggttgagaatcagaccctctgcccagggtttgtgactttattgcacagaaggctgcatcacccgcaaccgtcatcttaatactgccaccgaatttcattttgctgtttttgtttgcgaaggacctggagtgactcggatagaattactgctggaataaatgacgtatgaaatgagaaatctttgtccagtgttgcaagggggagggagagaagaaaagaaaggctttgatggaaccgctgttgtacagaattagtttccataagaccagaaaatacagaagaacaaaataaaacgtcatcagatatttttct

SEQ ID NO: 25926 - DNA, 306 bp, Homo sapiens
tatagatcactgacaaagtatctgttttagcagatagggacaaagtttaaataatttggccaaggtcatagtagaccaagatttggacccagcacaagcatcctctttccaggaaaccttccctcaggcccttagttggtttaagtgccctctctctgtactattagcatatgcacacacattcattttagcgttgactttaataataaggatgtttaccatgtaccagatacatagtacttgcacctatgttatctatgtttaagtgttttgtaggcattagttcatttaagcctcataactgcc

SEQ ID NO: 25927 - DNA, 504 bp, Homo sapiens
tataattaattgtactatatgctgagtacaactaaaaactctgaatattatacgtaaaacacaagaagactctgaaaggtggagagaataaggcagaggagctagggatctcaggacccaaataatgacactgcagtagttccctgccttttcttttagcctcatatattccataattagagctaaagaagctgataacccagaagtgcaatggccacagacaaagaaagcgccagcaaaagcccagtcttttaaatactagtagagggacaccatagcaagacagaaaactttttgagaataaccattctacttcaaccaaacaccacagaaaaaaacattggtcacactcatagctgcaaaggccaagtagggatcctagatttccatcctcaccaagctgttatgaggcaccctaacacctcctccactggaattgtgtcagattaggccaggtacagagttgggactttaattcccatagaatggttaactagcctttcc

SEQ ID NO: 25928 - DNA, 563 bp, Homo sapiens
tagtatgagctgtgttggaaagttttctactcactcttttctaccaggttaatcaatgttgtgggtaggagcttggattttggcatcgcacagactggcgttcaaattcacactatgctatttattgactgtgacttttgaacaaataccttccctgattctcagtcccttcatctgtgaaatgggggaaatgccaccaacctgataaagttattttgagaattacatgaagtactgaatgttgaacgcttactataacatcatggtgaatgaaataatgcagacacaaaaggaaaaatactgtatggttccatatatatgaagtacctcgtagagaattttgagctgaggggaagggcaagagttcttgtttaatggctgcagaattccagttgggggaaaggtgtggagatgatcacacaacaatgtgaacgtataaatgccgctgaactgtacatgtttaaatcggcaaaatggtaaatgtatattatgcatattttaacacaataaaataaacaaattttaaaatgtttacagtagagcttggcgcacaataaatggct

SEQ ID NO: 25929 - DNA, 491 bp, Homo sapiens
tagctgttccagaggatccccgtccataaggtgtgccagcagcagtatcacaatcaccaaaaggttgaacaaacctagagtgctcatcagcagatgaagtgtgggctatctaaccataaatggaatattatacagtcataaaaaaggaatgaagtactaatacatactctgacatggatgaaccttgaaacattacactacatgaatgtctgactaaaaggaaaaatactgtatggttccatatatatgaagtacctcgtagagaattttgagctgaggggaagggcaagagttcttgtttaatggctgcagaattccagttgggggaaaggtgtggagatgatcacacaacaatgtgaacgtataaatgccgctgaactgtacatgtttaaatcggcaaaatggtaaatgtatattatgcatattttaacacaataaaataaacaaattttaaaatgtttacagtagagcttggcgcacaataaatggct

SEQ ID NO: 25930 - DNA, 433 bp, Homo sapiens
actaaagaaagtaaagttcatttgttgactacagaaattccttaatatgcatacctggtctcacttacttaaggtataagactgaggtcagcaggaaaaggaaaatcaacagcaaaagggcaaagatcagatggattccatatctaaggattgttatttcatagttcccatggagatgaataaagaaaagcatgagaagtatgagtgatgcaaagccattggccatccagattagactggtcactactaagacaaaaataaattcctttaagttttataaggcgactagattacttcaaagtactctactggatagccactcaaatatctcctaatggtgtcctaatttgaactcgtaagaactggggtcagagtatttctagagaggagccatattttaaaaatgccttctgtctgtcctaacctttgatat

SEQ ID NO: 25931 - DNA, 1587 bp, Homo sapiens
gtctagtagagcctggtgttaatcggccgaggagcggggaccgggaagcatggcccgggggtcggcggttgcctgggcggcgctcgggccgttgttgtggggctgcgcgctggggctgcagggcgggatgctgtacccccaggagagcccgtcgcgggagtgcaaggagctggacggcctctggagcttccgcgccgacttctctgacaaccgacgccggggcttcgaggagcagtggtaccggcggccgctgtgggagtcaggccccaccgtggacatgccagttccctccagcttcaatgacatcagccaggactggcgtctgcggcattttgtcggctgggtgtggtacgaacgggaggtgatcctgccggagcgatggacccaggacctgcgcacaagagtggtgctgaggattggcagtgcccattcctatgccatcgtgtgggtgaatggggtcgacacgctagagcatgaggggggctacctccccttcgaggccgacatcagcaacctggtccaggtggggcccctgccctcccggctccgaatcactatcgccatcaacaacacactcacccccaccaccctgccaccagggaccatccaatacctgactgacacctccaagtatcccaagggttactttgtccagaacacatattttgactttttcaactacgctggactgcagcggtctgtacttctgtacacgacacccaccacctacatcgatgacatcaccgtcaccaccagcgtggagcaagacagtgggctggtgaattaccagatctctgtcaagggcagtaacctgttcaagttggaagtgcgtcttttggatgcagaaaacaaagtcgtggcgaatgggactgggacccagggccaacttaaggtgccaggtgtcagcctctggtggccgtacctgatgcacgaacgccctgcctatctgtattcattggagatccgagggaagggcttcgactggccgctgctggtgaaggacttcaacctgcttcgctggcttggtgccaacgctttccgtaccagccactacccctatgcagaggaagtgatgcagatgtgtgaccgctatgggattgtggtcatcgatgagtgtcccggcgtgggcctggcgctgccgcagttcttcaacaacgtttctctgcatcaccacatgcaggtgatggaagaagtggtgcgtagggacaagaaccaccccgcggtcgtgatgtggtctgtggccaacgagcctgcgtcccacctagaatctgctggctactacttgaagatggtgatcgctcacaccaaatccttggaccctcccggctgtgacctttgtgagcaactctaactatgcagcagacaagggggctccgtatgtggatgtgatctgtttgaacagctactactcttggtatcacgactacgggcacctggagttgattcaggctgcagctggccaccagtttgagaactggtaataagaagtatcaagaagcccattattcagagcgagtatggaagaggaaacgattgcagggtttcaccagggatccaactctgatgtacactgaaggagtaccagaa

SEQ ID NO: 25932 - DNA, 1737 bp, Homo sapiens
ttagcgccgcagacggtggccgagcgggggacggggaccgggaagcatggcccgggggtcggcggttgcctgggcggcgctcgggccgttgttgtggggctgcgcgctggggctgcagggcgggatgctgtacccccaggagagcccgtcgcgggagtgcaaggagctggacggcctctggagcttccgcgccgacttctctgacaaccgacgccggggcttcgaggagcagtggtaccggcggccgctgtgggagtcaggccccaccgtggacatgccagttccctccagcttcaatgacatcagccaggactggcgtctgcggcattttgtcggctgggtgtggtacgaacgggaggtgatcctgccggagcgatggacccaggacctgcgcacaagagtggtgctgaggattggcagtgcccattcctatgccatcgtgtgggtgaatggggtcgacacgctagagcatgaggggggctacctccccttcgaggccgacatcagcaacctggtccaggtggggcccctgccctcccggctccgaatcactatcgccatcaacaacacactcacccccaccaccctgccaccagggaccatccaatacctgactgacacctccaagtatcccaagggttactttgtccagaacacatattttgactttttcaactacgctggactgcagcggtctgtacttctgtacacgacacccaccacctacatcgatgacatcaccgtcaccaccagcgtggagcaagacagtgggctggtgaattaccagatctctgtcaagggcagtaacctgttcaagttggaagtgcgtcttttggatgcagaaaacaaagtcgtggcgaatgggactgggacccagggccaacttaaggtgccaggtgtcagcctctggtggccgtacctgatgcacgaacgccctgcctatctgtattcattggaggtgcagctgactgcacagacgtcactggggcctgtgtctgacttctacacactccctgtggggatccgcactgtggctgtcaccaagagccagttcctcatcaatgggaaacctttctatttccacggtgtcaacaagcatgaggatgcggacatccgagggaagggcttcgactggccgctgctggtgaaggacttcaacctgcttcgctggcttggtgccaacgctttccgtaccagccactacccctatgcagaggaagtgatgcagatgtgtgaccgctatgggattgtggtcatcgatgagtgtcccggcgtgggcctggcgctgccgcagttcttcaacaacgtttctctgcatcaccacatgcaggtgatggaagaagtggtgcgtagggacaagaaccaccccgcggtcgtgatgtggtctgtggccaacgagcctgcgtcccacctagaatctgctggctactacttgaagatggtgatcgctcacaccaaatccttggaccctcccggctgtgacctttgtgagcaactctaactatgcagcagacaagggggctccgtatgtggatgtgatctgtttgaacagctactactcttggtatcacgactacgggcacctggagttgattcaggctgcagctggccaccagtttgagaactggtaataagaagtatcaagaagcccattattcagagcgagtatggaagaggaaacgattgcagggtttcaccagggatccaactctgatgtacactgaaggagtaccagaa

SEQ ID NO: 25933 - DNA, 1077 bp, Homo sapiens
tcgaggctcgggttttaatttcgtgcgacgagggggagggcggggaccgggaagcatggcccgggggtcggcggttgcctgggcggcgctcgggccgttgttgtggggctgcgcgctggggctgcagggcgggatgctgtacccccaggagagcccgtcgcgggagtgcaaggagctggacggcctctggagcttccgcgccgacttctctgacaaccgacgccggggcttcgaggagcagtggtaccggcggccgctgtgggagtcaggccccaccgtggacatgccagttccctccagcttcaatgacatcagccaggactggcgtctgcggcattttgtcggctgggtgtggtacgaacgggaggtgatcctgccggagcgatggacccaggacctgcgcacaagagtggtgctgaggattggcagtgcccattcctatgccatcgtgatccgagggaagggcttcgactggccgctgctggtgaaggacttcaacctgcttcgctggcttggtgccaacgctttccgtaccagccactacccctatgcagaggaagtgatgcagatgtgtgaccgctatgggattgtggtcatcgatgagtgtcccggcgtgggcctggcgctgccgcagttcttcaacaacgtttctctgcatcaccacatgcaggtgatggaagaagtggtgcgtagggacaagaaccaccccgcggtcgtgatgtggtctgtggccaacgagcctgcgtcccacctagaatctgctggctactacttgaagatggtgatcgctcacaccaaatccttggaccctcccggctgtgacctttgtgagcaactctaactatgcagcagacaagggggctccgtatgtggatgtgatctgtttgaacagctactactcttggtatcacgactacgggcacctggagttgattcaggctgcagctggccaccagtttgagaactggtaataagaagtatcaagaagcccattattcagagcgagtatggaagaggaaacgattgcagggtttcaccagggatccaactctgatgtacactgaaggagtaccagaa

SEQ ID NO: 25934 - DNA, 1740 bp, Homo sapiens
gtctagtagagcctggtgttaatcggccgaggagcggggaccgggaagcatggcccgggggtcggcggttgcctgggcggcgctcgggccgttgttgtggggctgcgcgctggggctgcagggcgggatgctgtacccccaggagagcccgtcgcgggagtgcaaggagctggacggcctctggagcttccgcgccgacttctctgacaaccgacgccggggcttcgaggagcagtggtaccggcggccgctgtgggagtcaggccccaccgtggacatgccagttccctccagcttcaatgacatcagccaggactggcgtctgcggcattttgtcggctgggtgtggtacgaacgggaggtgatcctgccggagcgatggacccaggacctgcgcacaagagtggtgctgaggattggcagtgcccattcctatgccatcgtgtgggtgaatggggtcgacacgctagagcatgaggggggctacctccccttcgaggccgacatcagcaacctggtccaggtggggcccctgccctcccggctccgaatcactatcgccatcaacaacacactcacccccaccaccctgccaccagggaccatccaatacctgactgacacctccaagtatcccaagggttactttgtccagaacacatattttgactttttcaactacgctggactgcagcggtctgtacttctgtacacgacacccaccacctacatcgatgacatcaccgtcaccaccagcgtggagcaagacagtgggctggtgaattaccagatctctgtcaagggcagtaacctgttcaagttggaagtgcgtcttttggatgcagaaaacaaagtcgtggcgaatgggactgggacccagggccaacttaaggtgccaggtgtcagcctctggtggccgtacctgatgcacgaacgccctgcctatctgtattcattggaggtgcagctgactgcacagacgtcactggggcctgtgtctgacttctacacactccctgtggggatccgcactgtggctgtcaccaagagccagttcctcatcaatgggaaacctttctatttccacggtgtcaacaagcatgaggatgcggacatccgagggaagggcttcgactggccgctgctggtgaaggacttcaacctgcttcgctggcttggtgccaacgctttccgtaccagccactacccctatgcagaggaagtgatgcagatgtgtgaccgctatgggattgtggtcatcgatgagtgtcccggcgtgggcctggcgctgccgcagttcttcaacaacgtttctctgcatcaccacatgcaggtgatggaagaagtggtgcgtagggacaagaaccaccccgcggtcgtgatgtggtctgtggccaacgagcctgcgtcccacctagaatctgctggctactacttgaagatggtgatcgctcacaccaaatccttggaccctcccggctgtgacctttgtgagcaactctaactatgcagcagacaagggggctccgtatgtggatgtgatctgtttgaacagctactactcttggtatcacgactacgggcacctggagttgattcaggctgcagctggccaccagtttgagaactggtaataagaagtatcaagaagcccattattcagagcgagtatggaagaggaaacgattgcagggtttcaccagggatccaactctgatgtacactgaaggagtaccagaa

SEQ ID NO: 25935 - DNA, 1746 bp, Homo sapiens
tcgaggctcgggttttaatttcgtgcgacgagggggagggcggggaccgggaagcatggcccgggggtcggcggttgcctgggcggcgctcgggccgttgttgtggggctgcgcgctggggctgcagggcgggatgctgtacccccaggagagcccgtcgcgggagtgcaaggagctggacggcctctggagcttccgcgccgacttctctgacaaccgacgccggggcttcgaggagcagtggtaccggcggccgctgtgggagtcaggccccaccgtggacatgccagttccctccagcttcaatgacatcagccaggactggcgtctgcggcattttgtcggctgggtgtggtacgaacgggaggtgatcctgccggagcgatggacccaggacctgcgcacaagagtggtgctgaggattggcagtgcccattcctatgccatcgtgtgggtgaatggggtcgacacgctagagcatgaggggggctacctccccttcgaggccgacatcagcaacctggtccaggtggggcccctgccctcccggctccgaatcactatcgccatcaacaacacactcacccccaccaccctgccaccagggaccatccaatacctgactgacacctccaagtatcccaagggttactttgtccagaacacatattttgactttttcaactacgctggactgcagcggtctgtacttctgtacacgacacccaccacctacatcgatgacatcaccgtcaccaccagcgtggagcaagacagtgggctggtgaattaccagatctctgtcaagggcagtaacctgttcaagttggaagtgcgtcttttggatgcagaaaacaaagtcgtggcgaatgggactgggacccagggccaacttaaggtgccaggtgtcagcctctggtggccgtacctgatgcacgaacgccctgcctatctgtattcattggaggtgcagctgactgcacagacgtcactggggcctgtgtctgacttctacacactccctgtggggatccgcactgtggctgtcaccaagagccagttcctcatcaatgggaaacctttctatttccacggtgtcaacaagcatgaggatgcggacatccgagggaagggcttcgactggccgctgctggtgaaggacttcaacctgcttcgctggcttggtgccaacgctttccgtaccagccactacccctatgcagaggaagtgatgcagatgtgtgaccgctatgggattgtggtcatcgatgagtgtcccggcgtgggcctggcgctgccgcagttcttcaacaacgtttctctgcatcaccacatgcaggtgatggaagaagtggtgcgtagggacaagaaccaccccgcggtcgtgatgtggtctgtggccaacgagcctgcgtcccacctagaatctgctggctactacttgaagatggtgatcgctcacaccaaatccttggaccctcccggctgtgacctttgtgagcaactctaactatgcagcagacaagggggctccgtatgtggatgtgatctgtttgaacagctactactcttggtatcacgactacgggcacctggagttgattcaggctgcagctggccaccagtttgagaactggtaataagaagtatcaagaagcccattattcagagcgagtatggaagaggaaacgattgcagggtttcaccagggatccaactctgatgtacactgaaggagtaccagaa

SEQ ID NO: 25936 - DNA, 958 bp, Homo sapiens
gactgagactgtctcagaagaaaaacatttttttttgatagagatggggtctcagtctgtcaccaggctggtcttcaactcctggactcaagtgatcctcctgccttagcctcccaaagtgtgggaactccaggcatgagccaccttgtcttgtcaaagggaaggccatgttttgaagggcaggttcccagggtcagccagggtagggcagaacctctgattgctgcatctctgcttacaggcccagaggcagctgctggggtgcacgaggggccttcctgctggagggcaggccggatggggctcaggctgtcggggtgctcacacctggtgctttggctgtcataggtgcagctgactgcacagacgtcactggggcctgtgtctgacttctacacactccctgtggggatccgcactgtggctgtcaccaagagccagttcctcatcaatgggaaacctttctatttccacggtgtcaacaagcatgaggatgcggacgtgtgttggggctcctgggtccttgtgggggctgcttctggtcaccctccactttcgccttccctgtgtcctgcagttgagggcagctcagggcaatgaggcaaatggctccaaatggagagggggctcatggggtggctctccagggtcctggctctcagaggaagtgcagcttcgacagggacaggggtcacttggctctgctatctcctagatccgagggaagggcttcgactggccgctgctggtgaaggacttcaacctgcttcgctggcttggtgccaacgctttccgtaccagccactacccctatgcagaggaagtgatgcagatgtgtgaccgctatgggattgtggtcatcgatgagtgtcccggcgtgggcctggcgctgccgtgagtctctgctgtgcacctgctccgcctgcccagcccgggggcgtcaccgtgaccctctgtc

SEQ ID NO: 25937 - DNA, 773 bp, Homo sapiens
gcagatatccttgttcttaggataaagggaaatacacactgaaatatttaagagtaaagaggtctgaggggtgtgatgtccacaacttattttcatatggctcaagaaaatgcctgcgttgtaagtagtaattatgacaaagaacaaaaatgactaaataataaggcaaatatggcaaaataacaattggtgaatctcggtgaagggtatataggtatttttgtactagtcctgcaacttttctgtaagtgtgaaattacttcaaaataaaaaattttttaatgtggctgggcgcagtagctcacatctataatcccagcactttgggaggctgaggcggggtgggatcacttgaactcaggactttgagaccagcctgggcaacatggcaaaaccccatctctacaaaaaatacaaaaaacaaacaaacaaacaaacaaacaaacaaacaaaaacaaattggctgggcgtagaggcacacgcctgcagtcccagctacttgtggggctgaggctggaggatgacttgagcccaggaggttgaagctgcagcgagccgagatcacgtcactgcactccagcctgggtaacaaagtgaaactgtctcaaaataaaagtaaggtggacaaagatggagccctacttttctcccacaagccagtttcctttgtttctcctccaccttctcctccataatcccagccgtcctgccattaacttatatttgcttgtggtacaggtactggtacctgatttgaggatgaagagaaagag

SEQ ID NO: 25938 - DNA, 338 bp, Homo sapiens
gtgtatcttgattctttgtctgtgacatcacttattgtatatctggaaaacagccatgtgttctagtggtctagaagatatgtttacctatcttggttgcagacaatacttgcatgatttcaataggataaaagaaaatttaagtgtgtgaataactgagagatggtgagttaggaaaagttcttagaaattgtaaactttaagtcacagggatgtttcaaggaatcatcagtgttggattagccggtcattgagagaaaggatatgtattatatttaaggaataaaggcaaaaacaccatactttatttatctgcaggtcaactataatttttaaaa

SEQ ID NO: 25939 - DNA, 209 bp, Homo sapiens
aatctgcttgctactaggatcttattcttcactccagtccaggcattgggcggaagggtgaatgcagagtggcacacagcagcagatgggaattagctggctcctcagccttccagggtgggtttttttttgttgtttttgattggagagtccaggtgggtggttgctgtttttccccctttctgtgacacaatttaaggtaaagtaat

SEQ ID NO: 25940 - DNA, 302 bp, Homo sapiens
cctgaaaccagggccagcttcactggcctgcaacctgggcaggcacacagggtcctcattcagaagggccatgtgcccgcttcagtgctctactatagtcatctcgaaactcagtactttttggacaaagggccccacatttttattttgtgtcaggtcctgcaaattatatagctagtcctgcctgaagtatctttgtgtctctcagactaaaaaggatgtagggagaggggtacagttctgtgggtggccctgttctctctgctctgtgcagggcctgcctcccactgtgagctgcaaag

SEQ ID NO: 25941 - DNA, 892 bp, Homo sapiens
tttggtatccccacacttgggtgagagccagcccctcacccaggggaatctgtgctctacttacgtgcaaatctcccggtgaaatgctgctcccttgcaacacacttggacaaaagggagctaagcggggtggcccacctcgaagagagaacaaagagaacaaaaaggaagtttgttggtagtgtctgactaccccccctctgctagcctcctcatctatgccacatcttcacaaacctctgctctcagaggtgtcagctactgcctcttcccacccccatagggtttcagaaagcctgagtggcattcgatttcggcaggtccacaaacagcatctaaaagaggttccgtgtggccaatagggtttcaggctaccctttttgagagcctggcgcagaacaaggtctcctttcacttgaccctcctttgccaatacaaggctgtttggctgggtccagcaccccatggggcaaatgttcaggccaagaatagtcttcattcttcccatgaagctttcaaagtcttctaaagaacacaggaaattgtcagcctctattttctgctgaaaatggctgacactaaactttgaacattctgtggatgaatcccaaattatgggaaccaagtttgcttgaaaagcagcaaaagttttcattaaagatgagagactctgataaaccatctcggcattacttacaaagaatggtgtattttataactccaattactaacacctttcctcttttgaccaaaattaccttatttccatggaagtaactccaaaagactatctctgtgcacaaagaagcagatccagagacttaccatggcaccatgcacatttcctaaaaataaaccgtcactaaaactgagaagaaatactttttggtct

SEQ ID NO: 25942 - DNA, 365 bp, Homo sapiens
ggggcttgggtttctcatcagcgggattgatcgtctgcccagtctaatgattctgaaagctggagatttggaatagtctcacccccgagcccctccatcttgcatgctccccagccacctctgccccaaggcagacctgcagggaagaatttctctctggagaaactgactggggacacagaaaccacctcatcacattgatatttgggattctgcaaaaaaagagggcagaccctctggttgatcatcctagcaagaggcctgccctgcaataagcctcacccaatggaagattgcttcccactaacaatttttgatgcctcactcttggataaaaatggacaaccagtgatttaggagggaaa

SEQ ID NO: 25943 - DNA, 391 bp, Homo sapiens
cctacctctccctgactgatcagttctgcataacaattgatttttagagaagcaacactttatcaagttatacaatataaagttgaatattctttccaagagtcttctatttgcatagttaagaaaattgacttttttgatcccctcgaaacaaaaaaattgctacctaacgatgacttttcttgtttacttcctggtgtttcttatctgggaacattcagtactttgggtgcagcaatccttctttgtatgggactgccacacacatgacagcatctagcttcctgtcaccaacacaaatagtgtctcctagttgttatggtatgttaagacccctacacatttctacctgtcccctatggaggtagtagtgccccctgtttgagaactg

SEQ ID NO: 25944 - DNA, 434 bp, Homo sapiens
ttaaaaaaagggggtagatatggggtgagaggtacagacattaatcaaattatcacaacataaattaagccatggtaaatgttacaaggtaaagctttgaaggcatacaaaatggatgcaggaatgcccagcaggaacagatctaggttatgggatttcaaaaacaaaacacatcatctagtgaggaaagctcatcatctagtgaggaagacttgtacaaagaggtagcttgagtatagtgcaataccaggtaaaagtgcttccttgtgttcgaagcctgacaagatgttctaggcttatctatctcagacacttcctgcttagatttgaaaccagccacttctccaaggagccccaattcctttcactgggaattggccctttcagattagctctgtgccctctgacatggcttgaaagggctcctactggct

SEQ ID NO: 25945 - DNA, 507 bp, Homo sapiens
aaggtggccaatttgaagggtaattctcctttgggatgattgctaagggaaaaaaaaaaatccatgttgaacataaggtttgtaatcaagacaactggatttaaatattggatgcaccattcagctctctaaaactgagtatcttcatcttaaaatgggatgtgcagtgtaaggattaaggcagtaaagtatagaggctaagccgtgtgctatagcactggagctatcttacccaggtttgaatctagcttggccattttctagctatgtggccttgggtatgtttaaccttactttgcttcatcttgctcatttgtacaagcactgctcgttttattgcatttcactttattgcacttcacatatattgcatttcttacaaattgaaagtttttggcaaccttgtgtgggataagtctattggtgccatttttctaacagcatgtactcacttcatgtctctgtgtcagcattttttagcaataaagtattttttaaatcaaaaaa

SEQ ID NO: 25946 - DNA, 637 bp, Homo sapiens
gactaaattgtagggagaccctacatggaaagctgctgatgattatggtgggtgataggactgagtcttgtcagtcagccttgatattacacgtaagagtttggatttacaaaaaaaaaaaaaaagaaaaaagaaaaagacatctaggcattggggtccctttaaagatcaggtggaatgttttcctgatgttcaggattcttcctgcctgcctccctccttgcagaagaaaagataggtaggtataagtagtaggtaggtaaaggtatgtataagcaggtataattcaaaaggtatatgaagtacagcgaagtcattgtgttagataaaagcagaaactacaaaactgtaaggttttgcttattttgtcacagctctgcttctgtttttggtgttctgtggctctttccgccgatcctttgtctcagcctcatttgtaagtgacttgttttttccatttctcaagtgatccgcctgctttggcctcccaaagtgccctgggattacaggtgcaagccaccatgcccggccatttatttttattttattctattttattttttaagatggagtctcgctgtgtcatccactgcattctccagcctgggcaacaggccaagaccctgtctcaaaaaaa

SEQ ID NO: 25947 - DNA, 576 bp, Homo sapiens
gaaagatgtttattttctttcaaacaatattaaaacaaataaattacgtgcagttgagtaacacaatgagcacataatacagttaaccttttaaaaggcacttctggcataatcactaaagtaatgtagacaattagacaattatttgctttgacactttattaatttgaccattcatttcaattttcttttaatgttcttcagtgaattgtttcatttataaacacttcaaagttccatcataaaatatgcctagattaactgacttatcttaattctatttactatggaacctatcaccaaaaaatctaaaggacattttaaaatgttatcctttatttgggtactaaactaatcactcctccacagagtcataagaaagtgtttgaaataaacaaaaataaatgaagtggaactggtgattgatataaatcttctagaaacaaaagttgggtaagccagaggttttttgttattgacactgtttattctttttaagtgattttgttcttttattatttttaattatacaattttaaatagtatgcttttattttaaaatactttaaagtgttt

SEQ ID NO: 25948 - DNA, 576 bp, Homo sapiens
ggatatcataatcctaactccattctacataatcgaggtcagtctcctttgtagtctctaggaagtgcagatggctccaatgatacaacctgagaaactttaattgaggcttaaaaaagaaagggaaagtaacagttaacaacttttttcactgttcctacctaatttgatgctcacaaccaccctttaaaggtaagtggacatagtccccttcatagatgagggggtagacgtttatttgttccggaagaggtaggttttaaccacctgggtgactggtagcctttgctcctcttactactctactgcatggttctctgagcctctttaagtcatttcggccattcaggtctgaaggaagcatctttgccagaagtgatgcagattcaggaatggaggagagagattattttaggtttcagtcagggggcggaagctccaagcaaccagccaccttttgagatgattttggagccttggtgctccaagaatggtgcacttcatgttacaatgttctaaacttgctggagggtttacagtggcattttgaatctggagacatttcgattgggaatc

SEQ ID NO: 25949 - DNA, 458 bp, Homo sapiens
agaggaacctggaaaattattagtaccaatattgaattagaaactatttaagtaatatgaaatataatgtaaaaatttggctttttaagtaatacataaatcacaaacttgattcaaacaaattagagaatgcttcatttgtttgtacatcattcattaaatgaagttaagggatgaaagcatttgtccagttcaggaagattatatgattaaggctagaaaaagtggtatgccttttttttatattatacattgggggactttaaagggaattttttgttattttcattccagagtacatggatggtctttagtagtcctgttaggtttatataaaagttactagacaatttgtagttttaaataatgcaacttttttttaaaagtagttcttgttagcccattgtaaggtcaacagaatgtaaaggtattactagtaagaacaaatcactgagtta

SEQ ID NO: 25950 - DNA, 142 bp, Homo sapiens
aatagtgtttatcctgatgacttaggtatttggcatccccttagcttttttatttttttttgagacagggttcttactctgtcacccacgctggagcgcagtggtgtgacttcggctcactgaagcctcgacctcccaggct

SEQ ID NO: 25951 - DNA, 267 bp, Homo sapiens
aattatttttaagtgaatggcaggtggaacactacaacatccataattttgcaagctgagaaagagctgaacgtctttttattgccaaaaaaattgctggtgttagtgacaacagtttttttctggatctgattgaagacatttatgaaaaatcagtcctaaatatgaatattcccataaggaaactgcttctaaggagacttaaaaatactcctgaagtcagatgtgtatcaatttctatttttgtgacttccccccttaacttcc

SEQ ID NO: 25952 - DNA, 197 bp, Homo sapiens
ggccagtttcacctgatttttttttggaatattaaagccttgaggttaaagaaaataataagagttgttaaaaggcagaattgtgtttaggagactcaatatgtagtgttgcaacactaggaggaaaaactacaggtacatattattcactcagtttaaaacttgcggatctgtttatacaacttcagctatagcca

SEQ ID NO: 25953 - DNA, 421 bp, Homo sapiens
gagacagggtcttgctctgttgcccaggcttgagtacagtggcacaagcacagctcactgcagccttgacccccaggctcaagggatcctcccacctcagcctgctcaagtagctgggaccacaggcatatgccactacacctgggtaacttttttatttttagcagagatagggtcttgctatgttgctcaggcaggtctcaaattcctgggttcaagagatcctcccaccttggcctcccagtgtgctgggattacaggcatacaccactgtgcccagcctataaatttcttaacagcaatccagtcattcaatagtttagtccattgggctctgcatagaagctgttcatttttcagttatatggacttaagtggtatggaagttacatatagcagtcaacacatggctacgtaaaga

SEQ ID NO: 25954 - DNA, 347 bp, Homo sapiens
ctgttaaggtggaatgactctctccctatctcactcctctgtccatgcctttattagtgtacatataaatgacatttggggctggagaatcgaatgaattgagtcatcagcatctgctgcatgggggatgcggatcaagaaggaaggagcaataaaaaaccaagacaagctgagaagggcaccatcagggcgctcaactctagttaagaagacagaagcatctgggcacagtggctcacacctgtaatcccagcattttgggaggccgaggcgggtggatcacttgaggtcaggagttctagaccagcctggccagaatggtgaaaccaggtctatactaaaaatac

SEQ ID NO: 25955 - DNA, 391 bp, Homo sapiens
ggcaaccaagtgagatcctgtctcaaaaaaaaaaaaaaaattgaattaataattttggtaaatatatatgtattcagatacgttaaaggatagcattttgcatacttgtctggtagaatgagttggacataatttttagttacagtaaaaagttctttagagagctaaaaagttttagtggtatttttgcttttccaaatcccacatgtcccagaatttggcaaggaaatagaaaaaggaaatagaaatcacagtgctgtagtaacagaggtgcaaaaaaaaatgataatgttggtcaaaatgtataatgttaagaaaaacagtgtttgtggttaataaaagtgtattgattttgttcaaattttgttgagaaaatattctctccttttct

SEQ ID NO: 25956 - DNA, 893 bp, Homo sapiens
  misc_feature (775)..(775): n is a, c, g, or t
  misc_feature (805)..(806): n is a, c, g, or t
ggcacgagggtgacgcgaggctctgcggagaccaggagtcagactgtaggacgacctcgggtcccacgtgtccccggtactcgccggccggagcccccggcttcccggggccgggggaccttagcggcacccacacacagcctactttccaagcggagccatgtctggtaacggcaatgcggctgcaacggcggaagaaaacagcccaaagatgagagtgattcgcgtgggtacccgcaagagccagcttgctcgcatacagacggacagtgtggtggcaacattgaaagcctcgtaccctggcctgcagtttgaaatcattgctatgtccaccacaggggacaagattcttgatactgcactctctaagattggagagaaaagcctgtttaccaaggagcttgaacatgccctggagaagaatgaagtggacctggttgttcactccttgaaggacctgcccactgtgcttcctcctggcttcaccatcggagccatctgcaagcgggaaaaccctcatgatgctgttgtctttcacccaaaatttgttgggaagaccctagaaaccctgccagagaagagtgtggtgggaaccagctccctgcgaagagcagcccagctgcagagaaagttcccgcatctggagttcaggagtattcggggaaacctcaacacccggcttcggaagctggacgagcagcaggagttcagtgccatcatcctggcaacagctggcctgcagcgcatgggctggcacaaccgggtggggcaggtnagggcctgccctatctctcccaagtcattnnatctctttctggcttaaagtcatccccattggatcttagacttacgatcgtgtgaagcgaaaccgtcagaaatggttgtcctacagc

SEQ ID NO: 25957 - DNA, 1481 bp, Homo sapiens
ggcacgagggtgacgcgaggctctgcggagaccaggagtcagactgtaggacgacctcgggtcccacgtgtccccggtactcgccggccggagcccccggcttcccggggccgggggaccttagcggcacccacacacagcctactttccaagcggagccatgtctggtaacggcaatgcggctgcaacggcggtgagtgctgagccggtgaccagcacactttgggcttctggacgagccgtgcagcgattggccccaggttgccatcctcagtcgtctattggaagaaaacagcccaaagatgagagtgattcgcgtgggtacccgcaagagccagcttgctcgcatacagacggacagtgtggtggcaacattgaaagcctcgtaccctggcctgcagtttgaaatcattgctatgtccaccacaggggacaagattcttgatactgcactctctaagattggagagaaaagcctgtttaccaaggagcttgaacatgccctggagaagaatgaagtggacctggttgttcactccttgaaggacctgcccactgtgcttcctcctggcttcaccatcggagccatctgcaagcgggaaaaccctcatgatgctgttgtctttcacccaaaatttgttgggaagaccctagaaaccctgccagagaagagtgtggtgggaaccagctccctgcgaagagcagcccagctgcagagaaagttcccgcatctggagttcaggagtattcggggaaacctcaacacccggcttcggaagctggacgagcagcaggagttcagtgccatcatcctggcaacagctggcctgcagcgcatgggctggcacaaccgggtggggcagatcctgcaccctgaggaatgcatgtatgctgtgggccaggaaggaggctgcagtgtgccagtagccgtgcatacagctatgaaggatgggcaactgtacctgactggaggagtctggagtctagacggctcagatagcatacaagagaccatgcaggctaccatccatgtccctgcccagcatgaagatggccctgaggatgacccacagttggtaggcatcactgctcgtaacattccacgagggccccagttggctgcccagaacttgggcatcagcctggccaacttgttgctgagcaaaggagccaaaaacatcctggatgttgcacggcagcttaacgatgcccattaactggtttgtggggcacagatgcctgggttgctgctgtccagtgcctacatcccgggcctcagtgccccattctcactgctatctggggagtgattaccccgggagactgaactgcagggttcaagccttccagggatttgcctcaccttggggccttgatgactgccttgcctcctcagtatgtgggggcttcatctctttagagaagtccaagcaacagcctttgaatgtaaccaatcctactaataaaccagttctgaaggt

SEQ ID NO: 25958 - DNA, 1390 bp, Homo sapiens
ggcacgagggtgacgcgaggctctgcggagaccaggagtcagactgtaggacgacctcgggtcccacgtgtccccggtactcgccggccggagcccccggcttcccggggccgggggaccttagcggcacccacacacagcctactttccaagcggagccatgtctggtaacggcaatgcggctgcaacggcggaagaaaacagcccaaagatgagagtgattcgcgtgggtacccgcaagagccagcttgctcgcatacagacggacagtgtggtggcaacattgaaagcctcgtaccctggcctgcagtttgaaatcattgctatgtccaccacaggggacaagattcttgatactgcactctctaagattggagagaaaagcctgtttaccaaggagcttgaacatgccctggagaagaatgaagtggacctggttgttcactccttgaaggacctgcccactgtgcttcctcctggcttcaccatcggagccatctgcaagcgggaaaaccctcatgatgctgttgtctttcacccaaaatttgttgggaagaccctagaaaccctgccagagaagagtgtggtgggaaccagctccctgcgaagagcagcccagctgcagagaaagttcccgcatctggagttcaggagtattcggggaaacctcaacacccggcttcggaagctggacgagcagcaggagttcagtgccatcatcctggcaacagctggcctgcagcgcatgggctggcacaaccgggtggggcagatcctgcaccctgaggaatgcatgtatgctgtgggccaggaaggaggctgcagtgtgccagtagccgtgcatacagctatgaaggatgggcaactgtacctgactggaggagtctggagtctagacggctcagatagcatacaagagaccatgcaggctaccatccatgtccctgcccagcatgaagatggccctgaggatgacccacagttggtaggcatcactgctcgtaacattccacgagggccccagttggctgcccagaacttgggcatcagcctggccaacttgttgctgagcaaaggagccaaaaacatcctggatgttgcacggcagcttaacgatgcccattaactggtttgtggggcacagatgcctgggttgctgctgtccagtgcctacatcccgggcctcagtgccccattctcactgctatctggggagtgattaccccgggagactgaactgcagggttcaagccttccagggatttgcctcaccttggggccttgatgactgccttgcctcctcagtatgtgggggcttcatctctttagagaagtccaagcaacagcctttgaatgtaaccaatcctactaataaaccagttctgaaggt

SEQ ID NO: 25959 - DNA, 1534 bp, Homo sapiens
ggcacgagggtgacgcgaggctctgcggagaccaggagtcagactgtaggacgacctcgggtcccacgtgtccccggtactcgccggccggagcccccggcttcccggggccgggggaccttagcggcacccacacacagcctactttccaagcggagccatgtctggtaacggcaatgcggctgcaacggcggaagaaaacagcccaaagatgagagtgattcgcgtgggtacccgcaagagccagcttgctcgcatacagacggacagtgtggtggcaacattgaaagcctcgtaccctggcctgcagtttgaaatcagtgagttttctggaaaggagtggaagctaatgggaagcccagtaccccgagaggagagaacacaacatttctggctttgcctatagctaaagcccgtcccgctgccccgagattccttctgggctgctcccagttctgaagttgctatgtccaccacaggggacaagattcttgatactgcactctctaagattggagagaaaagcctgtttaccaaggagcttgaacatgccctggagaagaatgaagtggacctggttagttcactccttgaaggacctggcccacatgtgcttcctcctggcttcaccatcggagccatctgcaagcgggaaaaccctcatgatgctgttgtctttcacccaaaatttgttgggaagaccctagaaaccctgccagagaagagtgtggtgggaaccagctccctgcgaagagcagcccagctgcagagaaagttcccgcatctggagttcaggagtattcggggaaacctcaacacccggcttcggaagctggacgagcagcaggagttcagtgccatcatcctggcaacagctggcctgcagcgcatgggctggcacaaccgggtggggcagatcctgcaccctgaggaatgcatgtatgctgtgggccaggaaggaggctgcagtgtgccagtagccgtgcatacagctatgaaggatgggcaactgtacctgactggaggagtctggagtctagacggctcagatagcatacaagagaccatgcaggctaccatccatgtccctgcccagcatgaagatggccctgaggatgacccacagttggtaggcatcactgctcgtaacattccacgagggccccagttggctgcccagaacttgggcatcagcctggccaacttgttgctgagcaaaggagccaaaaacatcctggatgttgcacggcagcttaacgatgcccattaactggtttgtggggcacagatgcctgggttgctgctgtccagtgcctacatcccgggcctcagtgccccattctcactgctatctggggagtgattaccccgggagactgaactgcagggttcaagccttccagggatttgcctcaccttggggccttgatgactgccttgcctcctcagtatgtgggggcttcatctctttagagaagtccaagcaacagcctttgaatgtaaccaatcctactaataaaccagttctgaaggt

SEQ ID NO: 25960 - DNA, 1418 bp, Homo sapiens
ggcacgagggtgacgcgaggctctgcggagaccaggagtcagactgtaggacgacctcgggtcccacgtgtccccggtactcgccggccggagcccccggcttcccggggccgggggaccttagcggcacccacacacagcctactttccaagcggagccatgtctggtaacggcaatgcggctgcaacggcgcttgctcgcatacagacggacagtgtggtggcaacattgaaagcctcgtaccctggcctgcagtttgaaatcattgctatgtccaccacaggggacaagattcttgatactgcactctctaagattggagagaaaagcctgtttaccaaggagcttgaacatgccctggagaagaatgaagtggacctggttgttcactccttgaaggacctgcccactgtgcttcctcctggcttcaccatcggagccatctgcaagcgggaaaaccctcatgatgctgttgtctttcacccaaaatttgttgggaagaccctagaaaccctgccagagaagagtgtggtgggaaccagctccctgcgaagagcagcccagctgcagagaaagttcccgcatctggagttcaggagtattcggggaaacctcaacacccggcttcggaagctggacgagcagcaggagttcagtgccatcatcctggcaacagctggcctgcagcgcatgggctggcacaaccgggtggggcaggggggccttgggcgtggaagtgcgagccaaggaccaggacatcttggatctggtgggtgtgctgcacgatcccgagactctgcttcgctgcatcgctgaaagggccttcctgaggcacctggaaggaggctgcagtgtgccagtagccgtgcatacagctatgaaggatgggcaactgtacctgactggaggagtctggagtctagacggctcagatagcatacaagagaccatgcaggctaccatccatgtccctgcccagcatgaagatggccctgaggatgacccacagttggtaggcatcactgctcgtaacattccacgagggccccagttggctgcccagaacttgggcatcagcctggccaacttgttgctgagcaaaggagccaaaaacatcctggatgttgcacggcagcttaacgatgcccattaactggtttgtggggcacagatgcctgggttgctgctgtccagtgcctacatcccgggcctcagtgccccattctcactgctatctggggagtgattaccccgggagactgaactgcagggttcaagccttccagggatttgcctcaccttggggccttgatgactgccttgcctcctcagtatgtgggggcttcatctctttagagaagtccaagcaacagcctttgaatgtaaccaatcctactaataaaccagttctgaaggt

SEQ ID NO: 25961 - DNA, 1764 bp, Homo sapiens
ggcacgagggtgacgcgaggctctgcggagaccaggagtcagactgtaggacgacctcgggtcccacgtgtccccggtactcgccggccggagcccccggcttcccggggccgggggaccttagcggcacccacacacagcctactttccaagcggagccatgtctggtaacggcaatgcggctgcaacggcggaagaaaacagcccaaagatgagagtgattcgcgtgggtacccgcaagagccagcttgctcgcatacagacggacagtgtggtggcaacattgaaagcctcgtaccctggcctgcagtttgaaatcagtgagttttctggaaaggagtggaagctaatgggaagcccagtaccccgagaggagagaacacaacatttctggctttgcctatagctaaagcccgtcccgctgccccgagattccttctgggctgctcccagttctgaaggtgctttcctctgaatacctccagctctgactacctggattagcctggcatttaacatcttgagctttgggtctttttatgagtgtttctggtcttcctgctcgattgtatatactcagagggcaggaaccagggattatgtgcctctgtccccatcatgaatcgtagcacagtgctaggctcagtaaatgctgatcaataatgagcacctgattgattgactctctcctcagttgctatgtccaccacaggggacaagattcttgatactgcactctctaagattggagagaaaagcctgtttaccaaggagcttgaacatgccctggagaagaatgaagtggacctggttgttcactccttgaaggacctgcccactgtgcttcctcctggcttcaccatcggagccatctgcaagcgggaaaaccctcatgatgctgttgtctttcacccaaaatttgttgggaagaccctagaaaccctgccagagaagagtgtggtgggaaccagctccctgcgaagagcagcccagctgcagagaaagttcccgcatctggagttcaggagtattcggggaaacctcaacacccggcttcggaagctggacgagcagcaggagttcagtgccatcatcctggcaacagctggcctgcagcgcatgggctggcacaaccgggtggggcagatcctgcaccctgaggaatgcatgtatgctgtgggccaggaaggaggctgcagtgtgccagtagccgtgcatacagctatgaaggatgggcaactgtacctgactggaggagtctggagtctagacggctcagatagcatacaagagaccatgcaggctaccatccatgtccctgcccagcatgaagatggccctgaggatgacccacagttggtaggcatcactgctcgtaacattccacgagggccccagttggctgcccagaacttgggcatcagcctggccaacttgttgctgagcaaaggagccaaaaacatcctggatgttgcacggcagcttaacgatgcccattaactggtttgtggggcacagatgcctgggttgctgctgtccagtgcctacatcccgggcctcagtgccccattctcactgctatctggggagtgattaccccgggagactgaactgcagggttcaagccttccagggatttgcctcaccttggggccttgatgactgccttgcctcctcagtatgtgggggcttcatctctttagagaagtccaagcaacagcctttgaatgtaaccaatcctactaataaaccagttctgaaggt

SEQ ID NO: 25962 - DNA, 1468 bp, Homo sapiens
ctcagtgtcctggttactgcagcggcagcaacagcaggtcctactatcgcctccctctagtctctgcttctctggatccctgaggagggcagaaggtactgaggaaggttaaagggaccagccttggagtatttccccactctgagactcagctggccacaggccaggttctgaagttcctttcttccaagccagtgattctggttcttggacaaggtgttgaggaacactagaaacagaggggactgtgacctggggactttttctgcaggaagaaaacagcccaaagatgagagtgattcgcgtgggtacccgcaagagccagcttgctcgcatacagacggacagtgtggtggcaacattgaaagcctcgtaccctggcctgcagtttgaaatcattgctatgtccaccacaggggacaagattcttgatactgcactctctaagattggagagaaaagcctgtttaccaaggagcttgaacatgccctggagaagaatgaagtggacctggttgttcactccttgaaggacctgcccactgtgcttcctcctggcttcaccatcggagccatctgcaagcgggaaaaccctcatgatgctgttgtctttcacccaaaatttgttgggaagaccctagaaaccctgccagagaagagtgtggtgggaaccagctccctgcgaagagcagcccagctgcagagaaagttcccgcatctggagttcaggagtattcggggaaacctcaacacccggcttcggaagctggacgagcagcaggagttcagtgccatcatcctggcaacagctggcctgcagcgcatgggctggcacaaccgggtggggcagatcctgcaccctgaggaatgcatgtatgctgtgggccaggaaggaggctgcagtgtgccagtagccgtgcatacagctatgaaggatgggcaactgtacctgactggaggagtctggagtctagacggctcagatagcatacaagagaccatgcaggctaccatccatgtccctgcccagcatgaagatggccctgaggatgacccacagttggtaggcatcactgctcgtaacattccacgagggccccagttggctgcccagaacttgggcatcagcctggccaacttgttgctgagcaaaggagccaaaaacatcctggatgttgcacggcagcttaacgatgcccattaactggtttgtggggcacagatgcctgggttgctgctgtccagtgcctacatcccgggcctcagtgccccattctcactgctatctggggagtgattaccccgggagactgaactgcagggttcaagccttccagggatttgcctcaccttggggccttgatgactgccttgcctcctcagtatgtgggggcttcatctctttagagaagtccaagcaacagcctttgaatgtaaccaatcctactaataaaccagttctgaaggt

SEQ ID NO: 25963 - DNA, 1510 bp, Homo sapiens
ggcacgagggtgacgcgaggctctgcggagaccaggagtcagactgtaggacgacctcgggtcccacgtgtccccggtactcgccggccggagcccccggcttcccggggccgggggaccttagcggcacccacacacagcctactttccaagcggagccatgtctggtaacggcaatgcggctgcaacggcggaagaaaacagcccaaagatgagagtgattcgcgtgggtacccgcaagagccagcttgctcgcatacagacggacagtgtggtggcaacattgaaagcctcgtaccctggcctgcagtttgaaatcattgctatgtccaccacaggggacaagattcttgatactgcactctctaagattggagagaaaagcctgtttaccaaggagcttgaacatgccctggagaagaatgaagtggacctggttgttcactccttgaaggacctgcccactgtgcttcctcctggcttcaccatcggagccatctgcaagcgggaaaaccctcatgatgctgttgtctttcacccaaaatttgttgggaagaccctagaaaccctgccagagaagagtgtggtgggaaccagctccctgcgaagagcagcccagctgcagagaaagttcccgcatctggagttcaggagtattcggggaaacctcaacacccggcttcggaagctggacgagcagcaggagttcagtgccatcatcctggcaacagctggcctgcagcgcatgggctggcacaaccgggtggggcagatcctgcaccctgaggaatgcatgtatgctgtgggccagggggccttgggcgtggaagtgcgagccaaggaccaggacatcttggatctggtgggtgtgctgcacgatcccgagactctgcttcgctgcatcgctgaaagggccttcctgaggcacctggaaggaggctgcagtgtgccagtagccgtgcatacagctatgaaggatgggcaactgtacctgactggaggagtctggagtctagacggctcagatagcatacaagagaccatgcaggctaccatccatgtccctgcccagcatgaagatggccctgaggatgacccacagttggtaggcatcactgctcgtaacattccacgagggccccagttggctgcccagaacttgggcatcagcctggccaacttgttgctgagcaaaggagccaaaaacatcctggatgttgcacggcagcttaacgatgcccattaactggtttgtggggcacagatgcctgggttgctgctgtccagtgcctacatcccgggcctcagtgccccattctcactgctatctggggagtgattaccccgggagactgaactgcagggttcaagccttccagggatttgcctcaccttggggccttgatgactgccttgcctcctcagtatgtgggggcttcatctctttagagaagtccaagcaacagcctttgaatgtaaccaatcctactaataaaccagttctgaaggt

SEQ ID NO: 25964 - DNA, 881 bp, Homo sapiens
ctcagtgtcctggttactgcagcggcagcaacagcaggtcctactatcgcctccctctagtctctgcttctctggatccctgaggagggcagaagtgattctggttcttggacaaggtgttgaggaacactagaaacagaggggactgtgacctggggactttttctgcaggaagaaaacagcccaaagatgagagtgattcgcgtgggtacccgcaagagccagcttgctcgcatacagacggacagtgtggtggcaacattgaaagcctcgtaccctggcctgcagtttgaaatcattgctatgtccaccacaggggacaagattcttgatactgcactctctaagattggagagaaaagcctgtttaccaaggagcttgaacatgccctggagaagaatgaagtggacctggttgttcactccttgaaggacctgcccactgtgcttcctcctggcttcaccatcggagccatctgcaagcgggaaaaccctcatgatgctgttgtctttcacccaaaatttgttgggaagaccctagaaaccctgccagagaagagtgtggtgggaaccagctccctgcgaagagcagcccagctgcagagaaagttcccgcatctggagttcaggagtattcggggaaacctcaacacccggcttcggaagctggacgagcagcaggagttcagtgccatcatcctggcaacagctggcctgcagcgcatgggctggcacaaccgggtggggcagatcctgcaccctgaggaatgcatgtatgctgtgggccaggtacaccttgaccagggaagccatatggtggacatttgctttccctttgttctcaaccagaagcttgtctcacaactctgaattgtttcccg

SEQ ID NO: 25965 - DNA, 1427 bp, Homo sapiens
ggcacgagggtgacgcgaggctctgcggagaccaggagtcagactgtaggacgacctcgggtcccacgtgtccccggtactcgccggccggagcccccggcttcccggggccgggggaccttagcggcacccacacacagcctactttccaagcggagccatgtctggtaacggcaatgcggctgcaacggcggtgagtgctgagccggtgaccagcacactttgggcttctggacgagccgtgcagcgattggccccaggttgccatcctcagtcgtctattgcttgctcgcatacagacggacagtgtggtggcaacattgaaagcctcgtaccctggcctgcagtttgaaatcattgctatgtccaccacaggggacaagattcttgatactgcactctctaagattggagagaaaagcctgtttaccaaggagcttgaacatgccctggagaagaatgaagtggacctggttgttcactccttgaaggacctgcccactgtgcttcctcctggcttcaccatcggagccatctgcaagcgggaaaaccctcatgatgctgttgtctttcacccaaaatttgttgggaagaccctagaaaccctgccagagaagagtgtggtgggaaccagctccctgcgaagagcagcccagctgcagagaaagttcccgcatctggagttcaggagtattcggggaaacctcaacacccggcttcggaagctggacgagcagcaggagttcagtgccatcatcctggcaacagctggcctgcagcgcatgggctggcacaaccgggtggggcagatcctgcaccctgaggaatgcatgtatgctgtgggccaggaaggaggctgcagtgtgccagtagccgtgcatacagctatgaaggatgggcaactgtacctgactggaggagtctggagtctagacggctcagatagcatacaagagaccatgcaggctaccatccatgtccctgcccagcatgaagatggccctgaggatgacccacagttggtaggcatcactgctcgtaacattccacgagggccccagttggctgcccagaacttgggcatcagcctggccaacttgttgctgagcaaaggagccaaaaacatcctggatgttgcacggcagcttaacgatgcccattaactggtttgtggggcacagatgcctgggttgctgctgtccagtgcctacatcccgggcctcagtgccccattctcactgctatctggggagtgattaccccgggagactgaactgcagggttcaagccttccagggatttgcctcaccttggggccttgatgactgccttgcctcctcagtatgtgggggcttcatctctttagagaagtccaagcaacagcctttgaatgtaaccaatcctactaataaaccagttctgaaggt

SEQ ID NO: 25966 - DNA, 1347 bp, Homo sapiens
ggcacgagggtgacgcgaggctctgcggagaccaggagtcagactgtaggacgacctcgggtcccacgtgtccccggtactcgccggccggagcccccggcttcccggggccgggggaccttagcggcacccacacacagcctactttccaagcggagccatgtctggtaacggcaatgcggctgcaacggcggaagaaaacagcccaaagatgagagtgattcgcgtgggtacccgcaagagccagcttgctcgcatacagacggacagtgtggtggcaacattgaaagcctcgtaccctggcctgcagtttgaaatcattgctatgtccaccacaggggacaagattcttgatactgcactctctaagattggagagaaaagcctgtttaccaaggagcttgaacatgccctggagaagaatgacttcctcctggcttcaccatcggagccatctgcaagcgggaaaaccctcatgatgctgttgtctttcacccaaaatttgttgggaagaccctagaaaccctgccagagaagagtgtggtgggaaccagctccctgcgaagagcagcccagctgcagagaaagttcccgcatctggagttcaggagtattcggggaaacctcaacacccggcttcggaagctggacgagcagcaggagttcagtgccatcatcctggcaacagctggcctgcagcgcatgggctggcacaaccgggtggggcagatcctgcaccctgaggaatgcatgtatgctgtgggccaggaaggaggctgcagtgtgccagtagccgtgcatacagctatgaaggatgggcaactgtacctgactggaggagtctggagtctagacggctcagatagcatacaagagaccatgcaggctaccatccatgtccctgcccagcatgaagatggccctgaggatgacccacagttggtaggcatcactgctcgtaacattccacgagggccccagttggctgcccagaacttgggcatcagcctggccaacttgttgctgagcaaaggagccaaaaacatcctggatgttgcacggcagcttaacgatgcccattaactggtttgtggggcacagatgcctgggttgctgctgtccagtgcctacatcccgggcctcagtgccccattctcactgctatctggggagtgattaccccgggagactgaactgcagggttcaagccttccagggatttgcctcaccttggggccttgatgactgccttgcctcctcagtatgtgggggcttcatctctttagagaagtccaagcaacagcctttgaatgtaaccaatcctactaataaaccagttctgaaggt

SEQ ID NO: 25967 - DNA, 1456 bp, Homo sapiens
ggcacgagggtgacgcgaggctctgcggagaccaggagtcagactgtaggacgacctcgggtcccacgtgtccccggtactcgccggccggagcccccggcttcccggggccgggggaccttagcggcacccacacacagcctactttccaagcggagccatgtctggtaacggcaatgcggctgcaacggcgcttgctcgcatacagacggacagtgtggtggcaacattgaaagcctcgtaccctggcctgcagtttgaaatcattgctatgtccaccacaggggacaagattcttgatactgcactctctaagattggagagaaaagcctgtttaccaaggagcttgaacatgccctggagaagaatgaagtggacctggttgttcactccttgaaggacctgcccactgtgcttcctcctggcttcaccatcggagccatctgcaagcgggaaaaccctcatgatgctgttgtctttcacccaaaatttgttgggaagaccctagaaaccctgccagagaagagtgtggtgggaaccagctccctgcgaagagcagcccagctgcagagaaagttcccgcatctggagttcaggagtattcggggaaacctcaacacccggcttcggaagctggacgagcagcaggagttcagtgccatcatcctggcaacagctggcctgcagcgcatgggctggcacaaccgggtggggcagatcctgcaccctgaggaatgcatgtatgctgtgggccagggggccttgggcgtggaagtgcgagccaaggaccaggacatcttggatctggtgggtgtgctgcacgatcccgagactctgcttcgctgcatcgctgaaagggccttcctgaggcacctggaaggaggctgcagtgtgccagtagccgtgcatacagctatgaaggatgggcaactgtacctgactggaggagtctggagtctagacggctcagatagcatacaagagaccatgcaggctaccatccatgtccctgcccagcatgaagatggccctgaggatgacccacagttggtaggcatcactgctcgtaacattccacgagggccccagttggctgcccagaacttgggcatcagcctggccaacttgttgctgagcaaaggagccaaaaacatcctggatgttgcacggcagcttaacgatgcccattaactggtttgtggggcacagatgcctgggttgctgctgtccagtgcctacatcccgggcctcagtgccccattctcactgctatctggggagtgattaccccgggagactgaactgcagggttcaagccttccagggatttgcctcaccttggggccttgatgactgccttgcctcctcagtatgtgggggcttcatctctttagagaagtccaagcaacagcctttgaatgtaaccaatcctactaataaaccagttctgaaggt

SEQ ID NO: 25968 - DNA, 1593 bp, Homo sapiens
ggcacgagggtgacgcgaggctctgcggagaccaggagtcagactgtaggacgacctcgggtcccacgtgtccccggtactcgccggccggagcccccggcttcccggggccgggggaccttagcggcacccacacacagcctactttccaagcggagccatgtctggtaacggcaatgcggctgcaacggcgtcattccagagccctggactaggagtaggaagatctgaattgtggccccaactctctttcggttattagctctgtgaccctaggaagaaaacagcccaaagatgagagtgattcgcgtgggtacccgcaagagccagcttgctcgcatacagacggacagtgtggtggcaacattgaaagcctcgtaccctggcctgcagtttgaaatcattgctatgtccaccacaggggacaagattcttgatactgcactctctaagattggagagaaaagcctgtttaccaaggagcttgaacatgccctggagaagaatgaagtggacctggttgttcactccttgaaggacctgcccactgtgcttcctcctggcttcaccatcggagccatctgcaagcgggaaaaccctcatgatgctgttgtctttcacccaaaatttgttgggaagaccctagaaaccctgccagagaagagtgtggtgggaaccagctccctgcgaagagcagcccagctgcagagaaagttcccgcatctggagttcaggagtattcggggaaacctcaacacccggcttcggaagctggacgagcagcaggagttcagtgccatcatcctggcaacagctggcctgcagcgcatgggctggcacaaccgggtggggcagatcctgcaccctgaggaatgcatgtatgctgtgggccagggggccttgggcgtggaagtgcgagccaaggaccaggacatcttggatctggtgggtgtgctgcacgatcccgagactctgcttcgctgcatcgctgaaagggccttcctgaggcacctggaaggaggctgcagtgtgccagtagccgtgcatacagctatgaaggatgggcaactgtacctgactggaggagtctggagtctagacggctcagatagcatacaagagaccatgcaggctaccatccatgtccctgcccagcatgaagatggccctgaggatgacccacagttggtaggcatcactgctcgtaacattccacgagggccccagttggctgcccagaacttgggcatcagcctggccaacttgttgctgagcaaaggagccaaaaacatcctggatgttgcacggcagcttaacgatgcccattaactggtttgtggggcacagatgcctgggttgctgctgtccagtgcctacatcccgggcctcagtgccccattctcactgctatctggggagtgattaccccgggagactgaactgcagggttcaagccttccagggatttgcctcaccttggggccttgatgactgccttgcctcctcagtatgtgggggcttcatctctttagagaagtccaagcaacagcctttgaatgtaaccaatcctactaataaaccagttctgaaggt

SEQ ID NO: 25969 - DNA, 309 bp, Homo sapiens
ggttttctagatgagcagtctcttaagcagtttctctgtttaagaggacttgggtaccttaagcagagctgatgctctatttcatgttctaagacacttttttggggttgtgttttaatgtatccaaaattgagatctgattcacagttgatgtggtgggaaggcattgtatcaaagtttaaatggccacatttttttcatttcttggtggtccataaaataatgacatattttataaattaaaggcagctgatatttgatgaaatctgatagatcactttcagaacaggctgcagagatcatttctat

SEQ ID NO: 25970 - DNA, 1058 bp, Homo sapiens
aaaagcaaaatctgagcaggcttccgaggtttcctatgcaggagtgattggggcagatgtgagagggcacggcctcatctgtgaggggcagccagtgacgtcacggctggctgtcatctgtggaacgtcttcttgtcacatggggatcagcaaagacccgatttttgtaccaggcgtctgggggccttatttctcagccatggtacctgggttctggctgaatgaaggtggtcagagcgttactggaaaattgatagaccacatggtacaaggccatgctgcttttccagaactacaagtaaaggccacagccagatgccagagtatatatgcatatttgaacagtcacctggatctgattaagaaggctcagcctgtgggtttccttactgttgatttacatgtttggccagatttccatggcaaccggtctcccttagcagatctgacactaaagggcatggtcaccggattgaaactgtctcaggaccttgatgatcttgccattctctacctggccacagttcaagccattgctttggggactcgcttcattatagaagccatggaggcagcagggcactcaatcagtactcttttcctatgtggaggcctcagcaagaatcccctttttgtgcaaatgcatgcggacattactggcatgcctgtggtcctgtcgcaagaggtggagtccgttcttgtgggtgctgctgttctgggtgcctgtgcctcaggggatttcgcttctgtacaggaagcaatggcaaaaatgagcaaagttgggaaagttgtgttcccgagactacaggataaaaaatactatgataagaaataccaagtattcctgaagctggttgaacaccagaaggagtatttggcgatcatgaatgatgactgaacagggcttgcaggtgctgatgccagaagcttctgtgccattgcattaaagacttctgtcatttgatccatgttcaagacccttgaggtattgtttcatcatttctgtattgtctttcaataaagaaaaaacaaacatgtgcaaccagaattaaagtctt

SEQ ID NO: 25971 - DNA, 361 bp, Homo sapiens
  misc_feature (19)..(19): n is a, c, g, or t
tttatttttttatattttnaaagtaagattgtgcgttcgtgtaaaagattatgctcggaagcaatggcaaaaatgagcaaagttgggaaagttgtgttcccgagactacaggataaaaaatactatgataagaaataccaagtattcctgaagctggttgaacaccagaaggagtatttggcgatcatgaatgatgactgaacagggcttgcaggtgctgatgccagaagcttctgtgccattgcattaaagacttctgtcatttgatccatgttcaagacccttgaggtattgtttcatcatttctgtattgtctttcaataaagaaaaaacaaacatgtgcaaccagaattaaagtctt

SEQ ID NO: 25972 - DNA, 355 bp, Homo sapiens
taagtaaggtgacttgacgaattaacaacaaaaacaaaaggctcgagtgaggaagcaatggcaaaaatgagcaaagttgggaaagttgtgttcccgagactacaggataaaaaatactatgataagaaataccaagtattcctgaagctggttgaacaccagaaggagtatttggcgatcatgaatgatgactgaacagggcttgcaggtgctgatgccagaagcttctgtgccattgcattaaagacttctgtcatttgatccatgttcaagacccttgaggtattgtttcatcatttctgtattgtctttcaataaagaaaaaacaaacatgtgcaaccagaattaaagtctt

SEQ ID NO: 25973 - DNA, 241 bp, Homo sapiens
  misc_feature (16)..(16): n is a, c, g, or t
tcgtcagcaggatctnaataaatgttggtcattgatgcccatgcaggaggactaggtaatctcttatttgttgcctacagccaaaaccgtattcaaatggaatattccctagaaccgaagacactccttttctgtttttaaaacaaaggtcaaggactttggtgtttcaggatataataatgaaaagcccttttacagctaggcatttggatagaattacagaacttttcatcaatgacca

SEQ ID NO: 25974 - DNA, 1182 bp, Homo sapiens
ggccagtctttcccatgctgttctcgtgatagtaagtctcacaagatctgatgggtttatcaggcttttctgcgttgcttcttcctcattctttcttgctgccaccatgtaagaagtgcctttgccctccaccatgattatgagacctcccagccgtgtggaactgagtgattggggcagatgtgagagggcacggcctcatctgtgaggggcagccagtgacgtcacggctggctgtcatctgtggaacgtcttcttgtcacatggggatcagcaaagacccgatttttgtaccaggcgtctgggggccttatttctcagccatggtacctgggttctggctgaatgaaggtggtcagagcgttactggaaaattgatagaccacatggtacaaggccatgctgcttttccagaactacaagtaaaggccacagccagatgccagagtatatatgcatatttgaacagtcacctggatctgattaagaaggctcagcctgtgggtttccttactgttgatttacatgtttggccagatttccatggcaaccggtctcccttagcagatctgacactaaagggcatggtcaccggattgaaactgtctcaggaccttgatgatcttgccattctctacctggccacagttcaagccattgctttggggactcgcttcattatagaagccatggaggcagcagggcactcaatcagtactcttttcctatgtggaggcctcagcaagaatcccctttttgtgcaaatgcatgcggacattactggcatgcctgtggtcctgtcgcaagaggtggagtccgttcttgtgggtgctgctgttctgggtgcctgtgcctcaggggatttcgcttctgtacaggaagcaatggcaaaaatgagcaaagttgggaaagttgtgttcccgagactacaggataaaaaatactatgataagaaataccaagtattcctgaagctggttgaacaccagaaggagtatttggcgatcatgaatgatgactgaacagggcttgcaggtgctgatgccagaagcttctgtgccattgcattaaagacttctgtcatttgatccatgttcaagacccttgaggtattgtttcatcatttctgtattgtctttcaataaagaaaaaacaaacatgtgcaaccagaattaaagtctt

SEQ ID NO: 25975 - DNA, 1208 bp, Homo sapiens
  misc_feature (1156)..(1156): n is a, c, g, or t
ggccagtctttcccatgctgttctcgtgatagtaagtctcacaagatctgatgggtttatcaggcttttctgcgttgcttcttcctcattctttcttgctgccaccatgtaagaagtgcctttgccctccaccatgattatgagacctcccagccgtgtggaactgagtgattggggcagatgtgagagggcacggcctcatctgtgaggggcagccagtgacgtcacggctggctgtcatctgtggaacgtcttcttgtcacatggggatcagcaaagacccgatttttgtaccaggcgtctgggggccttatttctcagccatggtacctgggttctggctgaatgaaggtggtcagagcgttactggaaaattgatagaccacatggtacaaggccatgctgcttttccagaactacaagtaaaggccacagccagatgccagagtatatatgcatatttgaacagtcacctggatctgattaagaaggctcagcctgtgggtttccttactgttgatttacatgtttggccagatttccatggcaaccggtctcccttagcagatctgacactaaagggcatggtcaccggattgaaactgtctcaggaccttgatgatcttgccattctctacctggccacagttcaagccattgctttggggactcgcttcattatagaagccatggaggcagcagggcactcaatcagtactcttttcctatgtggaggcctcagcaagaatcccctttttgtgcaaatgcatgcggacattactggcatgcctgtggtcctgtcgcaagaggtggagtccgttcttgtgggtgctgctgttctgggtgcctgtgcctcaggggatttcgcttctgtacaggaagcaatggcaaaaatgagcaaagttgggaaagttgtgttcccgagactacaggataaaaaatactatgataagaaataccaagtattcctgaagctggttgaacaccagaaggagtatttggcgatcatgaatgatgactgaacagggcttgcaggtgctgatgccagaagcttctgtgccattgcattaaagacttctgtcatttgatccatgttcaagacccttgaggtattgtttcatcatttctgtattgtctttcaataaagaaaaaacgntgcggccgaagcccccttcctccgtcaattggcccagtattaggaggcagag

SEQ ID NO: 25976 - DNA, 1679 bp, Homo sapiens
cgcacgcccagaaagaggcttctccaacccggcccggcccttccttcccctttcccgcagtcgttgcctcctcctcccctgcctcctcctccccttcctcctcctggccgcttagtctcacacccgccgggccgttgttcccgagacgttgttgagtcccctgtgtcctcttctgggggattcccatcgaaacgtcatcatgtggctggaccatcgagcagtcagtcaagttaacaggatcaatgagaccaagcacagtgtcctccagtacgtcgggggggtgatgtctgtggaaatgcaggccccgaaacttctgtggctgaaagagaacttgagagagatttgctgggataaggcgggacatttctttgatctcccggacttcttatcgtggaaggcaacaggtgtcacagcacggtctctctgctccctggtgtgtaagtggacatattcagcagagaaaggctgggacgacagtttctggaaaatgattggtttggaagactttgttgcagataattacagcaaaataggaaaccaagtgctacctcctggagcttctcttggaaatgggctcacaccagaggcagcaagagaccttggccttctccctgggattgcggtcgcagcttcactcattgatgcccatgcaggaggactaggagtgattggggcagatgtgagagggcacggcctcatctgtgaggggcagccagtgacgtcacggctggctgtcatctgtggaacgtcttcttgtcacatggggatcagcaaagacccgatttttgtaccaggcgtctgggggccttatttctcagccatggtacctgggttctggctgaatgaaggtggtcagagcgttactggaaaattgatagaccacatggtacaaggccatgctgcttttccagaactacaagtaaaggccacagccagatgccagagtatatatgcatatttgaacagtcacctggatctgattaagaaggctcagcctgtgggtttccttactgttgatttacatgtttggccagatttccatggcaaccggtctcccttagcagatctgacactaaagggcatggtcaccggattgaaactgtctcaggaccttgatgatcttgccattctctacctggccacagttcaagccattgctttggggactcgcttcattatagaagccatggaggcagcagggcactcaatcagtactcttttcctatgtggaggcctcagcaagaatcccctttttgtgcaaatgcatgcggacattactggcatgcctgtggtcctgtcgcaagaggtggagtccgttcttgtgggtgctgctgttctgggtgcctgtgcctcaggggatttcgcttctgtacaggaagcaatggcaaaaatgagcaaagttgggaaagttgtgttcccgagactacaggataaaaaatactatgataagaaataccaagtattcctgaagctggttgaacaccagaaggagtatttggcgatcatgaatgatgactgaacagggcttgcaggtgctgatgccagaagcttctgtgccattgcattaaagacttctgtcatttgatccatgttcaagacccttgaggtattgtttcatcatttctgtattgtctttcaataaagaaaaaacaaacatgtgcaaccagaattaaagtctt

SEQ ID NO: 25977 - DNA, 1207 bp, Homo sapiens
ggccagtctttcccatgctgttctcgtgatagtaagtctcacaagatctgatgggtttatcaggcttttctgcgttgcttcttcctcattctttcttgctgccaccatgtaagaagtgcctttgccctccaccatgattatgagacctcccagccgtgtggaactgagtgattggggcagatgtgagagggcacggcctcatctgtgaggggcagccagtgacgtcacggctggctgtcatctgtggaacgtcttcttgtcacatggggatcagcaaagacccgatttttgtaccaggcgtctgggggccttatttctcagccatggtacctgggttctggctgaatgaaggtggtcagagcgttactggaaaattgatagaccacatggtacaaggccatgctgcttttccagaactacaagtaaaggccacagccagatgccagagtatatatgcatatttgaacagtcacctggatctgattaagaaggctcagcctgtgggtttccttactgttgatttacatgtttggccagatttccatggcaaccggtctcccttagcagatctgacactaaagggcatggtcaccggattgaaactgtctcaggaccttgatgatcttgccattctctacctggccacagttcaagccattgctttggggactcgcttcattatagaagccatggaggcagcagggcactcaatcagtactcttttcctatgtggaggcctcagcaagaatcccctttttgtgcaaatgcatgcggacattactggcatgcctgtggtcctgtcgcaagaggtggagtccgttcttgtgggtgctgctgttctgggtgcctgtgcctcaggggatttcgcttctgtacaggaagcaatggcaaaaatgagcaaagttgggaaagttgtgttcccgagactacaggataaaaaatactatgataagaaataccaagtattcctgaagctggttgaacaccagaaggagtatttggcgatcatgaatgatgactgaacagggcttgcaggtgctgatgccagaagcttctgtgccattgcattaaagacttctgtcatttgatccatgttcaagacccttgaggtattgtttcatcatttctgtattgtctttcaataaagaaagatgcgccccgcctactctcatatacaaacctactattctgtcatggcgagaagtgt

SEQ ID NO: 25978 - DNA, 1208 bp, Homo sapiens
ggccagtctttcccatgctgttctcgtgatagtaagtctcacaagatctgatgggtttatcaggcttttctgcgttgcttcttcctcattctttcttgctgccaccatgtaagaagtgcctttgccctccaccatgattatgagacctcccagccgtgtggaactgagtgattggggcagatgtgagagggcacggcctcatctgtgaggggcagccagtgacgtcacggctggctgtcatctgtggaacgtcttcttgtcacatggggatcagcaaagacccgatttttgtaccaggcgtctgggggccttatttctcagccatggtacctgggttctggctgaatgaaggtggtcagagcgttactggaaaattgatagaccacatggtacaaggccatgctgcttttccagaactacaagtaaaggccacagccagatgccagagtatatatgcatatttgaacagtcacctggatctgattaagaaggctcagcctgtgggtttccttactgttgatttacatgtttggccagatttccatggcaaccggtctcccttagcagatctgacactaaagggcatggtcaccggattgaaactgtctcaggaccttgatgatcttgccattctctacctggccacagttcaagccattgctttggggactcgcttcattatagaagccatggaggcagcagggcactcaatcagtactcttttcctatgtggaggcctcagcaagaatcccctttttgtgcaaatgcatgcggacattactggcatgcctgtggtcctgtcgcaagaggtggagtccgttcttgtgggtgctgctgttctgggtgcctgtgcctcaggggatttcgcttctgtacaggaagcaatggcaaaaatgagcaaagttgggaaagttgtgttcccgagactacaggataaaaaatactatgataagaaataccaagtattcctgaagctggttgaacaccagaaggagtatttggcgatcatgaatgatgactgaacagggcttgcaggtgctgatgccagaagcttctgtgccattgcattaaagacttctgtcatttgatccatgttcaagacccttgaggtattgtttcatcatttctgtattgtctttcaataaagaaagatgtcggccgaaactctctaccccaccaaaatcattatttaacgcatgggcaacact

SEQ ID NO: 25979 - DNA, 1015 bp, Homo sapiens
gaagtgccttttgctcttcgccatgattatgagacctccccagccatgtggaactgagtgattggggcagatgtgagagggcacggcctcatctgtgaggggcagccagtgacgtcacggctggctgtcatctgtggaacgtcttcttgtcacatggggatcagcaaagacccgatttttgtaccaggcgtctgggggccttatttctcagccatggtacctgggttctggctgaatgaaggtggtcagagcgttactggggccacagccagatgccagagtatatatgcatatttgaacagtcacctggatctgattaagaaggctcagcctgtgggtttccttactgttgatttacatgtttggccagatttccatggcaaccggtctcccttagcagatctgacactaaagggcatggtcaccggattgaaactgtctcaggaccttgatgatcttgccattctctacctggccacagttcaagccattgctttggggactcgcttcattatagaagccatggaggcagcagggcactcaatcagtactcttttcctatgtggaggcctcagcaagaatcccctttttgtgcaaatgcatgcggacattactggcatgcctgtggtcctgtcgcaagaggtggagtccgttcttgtgggtgctgctgttctgggtgcctgtgcctcaggggatttcgcttctgtacaggaagcaatggcaaaaatgagcaaagttgggaaagttgtgttcccgagactacaggataaaaaatactatgataagaaataccaagtattcctgaagctggttgaacaccagaaggagtatttggcgatcatgaatgatgactgaacagggcttgcaggtgctgatgccagaagcttctgtgccattgcattaaagacttctgtcatttgatccatgttcaagacccttgaggtattgtttcatcatttctgtattgtctttcaataaagaaaaaacaaacatgtgcaaccagaattaaagtctt

SEQ ID NO: 25980 - DNA, 1206 bp, Homo sapiens
  misc_feature (15)..(15): n is a, c, g, or t
  misc_feature (63)..(63): n is a, c, g, or t
  misc_feature (79)..(79): n is a, c, g, or t
ggggggggggtttanaggggggggggtttaaaggggggggggtttagaggggggggggtttanaggggggggggtttanagggggggggggggggggggggggatgggggggaaggggggggtgtagggggggggggaggggggtggtgaggcgccgtggggttcggcgcggctacgtgcagaatccgtctagctaaaatgtaatttcagattggacaagtactgtggaggaactgcaatgtctggtggagaacagaaaccagagaggtactatgtgggtgtggacgttggaacaggcagtgtccgtgcagctctggtggaccagagtggggtcctgttggcttttgcagaccagccaattaagaattgggagccccagttcaaccaccatgagcagtcctccgaggacatctgggctgcgtgctgtgttgtcacaaagaaagttgtacaagggattgatttaaaccaaattcgaggacttgggtttgatgccacgtgttctctggttgttttggataagcagtttcacccattaccagtcaaccaggaaggggattcccatcgaaacgtcatcatgtggctggaccatcgagcagtcagtcaagttaacaggatcaatgagaccaagcacagtgtcctccagtacgtcgggggggtgatgtctgtggaaatgcaggccccgaaacttctgtggctgaaagagaacttgagagagatttgctgggataaggcgggacatttctttgatctcccggacttcttatcgtggaaggcaacaggtgtcacagcacgggaactctctgctccctggtgttgtaacgtggacattattcagcagagcataggctgggacccacagaaactggcagaactgattcggctgggacagacttcgcttgcacattaatttccggggaaaagtagggaaacccaacgttgctagccttcctggaggacgtaccacttggcacaatggggctccgtgcgcgtcacggtaggcatgcaggacctgtggccttcctcccctgtcgaattgcgggtccgcacgtttcacctcatttggatgccgccattccgcgcggtccttggagctgcatctggcggcccccatcttccgacggccccggccctactcgtgtctcgggtgccttcccgcttcccttcccggttgggcctccccctgtcgccgcgccctctgtgcccacg

SEQ ID NO: 25981 - DNA, 739 bp, Homo sapiens
tgggaatccataattgttcccttgaattagaaggaagagaatgtgtgtccatctgcatctccctctcgtttctgctaggggattcccatcgaaacgtcatcatgtggctggaccatcgagcagtcagtcaagttaacaggatcaatgagaccaagcacagtgtcctccagtacgtcgggggggtgatgtctgtggaaatgcaggccccgaaacttctgtggctgaaagaggtgagtgcatagggtctaagagaagataccaacaatagtagaggattcctgttactgtggacctgtaggtaccaggcaccctgctaaaatcggttatgtttgatttttcccagcaactaggaggaaggttgatcccattttattgattacagtgtagttaaatcacacctgtttttatgtgcctaactcatactaggcactgtgacaagtattgtacacattatctctttgaaggccaacgaccctatgaagtgtttgtgtgtggtgtttattttagggtgtctgttttgtagacaagaaaacgaatgttcatagagataaaacaactcactcaaagtgacaaagtaaatatgtgacagaaccagaatttgaacctaagactggctgactccaaaatcatttttttttaattttaaaatgtttcttttgtagagacttggtctcactattttggccaggctgatttcgaactcctggccttatgtgatcctgcaaaagtgatatgatta

SEQ ID NO: 25982 - DNA, 271 bp, Homo sapiens
agggaagccctgtggcagttttgtcttgagatcattcaacatatttatatttctcccacagatactatgataagaaataccaagtattcctgaagctggttgaacaccagaaggagtatttggcgatcatgaatgatgactgaacagggcttgcaggtgctgatgccagaagcttctgtgccattgcattaaagacttctgtcatttgatccatgttcaagacccttgaggtattgtttcatcatttctgtattgtctttcaataaagaaa

SEQ ID NO: 25983 - DNA, 2006 bp, Homo sapiens
cgcacgcccagaaagaggcttctccaacccggcccggcccttccttcccctttcccgcagtcgttgcctcctcctcccctgcctcctcctccccttcctcctcctggccgcttagtctcacacccgccgggccgttgttcccgagacgttgttgagtcccctgtgtcctcttctgggtggaggaactgcaatgtctggtggagaacagaaaccagagaggtactatgtgggtgtggacgttggaacaggcagtgtccgtgcagctctggtggaccagagtggggtcctgttggcttttgcagaccagccaattaagaattgggagccccagttcaaccaccatgagcagtcctccgaggacatctgggctgcgtgctgtgttgtcacaaagaaagttgtacaagggattgatttaaaccaaattcgaggacttgggtttgatgccacgtgttctctggttgttttggataagcagtttcacccattaccagtcaaccaggaaggggattcccatcgaaacgtcatcatgtggctggaccatcgagcagtcagtcaagttaacaggatcaatgagaccaagcacagtgtcctccagtacgtcgggggggtgatgtctgtggaaatgcaggccccgaaacttctgtggctgaaagagaacttgagagagatttgctgggataaggcgggacatttctttgatctcccggacttcttatcgtggaaggcaacaggtgtcacagcacggtctctctgctccctggtgtgtaagtggacatattcagcagagaaaggctgggacgacagtttctggaaaatgattggtttggaagactttgttgcagataattacagcaaaataggaaaccaagtgctacctcctggagcttctcttggaaatgggctcacaccagaggcagcaagagaccttggccttctccctgggattgcggtcgcagcttcactcattgatgcccatgcaggaggactaggagtgattggggcagatgtgagagggcacggcctcatctgtgaggggcagccagtgacgtcacggctggctgtcatctgtggaacgtcttcttgtcacatggggatcagcaaagacccgatttttgtaccaggcgtctgggggccttatttctcagccatggtacctgggttctggctgaatgaaggtggtcagagcgttactggaaaattgatagaccacatggtacaaggccatgctgcttttccagaactacaagtaaaggccacagccagatgccagagtatatatgcatatttgaacagtcacctggatctgattaagaaggctcagcctgtgggtttccttactgttgatttacatgtttggccagatttccatggcaaccggtctcccttagcagatctgacactaaagggcatggtcaccggattgaaactgtctcaggaccttgatgatcttgccattctctacctggccacagttcaagccattgctttggggactcgcttcattatagaagccatggaggcagcagggcactcaatcagtactcttttcctatgtggaggcctcagcaagaatcccctttttgtgcaaatgcatgcggacattactggcatgcctgtggtcctgtcgcaagaggtggagtccgttcttgtgggtgctgctgttctgggtgcctgtgcctcaggggatttcgcttctgtacaggaagcaatggcaaaaatgagcaaagttgggaaagttgtgttcccgagactacaggataaaaaatactatgataagaaataccaagtattcctgaagctggttgaacaccagaaggagtatttggcgatcatgaatgatgactgaacagggcttgcaggtgctgatgccagaagcttctgtgccattgcattaaagacttctgtcatttgatccatgttcaagacccttgaggtattgtttcatcatttctgtattgtctttcaataaagaaaaaacaaacatgtgcaaccagaattaaagtctt

SEQ ID NO: 25984 - DNA, 1956 bp, Homo sapiens
cgcacgcccagaaagaggcttctccaacccggcccggcccttccttcccctttcccgcagtcgttgcctcctcctcccctgcctcctcctccccttcctcctcctggccgcttagtctcacacccgccgggccgttgttcccgagacgttgttgagtcccctgtgtcctcttctgggtggaggaactgcaatgtctggtggagaacagaaaccagagaggtactatgtgggtgtggacgttggaacaggcagtgtccgtgcagctctggtggaccagagtggggtcctgttggcttttgcagaccagccaattaagaattgggagccccagttcaaccaccatgagcagtcctccgaggacatctgggctgcgtgctgtgttgtcacaaaggggattcccatcgaaacgtcatcatgtggctggaccatcgagcagtcagtcaagttaacaggatcaatgagaccaagcacagtgtcctccagtacgtcgggggggtgatgtctgtggaaatgcaggccccgaaacttctgtggctgaaagagaacttgagagagatttgctgggataaggcgggacatttctttgatctcccggacttcttatcgtggaaggcaacaggtgtcacagcacggtctctctgctccctggtgtgtaagtggacatattcagcagagaaaggctgggacgacagtttctggaaaatgattggtttggaagactttgttgcagataattacagcaaaataggaaaccaagtgctacctcctggagcttctcttggaaatgggctcacaccagaggcagcaagagaccttggccttctccctgggattgcggtcgcagcttcactcattgatgcccatgcaggaggactaggagtgattggggcagatgtgagagggcacggcctcatctgtgaggggcagccagtgacgtcacggctggctgtcatctgtggaacgtcttcttgtcacatggggatcagcaaagacccgatttttgtaccaggcgtctgggggccttatttctcagccatggtacctgggttctggctgaatgaaggtggtcagagcgttactggaaaattgatagaccacatggtacaaggccatgctgcttttccagaactacaagtaaaggccacagccaggtaactgctgtctctgttccctctaaaattttccttgtgtgactgtattgagagaattcacgttgggcagttgggtgattttcagatcctacagacaatgaaaatgcctgttagtgcttgaaagatagtcacctggatgatccagaagatagatgtattaattctttaaatgaggtaagagaacttagagaacctagagataccccaagaatatacccagggactatagataagaaactctgatgtagaagaaggaccatggattctggagtcaaaacttcttagtttcacatcccagccatactccttaatagatacaggaccttgagctagttacttaacctctttatgcctgtctcttcatctgtaaaactgaagataataactgatatggagtgatttctagaatattttgaagcaagctgagtgcaaaaaaaatttacgatatactccctttcatgtaaaaagaaagacataggaaaatacatgtgtatctgttcatttttgcaaaagaaatataggaagtggccaggtgcggtggctcactcctgtaaccccagcaccttgggaggccgaggcgggcagatcacgagttcagagatcgagaccagcctggccaacatggtgaaaccccatctctactaaaaatacaaaagttagccgggcatggtgatgtatgcctataatcccagttacttgggaggttgaggcaggagaattgctcaaacccgggaggtggaggttgcagtgagcagagatcgtgccactgcactccagcctgggcaataaagtgagactccgtctc

SEQ ID NO: 25985 - DNA, 2054 bp, Homo sapiens
  misc_feature (15)..(15): n is a, c, g, or t
  misc_feature (63)..(63): n is a, c, g, or t
  misc_feature (79)..(79): n is a, c, g, or t
ggggggggggtttanaggggggggggtttaaaggggggggggtttagaggggggggggtttanaggggggggggtttanagggggggggggggggggggggggatgggggggaaggggggggtgtagggggggggggaggggggtggtgaggcgccgtggggttcggcgcggctacgtgcagaatccgtctagctaaaatgtaatttcagattggacaagtactgtggaggaactgcaatgtctggtggagaacagaaaccagagaggtactatgtgggtgtggacgttggaacaggcagtgtccgtgcagctctggtggaccagagtggggtcctgttggcttttgcagaccagccaattaagaattgggagccccagttcaaccaccatgagcagtcctccgaggacatctgggctgcgtgctgtgttgtcacaaagaaagttgtacaagggattgatttaaaccaaattcgaggacttgggtttgatgccacgtgttctctggttgttttggataagcagtttcacccattaccagtcaaccaggaaggggattcccatcgaaacgtcatcatgtggctggaccatcgagcagtcagtcaagttaacaggatcaatgagaccaagcacagtgtcctccagtacgtcgggggggtgatgtctgtggaaatgcaggccccgaaacttctgtggctgaaagagaacttgagagagatttgctgggataaggcgggacatttctttgatctcccggacttcttatcgtggaaggcaacaggtgtcacagcacggtctctctgctccctggtgtgtaagtggacatattcagcagagaaaggctgggacgacagtttctggaaaatgattggtttggaagactttgttgcagataattacagcaaaataggaaaccaagtgctacctcctggagcttctcttggaaatgggctcacaccagaggcagcaagagaccttggccttctccctgggattgcggtcgcagcttcactcattgatgcccatgcaggaggactaggagtgattggggcagatgtgagagggcacggcctcatctgtgaggggcagccagtgacgtcacggctggctgtcatctgtggaacgtcttcttgtcacatggggatcagcaaagacccgatttttgtaccaggcgtctgggggccttatttctcagccatggtacctgggttctggctgaatgaaggtggtcagagcgttactggaaaattgatagaccacatggtacaaggccatgctgcttttccagaactacaagtaaaggccacagccagatgccagagtatatatgcatatttgaacagtcacctggatctgattaagaaggctcagcctgtgggtttccttactgttgatttacatgtttggccagatttccatggcaaccggtctcccttagcagatctgacactaaagggcatggtcaccggattgaaactgtctcaggaccttgatgatcttgccattctctacctggccacagttcaagccattgctttggggactcgcttcattatagaagccatggaggcagcagggcactcaatcagtactcttttcctatgtggaggcctcagcaagaatcccctttttgtgcaaatgcatgcggacattactggcatgcctgtggtcctgtcgcaagaggtggagtccgttcttgtgggtgctgctgttctgggtgcctgtgcctcaggggatttcgcttctgtacaggaagcaatggcaaaaatgagcaaagttgggaaagttgtgttcccgagactacaggataaaaaatactatgataagaaataccaagtattcctgaagctggttgaacaccagaaggagtatttggcgatcatgaatgatgactgaacagggcttgcaggtgctgatgccagaagcttctgtgccattgcattaaagacttctgtcatttgatccatgttcaagacccttgaggtattgtttcatcatttctgtattgtctttcaataaagaaaaaacaaacatgtgcaaccagaattaaagtctt

SEQ ID NO: 25986 - DNA, 1894 bp, Homo sapiens
cgcacgcccagaaagaggcttctccaacccggcccggcccttccttcccctttcccgcagtcgttgcctcctcctcccctgcctcctcctccccttcctcctcctggccgcttagtctcacacccgccgggccgttgttcccgagacgttgttgagtcccctgtgtcctcttctgggtggaggaactgcaatgtctggtggagaacagaaaccagagaggtactatgtgggtgtggacgttggaacaggcagtgtccgtgcagctctggtggaccagagtggggtcctgttggcttttgcagaccagccaattaagaattgggagccccagttcaaccaccatgagcagtcctccgaggacatctgggctgcgtgctgtgttgtcacaaaggggattcccatcgaaacgtcatcatgtggctggaccatcgagcagtcagtcaagttaacaggatcaatgagaccaagcacagtgtcctccagtacgtcgggggggtgatgtctgtggaaatgcaggccccgaaacttctgtggctgaaagagaacttgagagagatttgctgggataaggcgggacatttctttgatctcccggacttcttatcgtggaaggcaacaggtgtcacagcacggtctctctgctccctggtgtgtaagtggacatattcagcagagaaaggctgggacgacagtttctggaaaatgattggtttggaagactttgttgcagataattacagcaaaataggaaaccaagtgctacctcctggagcttctcttggaaatgggctcacaccagaggcagcaagagaccttggccttctccctgggattgcggtcgcagcttcactcattgatgcccatgcaggaggactaggagtgattggggcagatgtgagagggcacggcctcatctgtgaggggcagccagtgacgtcacggctggctgtcatctgtggaacgtcttcttgtcacatggggatcagcaaagacccgatttttgtaccaggcgtctgggggccttatttctcagccatggtacctgggttctggctgaatgaaggtggtcagagcgttactggaaaattgatagaccacatggtacaaggccatgctgcttttccagaactacaagtaaaggccacagccagatgccagagtatatatgcatatttgaacagtcacctggatctgattaagaaggctcagcctgtgggtttccttactgttgatttacatgtttggccagatttccatggcaaccggtctcccttagcagatctgacactaaagggcatggtcaccggattgaaactgtctcaggaccttgatgatcttgccattctctacctggccacagttcaagccattgctttggggactcgcttcattatagaagccatggaggcagcagggcactcaatcagtactcttttcctatgtggaggcctcagcaagaatcccctttttgtgcaaatgcatgcggacattactggcatgcctgtggtcctgtcgcaagaggtggagtccgttcttgtgggtgctgctgttctgggtgcctgtgcctcaggggatttcgcttctgtacaggaagcaatggcaaaaatgagcaaagttgggaaagttgtgttcccgagactacaggataaaaaatactatgataagaaataccaagtattcctgaagctggttgaacaccagaaggagtatttggcgatcatgaatgatgactgaacagggcttgcaggtgctgatgccagaagcttctgtgccattgcattaaagacttctgtcatttgatccatgttcaagacccttgaggtattgtttcatcatttctgtattgtctttcaataaagaaaaaacaaacatgtgcaaccagaattaaagtctt

SEQ ID NO: 25987 - DNA, 1727 bp, Homo sapiens
  misc_feature (15)..(15): n is a, c, g, or t
  misc_feature (63)..(63): n is a, c, g, or t
  misc_feature (79)..(79): n is a, c, g, or t
ggggggggggtttanaggggggggggtttaaaggggggggggtttagaggggggggggtttanaggggggggggtttanagggggggggggggggggggggggatgggggggaaggggggggtgtagggggggggggaggggggtggtgaggcgccgtggggttcggcgcggctacgtgcagaatccgtctagctaaaatgtaatttcagattggacaagtactgggattcccatcgaaacgtcatcatgtggctggaccatcgagcagtcagtcaagttaacaggatcaatgagaccaagcacagtgtcctccagtacgtcgggggggtgatgtctgtggaaatgcaggccccgaaacttctgtggctgaaagagaacttgagagagatttgctgggataaggcgggacatttctttgatctcccggacttcttatcgtggaaggcaacaggtgtcacagcacggtctctctgctccctggtgtgtaagtggacatattcagcagagaaaggctgggacgacagtttctggaaaatgattggtttggaagactttgttgcagataattacagcaaaataggaaaccaagtgctacctcctggagcttctcttggaaatgggctcacaccagaggcagcaagagaccttggccttctccctgggattgcggtcgcagcttcactcattgatgcccatgcaggaggactaggagtgattggggcagatgtgagagggcacggcctcatctgtgaggggcagccagtgacgtcacggctggctgtcatctgtggaacgtcttcttgtcacatggggatcagcaaagacccgatttttgtaccaggcgtctgggggccttatttctcagccatggtacctgggttctggctgaatgaaggtggtcagagcgttactggaaaattgatagaccacatggtacaaggccatgctgcttttccagaactacaagtaaaggccacagccagatgccagagtatatatgcatatttgaacagtcacctggatctgattaagaaggctcagcctgtgggtttccttactgttgatttacatgtttggccagatttccatggcaaccggtctcccttagcagatctgacactaaagggcatggtcaccggattgaaactgtctcaggaccttgatgatcttgccattctctacctggccacagttcaagccattgctttggggactcgcttcattatagaagccatggaggcagcagggcactcaatcagtactcttttcctatgtggaggcctcagcaagaatcccctttttgtgcaaatgcatgcggacattactggcatgcctgtggtcctgtcgcaagaggtggagtccgttcttgtgggtgctgctgttctgggtgcctgtgcctcaggggatttcgcttctgtacaggaagcaatggcaaaaatgagcaaagttgggaaagttgtgttcccgagactacaggataaaaaatactatgataagaaataccaagtattcctgaagctggttgaacaccagaaggagtatttggcgatcatgaatgatgactgaacagggcttgcaggtgctgatgccagaagcttctgtgccattgcattaaagacttctgtcatttgatccatgttcaagacccttgaggtattgtttcatcatttctgtattgtctttcaataaagaaaaaacaaacatgtgcaaccagaattaaagtctt

SEQ ID NO: 25988 - DNA, 1296 bp, Homo sapiens
ggattttgctctgctgtctccatggaaaagtcaggtctctctgctccctggtgtgtaagtggacatattcagcagagaaaggctgggacgacagtttctggaaaatgattggtttggaagactttgttgcagataattacagcaaaataggaaaccaagtgctacctcctggagcttctcttggaaatgggctcacaccagaggcagcaagagaccttggccttctccctgggattgcggtcgcagcttcactcattgatgcccatgcaggaggactaggagtgattggggcagatgtgagagggcacggcctcatctgtgaggggcagccagtgacgtcacggctggctgtcatctgtggaacgtcttcttgtcacatggggatcagcaaagacccgatttttgtaccaggcgtctgggggccttatttctcagccatggtacctgggttctggctgaatgaaggtggtcagagcgttactggaaaattgatagaccacatggtacaaggccatgctgcttttccagaactacaagtaaaggccacagccagatgccagagtatatatgcatatttgaacagtcacctggatctgattaagaaggctcagcctgtgggtttccttactgttgatttacatgtttggccagatttccatggcaaccggtctcccttagcagatctgacactaaagggcatggtcaccggattgaaactgtctcaggaccttgatgatcttgccattctctacctggccacagttcaagccattgctttggggactcgcttcattatagaagccatggaggcagcagggcactcaatcagtactcttttcctatgtggaggcctcagcaagaatcccctttttgtgcaaatgcatgcggacattactggcatgcctgtggtcctgtcgcaagaggtggagtccgttcttgtgggtgctgctgttctgggtgcctgtgcctcaggggatttcgcttctgtacaggaagcaatggcaaaaatgagcaaagttgggaaagttgtgttcccgagactacaggataaaaaatactatgataagaaataccaagtattcctgaagctggttgaacaccagaaggagtatttggcgatcatgaatgatgactgaacagggcttgcaggtgctgatgccagaagcttctgtgccattgcattaaagacttctgtcatttgatccatgttcaagacccttgaggtattgtttcatcatttctgtattgtctttcaataaagaaaaaacaaacatgtgcaaccagaattaaagtctt

SEQ ID NO: 25989 - DNA, 1911 bp, Homo sapiens
cgcacgcccagaaagaggcttctccaacccggcccggcccttccttcccctttcccgcagtcgttgcctcctcctcccctgcctcctcctccccttcctcctcctggccgcttagtctcacacccgccgggccgttgttcccgagacgttgttgagtcccctgtgtcctcttctgggtggaggaactgcaatgtctggtggagaacagaaaccagagaggtactatgtgggtgtggacgttggaacaggcagtgtccgtgcagctctggtggaccagagtggggtcctgttggcttttgcagaccagccaattaagaattgggagccccagttcaaccaccatgagcagtcctccgaggacatctgggctgcgtgctgtgttgtcacaaagaaagttgtacaagggattgatttaaaccaaattcgaggacttgggtttgatgccacgtgttctctggttgttttggataagcagtttcacccattaccagtcaaccaggaaggggattcccatcgaaacgtcatcatgtggctggaccatcgagcagtcagtcaagttaacaggatcaatgagaccaagcacagtgtcctccagtacgtcgggggggtgatgtctgtggaaatgcaggccccgaaacttctgtggctgaaagagaacttgagagagatttgctgggataaggcgggacatttctttgatctcccggacttcttatcgtggaaggcaacaggtgtcacagcacggtctctctgctccctggtgtgtaagtggacatattcagcagagaaaggctgggacgacagtttctggaaaatgattggtttggaagactttgttgcagataattacagcaaaataggaaaccaagtgctacctcctggagcttctcttggaaatgggctcacaccagaggcagcaagagaccttggccttctccctgggattgcggtcgcagcttcactcattgatgcccatgcaggaggactaggagtgattggggcagatgtgagagggcacggcctcatctgtgaggggcagccagtgacgtcacggctggctgtcatctgtggaacgtcttcttgtcacatggggatcagcaaagacccgatttttgtaccaggcgtctgggggccttatttctcagccatggtacctgggttctggctgaatgaaggtggtcagagcgttactggaaaattgatagaccacatggtacaaggccatgctgcttttccagaactacaagtaaaggccacagccagatgccagagtatatatgcatatttgaacagtcacctggatctgattaagaaggctcagcctgtgggtttccttactgttgatttacatgtttggccagatttccatggcaaccggtctcccttagcagatctgacactaaagggcatggtcaccggattgaaactgtctcaggaccttgatgatcttgccattctctacctggccacagttcaagccattgctttggggactcgcttcattatagaagccatggaggcagcagggcactcaatcagtactcttttcctatgtggaggcctcagcaagaatcccctttttgtgcaaatgcatgcggacattactggaagcaatggcaaaaatgagcaaagttgggaaagttgtgttcccgagactacaggataaaaaatactatgataagaaataccaagtattcctgaagctggttgaacaccagaaggagtatttggcgatcatgaatgatgactgaacagggcttgcaggtgctgatgccagaagcttctgtgccattgcattaaagacttctgtcatttgatccatgttcaagacccttgaggtattgtttcatcatttctgtattgtctttcaataaagaaaaaacaaacatgtgcaaccagaattaaagtctt

SEQ ID NO: 25990 - DNA, 340 bp, Homo sapiens
attttctttgttctgaagtctagttaatctgacattgatatagtctctttctttttgtttaatgtttgggcagtatatcttttttcatttttttgagacagggtctggctgtctcacccagactggagtacagtggtgtgatttcggctcactgcaacctccacctcccacgttcaagtgattctcatgcctcagccttccaagtagctgggattacaggcatgtgccaccaagctcagctaattgttgtatttttagtaaagacaggttttcgccgtgttggccaggctggtctcgaactcctgacctcaagcaatcctcctgccttggcctcccaaaa

SEQ ID NO: 25991 - DNA, 725 bp, Homo sapiens
tcccggctgtccctgcactccgtggcggaaggcggctagagcggctccctctgagctctccgagagattggtcgggacctgaagcgttgaggttaagggcaaggcaaggagcaacgaggagtttttcgttacgttagaaaaatttcgttgcgtgctgaagcgcttttacctgtgttgtatgatttaaccttatgaaaatggacagtattccagttttacaagtgaggaaagaagattaagaaacttgcctccgccaggcgtggtggttcactcctgtaatcccagcactttcggcggcgaggcaggcggatcacttgaggtcaggagttcgagaccagcctggccaacatggtgaaaccccggctctactaaaaatgcaaaaattagccgggcgtagtggcacgcgcctgtaatcccagctactctggaggctgaggcaggagaatcgcttgaacctaggaggcggaggttgcagtgagccgagatcgcgccactacactccagcctgggcgacagcgcgagactccgtctcaaaaaaaagaaacttgccttgagtcctacatatagtttgctgtagtagcagaatttgaactcggaccgactaatggtctacttaataaaatgctatttggattctctataaaattaataatatagaagtaatgttaattatagaaaacttggaaaatattaaattcattcgataaagattgaatatgtagcac

SEQ ID NO: 25992 - DNA, 402 bp, Homo sapiens
ctcaagaccatctggctactattcctctcagagagttaaagcgacttgcccagtagggttaaagctatgtttgaaaccagggttttcctgttttaaaaatccattctcctttcactatcctaggctctagagttctgctgtgaaatacggtggctatttaaatttaaatctaatttattcaagttaactaaaattaacaattcagttcctcactcagactaagtacatttcaagtgtagctagtaacctgctgatgtggacagctcagatacaggaagttttcatcacctcagcaagttttattgaacaggcattttctagagtttccagagtaattctcttgctatgaatctctttgtatattagagcaccaccccaaatcctgacgttattatccccatt

SEQ ID NO: 25993 - DNA, 398 bp, Homo sapiens
taaaaaccactttcttagggctgtttttaattacaagtcacatcatcaattcagtaagtaaagatcagcatttgtttgaaaaatctggaaataggccaggtgcggtggctcacgcctgtaatcccagcactttgggaggctgaggtgggcggatcagttgaggtcaggagttcaagaccagcctggccaacatggtgaaatcccatctttaccaaaaatacgaaaattaactgggcgtggtggtgcatgcctgtaatcccagctacttgggagactgaggcaggagaatcgcttgaaccctgggggtggaggttgcagtgagcctagatcgcaccaccacactccagcctgggtgacagagtgaatctccatctcaaaaaaaaaaaaaaaaaatcagg

SEQ ID NO: 25994 - DNA, 390 bp, Homo sapiens
ggatgaaagaataatagcactcttaattcaggcactttcaagatgaaaggataatgaagaaaagttattaagatatatttctgaactggaaggaaagaaactaacatttagttgcagttaaacaatatttagtacaaactgagttgacatccccgggttataattttatttctatcttggggttaattgaagcatgtctgccattccccagtaatatatgtgaaaatggctacatttacattaagccagatttattgctatgcttatcctgatatttcatagaaattgtgttatttttcttttgtactttagtagaaagttaaaagcaaatatttaattgctgacctcagaatttcttgtttttttgagatggtcttgctctgtcctcca
